United States Patent 11,640,849 (METHODS FOR HISTOLOGICAL DIAGNOSIS AND TREATMENT OF DISEASES) - sequence listing, part 61

SEQ ID NO: 2325454 - protein, 23 aa, Cryptosporidium parvum
LQFKHYFSIFWSKTMRPHLKFDH

SEQ ID NO: 2325455 - protein, 24 aa, Cryptosporidium parvum
LQLRYLKQIILLPSTLLNIIETSS

SEQ ID NO: 2325456 - protein, 24 aa, Cryptosporidium parvum
LQNNYWLFHILGVNLNAPNLSLND

SEQ ID NO: 2325457 - protein, 21 aa, Cryptosporidium parvum
LQSPPLLVLTPSTPIPIVPTT

SEQ ID NO: 2325458 - protein, 17 aa, Cryptosporidium parvum
LQYAFGLLSLTIELLMN

SEQ ID NO: 2325459 - protein, 17 aa, Cryptosporidium parvum
LQYSQILLRLYFELLRQ

SEQ ID NO: 2325460 - protein, 21 aa, Cryptosporidium parvum
LRCDSVLYLLVYPQKPLCKTR

SEQ ID NO: 2325461 - protein, 18 aa, Cryptosporidium parvum
LREHYFFIVIPNEYTRDA

SEQ ID NO: 2325462 - protein, 17 aa, Cryptosporidium parvum
LRFVMSIAPLAISTTGR

SEQ ID NO: 2325463 - protein, 17 aa, Cryptosporidium parvum
LRILAIRLWDKRIMLKG

SEQ ID NO: 2325464 - protein, 17 aa, Cryptosporidium parvum
LRKFRSYLKSKLKSRIT

SEQ ID NO: 2325465 - protein, 19 aa, Cryptosporidium parvum
LRRMLNRPSTLFRLPIIER

SEQ ID NO: 2325466 - protein, 19 aa, Cryptosporidium parvum
LSIGIIQMLYILNKQWERS

SEQ ID NO: 2325467 - protein, 19 aa, Cryptosporidium parvum
LSLYLSFWCFSAAAALSSL

SEQ ID NO: 2325468 - protein, 20 aa, Cryptosporidium parvum
LSPIQLFLRPFMQCCAPRSR

SEQ ID NO: 2325469 - protein, 19 aa, Cryptosporidium parvum
LSRFDLQFLLLDIPDKEKD

SEQ ID NO: 2325470 - protein, 25 aa, Cryptosporidium parvum
LTEFFSRWLIWSLIWGFSSSMNLSD

SEQ ID NO: 2325471 - protein, 18 aa, Cryptosporidium parvum
LTFIKELFRRNIDICLPK

SEQ ID NO: 2325472 - protein, 17 aa, Cryptosporidium parvum
LTPLKIKYPYLTGTYTQ

SEQ ID NO: 2325473 - protein, 19 aa, Cryptosporidium parvum
LTTSFLRKYIHYCKYVRNT

SEQ ID NO: 2325474 - protein, 19 aa, Cryptosporidium parvum
LVDGLFGRIWEFPKCENVR

SEQ ID NO: 2325475 - protein, 23 aa, Cryptosporidium parvum
LVQSLHLLALLWRCYKICEERGY

SEQ ID NO: 2325476 - protein, 25 aa, Cryptosporidium parvum
LVRELVMLFILLRPTIHKERLDSDP

SEQ ID NO: 2325477 - protein, 23 aa, Cryptosporidium parvum
LVSKLTKVLFKHIRTFLPDIRRE

SEQ ID NO: 2325478 - protein, 19 aa, Cryptosporidium parvum
LVVWLRKMYCKYNQPYLTC

SEQ ID NO: 2325479 - protein, 17 aa, Cryptosporidium parvum
LWCNFFTSIGISLCNFR

SEQ ID NO: 2325480 - protein, 20 aa, Cryptosporidium parvum
LWDLFSSNFLLFKFYPSGNE

SEQ ID NO: 2325481 - protein, 20 aa, Cryptosporidium parvum
LWIRYMSYYLDLEDLDKARM

SEQ ID NO: 2325482 - protein, 17 aa, Cryptosporidium parvum
LWWLKYTLNKRPILGPT

SEQ ID NO: 2325483 - protein, 19 aa, Cryptosporidium parvum
LYCPLAIGYFWIDKFMWQM

SEQ ID NO: 2325484 - protein, 17 aa, Cryptosporidium parvum
LYFQIQAAYWWYEDMWY

SEQ ID NO: 2325485 - protein, 20 aa, Cryptosporidium parvum
LYGSIYYFKLGIIKDLPPPI

SEQ ID NO: 2325486 - protein, 17 aa, Cryptosporidium parvum
LYLQQWFEWLKQTGQVK

SEQ ID NO: 2325487 - protein, 25 aa, Cryptosporidium parvum
LYQGSINFIKLKLLIYIEEPEILLA

SEQ ID NO: 2325488 - protein, 18 aa, Cryptosporidium parvum
LYSLCYYPYILTSDICLS

SEQ ID NO: 2325489 - protein, 20 aa, Cryptosporidium parvum
LYYAALLITSAWWSPGIDTY

SEQ ID NO: 2325490 - protein, 18 aa, Cryptosporidium parvum
MDDRWFISKLSSGSFFGI

SEQ ID NO: 2325491 - protein, 21 aa, Cryptosporidium parvum
MDILLLINDLFNNIKLVFSEK

SEQ ID NO: 2325492 - protein, 24 aa, Cryptosporidium parvum
MDQFIFFGLPFFFPPVLGIKPNEN

SEQ ID NO: 2325493 - protein, 23 aa, Cryptosporidium parvum
MEDISLLPGWILRNLSLMREIDK

SEQ ID NO: 2325494 - protein, 25 aa, Cryptosporidium parvum
MEQTFVKPLLYYSPKMKFIAKLAAS

SEQ ID NO: 2325495 - protein, 18 aa, Cryptosporidium parvum
MFLFLKLLEGYKDHWVDS

SEQ ID NO: 2325496 - protein, 21 aa, Cryptosporidium parvum
MGCIFLEILCKRTPLQHILDK

SEQ ID NO: 2325497 - protein, 25 aa, Cryptosporidium parvum
MHLNLIKLFKFCNILFQPQFQNSNY

SEQ ID NO: 2325498 - protein, 19 aa, Cryptosporidium parvum
MIFMASLVRKKVIASTVVL

SEQ ID NO: 2325499 - protein, 25 aa, Cryptosporidium parvum
MINKRLLFTLVRLKLWIVEEILYDE

SEQ ID NO: 2325500 - protein, 17 aa, Cryptosporidium parvum
MINLLDALKFIHKNGII

SEQ ID NO: 2325501 - protein, 23 aa, Cryptosporidium parvum
MLDVWNLLLKPLGLSLQVVNMGS

SEQ ID NO: 2325502 - protein, 17 aa, Cryptosporidium parvum
MLKLIQMYLLRPAEQWV

SEQ ID NO: 2325503 - protein, 25 aa, Cryptosporidium parvum
MLKSLRRYYVSPLLKKIALTVIARY

SEQ ID NO: 2325504 - protein, 18 aa, Cryptosporidium parvum
MLLLLKLVDNILIRIILL

SEQ ID NO: 2325505 - protein, 18 aa, Cryptosporidium parvum
MLTYYKFPFKNKLNRPFS

SEQ ID NO: 2325506 - protein, 23 aa, Cryptosporidium parvum
MNYICEIVKLYWTPFYFKETEKF

SEQ ID NO: 2325507 - protein, 24 aa, Cryptosporidium parvum
MQTMSFVWHLVYKEKLRGPFLVVA

SEQ ID NO: 2325508 - protein, 17 aa, Cryptosporidium parvum
MQTVWWVFKQLFDKNLV

SEQ ID NO: 2325509 - protein, 25 aa, Cryptosporidium parvum
MRELDILLILEFLVDLRLSYESCGI

SEQ ID NO: 2325510 - protein, 23 aa, Cryptosporidium parvum
MRFVCILWRKILPYRQFICGLAL

SEQ ID NO: 2325511 - protein, 23 aa, Cryptosporidium parvum
MSAANPMLLAFNPQLAAAAAATA

SEQ ID NO: 2325512 - protein, 20 aa, Cryptosporidium parvum
MSFRLIFKWFKETFKSLKLK

SEQ ID NO: 2325513 - protein, 17 aa, Cryptosporidium parvum
MSHPWLLAINNLTNIDI

SEQ ID NO: 2325514 - protein, 17 aa, Cryptosporidium parvum
MSKNYFDKLNSGGLHSA

SEQ ID NO: 2325515 - protein, 20 aa, Cryptosporidium parvum
MWRRRWEPCLPHILRSPLSI

SEQ ID NO: 2325516 - protein, 23 aa, Cryptosporidium parvum
MWSLGVILYILLCGYPPFHGSND

SEQ ID NO: 2325517 - protein, 18 aa, Cryptosporidium parvum
MWYILVPYEYGIPIITET

SEQ ID NO: 2325518 - protein, 24 aa, Cryptosporidium parvum
MYADLCQILKWRSPVLVNKDGKST

SEQ ID NO: 2325519 - protein, 18 aa, Cryptosporidium parvum
NAIKLPTRLPPPPPPPIS

SEQ ID NO: 2325520 - protein, 19 aa, Cryptosporidium parvum
NARKLVERLLLKIYQEYDD

SEQ ID NO: 2325521 - protein, 22 aa, Cryptosporidium parvum
NDIGVLPDVLYLLGSLAIIPNI

SEQ ID NO: 2325522 - protein, 23 aa, Cryptosporidium parvum
NDIVELFLIPQWWMNCKPFAEKA

SEQ ID NO: 2325523 - protein, 24 aa, Cryptosporidium parvum
NDKLEIFFIDFDLMPLLLEENYIS

SEQ ID NO: 2325524 - protein, 23 aa, Cryptosporidium parvum
NDPLLLEFLFYIVGYTGLKEENI

SEQ ID NO: 2325525 - protein, 17 aa, Cryptosporidium parvum
NDPYFGRAFIFFYNVES

SEQ ID NO: 2325526 - protein, 17 aa, Cryptosporidium parvum
NEGWSVELIFKGLAEFI

SEQ ID NO: 2325527 - protein, 21 aa, Cryptosporidium parvum
NEKYQFPFSRLPPIIDFSFAE

SEQ ID NO: 2325528 - protein, 21 aa, Cryptosporidium parvum
NENFFMCLKWPESLSVTPEAE

SEQ ID NO: 2325529 - protein, 23 aa, Cryptosporidium parvum
NENLLNYFINLPESIWLSGFLDQ

SEQ ID NO: 2325530 - protein, 23 aa, Cryptosporidium parvum
NENNTWLFRKMLFISESLIIDDI

SEQ ID NO: 2325531 - protein, 25 aa, Cryptosporidium parvum
NENSRFLFQVPPPPPLVYSSSGQPV

SEQ ID NO: 2325532 - protein, 23 aa, Cryptosporidium parvum
NESFSCNIILLDRPRPSFKLDNE

SEQ ID NO: 2325533 - protein, 20 aa, Cryptosporidium parvum
NESLWFDALRHLLKWTLQWD

SEQ ID NO: 2325534 - protein, 20 aa, Cryptosporidium parvum
NFEEKLSWLPNIEILDMPEK

SEQ ID NO: 2325535 - protein, 24 aa, Cryptosporidium parvum
NFKDLHAYRLIFRCLGNLRPSSMP

SEQ ID NO: 2325536 - protein, 27 aa, Cryptosporidium parvum
NFNRLRLQFIFFYYDSNRDGLLSIDEL

SEQ ID NO: 2325537 - protein, 25 aa, Cryptosporidium parvum
NIDILDLFPIFSWLENPNNFNHPMY

SEQ ID NO: 2325538 - protein, 23 aa, Cryptosporidium parvum
NIDWNKRISSRLFQIAIGKGTRA

SEQ ID NO: 2325539 - protein, 24 aa, Cryptosporidium parvum
NIESISAIFFLRNLKRLSLVNNPI

SEQ ID NO: 2325540 - protein, 18 aa, Cryptosporidium parvum
NIFLHGFDPNFSLYSVSD

SEQ ID NO: 2325541 - protein, 19 aa, Cryptosporidium parvum
NIITAIKLLAIVRDIKRQI

SEQ ID NO: 2325542 - protein, 21 aa, Cryptosporidium parvum
NILQLYAWFEDKSRIWLVIEI

SEQ ID NO: 2325543 - protein, 21 aa, Cryptosporidium parvum
NINLLPWEILSRALPLDLGID

SEQ ID NO: 2325544 - protein, 23 aa, Cryptosporidium parvum
NIQELFLFLSLFYHNYQREWILP

SEQ ID NO: 2325545 - protein, 21 aa, Cryptosporidium parvum
NIQLRYFVRLTVLRAYASNIV

SEQ ID NO: 2325546 - protein, 20 aa, Cryptosporidium parvum
NIRWTYYSFYPLILSSYLQA

SEQ ID NO: 2325547 - protein, 24 aa, Cryptosporidium parvum
NKIKDCPLFLSFSYGRALQASVLK

SEQ ID NO: 2325548 - protein, 18 aa, Cryptosporidium parvum
NKLRLILKAFLLLGNYVN

SEQ ID NO: 2325549 - protein, 23 aa, Cryptosporidium parvum
NKNRLIFAVLPFGTGNDWAKSFG

SEQ ID NO: 2325550 - protein, 24 aa, Cryptosporidium parvum
NKVSIPYFFFSKLGSPFDLIDVNK

SEQ ID NO: 2325551 - protein, 25 aa, Cryptosporidium parvum
NLEELWSLLHFLNPLRFQNYQEFRL

SEQ ID NO: 2325552 - protein, 20 aa, Cryptosporidium parvum
NLFIVRNLLYLKYELINLSK

SEQ ID NO: 2325553 - protein, 21 aa, Cryptosporidium parvum
NLFKVFLRYFIYPAYLDLYSY

SEQ ID NO: 2325554 - protein, 21 aa, Cryptosporidium parvum
NLHERIYPSPLNEIVKILNMH

SEQ ID NO: 2325555 - protein, 21 aa, Cryptosporidium parvum
NLLNYYHFIPNQLFLQILAKS

SEQ ID NO: 2325556 - protein, 18 aa, Cryptosporidium parvum
NLMSDFYYDYLKLILDSI

SEQ ID NO: 2325557 - protein, 20 aa, Cryptosporidium parvum
NLPICGLLIYFISSLIHRSP

SEQ ID NO: 2325558 - protein, 24 aa, Cryptosporidium parvum
NLRPSSMPIFILRPIIKQLDEYRK

SEQ ID NO: 2325559 - protein, 25 aa, Cryptosporidium parvum
NLSLTPYVLGLRVFKLINSNKKQVS

SEQ ID NO: 2325560 - protein, 18 aa, Cryptosporidium parvum
NLTKQWIPIRPKSRFLYY

SEQ ID NO: 2325561 - protein, 26 aa, Cryptosporidium parvum
NLVPYPRIHFMLSSYAPIISAEKAFH

SEQ ID NO: 2325562 - protein, 19 aa, Cryptosporidium parvum
NMFQILLDILFLDINNSQI

SEQ ID NO: 2325563 - protein, 20 aa, Cryptosporidium parvum
NMNLELYRWVFKPLLSNRRI

SEQ ID NO: 2325564 - protein, 32 aa, Cryptosporidium parvum
NNESEWEFFWQELLIYLFFKPILNKNSIELRD

SEQ ID NO: 2325565 - protein, 17 aa, Cryptosporidium parvum
NNEYIFPLKIYSSNMIK

SEQ ID NO: 2325566 - protein, 21 aa, Cryptosporidium parvum
NNIILRMDILWIGDLNGKLPE

SEQ ID NO: 2325567 - protein, 23 aa, Cryptosporidium parvum
NNKKIQFPLDYYQKWVLEYNQII

SEQ ID NO: 2325568 - protein, 24 aa, Cryptosporidium parvum
NNNIVFLLLIVKVKFPIPGKLQID

SEQ ID NO: 2325569 - protein, 25 aa, Cryptosporidium parvum
NNNYNIYIYCFKPYNSHFPEINIEN

SEQ ID NO: 2325570 - protein, 23 aa, Cryptosporidium parvum
NNPPRILICNPLKYLILERDSQI

SEQ ID NO: 2325571 - protein, 24 aa, Cryptosporidium parvum
NNRGTRYLNYKLLIRKIRWVSEQE

SEQ ID NO: 2325572 - protein, 17 aa, Cryptosporidium parvum
NNRSLMHILKYYFDLMT

SEQ ID NO: 2325573 - protein, 19 aa, Cryptosporidium parvum
NNVLQDHLMLLKAQLEIST

SEQ ID NO: 2325574 - protein, 18 aa, Cryptosporidium parvum
NNYSIIWRQFILNKSNNN

SEQ ID NO: 2325575 - protein, 23 aa, Cryptosporidium parvum
NPGPIQYFNLFKNLFNRTLFESE

SEQ ID NO: 2325576 - protein, 20 aa, Cryptosporidium parvum
NPLNFYFENIYEKSLKTLSN

SEQ ID NO: 2325577 - protein, 24 aa, Cryptosporidium parvum
NPNPPFLFSFLKKSNRLYTFHTLN

SEQ ID NO: 2325578 - protein, 27 aa, Cryptosporidium parvum
NPSSLYSISLLLIIGLALKKNGENETL

SEQ ID NO: 2325579 - protein, 27 aa, Cryptosporidium parvum
NQIDLNNISFLPKKEFFKPYYTTSTTT

SEQ ID NO: 2325580 - protein, 25 aa, Cryptosporidium parvum
NQISNYWLLLVLAYEQLFGNLKIQG

SEQ ID NO: 2325581 - protein, 18 aa, Cryptosporidium parvum
NRIYIFSKRLPLLDNGDV

SEQ ID NO: 2325582 - protein, 18 aa, Cryptosporidium parvum
NSFPSCSLAIIKSLTRGD

SEQ ID NO: 2325583 - protein, 20 aa, Cryptosporidium parvum
NSIFFYKPWIPIMRISFKHN

SEQ ID NO: 2325584 - protein, 21 aa, Cryptosporidium parvum
NSIIRLVPKEQLNSVFFLVSS

SEQ ID NO: 2325585 - protein, 22 aa, Cryptosporidium parvum
NSKPLSIYWIQDSKLILDDLIN

SEQ ID NO: 2325586 - protein, 23 aa, Cryptosporidium parvum
NSTEFAVFILVLIGSEVELKLID

SEQ ID NO: 2325587 - protein, 21 aa, Cryptosporidium parvum
NSYFIKPYYVIKQLEGIEEGG

SEQ ID NO: 2325588 - protein, 22 aa, Cryptosporidium parvum
NTFYLFNVWVNDFYRILKWDPF

SEQ ID NO: 2325589 - protein, 20 aa, Cryptosporidium parvum
NTHLGFIWLQANNIPFQKPT

SEQ ID NO: 2325590 - protein, 26 aa, Cryptosporidium parvum
NTNPNFQNMPIPYPPKAPLSDCNNSD

SEQ ID NO: 2325591 - protein, 24 aa, Cryptosporidium parvum
NVAPPPLPIYQQPPGYPLSNGPAP

SEQ ID NO: 2325592 - protein, 19 aa, Cryptosporidium parvum
NVFCYWISSRYLRIKKKEF

SEQ ID NO: 2325593 - protein, 18 aa, Cryptosporidium parvum
NVFMFPIPIWKSPTQKKN

SEQ ID NO: 2325594 - protein, 18 aa, Cryptosporidium parvum
NVFRCYLLELYSLKLEKY

SEQ ID NO: 2325595 - protein, 21 aa, Cryptosporidium parvum
NVLKLILQFLLESGLLESYST

SEQ ID NO: 2325596 - protein, 28 aa, Cryptosporidium parvum
NVMPNLDYFLFLLPTPKILIIGDSSPSY

SEQ ID NO: 2325597 - protein, 25 aa, Cryptosporidium parvum
NVTIIYLLFLIFKSQYKTGLEDGQE

SEQ ID NO: 2325598 - protein, 19 aa, Cryptosporidium parvum
NVVLLPYNYLLDSITRQNL

SEQ ID NO: 2325599 - protein, 18 aa, Cryptosporidium parvum
NWLYKSLSPVYFYDLNLL

SEQ ID NO: 2325600 - protein, 18 aa, Cryptosporidium parvum
NWPPPWLVRMQKYGPPPS

SEQ ID NO: 2325601 - protein, 18 aa, Cryptosporidium parvum
NWRFHKIPMFWLQVKLIE

SEQ ID NO: 2325602 - protein, 26 aa, Cryptosporidium parvum
NYIRDLLCILSRDIWSLLLSCHQNFG

SEQ ID NO: 2325603 - protein, 22 aa, Cryptosporidium parvum
NYKSFLLSYPKLFRIFGKDDNH

SEQ ID NO: 2325604 - protein, 20 aa, Cryptosporidium parvum
NYLDQLKSINKKRKIAFCLD

SEQ ID NO: 2325605 - protein, 20 aa, Cryptosporidium parvum
NYRHSIFGNFRWNNKRRRLG

SEQ ID NO: 2325606 - protein, 19 aa, Cryptosporidium parvum
PAEESSWFSGWFGASETTP

SEQ ID NO: 2325607 - protein, 28 aa, Cryptosporidium parvum
PASPVEFEWLLHLVLHSALSQLGPMVSH

SEQ ID NO: 2325608 - protein, 21 aa, Cryptosporidium parvum
PCKRWPELLPYLIRLVQNNSD

SEQ ID NO: 2325609 - protein, 22 aa, Cryptosporidium parvum
PDEFTLIPLPYPDFSMIAKTRG

SEQ ID NO: 2325610 - protein, 26 aa, Cryptosporidium parvum
PDGRPMPYWLYKLNGLGIEFKCEICG

SEQ ID NO: 2325611 - protein, 23 aa, Cryptosporidium parvum
PDKDLIIKWPKYDKLFIGNWIDT

SEQ ID NO: 2325612 - protein, 17 aa, Cryptosporidium parvum
PDKVKFIPLSSLKKLQS

SEQ ID NO: 2325613 - protein, 26 aa, Cryptosporidium parvum
PDSGLIELLPFYSFHILSRTPVSKIP

SEQ ID NO: 2325614 - protein, 20 aa, Cryptosporidium parvum
PECCGWLYVLNLKGNQYGRD

SEQ ID NO: 2325615 - protein, 26 aa, Cryptosporidium parvum
PEIDEPFLEFFKPKPKLRIKQKSRGK

SEQ ID NO: 2325616 - protein, 19 aa, Cryptosporidium parvum
PELFEHVIFACWNFHIAHA

SEQ ID NO: 2325617 - protein, 21 aa, Cryptosporidium parvum
PELSLPYKLWIDAKSRDWILE

SEQ ID NO: 2325618 - protein, 24 aa, Cryptosporidium parvum
PENFKTFVQILLRLFHDSPAIIVG

SEQ ID NO: 2325619 - protein, 17 aa, Cryptosporidium parvum
PEREFFFDLFYNEKAQL

SEQ ID NO: 2325620 - protein, 20 aa, Cryptosporidium parvum
PFCRFFVIDPYNKIIKPLFF

SEQ ID NO: 2325621 - protein, 20 aa, Cryptosporidium parvum
PFLCLLVKLLQIRPSTEIVL

SEQ ID NO: 2325622 - protein, 17 aa, Cryptosporidium parvum
PFLPIKKVQKRSGFSGC

SEQ ID NO: 2325623 - protein, 20 aa, Cryptosporidium parvum
PHIPQFIAKAPWYINQQESS

SEQ ID NO: 2325624 - protein, 23 aa, Cryptosporidium parvum
PHKIWLYLDHWLFWLSLTNENNN

SEQ ID NO: 2325625 - protein, 25 aa, Cryptosporidium parvum
PIDDRLYLWNGLYWIRILDQSKSGA

SEQ ID NO: 2325626 - protein, 21 aa, Cryptosporidium parvum
PIEVVLSQFLYQRTLYPCFPV

SEQ ID NO: 2325627 - protein, 22 aa, Cryptosporidium parvum
PIFYQFFCFQRYPILILRPLFS

SEQ ID NO: 2325628 - protein, 19 aa, Cryptosporidium parvum
PIIHHPIIQHPISPEIQTL

SEQ ID NO: 2325629 - protein, 24 aa, Cryptosporidium parvum
PIISLRAYYPERFASSKPKYIPGN

SEQ ID NO: 2325630 - protein, 26 aa, Cryptosporidium parvum
PIKLNSCKIFYLNLPKLRSIKLKCKS

SEQ ID NO: 2325631 - protein, 20 aa, Cryptosporidium parvum
PILASLITNIDWWRIVLDEA

SEQ ID NO: 2325632 - protein, 17 aa, Cryptosporidium parvum
PILLRIFSKKAINLTLV

SEQ ID NO: 2325633 - protein, 17 aa, Cryptosporidium parvum
PIPLPKPWDELLLEDVC

SEQ ID NO: 2325634 - protein, 20 aa, Cryptosporidium parvum
PIQRYFLFPIYEQPNINTND

SEQ ID NO: 2325635 - protein, 25 aa, Cryptosporidium parvum
PIVFKLIGRLINGIFPIISKNQPIK

SEQ ID NO: 2325636 - protein, 24 aa, Cryptosporidium parvum
PKFKLFFIHFLLSPSINSFRNINN

SEQ ID NO: 2325637 - protein, 21 aa, Cryptosporidium parvum
PKFSQWLNPPYFRIGPQFEPV

SEQ ID NO: 2325638 - protein, 22 aa, Cryptosporidium parvum
PKGPMVLFCYFLGKLYMQQDRF

SEQ ID NO: 2325639 - protein, 25 aa, Cryptosporidium parvum
PKLDFVVDHLFLWGSPLPAMLVMMF

SEQ ID NO: 2325640 - protein, 22 aa, Cryptosporidium parvum
PKLFWLSIYYLVNSMKFISREH

SEQ ID NO: 2325641 - protein, 25 aa, Cryptosporidium parvum
PKMESSILELISFFGFKYDEKSQKL

SEQ ID NO: 2325642 - protein, 27 aa, Cryptosporidium parvum
PLEIQKPYFLLFKLPRTLSLVALEPKS

SEQ ID NO: 2325643 - protein, 23 aa, Cryptosporidium parvum
PLETFYQFIWRPHPPSLLSQEKF

SEQ ID NO: 2325644 - protein, 19 aa, Cryptosporidium parvum
PLKVTILTKLFLLISRVYS

SEQ ID NO: 2325645 - protein, 17 aa, Cryptosporidium parvum
PLLPWKTLCTDIVESWR

SEQ ID NO: 2325646 - protein, 20 aa, Cryptosporidium parvum
PLMHRVLGFPLSFNHANPKI

SEQ ID NO: 2325647 - protein, 17 aa, Cryptosporidium parvum
PLWHLFSSLCWQGYHNQ

SEQ ID NO: 2325648 - protein, 23 aa, Cryptosporidium parvum
PMIKYVINFDFPLSPKLFVHRTG

SEQ ID NO: 2325649 - protein, 18 aa, Cryptosporidium parvum
PNCVFPKSFYLWLLNENN

SEQ ID NO: 2325650 - protein, 17 aa, Cryptosporidium parvum
PNEYWIYKLHNFEAKTN

SEQ ID NO: 2325651 - protein, 23 aa, Cryptosporidium parvum
PNTQLQWLFIDKWPHLVVLTIPG

SEQ ID NO: 2325652 - protein, 25 aa, Cryptosporidium parvum
PPAEESSWFSGWFGAAAPAEPEPEP

SEQ ID NO: 2325653 - protein, 20 aa, Cryptosporidium parvum
PPAILRPQPLWTGKQIITVL

SEQ ID NO: 2325654 - protein, 23 aa, Cryptosporidium parvum
PPQGPWPLWGWNVYIIDSIKQRL

SEQ ID NO: 2325655 - protein, 22 aa, Cryptosporidium parvum
PPYYIIVPIYVPPKPFFQPIAE

SEQ ID NO: 2325656 - protein, 19 aa, Cryptosporidium parvum
PQARFILPIIYLESNKRTS

SEQ ID NO: 2325657 - protein, 21 aa, Cryptosporidium parvum
PQFCLFLILKYILNDYKQFIN

SEQ ID NO: 2325658 - protein, 25 aa, Cryptosporidium parvum
PSSPNLWLLYGFIYRKAFPDRINEA

SEQ ID NO: 2325659 - protein, 20 aa, Cryptosporidium parvum
PSSYLLYLHVNKEPVRLGFE

SEQ ID NO: 2325660 - protein, 19 aa, Cryptosporidium parvum
PTHWLWDRIIFSNTRQILG

SEQ ID NO: 2325661 - protein, 17 aa, Cryptosporidium parvum
PTRLPPPPPPPISPSPP

SEQ ID NO: 2325662 - protein, 23 aa, Cryptosporidium parvum
PVDQMLIPPFPQVSGIPMFEDGT

SEQ ID NO: 2325663 - protein, 18 aa, Cryptosporidium parvum
PVDVIRTFLVLRKNSEHS

SEQ ID NO: 2325664 - protein, 17 aa, Cryptosporidium parvum
PVFLKYLPSIVLDSELH

SEQ ID NO: 2325665 - protein, 23 aa, Cryptosporidium parvum
PVRDVYLPLDYYTRRPRGFGFVE

SEQ ID NO: 2325666 - protein, 21 aa, Cryptosporidium parvum
PWGLYICHLPIGPTSYFRIRS

SEQ ID NO: 2325667 - protein, 21 aa, Cryptosporidium parvum
PWINKLYYYWEDNHFYYMLME

SEQ ID NO: 2325668 - protein, 20 aa, Cryptosporidium parvum
PWNLRLWKELLSYLKKVLAF

SEQ ID NO: 2325669 - protein, 19 aa, Cryptosporidium parvum
PWNYIFKCSRDFSLSQFHS

SEQ ID NO: 2325670 - protein, 17 aa, Cryptosporidium parvum
PYDRQFWSYAYKTGRLH

SEQ ID NO: 2325671 - protein, 23 aa, Cryptosporidium parvum
PYKLDFLPYHFLLCSIGEFGELR

SEQ ID NO: 2325672 - protein, 23 aa, Cryptosporidium parvum
PYNYAYLNYAGYTANFPYMVGNT

SEQ ID NO: 2325673 - protein, 19 aa, Cryptosporidium parvum
QALQHPWLRSWDTPNIPLC

SEQ ID NO: 2325674 - protein, 19 aa, Cryptosporidium parvum
QAYLYFDILKVLGIDFDSS

SEQ ID NO: 2325675 - protein, 18 aa, Cryptosporidium parvum
QDIPIFKPFTFFSVNSEE

SEQ ID NO: 2325676 - protein, 22 aa, Cryptosporidium parvum
QEIDMLNIPIWLYKESGSLTVN

SEQ ID NO: 2325677 - protein, 22 aa, Cryptosporidium parvum
QEKAFTEIPLINSLLNLNKESS

SEQ ID NO: 2325678 - protein, 17 aa, Cryptosporidium parvum
QEPDKVKFIPLSSLKKL

SEQ ID NO: 2325679 - protein, 23 aa, Cryptosporidium parvum
QERYKSINLLYLVGQKKLIREII

SEQ ID NO: 2325680 - protein, 21 aa, Cryptosporidium parvum
QFDWVWFDWPHSKIPFSRSEL

SEQ ID NO: 2325681 - protein, 20 aa, Cryptosporidium parvum
QFNWLLSQLFVWASIDISIV

SEQ ID NO: 2325682 - protein, 17 aa, Cryptosporidium parvum
QFYYLNLDLLRMEKKRI

SEQ ID NO: 2325683 - protein, 34 aa, Cryptosporidium parvum; identical to SEQ ID NO: 2200376

SEQ ID NO: 2325684 - protein, 21 aa, Cryptosporidium parvum
QGYLKNLFLLSLDKNKDKINF

SEQ ID NO: 2325685 - protein, 24 aa, Cryptosporidium parvum
QHFRTVLYLILPKLTSVQLDWLYA

SEQ ID NO: 2325686 - protein, 23 aa, Cryptosporidium parvum
QIEPLYYVPIIPMILVNGTDGIG

SEQ ID NO: 2325687 - protein, 23 aa, Cryptosporidium parvum
QIINRFFYIYKTWQWKNPVILCE

SEQ ID NO: 2325688 - protein, 19 aa, Cryptosporidium parvum
QILLRLYFELLRQGGSSEE

SEQ ID NO: 2325689 - protein, 19 aa, Cryptosporidium parvum
QINIKYCFPFIVIYDASNT

SEQ ID NO: 2325690 - protein, 22 aa, Cryptosporidium parvum
QIQTLNCAIPFFSLPRKRLNPS

SEQ ID NO: 2325691 - protein, 23 aa, Cryptosporidium parvum
QKEFEEFWFELDKRQKNISTREK

SEQ ID NO: 2325692 - protein, 17 aa, Cryptosporidium parvum
QKRYILRYLIYDCICIE

SEQ ID NO: 2325693 - protein, 24 aa, Cryptosporidium parvum
QKTLKCCFEWFKTFKIMESDGVVC

SEQ ID NO: 2325694 - protein, 24 aa, Cryptosporidium parvum
QLEFKAILFIPRRAPFDLFETRKK

SEQ ID NO: 2325695 - protein, 18 aa, Cryptosporidium parvum
QLFDYQLAGLNWLLQLWS

SEQ ID NO: 2325696 - protein, 18 aa, Cryptosporidium parvum
QLIFLRWIRLLFSREFSD

SEQ ID NO: 2325697 - protein, 19 aa, Cryptosporidium parvum
QLIWKRPLEKFAPRLLNAV

SEQ ID NO: 2325698 - protein, 19 aa, Cryptosporidium parvum
QLLLLLEKIILLIELARIE

SEQ ID NO: 2325699 - protein, 22 aa, Cryptosporidium parvum
QLLSCILYSKRFFPYYSFCLLS

SEQ ID NO: 2325700 - protein, 23 aa, Cryptosporidium parvum
QLRNCNLLYFNKEVVFNCIVDIE

SEQ ID NO: 2325701 - protein, 22 aa, Cryptosporidium parvum
QLSNILNYLLFIKFNKYPTCES

SEQ ID NO: 2325702 - protein, 20 aa, Cryptosporidium parvum
QLWDPLPMSPGNPLMMTYLQ

SEQ ID NO: 2325703 - protein, 20 aa, Cryptosporidium parvum
QNELIGYLYLIINPSIITSD

SEQ ID NO: 2325704 - protein, 23 aa, Cryptosporidium parvum
QNGFIRLWDLRFAQQPFLYMNSN

SEQ ID NO: 2325705 - protein, 17 aa, Cryptosporidium parvum
QNIVSFFLPNILNFLRI

SEQ ID NO: 2325706 - protein, 23 aa, Cryptosporidium parvum
QNRPKWWQLCFCKPIISVTLFAR

SEQ ID NO: 2325707 - protein, 20 aa, Cryptosporidium parvum
QNSSFIPTWAWPASLRNNED

SEQ ID NO: 2325708 - protein, 17 aa, Cryptosporidium parvum
QQGLFPQAPRPSSSYMS

SEQ ID NO: 2325709 - protein, 23 aa, Cryptosporidium parvum
QQIKNFFIVLFHNMDLQLSELRY

SEQ ID NO: 2325710 - protein, 23 aa, Cryptosporidium parvum
QQLLFCFHNNFPILWHPQVIAII

SEQ ID NO: 2325711 - protein, 26 aa, Cryptosporidium parvum
QQQQMPVRYLVPPPPPPPSKTSGALQ

SEQ ID NO: 2325712 - protein, 24 aa, Cryptosporidium parvum
QREKLLMRLYMKLVIKQLVEPAFD

SEQ ID NO: 2325713 - protein, 22 aa, Cryptosporidium parvum
QRLRWSIRMIPQKLPLDLIIAL

SEQ ID NO: 2325714 - protein, 20 aa, Cryptosporidium parvum
QRSALFKALILYSLKNKEYM

SEQ ID NO: 2325715 - protein, 29 aa, Cryptosporidium parvum
QRSLLALSLILSMLRFKPAPVYILDEIDS

SEQ ID NO: 2325716 - protein, 30 aa, Cryptosporidium parvum
QSDLVPDLWLKLLPILLYSLDIWLSDLIRK

SEQ ID NO: 2325717 - protein, 22 aa, Cryptosporidium parvum
QSFRSRFLSRIYLNLFNTISHG

SEQ ID NO: 2325718 - protein, 23 aa, Cryptosporidium parvum
QSHTLFYRFLKFIETHLWTTVID

SEQ ID NO: 2325719 - protein, 23 aa, Cryptosporidium parvum
QSPNIMFLIVLDSSLPWTLNDDL

SEQ ID NO: 2325720 - protein, 22 aa, Cryptosporidium parvum
QSSLLQWFLFYIHQNGLFDFSN

SEQ ID NO: 2325721 - protein, 24 aa, Cryptosporidium parvum
QSYLNIWISLFWNSLINNSKKKKV

SEQ ID NO: 2325722 - protein, 23 aa, Cryptosporidium parvum
QTKYWVPSFLSFKPKFMYSIPFK

SEQ ID NO: 2325723 - protein, 17 aa, Cryptosporidium parvum
QVIVIHIFPICYKEMIE

SEQ ID NO: 2325724 - protein, 26 aa, Cryptosporidium parvum
QVKSRVLWWVWPVKFLIFHLNNKYIV

SEQ ID NO: 2325725 - protein, 20 aa, Cryptosporidium parvum
QVLWLIKNYLCGLEANKAVK

SEQ ID NO: 2325726 - protein, 20 aa, Cryptosporidium parvum
QYEYYVVRAWVRNARRIQIK

SEQ ID NO: 2325727 - protein, 24 aa, Cryptosporidium parvum
QYHKRLFRLFLLASYLKRGDKLVN

SEQ ID NO: 2325728 - protein, 21 aa, Cryptosporidium parvum
QYKLQIFKFLNIKIPIKCDDQ

SEQ ID NO: 2325729 - protein, 20 aa, Cryptosporidium parvum
RAFCQFIMEPICQLFSSIMN

SEQ ID NO: 2325730 - protein, 17 aa, Cryptosporidium parvum
RAHERSEFKYLRSNVKN

SEQ ID NO: 2325731 - protein, 19 aa, Cryptosporidium parvum
RAKRYALEICQWLDGILKD

SEQ ID NO: 2325732 - protein, 25 aa, Cryptosporidium parvum
RCIDDFIFLCFFIGNDFLPNLPVFS

SEQ ID NO: 2325733 - protein, 27 aa, Cryptosporidium parvum
RDEYRFNNPMFLIPKKVKKNFKNEVCS

SEQ ID NO: 2325734 - protein, 17 aa, Cryptosporidium parvum
RDKFRLLPGWAQLVLFS

SEQ ID NO: 2325735 - protein, 21 aa, Cryptosporidium parvum
RDTLQIPICKFSLIKKIIVAL

SEQ ID NO: 2325736 - protein, 27 aa, Cryptosporidium parvum
RENLFDTFFWKLLIYSYFKLNSTLSSM

SEQ ID NO: 2325737 - protein, 24 aa, Cryptosporidium parvum
REYYKWDYIILLTTRYISPDSNTI

SEQ ID NO: 2325738 - protein, 25 aa, Cryptosporidium parvum
RFEEAFITIIPTLKGYYRSCGNNVN

SEQ ID NO: 2325739 - protein, 17 aa, Cryptosporidium parvum
RFFIFPLLDLIKNYIES

SEQ ID NO: 2325740 - protein, 25 aa, Cryptosporidium parvum
RFPPDAWHLCCWLLRKNSNERASPI

SEQ ID NO: 2325741 - protein, 21 aa, Cryptosporidium parvum
RFSLRLPIIMLFESLLKVDLH

SEQ ID NO: 2325742 - protein, 28 aa, Cryptosporidium parvum
RFSSVQQFWWLWHNIPQPSELLKGKRMI

SEQ ID NO: 2325743 - protein, 25 aa, Cryptosporidium parvum
RGIFQSCIVLLWRLESIVFEILNII

SEQ ID NO: 2325744 - protein, 18 aa, Cryptosporidium parvum
RGILLEHFLIQISQIRIV

SEQ ID NO: 2325745 - protein, 19 aa, Cryptosporidium parvum
RGILRWIKSWDNFVFKSES

SEQ ID NO: 2325746 - protein, 21 aa, Cryptosporidium parvum
RGKSLWLWKPLPQFISRSNRY

SEQ ID NO: 2325747 - protein, 23 aa, Cryptosporidium parvum
RHIRMLFLLHKWDAPMNYSPETS

SEQ ID NO: 2325748 - protein, 17 aa, Cryptosporidium parvum
RHSLLNLIRHFQLVQSK

SEQ ID NO: 2325749 - protein, 22 aa, Cryptosporidium parvum
RHSSLIIPGWYLNKFPSAKNSL

SEQ ID NO: 2325750 - protein, 18 aa, Cryptosporidium parvum
RIFDIYLLGQDYVGILVD

SEQ ID NO: 2325751 - protein, 18 aa, Cryptosporidium parvum
RIFQLIPCPYLCLSATIG

SEQ ID NO: 2325752 - protein, 19 aa, Cryptosporidium parvum
RIIFRQKGIYKVLLNSPLN

SEQ ID NO: 2325753 - protein, 20 aa, Cryptosporidium parvum
RIIHLLLYKILGKCLIRVFH

SEQ ID NO: 2325754 - protein, 30 aa, Cryptosporidium parvum; identical to SEQ ID NO: 2200442

SEQ ID NO: 2325755 - protein, 18 aa, Cryptosporidium parvum
RIMRICTYFIIRGREDFV

SEQ ID NO: 2325756 - protein, 17 aa, Cryptosporidium parvum
RIRRWFGLYKAVENKDV

SEQ ID NO: 2325757 - protein, 25 aa, Cryptosporidium parvum
RIRVIGLFLPYISRRTQFLRNIRLQ

SEQ ID NO: 2325758 - protein, 26 aa, Cryptosporidium parvum
RISRIKLISFTWRKIVLNAKLSSFKT

SEQ ID NO: 2325759 - protein, 24 aa, Cryptosporidium parvum
RKDPNFELFIYPIDPVRDGCLDYF

SEQ ID NO: 2325760 - protein, 20 aa, Cryptosporidium parvum
RKFPFLYYYGRQPSINNDYG

SEQ ID NO: 2325761 - protein, 23 aa, Cryptosporidium parvum
RKYRLYWIAILRNAPEGLEGLYD

SEQ ID NO: 2325762 - protein, 17 aa, Cryptosporidium parvum
RLHSFFLEQLLYRDTVL

SEQ ID NO: 2325763 - protein, 18 aa, Cryptosporidium parvum
RLIPPRMSPLLRSQRQRL

SEQ ID NO: 2325764 - protein, 25 aa, Cryptosporidium parvum
RLKNTPLLIIPFKDTEYYGDAKKRQ

SEQ ID NO: 2325765 - protein, 17 aa, Cryptosporidium parvum
RLLPYFLKTEGLVKHHI

SEQ ID NO: 2325766 - protein, 20 aa, Cryptosporidium parvum
RLLVFFKWLFNSLNRGSRAV

SEQ ID NO: 2325767 - protein, 19 aa, Cryptosporidium parvum
RLMVEKSLPNIFKIVNNDL

SEQ ID NO: 2325768 - protein, 22 aa, Cryptosporidium parvum
RLNELILPPRWDPLDGRLDHEF

SEQ ID NO: 2325769 - protein, 18 aa, Cryptosporidium parvum
RLQIWMNGFIDLVAYLPE

SEQ ID NO: 2325770 - protein, 22 aa, Cryptosporidium parvum
RLQMVDAFWRIQTRPSKRNLVE

SEQ ID NO: 2325771 - protein, 19 aa, Cryptosporidium parvum
RLRANGFLSIPFLPDLTSP

SEQ ID NO: 2325772 - protein, 24 aa, Cryptosporidium parvum
RLRLQSFCFMWMLPEHALLNSIIE

SEQ ID NO: 2325773 - protein, 19 aa, Cryptosporidium parvum
RLWIKLCEILIKYGVNLTI

SEQ ID NO: 2325774 - protein, 19 aa, Cryptosporidium parvum
RLYGLKPIRTLTLGTTKKS

SEQ ID NO: 2325775 - protein, 19 aa, Cryptosporidium parvum
RMCWLYLKNDWKEIKEFAW

SEQ ID NO: 2325776 - protein, 20 aa, Cryptosporidium parvum
RMMFILFPVTDAQHPILTPV

SEQ ID NO: 2325777 - protein, 18 aa, Cryptosporidium parvum
RNINIPIWRQGTMLPRVC

SEQ ID NO: 2325778 - protein, 23 aa, Cryptosporidium parvum
RNNYAWLHDLLTKNWEKLSKPRN

SEQ ID NO: 2325779 - protein, 18 aa, Cryptosporidium parvum
RNWTKFPILLKYDDLLIM

SEQ ID NO: 2325780 - protein, 22 aa, Cryptosporidium parvum
RPFLFVINETKLSRPWVFCPNI

SEQ ID NO: 2325781 - protein, 21 aa, Cryptosporidium parvum
RQLILKLRWYGAKTLDYYSSR

SEQ ID NO: 2325782 - protein, 17 aa, Cryptosporidium parvum
RQLIWPTSLHFLLAQFF

SEQ ID NO: 2325783 - protein, 29 aa, Cryptosporidium parvum
RQRALDRANVFLRWNLAPTKQQIAEFLEM

SEQ ID NO: 2325784 - protein, 19 aa, Cryptosporidium parvum
RRDFLIKKILPWEIELEVV

SEQ ID NO: 2325785 - protein, 21 aa, Cryptosporidium parvum
RRFDVPFRNMLLWGKPGTGKT

SEQ ID NO: 2325786 - protein, 24 aa, Cryptosporidium parvum
RRNLATIFYLKKLKKLGLSMNYFI

SEQ ID NO: 2325787 - protein, 21 aa, Cryptosporidium parvum
RRNRLLLWRSIKCQIWKTQYI

SEQ ID NO: 2325788 - protein, 19 aa, Cryptosporidium parvum
RSEIATFIFLILPTSLISQ

SEQ ID NO: 2325789 - protein, 21 aa, Cryptosporidium parvum
RSFVEFILNPIYKLLGYTVSE

SEQ ID NO: 2325790 - protein, 23 aa, Cryptosporidium parvum
RSTNPYRILLSKLYTFLGRRTDS

SEQ ID NO: 2325791 - protein, 17 aa, Cryptosporidium parvum
RTKYKIQIPLPPKIDPS

SEQ ID NO: 2325792 - protein, 22 aa, Cryptosporidium parvum
RTQIWGFAALRFLIRSSLNACN

SEQ ID NO: 2325793 - protein, 18 aa, Cryptosporidium parvum
RVKPPLKPKPKFLAPPKN

SEQ ID NO: 2325794 - protein, 21 aa, Cryptosporidium parvum
RYRGLFFSLIANMFVLCEDDK

SEQ ID NO: 2325795 - protein, 17 aa, Cryptosporidium parvum
RYYLCIPSKGDFLVTTP

SEQ ID NO: 2325796 - protein, 23 aa, Cryptosporidium parvum
SAGVILYILLCGYPPFHGKDNVE

SEQ ID NO: 2325797 - protein, 21 aa, Cryptosporidium parvum
SAGVILYILLSGTPPFYGKNE

SEQ ID NO: 2325798 - protein, 22 aa, Cryptosporidium parvum
SAGVLLHLLLMGAVPFPGVNDA

SEQ ID NO: 2325799 - protein, 25 aa, Cryptosporidium parvum
SAYNSVIIFFFLYHCAFKNESSFEF

SEQ ID NO: 2325800 - protein, 17 aa, Cryptosporidium parvum
SDIFYVYYQLSFDFFIY

SEQ ID NO: 2325801 - protein, 19 aa, Cryptosporidium parvum
SDWLLCELIWEQVLLELGV

SEQ ID NO: 2325802 - protein, 20 aa, Cryptosporidium parvum
SDWLYIRAASILRHLYVRPN

SEQ ID NO: 2325803 - protein, 24 aa, Cryptosporidium parvum
SDWSYYIWWLFSRRPEISKISPKL

SEQ ID NO: 2325804 - protein, 26 aa, Cryptosporidium parvum
SEACKSWPLCPYGPGCFFIHPTVPCR

SEQ ID NO: 2325805 - protein, 20 aa, Cryptosporidium parvum
SEDLLWEDYYILYRLMVCIN

SEQ ID NO: 2325806 - protein, 28 aa, Cryptosporidium parvum
SEKGYDYCLLYFELLRDGLINAHLWRDT

SEQ ID NO: 2325807 - protein, 17 aa, Cryptosporidium parvum
SELIRHSLLNLIRHFQL

SEQ ID NO: 2325808 - protein, 18 aa, Cryptosporidium parvum
SELVPILILAYDLSTFLG

SEQ ID NO: 2325809 - protein, 22 aa, Cryptosporidium parvum
SEQFLLALSFLRKMKLTHTDLK

SEQ ID NO: 2325810 - protein, 22 aa, Cryptosporidium parvum
SERDIRLAFLRLVRKFHPDKNI

SEQ ID NO: 2325811 - protein, 18 aa, Cryptosporidium parvum
SFEQLYLESLKWIEEKIR

SEQ ID NO: 2325812 - protein, 22 aa, Cryptosporidium parvum
SFFLKLIIYIDWLIYLINHSNK

SEQ ID NO: 2325813 - protein, 18 aa, Cryptosporidium parvum
SFFNGCGVVKRVSIPRYS

SEQ ID NO: 2325814 - protein, 18 aa, Cryptosporidium parvum
SFLDIFLLSLFRSKIPQL

SEQ ID NO: 2325815 - protein, 23 aa, Cryptosporidium parvum
SFLERIFLRYNQLFEIFLCQVND

SEQ ID NO: 2325816 - protein, 26 aa, Cryptosporidium parvum
SFNEFCQLFLWPLFHNVLNPEELSNA

SEQ ID NO: 2325817 - protein, 18 aa, Cryptosporidium parvum
SFYPLILSSYLQAYNNLK

SEQ ID NO: 2325818 - protein, 24 aa, Cryptosporidium parvum
SGEIFWSLLFWKMPELFFLSVSKS

SEQ ID NO: 2325819 - protein, 23 aa, Cryptosporidium parvum
SGIRWLCFILGEYGKLISSKVSI

SEQ ID NO: 2325820 - protein, 18 aa, Cryptosporidium parvum
SGKLVFLFQFNGPNGFIS

SEQ ID NO: 2325821 - protein, 24 aa, Cryptosporidium parvum
SGKLYLIFDFFPIGPTMAPDTGAR

SEQ ID NO: 2325822 - protein, 21 aa, Cryptosporidium parvum
SGLLKLILVLKNRIAPKILHF

SEQ ID NO: 2325823 - protein, 24 aa, Cryptosporidium parvum
SGTSGVVGPWRRSLHGGQTVDSLE

SEQ ID NO: 2325824 - protein, 25 aa, Cryptosporidium parvum
SGVDLLLSYILHRLFDTPFTDEDGK

SEQ ID NO: 2325825 - protein, 19 aa, Cryptosporidium parvum
SHLKLWIKLLFGYSIDKKD

SEQ ID NO: 2325826 - protein, 17 aa, Cryptosporidium parvum
SHQYKLQIFKFLNIKIP

SEQ ID NO: 2325827 - protein, 21 aa, Cryptosporidium parvum
SHSLPVLCRLLYFSDLEVMTD

SEQ ID NO: 2325828 - protein, 19 aa, Cryptosporidium parvum
SICKLIFPIEILQLFKGFV

SEQ ID NO: 2325829 - protein, 24 aa, Cryptosporidium parvum
SIESIIKLIFLLWSITKNEVEIYS

SEQ ID NO: 2325830 - protein, 25 aa, Cryptosporidium parvum
SIIHPFYQPMVLIATLFQKSSQKQG

SEQ ID NO: 2325831 - protein, 23 aa, Cryptosporidium parvum
SIIVISNLMWWINDIHVRELATE

SEQ ID NO: 2325832 - protein, 20 aa, Cryptosporidium parvum
SIIYRRLFSYFIQSIIRYHF

SEQ ID NO: 2325833 - protein, 17 aa, Cryptosporidium parvum
SILRPFLLRRVKSDVLQ

SEQ ID NO: 2325834 - protein, 22 aa, Cryptosporidium parvum
SINPFMMPIFPSLIQNNTNLNT

SEQ ID NO: 2325835 - protein, 20 aa, Cryptosporidium parvum
SIRGIYQWFRKYFKTYYLPN

SEQ ID NO: 2325836 - protein, 17 aa, Cryptosporidium parvum
SIRTWRGWKPLKKLKKF

SEQ ID NO: 2325837 - protein, 20 aa, Cryptosporidium parvum
SISLLFIPILLKADLKKTRV

SEQ ID NO: 2325838 - protein, 17 aa, Cryptosporidium parvum
SITLIKIWLTLLTDINI

SEQ ID NO: 2325839 - protein, 23 aa, Cryptosporidium parvum
SITQKYVIPLIMSYPIAGIVFFN

SEQ ID NO: 2325840 - protein, 17 aa, Cryptosporidium parvum
SIYLFDTLCNLVSFQKI

SEQ ID NO: 2325841 - protein, 24 aa, Cryptosporidium parvum
SIYLKCEILFIITAYIRELSTFEK

SEQ ID NO: 2325842 - protein, 18 aa, Cryptosporidium parvum
SIYTLLALRTISSEFKNL

SEQ ID NO: 2325843 - protein, 25 aa, Cryptosporidium parvum
SKATRSRLLLKERIFSMNPFEVNIN

SEQ ID NO: 2325844 - protein, 23 aa, Cryptosporidium parvum
SKCILFLDYLILRTKKLSYIIDS

SEQ ID NO: 2325845 - protein, 23 aa, Cryptosporidium parvum
SKFLDPFLFWEGRVKLFPPELLS

SEQ ID NO: 2325846 - protein, 22 aa, Cryptosporidium parvum
SKIRRVLIYRSEWKRPPMYLLI

SEQ ID NO: 2325847 - protein, 22 aa, Cryptosporidium parvum
SKISFLLNRPLIMSIQDFIATY

SEQ ID NO: 2325848 - protein, 23 aa, Cryptosporidium parvum
SKKRRIIMRLSKLKKGLRGEVEI

SEQ ID NO: 2325849 - protein, 23 aa, Cryptosporidium parvum
SKMKKIIFSIFKIVITDLDKKAL

SEQ ID NO: 2325850 - protein, 29 aa, Cryptosporidium parvum
SKNTLLLMYIGYLCYYMMLKTSPDINIKE

SEQ ID NO: 2325851 - protein, 18 aa, Cryptosporidium parvum
SKRIIIEWPLHLLKNLKA

SEQ ID NO: 2325852 - protein, 25 aa, Cryptosporidium parvum
SKRVKLFHHLLQKLLLRRTKDLVIK

SEQ ID NO: 2325853 - protein, 23 aa, Cryptosporidium parvum
SKVFPYPICFVSKSLPTPPKDYN

SEQ ID NO: 2325854 - protein, 18 aa, Cryptosporidium parvum
SKWIRDEYRFNNPMFLIP

SEQ ID NO: 2325855 - protein, 21 aa, Cryptosporidium parvum
SLARLWFDYVFSVKCLSPSTS

SEQ ID NO: 2325856 - protein, 19 aa, Cryptosporidium parvum
SLCCALSGTFRYLTTILLC

SEQ ID NO: 2325857 - protein, 17 aa, Cryptosporidium parvum
SLDLVFFELIKSLFRVL

SEQ ID NO: 2325858 - protein, 23 aa, Cryptosporidium parvum
SLDNLLRIVWISPQLISIRWCEA

SEQ ID NO: 2325859 - protein, 18 aa, Cryptosporidium parvum
SLDTHWLKYLLDSGLTMI

SEQ ID NO: 2325860 - protein, 19 aa, Cryptosporidium parvum
SLEIHFLRLVRFQLFVTEH

SEQ ID NO: 2325861 - protein, 19 aa, Cryptosporidium parvum
SLFGFLKHTITPGGTRLLK

SEQ ID NO: 2325862 - protein, 21 aa, Cryptosporidium parvum
SLHLSLYLWDPLDGEYHPPHL

SEQ ID NO: 2325863 - protein, 18 aa, Cryptosporidium parvum
SLILYIFKMYCIKTISCT

SEQ ID NO: 2325864 - protein, 19 aa, Cryptosporidium parvum
SLLLLFPSILFITIQKHKN

SEQ ID NO: 2325865 - protein, 20 aa, Cryptosporidium parvum
SLMHILKYYFDLMTLPPHSV

SEQ ID NO: 2325866 - protein, 24 aa, Cryptosporidium parvum
SLQKLLLTFSFEGGIWRVLLGLLR

SEQ ID NO: 2325867 - protein, 23 aa, Cryptosporidium parvum
SLQSLYIYNLYNPQLVLLDCNVQ

SEQ ID NO: 2325868 - protein, 25 aa, Cryptosporidium parvum
SLRCPLFYMALMKLLFDEYPMITET

SEQ ID NO: 2325869 - protein, 19 aa, Cryptosporidium parvum
SLRERIQILEKIRANLLRI

SEQ ID NO: 2325870 - protein, 20 aa, Cryptosporidium parvum
SLTLRILPSLIYRIPNLTPG

SEQ ID NO: 2325871 - protein, 19 aa, Cryptosporidium parvum
SMITYLCRSCFLPEIFSTN

SEQ ID NO: 2325872 - protein, 23 aa, Cryptosporidium parvum
SMSGRFLMVKLAADPFPFETKRS

SEQ ID NO: 2325873 - protein, 26 aa, Cryptosporidium parvum
SMVDKWLMLYILLKMNVIPRKCLIFV

SEQ ID NO: 2325874 - protein, 24 aa, Cryptosporidium parvum
SNDVFLFFEMWPSKLLPNAGNTTE

SEQ ID NO: 2325875 - protein, 18 aa, Cryptosporidium parvum
SNIIIPKCFILDIIYGIF

SEQ ID NO: 2325876 - protein, 23 aa, Cryptosporidium parvum
SNKVIYIIKICNFSFQLIGRFIH

SEQ ID NO: 2325877 - protein, 27 aa, Cryptosporidium parvum
SNSQLQLLLIFILKIYGAMNVSELLNL

SEQ ID NO: 2325878 - protein, 19 aa, Cryptosporidium parvum
SNYDYLFRLIWVETSTLYD

SEQ ID NO: 2325879 - protein, 17 aa, Cryptosporidium parvum
SPAFWFAEASYLRDEKE

SEQ ID NO: 2325880 - protein, 30 aa, Cryptosporidium parvum
SPHPMGLQPFPMHSILLPTLLQAQIQAQMR

SEQ ID NO: 2325881 - protein, 22 aa, Cryptosporidium parvum
SPNFHLIIILKIEAIISNSSIS

SEQ ID NO: 2325882 - protein, 24 aa, Cryptosporidium parvum
SPNFISFIEFWRLYEEMLKHSGVY

SEQ ID NO: 2325883 - protein, 29 aa, Cryptosporidium parvum
SPYSEYLLERLKWKIALRIYYTLDPNDKG

SEQ ID NO: 2325884 - protein, 24 aa, Cryptosporidium parvum
SQDQLLQLLLFRPNSTESKYSVSI

SEQ ID NO: 2325885 - protein, 21 aa, Cryptosporidium parvum
SQFRHDLVFTLLRQTLQYYEN

SEQ ID NO: 2325886 - protein, 25 aa, Cryptosporidium parvum
SQIMGIKPLFPVKPLLSISSPDFEQ

SEQ ID NO: 2325887 - protein, 18 aa, Cryptosporidium parvum
SQLFHILFYSDENIFLGA

SEQ ID NO: 2325888 - protein, 20 aa, Cryptosporidium parvum
SQLFQALSRLSLELSNTNLA

SEQ ID NO: 2325889 - protein, 17 aa, Cryptosporidium parvum
SQLLSFFNMRAIAIVGN

SEQ ID NO: 2325890 - protein, 21 aa, Cryptosporidium parvum
SQMFPRQVPIPRVGVMGKPPG

SEQ ID NO: 2325891 - protein, 25 aa, Cryptosporidium parvum
SQNLSYITISYFPSSFSGLTTLPVS

SEQ ID NO: 2325892 - protein, 24 aa, Cryptosporidium parvum
SQNYWKLLLRQPAINILKMASIDE

SEQ ID NO: 2325893 - protein, 22 aa, Cryptosporidium parvum
SRFPLLHWIVQIVRGSFGDNRR

SEQ ID NO: 2325894 - protein, 18 aa, Cryptosporidium parvum
SRHLIMNFGYTDLLLRFT

SEQ ID NO: 2325895 - protein, 17 aa, Cryptosporidium parvum
SRKQYLRMLLRKKYLKL

SEQ ID NO: 2325896 - protein, 24 aa, Cryptosporidium parvum
SRKSSWRIRTILFFIIFKSMESYG

SEQ ID NO: 2325897 - protein, 19 aa, Cryptosporidium parvum
SRPTGLPPPLPYNSINNRE

SEQ ID NO: 2325898 - protein, 25 aa, Cryptosporidium parvum
SRTQKWLLRNVKLEDFKYLIRVDQL

SEQ ID NO: 2325899 - protein, 24 aa, Cryptosporidium parvum
SSDESLFCFIWKNILIIWNTQYPD

SEQ ID NO: 2325900 - protein, 23 aa, Cryptosporidium parvum
SSELRLIIAPLALALVPVGEVKK

SEQ ID NO: 2325901 - protein, 21 aa, Cryptosporidium parvum
SSFRRFMNFDWFTSMFSSRRR

SEQ ID NO: 2325902 - protein, 26 aa, Cryptosporidium parvum
SSGTPCIPPFWNTNPALLASAASLIG

SEQ ID NO: 2325903 - protein, 24 aa, Cryptosporidium parvum
SSIPIFFPSRQLIWPTSLHFLLAQ

SEQ ID NO: 2325904 - protein, 29 aa, Cryptosporidium parvum
SSIYCDPFYELLWLGWTNGFLSSFRFPHC

SEQ ID NO: 2325905 - protein, 20 aa, Cryptosporidium parvum
SSKDFRLKRLLYASKSQLKN

SEQ ID NO: 2325906 - protein, 24 aa, Cryptosporidium parvum
SSKNWFCFQCLSLTLRILPSLIYR

SEQ ID NO: 2325907 - protein, 17 aa, Cryptosporidium parvum
SSKSAISSLPKPKAKSA

SEQ ID NO: 2325908 - protein, 23 aa, Cryptosporidium parvum
SSKSINIKIPYRETSHIPSCLFE

SEQ ID NO: 2325909 - protein, 17 aa, Cryptosporidium parvum
SSLRRMLNRPSTLFRLP

SEQ ID NO: 2325910 - protein, 19 aa, Cryptosporidium parvum
SSLYRISRIKLISFTWRKI

SEQ ID NO: 2325911 - protein, 19 aa, Cryptosporidium parvum
SSNEILPWSKGIISIDGLA

SEQ ID NO: 2325912 - protein, 27 aa, Cryptosporidium parvum
SSNSEYYLFLTWNNCILGYIPINTNKI

SEQ ID NO: 2325913 - protein, 17 aa, Cryptosporidium parvum
SSPPRVKPPLKPKPKFL

SEQ ID NO: 2325914 - protein, 31 aa, Cryptosporidium parvum; identical to SEQ ID NO: 2200595

SEQ ID NO: 2325915 - protein, 24 aa, Cryptosporidium parvum
SSVKPIMITSLWSCIYKSLRYNMN

SEQ ID NO: 2325916 - protein, 24 aa, Cryptosporidium parvum
STAAPLFYFGLPEETLMGGGYTGT

SEQ ID NO: 2325917 - protein, 23 aa, Cryptosporidium parvum
STIELLMLLQNWKKARTFLDLAR

SEQ ID NO: 2325918 - protein, 19 aa, Cryptosporidium parvum
STKLPLWHLFSSLCWQGYH

SEQ ID NO: 2325919 - protein, 22 aa, Cryptosporidium parvum
STKTRFLPILPTSPRKEMYENL

SEQ ID NO: 2325920 - protein, 25 aa, Cryptosporidium parvum
STPSILGILLKYFDVSWPSHIFESL

SEQ ID NO: 2325921 - protein, 20 aa, Cryptosporidium parvum
STVPLYWYLLQEGGLIYIVT

SEQ ID NO: 2325922 - protein, 18 aa, Cryptosporidium parvum
SVIFWRKVWINIYKIVHG

SEQ ID NO: 2325923 - protein, 23 aa, Cryptosporidium parvum
SVKYYEGFKLPLGDLGRKMLLKK

SEQ ID NO: 2325924 - protein, 19 aa, Cryptosporidium parvum
SVRTFIRFCPSKKTIIEDS

SEQ ID NO: 2325925 - protein, 22 aa, Cryptosporidium parvum
SVTASLLLMRKVQTLTSSVEEL

SEQ ID NO: 2325926 - protein, 18 aa, Cryptosporidium parvum
SVWGSYYDPNVKKWGFKC

SEQ ID NO: 2325927 - protein, 27 aa, Cryptosporidium parvum
SWCVRRKTWRVWFITSGGTRATRSFNP

SEQ ID NO: 2325928 - protein, 22 aa, Cryptosporidium parvum
SYLGIPIWRFYGRCTQCGNEIV

SEQ ID NO: 2325929 - protein, 24 aa, Cryptosporidium parvum
SYLVRLMKRRLIFVSISLLDLLDD

SEQ ID NO: 2325930 - protein, 23 aa, Cryptosporidium parvum
SYTCQIFLEMWLRIKYKAFEYDK

SEQ ID NO: 2325931 - protein, 27 aa, Cryptosporidium parvum
TDDSILLEMFMFAPFTLPLIYGKEYFE

SEQ ID NO: 2325932 - protein, 18 aa, Cryptosporidium parvum
TDIRHFAFILFKKNLNVL

SEQ ID NO: 2325933 - protein, 19 aa, Cryptosporidium parvum
TDLQTLCNVLLIADSYNLS

SEQ ID NO: 2325934 - protein, 23 aa, Cryptosporidium parvum
TDPPIWKYWSLPNIEFHGLWDVL

SEQ ID NO: 2325935 - protein, 26 aa, Cryptosporidium parvum
TDSLFQLLPYLLKLTKFQIIRNEFSL

SEQ ID NO: 2325936 - protein, 24 aa, Cryptosporidium parvum
TEAQRYDLIFKDILLRDMNRMDAM

SEQ ID NO: 2325937 - protein, 17 aa, Cryptosporidium parvum
TEDVLKIVYYPMTPFKI

SEQ ID NO: 2325938 - protein, 23 aa, Cryptosporidium parvum
TEELWPLLNYIEPIKFASIEAFT

SEQ ID NO: 2325939 - protein, 22 aa, Cryptosporidium parvum
TERFLFFRRYLLKGATKVIFCG

SEQ ID NO: 2325940 - protein, 20 aa, Cryptosporidium parvum
TFHPTIIFPLLGLPPQQSVE

SEQ ID NO: 2325941 - protein, 18 aa, Cryptosporidium parvum
TFLLLKLWCIRWKIWNHL

SEQ ID NO: 2325942 - protein, 20 aa, Cryptosporidium parvum
TFTLPPLWHVAALCTLTMLE

SEQ ID NO: 2325943 - protein, 22 aa, Cryptosporidium parvum
TGRLRYYVFNWKIPQISPSNVG

SEQ ID NO: 2325944 - protein, 23 aa, Cryptosporidium parvum
TGVNLPHLILNKSSIKQLECVKK

SEQ ID NO: 2325945 - protein, 19 aa, Cryptosporidium parvum
TICLLFALKIRYPRQIHLI

SEQ ID NO: 2325946 - protein, 20 aa, Cryptosporidium parvum
TIPIYFFSAFFLIKYPEDKI

SEQ ID NO: 2325947 - protein, 20 aa, Cryptosporidium parvum
TIQLFKINPFKYLIDIQIYD

SEQ ID NO: 2325948 - protein, 24 aa, Cryptosporidium parvum
TIRIKLYFLLAFLHSVILERKRYT

SEQ ID NO: 2325949 - protein, 17 aa, Cryptosporidium parvum
TITQPRIIFRQKGIYKV

SEQ ID NO: 2325950 - protein, 22 aa, Cryptosporidium parvum
TKAQKKIPLWARSMNWIPKMKE

SEQ ID NO: 2325951 - protein, 21 aa, Cryptosporidium parvum
TKISIYLVLLLSSYDIYIQEI

SEQ ID NO: 2325952 - protein, 18 aa, Cryptosporidium parvum
TKLLLWYGQNRIIDLFVK

SEQ ID NO: 2325953 - protein, 23 aa, Cryptosporidium parvum
TKSQRFLLIFIRTSLLDFKRIIL

SEQ ID NO: 2325954 - protein, 18 aa, Cryptosporidium parvum
TKYDPGQYFNITPITFVE

SEQ ID NO: 2325955 - protein, 19 aa, Cryptosporidium parvum
TLFTLPLPGASQYTRTGSL

SEQ ID NO: 2325956 - protein, 18 aa, Cryptosporidium parvum
TLHPFGCKFYFNLSLDIN

SEQ ID NO: 2325957 - protein, 17 aa, Cryptosporidium parvum
TLHYWLFGFEFSDTLIL

SEQ ID NO: 2325958 - protein, 21 aa, Cryptosporidium parvum
TLIYKILTLMIPYFSNITSNL

SEQ ID NO: 2325959 - protein, 17 aa, Cryptosporidium parvum
TLLFHISKMYLAIKTCK

SEQ ID NO: 2325960 - protein, 23 aa, Cryptosporidium parvum
TLLHKKIVIFQFISFLVIDEGDR

SEQ ID NO: 2325961 - protein, 19 aa, Cryptosporidium parvum
TLPYIYLFERFMNYLIEAG

SEQ ID NO: 2325962 - protein, 21 aa, Cryptosporidium parvum
TLRFWQIFPTGRPKGPKNLAA

SEQ ID NO: 2325963 - protein, 23 aa, Cryptosporidium parvum
TLVSYYLFIWRDSIARLLDVSPS

SEQ ID NO: 2325964 - protein, 24 aa, Cryptosporidium parvum
TMEEPILLFLTYQFAETLLAFNEM

SEQ ID NO: 2325965 - protein, 24 aa, Cryptosporidium parvum
TMINKAILPWFRLGSRPILSDESD

SEQ ID NO: 2325966 - protein, 17 aa, Cryptosporidium parvum
TNFFWKIRENLLKNSRL

SEQ ID NO: 2325967 - protein, 18 aa, Cryptosporidium parvum
TNHKHLLLLILLIERNLS

SEQ ID NO: 2325968 - protein, 19 aa, Cryptosporidium parvum
TPCFLLAVKCSIDLTLPIY

SEQ ID NO: 2325969 - protein, 20 aa, Cryptosporidium parvum
TPLLLRVDGLVGLLARIRRD

SEQ ID NO: 2325970 - protein, 21 aa, Cryptosporidium parvum
TPLRQFFFFDAFEQLDLISNE

SEQ ID NO: 2325971 - protein, 18 aa, Cryptosporidium parvum
TPYFIPYTPYGVYSNLYA

SEQ ID NO: 2325972 - protein, 18 aa, Cryptosporidium parvum
TQHYKFHVLLTSYEILLA

SEQ ID NO: 2325973 - protein, 23 aa, Cryptosporidium parvum
TQSLYLCLDLLFESSFFLCKINH

SEQ ID NO: 2325974 - protein, 27 aa, Cryptosporidium parvum
TRDKFLQLLLCIPYWNGNIPPPAILRP

SEQ ID NO: 2325975 - protein, 20 aa, Cryptosporidium parvum
TRDLLLDFLFLPASICNVPP

SEQ ID NO: 2325976 - protein, 21 aa, Cryptosporidium parvum
TRRFRRLYFGNLPINLGLTES

SEQ ID NO: 2325977 - protein, 24 aa, Cryptosporidium parvum
TSCWKLPTFLFYSDKKGNLLNYLF

SEQ ID NO: 2325978 - protein, 24 aa, Cryptosporidium parvum
TSGRVFPLKLLPHYQLMSLVADYR

SEQ ID NO: 2325979 - protein, 25 aa, Cryptosporidium parvum
TSIETLMSLYTWLKSHLLNPKSPFF

SEQ ID NO: 2325980 - protein, 17 aa, Cryptosporidium parvum
TSNLKHQFILDPKLFRP

SEQ ID NO: 2325981 - protein, 22 aa, Cryptosporidium parvum
TSVQLDWLYALAPKDLFGNVKY

SEQ ID NO: 2325982 - protein, 24 aa, Cryptosporidium parvum
TTNNAFLPPITYLFHSLDYDFRKQ

SEQ ID NO: 2325983 - protein, 25 aa, Cryptosporidium parvum
TTVSSPLLPPIAFPTKVIDTNQQNN

SEQ ID NO: 2325984 - protein, 18 aa, Cryptosporidium parvum
TVEESSWFSGWFGASETT

SEQ ID NO: 2325985 - protein, 24 aa, Cryptosporidium parvum
TVKIPLRVFLLKFSEIYIPRIHKK

SEQ ID NO: 2325986 - protein, 23 aa, Cryptosporidium parvum
TVLLKFCFIVWPSLNNTKTEIDA

SEQ ID NO: 2325987 - protein, 24 aa, Cryptosporidium parvum
TYRHLFLFLPKSLLEWSYKSIDDV

SEQ ID NO: 2325988 - protein, 18 aa, Cryptosporidium parvum
VALYYDILSKMFLLTENY

SEQ ID NO: 2325989 - protein, 24 aa, Cryptosporidium parvum
VANYVFLLDPWWNPAVELQAFQRA

SEQ ID NO: 2325990 - protein, 20 aa, Cryptosporidium parvum
VAYSLYWLLKFTNSTNVPIY

SEQ ID NO: 2325991 - protein, 21 aa, Cryptosporidium parvum
VCKHIFCFVCIKQWSDVATQC

SEQ ID NO: 2325992 - protein, 17 aa, Cryptosporidium parvum
VCKSNVVLIPYYGGLTK

SEQ ID NO: 2325993 - protein, 19 aa, Cryptosporidium parvum
VDFDLWCNFFTSIGISLCN

SEQ ID NO: 2325994 - protein, 24 aa, Cryptosporidium parvum
VDGTGWLWMAPDGRVLSVLSGHGD

SEQ ID NO: 2325995 - protein, 27 aa, Cryptosporidium parvum
VDIKIRFFPLRTLTLYLLYKKSLEVDT

SEQ ID NO: 2325996 - protein, 18 aa, Cryptosporidium parvum
VDLRWPAIKTWIYVCNQI

SEQ ID NO: 2325997 - protein, 22 aa, Cryptosporidium parvum
VDSCYSFWFTGLLFCIEEILRI

SEQ ID NO: 2325998 - protein, 25 aa, Cryptosporidium parvum
VDSLDHWMMLFLQPLGITCDSLSLN

SEQ ID NO: 2325999 - protein, 21 aa, Cryptosporidium parvum
VDSWCLGWSTFYLLFGTELFE

SEQ ID NO: 2326000 - protein, 18 aa, Cryptosporidium parvum
VEEYLFILVLKLPSICFA

SEQ ID NO: 2326001 - protein, 17 aa, Cryptosporidium parvum
VEKKLMINYSFSSLIFF

SEQ ID NO: 2326002 - protein, 28 aa, Cryptosporidium parvum
VESVKLIRSFFYYFQNLSELFVKEKKNN

SEQ ID NO: 2326003 - protein, 18 aa, Cryptosporidium parvum
VFCLGWMLLFTLTKYQPF

SEQ ID NO: 2326004 - protein, 17 aa, Cryptosporidium parvum
VFINRQLIYNYPDQLFK

SEQ ID NO: 2326005 - protein, 17 aa, Cryptosporidium parvum
VFIRKAPWQILVKNLNY

SEQ ID NO: 2326006 - protein, 21 aa, Cryptosporidium parvum
VFLIKNLLIQLFKVGPRALPF

SEQ ID NO: 2326007 - protein, 24 aa, Cryptosporidium parvum
VFMDFYILFWYLDLSDISLPYQHY

SEQ ID NO: 2326008 - protein, 20 aa, Cryptosporidium parvum
VFPKSFYLWLLNENNNKYFS

SEQ ID NO: 2326009 - protein, 24 aa, Cryptosporidium parvum
VFVNLFSWKFLTFIRIWSLSISNI

SEQ ID NO: 2326010 - protein, 25 aa, Cryptosporidium parvum
VGETRYFFLVLKWNGLQQIVGASGL

SEQ ID NO: 2326011 - protein, 26 aa, Cryptosporidium parvum
VGLIWKYRFYLFRFKAGIPMLFHFIN

SEQ ID NO: 2326012 - protein, 17 aa, Cryptosporidium parvum
VGQWKILYLPPKGGNLM

SEQ ID NO: 2326013 - protein, 23 aa, Cryptosporidium parvum
VHKGLYISWHPKTRRFVVALKSC

SEQ ID NO: 2326014 - protein, 17 aa, Cryptosporidium parvum
VIKRNQLYAFRLLQYQA

SEQ ID NO: 2326015 - protein, 18 aa, Cryptosporidium parvum
VILVLFTLKIMYPYHVHL

SEQ ID NO: 2326016 - protein, 24 aa, Cryptosporidium parvum
VISILFSLKIMFPDKIFLLRGNHE

SEQ ID NO: 2326017 - protein, 19 aa, Cryptosporidium parvum
VISRLHSILRPFLLRRVKS

SEQ ID NO: 2326018 - protein, 18 aa, Cryptosporidium parvum
VKCSIDLTLPIYVYKRNL

SEQ ID NO: 2326019 - protein, 20 aa, Cryptosporidium parvum
VLCLYKCKLLINGIWRNIFV

SEQ ID NO: 2326020 - protein, 18 aa, Cryptosporidium parvum
VLCYFMILNRPLIKPKNS

SEQ ID NO: 2326021 - protein, 19 aa, Cryptosporidium parvum
VLEIFLLTIYKFREKLSSS

SEQ ID NO: 2326022 - protein, 24 aa, Cryptosporidium parvum
VLQGVHFLLRRWISKRLAPHYIPK

SEQ ID NO: 2326023 - protein, 17 aa, Cryptosporidium parvum
VLYKLLFLLCKLNFINF

SEQ ID NO: 2326024 - protein, 23 aa, Cryptosporidium parvum
VLYLDLWDYLLMTILFVLKVERD

SEQ ID NO: 2326025 - protein, 20 aa, Cryptosporidium parvum
VNCWLIFVYINELLIQILSS

SEQ ID NO: 2326026 - protein, 18 aa, Cryptosporidium parvum
VNLWLTAYFEKRIKKKQL

SEQ ID NO: 2326027 - protein, 18 aa, Cryptosporidium parvum
VNTLMPLVKWRPSSHFQN

SEQ ID NO: 2326028 - protein, 18 aa, Cryptosporidium parvum
VNYLKYLLYWCEFPYVKY

SEQ ID NO: 2326029 - protein, 21 aa, Cryptosporidium parvum
VPAQETSWFTGWFGIGAESSP

SEQ ID NO: 2326030 - protein, 21 aa, Cryptosporidium parvum
VPFPRLHFFMIGFAPLTSRGS

SEQ ID NO: 2326031 - protein, 17 aa, Cryptosporidium parvum
VPMTPWYKSFKGKIFPI

SEQ ID NO: 2326032 - protein, 24 aa, Cryptosporidium parvum
VPPQPTLALTPLGLIPILPKVVGN

SEQ ID NO: 2326033 - protein, 20 aa, Cryptosporidium parvum
VPYMIKNLWRRLENASYQRV

SEQ ID NO: 2326034 - protein, 21 aa, Cryptosporidium parvum
VQCLWPVFLLPLVSGELFFTI

SEQ ID NO: 2326035 - protein, 22 aa, Cryptosporidium parvum
VQHPMRGLFLRYFLIQTCKDVL

SEQ ID NO: 2326036 - protein, 24 aa, Cryptosporidium parvum
VQNNSYQLLLSQLMQYLYGGNNNN

SEQ ID NO: 2326037 - protein, 20 aa, Cryptosporidium parvum
VRDLTSFSWNFTRRAKRRTV

SEQ ID NO: 2326038 - protein, 30 aa, Cryptosporidium parvum
VRKCRSGSIFFPYFLPYIAPYFAEAYTTKT

SEQ ID NO: 2326039 - protein, 18 aa, Cryptosporidium parvum
VRMLLLFIYGHTTSLRGA

SEQ ID NO: 2326040 - protein, 23 aa, Cryptosporidium parvum
VRYIMRALIVFSLRKKYNIYNCE

SEQ ID NO: 2326041 - protein, 17 aa, Cryptosporidium parvum
VSIIRLPYACKLLFQEL

SEQ ID NO: 2326042 - protein, 24 aa, Cryptosporidium parvum
VSNSINPYWFLKDTKRIISNFPVK

SEQ ID NO: 2326043 - protein, 28 aa, Cryptosporidium parvum
VSVYPPPILIQKSLVIPGFIREGRQLSR

SEQ ID NO: 2326044 - protein, 18 aa, Cryptosporidium parvum
VTGLLKFINKWYLPNNMC

SEQ ID NO: 2326045 - protein, 23 aa, Cryptosporidium parvum
VTRKRLVILLQTFGDKMTEDEIN

SEQ ID NO: 2326046 - protein, 19 aa, Cryptosporidium parvum
VTRYELLSFWYTISSLYSF

SEQ ID NO: 2326047 - protein, 19 aa, Cryptosporidium parvum
VTWCSERRTWRICYAPEPG

SEQ ID NO: 2326048 - protein, 25 aa, Cryptosporidium parvum
VVENPHYFTLIRFLGLISNTSMAID

SEQ ID NO: 2326049 - protein, 17 aa, Cryptosporidium parvum
VVLIPYYGGLTKGNYLR

SEQ ID NO: 2326050 - protein, 17 aa, Cryptosporidium parvum
VVPLPLHGELHIALDNI

SEQ ID NO: 2326051 - protein, 19 aa, Cryptosporidium parvum
VVTWQDIPIFKPFTFFSVN

SEQ ID NO: 2326052 - protein, 17 aa, Cryptosporidium parvum
VVVFIRKSKDKAFLCVV

SEQ ID NO: 2326053 - protein, 30 aa, Cryptosporidium parvum
VWGTYRSYDPIYWWVDFVLPSVNPYISTYS

SEQ ID NO: 2326054 - protein, 17 aa, Cryptosporidium parvum
VYASWTFFLQHLRNYFF

SEQ ID NO: 2326055 - protein, 18 aa, Cryptosporidium parvum
VYETIVFPPGYFEYKKQL

SEQ ID NO: 2326056 - protein, 27 aa, Cryptosporidium parvum
VYKRYEDYIRLLPFFKERKYIPLFSNT

SEQ ID NO: 2326057 - protein, 21 aa, Cryptosporidium parvum
VYRMGLILEETWDKSLEGSRA

SEQ ID NO: 2326058 - protein, 19 aa, Cryptosporidium parvum
WAIGCIFFEILHLRRPFGL

SEQ ID NO: 2326059 - protein, 17 aa, Cryptosporidium parvum
WCPSGIVPRPRRIWSIL

SEQ ID NO: 2326060 - protein, 19 aa, Cryptosporidium parvum
WDTQSYLPMSYYAGAYDPN

SEQ ID NO: 2326061 - protein, 25 aa, Cryptosporidium parvum
WEKYLHSYLLLIYFFEINQDVNSPN

SEQ ID NO: 2326062 - protein, 21 aa, Cryptosporidium parvum
WFFSTLLTIILFKDKYKNLLK

SEQ ID NO: 2326063 - protein, 19 aa, Cryptosporidium parvum
WFHSVIWPAMLLSVGLSLP

SEQ ID NO: 2326064 - protein, 17 aa, Cryptosporidium parvum
WFLILQAQIETGTPFIC

SEQ ID NO: 2326065 - protein, 18 aa, Cryptosporidium parvum
WFRKYFKTYYLPNEYWIY

SEQ ID NO: 2326066 - protein, 17 aa, Cryptosporidium parvum
WFSILLFHQNRKKGNFG

SEQ ID NO: 2326067 - protein, 25 aa, Cryptosporidium parvum
WHDVWSPFLFFEKHKHFIQVKMLSN

SEQ ID NO: 2326068 - protein, 19 aa, Cryptosporidium parvum
WHFLSLGAIFLKYSKKNSI

SEQ ID NO: 2326069 - protein, 26 aa, Cryptosporidium parvum
WIEVFNKWYYPIRIILFHGKGESERR

SEQ ID NO: 2326070 - protein, 17 aa, Cryptosporidium parvum
WIKFLNRFGIWLRKNDE

SEQ ID NO: 2326071 - protein, 18 aa, Cryptosporidium parvum
WIPIRPKSRFLYYYKKKG

SEQ ID NO: 2326072 - protein, 24 aa, Cryptosporidium parvum
WISKRLAPHYIPKSSLDFLPLDIL

SEQ ID NO: 2326073 - protein, 17 aa, Cryptosporidium parvum
WKDFIFWDQAKNSWVGL

SEQ ID NO: 2326074 - protein, 18 aa, Cryptosporidium parvum
WKRPPMYLLITHKGRHCK

SEQ ID NO: 2326075 - protein, 18 aa, Cryptosporidium parvum
WLKSHLLNPKSPFFDLDY

SEQ ID NO: 2326076 - protein, 18 aa, Cryptosporidium parvum
WLQYMRMYWMSKDCQKNL

SEQ ID NO: 2326077 - protein, 17 aa, Cryptosporidium parvum
WLYVLNLKGNQYGRDIS

SEQ ID NO: 2326078 - protein, 18 aa, Cryptosporidium parvum
WPHFISLLKLLSSRGALH

SEQ ID NO: 2326079 - protein, 18 aa, Cryptosporidium parvum
WQERFFILRSDGALIWCH

SEQ ID NO: 2326080 - protein, 19 aa, Cryptosporidium parvum
WRFKLLKRRQISWSDISHP

SEQ ID NO: 2326081 - protein, 29 aa, Cryptosporidium parvum
WSCCNSCLRFIWTLIQYKSLRYNDIDEKN

SEQ ID NO: 2326082 - protein, 17 aa, Cryptosporidium parvum
WSNIREIFTTKSELRMV

SEQ ID NO: 2326083 - protein, 25 aa, Cryptosporidium parvum
WSNRQMAWLAFWKEDNQRRSKTFSA

SEQ ID NO: 2326084 - protein, 21 aa, Cryptosporidium parvum
WSVGIILFEMLFGGPPLSDPG

SEQ ID NO: 2326085 - protein, 17 aa, Cryptosporidium parvum
WVKHPKLAWAPATILRR

SEQ ID NO: 2326086 - protein, 17 aa, Cryptosporidium parvum
WWELMVYILRWSFELGP

SEQ ID NO: 2326087 - protein, 17 aa, Cryptosporidium parvum
WYKYPWRFTFSDFTNKK

SEQ ID NO: 2326088 - protein, 17 aa, Cryptosporidium parvum
WYYPYRYAPFACDIAII

SEQ ID NO: 2326089 - protein, 18 aa, Cryptosporidium parvum
YAICYPMIRFLLSNRTLS

SEQ ID NO: 2326090 - protein, 17 aa, Cryptosporidium parvum
YAPLLPNTLIEISALTK

SEQ ID NO: 2326091 - protein, 24 aa, Cryptosporidium parvum
YAVECLCQLIMTTGYYLDSNEKSQ

SEQ ID NO: 2326092 - protein, 26 aa, Cryptosporidium parvum
YCARKLKWWLDAFQPIVSPIFPNMDT

SEQ ID NO: 2326093 - protein, 18 aa, Cryptosporidium parvum
YCKHVRWIIQIPRLYNIF

SEQ ID NO: 2326094 - protein, 17 aa, Cryptosporidium parvum
YDLLFGNNKRKLPKGGI

SEQ ID NO: 2326095 - protein, 18 aa, Cryptosporidium parvum
YEFKFLDGLFVFDPSIKG

SEQ ID NO: 2326096 - protein, 18 aa, Cryptosporidium parvum
YENWPFVKSFFDLVSMIL

SEQ ID NO: 2326097 - protein, 17 aa, Cryptosporidium parvum
YFDKLNSGGLHSAIPFS

SEQ ID NO: 2326098 - protein, 27 aa, Cryptosporidium parvum
YFEFPDLITIIYRFPFYINPMKLSHGK

SEQ ID NO: 2326099 - protein, 17 aa, Cryptosporidium parvum
YFIIPNYNYAFQSFYPS

SEQ ID NO: 2326100 - protein, 23 aa, Cryptosporidium parvum
YFKESIWIPNALIPLVRQRNKDK

SEQ ID NO: 2326101 - protein, 24 aa, Cryptosporidium parvum
YFRGVPSWRWYYPYRYAPFACDIA

SEQ ID NO: 2326102 - protein, 22 aa, Cryptosporidium parvum
YGFLLDTLYLYYPRNESKNPVH

SEQ ID NO: 2326103 - protein, 24 aa, Cryptosporidium parvum
YGNIYGIIFLFKFTEKFKGNHFSQ

SEQ ID NO: 2326104 - protein, 23 aa, Cryptosporidium parvum
YHNKVLLKRRKIVYITAGFNGCT

SEQ ID NO: 2326105 - protein, 19 aa, Cryptosporidium parvum
YIFPLKIYSSNMIKSNHNI

SEQ ID NO: 2326106 - protein, 24 aa, Cryptosporidium parvum
YKEYQLPFIFPFKSLSIGEIAASF

SEQ ID NO: 2326107 - protein, 19 aa, Cryptosporidium parvum
YKGCNKLILLGIPSSLRPN

SEQ ID NO: 2326108 - protein, 31 aa, Cryptosporidium parvum; identical to SEQ ID NO: 2200760

SEQ ID NO: 2326109 - protein, 19 aa, Cryptosporidium parvum
YKIQIPLPPKIDPSVAMMT

SEQ ID NO: 2326110 - protein, 25 aa, Cryptosporidium parvum
YKNFNFRIMILPKVKLTSGGSLEGH

SEQ ID NO: 2326111 - protein, 17 aa, Cryptosporidium parvum
YKRFLYDSLPLESCFGV

SEQ ID NO: 2326112 - protein, 21 aa, Cryptosporidium parvum
YKRIPLKNIWFIFKRIYSMKP

SEQ ID NO: 2326113 - protein, 19 aa, Cryptosporidium parvum
YLDDGSGLILIDWLVDNTG

SEQ ID NO: 2326114 - protein, 20 aa, Cryptosporidium parvum
YLDLFPCFVLAIFKSLVLLD

SEQ ID NO: 2326115 - protein, 21 aa, Cryptosporidium parvum
YLDYFFPLFLLECQQSIQRAK

SEQ ID NO: 2326116 - protein, 26 aa, Cryptosporidium parvum
YLFKDLNVYFGWETPLVIPIITEPDC

SEQ ID NO: 2326117 - protein, 21 aa, Cryptosporidium parvum
YLIHHLILIPFTYGSKFPPPI

SEQ ID NO: 2326118 - protein, 27 aa, Cryptosporidium parvum
YLKKNFIYMLLPMIIKKAFLAYNSLKE

SEQ ID NO: 2326119 - protein, 17 aa, Cryptosporidium parvum
YLLVLRVVSKKADIVIS

SEQ ID NO: 2326120 - protein, 17 aa, Cryptosporidium parvum
YLNIRWRRKMGEKLIDI

SEQ ID NO: 2326121 - protein, 17 aa, Cryptosporidium parvum
YLRWVALYYDILSKMFL

SEQ ID NO: 2326122 - protein, 24 aa, Cryptosporidium parvum
YLVPLFMRCLYSSLLLLYDYSSYL

SEQ ID NO: 2326123 - protein, 18 aa, Cryptosporidium parvum
YLYVYRFSNGMPIICKDT

SEQ ID NO: 2326124 - protein, 19 aa, Cryptosporidium parvum
YMLQRRWKVVIWDLSIENL

SEQ ID NO: 2326125 - protein, 17 aa, Cryptosporidium parvum
YMMFLGCKTHRAASIVL

SEQ ID NO: 2326126 - protein, 17 aa, Cryptosporidium parvum
YNDPALLQLYFTNLFQG

SEQ ID NO: 2326127 - protein, 24 aa, Cryptosporidium parvum
YNFEKPFLWLARRLTNQPALQLVG

SEQ ID NO: 2326128 - protein, 20 aa, Cryptosporidium parvum
YNIHKILLSIIDLYDLILDE

SEQ ID NO: 2326129 - protein, 18 aa, Cryptosporidium parvum
YNLWIKCLDIYSSCLWQL

SEQ ID NO: 2326130 - protein, 23 aa, Cryptosporidium parvum
YNNMILSNMLLLNGALSGSSPSN

SEQ ID NO: 2326131 - protein, 24 aa, Cryptosporidium parvum
YNSDFYMMLKYPLKVRPFYTMPDF

SEQ ID NO: 2326132 - protein, 25 aa, Cryptosporidium parvum
YNTWFRYNLPFYLEPQYYHLLSYKL

SEQ ID NO: 2326133 - protein, 25 aa, Cryptosporidium parvum
YNYKRALCRHWMRGYCWLEADCKFA

SEQ ID NO: 2326134 - protein, 20 aa, Cryptosporidium parvum
YPCKCRYQICLWCFYHVRDQ

SEQ ID NO: 2326135 - protein, 20 aa, Cryptosporidium parvum
YPKHYIAWLCIMWLSIHLKE

SEQ ID NO: 2326136 - protein, 24 aa, Cryptosporidium parvum
YPKRLRTAPLKWYLGERLEYHRDE

SEQ ID NO: 2326137 - protein, 27 aa, Cryptosporidium parvum
YQALKKAMFKPAAWFKGILLPLAEDES

SEQ ID NO: 2326138 - protein, 21 aa, Cryptosporidium parvum
YQNFAFIKFYDLNILCDCPLI

SEQ ID NO: 2326139 - protein, 23 aa, Cryptosporidium parvum
YSDDHWWYIFKKKFNMSTKGGIS

SEQ ID NO: 2326140 - protein, 21 aa, Cryptosporidium parvum
YSQLLYRPIYISKNKKLLVFL

SEQ ID NO: 2326141 - protein, 29 aa, Cryptosporidium parvum
YSRRFILRLFRQFWGFLDYMDLSLIENLN

SEQ ID NO: 2326142 - protein, 22 aa, Cryptosporidium parvum
YTFGDPWVVHPKNKSWRRIQIL

SEQ ID NO: 2326143 - protein, 17 aa, Cryptosporidium parvum
YTRPLKVTILTKLFLLI

SEQ ID NO: 2326144 - protein, 26 aa, Cryptosporidium parvum
YVPAFSGKFAFLPQPPLDGSSSTGDY

SEQ ID NO: 2326145 - protein, 17 aa, Cryptosporidium parvum
YWRYIGIIKLYKKVQGL

SEQ ID NO: 2326146 - protein, 19 aa, Cryptosporidium parvum
YWTPFYFKETEKFVKSIRN

SEQ ID NO: 2326147 - protein, 4 aa, Cryptosporidium parvum
CDDE

SEQ ID NO: 2326148 - protein, 6 aa, Cryptosporidium parvum
ATSAKI

SEQ ID NO: 2326149 - protein, 4 aa, Cryptosporidium parvum
MPED

SEQ ID NO: 2326150 - protein, 7 aa, Cryptosporidium parvum
NGTSAKI

SEQ ID NO: 2326151 - protein, 5 aa, Cryptosporidium parvum
NNTKK

SEQ ID NO: 2326152 - protein, 19 aa, Cryptosporidium parvum
STETAAFPASRTKYPANTE

SEQ ID NO: 2326153 - protein, 25 aa, Cryptosporidium parvum
AVGKTNHQDSSQKEPKSKRKPLTRR

SEQ ID NO: 2326154 - protein, 5 aa, Cryptosporidium parvum
ECSPE

SEQ ID NO: 2326155 - protein, 4 aa, Cryptosporidium parvum
ENPK

SEQ ID NO: 2326156 - protein, 26 aa, Cryptosporidium parvum
HRTGANKNSNRRNSSDLDDEEEEDEE

SEQ ID NO: 2326157 - protein, 5 aa, Cryptosporidium parvum
ISSSD

SEQ ID NO: 2326158 - protein, 5 aa, Cryptosporidium parvum
ITSDS

SEQ ID NO: 2326159 - protein, 5 aa, Cryptosporidium parvum
KEEIP

SEQ ID NO: 2326160 - protein, 17 aa, Cryptosporidium parvum
KNEKTSTESVVGSPQCG

SEQ ID NO: 2326161 - protein, 4 aa, Cryptosporidium parvum
KNIP

SEQ ID NO: 2326162 - protein, 6 aa, Cryptosporidium parvum
KSIDEL

SEQ ID NO: 2326163 - protein, 8 aa, Cryptosporidium parvum
LEKENSGC

SEQ ID NO: 2326164 - protein, 5 aa, Cryptosporidium parvum
LPSTE

SEQ ID NO: 2326165 - protein, 17 aa, Cryptosporidium parvum
NTTTGQFEKDEDNTNLD

SEQ ID NO: 2326166 - protein, 22 aa, Cryptosporidium parvum
NTTTGQFEKNEDHPNPDEINPF

SEQ ID NO: 2326167 - protein, 19 aa, Cryptosporidium parvum
PDKDENTGEIKPEDKYGES

SEQ ID NO: 2326168 - protein, 4 aa, Cryptosporidium parvum
PEVL

SEQ ID NO: 2326169 - protein, 17 aa, Cryptosporidium parvum
QPAPIDGDENNTPPNYH

SEQ ID NO: 2326170 - protein, 4 aa, Cryptosporidium parvum
RGPD

SEQ ID NO: 2326171 - protein, 5 aa, Cryptosporidium parvum
SATSK

SEQ ID NO: 2326172 - protein, 4 aa, Cryptosporidium parvum
SPEL

SEQ ID NO: 2326173 - protein, 5 aa, Cryptosporidium parvum
SSSTL

SEQ ID NO: 2326174 - protein, 4 aa, Cryptosporidium parvum
VDDS

SEQ ID NO: 2326175 - protein, 7 aa, Cryptosporidium parvum
VNNGTWG

SEQ ID NO: 2326176 - protein, 9 aa, Cryptosporidium parvum
VPEYGDNSN

SEQ ID NO: 2326177 - protein, 11 aa, Cryptosporidium parvum
VPEYGDNSNNI

SEQ ID NO: 2326178 - protein, 12 aa, Cryptosporidium parvum
AAAAAAASKESV

SEQ ID NO: 2326179 - protein, 7 aa, Cryptosporidium parvum
AAEKRKV

SEQ ID NO: 2326180 - protein, 14 aa, Cryptosporidium parvum
AAELPNSSNKPQVV

SEQ ID NO: 2326181 - protein, 7 aa, Cryptosporidium parvum
AAGDEFS

SEQ ID NO: 2326182 - protein, 20 aa, Cryptosporidium parvum
AAKETSTVYETSEIQNPGHH

SEQ ID NO: 2326183 - protein, 12 aa, Cryptosporidium parvum
AAKNGFITIVRD

SEQ ID NO: 2326184 - protein, 16 aa, Cryptosporidium parvum
AALPASRTGQPSETTH

SEQ ID NO: 2326185 - protein, 11 aa, Cryptosporidium parvum
AALQQKQKALA

SEQ ID NO: 2326186 - protein, 7 aa, Cryptosporidium parvum
AANGSEH

SEQ ID NO: 2326187 - protein, 7 aa, Cryptosporidium parvum
AANNSDQ

SEQ ID NO: 2326188 - protein, 12 aa, Cryptosporidium parvum
AAPEKSPLAGVP

SEQ ID NO: 2326189 - protein, 8 aa, Cryptosporidium parvum
AAPENTEN

SEQ ID NO: 2326190 - protein, 9 aa, Cryptosporidium parvum
AAPKPRQLT

SEQ ID NO: 2326191 - protein, 11 aa, Cryptosporidium parvum
AAPLDEHTQRD

SEQ ID NO: 2326192 - protein, 5 aa, Cryptosporidium parvum
AAPLN

SEQ ID NO: 2326193 - protein, 6 aa, Cryptosporidium parvum
AAQPPY

SEQ ID NO: 2326194 - protein, 12 aa, Cryptosporidium parvum
AARSSTRKISDE

SEQ ID NO: 2326195 - protein, 6 aa, Cryptosporidium parvum
AASELE

SEQ ID NO: 2326196 - protein, 5 aa, Cryptosporidium parvum
AASIY

SEQ ID NO: 2326197 - protein, 7 aa, Cryptosporidium parvum
AASNPPK

SEQ ID NO: 2326198 - protein, 7 aa, Cryptosporidium parvum
AASYTGK

SEQ ID NO: 2326199 - protein, 6 aa, Cryptosporidium parvum
AATEKY

SEQ ID NO: 2326200 - protein, 11 aa, Cryptosporidium parvum
AATGTADVNNS

SEQ ID NO: 2326201 - protein, 4 aa, Cryptosporidium parvum
ACSE

SEQ ID NO: 2326202 - protein, 19 aa, Cryptosporidium parvum
ADAKKKEVDVSSSIPGSTD

SEQ ID NO: 2326203 - protein, 6 aa, Cryptosporidium parvum
ADESLR

SEQ ID NO: 2326204 - protein, 7 aa, Cryptosporidium parvum
ADEYGNS

SEQ ID NO: 2326205 - protein, 7 aa, Cryptosporidium parvum
ADHGENP

SEQ ID NO: 2326206 - protein, 6 aa, Cryptosporidium parvum
ADHGKT

SEQ ID NO: 2326207 - protein, 18 aa, Cryptosporidium parvum
ADIDPFSDSEFSNSYPSV

SEQ ID NO: 2326208 - protein, 6 aa, Cryptosporidium parvum
ADKDGK

SEQ ID NO: 2326209 - protein, 9 aa, Cryptosporidium parvum
ADLENGDSI

SEQ ID NO: 2326210 - protein, 14 aa, Cryptosporidium parvum
ADLPRDNKFASKPA

SEQ ID NO: 2326211 - protein, 15 aa, Cryptosporidium parvum
ADLSNETSEVQNPEQ

SEQ ID NO: 2326212 - protein, 7 aa, Cryptosporidium parvum
ADNEDDL

SEQ ID NO: 2326213 - protein, 61 aa, Cryptosporidium parvum
ADNKSSNSTEELEAKPTERPEVPRVEEKGKPQKDEPKNEGTQNSKGKFEIRTKEEKGAARK

SEQ ID NO: 2326214 - protein, 7 aa, Cryptosporidium parvum
ADPATEK

SEQ ID NO: 2326215 - protein, 18 aa, Cryptosporidium parvum
ADPQIKCPNGSSATPQGT

SEQ ID NO: 2326216 - protein, 5 aa, Cryptosporidium parvum
ADQEA

SEQ ID NO: 2326217 - protein, 11 aa, Cryptosporidium parvum
ADSDPSLLKSE

SEQ ID NO: 2326218 - protein, 8 aa, Cryptosporidium parvum
ADSNSDGV

SEQ ID NO: 2326219 - protein, 44 aa, Cryptosporidium parvum; identical to SEQ ID NO: 2200830

SEQ ID NO: 2326220 - protein, 7 aa, Cryptosporidium parvum
ADTESQW

SEQ ID NO: 2326221 - protein, 7 aa, Cryptosporidium parvum
ADTQVTC

SEQ ID NO: 2326222 - protein, 5 aa, Cryptosporidium parvum
ADTSS

SEQ ID NO: 2326223 - protein, 9 aa, Cryptosporidium parvum
ADVKEEEKY

SEQ ID NO: 2326224 - protein, 5 aa, Cryptosporidium parvum
ADYEY

SEQ ID NO: 2326225 - protein, 4 aa, Cryptosporidium parvum
ADYR

SEQ ID NO: 2326226 - protein, 7 aa, Cryptosporidium parvum
AEAEVEA

SEQ ID NO: 2326227 - protein, 14 aa, Cryptosporidium parvum
AEAIENTPQQIIED

SEQ ID NO: 2326228 - protein, 17 aa, Cryptosporidium parvum
AEAPHSSDESEELDEEE

SEQ ID NO: 2326229 - protein, 11 aa, Cryptosporidium parvum
AEDIDSTKNIE

SEQ ID NO: 2326230 - protein, 5 aa, Cryptosporidium parvum
AEDPE

SEQ ID NO: 2326231 - protein, 7 aa, Cryptosporidium parvum
AEDSTYN

SEQ ID NO: 2326232 - protein, 18 aa, Cryptosporidium parvum
AEEAKKEESDKLSSQIAE

SEQ ID NO: 2326233 - protein, 6 aa, Cryptosporidium parvum
AEEHSI

SEQ ID NO: 2326234 - protein, 6 aa, Cryptosporidium parvum
AEEQKK

SEQ ID NO: 2326235 - protein, 5 aa, Cryptosporidium parvum
AEESG

SEQ ID NO: 2326236 - protein, 8 aa, Cryptosporidium parvum
AEHQDNSQ

SEQ ID NO: 2326237 - protein, 9 aa, Cryptosporidium parvum
AEIQNGIDG

SEQ ID NO: 2326238 - protein, 7 aa, Cryptosporidium parvum
AEKQSTI

SEQ ID NO: 2326239 - protein, 8 aa, Cryptosporidium parvum
AEKSRDGL

SEQ ID NO: 2326240 - protein, 10 aa, Cryptosporidium parvum
AELESSYHRK

SEQ ID NO: 2326241 - protein, 4 aa, Cryptosporidium parvum
AEMP

SEQ ID NO: 2326242 - protein, 8 aa, Cryptosporidium parvum
AENASELN

SEQ ID NO: 2326243 - protein, 12 aa, Cryptosporidium parvum
AENETGSYQTKS

SEQ ID NO: 2326244 - protein, 5 aa, Cryptosporidium parvum
AENRE

SEQ ID NO: 2326245 - protein, 13 aa, Cryptosporidium parvum
AEPSYVPDPHPEG

SEQ ID NO: 2326246 - protein, 16 aa, Cryptosporidium parvum
AEPTITSLPDTEAKKV

SEQ ID NO: 2326247 - protein, 8 aa, Cryptosporidium parvum
AEQAEDGR

SEQ ID NO: 2326248 - protein, 8 aa, Cryptosporidium parvum
AEQGGYSS

SEQ ID NO: 2326249 - protein, 21 aa, Cryptosporidium parvum
AERQEIDQKEEEEEEEKVANV

SEQ ID NO: 2326250 - protein, 6 aa, Cryptosporidium parvum
AESEEA

SEQ ID NO: 2326251 - protein, 6 aa, Cryptosporidium parvum
AESGVT

SEQ ID NO: 2326252 - protein, 8 aa, Cryptosporidium parvum
AESNTEDY

SEQ ID NO: 2326253 - protein, 6 aa, Cryptosporidium parvum
AESQVD

SEQ ID NO: 2326254 - protein, 12 aa, Cryptosporidium parvum
AETNVNNGTWGE

SEQ ID NO: 2326255 - protein, 8 aa, Cryptosporidium parvum
AETYTNGP

SEQ ID NO: 2326256 - protein, 6 aa, Cryptosporidium parvum
AEVESG

SEQ ID NO: 2326257 - protein, 4 aa, Cryptosporidium parvum
AEVT

SEQ ID NO: 2326258 - protein, 11 aa, Cryptosporidium parvum
AFEKQSKTRTL

SEQ ID NO: 2326259 - protein, 20 aa, Cryptosporidium parvum
AFGEEGLKSEGFGGGGDGGF

SEQ ID NO: 2326260 - protein, 12 aa, Cryptosporidium parvum
AFPKNSEETESD

SEQ ID NO: 2326261 - protein, 8 aa, Cryptosporidium parvum
AGEGGRRI

SEQ ID NO: 2326262 - protein, 6 aa, Cryptosporidium parvum
AGEGGS

SEQ ID NO: 2326263 - protein, 27 aa, Cryptosporidium parvum
AGEKINPCSQNKTIDNSYATKKTIREE

SEQ ID NO: 2326264 - protein, 11 aa, Cryptosporidium parvum
AGFTPGGSSRI

SEQ ID NO: 2326265 - protein, 8 aa, Cryptosporidium parvum
AGGAQERR

SEQ ID NO: 2326266 - protein, 8 aa, Cryptosporidium parvum
AGGGGGGE

SEQ ID NO: 2326267 - protein, 6 aa, Cryptosporidium parvum
AGKKRT

SEQ ID NO: 2326268 - protein, 10 aa, Cryptosporidium parvum
AGKPNCKKPD

SEQ ID NO: 2326269 - protein, 5 aa, Cryptosporidium parvum
AGKPV

SEQ ID NO: 2326270 - protein, 6 aa, Cryptosporidium parvum
AGLSGN

SEQ ID NO: 2326271 - protein, 4 aa, Cryptosporidium parvum
AGPY

SEQ ID NO: 2326272 - protein, 6 aa, Cryptosporidium parvum
AGQERF

SEQ ID NO: 2326273 - protein, 14 aa, Cryptosporidium parvum
AGQHKNTETAQSDT

SEQ ID NO: 2326274 - protein, 7 aa, Cryptosporidium parvum
AGSTGKF

SEQ ID NO: 2326275 - protein, 5 aa, Cryptosporidium parvum
AGTEI

SEQ ID NO: 2326276 - protein, 7 aa, Cryptosporidium parvum
AGTGGRG

SEQ ID NO: 2326277 - protein, 7 aa, Cryptosporidium parvum
AGTSGDF

SEQ ID NO: 2326278 - protein, 5 aa, Cryptosporidium parvum
AGYPV

SEQ ID NO: 2326279 - protein, 7 aa, Cryptosporidium parvum
AGYSTGR

SEQ ID NO: 2326280 - protein, 32 aa, Cryptosporidium parvum
AHEEALEKEKEMRHSGATTSSGLKPASPIQQG

SEQ ID NO: 2326281 - protein, 6 aa, Cryptosporidium parvum
AHSKNC

SEQ ID NO: 2326282 - protein, 8 aa, Cryptosporidium parvum
AHSTREEA

SEQ ID NO: 2326283 - protein, 6 aa, Cryptosporidium parvum
AIDNNN

SEQ ID NO: 2326284 - protein, 24 aa, Cryptosporidium parvum
AIDPKKSKEEESSSFGSSDKVEED

SEQ ID NO: 2326285 - protein, 13 aa, Cryptosporidium parvum
AIKGEEEEREGLN

SEQ ID NO: 2326286 - protein, 11 aa, Cryptosporidium parvum
AILPNGNSTNL

SEQ ID NO: 2326287 - protein, 15 aa, Cryptosporidium parvum
AINPQSRKPLKRNRQ

SEQ ID NO: 2326288 - protein, 6 aa, Cryptosporidium parvum
AINQQN

SEQ ID NO: 2326289 - protein, 4 aa, Cryptosporidium parvum
AIPD

SEQ ID NO: 2326290 - protein, 4 aa, Cryptosporidium parvum
AISP

SEQ ID NO: 2326291 - protein, 6 aa, Cryptosporidium parvum
AISPAV

SEQ ID NO: 2326292 - protein, 12 aa, Cryptosporidium parvum
AISSNKKSYTNG

SEQ ID NO: 2326293 - protein, 26 aa, Cryptosporidium parvum
AISSPRPVRPRKQIKGRNPSNIPGAS

SEQ ID NO: 2326294 - protein, 18 aa, Cryptosporidium parvum
AISSRSPVHAKKDSNKVH

SEQ ID NO: 2326295 - protein, 9 aa, Cryptosporidium parvum
AISTEESRI

SEQ ID NO: 2326296 - protein, 4 aa, Cryptosporidium parvum
AKAK

SEQ ID NO: 2326297 - protein, 9 aa, Cryptosporidium parvum
AKCEKGSCK

SEQ ID NO: 2326298 - protein, 10 aa, Cryptosporidium parvum
AKCTGGECTP

SEQ ID NO: 2326299 - protein, 7 aa, Cryptosporidium parvum
AKDGESN

SEQ ID NO: 2326300 - protein, 25 aa, Cryptosporidium parvum
AKDKGTGKSEKITITNDKGRLSQED

SEQ ID NO: 2326301 - protein, 10 aa, Cryptosporidium parvum
AKDVAEKDEQ

SEQ ID NO: 2326302 - protein, 11 aa, Cryptosporidium parvum
AKEIKTNNDGN

SEQ ID NO: 2326303 - protein, 24 aa, Cryptosporidium parvum
AKENNVPESQAHPCGKCSSGSTCC

SEQ ID NO: 2326304 - protein, 9 aa, Cryptosporidium parvum
AKEPEESAK

SEQ ID NO: 2326305 - protein, 22 aa, Cryptosporidium parvum
AKEVKNEAENVPKETQPEEKRR

SEQ ID NO: 2326306 - protein, 7 aa, Cryptosporidium parvum
AKEWEST

SEQ ID NO: 2326307 - protein, 9 aa, Cryptosporidium parvum
AKGACNRAQ

SEQ ID NO: 2326308 - protein, 5 aa, Cryptosporidium parvum
AKGGD

SEQ ID NO: 2326309 - protein, 10 aa, Cryptosporidium parvum
AKGNPSPPQM

SEQ ID NO: 2326310 - protein, 6 aa, Cryptosporidium parvum
AKHGPR

SEQ ID NO: 2326311 - protein, 9 aa, Cryptosporidium parvum
AKHNKDTRK

SEQ ID NO: 2326312 - protein, 9 aa, Cryptosporidium parvum
AKKENLDNS

SEQ ID NO: 2326313 - protein, 6 aa, Cryptosporidium parvum
AKKGEV

SEQ ID NO: 2326314 - protein, 5 aa, Cryptosporidium parvum
AKKGQ

SEQ ID NO: 2326315 - protein, 5 aa, Cryptosporidium parvum
AKKNV

SEQ ID NO: 2326316 - protein, 14 aa, Cryptosporidium parvum
AKKPIKTEPTKERR

SEQ ID NO: 2326317 - protein, 6 aa, Cryptosporidium parvum
AKLETN

SEQ ID NO: 2326318 - protein, 6 aa, Cryptosporidium parvum
AKLNDL

SEQ ID NO: 2326319 - protein, 8 aa, Cryptosporidium parvum
AKLSASYE

SEQ ID NO: 2326320 - protein, 9 aa, Cryptosporidium parvum
AKNESVPSS

SEQ ID NO: 2326321 - protein, 4 aa, Cryptosporidium parvum
AKNR

SEQ ID NO: 2326322 - protein, 4 aa, Cryptosporidium parvum
AKNV

SEQ ID NO: 2326323 - protein, 8 aa, Cryptosporidium parvum
AKPCTQPT

SEQ ID NO: 2326324 - protein, 8 aa, Cryptosporidium parvum
AKPGEYPN

SEQ ID NO: 2326325 - protein, 7 aa, Cryptosporidium parvum
AKPKNNS

SEQ ID NO: 2326326 - protein, 6 aa, Cryptosporidium parvum
AKPSQY

SEQ ID NO: 2326327 - protein, 10 aa, Cryptosporidium parvum
AKQEKERQRL

SEQ ID NO: 2326328 - protein, 10 aa, Cryptosporidium parvum
AKRSNKGNNN

SEQ ID NO: 2326329 - protein, 7 aa, Cryptosporidium parvum
AKRTIEG

SEQ ID NO: 2326330 - protein, 7 aa, Cryptosporidium parvum
AKSDEEI

SEQ ID NO: 2326331 - protein, 7 aa, Cryptosporidium parvum
AKSMGKN

SEQ ID NO: 2326332 - protein, 14 aa, Cryptosporidium parvum
AKSNDPGSIETKAE

SEQ ID NO: 2326333 - protein, 10 aa, Cryptosporidium parvum
AKSPDGTSGR

SEQ ID NO: 2326334 - protein, 8 aa, Cryptosporidium parvum
AKSSAKQC

SEQ ID NO: 2326335 - protein, 8 aa, Cryptosporidium parvum
AKTKHRGS

SEQ ID NO: 2326336 - protein, 9 aa, Cryptosporidium parvum
AKYNNSPVG

SEQ ID NO: 2326337 - protein, 13 aa, Cryptosporidium parvum
ALGKDTSATNCPN

SEQ ID NO: 2326338 - protein, 24 aa, Cryptosporidium parvum
ALGKEGYKAHKQKKQADSKKRKEM

SEQ ID NO: 2326339 - protein, 10 aa, Cryptosporidium parvum
ALKDSGSDFN

SEQ ID NO: 2326340 - protein, 10 aa, Cryptosporidium parvum
ALKGSDTGID

SEQ ID NO: 2326341 - protein, 4 aa, Cryptosporidium parvum
ALLP

SEQ ID NO: 2326342 - protein, 5 aa, Cryptosporidium parvum
ALREE

SEQ ID NO: 2326343 - protein, 21 aa, Cryptosporidium parvum
ALREQKRKKELKKEKLENQEK

SEQ ID NO: 2326344 - protein, 13 aa, Cryptosporidium parvum
ALSQTTQQAPTSQ

SEQ ID NO: 2326345 - protein, 8 aa, Cryptosporidium parvum
ALSSQSKV

SEQ ID NO: 2326346 - protein, 10 aa, Cryptosporidium parvum
ALVSPTGGKL

SEQ ID NO: 2326347 - protein, 8 aa, Cryptosporidium parvum
AMDSQNAR

SEQ ID NO: 2326348 - protein, 10 aa, Cryptosporidium parvum
AMNPQEQKRL

SEQ ID NO: 2326349 - protein, 4 aa, Cryptosporidium parvum
ANAT

SEQ ID NO: 2326350 - protein, 8 aa, Cryptosporidium parvum
ANATELSR

SEQ ID NO: 2326351 - protein, 6 aa, Cryptosporidium parvum
ANDPYI

SEQ ID NO: 2326352 - protein, 6 aa, Cryptosporidium parvum
ANERPE

SEQ ID NO: 2326353 - protein, 6 aa, Cryptosporidium parvum
ANESVG

SEQ ID NO: 2326354 - protein, 6 aa, Cryptosporidium parvum
ANETLL

SEQ ID NO: 2326355 - protein, 9 aa, Cryptosporidium parvum
ANGNQAVTC

SEQ ID NO: 2326356 - protein, 8 aa, Cryptosporidium parvum
ANGRPSAI

SEQ ID NO: 2326357 - protein, 7 aa, Cryptosporidium parvum
ANHPAQY

SEQ ID NO: 2326358 - protein, 10 aa, Cryptosporidium parvum
ANHSDNKYES

SEQ ID NO: 2326359 - protein, 23 aa, Cryptosporidium parvum
ANINKDRDNVPAATSSLSKAYNP

SEQ ID NO: 2326360 - protein, 17 aa, Cryptosporidium parvum
ANIPNDDGEDNPKNVEK

SEQ ID NO: 2326361 - protein, 17 aa, Cryptosporidium parvum
ANKESGEENLPGEYTST

SEQ ID NO: 2326362 - protein, 6 aa, Cryptosporidium parvum
ANKQLK

SEQ ID NO: 2326363 - protein, 19 aa, Cryptosporidium parvum
ANKSLQPTKKINESNMSNL

SEQ ID NO: 2326364 - protein, 5 aa, Cryptosporidium parvum
ANNGK

SEQ ID NO: 2326365 - protein, 6 aa, Cryptosporidium parvum
ANNPIE

SEQ ID NO: 2326366 - protein, 17 aa, Cryptosporidium parvum
ANPIDQKEVSQDPTGSE

SEQ ID NO: 2326367 - protein, 7 aa, Cryptosporidium parvum
ANPPPAS

SEQ ID NO: 2326368 - protein, 6 aa, Cryptosporidium parvum
ANQPRY

SEQ ID NO: 2326369 - protein, 11 aa, Cryptosporidium parvum
ANRSNGTIDNK

SEQ ID NO: 2326370 - protein, 4 aa, Cryptosporidium parvum
ANSG

SEQ ID NO: 2326371 - protein, 10 aa, Cryptosporidium parvum
ANSKSSNNET

SEQ ID NO: 2326372 - protein, 5 aa, Cryptosporidium parvum
ANSPG

SEQ ID NO: 2326373 - protein, 14 aa, Cryptosporidium parvum
ANSVQGENKKYSSP

SEQ ID NO: 2326374 - protein, 9 aa, Cryptosporidium parvum
ANSVTGRSN

SEQ ID NO: 2326375 - protein, 5 aa, Cryptosporidium parvum
ANSYS

SEQ ID NO: 2326376 - protein, 5 aa, Cryptosporidium parvum
ANTDS

SEQ ID NO: 2326377 - protein, 5 aa, Cryptosporidium parvum
ANTTH

SEQ ID NO: 2326378 - protein, 21 aa, Cryptosporidium parvum
ANWGKKGYAKIRRGKNIGGIE

SEQ ID NO: 2326379 - protein, 8 aa, Cryptosporidium parvum
ANYDDYPT

SEQ ID NO: 2326380 - protein, 6 aa, Cryptosporidium parvum
APAFSS

SEQ ID NO: 2326381 - protein, 13 aa, Cryptosporidium parvum
APAPRFTNSPSYP

SEQ ID NO: 2326382 - protein, 7 aa, Cryptosporidium parvum
APAVPVP

SEQ ID NO: 2326383 - protein, 8 aa, Cryptosporidium parvum
APDSEGSV

SEQ ID NO: 2326384 - protein, 6 aa, Cryptosporidium parvum
APEEHV

SEQ ID NO: 2326385 - protein, 8 aa, Cryptosporidium parvum
APELTCSK

SEQ ID NO: 2326386 - protein, 7 aa, Cryptosporidium parvum
APEMSQY

SEQ ID NO: 2326387 - protein, 14 aa, Cryptosporidium parvum
APESAELESTCPPN

SEQ ID NO: 2326388 - protein, 5 aa, Cryptosporidium parvum
APGRP

SEQ ID NO: 2326389 - protein, 14 aa, Cryptosporidium parvum
APIDGNEANTPPGY

SEQ ID NO: 2326390 - protein, 6 aa, Cryptosporidium parvum
APIDTK

SEQ ID NO: 2326391 - protein, 9 aa, Cryptosporidium parvum
APKDNPNKL

SEQ ID NO: 2326392 - protein, 9 aa, Cryptosporidium parvum
APKEEQKSL

SEQ ID NO: 2326393 - protein, 8 aa, Cryptosporidium parvum
APKFQGEI

SEQ ID NO: 2326394 - protein, 5 aa, Cryptosporidium parvum
APKQW

SEQ ID NO: 2326395 - protein, 8 aa, Cryptosporidium parvum
APKTAKLS

SEQ ID NO: 2326396 - protein, 5 aa, Cryptosporidium parvum
APLNK

SEQ ID NO: 2326397 - protein, 5 aa, Cryptosporidium parvum
APLPG

SEQ ID NO: 2326398 - protein, 16 aa, Cryptosporidium parvum
APNGDKYYKYNKENDY

SEQ ID NO: 2326399 - protein, 7 aa, Cryptosporidium parvum
APPFAPP

SEQ ID NO: 2326400 - protein, 5 aa, Cryptosporidium parvum
APPGL

SEQ ID NO: 2326401 - protein, 6 aa, Cryptosporidium parvum
APPNRK

SEQ ID NO: 2326402 - protein, 11 aa, Cryptosporidium parvum
APQVKPNIPGV

SEQ ID NO: 2326403 - protein, 149 aa, Cryptosporidium parvum
APSCKNPGCKGTNCDGSKCKGSECVRPSTTTTTRFTTTTTTRSTTTTTRPTTTTRPTTTTTTTTRPTTTTTRSTTTTTRSTTTTTRSTTTTTRPTTTTTRPTTTTTRSTTTTTRPTTTTTRPTTTTTRPTTTTTRPTTTTTTTTTTTRY

SEQ ID NO: 2326404 - protein, 6 aa, Cryptosporidium parvum
APSKVT

SEQ ID NO: 2326405 - protein, 4 aa, Cryptosporidium parvum
APSP

SEQ ID NO: 2326406 - protein, 6 aa, Cryptosporidium parvum
APSQEQ

SEQ ID NO: 2326407 - protein, 17 aa, Cryptosporidium parvum
APYDSARAEYSPDGPSV

SEQ ID NO: 2326408 - protein, 16 aa, Cryptosporidium parvum
APYSYDSAPFSSSNDL

SEQ ID NO: 2326409 - protein, 8 aa, Cryptosporidium parvum
AQEGGALE

SEQ ID NO: 2326410 - protein, 18 aa, Cryptosporidium parvum
AQEPPQKPMKKPLPIPKD

SEQ ID NO: 2326411 - protein, 5 aa, Cryptosporidium parvum
AQFDE

SEQ ID NO: 2326412 - protein, 13 aa, Cryptosporidium parvum
AQINRQPNSNFQN

SEQ ID NO: 2326413 - protein, 9 aa, Cryptosporidium parvum
AQNGSPYGI

SEQ ID NO: 2326414 - protein, 11 aa, Cryptosporidium parvum
AQNRNNESYRI

SEQ ID NO: 2326415 - protein, 12 aa, Cryptosporidium parvum
AQRQATKDAGAI

SEQ ID NO: 2326416 - protein, 13 aa, Cryptosporidium parvum
AQSNISAPFSTNG

SEQ ID NO: 2326417 - protein, 5 aa, Cryptosporidium parvum
AQSNQ

SEQ ID NO: 2326418 - protein, 8 aa, Cryptosporidium parvum
AQSSLQEA

SEQ ID NO: 2326419 - protein, 13 aa, Cryptosporidium parvum
AQTFSNKADYKNK

SEQ ID NO: 2326420 - protein, 8 aa, Cryptosporidium parvum
AQTPADYK

SEQ ID NO: 2326421 - protein, 4 aa, Cryptosporidium parvum
AQVD

SEQ ID NO: 2326422 - protein, 10 aa, Cryptosporidium parvum
AQVKDSGSVT

SEQ ID NO: 2326423 - protein, 18 aa, Cryptosporidium parvum
ARASGETVFEDEQEVNTY

SEQ ID NO: 2326424 - protein, 8 aa, Cryptosporidium parvum
ARDSESLE

SEQ ID NO: 2326425 - protein, 6 aa, Cryptosporidium parvum
ARDVLS

SEQ ID NO: 2326426 - protein, 5 aa, Cryptosporidium parvum
ARELK

SEQ ID NO: 2326427 - protein, 13 aa, Cryptosporidium parvum
ARKNEQINESGDF

SEQ ID NO: 2326428 - protein, 13 aa, Cryptosporidium parvum
ARKNTREGEDFGS

SEQ ID NO: 2326429 - protein, 10 aa, Cryptosporidium parvum
ARLPTTKRKL

SEQ ID NO: 2326430 - protein, 4 aa, Cryptosporidium parvum
ARNA

SEQ ID NO: 2326431 - protein, 13 aa, Cryptosporidium parvum
ARSALERSAASEQ

SEQ ID NO: 2326432 - protein, 6 aa, Cryptosporidium parvum
ARSRAF

SEQ ID NO: 2326433 - protein, 6 aa, Cryptosporidium parvum
ARTPTK

SEQ ID NO: 2326434 - protein, 6 aa, Cryptosporidium parvum
ASADQV

SEQ ID NO: 2326435 - protein, 8 aa, Cryptosporidium parvum
ASAPTSGF

SEQ ID NO: 2326436 - protein, 9 aa, Cryptosporidium parvum
ASASINNRI

SEQ ID NO: 2326437 - protein, 24 aa, Cryptosporidium parvum
ASASLEENKPSQPPVATQSTTSFV

SEQ ID NO: 2326438 - protein, 7 aa, Cryptosporidium parvum
ASDGSSI

SEQ ID NO: 2326439 - protein, 15 aa, Cryptosporidium parvum
ASDIQGESEGSLNEE

SEQ ID NO: 2326440 - protein, 5 aa, Cryptosporidium parvum
ASDLT

SEQ ID NO: 2326441 - protein, 17 aa, Cryptosporidium parvum
ASDMTSSGSLKASNNLE

SEQ ID NO: 2326442 - protein, 5 aa, Cryptosporidium parvum
ASDQS

SEQ ID NO: 2326443 - protein, 11 aa, Cryptosporidium parvum
ASDSTEDKKKT

SEQ ID NO: 2326444 - protein, 6 aa, Cryptosporidium parvum
ASDTGL

SEQ ID NO: 2326445 - protein, 12 aa, Cryptosporidium parvum
ASEEKQDEKDSI

SEQ ID NO: 2326446 - protein, 5 aa, Cryptosporidium parvum
ASEEN

SEQ ID NO: 2326447 - protein, 9 aa, Cryptosporidium parvum
ASESPSKRE

SEQ ID NO: 2326448 - protein, 7 aa, Cryptosporidium parvum
ASETVSE

SEQ ID NO: 2326449 - protein, 37 aa, Cryptosporidium parvum
ASGAGVGTGSGVGTGSGVGTGADAGTGADAGTGVGAG

SEQ ID NO: 2326450 - protein, 15 aa, Cryptosporidium parvum
ASGDDYFSNSPTARE

SEQ ID NO: 2326451 - protein, 6 aa, Cryptosporidium parvum
ASGDSR

SEQ ID NO: 2326452 - protein, 7 aa, Cryptosporidium parvum
ASGDVES

SEQ ID NO: 2326453 - protein, 6 aa, Cryptosporidium parvum
ASGFDG

SEQ ID NO: 2326454 - protein, 8 aa, Cryptosporidium parvum
ASGGNDGK

SEQ ID NO: 2326455 - protein, 6 aa, Cryptosporidium parvum
ASGPVI

SEQ ID NO: 2326456 - protein, 4 aa, Cryptosporidium parvum
ASGS

SEQ ID NO: 2326457 - protein, 6 aa, Cryptosporidium parvum
ASHNDK

SEQ ID NO: 2326458 - protein, 12 aa, Cryptosporidium parvum
ASIKNNPRSRKK

SEQ ID NO: 2326459 - protein, 6 aa, Cryptosporidium parvum
ASIQQQ

SEQ ID NO: 2326460 - protein, 5 aa, Cryptosporidium parvum
ASIRS

SEQ ID NO: 2326461 - protein, 25 aa, Cryptosporidium parvum
ASISEQDHASSSQVGAESATKCEDS

SEQ ID NO: 2326462 - protein, 10 aa, Cryptosporidium parvum
ASISRKHSSI

SEQ ID NO: 2326463 - protein, 10 aa, Cryptosporidium parvum
ASKAPNSNVE

SEQ ID NO: 2326464 - protein, 49 aa, Cryptosporidium parvum
ASKDPPRKASEVLESSPGLSTQSENKDAHSQETTSLGTTPSNTATNLQS

SEQ ID NO: 2326465 - protein, 8 aa, Cryptosporidium parvum
ASKEEIDA

SEQ ID NO: 2326466 - protein, 6 aa, Cryptosporidium parvum
ASKIPG

SEQ ID NO: 2326467 - protein, 5 aa, Cryptosporidium parvum
ASKQK

SEQ ID NO: 2326468 - protein, 11 aa, Cryptosporidium parvum
ASKSDQSVLEE

SEQ ID NO: 2326469 - protein, 6 aa, Cryptosporidium parvum
ASKTGF

SEQ ID NO: 2326470 - protein, 11 aa, Cryptosporidium parvum
ASLKSNEKNES

SEQ ID NO: 2326471 - protein, 8 aa, Cryptosporidium parvum
ASLTGSVG

SEQ ID NO: 2326472 - protein, 12 aa, Cryptosporidium parvum
ASNDYSINSSTL

SEQ ID NO: 2326473 - protein, 5 aa, Cryptosporidium parvum
ASNED

SEQ ID NO: 2326474 - protein, 9 aa, Cryptosporidium parvum
ASNNGEPLM

SEQ ID NO: 2326475 - protein, 9 aa, Cryptosporidium parvum
ASNPTESIT

SEQ ID NO: 2326476 - protein, 4 aa, Cryptosporidium parvum
ASNS

SEQ ID NO: 2326477 - protein, 14 aa, Cryptosporidium parvum
ASNSDNQSNTKNDV

SEQ ID NO: 2326478 - protein, 14 aa, Cryptosporidium parvum
ASNSNSRNSRNNNI

SEQ ID NO: 2326479 - protein, 10 aa, Cryptosporidium parvum
ASPAPETNNE

SEQ ID NO: 2326480 - protein, 5 aa, Cryptosporidium parvum
ASPES

SEQ ID NO: 2326481 - protein, 9 aa, Cryptosporidium parvum
ASPESTATT

SEQ ID NO: 2326482 - protein, 7 aa, Cryptosporidium parvum
ASPPTGG

SEQ ID NO: 2326483 - protein, 15 aa, Cryptosporidium parvum
ASPQAAASNSTSGAL

SEQ ID NO: 2326484 - protein, 9 aa, Cryptosporidium parvum
ASPQNKDRM

SEQ ID NO: 2326485 - protein, 8 aa, Cryptosporidium parvum
ASQETSNK

SEQ ID NO: 2326486 - protein, 4 aa, Cryptosporidium parvum
ASQF

SEQ ID NO: 2326487 - protein, 7 aa, Cryptosporidium parvum
ASQKEAI

SEQ ID NO: 2326488 - protein, 6 aa, Cryptosporidium parvum
ASQNEL

SEQ ID NO: 2326489 - protein, 8 aa, Cryptosporidium parvum
ASQPRDDK

SEQ ID NO: 2326490 - protein, 5 aa, Cryptosporidium parvum
ASQYI

SEQ ID NO: 2326491 - protein, 10 aa, Cryptosporidium parvum
ASRKSYTHGV

SEQ ID NO: 2326492 - protein, 4 aa, Cryptosporidium parvum
ASRL

SEQ ID NO: 2326493 - protein, 18 aa, Cryptosporidium parvum
ASRREKRERRNQARNSKI

SEQ ID NO: 2326494 - protein, 40 aa, Cryptosporidium parvum
ASRRSDIDMNPNSYDASHGLEAEESTGAPEESPASPDVSV

SEQ ID NO: 2326495 - protein, 11 aa, Cryptosporidium parvum
ASSCPEEGNRG

SEQ ID NO: 2326496 - protein, 8 aa, Cryptosporidium parvum
ASSDEERF

SEQ ID NO: 2326497 - protein, 13 aa, Cryptosporidium parvum
ASSEGLSGEKRHI

SEQ ID NO: 2326498 - protein, 47 aa, Cryptosporidium parvum
ASSENIDTSDSDSNSTSDSNSSSNSNSSSNSGENGNQNENSLTETHK

SEQ ID NO: 2326499 - protein, 6 aa, Cryptosporidium parvum
ASSGDY

SEQ ID NO: 2326500 - protein, 14 aa, Cryptosporidium parvum
ASSKADFSNTASAR

SEQ ID NO: 2326501 - protein, 4 aa, Cryptosporidium parvum
ASSS

SEQ ID NO: 2326502 - protein, 102 aa, Cryptosporidium parvum
ASSSSTSREALAAQGPLETSESGTGGGAAASDGGASGGASGGASGGASGGASGGASGGVGALGGGKRGAGGAGRGAVRGASGGASGGASGGASSGTRARSSL

SEQ ID NO: 2326503 - protein, 8 aa, Cryptosporidium parvum
ASTGSPVG

SEQ ID NO: 2326504 - protein, 5 aa, Cryptosporidium parvum
ASTRR

SEQ ID NO: 2326505 - protein, 4 aa, Cryptosporidium parvum
ASTS

SEQ ID NO: 2326506 - protein, 8 aa, Cryptosporidium parvum
ASTSVPGA

SEQ ID NO: 2326507 - protein, 14 aa, Cryptosporidium parvum
ASVSTDSVSLPSKL

SEQ ID NO: 2326508 - protein, 8 aa, Cryptosporidium parvum
ATASDPLS

SEQ ID NO: 2326509 - protein, 7 aa, Cryptosporidium parvum
ATDQSIE

SEQ ID NO: 2326510 - protein, 10 aa, Cryptosporidium parvum
ATDSENRIQE

SEQ ID NO: 2326511 - protein, 17 aa, Cryptosporidium parvum
ATDTTTITTTAMPTSSK

SEQ ID NO: 2326512 - protein, 16 aa, Cryptosporidium parvum
ATGDQKAEQKDPYRST

SEQ ID NO: 2326513 - protein, 10 aa, Cryptosporidium parvum
ATGKAYTPAQ

SEQ ID NO: 2326514 - protein, 8 aa, Cryptosporidium parvum
ATGNKDLD

SEQ ID NO: 2326515 - protein, 15 aa, Cryptosporidium parvum
ATGPSTNERESESVR

SEQ ID NO: 2326516 - protein, 4 aa, Cryptosporidium parvum
ATGV

SEQ ID NO: 2326517 - protein, 9 aa, Cryptosporidium parvum
ATHGPASRY

SEQ ID NO: 2326518 - protein, 12 aa, Cryptosporidium parvum
ATHSSSKSEDKV

SEQ ID NO: 2326519 - protein, 11 aa, Cryptosporidium parvum
ATINRRENDFS

SEQ ID NO: 2326520 - protein, 7 aa, Cryptosporidium parvum
ATKGTAG

SEQ ID NO: 2326521 - protein, 10 aa, Cryptosporidium parvum
ATKYTGCEKG

SEQ ID NO: 2326522 - protein, 4 aa, Cryptosporidium parvum
ATLE

SEQ ID NO: 2326523 - protein, 11 aa, Cryptosporidium parvum
ATNPLPELSPE

SEQ ID NO: 2326524 - protein, 6 aa, Cryptosporidium parvum
ATNPSI

SEQ ID NO: 2326525 - protein, 12 aa, Cryptosporidium parvum
ATPTKTTKKRVV

SEQ ID NO: 2326526 - protein, 6 aa, Cryptosporidium parvum
ATQEES

SEQ ID NO: 2326527 - protein, 23 aa, Cryptosporidium parvum
ATQQDIDESLKRERETSRILHIG

SEQ ID NO: 2326528 - protein, 4 aa, Cryptosporidium parvum
ATQW

SEQ ID NO: 2326529 - protein, 14 aa, Cryptosporidium parvum
ATRLESNATEPISN

SEQ ID NO: 2326530 - protein, 5 aa, Cryptosporidium parvum
ATSAQ

SEQ ID NO: 2326531 - protein, 10 aa, Cryptosporidium parvum
ATSDENQIED

SEQ ID NO: 2326532 - protein, 7 aa, Cryptosporidium parvum
ATSGSDQ

SEQ ID NO: 2326533 - protein, 4 aa, Cryptosporidium parvum
ATSN

SEQ ID NO: 2326534 - protein, 14 aa, Cryptosporidium parvum
ATSNGVSDFSSSLR

SEQ ID NO: 2326535 - protein, 6 aa, Cryptosporidium parvum
ATSTKF

SEQ ID NO: 2326536 - protein, 15 aa, Cryptosporidium parvum
ATTGRTLESPTQDFS

SEQ ID NO: 2326537 - protein, 7 aa, Cryptosporidium parvum
ATTPEGK

SEQ ID NO: 2326538 - protein, 14 aa, Cryptosporidium parvum
ATTTTTTTSPPWQD

SEQ ID NO: 2326539 - protein, 7 aa, Cryptosporidium parvum
AVKEYSP

SEQ ID NO: 2326540 - protein, 5 aa, Cryptosporidium parvum
AVKPL

SEQ ID NO: 2326541 - protein, 8 aa, Cryptosporidium parvum
AVPESKKL

SEQ ID NO: 2326542 - protein, 7 aa, Cryptosporidium parvum
AVPTHGG

SEQ ID NO: 2326543 - protein, 8 aa, Cryptosporidium parvum
AVQQENKL

SEQ ID NO: 2326544 - protein, 6 aa, Cryptosporidium parvum
AVRRST

SEQ ID NO: 2326545 - protein, 11 aa, Cryptosporidium parvum
AVSKSNSEECK

SEQ ID NO: 2326546 - protein, 12 aa, Cryptosporidium parvum
AVTNPKVNSDQV

SEQ ID NO: 2326547 - protein, 5 aa, Cryptosporidium parvum
AYGRI

SEQ ID NO: 2326548 - protein, 13 aa, Cryptosporidium parvum
AYNQENGKEFPRI

SEQ ID NO: 2326549 - protein, 10 aa, Cryptosporidium parvum
AYSEKKRQLM

SEQ ID NO: 2326550 - protein, 6 aa, Cryptosporidium parvum
AYSNDP

SEQ ID NO: 2326551 - protein, 6 aa, Cryptosporidium parvum
CAGDDK

SEQ ID NO: 2326552 - protein, 8 aa, Cryptosporidium parvum
CANNPGTK

SEQ ID NO: 2326553 - protein, 10 aa, Cryptosporidium parvum
CAPPSNEAEY

SEQ ID NO: 2326554 - protein, 8 aa, Cryptosporidium parvum
CASVGSSE

SEQ ID NO: 2326555 - protein, 7 aa, Cryptosporidium parvum
CATTREK

SEQ ID NO: 2326556 - protein, 5 aa, Cryptosporidium parvum
CDDEN

SEQ ID NO: 2326557 - protein, 4 aa, Cryptosporidium parvum
CDDK

SEQ ID NO: 2326558 - protein, 10 aa, Cryptosporidium parvum
CDKHGTEEQT

SEQ ID NO: 2326559 - protein, 4 aa, Cryptosporidium parvum
CDKR

SEQ ID NO: 2326560 - protein, 10 aa, Cryptosporidium parvum
CDNPKGCNSQ

SEQ ID NO: 2326561 - protein, 24 aa, Cryptosporidium parvum
CDSTSTGCSAQTLTNPCSKSQPGI

SEQ ID NO: 2326562 - protein, 12 aa, Cryptosporidium parvum
CEGPEAKKDRKL

SEQ ID NO: 2326563 - protein, 9 aa, Cryptosporidium parvum
CEKEGNKGL

SEQ ID NO: 2326564 - protein, 18 aa, Cryptosporidium parvum
CEKSPNKFTYNPEYSNPQ

SEQ ID NO: 2326565 - protein, 6 aa, Cryptosporidium parvum
CESEDQ

SEQ ID NO: 2326566 - protein, 11 aa, Cryptosporidium parvum
CGEKGTNYTKD

SEQ ID NO: 2326567 - protein, 22 aa, Cryptosporidium parvum
CGGKGGSSSSPVRLASEAENNI

SEQ ID NO: 2326568 - protein, 6 aa, Cryptosporidium parvum
CGLESD

SEQ ID NO: 2326569 - protein, 8 aa, Cryptosporidium parvum
CGNKTPNC

SEQ ID NO: 2326570 - protein, 12 aa, Cryptosporidium parvum
CGSDGKTYDNTS

SEQ ID NO: 2326571 - protein, 9 aa, Cryptosporidium parvum
CGSDGKTYS

SEQ ID NO: 2326572 - protein, 9 aa, Cryptosporidium parvum
CGSNNEDVD

SEQ ID NO: 2326573 - protein, 14 aa, Cryptosporidium parvum
CHNPNIKKQKGNRC

SEQ ID NO: 2326574 - protein, 11 aa, Cryptosporidium parvum
CHSSNNSYPSH

SEQ ID NO: 2326575 - protein, 6 aa, Cryptosporidium parvum
CKEEKN

SEQ ID NO: 2326576 - protein, 20 aa, Cryptosporidium parvum
CKKKPSKKKGFTLPPPPARS

SEQ ID NO: 2326577 - protein, 7 aa, Cryptosporidium parvum
CKNGSSC

SEQ ID NO: 2326578 - protein, 11 aa, Cryptosporidium parvum
CKNTKKSLTEQ

SEQ ID NO: 2326579 - protein, 16 aa, Cryptosporidium parvum
CKRNRKTKYPSEKNLY

SEQ ID NO: 2326580 - protein, 13 aa, Cryptosporidium parvum
CKSNEIDHKKGNI

SEQ ID NO: 2326581 - protein, 6 aa, Cryptosporidium parvum
CKSQSL

SEQ ID NO: 2326582 - protein, 9 aa, Cryptosporidium parvum
CKSSDKGIV

SEQ ID NO: 2326583 - protein, 12 aa, Cryptosporidium parvum
CKTELSKAKKSF

SEQ ID NO: 2326584 - protein, 6 aa, Cryptosporidium parvum
CKTPDV

SEQ ID NO: 2326585 - protein, 11 aa, Cryptosporidium parvum
CKYEQNKTMTN

SEQ ID NO: 2326586 - protein, 4 aa, Cryptosporidium parvum
CNCG

SEQ ID NO: 2326587 - protein, 17 aa, Cryptosporidium parvum
CNDKNKKNKKKQKHLSK

SEQ ID NO: 2326588 - protein, 6 aa, Cryptosporidium parvum
CNETEN

SEQ ID NO: 2326589 - protein, 5 aa, Cryptosporidium parvum
CNGNE

SEQ ID NO: 2326590 - protein, 15 aa, Cryptosporidium parvum
CNNGPNKNGGDPIVS

SEQ ID NO: 2326591 - protein, 8 aa, Cryptosporidium parvum
CNQSSCQK

SEQ ID NO: 2326592 - protein, 6 aa, Cryptosporidium parvum
CNTNPC

SEQ ID NO: 2326593 - protein, 10 aa, Cryptosporidium parvum
CNVNRSDVDE

SEQ ID NO: 2326594 - protein, 6 aa, Cryptosporidium parvum
CNYPRK

SEQ ID NO: 2326595 - protein, 19 aa, Cryptosporidium parvum
CPEGFKSSPGATQCSKNVH

SEQ ID NO: 2326596 - protein, 9 aa, Cryptosporidium parvum
CPENNQKRS

SEQ ID NO: 2326597 - protein, 9 aa, Cryptosporidium parvum
CPGQESFPA

SEQ ID NO: 2326598 - protein, 22 aa, Cryptosporidium parvum
CPKADGDSIKREPKTGNVNNSS

SEQ ID NO: 2326599 - protein, 4 aa, Cryptosporidium parvum
CPNG

SEQ ID NO: 2326600 - protein, 12 aa, Cryptosporidium parvum
CPNPTPKPTNEF

SEQ ID NO: 2326601 - protein, 5 aa, Cryptosporidium parvum
CPPGI

SEQ ID NO: 2326602 - protein, 5 aa, Cryptosporidium parvum
CPPNK

SEQ ID NO: 2326603 - protein, 5 aa, Cryptosporidium parvum
CPQTK

SEQ ID NO: 2326604 - protein, 13 aa, Cryptosporidium parvum
CPSGGCEKIESTP

SEQ ID NO: 2326605 - protein, 11 aa, Cryptosporidium parvum
CPSGTTLNANG

SEQ ID NO: 2326606 - protein, 11 aa, Cryptosporidium parvum
CPSGYVTDQDG

SEQ ID NO: 2326607 - protein, 7 aa, Cryptosporidium parvum
CPSPSNT

SEQ ID NO: 2326608 - protein, 6 aa, Cryptosporidium parvum
CPTGVP

SEQ ID NO: 2326609 - protein, 7 aa, Cryptosporidium parvum
CQANPSS

SEQ ID NO: 2326610 - protein, 7 aa, Cryptosporidium parvum
CQDSKKS

SEQ ID NO: 2326611 - protein, 10 aa, Cryptosporidium parvum
CQESESSNEK

SEQ ID NO: 2326612 - protein, 8 aa, Cryptosporidium parvum
CQIPGGNY

SEQ ID NO: 2326613 - protein, 6 aa, Cryptosporidium parvum
CRDPSL

SEQ ID NO: 2326614 - protein, 11 aa, Cryptosporidium parvum
CRDSGKDIKSH

SEQ ID NO: 2326615 - protein, 6 aa, Cryptosporidium parvum
CRGING

SEQ ID NO: 2326616 - protein, 4 aa, Cryptosporidium parvum
CRNP

SEQ ID NO: 2326617 - protein, 4 aa, Cryptosporidium parvum
CSDD

SEQ ID NO: 2326618 - protein, 4 aa, Cryptosporidium parvum
CSEP

SEQ ID NO: 2326619 - protein, 11 aa, Cryptosporidium parvum
CSESSEDTESE

SEQ ID NO: 2326620 - protein, 5 aa, Cryptosporidium parvum
CSETA

SEQ ID NO: 2326621 - protein, 5 aa, Cryptosporidium parvum
CSGRT

SEQ ID NO: 2326622 - protein, 10 aa, Cryptosporidium parvum
CSIKDDKEME

SEQ ID NO: 2326623 - protein, 8 aa, Cryptosporidium parvum
CSKSDCQY

SEQ ID NO: 2326624 - protein, 9 aa, Cryptosporidium parvum
CSKSRYPVK

SEQ ID NO: 2326625 - protein, 5 aa, Cryptosporidium parvum
CSPPE

SEQ ID NO: 2326626 - protein, 8 aa, Cryptosporidium parvum
CSRPTGAE

SEQ ID NO: 2326627 - protein, 14 aa, Cryptosporidium parvum
CSRVKGNDGSSYSM

SEQ ID NO: 2326628 - protein, 5 aa, Cryptosporidium parvum
CSSEP

SEQ ID NO: 2326629 - protein, 34 aa, Cryptosporidium parvum
CSSKKEKKSKTKNKEKEVQNGETQRMDEQTPKTL

SEQ ID NO: 2326630 - protein, 5 aa, Cryptosporidium parvum
CSSQR

SEQ ID NO: 2326631 - protein, 8 aa, Cryptosporidium parvum
CSSTCGGG

SEQ ID NO: 2326632 - protein, 8 aa, Cryptosporidium parvum
CSTPAGSA

SEQ ID NO: 2326633 - protein, 6 aa, Cryptosporidium parvum
CSTSPV

SEQ ID NO: 2326634 - protein, 12 aa, Cryptosporidium parvum
CTKDTTSTTTST

SEQ ID NO: 2326635 - protein, 7 aa, Cryptosporidium parvum
CTKHSAS

SEQ ID NO: 2326636 - protein, 7 aa, Cryptosporidium parvum
CTLGPKD

SEQ ID NO: 2326637 - protein, 21 aa, Cryptosporidium parvum
CTQNSMSKRSRPLISTPPDMN

SEQ ID NO: 2326638 - protein, 18 aa, Cryptosporidium parvum
CTQTTQAPPQPECPPGTN

SEQ ID NO: 2326639 - protein, 8 aa, Cryptosporidium parvum
CTSSPSVS

SEQ ID NO: 2326640 - protein, 16 aa, Cryptosporidium parvum
CTSSSLDTKSEDLKEV

SEQ ID NO: 2326641 - protein, 41 aa, Cryptosporidium parvum
CVENSNRSRRASESSISSTDFSSSDSEFDEYDSSFSSDEAN

SEQ ID NO: 2326642 - protein, 21 aa, Cryptosporidium parvum
CVKTESAPRLTECPPGTTLEN

SEQ ID NO: 2326643 - protein, 4 aa, Cryptosporidium parvum
DACE

SEQ ID NO: 2326644 - protein, 12 aa, Cryptosporidium parvum
DAEKYRKSIDDN

SEQ ID NO: 2326645 - protein, 5 aa, Cryptosporidium parvum
DAETY

SEQ ID NO: 2326646 - protein, 7 aa, Cryptosporidium parvum
DAEYKGA

SEQ ID NO: 2326647 - protein, 5 aa, Cryptosporidium parvum
DAPFG

SEQ ID NO: 2326648 - protein, 17 aa, Cryptosporidium parvum
DAPGSFSIQTSGAQAFT

SEQ ID NO: 2326649 - protein, 8 aa, Cryptosporidium parvum
DAPHSQKR

SEQ ID NO: 2326650 - protein, 4 aa, Cryptosporidium parvum
DAPL

SEQ ID NO: 2326651 - protein, 8 aa, Cryptosporidium parvum
DAQKACDE

SEQ ID NO: 2326652 - protein, 26 aa, Cryptosporidium parvum
DASEAEARRREASDKAKLAAEKATEH

SEQ ID NO: 2326653 - protein, 11 aa, Cryptosporidium parvum
DASEKRAHAAN

SEQ ID NO: 2326654 - protein, 6 aa, Cryptosporidium parvum
DATENM

SEQ ID NO: 2326655 - protein, 5 aa, Cryptosporidium parvum
DAVAG

SEQ ID NO: 2326656 - protein, 10 aa, Cryptosporidium parvum
DAWSPNENDN

SEQ ID NO: 2326657 - protein, 14 aa, Cryptosporidium parvum
DCEKLSGGKQCETN

SEQ ID NO: 2326658 - protein, 5 aa, Cryptosporidium parvum
DCHSE

SEQ ID NO: 2326659 - protein, 7 aa, Cryptosporidium parvum
DCKTCSG

SEQ ID NO: 2326660 - protein, 11 aa, Cryptosporidium parvum
DCTDDNSLSCS

SEQ ID NO: 2326661 - protein, 7 aa, Cryptosporidium parvum
DDAQNEL

SEQ ID NO: 2326662 - protein, 7 aa, Cryptosporidium parvum
DDARTTI

SEQ ID NO: 2326663 - protein, 22 aa, Cryptosporidium parvum
DDCGDGSRPPQKPHLPVGFRLR

SEQ ID NO: 2326664 - protein, 9 aa, Cryptosporidium parvum
DDCGNDGGD

SEQ ID NO: 2326665 - protein, 14 aa, Cryptosporidium parvum
DDDDDNDDDDDNIY

SEQ ID NO: 2326666 - protein, 14 aa, Cryptosporidium parvum
DDDGYHDGTGCGDA

SEQ ID NO: 2326667 - protein, 8 aa, Cryptosporidium parvum
DDDRNPSL

SEQ ID NO: 2326668 - protein, 8 aa, Cryptosporidium parvum
DDEDDDDL

SEQ ID NO: 2326669 - protein, 7 aa, Cryptosporidium parvum
DDEDPRD

SEQ ID NO: 2326670 - protein, 8 aa, Cryptosporidium parvum
DDEELTKH

SEQ ID NO: 2326671 - protein, 9 aa, Cryptosporidium parvum
DDETSNKKI

SEQ ID NO: 2326672 - protein, 9 aa, Cryptosporidium parvum
DDEVNESIS

SEQ ID NO: 2326673 - protein, 8 aa, Cryptosporidium parvum
DDGKGVAP

SEQ ID NO: 2326674 - protein, 7 aa, Cryptosporidium parvum
DDGNKIA

SEQ ID NO: 2326675 - protein, 13 aa, Cryptosporidium parvum
DDHSQSRKNSYSY

SEQ ID NO: 2326676 - protein, 9 aa, Cryptosporidium parvum
DDINDPAPV

SEQ ID NO: 2326677 - protein, 7 aa, Cryptosporidium parvum
DDIPPNT

SEQ ID NO: 2326678 - protein, 9 aa, Cryptosporidium parvum
DDKDENSSF

SEQ ID NO: 2326679 - protein, 8 aa, Cryptosporidium parvum
DDLPESSE

SEQ ID NO: 2326680 - protein, 10 aa, Cryptosporidium parvum
DDLPKPSYFE

SEQ ID NO: 2326681 - protein, 14 aa, Cryptosporidium parvum
DDNEGDTRLTGKDR

SEQ ID NO: 2326682 - protein, 13 aa, Cryptosporidium parvum
DDNNDDSNYSSNY

SEQ ID NO: 2326683 - protein, 8 aa, Cryptosporidium parvum
DDNNEQIR

SEQ ID NO: 2326684 - protein, 17 aa, Cryptosporidium parvum
DDNNSNSNEEVNNKEKF

SEQ ID NO: 2326685 - protein, 18 aa, Cryptosporidium parvum
DDNSDKQDDFNKNDGNKH

SEQ ID NO: 2326686 - protein, 7 aa, Cryptosporidium parvum
DDPLNPE

SEQ ID NO: 2326687 - protein, 5 aa, Cryptosporidium parvum
DDRCN

SEQ ID NO: 2326688 - protein, 4 aa, Cryptosporidium parvum
DDRT

SEQ ID NO: 2326689 - protein, 4 aa, Cryptosporidium parvum
DDSE

SEQ ID NO: 2326690 - protein, 30 aa, Cryptosporidium parvum
DDSESSDSSCSSSDCSKSSDSEGEDSKSSC

SEQ ID NO: 2326691 - protein, 9 aa, Cryptosporidium parvum
DDSFTQKDL

SEQ ID NO: 2326692 - protein, 4 aa, Cryptosporidium parvum
DDSG

SEQ ID NO: 2326693 - protein, 7 aa, Cryptosporidium parvum
DDSPNNQ

SEQ ID NO: 2326694 - protein, 5 aa, Cryptosporidium parvum
DDSST

SEQ ID NO: 2326695 - protein, 8 aa, Cryptosporidium parvum
DDSTATGQ

SEQ ID NO: 2326696 - protein, 8 aa, Cryptosporidium parvum
DDSVQKDK

SEQ ID NO: 2326697 - protein, 5 aa, Cryptosporidium parvum
DDSVS

SEQ ID NO: 2326698 - protein, 4 aa, Cryptosporidium parvum
DDTL

SEQ ID NO: 2326699 - protein, 4 aa, Cryptosporidium parvum
DDTP

SEQ ID NO: 2326700 - protein, 12 aa, Cryptosporidium parvum
DDTSPTNQFSTP

SEQ ID NO: 2326701 - protein, 7 aa, Cryptosporidium parvum
DDWENNL

SEQ ID NO: 2326702 - protein, 13 aa, Cryptosporidium parvum
DEAAGTGSTSAVG

SEQ ID NO: 2326703 - protein, 19 aa, Cryptosporidium parvum
DEARGDVNYSSRDKAATEN

SEQ ID NO: 2326704 - protein, 10 aa, Cryptosporidium parvum
DEDCNNENCD

SEQ ID NO: 2326705 - protein, 7 aa, Cryptosporidium parvum
DEDQFEP

SEQ ID NO: 2326706 - protein, 5 aa, Cryptosporidium parvum
DEDYE

SEQ ID NO: 2326707 - protein, 9 aa, Cryptosporidium parvum
DEEEEDSEI

SEQ ID NO: 2326708 - protein, 6 aa, Cryptosporidium parvum
DEEPVS

SEQ ID NO: 2326709 - protein, 5 aa, Cryptosporidium parvum
DEEVK

SEQ ID NO: 2326710 - protein, 5 aa, Cryptosporidium parvum
DEFGQ

SEQ ID NO: 2326711 - protein, 8 aa, Cryptosporidium parvum
DEFPTQEQ

SEQ ID NO: 2326712 - protein, 4 aa, Cryptosporidium parvum
DEFQ

SEQ ID NO: 2326713 - protein, 11 aa, Cryptosporidium parvum
DEFSRKHKRNQ

SEQ ID NO: 2326714 - protein, 53 aa, Cryptosporidium parvum
DEGKSSEGVALSDGSSLDIGSGSSGVGVYGPSVSSKYHKSSREAARKAVAPRE

SEQ ID NO: 2326715 - protein, 43 aa, Cryptosporidium parvum
DEGRGPRNIKEPFSTNAVSSSKAPYKRNPMQKTAFDNYTTRNE

SEQ ID NO: 2326716 - protein, 4 aa, Cryptosporidium parvum
DEIG

SEQ ID NO: 2326717 - protein, 4 aa, Cryptosporidium parvum
DEIK

SEQ ID NO: 2326718 - protein, 24 aa, Cryptosporidium parvum
DEIRKPSPLDEQPLPSCEGVKSSK

SEQ ID NO: 2326719 - protein, 4 aa, Cryptosporidium parvum
DEIY

SEQ ID NO: 2326720 - protein, 9 aa, Cryptosporidium parvum
DEKGNPIDQ

SEQ ID NO: 2326721 - protein, 5 aa, Cryptosporidium parvum
DEKQE

SEQ ID NO: 2326722 - protein, 7 aa, Cryptosporidium parvum
DEKYQNN

SEQ ID NO: 2326723 - protein, 8 aa, Cryptosporidium parvum
DENENACK

SEQ ID NO: 2326724 - protein, 7 aa, Cryptosporidium parvum
DENENDE

SEQ ID NO: 2326725 - protein, 9 aa, Cryptosporidium parvum
DENKQIEKE

SEQ ID NO: 2326726 - protein, 5 aa, Cryptosporidium parvum
DENNN

SEQ ID NO: 2326727 - protein, 8 aa, Cryptosporidium parvum
DENSEKCE

SEQ ID NO: 2326728 - protein, 8 aa, Cryptosporidium parvum
DENTESKF

SEQ ID NO: 2326729 - protein, 4 aa, Cryptosporidium parvum
DENY

SEQ ID NO: 2326730 - protein, 32 aa, Cryptosporidium parvum
DEQGKTSKVTDSKPISADSTPKIDKDKSYIDD

SEQ ID NO: 2326731 - protein, 8 aa, Cryptosporidium parvum
DEQSKTQK

SEQ ID NO: 2326732 - protein, 6 aa, Cryptosporidium parvum
DEQTDL

SEQ ID NO: 2326733 - protein, 7 aa, Cryptosporidium parvum
DERTDNE

SEQ ID NO: 2326734 - protein, 8 aa, Cryptosporidium parvum
DESAQSDF

SEQ ID NO: 2326735 - protein, 94 aa, Cryptosporidium parvum
DESEEKTNDENKNTKSEEDIDKASSNDTTTTTSTTTSTSTASISDKDAKSTTKDELGKESDNKEEEKGIKVKDTDQEEKKNNETNNEKDSLESL

SEQ ID NO: 2326736 - protein, 19 aa, Cryptosporidium parvum
DESFQERDISQEDDDSIPY

SEQ ID NO: 2326737 - protein, 8 aa, Cryptosporidium parvum
DESKEDLP

SEQ ID NO: 2326738 - protein, 5 aa, Cryptosporidium parvum
DESKL

SEQ ID NO: 2326739 - protein, 8 aa, Cryptosporidium parvum
DESNPKNP

SEQ ID NO: 2326740 - protein, 8 aa, Cryptosporidium parvum
DESSGHTT

SEQ ID NO: 2326741 - protein, 7 aa, Cryptosporidium parvum
DESVFPA

SEQ ID NO: 2326742 - protein, 15 aa, Cryptosporidium parvum
DESYPKQGETSSAES

SEQ ID NO: 2326743 - protein, 7 aa, Cryptosporidium parvum
DETNSNE

SEQ ID NO: 2326744 - protein, 30 aa, Cryptosporidium parvum
DEVPKPPKVGTDDAEDDKTNVKELSPTVGE

SEQ ID NO: 2326745 - protein, 11 aa, Cryptosporidium parvum
DEVSTVASENE

SEQ ID NO: 2326746 - protein, 5 aa, Cryptosporidium parvum
DEYEK

SEQ ID NO: 2326747 - protein, 17 aa, Cryptosporidium parvum
DEYKAPPSITNKISEGH

SEQ ID NO: 2326748 - protein, 15 aa, Cryptosporidium parvum
DFDKSSLSKTKLNPT

SEQ ID NO: 2326749 - protein, 10 aa, Cryptosporidium parvum
DFDSSDNKVT

SEQ ID NO: 2326750 - protein, 5 aa, Cryptosporidium parvum
DFETE

SEQ ID NO: 2326751 - protein, 19 aa, Cryptosporidium parvum
DFPNGGFESSNPTEGNNGF

SEQ ID NO: 2326752 - protein, 4 aa, Cryptosporidium parvum
DFPV

SEQ ID NO: 2326753 - protein, 4 aa, Cryptosporidium parvum
DFRG

SEQ ID NO: 2326754 - protein, 7 aa, Cryptosporidium parvum
DFSGSSP

SEQ ID NO: 2326755 - protein, 4 aa, Cryptosporidium parvum
DFSQ

SEQ ID NO: 2326756 - protein, 8 aa, Cryptosporidium parvum
DFSTPKVD

SEQ ID NO: 2326757 - protein, 7 aa, Cryptosporidium parvum
DFTNSEN

SEQ ID NO: 2326758 - protein, 4 aa, Cryptosporidium parvum
DGAL

SEQ ID NO: 2326759 - protein, 10 aa, Cryptosporidium parvum
DGARSKACQS

SEQ ID NO: 2326760 - protein, 4 aa, Cryptosporidium parvum
DGDH

SEQ ID NO: 2326761 - protein, 6 aa, Cryptosporidium parvum
DGDSDI

SEQ ID NO: 2326762 - protein, 17 aa, Cryptosporidium parvum
DGDSYSNFPTSHKDQTT

SEQ ID NO: 2326763 - protein, 6 aa, Cryptosporidium parvum
DGEGFN

SEQ ID NO: 2326764 - protein, 14 aa, Cryptosporidium parvum
DGESSSEPKSESMK

SEQ ID NO: 2326765 - protein, 10 aa, Cryptosporidium parvum
DGFQDKAKET

SEQ ID NO: 2326766 - protein, 7 aa, Cryptosporidium parvum
DGFSSEN

SEQ ID NO: 2326767 - protein, 11 aa, Cryptosporidium parvum
DGGISTDSSLD

SEQ ID NO: 2326768 - protein, 7 aa, Cryptosporidium parvum
DGGSKFK

SEQ ID NO: 2326769 - protein, 4 aa, Cryptosporidium parvum
DGIT

SEQ ID NO: 2326770 - protein, 5 aa, Cryptosporidium parvum
DGITG

SEQ ID NO: 2326771 - protein, 8 aa, Cryptosporidium parvum
DGKMTDRT

SEQ ID NO: 2326772 - protein, 4 aa, Cryptosporidium parvum
DGKS

SEQ ID NO: 2326773 - protein, 25 aa, Cryptosporidium parvum
DGNDNGNESSIRYASENENNSDFEE

SEQ ID NO: 2326774 - protein, 5 aa, Cryptosporidium parvum
DGNIP

SEQ ID NO: 2326775 - protein, 9 aa, Cryptosporidium parvum
DGNSGAGVE

SEQ ID NO: 2326776 - protein, 6 aa, Cryptosporidium parvum
DGNSIK

SEQ ID NO: 2326777 - protein, 5 aa, Cryptosporidium parvum
DGQCE

SEQ ID NO: 2326778 - protein, 14 aa, Cryptosporidium parvum
DGSENYKDHPGTEY

SEQ ID NO: 2326779 - protein, 14 aa, Cryptosporidium parvum
DGSEYESDPAAKAA

SEQ ID NO: 2326780 - protein, 8 aa, Cryptosporidium parvum
DGSKKINV

SEQ ID NO: 2326781 - protein, 5 aa, Cryptosporidium parvum
DGSTC

SEQ ID NO: 2326782 - protein, 15 aa, Cryptosporidium parvum
DGSVEKQPISRNLPG

SEQ ID NO: 2326783 - protein, 4 aa, Cryptosporidium parvum
DGSY

SEQ ID NO: 2326784 - protein, 5 aa, Cryptosporidium parvum
DGTDD

SEQ ID NO: 2326785 - protein, 5 aa, Cryptosporidium parvum
DGTSL

SEQ ID NO: 2326786 - protein, 17 aa, Cryptosporidium parvum
DGTTVVTSGRGSKKLGD

SEQ ID NO: 2326787 - protein, 7 aa, Cryptosporidium parvum
DGVTYGN

SEQ ID NO: 2326788 - protein, 6 aa, Cryptosporidium parvum
DGVTYR

SEQ ID NO: 2326789 - protein, 22 aa, Cryptosporidium parvum
DGYNPTEAIKQKESLNSKTTIV

SEQ ID NO: 2326790 - protein, 20 aa, Cryptosporidium parvum
DHEEEKDEENKNEDSGIQEL

SEQ ID NO: 2326791 - protein, 12 aa, Cryptosporidium parvum
DHETFKDSNAKS

SEQ ID NO: 2326792 - protein, 5 aa, Cryptosporidium parvum
DHPGL

SEQ ID NO: 2326793 - protein, 9 aa, Cryptosporidium parvum
DHPNRGDSA

SEQ ID NO: 2326794 - protein, 6 aa, Cryptosporidium parvum
DHSGED

SEQ ID NO: 2326795 - protein, 14 aa, Cryptosporidium parvum
DICKSRENSEKSWQ

SEQ ID NO: 2326796 - protein, 6 aa, Cryptosporidium parvum
DIDNID

SEQ ID NO: 2326797 - protein, 11 aa, Cryptosporidium parvum
DIEDNKKIDET

SEQ ID NO: 2326798 - protein, 23 aa, Cryptosporidium parvum
DIEEARAASQGKTAEMRSQYKKT

SEQ ID NO: 2326799 - protein, 6 aa, Cryptosporidium parvum
DIETYD

SEQ ID NO: 2326800 - protein, 6 aa, Cryptosporidium parvum
DIGNER

SEQ ID NO: 2326801 - protein, 8 aa, Cryptosporidium parvum
DIKSGNPR

SEQ ID NO: 2326802 - protein, 11 aa, Cryptosporidium parvum
DINDSDDSYLG

SEQ ID NO: 2326803 - protein, 9 aa, Cryptosporidium parvum
DINEDNSFR

SEQ ID NO: 2326804 - protein, 6 aa, Cryptosporidium parvum
DINNIQ

SEQ ID NO: 2326805 - protein, 14 aa, Cryptosporidium parvum
DINNNNNNNGKSSW

SEQ ID NO: 2326806 - protein, 6 aa, Cryptosporidium parvum
DIRQEL

SEQ ID NO: 2326807 - protein, 6 aa, Cryptosporidium parvum
DISENS

SEQ ID NO: 2326808 - protein, 24 aa, Cryptosporidium parvum
DISNDEVPAQDDSNKTPSTETNKD

SEQ ID NO: 2326809 - protein, 6 aa, Cryptosporidium parvum
DISNSN

SEQ ID NO: 2326810 - protein, 10 aa, Cryptosporidium parvum
DISRTTESYL

SEQ ID NO: 2326811 - protein, 4 aa, Cryptosporidium parvum
DISS

SEQ ID NO: 2326812 - protein, 5 aa, Cryptosporidium parvum
DITGG

SEQ ID NO: 2326813 - protein, 7 aa, Cryptosporidium parvum
DITNGSN

SEQ ID NO: 2326814 - protein, 6 aa, Cryptosporidium parvum
DIYSKG

SEQ ID NO: 2326815 - protein, 4 aa, Cryptosporidium parvum
DKCD

SEQ ID NO: 2326816 - protein, 13 aa, Cryptosporidium parvum
DKDEEGVDCGGPC

SEQ ID NO: 2326817 - protein, 11 aa, Cryptosporidium parvum
DKDGTSKTSRA

SEQ ID NO: 2326818 - protein, 12 aa, Cryptosporidium parvum
DKDKDPKTRDNL

SEQ ID NO: 2326819 - protein, 24 aa, Cryptosporidium parvum
DKDKLAQKLEEEDKEKIKEALKDA

SEQ ID NO: 2326820 - protein, 9 aa, Cryptosporidium parvum
DKDQRENDK

SEQ ID NO: 2326821 - protein, 8 aa, Cryptosporidium parvum
DKDTGNEE

SEQ ID NO: 2326822 - protein, 6 aa, Cryptosporidium parvum
DKEELR

SEQ ID NO: 2326823 - protein, 6 aa, Cryptosporidium parvum
DKEESK

SEQ ID NO: 2326824 - protein, 8 aa, Cryptosporidium parvum
DKENGVKN

SEQ ID NO: 2326825 - protein, 7 aa, Cryptosporidium parvum
DKENSEF

SEQ ID NO: 2326826 - protein, 23 aa, Cryptosporidium parvum
DKESEQSKKEQHRENEDLNEDEF

SEQ ID NO: 2326827 - protein, 8 aa, Cryptosporidium parvum
DKETSDNI

SEQ ID NO: 2326828 - protein, 19 aa, Cryptosporidium parvum
DKEYVDGTQKVAESGKPTM

SEQ ID NO: 2326829 - protein, 15 aa, Cryptosporidium parvum
DKGDCNSKKNDSSLD

SEQ ID NO: 2326830 - protein, 5 aa, Cryptosporidium parvum
DKGIG

SEQ ID NO: 2326831 - protein, 95 aa, Cryptosporidium parvum
DKGQEAGKSESTNRTQSDKDEEVESSVGSNLSETDEESSRYEHSKSEESGSSGTDGYYETEDSTDNSQNTDDLQDQSTSESQDDSSEQSGSSGEY

SEQ ID NO: 2326832 - protein, 8 aa, Cryptosporidium parvum
DKHCKGKK

SEQ ID NO: 2326833 - protein, 9 aa, Cryptosporidium parvum
DKIEHQEKK

SEQ ID NO: 2326834 - protein, 7 aa, Cryptosporidium parvum
DKIHGLD

SEQ ID NO: 2326835 - protein, 47 aa, Cryptosporidium parvum
DKKAKKEKKPKKEKKQKETKAEKEARKQREKEEKLREKQQKEEEKKL

SEQ ID NO: 2326836 - protein, 7 aa, Cryptosporidium parvum
DKKASNY

SEQ ID NO: 2326837 - protein, 65 aa, Cryptosporidium parvum
DKKEKKREREEKKRLEAEKKKQLKNEKKNKNKNKSKNEGSGEKSIESPKEKKSSCFSKKKKQNYV

SEQ ID NO: 2326838 - protein, 20 aa, Cryptosporidium parvum
DKKGSSPSPSNKQQRRMRRK

SEQ ID NO: 2326839 - protein, 9 aa, Cryptosporidium parvum
DKKKGEAVL

SEQ ID NO: 2326840 - protein, 18 aa, Cryptosporidium parvum
DKKNQNEKIKRKDQLKNQ

SEQ ID NO: 2326841 - protein, 13 aa, Cryptosporidium parvum
DKKTLKSLTPMST

SEQ ID NO: 2326842 - protein, 4 aa, Cryptosporidium parvum
DKKY

SEQ ID NO: 2326843 - protein, 6 aa, Cryptosporidium parvum
DKLDGS

SEQ ID NO: 2326844 - protein, 12 aa, Cryptosporidium parvum
DKLGGLNKENQI

SEQ ID NO: 2326845 - protein, 9 aa, Cryptosporidium parvum
DKNDDTGIF

SEQ ID NO: 2326846 - protein, 7 aa, Cryptosporidium parvum
DKNDQPV

SEQ ID NO: 2326847 - protein, 7 aa, Cryptosporidium parvum
DKNEFST

SEQ ID NO: 2326848 - protein, 7 aa, Cryptosporidium parvum
DKNGNEV

SEQ ID NO: 2326849 - protein, 5 aa, Cryptosporidium parvum
DKNGS

SEQ ID NO: 2326850 - protein, 15 aa, Cryptosporidium parvum
DKNKPSSLEPLSEDD

SEQ ID NO: 2326851 - protein, 5 aa, Cryptosporidium parvum
DKNVE

SEQ ID NO: 2326852 - protein, 7 aa, Cryptosporidium parvum
DKPANAR

SEQ ID NO: 2326853 - protein, 9 aa, Cryptosporidium parvum
DKPDPEVPP

SEQ ID NO: 2326854 - protein, 5 aa, Cryptosporidium parvum
DKPFN

SEQ ID NO: 2326855 - protein, 12 aa, Cryptosporidium parvum
DKPQAKSQPNTF

SEQ ID NO: 2326856 - protein, 14 aa, Cryptosporidium parvum
DKPQWQRTQAPREE

SEQ ID NO: 2326857 - protein, 6 aa, Cryptosporidium parvum
DKQDQI

SEQ ID NO: 2326858 - protein, 8 aa, Cryptosporidium parvum
DKQKEVAD

SEQ ID NO: 2326859 - protein, 7 aa, Cryptosporidium parvum
DKQKKGI

SEQ ID NO: 2326860 - protein, 9 aa, Cryptosporidium parvum
DKQNGDEKA

SEQ ID NO: 2326861 - protein, 8 aa, Cryptosporidium parvum
DKQTSTDD

SEQ ID NO: 2326862 - protein, 8 aa, Cryptosporidium parvum
DKRGSSIF

SEQ ID NO: 2326863 - protein, 5 aa, Cryptosporidium parvum
DKRQR

SEQ ID NO: 2326864 - protein, 9 aa, Cryptosporidium parvum
DKSASNKIT

SEQ ID NO: 2326865 - protein, 7 aa, Cryptosporidium parvum
DKSFETQ

SEQ ID NO: 2326866 - protein, 21 aa, Cryptosporidium parvum
DKSLEELKDSLGGSTVDNTGV

SEQ ID NO: 2326867 - protein, 6 aa, Cryptosporidium parvum
DKSNQF

SEQ ID NO: 2326868 - protein, 6 aa, Cryptosporidium parvum
DKSSRK

SEQ ID NO: 2326869 - protein, 30 aa, Cryptosporidium parvum
DKSVGGFDEQGKNNDFPEIEENQKDFSSVG

SEQ ID NO: 2326870 - protein, 29 aa, Cryptosporidium parvum
DKSVSNKETKDVSINKSETISQVGKSEEI

SEQ ID NO: 2326871 - protein, 28 aa, Cryptosporidium parvum
DKTPENKESNQEANQKPKTSKSKSEKKK

SEQ ID NO: 2326872 - protein, 7 aa, Cryptosporidium parvum
DKVQGSY

SEQ ID NO: 2326873 - protein, 23 aa, Cryptosporidium parvum
DKYKESPYSETSMSSRRGKRSQN

SEQ ID NO: 2326874 - protein, 6 aa, Cryptosporidium parvum
DKYKKK

SEQ ID NO: 2326875 - protein, 13 aa, Cryptosporidium parvum
DKYLSSSNGLEGL

SEQ ID NO: 2326876 - protein, 22 aa, Cryptosporidium parvum
DLDKDLEDNDQGVYRPNKSYSG

SEQ ID NO: 2326877 - protein, 14 aa, Cryptosporidium parvum
DLDRNAGTNSQGTI

SEQ ID NO: 2326878 - protein, 26 aa, Cryptosporidium parvum
DLDTEPSESMEESGGDGVASLDSAGR

SEQ ID NO: 2326879 - protein, 21 aa, Cryptosporidium parvum
DLDTTTEDGIYSKSSRTVEKI

SEQ ID NO: 2326880 - protein, 17 aa, Cryptosporidium parvum
DLEAEAGNEFGGSRADQ

SEQ ID NO: 2326881 - protein, 15 aa, Cryptosporidium parvum
DLEGIQDKKRGSDAP

SEQ ID NO: 2326882 - protein, 10 aa, Cryptosporidium parvum
DLEKEKYKSR

SEQ ID NO: 2326883 - protein, 7 aa, Cryptosporidium parvum
DLKGSKY

SEQ ID NO: 2326884 - protein, 5 aa, Cryptosporidium parvum
DLKSG

SEQ ID NO: 2326885 - protein, 4 aa, Cryptosporidium parvum
DLND

SEQ ID NO: 2326886 - protein, 6 aa, Cryptosporidium parvum
DLNDPG

SEQ ID NO: 2326887 - protein, 26 aa, Cryptosporidium parvum
DLNEPKKLGGEPSLPSPEQSKLEEKL

SEQ ID NO: 2326888 - protein, 6 aa, Cryptosporidium parvum
DLNSKL

SEQ ID NO: 2326889 - protein, 20 aa, Cryptosporidium parvum
DLPKNERKNKTMSPQQSGFD

SEQ ID NO: 2326890 - protein, 4 aa, Cryptosporidium parvum
DLPP

SEQ ID NO: 2326891 - protein, 6 aa, Cryptosporidium parvum
DLPSES

SEQ ID NO: 2326892 - protein, 9 aa, Cryptosporidium parvum
DLQGDPNTF

SEQ ID NO: 2326893 - protein, 6 aa, Cryptosporidium parvum
DLRKNP

SEQ ID NO: 2326894 - protein, 19 aa, Cryptosporidium parvum
DLSEQSKDNSAESSSSPLF

SEQ ID NO: 2326895 - protein, 5 aa, Cryptosporidium parvum
DLSKD

SEQ ID NO: 2326896 - protein, 5 aa, Cryptosporidium parvum
DLSTE

SEQ ID NO: 2326897 - protein, 5 aa, Cryptosporidium parvum
DLTDE

SEQ ID NO: 2326898 - protein, 5 aa, Cryptosporidium parvum
DLTRK

SEQ ID NO: 2326899 - protein, 11 aa, Cryptosporidium parvum
DLYNDESDTSL

SEQ ID NO: 2326900 - protein, 12 aa, Cryptosporidium parvum
DMDTSGYEPLDA

SEQ ID NO: 2326901 - protein, 8 aa, Cryptosporidium parvum
DMNGPPDR

SEQ ID NO: 2326902 - protein, 7 aa, Cryptosporidium parvum
DMQRTTV

SEQ ID NO: 2326903 - protein, 7 aa, Cryptosporidium parvum
DMSRSPY

SEQ ID NO: 2326904 - protein, 10 aa, Cryptosporidium parvum
DNASISSAST

SEQ ID NO: 2326905 - protein, 5 aa, Cryptosporidium parvum
DNAYG

SEQ ID NO: 2326906 - protein, 13 aa, Cryptosporidium parvum
DNDQDGLVDATQN

SEQ ID NO: 2326907 - protein, 8 aa, Cryptosporidium parvum
DNDVTQRK

SEQ ID NO: 2326908 - protein, 5 aa, Cryptosporidium parvum
DNEAP

SEQ ID NO: 2326909 - protein, 23 aa, Cryptosporidium parvum
DNEEHYSKRQNSQGRGFDEEDMN

SEQ ID NO: 2326910 - protein, 23 aa, Cryptosporidium parvum
DNENIDNQNEYEDIDNSEEISQG

SEQ ID NO: 2326911 - protein, 7 aa, Cryptosporidium parvum
DNETRDS

SEQ ID NO: 2326912 - protein, 4 aa, Cryptosporidium parvum
DNFA

SEQ ID NO: 2326913 - protein, 5 aa, Cryptosporidium parvum
DNFGE

SEQ ID NO: 2326914 - protein, 9 aa, Cryptosporidium parvum
DNGGSTNNK

SEQ ID NO: 2326915 - protein, 4 aa, Cryptosporidium parvum
DNGS

SEQ ID NO: 2326916 - protein, 28 aa, Cryptosporidium parvum
DNIKSVKAKEQEDSKKKSSKQKKESRYP

SEQ ID NO: 2326917 - protein, 5 aa, Cryptosporidium parvum
DNISK

SEQ ID NO: 2326918 - protein, 33 aa, Cryptosporidium parvum
DNKEDSVEDQENTESQKEEEKKDNGDGEQQDSI

SEQ ID NO: 2326919 - protein, 4 aa, Cryptosporidium parvum
DNKF

SEQ ID NO: 2326920 - protein, 6 aa, Cryptosporidium parvum
DNKNNP

SEQ ID NO: 2326921 - protein, 4 aa, Cryptosporidium parvum
DNKT

SEQ ID NO: 2326922 - protein, 7 aa, Cryptosporidium parvum
DNKTQEL

SEQ ID NO: 2326923 - protein, 25 aa, Cryptosporidium parvum
DNKVSDSNNVVSEKEEEKNDNPNFN

SEQ ID NO: 2326924 - protein, 19 aa, Cryptosporidium parvum
DNLSKSGYKNSNLKSTTDF

SEQ ID NO: 2326925 - protein, 7 aa, Cryptosporidium parvum
DNLSTQE

SEQ ID NO: 2326926 - protein, 6 aa, Cryptosporidium parvum
DNNENI

SEQ ID NO: 2326927 - protein, 25 aa, Cryptosporidium parvum
DNNGNGKEDQTEGVTSGENDENSNK

SEQ ID NO: 2326928 - protein, 57 aa, Cryptosporidium parvum
DNNNDGVSNVSSSHKNQIHSTDSKNSSSPSGFKSDYNNRRRSISGGGKQTTENNDLG

SEQ ID NO: 2326929 - protein, 5 aa, Cryptosporidium parvum
DNNQD

SEQ ID NO: 2326930 - protein, 18 aa, Cryptosporidium parvum
DNNSGDLLSNKNEDSESG

SEQ ID NO: 2326931 - protein, 6 aa, Cryptosporidium parvum
DNNSNC

SEQ ID NO: 2326932 - protein, 16 aa, Cryptosporidium parvum
DNNSNSNNKLLTSQKD

SEQ ID NO: 2326933 - protein, 31 aa, Cryptosporidium parvum
DNNSSMSSESSEASSNSSSVPSSEQNRDQSE

SEQ ID NO: 2326934 - protein, 9 aa, Cryptosporidium parvum
DNPDPSNYK

SEQ ID NO: 2326935 - protein, 7 aa, Cryptosporidium parvum
DNPPREK

SEQ ID NO: 2326936 - protein, 16 aa, Cryptosporidium parvum
DNPTQKYTTDKSIPPT

SEQ ID NO: 2326937 - protein, 6 aa, Cryptosporidium parvum
DNPYEE

SEQ ID NO: 2326938 - protein, 27 aa, Cryptosporidium parvum
DNQSDTNNESKVSHDGITPCGNETPNC

SEQ ID NO: 2326939 - protein, 34 aa, Cryptosporidium parvum
DNQSDTNNESKVSHDGITPCGNKTPNCVGGYYIN

SEQ ID NO: 2326940 - protein, 5 aa, Cryptosporidium parvum
DNSEI

SEQ ID NO: 2326941 - protein, 7 aa, Cryptosporidium parvum
DNSEKSL

SEQ ID NO: 2326942 - protein, 11 aa, Cryptosporidium parvum
DNSGIGSKENL

SEQ ID NO: 2326943 - protein, 6 aa, Cryptosporidium parvum
DNSGTI

SEQ ID NO: 2326944 - protein, 9 aa, Cryptosporidium parvum
DNSKAREEK

SEQ ID NO: 2326945 - protein, 5 aa, Cryptosporidium parvum
DNSNS

SEQ ID NO: 2326946 - protein, 8 aa, Cryptosporidium parvum
DNSQSGEI

SEQ ID NO: 2326947 - protein, 5 aa, Cryptosporidium parvum
DNSSI

SEQ ID NO: 2326948 - protein, 21 aa, Cryptosporidium parvum
DNTEEKKSSCCGKKKSKFKEL

SEQ ID NO: 2326949 - protein, 4 aa, Cryptosporidium parvum
DNTK

SEQ ID NO: 2326950 - protein, 27 aa, Cryptosporidium parvum
DNTSNNDSTSNAQNESSEFTESTETTN

SEQ ID NO: 2326951 - protein, 5 aa, Cryptosporidium parvum
DNTSR

SEQ ID NO: 2326952 - protein, 9 aa, Cryptosporidium parvum
DNTWTENSQ

SEQ ID NO: 2326953 - protein, 8 aa, Cryptosporidium parvum
DNVSSSKI

SEQ ID NO: 2326954 - protein, 8 aa, Cryptosporidium parvum
DPASTSFT

SEQ ID NO: 2326955 - protein, 5 aa, Cryptosporidium parvum
DPDNP

SEQ ID NO: 2326956 - protein, 5 aa, Cryptosporidium parvum
DPEDL

SEQ ID NO: 2326957 - protein, 5 aa, Cryptosporidium parvum
DPEEI

SEQ ID NO: 2326958 - protein, 9 aa, Cryptosporidium parvum
DPEKHSQEF

SEQ ID NO: 2326959 - protein, 7 aa, Cryptosporidium parvum
DPEKRGI

SEQ ID NO: 2326960 - protein, 5 aa, Cryptosporidium parvum
DPELQ

SEQ ID NO: 2326961 - protein, 7 aa, Cryptosporidium parvum
DPENGKV

SEQ ID NO: 2326962 - protein, 5 aa, Cryptosporidium parvum
DPENL

SEQ ID NO: 2326963 - protein, 48 aa, Cryptosporidium parvum
DPENPASENNSSIPVTSTPSPKAKREAVSDVNASNLRKPCKPEQSKSQ

SEQ ID NO: 2326964 - protein, 8 aa, Cryptosporidium parvum
DPFKKEGE

SEQ ID NO: 2326965 - protein, 6 aa, Cryptosporidium parvum
DPFSGR

SEQ ID NO: 2326966 - protein, 7 aa, Cryptosporidium parvum
DPFTDEK

SEQ ID NO: 2326967 - protein, 8 aa, Cryptosporidium parvum
DPIEGVPN

SEQ ID NO: 2326968 - protein, 9 aa, Cryptosporidium parvum
DPINENNDD

SEQ ID NO: 2326969 - protein, 39 aa, Cryptosporidium parvum
DPKGGAKQKVKTKAVTSKNNNSRSSRRSRSRSPKPCTSL

SEQ ID NO: 2326970 - protein, 5 aa, Cryptosporidium parvum
DPMTN

SEQ ID NO: 2326971 - protein, 8 aa, Cryptosporidium parvum
DPNEPSTI

SEQ ID NO: 2326972 - protein, 12 aa, Cryptosporidium parvum
DPNNKDTTGGNS

SEQ ID NO: 2326973 - protein, 9 aa, Cryptosporidium parvum
DPNTFSRNK

SEQ ID NO: 2326974 - protein, 11 aa, Cryptosporidium parvum
DPRGNTIKRGT

SEQ ID NO: 2326975 - protein, 14 aa, Cryptosporidium parvum
DPRKSTPSERARNL

SEQ ID NO: 2326976 - protein, 4 aa, Cryptosporidium parvum
DPSD

SEQ ID NO: 2326977 - protein, 6 aa, Cryptosporidium parvum
DPSIET

SEQ ID NO: 2326978 - protein, 60 aa, Cryptosporidium parvum
DPSKTRTTSRGGSEGGERGGRGGRGGRGGEGGSGGRGGGGGGGRGGGGSGDGGKKAPKSY

SEQ ID NO: 2326979 - protein, 26 aa, Cryptosporidium parvum
DPSPIRKKNQKEIKQRDELDESYSNK

SEQ ID NO: 2326980 - protein, 6 aa, Cryptosporidium parvum
DPSPTY

SEQ ID NO: 2326981 - protein, 8 aa, Cryptosporidium parvum
DPSSPIQY

SEQ ID NO: 2326982 - protein, 4 aa, Cryptosporidium parvum
DPTC

SEQ ID NO: 2326983 - protein, 15 aa, Cryptosporidium parvum
DPTDGSYDPFSPSIN

SEQ ID NO: 2326984 - protein, 47 aa, Cryptosporidium parvum
DPVGISTTTTTTTTTTTTSTTTTTSTSTPGLDNTSSSTTTLPPDLSG

SEQ ID NO: 2326985 - protein, 8 aa, Cryptosporidium parvum
DPVPDTQE

SEQ ID NO: 2326986 - protein, 9 aa, Cryptosporidium parvum
DPYSKDDNA

SEQ ID NO: 2326987 - protein, 5 aa, Cryptosporidium parvum
DQDEE

SEQ ID NO: 2326988 - protein, 6 aa, Cryptosporidium parvum
DQDLED

SEQ ID NO: 2326989 - protein, 6 aa, Cryptosporidium parvum
DQDYSN

SEQ ID NO: 2326990 - protein, 7 aa, Cryptosporidium parvum
DQELNKE

SEQ ID NO: 2326991 - protein, 12 aa, Cryptosporidium parvum
DQGQKLESFFAL

SEQ ID NO: 2326992 - protein, 5 aa, Cryptosporidium parvum
DQGSE

SEQ ID NO: 2326993 - protein, 8 aa, Cryptosporidium parvum
DQISPGAA

SEQ ID NO: 2326994 - protein, 11 aa, Cryptosporidium parvum
DQKPGTSGLRK

SEQ ID NO: 2326995 - protein, 5 aa, Cryptosporidium parvum
DQLEE

SEQ ID NO: 2326996 - protein, 17 aa, Cryptosporidium parvum
DQMDGFGEKGENNFSKQ

SEQ ID NO: 2326997 - protein, 4 aa, Cryptosporidium parvum
DQRI

SEQ ID NO: 2326998 - protein, 6 aa, Cryptosporidium parvum
DQSCSS

SEQ ID NO: 2326999 - protein, 7 aa, Cryptosporidium parvum
DQSQDSF

SEQ ID NO: 2327000 - protein, 7 aa, Cryptosporidium parvum
DQSQLDS

SEQ ID NO: 2327001 - protein, 9 aa, Cryptosporidium parvum
DQSTNLNGD

SEQ ID NO: 2327002 - protein, 8 aa, Cryptosporidium parvum
DQSVKTQV

SEQ ID NO: 2327003 - protein, 20 aa, Cryptosporidium parvum
DQVNPQAEEVHGEDDTNEEL

SEQ ID NO: 2327004 - protein, 6 aa, Cryptosporidium parvum
DQVTSS

SEQ ID NO: 2327005 - protein, 18 aa, Cryptosporidium parvum
DREQNQSESSDSNSISSN

SEQ ID NO: 2327006 - protein, 7 aa, Cryptosporidium parvum
DRFSQNV

SEQ ID NO: 2327007 - protein, 5 aa, Cryptosporidium parvum
DRGSH

SEQ ID NO: 2327008 - protein, 7 aa, Cryptosporidium parvum
DRKASDF

SEQ ID NO: 2327009 - protein, 8 aa, Cryptosporidium parvum
DRKSDPNW

SEQ ID NO: 2327010 - protein, 9 aa, Cryptosporidium parvum
DRTRGPGCK

SEQ ID NO: 2327011 - protein, 33 aa, Cryptosporidium parvum; identical to SEQ ID NO: 2201377

SEQ ID NO: 2327012 - protein, 4 aa, Cryptosporidium parvum
DRVS

SEQ ID NO: 2327013 - protein, 15 aa, Cryptosporidium parvum
DRYNTRSDGSDIGEQ

SEQ ID NO: 2327014 - protein, 5 aa, Cryptosporidium parvum
DSAPF

SEQ ID NO: 2327015 - protein, 4 aa, Cryptosporidium parvum
DSDD

SEQ ID NO: 2327016 - protein, 6 aa, Cryptosporidium parvum
DSDDIH

SEQ ID NO: 2327017 - protein, 13 aa, Cryptosporidium parvum
DSDIGNGGGSETA

SEQ ID NO: 2327018 - protein, 10 aa, Cryptosporidium parvum
DSDKHDSMNI

SEQ ID NO: 2327019 - protein, 10 aa, Cryptosporidium parvum
DSDPCKGTNV

SEQ ID NO: 2327020 - protein, 9 aa, Cryptosporidium parvum
DSDPKNKEY

SEQ ID NO: 2327021 - protein, 11 aa, Cryptosporidium parvum
DSDQQDSRSSM

SEQ ID NO: 2327022 - protein, 10 aa, Cryptosporidium parvum
DSDRKYKAAD

SEQ ID NO: 2327023 - protein, 9 aa, Cryptosporidium parvum
DSEAEDAKE

SEQ ID NO: 2327024 - protein, 12 aa, Cryptosporidium parvum
DSEEDQKNPPKV

SEQ ID NO: 2327025 - protein, 9 aa, Cryptosporidium parvum
DSEGNPYVD

SEQ ID NO: 2327026 - protein, 4 aa, Cryptosporidium parvum
DSEL

SEQ ID NO: 2327027 - protein, 4 aa, Cryptosporidium parvum
DSEN

SEQ ID NO: 2327028 - protein, 4 aa, Cryptosporidium parvum
DSET

SEQ ID NO: 2327029 - protein, 7 aa, Cryptosporidium parvum
DSGPFET

SEQ ID NO: 2327030 - protein, 4 aa, Cryptosporidium parvum
DSIG

SEQ ID NO: 2327031 - protein, 13 aa, Cryptosporidium parvum
DSIKPTPSCPPEY

SEQ ID NO: 2327032 - protein, 7 aa, Cryptosporidium parvum
DSIPNDH

SEQ ID NO: 2327033 - protein, 6 aa, Cryptosporidium parvum
DSIQTQ

SEQ ID NO: 2327034 - protein, 6 aa, Cryptosporidium parvum
DSIYES

SEQ ID NO: 2327035 - protein, 4 aa, Cryptosporidium parvum
DSKD

SEQ ID NO: 2327036 - protein, 7 aa, Cryptosporidium parvum
DSKHVTE

SEQ ID NO: 2327037 - protein, 11 aa, Cryptosporidium parvum
DSKNDENKDSL

SEQ ID NO: 2327038 - protein, 6 aa, Cryptosporidium parvum
DSKPYI

SEQ ID NO: 2327039 - protein, 8 aa, Cryptosporidium parvum
DSKSWSTD

SEQ ID NO: 2327040 - protein, 12 aa, Cryptosporidium parvum
DSLKEDDSEVDS

SEQ ID NO: 2327041 - protein, 12 aa, Cryptosporidium parvum
DSNANSKDQFKR

SEQ ID NO: 2327042 - protein, 11 aa, Cryptosporidium parvum
DSNGKAVNYDS

SEQ ID NO: 2327043 - protein, 12 aa, Cryptosporidium parvum
DSNLDSQNPIQD

SEQ ID NO: 2327044 - protein, 5 aa, Cryptosporidium parvum
DSNLT

SEQ ID NO: 2327045 - protein, 9 aa, Cryptosporidium parvum
DSNNNSNIE

SEQ ID NO: 2327046 - protein, 6 aa, Cryptosporidium parvum
DSNQEC

SEQ ID NO: 2327047 - protein, 13 aa, Cryptosporidium parvum
DSNTTSNVSEDEK

SEQ ID NO: 2327048 - protein, 6 aa, Cryptosporidium parvum
DSPEAE

SEQ ID NO: 2327049 - protein, 6 aa, Cryptosporidium parvum
DSPKIM

SEQ ID NO: 2327050 - protein, 6 aa, Cryptosporidium parvum
DSPRDP

SEQ ID NO: 2327051 - protein, 6 aa, Cryptosporidium parvum
DSPVSI

SEQ ID NO: 2327052 - protein, 13 aa, Cryptosporidium parvum
DSQKLRNSLRSSG

SEQ ID NO: 2327053 - protein, 8 aa, Cryptosporidium parvum
DSQPKLRS

SEQ ID NO: 2327054 - protein, 7 aa, Cryptosporidium parvum
DSRIPSF

SEQ ID NO: 2327055 - protein, 5 aa, Cryptosporidium parvum
DSRTY

SEQ ID NO: 2327056 - protein, 7 aa, Cryptosporidium parvum
DSSAGAY

SEQ ID NO: 2327057 - protein, 6 aa, Cryptosporidium parvum
DSSDKI

SEQ ID NO: 2327058 - protein, 11 aa, Cryptosporidium parvum
DSSDKNNSFGA

SEQ ID NO: 2327059 - protein, 12 aa, Cryptosporidium parvum
DSSDSGSKSQKE

SEQ ID NO: 2327060 - protein, 7 aa, Cryptosporidium parvum
DSSELRD

SEQ ID NO: 2327061 - protein, 15 aa, Cryptosporidium parvum
DSSEQNELLENDDVF

SEQ ID NO: 2327062 - protein, 10 aa, Cryptosporidium parvum
DSSESSSGML

SEQ ID NO: 2327063 - protein, 6 aa, Cryptosporidium parvum
DSSFTS

SEQ ID NO: 2327064 - protein, 30 aa, Cryptosporidium parvum
DSSGSSSDSDSDSDSDSDSDSDSNSDDEIR

SEQ ID NO: 2327065 - protein, 7 aa, Cryptosporidium parvum
DSSKGDL

SEQ ID NO: 2327066 - protein, 8 aa, Cryptosporidium parvum
DSSNPNLE

SEQ ID NO: 2327067 - protein, 8 aa, Cryptosporidium parvum
DSSQGKPF

SEQ ID NO: 2327068 - protein, 9 aa, Cryptosporidium parvum
DSSQTDSNE

SEQ ID NO: 2327069 - protein, 7 aa, Cryptosporidium parvum
DSSQYYK

SEQ ID NO: 2327070 - protein, 12 aa, Cryptosporidium parvum
DSSRDLKNNGGI

SEQ ID NO: 2327071 - protein, 5 aa, Cryptosporidium parvum
DSSYK

SEQ ID NO: 2327072 - protein, 8 aa, Cryptosporidium parvum
DSTEKDDI

SEQ ID NO: 2327073 - protein, 12 aa, Cryptosporidium parvum
DSTGNLASSGRL

SEQ ID NO: 2327074 - protein, 8 aa, Cryptosporidium parvum
DSTKNVNV

SEQ ID NO: 2327075 - protein, 19 aa, Cryptosporidium parvum
DSTNKKNPNSNLEDGQVGR

SEQ ID NO: 2327076 - protein, 6 aa, Cryptosporidium parvum
DSTPND

SEQ ID NO: 2327077 - protein, 10 aa, Cryptosporidium parvum
DSTQKSSSNY

SEQ ID NO: 2327078 - protein, 7 aa, Cryptosporidium parvum
DSTSCNS

SEQ ID NO: 2327079 - protein, 9 aa, Cryptosporidium parvum
DSTSKRSAA

SEQ ID NO: 2327080 - protein, 6 aa, Cryptosporidium parvum
DSVENA

SEQ ID NO: 2327081 - protein, 11 aa, Cryptosporidium parvum
DSYAENSTKEY

SEQ ID NO: 2327082 - protein, 14 aa, Cryptosporidium parvum
DSYPTSNSQFYPPP

SEQ ID NO: 2327083 - protein, 10 aa, Cryptosporidium parvum
DTASGTIGEI

SEQ ID NO: 2327084 - protein, 21 aa, Cryptosporidium parvum
DTATTTTTTTTSTTSTTTEQP

SEQ ID NO: 2327085 - protein, 45 aa, Cryptosporidium parvum
DTATTTTTTTTTTTSTTTTTTTTTTTTTTTTTTTTSTTSTTTERP

SEQ ID NO: 2327086 - protein, 10 aa, Cryptosporidium parvum
DTCKPKAGTH

SEQ ID NO: 2327087 - protein, 22 aa, Cryptosporidium parvum
DTDPDETSEANQTQKKQSLNED

SEQ ID NO: 2327088 - protein, 9 aa, Cryptosporidium parvum
DTEDEDSRS

SEQ ID NO: 2327089 - protein, 5 aa, Cryptosporidium parvum
DTENE

SEQ ID NO: 2327090 - protein, 4 aa, Cryptosporidium parvum
DTGG

SEQ ID NO: 2327091 - protein, 6 aa, Cryptosporidium parvum
DTGKTK

SEQ ID NO: 2327092 - protein, 10 aa, Cryptosporidium parvum
DTGLSSGEWG

SEQ ID NO: 2327093 - protein, 6 aa, Cryptosporidium parvum
DTGNNA

SEQ ID NO: 2327094 - protein, 4 aa, Cryptosporidium parvum
DTGV

SEQ ID NO: 2327095 - protein, 4 aa, Cryptosporidium parvum
DTIS

SEQ ID NO: 2327096 - protein, 8 aa, Cryptosporidium parvum
DTISSTNN

SEQ ID NO: 2327097 - protein, 15 aa, Cryptosporidium parvum
DTKSKQSELKPTDSP

SEQ ID NO: 2327098 - protein, 20 aa, Cryptosporidium parvum
DTKTDLSNTNQENQSENVPV

SEQ ID NO: 2327099 - protein, 15 aa, Cryptosporidium parvum
DTNDSDHKALRPDYD

SEQ ID NO: 2327100 - protein, 9 aa, Cryptosporidium parvum
DTNGGAGVD

SEQ ID NO: 2327101 - protein, 11 aa, Cryptosporidium parvum
DTNKSDSLKNE

SEQ ID NO: 2327102 - protein, 4 aa, Cryptosporidium parvum
DTNP

SEQ ID NO: 2327103 - protein, 17 aa, Cryptosporidium parvum
DTNSDETKTKVSKIDPI

SEQ ID NO: 2327104 - protein, 5 aa, Cryptosporidium parvum
DTNSR

SEQ ID NO: 2327105 - protein, 7 aa, Cryptosporidium parvum
DTNTTEI

SEQ ID NO: 2327106 - protein, 13 aa, Cryptosporidium parvum
DTPHNNQDDPKLE

SEQ ID NO: 2327107 - protein, 5 aa, Cryptosporidium parvum
DTRSQ

SEQ ID NO: 2327108 - protein, 8 aa, Cryptosporidium parvum
DTSESKLP

SEQ ID NO: 2327109 - protein, 44 aa, Cryptosporidium parvum
DTSHLKGKSRSRRSRSRSRGASPTAPRTESVTEGDQSKDGELEA

SEQ ID NO: 2327110 - protein, 8 aa, Cryptosporidium parvum
DTSSREDG

SEQ ID NO: 2327111 - protein, 7 aa, Cryptosporidium parvum
DTSTQEY

SEQ ID NO: 2327112 - protein, 16 aa, Cryptosporidium parvum
DVEHRKEKLNEASENF

SEQ ID NO: 2327113 - protein, 11 aa, Cryptosporidium parvum
DVGSESSIDLG

SEQ ID NO: 2327114 - protein, 35 aa, Cryptosporidium parvum
DVKGKGKNKSKRRGSKKRRGRDKSKSRKGKKGKRV

SEQ ID NO: 2327115 - protein, 17 aa, Cryptosporidium parvum
DVNTGQYNPDDKYGENS

SEQ ID NO: 2327116 - protein, 13 aa, Cryptosporidium parvum
DVQEEKKKEKSQK

SEQ ID NO: 2327117 - protein, 22 aa, Cryptosporidium parvum
DVSNPDSKDSKKSLKRLPRPFG

SEQ ID NO: 2327118 - protein, 6 aa, Cryptosporidium parvum
DYDPKI

SEQ ID NO: 2327119 - protein, 15 aa, Cryptosporidium parvum
DYEAGSKSPNVSTKN

SEQ ID NO: 2327120 - protein, 15 aa, Cryptosporidium parvum
DYEKGDAKDRAFGSK

SEQ ID NO: 2327121 - protein, 4 aa, Cryptosporidium parvum
DYGQ

SEQ ID NO: 2327122 - protein, 17 aa, Cryptosporidium parvum
DYNESYTGSENPNTNST

SEQ ID NO: 2327123 - protein, 5 aa, Cryptosporidium parvum
DYNNQ

SEQ ID NO: 2327124 - protein, 5 aa, Cryptosporidium parvum
DYPSQ

SEQ ID NO: 2327125 - protein, 24 aa, Cryptosporidium parvum
DYSASSNINNKGQISEDGKYSDDE

SEQ ID NO: 2327126 - protein, 7 aa, Cryptosporidium parvum
DYSGDRG

SEQ ID NO: 2327127 - protein, 5 aa, Cryptosporidium parvum
DYSNS

SEQ ID NO: 2327128 - protein, 4 aa, Cryptosporidium parvum
DYSS

SEQ ID NO: 2327129 - protein, 6 aa, Cryptosporidium parvum
DYSSRY

SEQ ID NO: 2327130 - protein, 10 aa, Cryptosporidium parvum
EAAKARPHST

SEQ ID NO: 2327131 - protein, 9 aa, Cryptosporidium parvum
EADEKTIRA

SEQ ID NO: 2327132 - protein, 31 aa, Cryptosporidium parvum
EADNLQEEGSASGSASGSASGSVSGSVLGPP

SEQ ID NO: 2327133 - protein, 8 aa, Cryptosporidium parvum
EAEKDVDE

SEQ ID NO: 2327134 - protein, 4 aa, Cryptosporidium parvum
EAEL

SEQ ID NO: 2327135 - protein, 10 aa, Cryptosporidium parvum
EAGDEATKAE

SEQ ID NO: 2327136 - protein, 6 aa, Cryptosporidium parvum
EAGNPV

SEQ ID NO: 2327137 - protein, 9 aa, Cryptosporidium parvum
EAIENEKKA

SEQ ID NO: 2327138 - protein, 7 aa, Cryptosporidium parvum
EAIRRPK

SEQ ID NO: 2327139 - protein, 6 aa, Cryptosporidium parvum
EAKSKI

SEQ ID NO: 2327140 - protein, 14 aa, Cryptosporidium parvum
EALRETEKEINNKK

SEQ ID NO: 2327141 - protein, 4 aa, Cryptosporidium parvum
EANY

SEQ ID NO: 2327142 - protein, 25 aa, Cryptosporidium parvum
EAPEENSPNNSNNPSNEYSQDADLT

SEQ ID NO: 2327143 - protein, 17 aa, Cryptosporidium parvum
EAPINEKAHKSSSTSLI

SEQ ID NO: 2327144 - protein, 17 aa, Cryptosporidium parvum
EAQKPRKRRAPPPPTCS

SEQ ID NO: 2327145 - protein, 4 aa, Cryptosporidium parvum
EAQS

SEQ ID NO: 2327146 - protein, 8 aa, Cryptosporidium parvum
EAQSNASK

SEQ ID NO: 2327147 - protein, 6 aa, Cryptosporidium parvum
EARKPG

SEQ ID NO: 2327148 - protein, 12 aa, Cryptosporidium parvum
EARNKRNRDKSF

SEQ ID NO: 2327149 - protein, 33 aa, Cryptosporidium parvum
EASEGPIEPLGKDDLNREESIRYNGNDNNLISN

SEQ ID NO: 2327150 - protein, 10 aa, Cryptosporidium parvum
EASKPANPPY

SEQ ID NO: 2327151 - protein, 111 aa, Cryptosporidium parvum
EASNAIGTETSTPQEGHISRSKTRSKSKSRSKSRSKSRSKSKSRARSKSRTRARSKSRSRSRTRSRTRSRSRSRTRSRTRSRTRSRTRSRSNLDSELDSGTSKTECTEGSS

SEQ ID NO: 2327152 - protein, 11 aa, Cryptosporidium parvum
EASSTQQKREL

SEQ ID NO: 2327153 - protein, 7 aa, Cryptosporidium parvum
EATEGKG

SEQ ID NO: 2327154 - protein, 21 aa, Cryptosporidium parvum
EATPHVPTQEDENLTSEPTMS

SEQ ID NO: 2327155 - protein, 6 aa, Cryptosporidium parvum
EAYNSG

SEQ ID NO: 2327156 - protein, 5 aa, Cryptosporidium parvum
EAYYE

SEQ ID NO: 2327157 - protein, 7 aa, Cryptosporidium parvum
ECHEKNS

SEQ ID NO: 2327158 - protein, 7 aa, Cryptosporidium parvum
ECKPNEN

SEQ ID NO: 2327159 - protein, 7 aa, Cryptosporidium parvum
ECMSGTP

SEQ ID NO: 2327160 - protein, 7 aa, Cryptosporidium parvum
ECPEGYT

SEQ ID NO: 2327161 - protein, 9 aa, Cryptosporidium parvum
ECQPTKEQT

SEQ ID NO: 2327162 - protein, 4 aa, Cryptosporidium parvum
ECRE

SEQ ID NO: 2327163 - protein, 9 aa, Cryptosporidium parvum
ECSNGDSKC

SEQ ID NO: 2327164 - protein, 10 aa, Cryptosporidium parvum
EDAGIKKSEV

SEQ ID NO: 2327165 - protein, 14 aa, Cryptosporidium parvum
EDCSSVKQHNDGRD

SEQ ID NO: 2327166 - protein, 16 aa, Cryptosporidium parvum
EDDGNSDKCSKPTGEV

SEQ ID NO: 2327167 - protein, 7 aa, Cryptosporidium parvum
EDDNEYN

SEQ ID NO: 2327168 - protein, 8 aa, Cryptosporidium parvum
EDDSNRSK

SEQ ID NO: 2327169 - protein, 10 aa, Cryptosporidium parvum
EDEATGGAEG

SEQ ID NO: 2327170 - protein, 7 aa, Cryptosporidium parvum
EDEEIAA

SEQ ID NO: 2327171 - protein, 6 aa, Cryptosporidium parvum
EDESTE

SEQ ID NO: 2327172 - protein, 4 aa, Cryptosporidium parvum
EDGL

SEQ ID NO: 2327173 - protein, 21 aa, Cryptosporidium parvum
EDIPRNKQKEDVKKLEKNIKK

SEQ ID NO: 2327174 - protein, 10 aa, Cryptosporidium parvum
EDITSNEEEY

SEQ ID NO: 2327175 - protein, 4 aa, Cryptosporidium parvum
EDKD

SEQ ID NO: 2327176 - protein, 6 aa, Cryptosporidium parvum
EDLSQT

SEQ ID NO: 2327177 - protein, 7 aa, Cryptosporidium parvum
EDMEDIG

SEQ ID NO: 2327178 - protein, 11 aa, Cryptosporidium parvum
EDNKNEEDNSC

SEQ ID NO: 2327179 - protein, 10 aa, Cryptosporidium parvum
EDPDYGKPQH

SEQ ID NO: 2327180 - protein, 8 aa, Cryptosporidium parvum
EDPKVNSK

SEQ ID NO: 2327181 - protein, 8 aa, Cryptosporidium parvum
EDQQGIKG

SEQ ID NO: 2327182 - protein, 5 aa, Cryptosporidium parvum
EDRSL

SEQ ID NO: 2327183 - protein, 11 aa, Cryptosporidium parvum
EDSGNEYFSPY

SEQ ID NO: 2327184 - protein, 5 aa, Cryptosporidium parvum
EDSNE

SEQ ID NO: 2327185 - protein, 14 aa, Cryptosporidium parvum
EDSRGISSSEKGSL

SEQ ID NO: 2327186 - protein, 7 aa, Cryptosporidium parvum
EDSSVPV

SEQ ID NO: 2327187 - protein, 4 aa, Cryptosporidium parvum
EDST

SEQ ID NO: 2327188 - protein, 23 aa, Cryptosporidium parvum
EDTADDSKEGSEASTADLEDRTT

SEQ ID NO: 2327189 - protein, 13 aa, Cryptosporidium parvum
EDTKTIDGLNNDV

SEQ ID NO: 2327190 - protein, 6 aa, Cryptosporidium parvum
EDTPGH

SEQ ID NO: 2327191 - protein, 19 aa, Cryptosporidium parvum
EDVDSETQSEESEDDNEDE

SEQ ID NO: 2327192 - protein, 9 aa, Cryptosporidium parvum
EDVKPDDIN

SEQ ID NO: 2327193 - protein, 7 aa, Cryptosporidium parvum
EDVSAPE

SEQ ID NO: 2327194 - protein, 5 aa, Cryptosporidium parvum
EDVYD

SEQ ID NO: 2327195 - protein, 6 aa, Cryptosporidium parvum
EDYIGS

SEQ ID NO: 2327196 - protein, 41 aa, Cryptosporidium parvum
EDYQAKDVDGESQSNENGQQTDSDLQENADRGEKDNIQSKA

SEQ ID NO: 2327197 - protein, 67 aa, Cryptosporidium parvum
EEAKSIQKEQIRQTKQMEKTRYEAPKKRKQGERKTKNENQREKEEKEREEERERERIKEKERQENIQ

SEQ ID NO: 2327198 - protein, 12 aa, Cryptosporidium parvum
EEDDGVNDETEY

SEQ ID NO: 2327199 - protein, 13 aa, Cryptosporidium parvum
EEDGIKSKEENNI

SEQ ID NO: 2327200 - protein, 23 aa, Cryptosporidium parvum
EEDIKEKKIGKSVGKKGKHGTKK

SEQ ID NO: 2327201 - protein, 22 aa, Cryptosporidium parvum
EEDKEKYCNKPGAKAMCSSNSE

SEQ ID NO: 2327202 - protein, 11 aa, Cryptosporidium parvum
EEDRNKDLESV

SEQ ID NO: 2327203 - protein, 4 aa, Cryptosporidium parvum
EEDY

SEQ ID NO: 2327204 - protein, 5 aa, Cryptosporidium parvum
EEEFS

SEQ ID NO: 2327205 - protein, 8 aa, Cryptosporidium parvum
EEEKEYKE

SEQ ID NO: 2327206 - protein, 4 aa, Cryptosporidium parvum
EEEL

SEQ ID NO: 2327207 - protein, 6 aa, Cryptosporidium parvum
EEEREE

SEQ ID NO: 2327208 - protein, 6 aa, Cryptosporidium parvum
EEEREQ

SEQ ID NO: 2327209 - protein, 6 aa, Cryptosporidium parvum
EEFSSN

SEQ ID NO: 2327210 - protein, 6 aa, Cryptosporidium parvum
EEFTTL

SEQ ID NO: 2327211 - protein, 8 aa, Cryptosporidium parvum
EEGNHKHT

SEQ ID NO: 2327212 - protein, 22 aa, Cryptosporidium parvum
EEGTQIKTNNGHEYKVNSGSVG

SEQ ID NO: 2327213 - protein, 6 aa, Cryptosporidium parvum
EEHTDI

SEQ ID NO: 2327214 - protein, 6 aa, Cryptosporidium parvum
EEIEGE

SEQ ID NO: 2327215 - protein, 5 aa, Cryptosporidium parvum
EEIGI

SEQ ID NO: 2327216 - protein, 7 aa, Cryptosporidium parvum
EEIPNEA

SEQ ID NO: 2327217 - protein, 13 aa, Cryptosporidium parvum
EEKDKKESKIKKN

SEQ ID NO: 2327218 - protein, 12 aa, Cryptosporidium parvum
EEKKEREKSNSI

SEQ ID NO: 2327219 - protein, 6 aa, Cryptosporidium parvum
EEKNSR

SEQ ID NO: 2327220 - protein, 18 aa, Cryptosporidium parvum
EEKQKFQEKRKPQKSKHI

SEQ ID NO: 2327221 - protein, 9 aa, Cryptosporidium parvum
EEKSQEKYS

SEQ ID NO: 2327222 - protein, 4 aa, Cryptosporidium parvum
EELE

SEQ ID NO: 2327223 - protein, 15 aa, Cryptosporidium parvum
EELLGTDTTTPMPPT

SEQ ID NO: 2327224 - protein, 17 aa, Cryptosporidium parvum
EELNADETNSSRSNGLG

SEQ ID NO: 2327225 - protein, 7 aa, Cryptosporidium parvum
EELTPAT

SEQ ID NO: 2327226 - protein, 39 aa, Cryptosporidium parvum
EEMPTEPPRTQEGDGGNEQSEESEKKSSCCSSSSCKSKK

SEQ ID NO: 2327227 - protein, 7 aa, Cryptosporidium parvum
EENAASS

SEQ ID NO: 2327228 - protein, 4 aa, Cryptosporidium parvum
EEND

SEQ ID NO: 2327229 - protein, 9 aa, Cryptosporidium parvum
EENDSLERL

SEQ ID NO: 2327230 - protein, 5 aa, Cryptosporidium parvum
EENES

SEQ ID NO: 2327231 - protein, 9 aa, Cryptosporidium parvum
EENEYDKAL

SEQ ID NO: 2327232 - protein, 4 aa, Cryptosporidium parvum
EENS

SEQ ID NO: 2327233 - protein, 15 aa, Cryptosporidium parvum
EENSKATNGNETLED

SEQ ID NO: 2327234 - protein, 6 aa, Cryptosporidium parvum
EENTEM

SEQ ID NO: 2327235 - protein, 11 aa, Cryptosporidium parvum
EENTYLKENNK

SEQ ID NO: 2327236 - protein, 4 aa, Cryptosporidium parvum
EEPE

SEQ ID NO: 2327237 - protein, 4 aa, Cryptosporidium parvum
EEPK

SEQ ID NO: 2327238 - protein, 45 aa, Cryptosporidium parvum
EEPKNGDFVDSDEGDDEEEIKGGKKKSDKDSDKSKKASKYSTDFK

SEQ ID NO: 2327239 - protein, 8 aa, Cryptosporidium parvum
EEPRELKR

SEQ ID NO: 2327240 - protein, 8 aa, Cryptosporidium parvum
EEQKLSSI

SEQ ID NO: 2327241 - protein, 8 aa, Cryptosporidium parvum
EEQRDREK

SEQ ID NO: 2327242 - protein, 17 aa, Cryptosporidium parvum
EERKRVGAGLDREEVRR

SEQ ID NO: 2327243 - protein, 7 aa, Cryptosporidium parvum
EERLKQE

SEQ ID NO: 2327244 - protein, 10 aa, Cryptosporidium parvum
EERNLSNSEL

SEQ ID NO: 2327245 - protein, 13 aa, Cryptosporidium parvum
EESESSIKSRDSV

SEQ ID NO: 2327246 - protein, 5 aa, Cryptosporidium parvum
EESPD

SEQ ID NO: 2327247 - protein, 28 aa, Cryptosporidium parvum
EESQANKKKREDLGSLDRPRGPKCKQDC

SEQ ID NO: 2327248 - protein, 7 aa, Cryptosporidium parvum
EESRMTE

SEQ ID NO: 2327249 - protein, 9 aa, Cryptosporidium parvum
EESSESLSN

SEQ ID NO: 2327250 - protein, 5 aa, Cryptosporidium parvum
EESSM

SEQ ID NO: 2327251 - protein, 19 aa, Cryptosporidium parvum
EETEESSSRMRERARTSAY

SEQ ID NO: 2327252 - protein, 8 aa, Cryptosporidium parvum
EETKSGWE

SEQ ID NO: 2327253 - protein, 9 aa, Cryptosporidium parvum
EETQNTISE

SEQ ID NO: 2327254 - protein, 4 aa, Cryptosporidium parvum
EEVD

SEQ ID NO: 2327255 - protein, 10 aa, Cryptosporidium parvum
EEVDDDDDYR

SEQ ID NO: 2327256 - protein, 10 aa, Cryptosporidium parvum
EEVEKEKKNR

SEQ ID NO: 2327257 - protein, 30 aa, Cryptosporidium parvum
EEYGENKFTGRRPRRSRKKGSLEPLDRKPT

SEQ ID NO: 2327258 - protein, 4 aa, Cryptosporidium parvum
EEYK

SEQ ID NO: 2327259 - protein, 10 aa, Cryptosporidium parvum
EEYYGGREEN

SEQ ID NO: 2327260 - protein, 5 aa, Cryptosporidium parvum
EFCDS

SEQ ID NO: 2327261 - protein, 13 aa, Cryptosporidium parvum
EFESTRSKLESVE

SEQ ID NO: 2327262 - protein, 31 aa, Cryptosporidium parvum
EFKENQKKLEEKDPEQQGKAIDTPERAEEDK

SEQ ID NO: 2327263 - protein, 7 aa, Cryptosporidium parvum
EFKKSAS

SEQ ID NO: 2327264 - protein, 15 aa, Cryptosporidium parvum
EFNEKSGSKENIGQI

SEQ ID NO: 2327265 - protein, 7 aa, Cryptosporidium parvum
EFNKRYT

SEQ ID NO: 2327266 - protein, 10 aa, Cryptosporidium parvum
EFQENQSPLR

SEQ ID NO: 2327267 - protein, 21 aa, Cryptosporidium parvum
EFSKPESETNNKTDYNNENEY

SEQ ID NO: 2327268 - protein, 7 aa, Cryptosporidium parvum
EFSPSSK

SEQ ID NO: 2327269 - protein, 7 aa, Cryptosporidium parvum
EFSTPSY

SEQ ID NO: 2327270 - protein, 5 aa, Cryptosporidium parvum
EGANS

SEQ ID NO: 2327271 - protein, 7 aa, Cryptosporidium parvum
EGAPDYS

SEQ ID NO: 2327272 - protein, 4 aa, Cryptosporidium parvum
EGDI

SEQ ID NO: 2327273 - protein, 10 aa, Cryptosporidium parvum
EGDNNNSVEK

SEQ ID NO: 2327274 - protein, 5 aa, Cryptosporidium parvum
EGEDG

SEQ ID NO: 2327275 - protein, 13 aa, Cryptosporidium parvum
EGEENKTNSKSKG

SEQ ID NO: 2327276 - protein, 12 aa, Cryptosporidium parvum
EGFKQGSSLKTE

SEQ ID NO: 2327277 - protein, 11 aa, Cryptosporidium parvum
EGFSKTNKKIS

SEQ ID NO: 2327278 - protein, 6 aa, Cryptosporidium parvum
EGGERC

SEQ ID NO: 2327279 - protein, 30 aa, Cryptosporidium parvum
EGGKDLRSSSSSPLTKETSTINSDDEELSL

SEQ ID NO: 2327280 - protein, 14 aa, Cryptosporidium parvum
EGIDNDGQERAVEA

SEQ ID NO: 2327281 - protein, 10 aa, Cryptosporidium parvum
EGIKKTTSLE

SEQ ID NO: 2327282 - protein, 6 aa, Cryptosporidium parvum
EGISKS

SEQ ID NO: 2327283 - protein, 7 aa, Cryptosporidium parvum
EGITRER

SEQ ID NO: 2327284 - protein, 12 aa, Cryptosporidium parvum
EGKEESAKAQLE

SEQ ID NO: 2327285 - protein, 6 aa, Cryptosporidium parvum
EGKMTS

SEQ ID NO: 2327286 - protein, 8 aa, Cryptosporidium parvum
EGKNDGGI

SEQ ID NO: 2327287 - protein, 5 aa, Cryptosporidium parvum
EGKPS

SEQ ID NO: 2327288 - protein, 18 aa, Cryptosporidium parvum
EGKSQISQKDSEKLYSEA

SEQ ID NO: 2327289 - protein, 8 aa, Cryptosporidium parvum
EGKTNEPF

SEQ ID NO: 2327290 - protein, 5 aa, Cryptosporidium parvum
EGKTR

SEQ ID NO: 2327291 - protein, 5 aa, Cryptosporidium parvum
EGLGE

SEQ ID NO: 2327292 - protein, 14 aa, Cryptosporidium parvum
EGLSRGEKVIDTGS

SEQ ID NO: 2327293 - protein, 6 aa, Cryptosporidium parvum
EGMQSS

SEQ ID NO: 2327294 - protein, 9 aa, Cryptosporidium parvum
EGNGRTAKG

SEQ ID NO: 2327295 - protein, 7 aa, Cryptosporidium parvum
EGNPITS

SEQ ID NO: 2327296 - protein, 6 aa, Cryptosporidium parvum
EGNPYP

SEQ ID NO: 2327297 - protein, 19 aa, Cryptosporidium parvum
EGPKNSYEGSTKNEIESEK

SEQ ID NO: 2327298 - protein, 8 aa, Cryptosporidium parvum
EGQEQSLN

SEQ ID NO: 2327299 - protein, 11 aa, Cryptosporidium parvum
EGQVPNKYENY

SEQ ID NO: 2327300 - protein, 8 aa, Cryptosporidium parvum
EGRPELTP

SEQ ID NO: 2327301 - protein, 6 aa, Cryptosporidium parvum
EGRSSD

SEQ ID NO: 2327302 - protein, 9 aa, Cryptosporidium parvum
EGSAGLRTS

SEQ ID NO: 2327303 - protein, 4 aa, Cryptosporidium parvum
EGSF

SEQ ID NO: 2327304 - protein, 4 aa, Cryptosporidium parvum
EGSI

SEQ ID NO: 2327305 - protein, 5 aa, Cryptosporidium parvum
EGSNK

SEQ ID NO: 2327306 - protein, 5 aa, Cryptosporidium parvum
EGSNT

SEQ ID NO: 2327307 - protein, 7 aa, Cryptosporidium parvum
EGSPLGP

SEQ ID NO: 2327308 - protein, 5 aa, Cryptosporidium parvum
EGSPY

SEQ ID NO: 2327309 - protein, 42 aa, Cryptosporidium parvum
EGSRSSIAKDVENEDSVKHKPSTVSGKENHYDASYESNLEEM

SEQ ID NO: 2327310 - protein, 5 aa, Cryptosporidium parvum
EGSVS

SEQ ID NO: 2327311 - protein, 7 aa, Cryptosporidium parvum
EGTDDHP

SEQ ID NO: 2327312 - protein, 13 aa, Cryptosporidium parvum
EGTGQEKPKPEDE

SEQ ID NO: 2327313 - protein, 7 aa, Cryptosporidium parvum
EGTNDEC

SEQ ID NO: 2327314 - protein, 22 aa, Cryptosporidium parvum
EGVNKSEKDESGEKKESKGRWE

SEQ ID NO: 2327315 - protein, 14 aa, Cryptosporidium parvum
EGYEKSPVGNGENG

SEQ ID NO: 2327316 - protein, 7 aa, Cryptosporidium parvum
EHDETNK

SEQ ID NO: 2327317 - protein, 6 aa, Cryptosporidium parvum
EHDSSV

SEQ ID NO: 2327318 - protein, 13 aa, Cryptosporidium parvum
EHENKSEQESAQV

SEQ ID NO: 2327319 - protein, 39 aa, Cryptosporidium parvum
EHESEGNYKPKTSSAQKDEESFSDSTVATEGDEGSEEEQ

SEQ ID NO: 2327320 - protein, 6 aa, Cryptosporidium parvum
EHETDL

SEQ ID NO: 2327321 - protein, 11 aa, Cryptosporidium parvum
EHGSKSDGTIE

SEQ ID NO: 2327322 - protein, 9 aa, Cryptosporidium parvum
EHLKSSKYN

SEQ ID NO: 2327323 - protein, 7 aa, Cryptosporidium parvum
EHSEENR

SEQ ID NO: 2327324 - protein, 9 aa, Cryptosporidium parvum
EHSRDNSDN

SEQ ID NO: 2327325 - protein, 15 aa, Cryptosporidium parvum
EIDGEAEASGRQTVS

SEQ ID NO: 2327326 - protein, 16 aa, Cryptosporidium parvum
EIDKDLDEAASNLQIP

SEQ ID NO: 2327327 - protein, 7 aa, Cryptosporidium parvum
EIDRESD

SEQ ID NO: 2327328 - protein, 4 aa, Cryptosporidium parvum
EIEN

SEQ ID NO: 2327329 - protein, 12 aa, Cryptosporidium parvum
EIENSQKQNNDQ

SEQ ID NO: 2327330 - protein, 13 aa, Cryptosporidium parvum
EIGEEYDERNSPL

SEQ ID NO: 2327331 - protein, 9 aa, Cryptosporidium parvum
EIKKSKYNS

SEQ ID NO: 2327332 - protein, 8 aa, Cryptosporidium parvum
EINSRKGV

SEQ ID NO: 2327333 - protein, 19 aa, Cryptosporidium parvum
EINTEGETVKNHEYTDDEK

SEQ ID NO: 2327334 - protein, 9 aa, Cryptosporidium parvum
EINTRSENQ

SEQ ID NO: 2327335 - protein, 35 aa, Cryptosporidium parvum
EIPADTATTTTTTTTTTTTTTTTTTSTTSTTTEQP

SEQ ID NO: 2327336 - protein, 8 aa, Cryptosporidium parvum
EIPGGGSK

SEQ ID NO: 2327337 - protein, 26 aa, Cryptosporidium parvum
EIPNEGSSSSGNNNSEGLSRGGKKPV

SEQ ID NO: 2327338 - protein, 25 aa, Cryptosporidium parvum
EIPNEGSSSSGNNNSEGLSRGRKKP

SEQ ID NO: 2327339 - protein, 4 aa, Cryptosporidium parvum
EIPP

SEQ ID NO: 2327340 - protein, 12 aa, Cryptosporidium parvum
EIPSVDSKRKKL

SEQ ID NO: 2327341 - protein, 11 aa, Cryptosporidium parvum
EIQGYNKEQQA

SEQ ID NO: 2327342 - protein, 15 aa, Cryptosporidium parvum
EIQNTEERLREEYRE

SEQ ID NO: 2327343 - protein, 7 aa, Cryptosporidium parvum
EISKNNY

SEQ ID NO: 2327344 - protein, 17 aa, Cryptosporidium parvum
EISKQKSKNKMDSESYK

SEQ ID NO: 2327345 - protein, 5 aa, Cryptosporidium parvum
EISLE

SEQ ID NO: 2327346 - protein, 10 aa, Cryptosporidium parvum
EISRKDNKLE

SEQ ID NO: 2327347 - protein, 6 aa, Cryptosporidium parvum
EITGRS

SEQ ID NO: 2327348 - protein, 10 aa, Cryptosporidium parvum
EITGSDDDPI

SEQ ID NO: 2327349 - protein, 8 aa, Cryptosporidium parvum
EITKEEYN

SEQ ID NO: 2327350 - protein, 15 aa, Cryptosporidium parvum
EITRNYSDSNFSETT

SEQ ID NO: 2327351 - protein, 11 aa, Cryptosporidium parvum
EITSSAKSVNL

SEQ ID NO: 2327352 - protein, 7 aa, Cryptosporidium parvum
EKAIQQS

SEQ ID NO: 2327353 - protein, 7 aa, Cryptosporidium parvum
EKALSEL

SEQ ID NO: 2327354 - protein, 11 aa, Cryptosporidium parvum
EKANRRKKGLN

SEQ ID NO: 2327355 - protein, 4 aa, Cryptosporidium parvum
EKAQ

SEQ ID NO: 2327356 - protein, 7 aa, Cryptosporidium parvum
EKARIER

SEQ ID NO: 2327357 - protein, 15 aa, Cryptosporidium parvum
EKASMSSNSQGSSDS

SEQ ID NO: 2327358 - protein, 11 aa, Cryptosporidium parvum
EKDESSNKEIT

SEQ ID NO: 2327359 - protein, 9 aa, Cryptosporidium parvum
EKDPKDISN

SEQ ID NO: 2327360 - protein, 9 aa, Cryptosporidium parvum
EKDTQVSHG

SEQ ID NO: 2327361 - protein, 10 aa, Cryptosporidium parvum
EKDYEATTNE

SEQ ID NO: 2327362 - protein, 11 aa, Cryptosporidium parvum
EKECSGEQMDK

SEQ ID NO: 2327363 - protein, 5 aa, Cryptosporidium parvum
EKEKF

SEQ ID NO: 2327364 - protein, 8 aa, Cryptosporidium parvum
EKEKGLSS

SEQ ID NO: 2327365 - protein, 10 aa, Cryptosporidium parvum
EKEKKQNYYT

SEQ ID NO: 2327366 - protein, 8 aa, Cryptosporidium parvum
EKELKERK

SEQ ID NO: 2327367 - protein, 6 aa, Cryptosporidium parvum
EKELNN

SEQ ID NO: 2327368 - protein, 9 aa, Cryptosporidium parvum
EKENKLNEI

SEQ ID NO: 2327369 - protein, 10 aa, Cryptosporidium parvum
EKENVSSSNY

SEQ ID NO: 2327370 - protein, 10 aa, Cryptosporidium parvum
EKEPSVGADE

SEQ ID NO: 2327371 - protein, 12 aa, Cryptosporidium parvum
EKEQEKVKEEKE

SEQ ID NO: 2327372 - protein, 10 aa, Cryptosporidium parvum
EKERLEKEKI

SEQ ID NO: 2327373 - protein, 15 aa, Cryptosporidium parvum
EKESLGNKNSKVEQS

SEQ ID NO: 2327374 - protein, 8 aa, Cryptosporidium parvum
EKESNQFL

SEQ ID NO: 2327375 - protein, 6 aa, Cryptosporidium parvum
EKESPV

SEQ ID NO: 2327376 - protein, 4 aa, Cryptosporidium parvum
EKET

SEQ ID NO: 2327377 - protein, 13 aa, Cryptosporidium parvum
EKEYNDDGSKSPV

SEQ ID NO: 2327378 - protein, 12 aa, Cryptosporidium parvum
EKFSKGKYKKTL

SEQ ID NO: 2327379 - protein, 7 aa, Cryptosporidium parvum
EKGANRE

SEQ ID NO: 2327380 - protein, 7 aa, Cryptosporidium parvum
EKGGFSR

SEQ ID NO: 2327381 - protein, 12 aa, Cryptosporidium parvum
EKGKHNKRSPQN

SEQ ID NO: 2327382 - protein, 13 aa, Cryptosporidium parvum
EKGVPEEYKGSLP

SEQ ID NO: 2327383 - protein, 17 aa, Cryptosporidium parvum
EKGYGPAASKNDGKKIK

SEQ ID NO: 2327384 - protein, 9 aa, Cryptosporidium parvum
EKHKNELEE

SEQ ID NO: 2327385 - protein, 5 aa, Cryptosporidium parvum
EKHTD

SEQ ID NO: 2327386 - protein, 6 aa, Cryptosporidium parvum
EKIPTS

SEQ ID NO: 2327387 - protein, 18 aa, Cryptosporidium parvum
EKKDYDAKKKEKEKLPLQ

SEQ ID NO: 2327388 - protein, 8 aa, Cryptosporidium parvum
EKKKETIR

SEQ ID NO: 2327389 - protein, 7 aa, Cryptosporidium parvum
EKKKQEG

SEQ ID NO: 2327390 - protein, 8 aa, Cryptosporidium parvum
EKKNEDFG

SEQ ID NO: 2327391 - protein, 7 aa, Cryptosporidium parvum
EKKNLKK

SEQ ID NO: 2327392 - protein, 51 aa, Cryptosporidium parvum
EKKPGKYKESIENTQRSSELSNSLEKKSDISLSSGSLGQGSESSQREMSSE

SEQ ID NO: 2327393 - protein, 5 aa, Cryptosporidium parvum
EKKPL

SEQ ID NO: 2327394 - protein, 9 aa, Cryptosporidium parvum
EKKSGEKNF

SEQ ID NO: 2327395 - protein, 8 aa, Cryptosporidium parvum
EKKSGIQS

SEQ ID NO: 2327396 - protein, 8 aa, Cryptosporidium parvum
EKKTPTKI

SEQ ID NO: 2327397 - protein, 24 aa, Cryptosporidium parvum
EKKVDEDFTNKDSKLDERESNNKV

SEQ ID NO: 2327398 - protein, 7 aa, Cryptosporidium parvum
EKKVGEI

SEQ ID NO: 2327399 - protein, 16 aa, Cryptosporidium parvum
EKLEEIGKKYSSGEML

SEQ ID NO: 2327400 - protein, 14 aa, Cryptosporidium parvum
EKLRNKKRVKEEKL

SEQ ID NO: 2327401 - protein, 7 aa, Cryptosporidium parvum
EKLTSGH

SEQ ID NO: 2327402 - protein, 8 aa, Cryptosporidium parvum
EKMDQTKS

SEQ ID NO: 2327403 - protein, 12 aa, Cryptosporidium parvum
EKNDEEGEPKVK

SEQ ID NO: 2327404 - protein, 5 aa, Cryptosporidium parvum
EKNEE

SEQ ID NO: 2327405 - protein, 12 aa, Cryptosporidium parvum
EKNGGPAQDSVT

SEQ ID NO: 2327406 - protein, 11 aa, Cryptosporidium parvum
EKNIASSPAGI

SEQ ID NO: 2327407 - protein, 7 aa, Cryptosporidium parvum
EKNNEKI

SEQ ID NO: 2327408 - protein, 4 aa, Cryptosporidium parvum
EKNP

SEQ ID NO: 2327409 - protein, 13 aa, Cryptosporidium parvum
EKNPEISKTLDSE

SEQ ID NO: 2327410 - protein, 8 aa, Cryptosporidium parvum
EKNPNSEF

SEQ ID NO: 2327411 - protein, 6 aa, Cryptosporidium parvum
EKNSEY

SEQ ID NO: 2327412 - protein, 8 aa, Cryptosporidium parvum
EKNSKHSE

SEQ ID NO: 2327413 - protein, 9 aa, Cryptosporidium parvum
EKNSSSKIR

SEQ ID NO: 2327414 - protein, 8 aa, Cryptosporidium parvum
EKPEKHGA

SEQ ID NO: 2327415 - protein, 5 aa, Cryptosporidium parvum
EKPPP

SEQ ID NO: 2327416 - protein, 10 aa, Cryptosporidium parvum
EKPVKTPETL

SEQ ID NO: 2327417 - protein, 10 aa, Cryptosporidium parvum
EKQEELQHTR

SEQ ID NO: 2327418 - protein, 10 aa, Cryptosporidium parvum
EKQEYKGEAN

SEQ ID NO: 2327419 - protein, 8 aa, Cryptosporidium parvum
EKQQKYAT

SEQ ID NO: 2327420 - protein, 14 aa, Cryptosporidium parvum
EKQRNSPGTDEDEV

SEQ ID NO: 2327421 - protein, 7 aa, Cryptosporidium parvum
EKRACED

SEQ ID NO: 2327422 - protein, 31 aa, Cryptosporidium parvum
EKREQKRKRRSESEYSQYNSKLRSKSETIQI

SEQ ID NO: 2327423 - protein, 9 aa, Cryptosporidium parvum
EKRSDLSKQ

SEQ ID NO: 2327424 - protein, 13 aa, Cryptosporidium parvum
EKSAEEKKTEMIE

SEQ ID NO: 2327425 - protein, 18 aa, Cryptosporidium parvum
EKSDVRPFEETEEEKNMH

SEQ ID NO: 2327426 - protein, 19 aa, Cryptosporidium parvum
EKSIKAEISNSEWNSLGDS

SEQ ID NO: 2327427 - protein, 13 aa, Cryptosporidium parvum
EKSKQLSEKEKEI

SEQ ID NO: 2327428 - protein, 10 aa, Cryptosporidium parvum
EKSKSSTDYE

SEQ ID NO: 2327429 - protein, 11 aa, Cryptosporidium parvum
EKSLSNPKDES

SEQ ID NO: 2327430 - protein, 13 aa, Cryptosporidium parvum
EKSPSDPKGPLRR

SEQ ID NO: 2327431 - protein, 6 aa, Cryptosporidium parvum
EKSSLK

SEQ ID NO: 2327432 - protein, 11 aa, Cryptosporidium parvum
EKSSSIGERST

SEQ ID NO: 2327433 - protein, 11 aa, Cryptosporidium parvum
EKSTRRNDPNE

SEQ ID NO: 2327434 - protein, 16 aa, Cryptosporidium parvum
EKTGDASIAGSPQCGP

SEQ ID NO: 2327435 - protein, 10 aa, Cryptosporidium parvum
EKTLDGNENV

SEQ ID NO: 2327436 - protein, 6 aa, Cryptosporidium parvum
EKVEPE

SEQ ID NO: 2327437 - protein, 14 aa, Cryptosporidium parvum
EKYNKKKSWRKKTR

SEQ ID NO: 2327438 - protein, 18 aa, Cryptosporidium parvum
ELANSGSYSTSTPTFEDV

SEQ ID NO: 2327439 - protein, 26 aa, Cryptosporidium parvum
ELDGADESVSELPDISEEPSPLPEFE

SEQ ID NO: 2327440 - protein, 7 aa, Cryptosporidium parvum
ELDGRYN

SEQ ID NO: 2327441 - protein, 5 aa, Cryptosporidium parvum
ELDKR

SEQ ID NO: 2327442 - protein, 6 aa, Cryptosporidium parvum
ELEAPR

SEQ ID NO: 2327443 - protein, 8 aa, Cryptosporidium parvum
ELEEKRKH

SEQ ID NO: 2327444 - protein, 18 aa, Cryptosporidium parvum
ELEENNKNLYEDPNLDEA

SEQ ID NO: 2327445 - protein, 8 aa, Cryptosporidium parvum
ELEKNYSR

SEQ ID NO: 2327446 - protein, 12 aa, Cryptosporidium parvum
ELEPNNQPCKGF

SEQ ID NO: 2327447 - protein, 11 aa, Cryptosporidium parvum
ELESEIKGSME

SEQ ID NO: 2327448 - protein, 10 aa, Cryptosporidium parvum
ELGNSGKSDK

SEQ ID NO: 2327449 - protein, 9 aa, Cryptosporidium parvum
ELGSKRKGK

SEQ ID NO: 2327450 - protein, 6 aa, Cryptosporidium parvum
ELKEEY

SEQ ID NO: 2327451 - protein, 5 aa, Cryptosporidium parvum
ELKEK

SEQ ID NO: 2327452 - protein, 47 aa, Cryptosporidium parvum
ELKKTNSSNSKLRSLEEDLKKKERQNNSLSSTLSQKEKTISEQKAEI

SEQ ID NO: 2327453 - protein, 4 aa, Cryptosporidium parvum
ELKN

SEQ ID NO: 2327454 - protein, 7 aa, Cryptosporidium parvum
ELKPRKY

SEQ ID NO: 2327455 - protein, 26 aa, Cryptosporidium parvum
ELKTEDSIGKRNIRSHPNNAKNSKLP

SEQ ID NO: 2327456 - protein, 11 aa, Cryptosporidium parvum
ELNSKSKVKHE

SEQ ID NO: 2327457 - protein, 5 aa, Cryptosporidium parvum
ELPEY

SEQ ID NO: 2327458 - protein, 6 aa, Cryptosporidium parvum
ELPHET

SEQ ID NO: 2327459 - protein, 6 aa, Cryptosporidium parvum
ELPQDI

SEQ ID NO: 2327460 - protein, 9 aa, Cryptosporidium parvum
ELRKTEKPT

SEQ ID NO: 2327461 - protein, 8 aa, Cryptosporidium parvum
ELSDDEKK

SEQ ID NO: 2327462 - protein, 5 aa, Cryptosporidium parvum
ELSDK

SEQ ID NO: 2327463 - protein, 5 aa, Cryptosporidium parvum
ELSEE

SEQ ID NO: 2327464 - protein, 12 aa, Cryptosporidium parvum
ELSEQGIGGELS

SEQ ID NO: 2327465 - protein, 8 aa, Cryptosporidium parvum
ELSESEKL

SEQ ID NO: 2327466 - protein, 10 aa, Cryptosporidium parvum
ELSGTASSTM

SEQ ID NO: 2327467 - protein, 21 aa, Cryptosporidium parvum
ELSISTEEANVNESAPESEHY

SEQ ID NO: 2327468 - protein, 39 aa, Cryptosporidium parvum
ELSKEQTKEREKRAKELQEKNQKEKEEKRQKEKEEEERL

SEQ ID NO: 2327469 - protein, 11 aa, Cryptosporidium parvum
ELSNDNDNDII

SEQ ID NO: 2327470 - protein, 6 aa, Cryptosporidium parvum
ELSNKE

SEQ ID NO: 2327471 - protein, 6 aa, Cryptosporidium parvum
ELSNSS

SEQ ID NO: 2327472 - protein, 7 aa, Cryptosporidium parvum
ELSPDDA

SEQ ID NO: 2327473 - protein, 6 aa, Cryptosporidium parvum
ELSTHS

SEQ ID NO: 2327474 - protein, 5 aa, Cryptosporidium parvum
ELTDS

SEQ ID NO: 2327475 - protein, 10 aa, Cryptosporidium parvum
ELTKESSIKV

SEQ ID NO: 2327476 - protein, 7 aa, Cryptosporidium parvum
ELTPQHR

SEQ ID NO: 2327477 - protein, 6 aa, Cryptosporidium parvum
ELTQGE

SEQ ID NO: 2327478 - protein, 7 aa, Cryptosporidium parvum
EMGNNQL

SEQ ID NO: 2327479 - protein, 13 aa, Cryptosporidium parvum
EMKNTQSTSGKTL

SEQ ID NO: 2327480 - protein, 6 aa, Cryptosporidium parvum
EMSTGL

SEQ ID NO: 2327481 - protein, 8 aa, Cryptosporidium parvum
EMTSNTGG

SEQ ID NO: 2327482 - protein, 15 aa, Cryptosporidium parvum
ENAEGSDIKYEENNA

SEQ ID NO: 2327483 - protein, 7 aa, Cryptosporidium parvum
ENAGGLR

SEQ ID NO: 2327484 - protein, 9 aa, Cryptosporidium parvum
ENDKTSWES

SEQ ID NO: 2327485 - protein, 10 aa, Cryptosporidium parvum
ENDLPKDEFY

SEQ ID NO: 2327486 - protein, 14 aa, Cryptosporidium parvum
ENDSSYKYNKNPFT

SEQ ID NO: 2327487 - protein, 7 aa, Cryptosporidium parvum
ENDSVPN

SEQ ID NO: 2327488 - protein, 7 aa, Cryptosporidium parvum
ENDYAPI

SEQ ID NO: 2327489 - protein, 6 aa, Cryptosporidium parvum
ENECRN

SEQ ID NO: 2327490 - protein, 5 aa, Cryptosporidium parvum
ENEDI

SEQ ID NO: 2327491 - protein, 9 aa, Cryptosporidium parvum
ENEENNKNL

SEQ ID NO: 2327492 - protein, 8 aa, Cryptosporidium parvum
ENEHENNV

SEQ ID NO: 2327493 - protein, 6 aa, Cryptosporidium parvum
ENEHKL

SEQ ID NO: 2327494 - protein, 14 aa, Cryptosporidium parvum
ENEKIDEKGGNESL

SEQ ID NO: 2327495 - protein, 8 aa, Cryptosporidium parvum
ENENTLQK

SEQ ID NO: 2327496 - protein, 8 aa, Cryptosporidium parvum
ENERANNF

SEQ ID NO: 2327497 - protein, 22 aa, Cryptosporidium parvum
ENERENSQAKEEIKDLKSTKVS

SEQ ID NO: 2327498 - protein, 10 aa, Cryptosporidium parvum
ENEREQEAIE

SEQ ID NO: 2327499 - protein, 6 aa, Cryptosporidium parvum
ENFDGD

SEQ ID NO: 2327500 - protein, 16 aa, Cryptosporidium parvum
ENFNSKNVKGKYLGGG

SEQ ID NO: 2327501 - protein, 5 aa, Cryptosporidium parvum
ENGDR

SEQ ID NO: 2327502 - protein, 10 aa, Cryptosporidium parvum
ENGGESSKYE

SEQ ID NO: 2327503 - protein, 5 aa, Cryptosporidium parvum
ENGNR

SEQ ID NO: 2327504 - protein, 4 aa, Cryptosporidium parvum
ENGS

SEQ ID NO: 2327505 - protein, 6 aa, Cryptosporidium parvum
ENGTDE

SEQ ID NO: 2327506 - protein, 7 aa, Cryptosporidium parvum
ENHESER

SEQ ID NO: 2327507 - protein, 12 aa, Cryptosporidium parvum
ENICKEDETGKF

SEQ ID NO: 2327508 - protein, 5 aa, Cryptosporidium parvum
ENIPN

SEQ ID NO: 2327509 - protein, 6 aa, Cryptosporidium parvum
ENIPQN

SEQ ID NO: 2327510 - protein, 4 aa, Cryptosporidium parvum
ENKE

SEQ ID NO: 2327511 - protein, 8 aa, Cryptosporidium parvum
ENKEEGEV

SEQ ID NO: 2327512 - protein, 20 aa, Cryptosporidium parvum
ENKFKEKKKKKLPNKLKEPE

SEQ ID NO: 2327513 - protein, 10 aa, Cryptosporidium parvum
ENKGNENVNI

SEQ ID NO: 2327514 - protein, 6 aa, Cryptosporidium parvum
ENKGNL

SEQ ID NO: 2327515 - protein, 8 aa, Cryptosporidium parvum
ENKNNTEL

SEQ ID NO: 2327516 - protein, 6 aa, Cryptosporidium parvum
ENLGQN

SEQ ID NO: 2327517 - protein, 8 aa, Cryptosporidium parvum
ENLNDKEA

SEQ ID NO: 2327518 - protein, 5 aa, Cryptosporidium parvum
ENLNE

SEQ ID NO: 2327519 - protein, 6 aa, Cryptosporidium parvum
ENLPPE

SEQ ID NO: 2327520 - protein, 7 aa, Cryptosporidium parvum
ENLPSKK

SEQ ID NO: 2327521 - protein, 7 aa, Cryptosporidium parvum
ENLSQQL

SEQ ID NO: 2327522 - protein, 14 aa, Cryptosporidium parvum
ENNDENAPREQFTG

SEQ ID NO: 2327523 - protein, 15 aa, Cryptosporidium parvum
ENNEANSKAEDDYEK

SEQ ID NO: 2327524 - protein, 8 aa, Cryptosporidium parvum
ENNECTEE

SEQ ID NO: 2327525 - protein, 13 aa, Cryptosporidium parvum
ENNEFRDLEMIEN

SEQ ID NO: 2327526 - protein, 14 aa, Cryptosporidium parvum
ENNKGELDYETGKK

SEQ ID NO: 2327527 - protein, 4 aa, Cryptosporidium parvum
ENNL

SEQ ID NO: 2327528 - protein, 10 aa, Cryptosporidium parvum
ENNQEKNFQN

SEQ ID NO: 2327529 - protein, 4 aa, Cryptosporidium parvum
ENPA

SEQ ID NO: 2327530 - protein, 8 aa, Cryptosporidium parvum
ENPCENNR

SEQ ID NO: 2327531 - protein, 15 aa, Cryptosporidium parvum
ENPDQNLTEEKASQL

SEQ ID NO: 2327532 - protein, 7 aa, Cryptosporidium parvum
ENPFRTS

SEQ ID NO: 2327533 - protein, 5 aa, Cryptosporidium parvum
ENPND

SEQ ID NO: 2327534 - protein, 5 aa, Cryptosporidium parvum
ENPPF

SEQ ID NO: 2327535 - protein, 11 aa, Cryptosporidium parvum
ENPPNKETQIE

SEQ ID NO: 2327536 - protein, 7 aa, Cryptosporidium parvum
ENPSEFA

SEQ ID NO: 2327537 - protein, 11 aa, Cryptosporidium parvum
ENPSEKFEDGT

SEQ ID NO: 2327538 - protein, 13 aa, Cryptosporidium parvum
ENPSLRGGNSGSI

SEQ ID NO: 2327539 - protein, 7 aa, Cryptosporidium parvum
ENQESSF

SEQ ID NO: 2327540 - protein, 6 aa, Cryptosporidium parvum
ENQIDQ

SEQ ID NO: 2327541 - protein, 5 aa, Cryptosporidium parvum
ENQLP

SEQ ID NO: 2327542 - protein, 8 aa, Cryptosporidium parvum
ENQSEKPF

SEQ ID NO: 2327543 - protein, 17 aa, Cryptosporidium parvum
ENQSKPPESEESSNLHK

SEQ ID NO: 2327544 - protein, 5 aa, Cryptosporidium parvum
ENQVD

SEQ ID NO: 2327545 - protein, 7 aa, Cryptosporidium parvum
ENRDKTI

SEQ ID NO: 2327546 - protein, 10 aa, Cryptosporidium parvum
ENREKTQLRP

SEQ ID NO: 2327547 - protein, 9 aa, Cryptosporidium parvum
ENRLEEKEN

SEQ ID NO: 2327548 - protein, 6 aa, Cryptosporidium parvum
ENRNSQ

SEQ ID NO: 2327549 - protein, 5 aa, Cryptosporidium parvum
ENSDV

SEQ ID NO: 2327550 - protein, 4 aa, Cryptosporidium parvum
ENSE

SEQ ID NO: 2327551 - protein, 11 aa, Cryptosporidium parvum
ENSERNQDMET

SEQ ID NO: 2327552 - protein, 8 aa, Cryptosporidium parvum
ENSGASFN

SEQ ID NO: 2327553 - protein, 10 aa, Cryptosporidium parvum
ENSNRPELTS

SEQ ID NO: 2327554 - protein, 8 aa, Cryptosporidium parvum
ENSRIPND

SEQ ID NO: 2327555 - protein, 7 aa, Cryptosporidium parvum
ENSSISD

SEQ ID NO: 2327556 - protein, 7 aa, Cryptosporidium parvum
ENTENSK

SEQ ID NO: 2327557 - protein, 7 aa, Cryptosporidium parvum
ENTGIQG

SEQ ID NO: 2327558 - protein, 11 aa, Cryptosporidium parvum
ENTQYSNGIPS

SEQ ID NO: 2327559 - protein, 51 aa, Cryptosporidium parvum
ENTTGGKRKQAKKNKNNKKKVEEKHQRELRQKEEIDDKESGDENKNQNYSS

SEQ ID NO: 2327560 - protein, 6 aa, Cryptosporidium parvum
ENTTNA

SEQ ID NO: 2327561 - protein, 23 aa, Cryptosporidium parvum
ENVGETQKSASPAVHQEASSGVH

SEQ ID NO: 2327562 - protein, 7 aa, Cryptosporidium parvum
ENVTYKN

SEQ ID NO: 2327563 - protein, 14 aa, Cryptosporidium parvum
ENYESSNLETSSRT

SEQ ID NO: 2327564 - protein, 6 aa, Cryptosporidium parvum
ENYPLS

SEQ ID NO: 2327565 - protein, 4 aa, Cryptosporidium parvum
ENYQ

SEQ ID NO: 2327566 - protein, 11 aa, Cryptosporidium parvum
ENYSPEKTIKQ

SEQ ID NO: 2327567 - protein, 7 aa, Cryptosporidium parvum
EPALSQS

SEQ ID NO: 2327568 - protein, 24 aa, Cryptosporidium parvum
EPDYDANDPEGEYRKSPNTKSAIR

SEQ ID NO: 2327569 - protein, 8 aa, Cryptosporidium parvum
EPERTLTK

SEQ ID NO: 2327570 - protein, 10 aa, Cryptosporidium parvum
EPGKGEESIK

SEQ ID NO: 2327571 - protein, 4 aa, Cryptosporidium parvum
EPIN

SEQ ID NO: 2327572 - protein, 8 aa, Cryptosporidium parvum
EPKLRSEP

SEQ ID NO: 2327573 - protein, 17 aa, Cryptosporidium parvum
EPKSRGGISVKSDGKFE

SEQ ID NO: 2327574 - protein, 7 aa, Cryptosporidium parvum
EPKTTLE

SEQ ID NO: 2327575 - protein, 9 aa, Cryptosporidium parvum
EPKTTNSMT

SEQ ID NO: 2327576 - protein, 12 aa, Cryptosporidium parvum
EPKYNNSDSELN

SEQ ID NO: 2327577 - protein, 19 aa, Cryptosporidium parvum
EPNFPNDINADGTSPLSEN

SEQ ID NO: 2327578 - protein, 4 aa, Cryptosporidium parvum
EPNK

SEQ ID NO: 2327579 - protein, 12 aa, Cryptosporidium parvum
EPNKTIENPLSN

SEQ ID NO: 2327580 - protein, 7 aa, Cryptosporidium parvum
EPPSYRC

SEQ ID NO: 2327581 - protein, 8 aa, Cryptosporidium parvum
EPQEREKL

SEQ ID NO: 2327582 - protein, 7 aa, Cryptosporidium parvum
EPQTRES

SEQ ID NO: 2327583 - protein, 8 aa, Cryptosporidium parvum
EPREGEKI

SEQ ID NO: 2327584 - protein, 6 aa, Cryptosporidium parvum
EPRKVN

SEQ ID NO: 2327585 - protein, 5 aa, Cryptosporidium parvum
EPRTV

SEQ ID NO: 2327586 - protein, 10 aa, Cryptosporidium parvum
EPSKDPSLSQ

SEQ ID NO: 2327587 - protein, 13 aa, Cryptosporidium parvum
EPTDGQAKVVTSQ

SEQ ID NO: 2327588 - protein, 8 aa, Cryptosporidium parvum
EQADVKSE

SEQ ID NO: 2327589 - protein, 12 aa, Cryptosporidium parvum
EQDEPTTSTSTG

SEQ ID NO: 2327590 - protein, 9 aa, Cryptosporidium parvum
EQDESSYTS

SEQ ID NO: 2327591 - protein, 6 aa, Cryptosporidium parvum
EQFAEE

SEQ ID NO: 2327592 - protein, 6 aa, Cryptosporidium parvum
EQGASG

SEQ ID NO: 2327593 - protein, 8 aa, Cryptosporidium parvum
EQGEEVPE

SEQ ID NO: 2327594 - protein, 5 aa, Cryptosporidium parvum
EQGPV

SEQ ID NO: 2327595 - protein, 10 aa, Cryptosporidium parvum
EQGSQNFNQP

SEQ ID NO: 2327596 - protein, 8 aa, Cryptosporidium parvum
EQIGQCGE

SEQ ID NO: 2327597 - protein, 6 aa, Cryptosporidium parvum
EQINGG

SEQ ID NO: 2327598 - protein, 4 aa, Cryptosporidium parvum
EQKY

SEQ ID NO: 2327599 - protein, 4 aa, Cryptosporidium parvum
EQLP

SEQ ID NO: 2327600 - protein, 7 aa, Cryptosporidium parvum
EQNELGD

SEQ ID NO: 2327601 - protein, 9 aa, Cryptosporidium parvum
EQNKASSLD

SEQ ID NO: 2327602 - protein, 11 aa, Cryptosporidium parvum
EQNTPPIAGRK

SEQ ID NO: 2327603 - protein, 9 aa, Cryptosporidium parvum
EQNVTSDTD

SEQ ID NO: 2327604 - protein, 39 aa, Cryptosporidium parvum
EQQEGEEPIEGNKKSKKDKKAKKDKKDKKSKKSKKDENG

SEQ ID NO: 2327605 - protein, 9 aa, Cryptosporidium parvum
EQQKNSRRL

SEQ ID NO: 2327606 - protein, 6 aa, Cryptosporidium parvum
EQQQSI

SEQ ID NO: 2327607 - protein, 8 aa, Cryptosporidium parvum
EQQSQFNP

SEQ ID NO: 2327608 - protein, 13 aa, Cryptosporidium parvum
EQSGSYKEDPERM

SEQ ID NO: 2327609 - protein, 6 aa, Cryptosporidium parvum
EQSKRN

SEQ ID NO: 2327610 - protein, 16 aa, Cryptosporidium parvum
EQSNRSEFPESGSISS

SEQ ID NO: 2327611 - protein, 6 aa, Cryptosporidium parvum
EQTLYS

SEQ ID NO: 2327612 - protein, 6 aa, Cryptosporidium parvum
EQTSYQ

SEQ ID NO: 2327613 - protein, 8 aa, Cryptosporidium parvum
EQVRPEKQ

SEQ ID NO: 2327614 - protein, 14 aa, Cryptosporidium parvum
EQVSQNPEINPYAP

SEQ ID NO: 2327615 - protein, 5 aa, Cryptosporidium parvum
EQYKN

SEQ ID NO: 2327616 - protein, 8 aa, Cryptosporidium parvum
EQYNSKSA

SEQ ID NO: 2327617 - protein, 9 aa, Cryptosporidium parvum
ERDNANKAL

SEQ ID NO: 2327618 - protein, 46 aa, Cryptosporidium parvum
EREEMEKRKKQKEEKERKENREARRKLKEEKAGNKKPKKERTFPTV

SEQ ID NO: 2327619 - protein, 12 aa, Cryptosporidium parvum
EREKRRNRGKIN

SEQ ID NO: 2327620 - protein, 4 aa, Cryptosporidium parvum
EREN

SEQ ID NO: 2327621 - protein, 4 aa, Cryptosporidium parvum
EREQ

SEQ ID NO: 2327622 - protein, 30 aa, Cryptosporidium parvum; identical to SEQ ID NO: 2201817

SEQ ID NO: 2327623 - protein, 13 aa, Cryptosporidium parvum
ERINNNNNNYEEI

SEQ ID NO: 2327624 - protein, 12 aa, Cryptosporidium parvum
ERITTTKNGSIT

SEQ ID NO: 2327625 - protein, 8 aa, Cryptosporidium parvum
ERKESNKG

SEQ ID NO: 2327626 - protein, 15 aa, Cryptosporidium parvum
ERKNQTISSNSDALE

SEQ ID NO: 2327627 - protein, 12 aa, Cryptosporidium parvum
ERLPDKDPCNHP

SEQ ID NO: 2327628 - protein, 6 aa, Cryptosporidium parvum
ERNPEK

SEQ ID NO: 2327629 - protein, 6 aa, Cryptosporidium parvum
ERNRLE

SEQ ID NO: 2327630 - protein, 35 aa, Cryptosporidium parvum
ERQEQSKGRPSLRSLQEKSNNPEKAVSSDKKSEKG

SEQ ID NO: 2327631 - protein, 9 aa, Cryptosporidium parvum
ERQKSSISK

SEQ ID NO: 2327632 - protein, 9 aa, Cryptosporidium parvum
ERRGNDPKT

SEQ ID NO: 2327633 - protein, 5 aa, Cryptosporidium parvum
ERRSA

SEQ ID NO: 2327634 - protein, 7 aa, Cryptosporidium parvum
ERSKYNN

SEQ ID NO: 2327635 - protein, 7 aa, Cryptosporidium parvum
ERSPPKV

SEQ ID NO: 2327636 - protein, 4 aa, Cryptosporidium parvum
ERSQ

SEQ ID NO: 2327637 - protein, 5 aa, Cryptosporidium parvum
ERSQA

SEQ ID NO: 2327638 - protein, 11 aa, Cryptosporidium parvum
ERTDQTKTTQV

SEQ ID NO: 2327639 - protein, 7 aa, Cryptosporidium parvum
ESAIPRC

SEQ ID NO: 2327640 - protein, 8 aa, Cryptosporidium parvum
ESAPEGYE

SEQ ID NO: 2327641 - protein, 7 aa, Cryptosporidium parvum
ESCNNQQ

SEQ ID NO: 2327642 - protein, 4 aa, Cryptosporidium parvum
ESDF

SEQ ID NO: 2327643 - protein, 7 aa, Cryptosporidium parvum
ESEEGLT

SEQ ID NO: 2327644 - protein, 17 aa, Cryptosporidium parvum
ESEETTNEGYSDAESFS

SEQ ID NO: 2327645 - protein, 7 aa, Cryptosporidium parvum
ESEGNTL

SEQ ID NO: 2327646 - protein, 14 aa, Cryptosporidium parvum
ESEQKNGSSTLSKN

SEQ ID NO: 2327647 - protein, 7 aa, Cryptosporidium parvum
ESESPKE

SEQ ID NO: 2327648 - protein, 7 aa, Cryptosporidium parvum
ESETNSS

SEQ ID NO: 2327649 - protein, 13 aa, Cryptosporidium parvum
ESFGTGSDHIREK

SEQ ID NO: 2327650 - protein, 8 aa, Cryptosporidium parvum
ESFNSEDS

SEQ ID NO: 2327651 - protein, 8 aa, Cryptosporidium parvum
ESGNGECI

SEQ ID NO: 2327652 - protein, 5 aa, Cryptosporidium parvum
ESHNT

SEQ ID NO: 2327653 - protein, 9 aa, Cryptosporidium parvum
ESIGNKDDA

SEQ ID NO: 2327654 - protein, 9 aa, Cryptosporidium parvum
ESIKNTTIN

SEQ ID NO: 2327655 - protein, 15 aa, Cryptosporidium parvum
ESIKTNSGKGKCEAV

SEQ ID NO: 2327656 - protein, 6 aa, Cryptosporidium parvum
ESISKI

SEQ ID NO: 2327657 - protein, 7 aa, Cryptosporidium parvum
ESISPNQ

SEQ ID NO: 2327658 - protein, 5 aa, Cryptosporidium parvum
ESISQ

SEQ ID NO: 2327659 - protein, 9 aa, Cryptosporidium parvum
ESKEGMAKM

SEQ ID NO: 2327660 - protein, 9 aa, Cryptosporidium parvum
ESKGYRESR

SEQ ID NO: 2327661 - protein, 6 aa, Cryptosporidium parvum
ESKKNC

SEQ ID NO: 2327662 - protein, 7 aa, Cryptosporidium parvum
ESKKSTT

SEQ ID NO: 2327663 - protein, 6 aa, Cryptosporidium parvum
ESKNIT

SEQ ID NO: 2327664 - protein, 14 aa, Cryptosporidium parvum
ESKQIEEKANSAYK

SEQ ID NO: 2327665 - protein, 15 aa, Cryptosporidium parvum
ESKSSEDESSRNESE

SEQ ID NO: 2327666 - protein, 5 aa, Cryptosporidium parvum
ESLIE

SEQ ID NO: 2327667 - protein, 7 aa, Cryptosporidium parvum
ESNAESY

SEQ ID NO: 2327668 - protein, 8 aa, Cryptosporidium parvum
ESNHKLPT

SEQ ID NO: 2327669 - protein, 9 aa, Cryptosporidium parvum
ESNKSPRIG

SEQ ID NO: 2327670 - protein, 16 aa, Cryptosporidium parvum
ESNKTCSSEEKYDPKR

SEQ ID NO: 2327671 - protein, 7 aa, Cryptosporidium parvum
ESNMEKK

SEQ ID NO: 2327672 - protein, 7 aa, Cryptosporidium parvum
ESNNENL

SEQ ID NO: 2327673 - protein, 11 aa, Cryptosporidium parvum
ESNNTRISDDG

SEQ ID NO: 2327674 - protein, 4 aa, Cryptosporidium parvum
ESNP

SEQ ID NO: 2327675 - protein, 4 aa, Cryptosporidium parvum
ESNQ

SEQ ID NO: 2327676 - protein, 10 aa, Cryptosporidium parvum
ESNTNIKGSN

SEQ ID NO: 2327677 - protein, 16 aa, Cryptosporidium parvum
ESNTSEDSTQTEKSKE

SEQ ID NO: 2327678 - protein, 10 aa, Cryptosporidium parvum
ESNYEENGAS

SEQ ID NO: 2327679 - protein, 4 aa, Cryptosporidium parvum
ESPR

SEQ ID NO: 2327680 - protein, 9 aa, Cryptosporidium parvum
ESPSDVTTL

SEQ ID NO: 2327681 - protein, 9 aa, Cryptosporidium parvum
ESPVNSPHP

SEQ ID NO: 2327682 - protein, 16 aa, Cryptosporidium parvum
ESQEEPENKEEFGNEN

SEQ ID NO: 2327683 - protein, 5 aa, Cryptosporidium parvum
ESRDE

SEQ ID NO: 2327684 - protein, 8 aa, Cryptosporidium parvum
ESRDQNRA

SEQ ID NO: 2327685 - protein, 4 aa, Cryptosporidium parvum
ESRE

SEQ ID NO: 2327686 - protein, 4 aa, Cryptosporidium parvum
ESRH

SEQ ID NO: 2327687 - protein, 4 aa, Cryptosporidium parvum
ESRK

SEQ ID NO: 2327688 - protein, 29 aa, Cryptosporidium parvum
ESRKDLSKDDNRTEGGSDSDTNECSHSDF

SEQ ID NO: 2327689 - protein, 7 aa, Cryptosporidium parvum
ESSEEAI

SEQ ID NO: 2327690 - protein, 5 aa, Cryptosporidium parvum
ESSIQ

SEQ ID NO: 2327691 - protein, 10 aa, Cryptosporidium parvum
ESSKPNSLIP

SEQ ID NO: 2327692 - protein, 8 aa, Cryptosporidium parvum
ESSLGEEY

SEQ ID NO: 2327693 - protein, 4 aa, Cryptosporidium parvum
ESSP

SEQ ID NO: 2327694 - protein, 5 aa, Cryptosporidium parvum
ESSRR

SEQ ID NO: 2327695 - protein, 9 aa, Cryptosporidium parvum
ESSSIEEIQ

SEQ ID NO: 2327696 - protein, 8 aa, Cryptosporidium parvum
ESSSPRTT

SEQ ID NO: 2327697 - protein, 7 aa, Cryptosporidium parvum
ESSTTRL

SEQ ID NO: 2327698 - protein, 5 aa, Cryptosporidium parvum
ESTDI

SEQ ID NO: 2327699 - protein, 10 aa, Cryptosporidium parvum
ESTDYSPPVS

SEQ ID NO: 2327700 - protein, 9 aa, Cryptosporidium parvum
ESTNSVDQL

SEQ ID NO: 2327701 - protein, 6 aa, Cryptosporidium parvum
ESTRSM

SEQ ID NO: 2327702 - protein, 6 aa, Cryptosporidium parvum
ESTSIT

SEQ ID NO: 2327703 - protein, 4 aa, Cryptosporidium parvum
ESVI

SEQ ID NO: 2327704 - protein, 14 aa, Cryptosporidium parvum
ESVISNQDNKEENK

SEQ ID NO: 2327705 - protein, 12 aa, Cryptosporidium parvum
ESVKPVTKVEEP

SEQ ID NO: 2327706 - protein, 6 aa, Cryptosporidium parvum
ESVSPT

SEQ ID NO: 2327707 - protein, 7 aa, Cryptosporidium parvum
ESYADPN

SEQ ID NO: 2327708 - protein, 7 aa, Cryptosporidium parvum
ESYSEEK

SEQ ID NO: 2327709 - protein, 14 aa, Cryptosporidium parvum
ESYVTNSKNASEGI

SEQ ID NO: 2327710 - protein, 30 aa, Cryptosporidium parvum
ETAGSSSKNSEAKAESIEPVNNGEEVDRDS

SEQ ID NO: 2327711 - protein, 7 aa, Cryptosporidium parvum
ETANGAF

SEQ ID NO: 2327712 - protein, 4 aa, Cryptosporidium parvum
ETAS

SEQ ID NO: 2327713 - protein, 19 aa, Cryptosporidium parvum
ETCPTRNQRTDQGDYEYEG

SEQ ID NO: 2327714 - protein, 8 aa, Cryptosporidium parvum
ETDKKSNN

SEQ ID NO: 2327715 - protein, 5 aa, Cryptosporidium parvum
ETDQK

SEQ ID NO: 2327716 - protein, 5 aa, Cryptosporidium parvum
ETDQL

SEQ ID NO: 2327717 - protein, 10 aa, Cryptosporidium parvum
ETDVNPRDGR

SEQ ID NO: 2327718 - protein, 12 aa, Cryptosporidium parvum
ETDVQRKHKDKL

SEQ ID NO: 2327719 - protein, 7 aa, Cryptosporidium parvum
ETEEENQ

SEQ ID NO: 2327720 - protein, 12 aa, Cryptosporidium parvum
ETEEKGTNNVNN

SEQ ID NO: 2327721 - protein, 4 aa, Cryptosporidium parvum
ETEK

SEQ ID NO: 2327722 - protein, 15 aa, Cryptosporidium parvum
ETEKGKMELSEESKS

SEQ ID NO: 2327723 - protein, 10 aa, Cryptosporidium parvum
ETETNLEKNE

SEQ ID NO: 2327724 - protein, 9 aa, Cryptosporidium parvum
ETETTETYY

SEQ ID NO: 2327725 - protein, 7 aa, Cryptosporidium parvum
ETFLESK

SEQ ID NO: 2327726 - protein, 4 aa, Cryptosporidium parvum
ETFQ

SEQ ID NO: 2327727 - protein, 39 aa, Cryptosporidium parvum
ETGDNLNSGDSNSFGNSSFKGLNNVDNDDFEAGSEKGID

SEQ ID NO: 2327728 - protein, 10 aa, Cryptosporidium parvum
ETGGLDPVTE

SEQ ID NO: 2327729 - protein, 13 aa, Cryptosporidium parvum
ETGKKKRPKTTKY

SEQ ID NO: 2327730 - protein, 7 aa, Cryptosporidium parvum
ETGNTAR

SEQ ID NO: 2327731 - protein, 8 aa, Cryptosporidium parvum
ETIPGSNL

SEQ ID NO: 2327732 - protein, 9 aa, Cryptosporidium parvum
ETISKRGTN

SEQ ID NO: 2327733 - protein, 5 aa, Cryptosporidium parvum
ETKFK

SEQ ID NO: 2327734 - protein, 8 aa, Cryptosporidium parvum
ETKIENEV

SEQ ID NO: 2327735 - protein, 5 aa, Cryptosporidium parvum
ETKSD

SEQ ID NO: 2327736 - protein, 9 aa, Cryptosporidium parvum
ETKTNQFNS

SEQ ID NO: 2327737 - protein, 8 aa, Cryptosporidium parvum
ETLPKGSE

SEQ ID NO: 2327738 - protein, 9 aa, Cryptosporidium parvum
ETLSSKYTN

SEQ ID NO: 2327739 - protein, 4 aa, Cryptosporidium parvum
ETLT

SEQ ID NO: 2327740 - protein, 6 aa, Cryptosporidium parvum
ETNGKI

SEQ ID NO: 2327741 - protein, 11 aa, Cryptosporidium parvum
ETNLSNLETQN

SEQ ID NO: 2327742 - protein, 8 aa, Cryptosporidium parvum
ETNLSPDS

SEQ ID NO: 2327743 - protein, 5 aa, Cryptosporidium parvum
ETNNT

SEQ ID NO: 2327744 - protein, 6 aa, Cryptosporidium parvum
ETNQSI

SEQ ID NO: 2327745 - protein, 7 aa, Cryptosporidium parvum
ETNSPNY

SEQ ID NO: 2327746 - protein, 8 aa, Cryptosporidium parvum
ETPERPQL

SEQ ID NO: 2327747 - protein, 5 aa, Cryptosporidium parvum
ETPFG

SEQ ID NO: 2327748 - protein, 4 aa, Cryptosporidium parvum
ETPK

SEQ ID NO: 2327749 - protein, 5 aa, Cryptosporidium parvum
ETPTD

SEQ ID NO: 2327750 - protein, 13 aa, Cryptosporidium parvum
ETPWTPSDDTSWG

SEQ ID NO: 2327751 - protein, 9 aa, Cryptosporidium parvum
ETQKQGAVS

SEQ ID NO: 2327752 - protein, 17 aa, Cryptosporidium parvum
ETRSKSNAKSDSNDTCN

SEQ ID NO: 2327753 - protein, 14 aa, Cryptosporidium parvum
ETSDDLEKKEVAGK

SEQ ID NO: 2327754 - protein, 7 aa, Cryptosporidium parvum
ETSIDGR

SEQ ID NO: 2327755 - protein, 7 aa, Cryptosporidium parvum
ETSKEIT

SEQ ID NO: 2327756 - protein, 8 aa, Cryptosporidium parvum
ETSKTNLN

SEQ ID NO: 2327757 - protein, 4 aa, Cryptosporidium parvum
ETSS

SEQ ID NO: 2327758 - protein, 13 aa, Cryptosporidium parvum
ETSTKEQASEMGE

SEQ ID NO: 2327759 - protein, 12 aa, Cryptosporidium parvum
ETTKANDTNSHK

SEQ ID NO: 2327760 - protein, 9 aa, Cryptosporidium parvum
ETTKKADGV

SEQ ID NO: 2327761 - protein, 13 aa, Cryptosporidium parvum
ETTLSKTPDTQIK

SEQ ID NO: 2327762 - protein, 4 aa, Cryptosporidium parvum
ETYI

SEQ ID NO: 2327763 - protein, 10 aa, Cryptosporidium parvum
ETYNSQGGHY

SEQ ID NO: 2327764 - protein, 12 aa, Cryptosporidium parvum
ETYYDSTERYRP

SEQ ID NO: 2327765 - protein, 5 aa, Cryptosporidium parvum
EVANK

SEQ ID NO: 2327766 - protein, 13 aa, Cryptosporidium parvum
EVAPDESEVDSEL

SEQ ID NO: 2327767 - protein, 14 aa, Cryptosporidium parvum
EVASGASIRNEGIQ

SEQ ID NO: 2327768 - protein, 4 aa, Cryptosporidium parvum
EVDP

SEQ ID NO: 2327769 - protein, 10 aa, Cryptosporidium parvum
EVDSESSENN

SEQ ID NO: 2327770 - protein, 28 aa, Cryptosporidium parvum
EVEIPTSVNPNEEFSNPESKYSEQSRSL

SEQ ID NO: 2327771 - protein, 7 aa, Cryptosporidium parvum
EVGKGVK

SEQ ID NO: 2327772 - protein, 9 aa, Cryptosporidium parvum
EVKPNNSVD

SEQ ID NO: 2327773 - protein, 8 aa, Cryptosporidium parvum
EVNGTDSI

SEQ ID NO: 2327774 - protein, 11 aa, Cryptosporidium parvum
EVNYGNSENNV

SEQ ID NO: 2327775 - protein, 4 aa, Cryptosporidium parvum
EVSD

SEQ ID NO: 2327776 - protein, 6 aa, Cryptosporidium parvum
EVSEEN

SEQ ID NO: 2327777 - protein, 6 aa, Cryptosporidium parvum
EVSERE

SEQ ID NO: 2327778 - protein, 11 aa, Cryptosporidium parvum
EVSSESGATGK

SEQ ID NO: 2327779 - protein, 22 aa, Cryptosporidium parvum
EVSTKETNELPDLANNKELNDI

SEQ ID NO: 2327780 - protein, 8 aa, Cryptosporidium parvum
EWTKQEED

SEQ ID NO: 2327781 - protein, 13 aa, Cryptosporidium parvum
EYDEEKDEKRGSN

SEQ ID NO: 2327782 - protein, 8 aa, Cryptosporidium parvum
EYDQGKNL

SEQ ID NO: 2327783 - protein, 12 aa, Cryptosporidium parvum
EYEDNGQKKTIT

SEQ ID NO: 2327784 - protein, 17 aa, Cryptosporidium parvum
EYEEEDDGEEKEEGKKR

SEQ ID NO: 2327785 - protein, 9 aa, Cryptosporidium parvum
EYHDGTKCG

SEQ ID NO: 2327786 - protein, 11 aa, Cryptosporidium parvum
EYKWETNDGLQ

SEQ ID NO: 2327787 - protein, 22 aa, Cryptosporidium parvum
EYNGGNASFPASRTQYPADPNH

SEQ ID NO: 2327788 - protein, 7 aa, Cryptosporidium parvum
EYNPTAT

SEQ ID NO: 2327789 - protein, 9 aa, Cryptosporidium parvum
EYNQSEGYN

SEQ ID NO: 2327790 - protein, 5 aa, Cryptosporidium parvum
EYPYA

SEQ ID NO: 2327791 - protein, 8 aa, Cryptosporidium parvum
EYSDLSNK

SEQ ID NO: 2327792 - protein, 18 aa, Cryptosporidium parvum
EYSESRKGYYKDQEGRPV

SEQ ID NO: 2327793 - protein, 9 aa, Cryptosporidium parvum
EYSRPDPPQ

SEQ ID NO: 2327794 - protein, 4 aa, Cryptosporidium parvum
EYSS

SEQ ID NO: 2327795 - protein, 4 aa, Cryptosporidium parvum
EYTP

SEQ ID NO: 2327796 - protein, 6 aa, Cryptosporidium parvum
EYYGSS

SEQ ID NO: 2327797 - protein, 13 aa, Cryptosporidium parvum
FADNEAQDNSNLS

SEQ ID NO: 2327798 - protein, 9 aa, Cryptosporidium parvum
FAKQDLKSG

SEQ ID NO: 2327799 - protein, 20 aa, Cryptosporidium parvum
FAQEKNDQTSSIQVKQSESI

SEQ ID NO: 2327800 - protein, 4 aa, Cryptosporidium parvum
FAQP

SEQ ID NO: 2327801 - protein, 50 aa, Cryptosporidium parvum
FAQPSNSLRRNSSLNPINSNSGHYDTDCDSGDLGDSDSDGSDSSSLFPTE

SEQ ID NO: 2327802 - protein, 9 aa, Cryptosporidium parvum
FAQSQSYGL

SEQ ID NO: 2327803 - protein, 52 aa, Cryptosporidium parvum
FASDSEESKGASSSRNSESEPEPASVASSENESQMTKPDQGIEPTVEESSTE

SEQ ID NO: 2327804 - protein, 7 aa, Cryptosporidium parvum
FASDTNI

SEQ ID NO: 2327805 - protein, 4 aa, Cryptosporidium parvum
FAST

SEQ ID NO: 2327806 - protein, 6 aa, Cryptosporidium parvum
FCSETD

SEQ ID NO: 2327807 - protein, 21 aa, Cryptosporidium parvum
FDDSPPEGLPNAPKTTSPEGV

SEQ ID NO: 2327808 - protein, 5 aa, Cryptosporidium parvum
FDPEE

SEQ ID NO: 2327809 - protein, 10 aa, Cryptosporidium parvum
FDPQNEPNLN

SEQ ID NO: 2327810 - protein, 6 aa, Cryptosporidium parvum
FEDYDK

SEQ ID NO: 2327811 - protein, 61 aa, Cryptosporidium parvum
FEEDTEVNKNEEDEPRTKEPDTQLDDTAPSPSRTSSYERSSITGENTDPTDMKTSTFDISA

SEQ ID NO: 2327812 - protein, 6 aa, Cryptosporidium parvum
FEEEYS

SEQ ID NO: 2327813 - protein, 8 aa, Cryptosporidium parvum
FEGDPRDL

SEQ ID NO: 2327814 - protein, 9 aa, Cryptosporidium parvum
FEGSEKSSH

SEQ ID NO: 2327815 - protein, 14 aa, Cryptosporidium parvum
FEGSGEQKLNQEPG

SEQ ID NO: 2327816 - protein, 20 aa, Cryptosporidium parvum
FEHSSESWSSITSARRKMKA

SEQ ID NO: 2327817 - protein, 4 aa, Cryptosporidium parvum
FEKP

SEQ ID NO: 2327818 - protein, 15 aa, Cryptosporidium parvum
FENFKNSTSNETEVD

SEQ ID NO: 2327819 - protein, 87 aa, Cryptosporidium parvum
FEPSEKKEDDNKKEEKDDKKDDDNKKDDEKAEEGESSSEKKDSSESEETSESSGSETSKSSKSDDVDSAMGAQDSASVHASEEEEEE

SEQ ID NO: 2327820 - protein, 18 aa, Cryptosporidium parvum
FEQQASHDGHPFTTNQSS

SEQ ID NO: 2327821 - protein, 6 aa, Cryptosporidium parvum
FERSGQ

SEQ ID NO: 2327822 - protein, 10 aa, Cryptosporidium parvum
FESDSYKENL

SEQ ID NO: 2327823 - protein, 27 aa, Cryptosporidium parvum
FESNRNGNSKYAKISNNEEKDDESADS

SEQ ID NO: 2327824 - protein, 5 aa, Cryptosporidium parvum
FESSI

SEQ ID NO: 2327825 - protein, 7 aa, Cryptosporidium parvum
FESTGEH

SEQ ID NO: 2327826 - protein, 18 aa, Cryptosporidium parvum
FETSNDKGSSEPLPDGAS

SEQ ID NO: 2327827 - protein, 9 aa, Cryptosporidium parvum
FETSTGSKR

SEQ ID NO: 2327828 - protein, 14 aa, Cryptosporidium parvum
FGANGGSFADESEA

SEQ ID NO: 2327829 - protein, 10 aa, Cryptosporidium parvum
FGASSKLNDE

SEQ ID NO: 2327830 - protein, 6 aa, Cryptosporidium parvum
FGEDGL

SEQ ID NO: 2327831 - protein, 10 aa, Cryptosporidium parvum
FGEKPGSFTS

SEQ ID NO: 2327832 - protein, 10 aa, Cryptosporidium parvum
FGEPGPSIRE

SEQ ID NO: 2327833 - protein, 11 aa, Cryptosporidium parvum
FGGNEDYNYNS

SEQ ID NO: 2327834 - protein, 50 aa, Cryptosporidium parvum
FGGSKKESEVTNREESVSVPAEESQKAAVESSVEEESEKPEELPDNNKGR

SEQ ID NO: 2327835 - protein, 8 aa, Cryptosporidium parvum
FGGSKSKA

SEQ ID NO: 2327836 - protein, 8 aa, Cryptosporidium parvum
FGNSESKI

SEQ ID NO: 2327837 - protein, 76 aa, Cryptosporidium parvum
FGPPIPVPTTSTSTTSTSSTSTSTTTTTTTTTTTTTTTTTTTTTTTTTTTTTTTTTTEVAESARIQNPNSRRLMVR

SEQ ID NO: 2327838 - protein, 6 aa, Cryptosporidium parvum
FGPTVG

SEQ ID NO: 2327839 - protein, 11 aa, Cryptosporidium parvum
FGQGDTNDEVE

SEQ ID NO: 2327840 - protein, 89 aa, Cryptosporidium parvum
FGQRPPSPPHPPPSSGSFTPPPPPPPPPPPPPPPPPPPPPSYTSPSNGIPSHIPTRENENWNPGPTVDKTSQWGSSQLGPKSSRRPLTK

SEQ ID NO: 2327841 - protein, 52 aa, Cryptosporidium parvum
FGQRPPSPPHPPPSSGSSAPPPPPHSPPPPPPPPPPSSPPSPPPSPPPYTPL

SEQ ID NO: 2327842 - protein, 7 aa, Cryptosporidium parvum
FGSDSST

SEQ ID NO: 2327843 - protein, 12 aa, Cryptosporidium parvum
FGSENEENPRKL

SEQ ID NO: 2327844 - protein, 7 aa, Cryptosporidium parvum
FGSGGNI

SEQ ID NO: 2327845 - protein, 4 aa, Cryptosporidium parvum
FGSH

SEQ ID NO: 2327846 - protein, 6 aa, Cryptosporidium parvum
FGSRDT

SEQ ID NO: 2327847 - protein, 12 aa, Cryptosporidium parvum
FGTEDSTRDPSS

SEQ ID NO: 2327848 - protein, 35 aa, Cryptosporidium parvum
FGTSENTPPGYHYNSTTSQFEKNEDHPNPDEINPF

SEQ ID NO: 2327849 - protein, 10 aa, Cryptosporidium parvum
FKGPYKTPVA

SEQ ID NO: 2327850 - protein, 9 aa, Cryptosporidium parvum
FKGSEKSSH

SEQ ID NO: 2327851 - protein, 10 aa, Cryptosporidium parvum
FKKDTSEFDS

SEQ ID NO: 2327852 - protein, 6 aa, Cryptosporidium parvum
FKPPAL

SEQ ID NO: 2327853 - protein, 12 aa, Cryptosporidium parvum
FKQGGYKSTSDV

SEQ ID NO: 2327854 - protein, 9 aa, Cryptosporidium parvum
FKQTKIKKE

SEQ ID NO: 2327855 - protein, 4 aa, Cryptosporidium parvum
FKRV

SEQ ID NO: 2327856 - protein, 5 aa, Cryptosporidium parvum
FKTEN

SEQ ID NO: 2327857 - protein, 5 aa, Cryptosporidium parvum
FLGEQ

SEQ ID NO: 2327858 - protein, 5 aa, Cryptosporidium parvum
FNDAK

SEQ ID NO: 2327859 - protein, 8 aa, Cryptosporidium parvum
FNEPNSSL

SEQ ID NO: 2327860 - protein, 6 aa, Cryptosporidium parvum
FNEPSH

SEQ ID NO: 2327861 - protein, 4 aa, Cryptosporidium parvum
FNER

SEQ ID NO: 2327862 - protein, 4 aa, Cryptosporidium parvum
FNEV

SEQ ID NO: 2327863 - protein, 9 aa, Cryptosporidium parvum
FNKQESPVF

SEQ ID NO: 2327864 - protein, 4 aa, Cryptosporidium parvum
FNPE

SEQ ID NO: 2327865 - protein, 6 aa, Cryptosporidium parvum
FNPEEN

SEQ ID NO: 2327866 - protein, 11 aa, Cryptosporidium parvum
FNRGGGGFEPN

SEQ ID NO: 2327867 - protein, 10 aa, Cryptosporidium parvum
FNSEKPQNMN

SEQ ID NO: 2327868 - protein, 6 aa, Cryptosporidium parvum
FNSSSI

SEQ ID NO: 2327869 - protein, 4 aa, Cryptosporidium parvum
FNSV

SEQ ID NO: 2327870 - protein, 9 aa, Cryptosporidium parvum
FNTNNKEDL

SEQ ID NO: 2327871 - protein, 4 aa, Cryptosporidium parvum
FNTP

SEQ ID NO: 2327872 - protein, 13 aa, Cryptosporidium parvum
FPASRTSQPTETK

SEQ ID NO: 2327873 - protein, 9 aa, Cryptosporidium parvum
FPATHTDHR

SEQ ID NO: 2327874 - protein, 5 aa, Cryptosporidium parvum
FPDGS

SEQ ID NO: 2327875 - protein, 20 aa, Cryptosporidium parvum
FPDTGPKVSDEESNTESQEI

SEQ ID NO: 2327876 - protein, 7 aa, Cryptosporidium parvum
FPEDPDK

SEQ ID NO: 2327877 - protein, 5 aa, Cryptosporidium parvum
FPETN

SEQ ID NO: 2327878 - protein, 4 aa, Cryptosporidium parvum
FPGG

SEQ ID NO: 2327879 - protein, 4 aa, Cryptosporidium parvum
FPGR

SEQ ID NO: 2327880 - protein, 8 aa, Cryptosporidium parvum
FPGSDESK

SEQ ID NO: 2327881 - protein, 9 aa, Cryptosporidium parvum
FPGTKSPLN

SEQ ID NO: 2327882 - protein, 8 aa, Cryptosporidium parvum
FPKDGNDL

SEQ ID NO: 2327883 - protein, 6 aa, Cryptosporidium parvum
FPKPGS

SEQ ID NO: 2327884 - protein, 11 aa, Cryptosporidium parvum
FPKSRRGGKRI

SEQ ID NO: 2327885 - protein, 5 aa, Cryptosporidium parvum
FPNTV

SEQ ID NO: 2327886 - protein, 9 aa, Cryptosporidium parvum
FPPNPKYNK

SEQ ID NO: 2327887 - protein, 7 aa, Cryptosporidium parvum
FPPNYQS

SEQ ID NO: 2327888 - protein, 5 aa, Cryptosporidium parvum
FPPTS

SEQ ID NO: 2327889 - protein, 5 aa, Cryptosporidium parvum
FPPTV

SEQ ID NO: 2327890 - protein, 9 aa, Cryptosporidium parvum
FPQSPSSIG

SEQ ID NO: 2327891 - protein, 6 aa, Cryptosporidium parvum
FPSDKR

SEQ ID NO: 2327892 - protein, 4 aa, Cryptosporidium parvum
FPSK

SEQ ID NO: 2327893 - protein, 4 aa, Cryptosporidium parvum
FPTE

SEQ ID NO: 2327894 - protein, 6 aa, Cryptosporidium parvum
FPTSNN

SEQ ID NO: 2327895 - protein, 13 aa, Cryptosporidium parvum
FPTSNNKFSSISD

SEQ ID NO: 2327896 - protein, 12 aa, Cryptosporidium parvum
FPYSPKSSYTGV

SEQ ID NO: 2327897 - protein, 11 aa, Cryptosporidium parvum
FQANSSSSNSL

SEQ ID NO: 2327898 - protein, 10 aa, Cryptosporidium parvum
FQGGDKRTYL

SEQ ID NO: 2327899 - protein, 12 aa, Cryptosporidium parvum
FQNEKDYQESYR

SEQ ID NO: 2327900 - protein, 6 aa, Cryptosporidium parvum
FQNERD

SEQ ID NO: 2327901 - protein, 8 aa, Cryptosporidium parvum
FQSPSGEF

SEQ ID NO: 2327902 - protein, 15 aa, Cryptosporidium parvum
FQSSTTTPATECSEC

SEQ ID NO: 2327903 - protein, 12 aa, Cryptosporidium parvum
FQTYGGRDNRTF

SEQ ID NO: 2327904 - protein, 12 aa, Cryptosporidium parvum
FRDPAQRSRPST

SEQ ID NO: 2327905 - protein, 12 aa, Cryptosporidium parvum
FRDQGKKSKTEF

SEQ ID NO: 2327906 - protein, 4 aa, Cryptosporidium parvum
FRKD

SEQ ID NO: 2327907 - protein, 10 aa, Cryptosporidium parvum
FRNEDSANQL

SEQ ID NO: 2327908 - protein, 6 aa, Cryptosporidium parvum
FRTGNS

SEQ ID NO: 2327909 - protein, 4 aa, Cryptosporidium parvum
FRTN

SEQ ID NO: 2327910 - protein, 11 aa, Cryptosporidium parvum
FSDDEQTISDT

SEQ ID NO: 2327911 - protein, 13 aa, Cryptosporidium parvum
FSDNESQDSGSKP

SEQ ID NO: 2327912 - protein, 8 aa, Cryptosporidium parvum
FSDPSKEP

SEQ ID NO: 2327913 - protein, 15 aa, Cryptosporidium parvum
FSEENYKSKDSEISK

SEQ ID NO: 2327914 - protein, 14 aa, Cryptosporidium parvum
FSEEQEKNEETIKG

SEQ ID NO: 2327915 - protein, 9 aa, Cryptosporidium parvum
FSEGTPSFE

SEQ ID NO: 2327916 - protein, 18 aa, Cryptosporidium parvum
FSENDQLSKYEDNNKTNS

SEQ ID NO: 2327917 - protein, 21 aa, Cryptosporidium parvum
FSESTDEYQNNNVSQEVEPTG

SEQ ID NO: 2327918 - protein, 8 aa, Cryptosporidium parvum
FSETHPDS

SEQ ID NO: 2327919 - protein, 11 aa, Cryptosporidium parvum
FSETNVNNGTW

SEQ ID NO: 2327920 - protein, 10 aa, Cryptosporidium parvum
FSGNNSKIND

SEQ ID NO: 2327921 - protein, 10 aa, Cryptosporidium parvum
FSGTSDQDEC

SEQ ID NO: 2327922 - protein, 20 aa, Cryptosporidium parvum
FSKDGQDKETVEEKVARRRS

SEQ ID NO: 2327923 - protein, 15 aa, Cryptosporidium parvum
FSKNSETNKKKSQFD

SEQ ID NO: 2327924 - protein, 5 aa, Cryptosporidium parvum
FSKPE

SEQ ID NO: 2327925 - protein, 12 aa, Cryptosporidium parvum
FSKTPSELTTEG

SEQ ID NO: 2327926 - protein, 4 aa, Cryptosporidium parvum
FSND

SEQ ID NO: 2327927 - protein, 42 aa, Cryptosporidium parvum
FSNEGENKNNSQLQNTSTKKQNRVSLGGRKLAKGKSISKISQ

SEQ ID NO: 2327928 - protein, 9 aa, Cryptosporidium parvum
FSNKEKHAN

SEQ ID NO: 2327929 - protein, 8 aa, Cryptosporidium parvum
FSNMSQEG

SEQ ID NO: 2327930 - protein, 24 aa, Cryptosporidium parvum
FSPPPAPPPPPPLPGQSPTNSPSF

SEQ ID NO: 2327931 - protein, 46 aa, Cryptosporidium parvum
FSPPPSQEEIGSSFSSEDPDSLPSLPPPPPPVLPKPRRSVLRRVLN

SEQ ID NO: 2327932 - protein, 8 aa, Cryptosporidium parvum
FSQGGNNL

SEQ ID NO: 2327933 - protein, 20 aa, Cryptosporidium parvum
FSQKEGTNTHKKDQEGTPLS

SEQ ID NO: 2327934 - protein, 5 aa, Cryptosporidium parvum
FSQNS

SEQ ID NO: 2327935 - protein, 11 aa, Cryptosporidium parvum
FSQTPAPEVPL

SEQ ID NO: 2327936 - protein, 5 aa, Cryptosporidium parvum
FSSDP

SEQ ID NO: 2327937 - protein, 11 aa, Cryptosporidium parvum
FSSDTKPKKMR

SEQ ID NO: 2327938 - protein, 5 aa, Cryptosporidium parvum
FSSNG

SEQ ID NO: 2327939 - protein, 7 aa, Cryptosporidium parvum
FSSNRNN

SEQ ID NO: 2327940 - protein, 10 aa, Cryptosporidium parvum
FSTPGAPTTT

SEQ ID NO: 2327941 - protein, 12 aa, Cryptosporidium parvum
FTETGQTSTSPV

SEQ ID NO: 2327942 - protein, 4 aa, Cryptosporidium parvum
FTNS

SEQ ID NO: 2327943 - protein, 5 aa, Cryptosporidium parvum
FTPTK

SEQ ID NO: 2327944 - protein, 18 aa, Cryptosporidium parvum
FTPTQKRGPFSAKAETTE

SEQ ID NO: 2327945 - protein, 14 aa, Cryptosporidium parvum
FTRNNSRRRRRESR

SEQ ID NO: 2327946 - protein, 20 aa, Cryptosporidium parvum
FTRPQSNHHSDHAGHGHGHG

SEQ ID NO: 2327947 - protein, 11 aa, Cryptosporidium parvum
FTSPKNGGACT

SEQ ID NO: 2327948 - protein, 14 aa, Cryptosporidium parvum
FTSPSNSGSSSQLN

SEQ ID NO: 2327949 - protein, 10 aa, Cryptosporidium parvum
FTSSEYPKTE

SEQ ID NO: 2327950 - protein, 11 aa, Cryptosporidium parvum
FTTPSNNDTID

SEQ ID NO: 2327951 - protein, 8 aa, Cryptosporidium parvum
FVKSPYKN

SEQ ID NO: 2327952 - protein, 6 aa, Cryptosporidium parvum
FYPPGE

SEQ ID NO: 2327953 - protein, 6 aa, Cryptosporidium parvum
FYSTSD

SEQ ID NO: 2327954 - protein, 53 aa, Cryptosporidium parvum
GAAEPKENNEEKNNEEKKSEEKNDEKKPEEEKSSESSAAEKGKEAANSAKSLL

SEQ ID NO: 2327955 - protein, 4 aa, Cryptosporidium parvum
GAAI

SEQ ID NO: 2327956 - protein, 8 aa, Cryptosporidium parvum
GAANTQCR

SEQ ID NO: 2327957 - protein, 5 aa, Cryptosporidium parvum
GACPQ

SEQ ID NO: 2327958 - protein, 113 aa, Cryptosporidium parvum
GAGAGTGAGTGAGVGIGTGAGTGPEQGPGTGIKTGTKAEGTGTGPEQGTGTGTGTGTGTGTGTGTGTGTGTGTGTGTGTGTGTGTGTGTGTGTGTGTGTGTGTGTGTGTGAEI

SEQ ID NO: 2327959 - protein, 18 aa, Cryptosporidium parvum
GAGSRNEEVKSGQQNVPN

SEQ ID NO: 2327960 - protein, 22 aa, Cryptosporidium parvum
GAISKKGLLGKKKSKSAEIKSL

SEQ ID NO: 2327961 - protein, 6 aa, Cryptosporidium parvum
GAITPT

SEQ ID NO: 2327962 - protein, 12 aa, Cryptosporidium parvum
GAKCKKQEERDD

SEQ ID NO: 2327963 - protein, 10 aa, Cryptosporidium parvum
GALGENEEKN

SEQ ID NO: 2327964 - protein, 6 aa, Cryptosporidium parvum
GANNEQ

SEQ ID NO: 2327965 - protein, 7 aa, Cryptosporidium parvum
GANRGAW

SEQ ID NO: 2327966 - protein, 9 aa, Cryptosporidium parvum
GAQTPYPSE

SEQ ID NO: 2327967 - protein, 59 aa, Cryptosporidium parvum
GARPKTGTIRSRPRSRSSTRSSSRSRTRSRTRSRTRLRSKSRIRSSSRTRSRSRGRSPE

SEQ ID NO: 2327968 - protein, 5 aa, Cryptosporidium parvum
GARSL

SEQ ID NO: 2327969 - protein, 14 aa, Cryptosporidium parvum
GASNQSKSGEERFK

SEQ ID NO: 2327970 - protein, 17 aa, Cryptosporidium parvum
GASSEEYKEPRPKNRSI

SEQ ID NO: 2327971 - protein, 7 aa, Cryptosporidium parvum
GASSQED

SEQ ID NO: 2327972 - protein, 6 aa, Cryptosporidium parvum
GATGGL

SEQ ID NO: 2327973 - protein, 7 aa, Cryptosporidium parvum
GATKKDF

SEQ ID NO: 2327974 - protein, 9 aa, Cryptosporidium parvum
GATSNLVGE

SEQ ID NO: 2327975 - protein, 5 aa, Cryptosporidium parvum
GAVGT

SEQ ID NO: 2327976 - protein, 8 aa, Cryptosporidium parvum
GAYPGGVS

SEQ ID NO: 2327977 - protein, 5 aa, Cryptosporidium parvum
GCSPE

SEQ ID NO: 2327978 - protein, 9 aa, Cryptosporidium parvum
GDDNKLPEA

SEQ ID NO: 2327979 - protein, 11 aa, Cryptosporidium parvum
GDDPEGGNDYS

SEQ ID NO: 2327980 - protein, 11 aa, Cryptosporidium parvum
GDDTQTSPIPI

SEQ ID NO: 2327981 - protein, 10 aa, Cryptosporidium parvum
GDEKQKELPQ

SEQ ID NO: 2327982 - protein, 5 aa, Cryptosporidium parvum
GDEPK

SEQ ID NO: 2327983 - protein, 13 aa, Cryptosporidium parvum
GDFSGKKNALSSV

SEQ ID NO: 2327984 - protein, 21 aa, Cryptosporidium parvum
GDFTNGNGTGGKSIYGDSFED

SEQ ID NO: 2327985 - protein, 7 aa, Cryptosporidium parvum
GDGENDL

SEQ ID NO: 2327986 - protein, 321 aa, Cryptosporidium parvum
GDGGKKPKPVLTSSRSSSSRDSSSSGKGKTDVDSGSKKTRKGSAGSGAACGTSGGPSKADKTGKVGTAGKGKGTRDKQGRTPSRPGGRGSAQSSTSRGPSSASRGPSSASSSTPSGPSSTPSRAPSGIGGRGGASSSAPRGPSSTPSSTPSSTPSSTPSSTPSSTPSRAPSRSPGGLGGRGGASSSSPRGPSSTPSGPSGTLSESRSTPSGTGSAPTGAGKVATTGGSSSSPSAPSDTGSLGGISGGATSSGAGGSGSGAGGSGSGAGGGSSGGRGGGGGRRGREDGREEGNEDEDTDDDESGNGEDSDTSSNSSGSRREE

SEQ ID NO: 2327987 - protein, 4 aa, Cryptosporidium parvum
GDGN

SEQ ID NO: 2327988 - protein, 10 aa, Cryptosporidium parvum
GDGNNNIRSG

SEQ ID NO: 2327989 - protein, 11 aa, Cryptosporidium parvum
GDGRTKGTGCQ

SEQ ID NO: 2327990 - protein, 6 aa, Cryptosporidium parvum
GDHESH

SEQ ID NO: 2327991 - protein, 7 aa, Cryptosporidium parvum
GDHESVN

SEQ ID NO: 2327992 - protein, 28 aa, Cryptosporidium parvum
GDIEEGSSQTSTSTDQEGHSEKGEKRKI

SEQ ID NO: 2327993 - protein, 10 aa, Cryptosporidium parvum
GDKETIEDTG

SEQ ID NO: 2327994 - protein, 10 aa, Cryptosporidium parvum
GDKSEETDNL

SEQ ID NO: 2327995 - protein, 4 aa, Cryptosporidium parvum
GDLP

SEQ ID NO: 2327996 - protein, 15 aa, Cryptosporidium parvum
GDLSNDQTKSNNGRF

SEQ ID NO: 2327997 - protein, 4 aa, Cryptosporidium parvum
GDPN

SEQ ID NO: 2327998 - protein, 15 aa, Cryptosporidium parvum
GDPPRKRKLPTDEDG

SEQ ID NO: 2327999 - protein, 9 aa, Cryptosporidium parvum
GDPSATQYS

SEQ ID NO: 2328000 - protein, 6 aa, Cryptosporidium parvum
GDSEGN

SEQ ID NO: 2328001 - protein, 10 aa, Cryptosporidium parvum
GDSGPPPKVR

SEQ ID NO: 2328002 - protein, 8 aa, Cryptosporidium parvum
GDSQTKKN

SEQ ID NO: 2328003 - protein, 5 aa, Cryptosporidium parvum
GDSVS

SEQ ID NO: 2328004 - protein, 6 aa, Cryptosporidium parvum
GDTLKN

SEQ ID NO: 2328005 - protein, 13 aa, Cryptosporidium parvum
GDTNEEDLAPEDS

SEQ ID NO: 2328006 - protein, 7 aa, Cryptosporidium parvum
GDYGEGR

SEQ ID NO: 2328007 - protein, 5 aa, Cryptosporidium parvum
GDYKR

SEQ ID NO: 2328008 - protein, 4 aa, Cryptosporidium parvum
GEAN

SEQ ID NO: 2328009 - protein, 5 aa, Cryptosporidium parvum
GECEK

SEQ ID NO: 2328010 - protein, 8 aa, Cryptosporidium parvum
GECKPGKC

SEQ ID NO: 2328011 - protein, 7 aa, Cryptosporidium parvum
GEDEQPI

SEQ ID NO: 2328012 - protein, 4 aa, Cryptosporidium parvum
GEDF

SEQ ID NO: 2328013 - protein, 9 aa, Cryptosporidium parvum
GEDHRSPHQ

SEQ ID NO: 2328014 - protein, 9 aa, Cryptosporidium parvum
GEDQTNKDL

SEQ ID NO: 2328015 - protein, 12 aa, Cryptosporidium parvum
GEEEEEYTVDGK

SEQ ID NO: 2328016 - protein, 7 aa, Cryptosporidium parvum
GEEGAET

SEQ ID NO: 2328017 - protein, 11 aa, Cryptosporidium parvum
GEEKAFDNTKT

SEQ ID NO: 2328018 - protein, 29 aa, Cryptosporidium parvum
GEEPTDGDSVTSQPSLEHTESEQNSGNGR

SEQ ID NO: 2328019 - protein, 8 aa, Cryptosporidium parvum
GEEYKDND

SEQ ID NO: 2328020 - protein, 10 aa, Cryptosporidium parvum
GEFAHKDSNT

SEQ ID NO: 2328021 - protein, 11 aa, Cryptosporidium parvum
GEFTGKPLSTQ

SEQ ID NO: 2328022 - protein, 4 aa, Cryptosporidium parvum
GEGR

SEQ ID NO: 2328023 - protein, 14 aa, Cryptosporidium parvum
GEIPYEHKKSNDSL

SEQ ID NO: 2328024 - protein, 7 aa, Cryptosporidium parvum
GEIRSNN

SEQ ID NO: 2328025 - protein, 4 aa, Cryptosporidium parvum
GEKG

SEQ ID NO: 2328026 - protein, 16 aa, Cryptosporidium parvum
GEKKTGEKRNATITGT

SEQ ID NO: 2328027 - protein, 18 aa, Cryptosporidium parvum
GEKSQSNGELSKSSKEIS

SEQ ID NO: 2328028 - protein, 8 aa, Cryptosporidium parvum
GEKSVRNL

SEQ ID NO: 2328029 - protein, 9 aa, Cryptosporidium parvum
GELNNETNI

SEQ ID NO: 2328030 - protein, 12 aa, Cryptosporidium parvum
GELQTANKDTIK

SEQ ID NO: 2328031 - protein, 5 aa, Cryptosporidium parvum
GENGL

SEQ ID NO: 2328032 - protein, 4 aa, Cryptosporidium parvum
GENL

SEQ ID NO: 2328033 - protein, 11 aa, Cryptosporidium parvum
GENNDEEMNYE

SEQ ID NO: 2328034 - protein, 4 aa, Cryptosporidium parvum
GENQ

SEQ ID NO: 2328035 - protein, 5 aa, Cryptosporidium parvum
GENRV

SEQ ID NO: 2328036 - protein, 11 aa, Cryptosporidium parvum
GENTNKNDMSE

SEQ ID NO: 2328037 - protein, 4 aa, Cryptosporidium parvum
GEPE

SEQ ID NO: 2328038 - protein, 30 aa, Cryptosporidium parvum
GEQPSEISRADSEGSDFTQTSNFDESQGEL

SEQ ID NO: 2328039 - protein, 9 aa, Cryptosporidium parvum
GERPMTKDN

SEQ ID NO: 2328040 - protein, 6 aa, Cryptosporidium parvum
GERSTF

SEQ ID NO: 2328041 - protein, 5 aa, Cryptosporidium parvum
GESCS

SEQ ID NO: 2328042 - protein, 34 aa, Cryptosporidium parvum
GESESPNNNKDKETEFNQKDDEPYTSGQDYSSGT

SEQ ID NO: 2328043 - protein, 7 aa, Cryptosporidium parvum
GESPSAL

SEQ ID NO: 2328044 - protein, 7 aa, Cryptosporidium parvum
GESPYSK

SEQ ID NO: 2328045 - protein, 7 aa, Cryptosporidium parvum
GESQNER

SEQ ID NO: 2328046 - protein, 5 aa, Cryptosporidium parvum
GETAK

SEQ ID NO: 2328047 - protein, 12 aa, Cryptosporidium parvum
GETELTGKQKKE

SEQ ID NO: 2328048 - protein, 23 aa, Cryptosporidium parvum
GETFKESDNTYYSKIGKSPENIA

SEQ ID NO: 2328049 - protein, 8 aa, Cryptosporidium parvum
GETNQNTL

SEQ ID NO: 2328050 - protein, 7 aa, Cryptosporidium parvum
GETPKKK

SEQ ID NO: 2328051 - protein, 7 aa, Cryptosporidium parvum
GETQPKP

SEQ ID NO: 2328052 - protein, 6 aa, Cryptosporidium parvum
GETSEI

SEQ ID NO: 2328053 - protein, 14 aa, Cryptosporidium parvum
GETSGRVDDNKETI

SEQ ID NO: 2328054 - protein, 4 aa, Cryptosporidium parvum
GETT

SEQ ID NO: 2328055 - protein, 15 aa, Cryptosporidium parvum
GEVRIGEKTPNKEGV

SEQ ID NO: 2328056 - protein, 7 aa, Cryptosporidium parvum
GEYISPE

SEQ ID NO: 2328057 - protein, 13 aa, Cryptosporidium parvum
GFEDSDPSSMDET

SEQ ID NO: 2328058 - protein, 30 aa, Cryptosporidium parvum
GFEESKTSERSSSIGKLNTADSSFLNPNTE

SEQ ID NO: 2328059 - protein, 5 aa, Cryptosporidium parvum
GFGVG

SEQ ID NO: 2328060 - protein, 4 aa, Cryptosporidium parvum
GFNP

SEQ ID NO: 2328061 - protein, 17 aa, Cryptosporidium parvum
GFPENGYPITEKNNEVP

SEQ ID NO: 2328062 - protein, 20 aa, Cryptosporidium parvum
GFPQGGYDSTSDPTNSNGGF

SEQ ID NO: 2328063 - protein, 8 aa, Cryptosporidium parvum
GFPSPDRD

SEQ ID NO: 2328064 - protein, 19 aa, Cryptosporidium parvum
GFPTGGYESTSNSKDNNGF

SEQ ID NO: 2328065 - protein, 8 aa, Cryptosporidium parvum
GFRNSESI

SEQ ID NO: 2328066 - protein, 9 aa, Cryptosporidium parvum
GFSAREGSL

SEQ ID NO: 2328067 - protein, 12 aa, Cryptosporidium parvum
GFSNKKQKQKFH

SEQ ID NO: 2328068 - protein, 4 aa, Cryptosporidium parvum
GFSQ

SEQ ID NO: 2328069 - protein, 5 aa, Cryptosporidium parvum
GFSYP

SEQ ID NO: 2328070 - protein, 14 aa, Cryptosporidium parvum
GGAFNPPSSHESAQ

SEQ ID NO: 2328071 - protein, 5 aa, Cryptosporidium parvum
GGARL

SEQ ID NO: 2328072 - protein, 8 aa, Cryptosporidium parvum
GGDAQTTL

SEQ ID NO: 2328073 - protein, 19 aa, Cryptosporidium parvum
GGDASEGLRSSLASSIQPD

SEQ ID NO: 2328074 - protein, 94 aa, Cryptosporidium parvum
GGDKKEEKNENKQEQGPKSTQDTNGINPAAGVSKSEGNPPENSSKPPEEAKKPEGSHPEEKPPVEAKKAEGGHSEEKPPENHPPAEGGEPKQDN

SEQ ID NO: 2328075 - protein, 10 aa, Cryptosporidium parvum
GGDLPPDNNY

SEQ ID NO: 2328076 - protein, 9 aa, Cryptosporidium parvum
GGEEEEQPE

SEQ ID NO: 2328077 - protein, 9 aa, Cryptosporidium parvum
GGEESEDLY

SEQ ID NO: 2328078 - protein, 14 aa, Cryptosporidium parvum
GGEGDDIKGVETSL

SEQ ID NO: 2328079 - protein, 8 aa, Cryptosporidium parvum
GGEKSTSI

SEQ ID NO: 2328080 - protein, 7 aa, Cryptosporidium parvum
GGGASIN

SEQ ID NO: 2328081 - protein, 5 aa, Cryptosporidium parvum
GGGGD

SEQ ID NO: 2328082 - protein, 14 aa, Cryptosporidium parvum
GGGGHIPKYSDSYT

SEQ ID NO: 2328083 - protein, 5 aa, Cryptosporidium parvum
GGGTA

SEQ ID NO: 2328084 - protein, 12 aa, Cryptosporidium parvum
GGISQNEPQNLR

SEQ ID NO: 2328085 - protein, 9 aa, Cryptosporidium parvum
GGKGAYSIE

SEQ ID NO: 2328086 - protein, 8 aa, Cryptosporidium parvum
GGKPIELK

SEQ ID NO: 2328087 - protein, 10 aa, Cryptosporidium parvum
GGKTTYSSQP

SEQ ID NO: 2328088 - protein, 8 aa, Cryptosporidium parvum
GGKVGGSV

SEQ ID NO: 2328089 - protein, 10 aa, Cryptosporidium parvum
GGKYKEKKRF

SEQ ID NO: 2328090 - protein, 6 aa, Cryptosporidium parvum
GGKYPA

SEQ ID NO: 2328091 - protein, 4 aa, Cryptosporidium parvum
GGLQ

SEQ ID NO: 2328092 - protein, 6 aa, Cryptosporidium parvum
GGNNQQ

SEQ ID NO: 2328093 - protein, 7 aa, Cryptosporidium parvum
GGNPGSY

SEQ ID NO: 2328094 - protein, 4 aa, Cryptosporidium parvum
GGNR

SEQ ID NO: 2328095 - protein, 18 aa, Cryptosporidium parvum
GGPCPADVTRTGGISRED

SEQ ID NO: 2328096 - protein, 34 aa, Cryptosporidium parvum
GGPFGFGGGGGGRRQGSNSRSHFESQGSSYNNLY

SEQ ID NO: 2328097 - protein, 5 aa, Cryptosporidium parvum
GGQGT

SEQ ID NO: 2328098 - protein, 6 aa, Cryptosporidium parvum
GGQMGP

SEQ ID NO: 2328099 - protein, 4 aa, Cryptosporidium parvum
GGQP

SEQ ID NO: 2328100 - protein, 11 aa, Cryptosporidium parvum
GGRPSIPETVP

SEQ ID NO: 2328101 - protein, 10 aa, Cryptosporidium parvum
GGRQYDEDKR

SEQ ID NO: 2328102 - protein, 9 aa, Cryptosporidium parvum
GGSGESSGY

SEQ ID NO: 2328103 - protein, 17 aa, Cryptosporidium parvum
GGSGGMAAAKEAAKYGK

SEQ ID NO: 2328104 - protein, 10 aa, Cryptosporidium parvum
GGSNGKNKYI

SEQ ID NO: 2328105 - protein, 7 aa, Cryptosporidium parvum
GGSNRGA

SEQ ID NO: 2328106 - protein, 10 aa, Cryptosporidium parvum
GGSRPKLQSG

SEQ ID NO: 2328107 - protein, 6 aa, Cryptosporidium parvum
GGSYPS

SEQ ID NO: 2328108 - protein, 14 aa, Cryptosporidium parvum
GGTNNENLSPNIHS

SEQ ID NO: 2328109 - protein, 8 aa, Cryptosporidium parvum
GGTRGISN

SEQ ID NO: 2328110 - protein, 22 aa, Cryptosporidium parvum
GGTSYTDGGSIPSFKPISNSNI

SEQ ID NO: 2328111 - protein, 5 aa, Cryptosporidium parvum
GGTTR

SEQ ID NO: 2328112 - protein, 9 aa, Cryptosporidium parvum
GGVGAPNGT

SEQ ID NO: 2328113 - protein, 8 aa, Cryptosporidium parvum
GGVSNSES

SEQ ID NO: 2328114 - protein, 7 aa, Cryptosporidium parvum
GGYNEDE

SEQ ID NO: 2328115 - protein, 6 aa, Cryptosporidium parvum
GHCEKG

SEQ ID NO: 2328116 - protein, 9 aa, Cryptosporidium parvum
GHGGPLTHT

SEQ ID NO: 2328117 - protein, 25 aa, Cryptosporidium parvum
GHGHKHKHSNNHKDQNNKDEEGHIE

SEQ ID NO: 2328118 - protein, 7 aa, Cryptosporidium parvum
GHGKRNG

SEQ ID NO: 2328119 - protein, 4 aa, Cryptosporidium parvum
GHGT

SEQ ID NO: 2328120 - protein, 9 aa, Cryptosporidium parvum
GHKASGASQ

SEQ ID NO: 2328121 - protein, 8 aa, Cryptosporidium parvum
GHSKSGKF

SEQ ID NO: 2328122 - protein, 5 aa, Cryptosporidium parvum
GIADD

SEQ ID NO: 2328123 - protein, 11 aa, Cryptosporidium parvum
GIEAQQTQTIN

SEQ ID NO: 2328124 - protein, 9 aa, Cryptosporidium parvum
GIENGPAMA

SEQ ID NO: 2328125 - protein, 19 aa, Cryptosporidium parvum
GIETKSDKTLSIEDPEESI

SEQ ID NO: 2328126 - protein, 6 aa, Cryptosporidium parvum
GIGPTE

SEQ ID NO: 2328127 - protein, 5 aa, Cryptosporidium parvum
GIHPD

SEQ ID NO: 2328128 - protein, 7 aa, Cryptosporidium parvum
GIKPSKD

SEQ ID NO: 2328129 - protein, 12 aa, Cryptosporidium parvum
GILPSGSNLPNN

SEQ ID NO: 2328130 - protein, 5 aa, Cryptosporidium parvum
GINER

SEQ ID NO: 2328131 - protein, 10 aa, Cryptosporidium parvum
GINKSNNLGI

SEQ ID NO: 2328132 - protein, 7 aa, Cryptosporidium parvum
GIPDNEL

SEQ ID NO: 2328133 - protein, 4 aa, Cryptosporidium parvum
GIPN

SEQ ID NO: 2328134 - protein, 10 aa, Cryptosporidium parvum
GIPPAPRGVP

SEQ ID NO: 2328135 - protein, 6 aa, Cryptosporidium parvum
GIPSEK

SEQ ID NO: 2328136 - protein, 12 aa, Cryptosporidium parvum
GIQEKNETKEYY

SEQ ID NO: 2328137 - protein, 4 aa, Cryptosporidium parvum
GIQN

SEQ ID NO: 2328138 - protein, 21 aa, Cryptosporidium parvum
GIQSRSIETSASKSKIRGSDL

SEQ ID NO: 2328139 - protein, 23 aa, Cryptosporidium parvum
GIQTEETGTQTEETGMTDAATQT

SEQ ID NO: 2328140 - protein, 22 aa, Cryptosporidium parvum
GIRNKSGKNNQVSSKLSPIKSS

SEQ ID NO: 2328141 - protein, 11 aa, Cryptosporidium parvum
GISNDLSSLTS

SEQ ID NO: 2328142 - protein, 13 aa, Cryptosporidium parvum
GISRTRSDDTTKI

SEQ ID NO: 2328143 - protein, 9 aa, Cryptosporidium parvum
GISSSPQQK

SEQ ID NO: 2328144 - protein, 4 aa, Cryptosporidium parvum
GITS

SEQ ID NO: 2328145 - protein, 8 aa, Cryptosporidium parvum
GITSTVGS

SEQ ID NO: 2328146 - protein, 13 aa, Cryptosporidium parvum
GIVEKSSSIDTKN

SEQ ID NO: 2328147 - protein, 14 aa, Cryptosporidium parvum
GIYRPKKKKVGYGV

SEQ ID NO: 2328148 - protein, 39 aa, Cryptosporidium parvum
  misc_feature (17)..(18): Xaa can be any naturally occurring amino acid
  misc_feature (20)..(20): Xaa can be any naturally occurring amino acid
  misc_feature (22)..(22): Xaa can be any naturally occurring amino acid
  misc_feature (25)..(26): Xaa can be any naturally occurring amino acid
  misc_feature (30)..(31): Xaa can be any naturally occurring amino acid
GKASSKGDYIVGWFSPXXNXFXNSXXSEIXXAMEFTRRS

SEQ ID NO: 2328149 - protein, 32 aa, Cryptosporidium parvum
GKCTGNGSKEPSSTDGHLGGRPGSTVSPPPLR

SEQ ID NO: 2328150 - protein, 4 aa, Cryptosporidium parvum
GKDI

SEQ ID NO: 2328151 - protein, 10 aa, Cryptosporidium parvum
GKDVSKDSEL

SEQ ID NO: 2328152 - protein, 13 aa, Cryptosporidium parvum
GKEPNRGINPDEA

SEQ ID NO: 2328153 - protein, 4 aa, Cryptosporidium parvum
GKEV

SEQ ID NO: 2328154 - protein, 15 aa, Cryptosporidium parvum
GKGEYQLPSAEKTYQ

SEQ ID NO: 2328155 - protein, 5 aa, Cryptosporidium parvum
GKGFT

SEQ ID NO: 2328156 - protein, 12 aa, Cryptosporidium parvum
GKGGVGKSTISS

SEQ ID NO: 2328157 - protein, 12 aa, Cryptosporidium parvum
GKGNERERLTSQ

SEQ ID NO: 2328158 - protein, 5 aa, Cryptosporidium parvum
GKGSG

SEQ ID NO: 2328159 - protein, 5 aa, Cryptosporidium parvum
GKIHD

SEQ ID NO: 2328160 - protein, 4 aa, Cryptosporidium parvum
GKIT

SEQ ID NO: 2328161 - protein, 6 aa, Cryptosporidium parvum
GKITQH

SEQ ID NO: 2328162 - protein, 8 aa, Cryptosporidium parvum
GKKEKEMM

SEQ ID NO: 2328163 - protein, 12 aa, Cryptosporidium parvum
GKKKPNPSEKKI

SEQ ID NO: 2328164 - protein, 16 aa, Cryptosporidium parvum
GKKSNRDVKKEEFNKS

SEQ ID NO: 2328165 - protein, 7 aa, Cryptosporidium parvum
GKLGYSN

SEQ ID NO: 2328166 - protein, 6 aa, Cryptosporidium parvum
GKLNNE

SEQ ID NO: 2328167 - protein, 9 aa, Cryptosporidium parvum
GKLSKNDVD

SEQ ID NO: 2328168 - protein, 6 aa, Cryptosporidium parvum
GKNDAL

SEQ ID NO: 2328169 - protein, 8 aa, Cryptosporidium parvum
GKNHSKSE

SEQ ID NO: 2328170 - protein, 10 aa, Cryptosporidium parvum
GKNNNSPHEF

SEQ ID NO: 2328171 - protein, 14 aa, Cryptosporidium parvum
GKNRNFSNSTVTNN

SEQ ID NO: 2328172 - protein, 63 aa, Cryptosporidium parvum
GKNTDKSSEALESDLPSSTTTTTTTTSSSTTTTTTTTTTTTTTTTTTAIPPSMSDEEKSPFVS

SEQ ID NO: 2328173 - protein, 6 aa, Cryptosporidium parvum
GKPIPY

SEQ ID NO: 2328174 - protein, 5 aa, Cryptosporidium parvum
GKPIY

SEQ ID NO: 2328175 - protein, 6 aa, Cryptosporidium parvum
GKPSLD

SEQ ID NO: 2328176 - protein, 22 aa, Cryptosporidium parvum
GKQCTATKTASQQPSCPPGTTL

SEQ ID NO: 2328177 - protein, 18 aa, Cryptosporidium parvum
GKQSNSEARKSRSGAKSS

SEQ ID NO: 2328178 - protein, 5 aa, Cryptosporidium parvum
GKRWG

SEQ ID NO: 2328179 - protein, 12 aa, Cryptosporidium parvum
GKSEHKSIPRSV

SEQ ID NO: 2328180 - protein, 4 aa, Cryptosporidium parvum
GKSG

SEQ ID NO: 2328181 - protein, 8 aa, Cryptosporidium parvum
GKSITKNT

SEQ ID NO: 2328182 - protein, 10 aa, Cryptosporidium parvum
GKSLSSKTSY

SEQ ID NO: 2328183 - protein, 11 aa, Cryptosporidium parvum
GKSPTAQSSQY

SEQ ID NO: 2328184 - protein, 19 aa, Cryptosporidium parvum
GKSSGLNASQTNSGYYGNK

SEQ ID NO: 2328185 - protein, 10 aa, Cryptosporidium parvum
GKSTEGISES

SEQ ID NO: 2328186 - protein, 4 aa, Cryptosporidium parvum
GKTE

SEQ ID NO: 2328187 - protein, 24 aa, Cryptosporidium parvum
GKTLQEKADLQKRRKDKAHEREIR

SEQ ID NO: 2328188 - protein, 7 aa, Cryptosporidium parvum
GKTTARD

SEQ ID NO: 2328189 - protein, 7 aa, Cryptosporidium parvum
GKVPEKY

SEQ ID NO: 2328190 - protein, 20 aa, Cryptosporidium parvum
GKVSPKTHRSKIPVKDEQET

SEQ ID NO: 2328191 - protein, 11 aa, Cryptosporidium parvum
GKYDPRASQRY

SEQ ID NO: 2328192 - protein, 10 aa, Cryptosporidium parvum
GKYPEIGQYD

SEQ ID NO: 2328193 - protein, 4 aa, Cryptosporidium parvum
GKYY

SEQ ID NO: 2328194 - protein, 11 aa, Cryptosporidium parvum
GLDTPTNRRRK

SEQ ID NO: 2328195 - protein, 11 aa, Cryptosporidium parvum
GLENNDENVEN

SEQ ID NO: 2328196 - protein, 16 aa, Cryptosporidium parvum
GLESRAKPEHCEPGGR

SEQ ID NO: 2328197 - protein, 10 aa, Cryptosporidium parvum
GLGTAARKVH

SEQ ID NO: 2328198 - protein, 8 aa, Cryptosporidium parvum
GLKKRYPN

SEQ ID NO: 2328199 - protein, 7 aa, Cryptosporidium parvum
GLNNDQS

SEQ ID NO: 2328200 - protein, 11 aa, Cryptosporidium parvum
GLQLTSPSPRL

SEQ ID NO: 2328201 - protein, 6 aa, Cryptosporidium parvum
GLRDHP

SEQ ID NO: 2328202 - protein, 4 aa, Cryptosporidium parvum
GLSE

SEQ ID NO: 2328203 - protein, 4 aa, Cryptosporidium parvum
GLSK

SEQ ID NO: 2328204 - protein, 4 aa, Cryptosporidium parvum
GLSP

SEQ ID NO: 2328205 - protein, 8 aa, Cryptosporidium parvum
GLSSQNST

SEQ ID NO: 2328206 - protein, 6 aa, Cryptosporidium parvum
GLSYQG

SEQ ID NO: 2328207 - protein, 5 aa, Cryptosporidium parvum
GLTQD

SEQ ID NO: 2328208 - protein, 5 aa, Cryptosporidium parvum
GMDPS

SEQ ID NO: 2328209 - protein, 7 aa, Cryptosporidium parvum
GMKPEQK

SEQ ID NO: 2328210 - protein, 6 aa, Cryptosporidium parvum
GMNKHD

SEQ ID NO: 2328211 - protein, 30 aa, Cryptosporidium parvum; identical to SEQ ID NO: 2202204

SEQ ID NO: 2328212 - protein, 7 aa, Cryptosporidium parvum
GMTPGDA

SEQ ID NO: 2328213 - protein, 25 aa, Cryptosporidium parvum
GMYPSPSEIEKYGQNTEVSDPKEEK

SEQ ID NO: 2328214 - protein, 20 aa, Cryptosporidium parvum
GNAHSRNPSAELTNKKLSEA

SEQ ID NO: 2328215 - protein, 16 aa, Cryptosporidium parvum
GNCSAKDGDNETTKGE

SEQ ID NO: 2328216 - protein, 13 aa, Cryptosporidium parvum
GNDLDSKKNDVVE

SEQ ID NO: 2328217 - protein, 15 aa, Cryptosporidium parvum
GNDNSKVASIRPGRG

SEQ ID NO: 2328218 - protein, 16 aa, Cryptosporidium parvum
GNDRNNNDIRPTYPSA

SEQ ID NO: 2328219 - protein, 6 aa, Cryptosporidium parvum
GNDTPN

SEQ ID NO: 2328220 - protein, 10 aa, Cryptosporidium parvum
GNDYNKQVEE

SEQ ID NO: 2328221 - protein, 6 aa, Cryptosporidium parvum
GNENIY

SEQ ID NO: 2328222 - protein, 46 aa, Cryptosporidium parvum
GNESDFKTERISSEEVLQDSDSDYLEGDEYQEDSNERYRFSQESED

SEQ ID NO: 2328223 - protein, 9 aa, Cryptosporidium parvum
GNETNTDIN

SEQ ID NO: 2328224 - protein, 15 aa, Cryptosporidium parvum
GNFSRRSKLKNQGSK

SEQ ID NO: 2328225 - protein, 9 aa, Cryptosporidium parvum
GNGEEVKDL

SEQ ID NO: 2328226 - protein, 11 aa, Cryptosporidium parvum
GNGEQSRRVKK

SEQ ID NO: 2328227 - protein, 13 aa, Cryptosporidium parvum
GNGGISKLERGTS

SEQ ID NO: 2328228 - protein, 7 aa, Cryptosporidium parvum
GNGQDSQ

SEQ ID NO: 2328229 - protein, 6 aa, Cryptosporidium parvum
GNGRNV

SEQ ID NO: 2328230 - protein, 8 aa, Cryptosporidium parvum
GNIGDDSF

SEQ ID NO: 2328231 - protein, 4 aa, Cryptosporidium parvum
GNII

SEQ ID NO: 2328232 - protein, 13 aa, Cryptosporidium parvum
GNIPSSGEPIDSI

SEQ ID NO: 2328233 - protein, 12 aa, Cryptosporidium parvum
GNISGKEYLGPK

SEQ ID NO: 2328234 - protein, 14 aa, Cryptosporidium parvum
GNKKKQKCYSNPND

SEQ ID NO: 2328235 - protein, 15 aa, Cryptosporidium parvum
GNKNGDELSRSKKEI

SEQ ID NO: 2328236 - protein, 8 aa, Cryptosporidium parvum
GNKSSDIS

SEQ ID NO: 2328237 - protein, 7 aa, Cryptosporidium parvum
GNLGSSS

SEQ ID NO: 2328238 - protein, 42 aa, Cryptosporidium parvum
GNLRSTKGTDEEEDDGSLPTSTTTKTISESYPKSDEKDEKEE

SEQ ID NO: 2328239 - protein, 8 aa, Cryptosporidium parvum
GNLSEQRK

SEQ ID NO: 2328240 - protein, 8 aa, Cryptosporidium parvum
GNLTELNK

SEQ ID NO: 2328241 - protein, 35 aa, Cryptosporidium parvum
GNMDDEDDYYYQEKDSNQEFNSEKVSRGQGRRSKV

SEQ ID NO: 2328242 - protein, 7 aa, Cryptosporidium parvum
GNNIYGN

SEQ ID NO: 2328243 - protein, 5 aa, Cryptosporidium parvum
GNNPE

SEQ ID NO: 2328244 - protein, 4 aa, Cryptosporidium parvum
GNNS

SEQ ID NO: 2328245 - protein, 8 aa, Cryptosporidium parvum
GNNSINMR

SEQ ID NO: 2328246 - protein, 19 aa, Cryptosporidium parvum
GNPKTSSSNQLSNETNVGC

SEQ ID NO: 2328247 - protein, 7 aa, Cryptosporidium parvum
GNPPQKQ

SEQ ID NO: 2328248 - protein, 7 aa, Cryptosporidium parvum
GNPSFDI

SEQ ID NO: 2328249 - protein, 9 aa, Cryptosporidium parvum
GNQISTEDT

SEQ ID NO: 2328250 - protein, 7 aa, Cryptosporidium parvum
GNRDVRH

SEQ ID NO: 2328251 - protein, 7 aa, Cryptosporidium parvum
GNRQCNS

SEQ ID NO: 2328252 - protein, 15 aa, Cryptosporidium parvum
GNSEWRSASNLSAEQ

SEQ ID NO: 2328253 - protein, 7 aa, Cryptosporidium parvum
GNSIGQD

SEQ ID NO: 2328254 - protein, 17 aa, Cryptosporidium parvum
GNSNHNYTSTSRAIGTE

SEQ ID NO: 2328255 - protein, 13 aa, Cryptosporidium parvum
GNSNLKPKDLKEA

SEQ ID NO: 2328256 - protein, 11 aa, Cryptosporidium parvum
GNSTLQSEPPV

SEQ ID NO: 2328257 - protein, 5 aa, Cryptosporidium parvum
GNSYY

SEQ ID NO: 2328258 - protein, 6 aa, Cryptosporidium parvum
GNTGDV

SEQ ID NO: 2328259 - protein, 8 aa, Cryptosporidium parvum
GNTTPSQI

SEQ ID NO: 2328260 - protein, 16 aa, Cryptosporidium parvum
GNTVQSDARNYDSAKR

SEQ ID NO: 2328261 - protein, 11 aa, Cryptosporidium parvum
GNYHNTPSGYY

SEQ ID NO: 2328262 - protein, 14 aa, Cryptosporidium parvum
GPDLTSKESCTESQ

SEQ ID NO: 2328263 - protein, 7 aa, Cryptosporidium parvum
GPDYTDN

SEQ ID NO: 2328264 - protein, 6 aa, Cryptosporidium parvum
GPFGQR

SEQ ID NO: 2328265 - protein, 6 aa, Cryptosporidium parvum
GPGKTY

SEQ ID NO: 2328266 - protein, 5 aa, Cryptosporidium parvum
GPGNI

SEQ ID NO: 2328267 - protein, 14 aa, Cryptosporidium parvum
GPGRGDGERYRVPD

SEQ ID NO: 2328268 - protein, 8 aa, Cryptosporidium parvum
GPKAGEAM

SEQ ID NO: 2328269 - protein, 5 aa, Cryptosporidium parvum
GPKEA

SEQ ID NO: 2328270 - protein, 11 aa, Cryptosporidium parvum
GPKSKRNSKYQ

SEQ ID NO: 2328271 - protein, 7 aa, Cryptosporidium parvum
GPLETGE

SEQ ID NO: 2328272 - protein, 14 aa, Cryptosporidium parvum
GPMGGPIGGPFGSM

SEQ ID NO: 2328273 - protein, 15 aa, Cryptosporidium parvum
GPMGPQTGPMGGPMG

SEQ ID NO: 2328274 - protein, 12 aa, Cryptosporidium parvum
GPNARYKSRKLN

SEQ ID NO: 2328275 - protein, 9 aa, Cryptosporidium parvum
GPNGTKKNA

SEQ ID NO: 2328276 - protein, 4 aa, Cryptosporidium parvum
GPNL

SEQ ID NO: 2328277 - protein, 12 aa, Cryptosporidium parvum
GPPIPGTEPGIE

SEQ ID NO: 2328278 - protein, 8 aa, Cryptosporidium parvum
GPQHPPHD

SEQ ID NO: 2328279 - protein, 4 aa, Cryptosporidium parvum
GPSE

SEQ ID NO: 2328280 - protein, 13 aa, Cryptosporidium parvum
GPSQNLNYTGKYS

SEQ ID NO: 2328281 - protein, 4 aa, Cryptosporidium parvum
GPTS

SEQ ID NO: 2328282 - protein, 4 aa, Cryptosporidium parvum
GPYI

SEQ ID NO: 2328283 - protein, 6 aa, Cryptosporidium parvum
GPYKPF

SEQ ID NO: 2328284 - protein, 15 aa, Cryptosporidium parvum
GPYPGGKTLSSSSNL

SEQ ID NO: 2328285 - protein, 6 aa, Cryptosporidium parvum
GPYPKD

SEQ ID NO: 2328286 - protein, 10 aa, Cryptosporidium parvum
GPYPKDISQN

SEQ ID NO: 2328287 - protein, 20 aa, Cryptosporidium parvum
GQAGGAAGHAGGDDYSGHDE

SEQ ID NO: 2328288 - protein, 7 aa, Cryptosporidium parvum
GQCDPNC

SEQ ID NO: 2328289 - protein, 7 aa, Cryptosporidium parvum
GQDEKIK

SEQ ID NO: 2328290 - protein, 5 aa, Cryptosporidium parvum
GQENT

SEQ ID NO: 2328291 - protein, 10 aa, Cryptosporidium parvum
GQGESDQGEY

SEQ ID NO: 2328292 - protein, 12 aa, Cryptosporidium parvum
GQGPSKSMKNSY

SEQ ID NO: 2328293 - protein, 11 aa, Cryptosporidium parvum
GQKDPRPNVDP

SEQ ID NO: 2328294 - protein, 18 aa, Cryptosporidium parvum
GQNSPITGSSEHSPRGTF

SEQ ID NO: 2328295 - protein, 11 aa, Cryptosporidium parvum
GQRAKKTTEDK

SEQ ID NO: 2328296 - protein, 15 aa, Cryptosporidium parvum
GQREIRGNKTQSTGF

SEQ ID NO: 2328297 - protein, 11 aa, Cryptosporidium parvum
GQRNKTEMKDP

SEQ ID NO: 2328298 - protein, 10 aa, Cryptosporidium parvum
GQSSEKEDRH

SEQ ID NO: 2328299 - protein, 8 aa, Cryptosporidium parvum
GRAKDEFE

SEQ ID NO: 2328300 - protein, 84 aa, Cryptosporidium parvum
GRARGKYDSGSSGSSSSGSSSNGSSSNGSSSNGSSSNGSSSNGSSSNGSSSSGSSSSGSSSSGSSDSNGNSGSSGRSSCCSGSS

SEQ ID NO: 2328301 - protein, 6 aa, Cryptosporidium parvum
GRDDYS

SEQ ID NO: 2328302 - protein, 8 aa, Cryptosporidium parvum
GRDLKAGD

SEQ ID NO: 2328303 - protein, 14 aa, Cryptosporidium parvum
GREERGAKEGRGRM

SEQ ID NO: 2328304 - protein, 36 aa, Cryptosporidium parvum
GREYKENELNDEKQTKDNKKNNNENNKKLNSSYNPI

SEQ ID NO: 2328305 - protein, 7 aa, Cryptosporidium parvum
GRFSGNG

SEQ ID NO: 2328306 - protein, 5 aa, Cryptosporidium parvum
GRGDK

SEQ ID NO: 2328307 - protein, 8 aa, Cryptosporidium parvum
GRGPSSES

SEQ ID NO: 2328308 - protein, 5 aa, Cryptosporidium parvum
GRGST

SEQ ID NO: 2328309 - protein, 4 aa, Cryptosporidium parvum
GRGT

SEQ ID NO: 2328310 - protein, 5 aa, Cryptosporidium parvum
GRKQM

SEQ ID NO: 2328311 - protein, 7 aa, Cryptosporidium parvum
GRKSGVS

SEQ ID NO: 2328312 - protein, 13 aa, Cryptosporidium parvum
GRNASLPASRTQF

SEQ ID NO: 2328313 - protein, 14 aa, Cryptosporidium parvum
GRNTDDSSEFSPPF

SEQ ID NO: 2328314 - protein, 8 aa, Cryptosporidium parvum
GRNYEEGS

SEQ ID NO: 2328315 - protein, 5 aa, Cryptosporidium parvum
GRPIR

SEQ ID NO: 2328316 - protein, 4 aa, Cryptosporidium parvum
GRPS

SEQ ID NO: 2328317 - protein, 6 aa, Cryptosporidium parvum
GRQPDG

SEQ ID NO: 2328318 - protein, 21 aa, Cryptosporidium parvum
GRRGGKGKWSNGIGGLPSPRI

SEQ ID NO: 2328319 - protein, 5 aa, Cryptosporidium parvum
GRSMT

SEQ ID NO: 2328320 - protein, 5 aa, Cryptosporidium parvum
GSAAT

SEQ ID NO: 2328321 - protein, 67 aa, Cryptosporidium parvum
GSAGEKSSSMFPSNEESASASGEDLAGISSDSEVTSSSGSGIDGSNLDMSKSQSQGDLSASVGGIAP

SEQ ID NO: 2328322 - protein, 12 aa, Cryptosporidium parvum
GSCHSGSCSSTK

SEQ ID NO: 2328323 - protein, 9 aa, Cryptosporidium parvum
GSDGKTYTN

SEQ ID NO: 2328324 - protein, 34 aa, Cryptosporidium parvum
GSDHGNRYNSIGTGSLNIDEKESENNQDSSSTTF

SEQ ID NO: 2328325 - protein, 8 aa, Cryptosporidium parvum
GSDLSDSA

SEQ ID NO: 2328326 - protein, 29 aa, Cryptosporidium parvum
GSDSKSGSKKEAAISRSTDLNNPKTRSVS

SEQ ID NO: 2328327 - protein, 9 aa, Cryptosporidium parvum
GSDSQSGVF

SEQ ID NO: 2328328 - protein, 20 aa, Cryptosporidium parvum
GSDSYPSQSQMEPSNSLSYA

SEQ ID NO: 2328329 - protein, 8 aa, Cryptosporidium parvum
GSECTPAK

SEQ ID NO: 2328330 - protein, 9 aa, Cryptosporidium parvum
GSEGTSAKI

SEQ ID NO: 2328331 - protein, 7 aa, Cryptosporidium parvum
GSELGSY

SEQ ID NO: 2328332 - protein, 6 aa, Cryptosporidium parvum
GSENEV

SEQ ID NO: 2328333 - protein, 7 aa, Cryptosporidium parvum
GSETDLY

SEQ ID NO: 2328334 - protein, 23 aa, Cryptosporidium parvum
GSETEDSKAGDSSKKSELDEKSI

SEQ ID NO: 2328335 - protein, 5 aa, Cryptosporidium parvum
GSETK

SEQ ID NO: 2328336 - protein, 9 aa, Cryptosporidium parvum
GSETNKTLG

SEQ ID NO: 2328337 - protein, 12 aa, Cryptosporidium parvum
GSETSLPASTAI

SEQ ID NO: 2328338 - protein, 8 aa, Cryptosporidium parvum
GSEVPPSG

SEQ ID NO: 2328339 - protein, 9 aa, Cryptosporidium parvum
GSFESKSVD

SEQ ID NO: 2328340 - protein, 5 aa, Cryptosporidium parvum
GSGAA

SEQ ID NO: 2328341 - protein, 7 aa, Cryptosporidium parvum
GSGEDLQ

SEQ ID NO: 2328342 - protein, 7 aa, Cryptosporidium parvum
GSGGASL

SEQ ID NO: 2328343 - protein, 11 aa, Cryptosporidium parvum
GSGLSSTNQGV

SEQ ID NO: 2328344 - protein, 7 aa, Cryptosporidium parvum
GSGLYQK

SEQ ID NO: 2328345 - protein, 7 aa, Cryptosporidium parvum
GSGPSLE

SEQ ID NO: 2328346 - protein, 5 aa, Cryptosporidium parvum
GSGSP

SEQ ID NO: 2328347 - protein, 8 aa, Cryptosporidium parvum
GSGSTVST

SEQ ID NO: 2328348 - protein, 10 aa, Cryptosporidium parvum
GSGTITGFGP

SEQ ID NO: 2328349 - protein, 17 aa, Cryptosporidium parvum
GSGVPNKNTQNLQPSLA

SEQ ID NO: 2328350 - protein, 7 aa, Cryptosporidium parvum
GSHRKKK

SEQ ID NO: 2328351 - protein, 52 aa, Cryptosporidium parvum; identical to SEQ ID NO: 2202302

SEQ ID NO: 2328352 - protein, 5 aa, Cryptosporidium parvum
GSIPK

SEQ ID NO: 2328353 - protein, 8 aa, Cryptosporidium parvum
GSIPQDNS

SEQ ID NO: 2328354 - protein, 6 aa, Cryptosporidium parvum
GSITET

SEQ ID NO: 2328355 - protein, 7 aa, Cryptosporidium parvum
GSKENSA

SEQ ID NO: 2328356 - protein, 9 aa, Cryptosporidium parvum
GSKESPEMP

SEQ ID NO: 2328357 - protein, 5 aa, Cryptosporidium parvum
GSKHE

SEQ ID NO: 2328358 - protein, 4 aa, Cryptosporidium parvum
GSKI

SEQ ID NO: 2328359 - protein, 13 aa, Cryptosporidium parvum
GSKLGLGTSLGGG

SEQ ID NO: 2328360 - protein, 6 aa, Cryptosporidium parvum
GSKPGL

SEQ ID NO: 2328361 - protein, 8 aa, Cryptosporidium parvum
GSKSKDFQ

SEQ ID NO: 2328362 - protein, 10 aa, Cryptosporidium parvum
GSLAGVGSSY

SEQ ID NO: 2328363 - protein, 4 aa, Cryptosporidium parvum
GSLE

SEQ ID NO: 2328364 - protein, 4 aa, Cryptosporidium parvum
GSLS

SEQ ID NO: 2328365 - protein, 21 aa, Cryptosporidium parvum
GSMHPRGSRRRKHKLRSSRPE

SEQ ID NO: 2328366 - protein, 10 aa, Cryptosporidium parvum
GSNADTSIRE

SEQ ID NO: 2328367 - protein, 6 aa, Cryptosporidium parvum
GSNDGY

SEQ ID NO: 2328368 - protein, 16 aa, Cryptosporidium parvum
GSNEEELKKRSSEIDQ

SEQ ID NO: 2328369 - protein, 9 aa, Cryptosporidium parvum
GSNESNSEY

SEQ ID NO: 2328370 - protein, 26 aa, Cryptosporidium parvum
GSNNNRNTGNKSDSLINSRTSNNKSI

SEQ ID NO: 2328371 - protein, 7 aa, Cryptosporidium parvum
GSNSEQL

SEQ ID NO: 2328372 - protein, 9 aa, Cryptosporidium parvum
GSNSLKEPE

SEQ ID NO: 2328373 - protein, 5 aa, Cryptosporidium parvum
GSNVN

SEQ ID NO: 2328374 - protein, 7 aa, Cryptosporidium parvum
GSPGTAM

SEQ ID NO: 2328375 - protein, 8 aa, Cryptosporidium parvum
GSPIEPST

SEQ ID NO: 2328376 - protein, 4 aa, Cryptosporidium parvum
GSPN

SEQ ID NO: 2328377 - protein, 5 aa, Cryptosporidium parvum
GSPVT

SEQ ID NO: 2328378 - protein, 9 aa, Cryptosporidium parvum
GSQAQGKKT

SEQ ID NO: 2328379 - protein, 12 aa, Cryptosporidium parvum
GSQFSDSTTEDE

SEQ ID NO: 2328380 - protein, 7 aa, Cryptosporidium parvum
GSQGPDY

SEQ ID NO: 2328381 - protein, 9 aa, Cryptosporidium parvum
GSQITSKTN

SEQ ID NO: 2328382 - protein, 7 aa, Cryptosporidium parvum
GSQNNNC

SEQ ID NO: 2328383 - protein, 6 aa, Cryptosporidium parvum
GSQSER

SEQ ID NO: 2328384 - protein, 9 aa, Cryptosporidium parvum
GSRRAKTRK

SEQ ID NO: 2328385 - protein, 27 aa, Cryptosporidium parvum
GSSMKDNQNKKGGSSLNLNPGPVFGSE

SEQ ID NO: 2328386 - protein, 6 aa, Cryptosporidium parvum
GSSSFH

SEQ ID NO: 2328387 - protein, 11 aa, Cryptosporidium parvum
GSSSKEDSNAI

SEQ ID NO: 2328388 - protein, 9 aa, Cryptosporidium parvum
GSSSNKGYN

SEQ ID NO: 2328389 - protein, 5 aa, Cryptosporidium parvum
GSTFP

SEQ ID NO: 2328390 - protein, 9 aa, Cryptosporidium parvum
GSTGESEER

SEQ ID NO: 2328391 - protein, 8 aa, Cryptosporidium parvum
GSTKNRMK

SEQ ID NO: 2328392 - protein, 6 aa, Cryptosporidium parvum
GSTPAV

SEQ ID NO: 2328393 - protein, 8 aa, Cryptosporidium parvum
GSVATNEA

SEQ ID NO: 2328394 - protein, 13 aa, Cryptosporidium parvum
GSVSSKSVKMPST

SEQ ID NO: 2328395 - protein, 13 aa, Cryptosporidium parvum
GSYEFQQQPSSRR

SEQ ID NO: 2328396 - protein, 11 aa, Cryptosporidium parvum
GSYSGRTSKRI

SEQ ID NO: 2328397 - protein, 20 aa, Cryptosporidium parvum
GSYYDNPKFDGAPRNYRNDR

SEQ ID NO: 2328398 - protein, 26 aa, Cryptosporidium parvum
GTCGALEGKAKSKAKSKKKSGGRKKL

SEQ ID NO: 2328399 - protein, 10 aa, Cryptosporidium parvum
GTDGTTYPNP

SEQ ID NO: 2328400 - protein, 7 aa, Cryptosporidium parvum
GTELSHS

SEQ ID NO: 2328401 - protein, 9 aa, Cryptosporidium parvum
GTEPETQSE

SEQ ID NO: 2328402 - protein, 48 aa, Cryptosporidium parvum
GTESESENENENETDDPQQTLNEAERSSDPSDSGSEIAPEQEEENSFN

SEQ ID NO: 2328403 - protein, 7 aa, Cryptosporidium parvum
GTGIDSE

SEQ ID NO: 2328404 - protein, 19 aa, Cryptosporidium parvum
GTGSGSGSGSGSGSESDGM

SEQ ID NO: 2328405 - protein, 7 aa, Cryptosporidium parvum
GTGSVGA

SEQ ID NO: 2328406 - protein, 7 aa, Cryptosporidium parvum
GTIPSSS

SEQ ID NO: 2328407 - protein, 16 aa, Cryptosporidium parvum
GTNETLREIPSKNNLS

SEQ ID NO: 2328408 - protein, 4 aa, Cryptosporidium parvum
GTNN

SEQ ID NO: 2328409 - protein, 4 aa, Cryptosporidium parvum
GTNR

SEQ ID NO: 2328410 - protein, 8 aa, Cryptosporidium parvum
GTPIPTPN

SEQ ID NO: 2328411 - protein, 5 aa, Cryptosporidium parvum
GTPIQ

SEQ ID NO: 2328412 - protein, 4 aa, Cryptosporidium parvum
GTPT

SEQ ID NO: 2328413 - protein, 13 aa, Cryptosporidium parvum
GTQINAATEENDA

SEQ ID NO: 2328414 - protein, 15 aa, Cryptosporidium parvum
GTRISGKTKEERRQN

SEQ ID NO: 2328415 - protein, 14 aa, Cryptosporidium parvum
GTRTPIPYDGKRTV

SEQ ID NO: 2328416 - protein, 8 aa, Cryptosporidium parvum
GTSGTDII

SEQ ID NO: 2328417 - protein, 9 aa, Cryptosporidium parvum
GTSLSGKVP

SEQ ID NO: 2328418 - protein, 8 aa, Cryptosporidium parvum
GTSTLSHS

SEQ ID NO: 2328419 - protein, 10 aa, Cryptosporidium parvum
GTTENKGPRE

SEQ ID NO: 2328420 - protein, 19 aa, Cryptosporidium parvum
GTVTPLNKYQNDTAAWPGF

SEQ ID NO: 2328421 - protein, 6 aa, Cryptosporidium parvum
GTYRST

SEQ ID NO: 2328422 - protein, 7 aa, Cryptosporidium parvum
GVDGSEV

SEQ ID NO: 2328423 - protein, 4 aa, Cryptosporidium parvum
GVGI

SEQ ID NO: 2328424 - protein, 26 aa, Cryptosporidium parvum
GVKNGGASTKSCKDFGGEDVCGSEQE

SEQ ID NO: 2328425 - protein, 10 aa, Cryptosporidium parvum
GVKPEDETIK

SEQ ID NO: 2328426 - protein, 8 aa, Cryptosporidium parvum
GVKTSNSP

SEQ ID NO: 2328427 - protein, 19 aa, Cryptosporidium parvum
GVPGIPPALGSQASRFGAP

SEQ ID NO: 2328428 - protein, 5 aa, Cryptosporidium parvum
GVPPS

SEQ ID NO: 2328429 - protein, 16 aa, Cryptosporidium parvum
GVQGTAGSREDLNSEF

SEQ ID NO: 2328430 - protein, 7 aa, Cryptosporidium parvum
GVSPKRV

SEQ ID NO: 2328431 - protein, 14 aa, Cryptosporidium parvum
GVSRSMPTSTSLNN

SEQ ID NO: 2328432 - protein, 11 aa, Cryptosporidium parvum
GVSTTPSPDPV

SEQ ID NO: 2328433 - protein, 13 aa, Cryptosporidium parvum
GVTPGKPEEFSGN

SEQ ID NO: 2328434 - protein, 33 aa, Cryptosporidium parvum
GVVSTSEGSLANSSFSSGLATRKKKNNKSNLKE

SEQ ID NO: 2328435 - protein, 9 aa, Cryptosporidium parvum
GYAPKPSTF

SEQ ID NO: 2328436 - protein, 9 aa, Cryptosporidium parvum
GYAPSTSNF

SEQ ID NO: 2328437 - protein, 10 aa, Cryptosporidium parvum
GYATNSAQRI

SEQ ID NO: 2328438 - protein, 9 aa, Cryptosporidium parvum
GYEKSKSTY

SEQ ID NO: 2328439 - protein, 4 aa, Cryptosporidium parvum
GYEL

SEQ ID NO: 2328440 - protein, 6 aa, Cryptosporidium parvum
GYEPVQ

SEQ ID NO: 2328441 - protein, 6 aa, Cryptosporidium parvum
GYGRTK

SEQ ID NO: 2328442 - protein, 11 aa, Cryptosporidium parvum
GYKITGANNQL

SEQ ID NO: 2328443 - protein, 12 aa, Cryptosporidium parvum
GYLDTENSKPLQ

SEQ ID NO: 2328444 - protein, 7 aa, Cryptosporidium parvum
GYNEYGR

SEQ ID NO: 2328445 - protein, 7 aa, Cryptosporidium parvum
GYNPEGA

SEQ ID NO: 2328446 - protein, 7 aa, Cryptosporidium parvum
GYNPSNT

SEQ ID NO: 2328447 - protein, 10 aa, Cryptosporidium parvum
GYNSKLDKAS

SEQ ID NO: 2328448 - protein, 5 aa, Cryptosporidium parvum
GYNTE

SEQ ID NO: 2328449 - protein, 5 aa, Cryptosporidium parvum
GYPKI

SEQ ID NO: 2328450 - protein, 5 aa, Cryptosporidium parvum
GYSNG

SEQ ID NO: 2328451 - protein, 8 aa, Cryptosporidium parvum
GYSPLKSN

SEQ ID NO: 2328452 - protein, 7 aa, Cryptosporidium parvum
GYSPSRS

SEQ ID NO: 2328453 - protein, 8 aa, Cryptosporidium parvum
GYTDGDKG

SEQ ID NO: 2328454 - protein, 12 aa, Cryptosporidium parvum
HAHHNNESNNQH

SEQ ID NO: 2328455 - protein, 5 aa, Cryptosporidium parvum
HANED

SEQ ID NO: 2328456 - protein, 8 aa, Cryptosporidium parvum
HAQRTREK

SEQ ID NO: 2328457 - protein, 7 aa, Cryptosporidium parvum
HCHDKKQ

SEQ ID NO: 2328458 - protein, 12 aa, Cryptosporidium parvum
HCTGGSCSPARV

SEQ ID NO: 2328459 - protein, 6 aa, Cryptosporidium parvum
HDGPVK

SEQ ID NO: 2328460 - protein, 5 aa, Cryptosporidium parvum
HDHYE

SEQ ID NO: 2328461 - protein, 9 aa, Cryptosporidium parvum
HDPARKSNL

SEQ ID NO: 2328462 - protein, 14 aa, Cryptosporidium parvum
HDSLEEKLNSQEVV

SEQ ID NO: 2328463 - protein, 38 aa, Cryptosporidium parvum
HEASTSSNNQEKIKNDGEYSGSEHSEKSKTSQKEEVSG

SEQ ID NO: 2328464 - protein, 8 aa, Cryptosporidium parvum
HEATESPL

SEQ ID NO: 2328465 - protein, 10 aa, Cryptosporidium parvum
HEEDPNNIKD

SEQ ID NO: 2328466 - protein, 16 aa, Cryptosporidium parvum
HEEKFQSEYSPKNQEE

SEQ ID NO: 2328467 - protein, 4 aa, Cryptosporidium parvum
HENK

SEQ ID NO: 2328468 - protein, 37 aa, Cryptosporidium parvum
HENLTANSSISNGTKTSNVLNNTDSFENDVISTAREE

SEQ ID NO: 2328469 - protein, 10 aa, Cryptosporidium parvum
HENNDESDSM

SEQ ID NO: 2328470 - protein, 5 aa, Cryptosporidium parvum
HEPEN

SEQ ID NO: 2328471 - protein, 5 aa, Cryptosporidium parvum
HESNS

SEQ ID NO: 2328472 - protein, 6 aa, Cryptosporidium parvum
HESQNG

SEQ ID NO: 2328473 - protein, 13 aa, Cryptosporidium parvum
HETASSPASRTHY

SEQ ID NO: 2328474 - protein, 4 aa, Cryptosporidium parvum
HETN

SEQ ID NO: 2328475 - protein, 6 aa, Cryptosporidium parvum
HEYENQ

SEQ ID NO: 2328476 - protein, 7 aa, Cryptosporidium parvum
HGARTPV

SEQ ID NO: 2328477 - protein, 4 aa, Cryptosporidium parvum
HGDW

SEQ ID NO: 2328478 - protein, 13 aa, Cryptosporidium parvum
HGGKNNAYTSEER

SEQ ID NO: 2328479 - protein, 12 aa, Cryptosporidium parvum
HGKNPRNPNSYN

SEQ ID NO: 2328480 - protein, 9 aa, Cryptosporidium parvum
HGKSGNQSI

SEQ ID NO: 2328481 - protein, 5 aa, Cryptosporidium parvum
HGNGK

SEQ ID NO: 2328482 - protein, 16 aa, Cryptosporidium parvum
HGNPSNILGSELFSID

SEQ ID NO: 2328483 - protein, 9 aa, Cryptosporidium parvum
HGSSKQRKE

SEQ ID NO: 2328484 - protein, 5 aa, Cryptosporidium parvum
HIEGK

SEQ ID NO: 2328485 - protein, 13 aa, Cryptosporidium parvum
HIKGKNSNRKNRQ

SEQ ID NO: 2328486 - protein, 11 aa, Cryptosporidium parvum
HISTQKDENLN

SEQ ID NO: 2328487 - protein, 8 aa, Cryptosporidium parvum
HKEAPRPI

SEQ ID NO: 2328488 - protein, 4 aa, Cryptosporidium parvum
HKIS

SEQ ID NO: 2328489 - protein, 6 aa, Cryptosporidium parvum
HKKHGV

SEQ ID NO: 2328490 - protein, 4 aa, Cryptosporidium parvum
HKKK

SEQ ID NO: 2328491 - protein, 4 aa, Cryptosporidium parvum
HKNE

SEQ ID NO: 2328492 - protein, 7 aa, Cryptosporidium parvum
HKNSDYD

SEQ ID NO: 2328493 - protein, 13 aa, Cryptosporidium parvum
HKPIPDHFKANDP

SEQ ID NO: 2328494 - protein, 12 aa, Cryptosporidium parvum
HKPTKDEKRTTV

SEQ ID NO: 2328495 - protein, 5 aa, Cryptosporidium parvum
HKSKN

SEQ ID NO: 2328496 - protein, 10 aa, Cryptosporidium parvum
HKTENDNVEG

SEQ ID NO: 2328497 - protein, 68 aa, Cryptosporidium parvum
HKTGTNQNTTRRNSSSRAGGFGNGKRTPPHPPPSSGSSAPPPPPPPPPPPPPPPPPPPSPPPSPPPSP

SEQ ID NO: 2328498 - protein, 12 aa, Cryptosporidium parvum
HKTSKKTSKRRY

SEQ ID NO: 2328499 - protein, 11 aa, Cryptosporidium parvum
HLEGSDSAEHI

SEQ ID NO: 2328500 - protein, 11 aa, Cryptosporidium parvum
HLKNEKNDKSI

SEQ ID NO: 2328501 - protein, 34 aa, Cryptosporidium parvum; identical to SEQ ID NO: 2202417

SEQ ID NO: 2328502 - protein, 6 aa, Cryptosporidium parvum
HNGDKK

SEQ ID NO: 2328503 - protein, 6 aa, Cryptosporidium parvum
HNHSKQ

SEQ ID NO: 2328504 - protein, 10 aa, Cryptosporidium parvum
HNKRDLDPSH

SEQ ID NO: 2328505 - protein, 7 aa, Cryptosporidium parvum
HNPGSIQ

SEQ ID NO: 2328506 - protein, 12 aa, Cryptosporidium parvum
HNRKDSKNWRAR

SEQ ID NO: 2328507 - protein, 21 aa, Cryptosporidium parvum
HNSDKPTPECERSNKQSVTTV

SEQ ID NO: 2328508 - protein, 8 aa, Cryptosporidium parvum
HNSNNNLS

SEQ ID NO: 2328509 - protein, 5 aa, Cryptosporidium parvum
HNTIS

SEQ ID NO: 2328510 - protein, 4 aa, Cryptosporidium parvum
HNTQ

SEQ ID NO: 2328511 - protein, 19 aa, Cryptosporidium parvum
HNTTKSSNKYFNNQSSRMK

SEQ ID NO: 2328512 - protein, 16 aa, Cryptosporidium parvum
HPDKNKENSSDARSEE

SEQ ID NO: 2328513 - protein, 11 aa, Cryptosporidium parvum
HPDKNPGSKEK

SEQ ID NO: 2328514 - protein, 10 aa, Cryptosporidium parvum
HPDNGGSNYV

SEQ ID NO: 2328515 - protein, 6 aa, Cryptosporidium parvum
HPENTH

SEQ ID NO: 2328516 - protein, 8 aa, Cryptosporidium parvum
HPNSSEYR

SEQ ID NO: 2328517 - protein, 14 aa, Cryptosporidium parvum
HPNSSHYTPPKPSI

SEQ ID NO: 2328518 - protein, 8 aa, Cryptosporidium parvum
HPPDPADV

SEQ ID NO: 2328519 - protein, 35 aa, Cryptosporidium parvum
HPPPVGPPPPVGPPPPVGPPPPVGPPPPVGPPPPQ

SEQ ID NO: 2328520 - protein, 17 aa, Cryptosporidium parvum
HPPTPENLPDKASGRGF

SEQ ID NO: 2328521 - protein, 14 aa, Cryptosporidium parvum
HQKEAKEGKYKEEK

SEQ ID NO: 2328522 - protein, 19 aa, Cryptosporidium parvum
HQNPSSKIQRTNEDIKDGV

SEQ ID NO: 2328523 - protein, 5 aa, Cryptosporidium parvum
HQQEP

SEQ ID NO: 2328524 - protein, 4 aa, Cryptosporidium parvum
HQSS

SEQ ID NO: 2328525 - protein, 12 aa, Cryptosporidium parvum
HQSTDLRNNENS

SEQ ID NO: 2328526 - protein, 9 aa, Cryptosporidium parvum
HREKPEHLR

SEQ ID NO: 2328527 - protein, 4 aa, Cryptosporidium parvum
HRGK

SEQ ID NO: 2328528 - protein, 7 aa, Cryptosporidium parvum
HRRGGYV

SEQ ID NO: 2328529 - protein, 62 aa, Cryptosporidium parvum
HRTGANRNLTGGNPLSRDKSLGDEKRTPSPNIPPPPSFPAPPPPSIPSGTPSHTPIPKDENL

SEQ ID NO: 2328530 - protein, 100 aa, Cryptosporidium parvum
HRTGANRSLNGRNPLSRDKSLDEKRTPSLNIPSPPSFPAPQPPTYPKPSPPSYVSPSNGIPSHIPTRENENWNSGPTVDKTSQWGSSQLGPKSSRRPLTK

SEQ ID NO: 2328531 - protein, 6 aa, Cryptosporidium parvum
HSAGAK

SEQ ID NO: 2328532 - protein, 5 aa, Cryptosporidium parvum
HSEIA

SEQ ID NO: 2328533 - protein, 7 aa, Cryptosporidium parvum
HSHGHSH

SEQ ID NO: 2328534 - protein, 5 aa, Cryptosporidium parvum
HSKDG

SEQ ID NO: 2328535 - protein, 5 aa, Cryptosporidium parvum
HSKIP

SEQ ID NO: 2328536 - protein, 4 aa, Cryptosporidium parvum
HSNH

SEQ ID NO: 2328537 - protein, 41 aa, Cryptosporidium parvum
HSNSPSQILESSSSMSNTRGKQEQASCKNKDKEDEKSKKGL

SEQ ID NO: 2328538 - protein, 16 aa, Cryptosporidium parvum
HSPPIQRSSRSSRAIQ

SEQ ID NO: 2328539 - protein, 16 aa, Cryptosporidium parvum
HSPQTWPNRASPGENL

SEQ ID NO: 2328540 - protein, 7 aa, Cryptosporidium parvum
HSQKTHQ

SEQ ID NO: 2328541 - protein, 9 aa, Cryptosporidium parvum
HSQRKTATA

SEQ ID NO: 2328542 - protein, 6 aa, Cryptosporidium parvum
HSRGIP

SEQ ID NO: 2328543 - protein, 25 aa, Cryptosporidium parvum
HSRYGQSKVRSSTGAFPIGSKARKR

SEQ ID NO: 2328544 - protein, 5 aa, Cryptosporidium parvum
HSSAN

SEQ ID NO: 2328545 - protein, 10 aa, Cryptosporidium parvum
HSSNNQSGSH

SEQ ID NO: 2328546 - protein, 10 aa, Cryptosporidium parvum
HSSTAKFGLP

SEQ ID NO: 2328547 - protein, 8 aa, Cryptosporidium parvum
HSSYPNDK

SEQ ID NO: 2328548 - protein, 53 aa, Cryptosporidium parvum
HTKARRSARIASSRQHSSSHPFSPQTPSTSSSLQSEFSQSQTRLPSAHTTSRS

SEQ ID NO: 2328549 - protein, 10 aa, Cryptosporidium parvum
HTQTRMQNGS

SEQ ID NO: 2328550 - protein, 6 aa, Cryptosporidium parvum
HTSEEC

SEQ ID NO: 2328551 - protein, 6 aa, Cryptosporidium parvum
HTTLRK

SEQ ID NO: 2328552 - protein, 6 aa, Cryptosporidium parvum
HTTPTN

SEQ ID NO: 2328553 - protein, 7 aa, Cryptosporidium parvum
HTYQSSN

SEQ ID NO: 2328554 - protein, 13 aa, Cryptosporidium parvum
HVGSTGISSPDRL

SEQ ID NO: 2328555 - protein, 54 aa, Cryptosporidium parvum
HVKPSNEGKEQKKQDKKKTKAEKELKENEEGESSSCSSKKKSKKTKTTQTQGPE

SEQ ID NO: 2328556 - protein, 12 aa, Cryptosporidium parvum
HYNENNSSGKYL

SEQ ID NO: 2328557 - protein, 12 aa, Cryptosporidium parvum
HYRDKGASMDKS

SEQ ID NO: 2328558 - protein, 9 aa, Cryptosporidium parvum
HYSENKTQY

SEQ ID NO: 2328559 - protein, 5 aa, Cryptosporidium parvum
HYTSS

SEQ ID NO: 2328560 - protein, 11 aa, Cryptosporidium parvum
IAAKGNNHEGI

SEQ ID NO: 2328561 - protein, 9 aa, Cryptosporidium parvum
IAENYPNSN

SEQ ID NO: 2328562 - protein, 15 aa, Cryptosporidium parvum
IAEQKAKEAKEAKQN

SEQ ID NO: 2328563 - protein, 9 aa, Cryptosporidium parvum
IAKYGEDDI

SEQ ID NO: 2328564 - protein, 10 aa, Cryptosporidium parvum
IANSEKSCKE

SEQ ID NO: 2328565 - protein, 5 aa, Cryptosporidium parvum
IAPDL

SEQ ID NO: 2328566 - protein, 7 aa, Cryptosporidium parvum
IAPKDTM

SEQ ID NO: 2328567 - protein, 9 aa, Cryptosporidium parvum
IASKPKHPL

SEQ ID NO: 2328568 - protein, 13 aa, Cryptosporidium parvum
ICTSNDNSNSGGA

SEQ ID NO: 2328569 - protein, 22 aa, Cryptosporidium parvum
IDEGEQTEAEDDIKVEKSEDQF

SEQ ID NO: 2328570 - protein, 15 aa, Cryptosporidium parvum
IDGEDHYYNNENDLS

SEQ ID NO: 2328571 - protein, 9 aa, Cryptosporidium parvum
IDGSQNEVE

SEQ ID NO: 2328572 - protein, 9 aa, Cryptosporidium parvum
IDGTPDQSK

SEQ ID NO: 2328573 - protein, 5 aa, Cryptosporidium parvum
IDIDQ

SEQ ID NO: 2328574 - protein, 5 aa, Cryptosporidium parvum
IDNNT

SEQ ID NO: 2328575 - protein, 4 aa, Cryptosporidium parvum
IDNS

SEQ ID NO: 2328576 - protein, 6 aa, Cryptosporidium parvum
IDPDNL

SEQ ID NO: 2328577 - protein, 7 aa, Cryptosporidium parvum
IDPINNQ

SEQ ID NO: 2328578 - protein, 4 aa, Cryptosporidium parvum
IDPS

SEQ ID NO: 2328579 - protein, 9 aa, Cryptosporidium parvum
IDPSSTPNL

SEQ ID NO: 2328580 - protein, 5 aa, Cryptosporidium parvum
IDPTK

SEQ ID NO: 2328581 - protein, 7 aa, Cryptosporidium parvum
IDQEGGF

SEQ ID NO: 2328582 - protein, 14 aa, Cryptosporidium parvum
IDQPREWNTPQYSS

SEQ ID NO: 2328583 - protein, 8 aa, Cryptosporidium parvum
IDRKRSKA

SEQ ID NO: 2328584 - protein, 87 aa, Cryptosporidium parvum
IDSGETKSLETTQAESGDKLRSKSKEHSKTHSHSRSRSTRSRTGSRGRSKSRSKSRSRRGRSRSRRGRSRSRSRSGSSGRKSEHNFD

SEQ ID NO: 2328585 - protein, 11 aa, Cryptosporidium parvum
IDSGIGAATPM

SEQ ID NO: 2328586 - protein, 15 aa, Cryptosporidium parvum
IDTGGDPGATLSPSK

SEQ ID NO: 2328587 - protein, 4 aa, Cryptosporidium parvum
IDTP

SEQ ID NO: 2328588 - protein, 6 aa, Cryptosporidium parvum
IEAPEQ

SEQ ID NO: 2328589 - protein, 20 aa, Cryptosporidium parvum
IEDEQTSNQVNNSPEFSGEK

SEQ ID NO: 2328590 - protein, 62 aa, Cryptosporidium parvum
IEEEEEEEARAPKKHRRARRSQSDLETGHKDSQQEAGSSSDEDSSQREKYPKRRSKRGRSGV

SEQ ID NO: 2328591 - protein, 32 aa, Cryptosporidium parvum
IEEETKPKSKSKLRGNKSSNSMVSGSDCPQST

SEQ ID NO: 2328592 - protein, 19 aa, Cryptosporidium parvum
IEEGSHSAAVDHNGEVTDD

SEQ ID NO: 2328593 - protein, 5 aa, Cryptosporidium parvum
IEENG

SEQ ID NO: 2328594 - protein, 16 aa, Cryptosporidium parvum
IEENKNSDHSVGNGIY

SEQ ID NO: 2328595 - protein, 12 aa, Cryptosporidium parvum
IEESPSPIKQGE

SEQ ID NO: 2328596 - protein, 12 aa, Cryptosporidium parvum
IEGGKTSYGNTP

SEQ ID NO: 2328597 - protein, 4 aa, Cryptosporidium parvum
IEGN

SEQ ID NO: 2328598 - protein, 8 aa, Cryptosporidium parvum
IEIRTPEG

SEQ ID NO: 2328599 - protein, 12 aa, Cryptosporidium parvum
IEKTRSNTKNPF

SEQ ID NO: 2328600 - protein, 13 aa, Cryptosporidium parvum
IENNSGKGKHLSK

SEQ ID NO: 2328601 - protein, 5 aa, Cryptosporidium parvum
IEPNQ

SEQ ID NO: 2328602 - protein, 7 aa, Cryptosporidium parvum
IEPQPRE

SEQ ID NO: 2328603 - protein, 4 aa, Cryptosporidium parvum
IEPV

SEQ ID NO: 2328604 - protein, 10 aa, Cryptosporidium parvum
IEQESNKTFG

SEQ ID NO: 2328605 - protein, 17 aa, Cryptosporidium parvum
IEQMEEEELKSKKNKKM

SEQ ID NO: 2328606 - protein, 8 aa, Cryptosporidium parvum
IESDDPEV

SEQ ID NO: 2328607 - protein, 13 aa, Cryptosporidium parvum
IESEEKAEEDLAN

SEQ ID NO: 2328608 - protein, 80 aa, Cryptosporidium parvum
IESEGNIKVGNSAKDSEDDVNDESNSIIKGEEEKNNDQGLTMNNTESGNSTSTENTNDNNETISQNITEADSNNNNNDSL

SEQ ID NO: 2328609 - protein, 10 aa, Cryptosporidium parvum
IESKEYSTTT

SEQ ID NO: 2328610 - protein, 11 aa, Cryptosporidium parvum
IESRISSSKSK

SEQ ID NO: 2328611 - protein, 11 aa, Cryptosporidium parvum
IESSGATFDQE

SEQ ID NO: 2328612 - protein, 10 aa, Cryptosporidium parvum
IESSRTQNKL

SEQ ID NO: 2328613 - protein, 5 aa, Cryptosporidium parvum
IFTTT

SEQ ID NO: 2328614 - protein, 17 aa, Cryptosporidium parvum
IGANSKKVDEFSDEYSS

SEQ ID NO: 2328615 - protein, 5 aa, Cryptosporidium parvum
IGAPQ

SEQ ID NO: 2328616 - protein, 9 aa, Cryptosporidium parvum
IGENEDASR

SEQ ID NO: 2328617 - protein, 4 aa, Cryptosporidium parvum
IGER

SEQ ID NO: 2328618 - protein, 12 aa, Cryptosporidium parvum
IGESAKNQATIN

SEQ ID NO: 2328619 - protein, 5 aa, Cryptosporidium parvum
IGGEE

SEQ ID NO: 2328620 - protein, 23 aa, Cryptosporidium parvum
IGGGGRSGVLGQTSSVGPNLPDR

SEQ ID NO: 2328621 - protein, 5 aa, Cryptosporidium parvum
IGGNI

SEQ ID NO: 2328622 - protein, 29 aa, Cryptosporidium parvum
IGKKKGKNKKRKSKKKKNNKGKEKRSGIL

SEQ ID NO: 2328623 - protein, 5 aa, Cryptosporidium parvum
IGKKT

SEQ ID NO: 2328624 - protein, 8 aa, Cryptosporidium parvum
IGKSSSSY

SEQ ID NO: 2328625 - protein, 17 aa, Cryptosporidium parvum
IGNNDHSRTNSSFTTDS

SEQ ID NO: 2328626 - protein, 4 aa, Cryptosporidium parvum
IGNP

SEQ ID NO: 2328627 - protein, 6 aa, Cryptosporidium parvum
IGNPQY

SEQ ID NO: 2328628 - protein, 8 aa, Cryptosporidium parvum
IGNPTQPK

SEQ ID NO: 2328629 - protein, 5 aa, Cryptosporidium parvum
IGNSG

SEQ ID NO: 2328630 - protein, 5 aa, Cryptosporidium parvum
IGPLE

SEQ ID NO: 2328631 - protein, 9 aa, Cryptosporidium parvum
IGREGLASK

SEQ ID NO: 2328632 - protein, 6 aa, Cryptosporidium parvum
IGRNED

SEQ ID NO: 2328633 - protein, 5 aa, Cryptosporidium parvum
IGSAP

SEQ ID NO: 2328634 - protein, 11 aa, Cryptosporidium parvum
IGSDAQHTEPF

SEQ ID NO: 2328635 - protein, 34 aa, Cryptosporidium parvum
IGSDSSQNSSNESSGDEETCSSDVKKKKHVKKKD

SEQ ID NO: 2328636 - protein, 5 aa, Cryptosporidium parvum
IGSEV

SEQ ID NO: 2328637 - protein, 17 aa, Cryptosporidium parvum
IGSQDQEGGVVTTPEYP

SEQ ID NO: 2328638 - protein, 5 aa, Cryptosporidium parvum
IGSSC

SEQ ID NO: 2328639 - protein, 17 aa, Cryptosporidium parvum
IGTKGGRAIKGREVNPI

SEQ ID NO: 2328640 - protein, 7 aa, Cryptosporidium parvum
IGTNNKD

SEQ ID NO: 2328641 - protein, 27 aa, Cryptosporidium parvum
IGTSSSSSTQFTGSSSGQTGGNSTGFR

SEQ ID NO: 2328642 - protein, 7 aa, Cryptosporidium parvum
IGTTERI

SEQ ID NO: 2328643 - protein, 8 aa, Cryptosporidium parvum
IGTTPYSP

SEQ ID NO: 2328644 - protein, 4 aa, Cryptosporidium parvum
IHND

SEQ ID NO: 2328645 - protein, 4 aa, Cryptosporidium parvum
IIKT

SEQ ID NO: 2328646 - protein, 12 aa, Cryptosporidium parvum
IKAANNETHNKY

SEQ ID NO: 2328647 - protein, 27 aa, Cryptosporidium parvum
IKAKEEANKYKESIKKREMSRAEGSVR

SEQ ID NO: 2328648 - protein, 11 aa, Cryptosporidium parvum
IKATKTKTRRY

SEQ ID NO: 2328649 - protein, 5 aa, Cryptosporidium parvum
IKDAQ

SEQ ID NO: 2328650 - protein, 10 aa, Cryptosporidium parvum
IKDKETNTYL

SEQ ID NO: 2328651 - protein, 5 aa, Cryptosporidium parvum
IKDPA

SEQ ID NO: 2328652 - protein, 8 aa, Cryptosporidium parvum
IKENDPKV

SEQ ID NO: 2328653 - protein, 19 aa, Cryptosporidium parvum
IKENENEENLSNATSNLNE

SEQ ID NO: 2328654 - protein, 7 aa, Cryptosporidium parvum
IKENEPI

SEQ ID NO: 2328655 - protein, 8 aa, Cryptosporidium parvum
IKENPPRY

SEQ ID NO: 2328656 - protein, 105 aa, Cryptosporidium parvum
IKENSEENVSESQRSISPKSNLESENIQGLSNGHEYGYSTDSSITKGEKNNSNSLAQENSPNSDSNSHNSQPEMSSLKSESSLDFGSNTDLSSSDSKSVSGSNSG

SEQ ID NO: 2328657 - protein, 12 aa, Cryptosporidium parvum
IKEQVENEIENI

SEQ ID NO: 2328658 - protein, 42 aa, Cryptosporidium parvum
IKETAAKMNQRTKESREKRNKSHKPGGFSSSSSLSSSSGSLF

SEQ ID NO: 2328659 - protein, 5 aa, Cryptosporidium parvum
IKGGG

SEQ ID NO: 2328660 - protein, 11 aa, Cryptosporidium parvum
IKKEDPPKDAL

SEQ ID NO: 2328661 - protein, 12 aa, Cryptosporidium parvum
IKKFSQSQNNNM

SEQ ID NO: 2328662 - protein, 10 aa, Cryptosporidium parvum
IKKSGAPSEE

SEQ ID NO: 2328663 - protein, 14 aa, Cryptosporidium parvum
IKNETSNENNSEEV

SEQ ID NO: 2328664 - protein, 13 aa, Cryptosporidium parvum
IKNNKCGKYFCSR

SEQ ID NO: 2328665 - protein, 10 aa, Cryptosporidium parvum
IKNNPEQKKD

SEQ ID NO: 2328666 - protein, 11 aa, Cryptosporidium parvum
IKNSNSNDKTL

SEQ ID NO: 2328667 - protein, 9 aa, Cryptosporidium parvum
IKNTTEDNL

SEQ ID NO: 2328668 - protein, 10 aa, Cryptosporidium parvum
IKPGETTKLE

SEQ ID NO: 2328669 - protein, 5 aa, Cryptosporidium parvum
IKPGR

SEQ ID NO: 2328670 - protein, 6 aa, Cryptosporidium parvum
IKPSIF

SEQ ID NO: 2328671 - protein, 16 aa, Cryptosporidium parvum
IKQKKALENQSPKKKV

SEQ ID NO: 2328672 - protein, 25 aa, Cryptosporidium parvum
IKQNDQKIKEKELKEYNEREESSNL

SEQ ID NO: 2328673 - protein, 10 aa, Cryptosporidium parvum
IKQNNDKIQV

SEQ ID NO: 2328674 - protein, 9 aa, Cryptosporidium parvum
IKRNNGNDL

SEQ ID NO: 2328675 - protein, 7 aa, Cryptosporidium parvum
IKRTDEK

SEQ ID NO: 2328676 - protein, 10 aa, Cryptosporidium parvum
IKSYKKKKRN

SEQ ID NO: 2328677 - protein, 14 aa, Cryptosporidium parvum
IKYADKENNQIVSS

SEQ ID NO: 2328678 - protein, 17 aa, Cryptosporidium parvum
ILETSTQTKGRKSQNEI

SEQ ID NO: 2328679 - protein, 8 aa, Cryptosporidium parvum
ILNDTSQK

SEQ ID NO: 2328680 - protein, 12 aa, Cryptosporidium parvum
ILPRSSVSTMDR

SEQ ID NO: 2328681 - protein, 9 aa, Cryptosporidium parvum
IMDKPTSSL

SEQ ID NO: 2328682 - protein, 9 aa, Cryptosporidium parvum
IMEKKQGES

SEQ ID NO: 2328683 - protein, 6 aa, Cryptosporidium parvum
INAAKG

SEQ ID NO: 2328684 - protein, 5 aa, Cryptosporidium parvum
INART

SEQ ID NO: 2328685 - protein, 10 aa, Cryptosporidium parvum
INDGSNYHTK

SEQ ID NO: 2328686 - protein, 6 aa, Cryptosporidium parvum
INDREK

SEQ ID NO: 2328687 - protein, 7 aa, Cryptosporidium parvum
INDSSKN

SEQ ID NO: 2328688 - protein, 6 aa, Cryptosporidium parvum
INDTNK

SEQ ID NO: 2328689 - protein, 5 aa, Cryptosporidium parvum
INEKV

SEQ ID NO: 2328690 - protein, 9 aa, Cryptosporidium parvum
INENISESQ

SEQ ID NO: 2328691 - protein, 22 aa, Cryptosporidium parvum
INESGNKVGGKATESSSITASG

SEQ ID NO: 2328692 - protein, 5 aa, Cryptosporidium parvum
INESK

SEQ ID NO: 2328693 - protein, 12 aa, Cryptosporidium parvum
INETSIPNEETN

SEQ ID NO: 2328694 - protein, 5 aa, Cryptosporidium parvum
INGDV

SEQ ID NO: 2328695 - protein, 5 aa, Cryptosporidium parvum
INGER

SEQ ID NO: 2328696 - protein, 14 aa, Cryptosporidium parvum
INHESTEHNVKDEN

SEQ ID NO: 2328697 - protein, 6 aa, Cryptosporidium parvum
INKARQ

SEQ ID NO: 2328698 - protein, 11 aa, Cryptosporidium parvum
INKKRSVRKQE

SEQ ID NO: 2328699 - protein, 10 aa, Cryptosporidium parvum
INKSQSQSEI

SEQ ID NO: 2328700 - protein, 6 aa, Cryptosporidium parvum
INPDFA

SEQ ID NO: 2328701 - protein, 10 aa, Cryptosporidium parvum
INPGSGNING

SEQ ID NO: 2328702 - protein, 45 aa, Cryptosporidium parvum
INPKFNEAESHSAEATKEADNKTLQEYYPEQSESEEKTQITETGH

SEQ ID NO: 2328703 - protein, 23 aa, Cryptosporidium parvum
INPKKKIKSKSKSETSERKPLIN

SEQ ID NO: 2328704 - protein, 4 aa, Cryptosporidium parvum
INPS

SEQ ID NO: 2328705 - protein, 5 aa, Cryptosporidium parvum
INPYE

SEQ ID NO: 2328706 - protein, 11 aa, Cryptosporidium parvum
INQETNERSNF

SEQ ID NO: 2328707 - protein, 5 aa, Cryptosporidium parvum
INSED

SEQ ID NO: 2328708 - protein, 6 aa, Cryptosporidium parvum
INSEEM

SEQ ID NO: 2328709 - protein, 9 aa, Cryptosporidium parvum
INSEGADFN

SEQ ID NO: 2328710 - protein, 10 aa, Cryptosporidium parvum
INSENGPQLR

SEQ ID NO: 2328711 - protein, 8 aa, Cryptosporidium parvum
INSKNSET

SEQ ID NO: 2328712 - protein, 7 aa, Cryptosporidium parvum
INSNNNS

SEQ ID NO: 2328713 - protein, 5 aa, Cryptosporidium parvum
INSRY

SEQ ID NO: 2328714 - protein, 6 aa, Cryptosporidium parvum
INSSFE

SEQ ID NO: 2328715 - protein, 9 aa, Cryptosporidium parvum
INSSPESYT

SEQ ID NO: 2328716 - protein, 6 aa, Cryptosporidium parvum
INSVES

SEQ ID NO: 2328717 - protein, 5 aa, Cryptosporidium parvum
IPAGI

SEQ ID NO: 2328718 - protein, 18 aa, Cryptosporidium parvum
IPDHEDNQEFPSLEARDE

SEQ ID NO: 2328719 - protein, 28 aa, Cryptosporidium parvum
IPDPNSRKQNGKSDHQSGSGSSTDFGTS

SEQ ID NO: 2328720 - protein, 5 aa, Cryptosporidium parvum
IPEEN

SEQ ID NO: 2328721 - protein, 13 aa, Cryptosporidium parvum
IPEGPPPTPPPGY

SEQ ID NO: 2328722 - protein, 18 aa, Cryptosporidium parvum
IPEIPGPPSRRGSGPISD

SEQ ID NO: 2328723 - protein, 4 aa, Cryptosporidium parvum
IPEL

SEQ ID NO: 2328724 - protein, 5 aa, Cryptosporidium parvum
IPEYD

SEQ ID NO: 2328725 - protein, 11 aa, Cryptosporidium parvum
IPEYDNNSNNI

SEQ ID NO: 2328726 - protein, 11 aa, Cryptosporidium parvum
IPEYEDNSNNI

SEQ ID NO: 2328727 - protein, 5 aa, Cryptosporidium parvum
IPFGK

SEQ ID NO: 2328728 - protein, 11 aa, Cryptosporidium parvum
IPGADDNSAIE

SEQ ID NO: 2328729 - protein, 9 aa, Cryptosporidium parvum
IPGDPDALE

SEQ ID NO: 2328730 - protein, 29 aa, Cryptosporidium parvum
IPGETGPEDFPQYETPGSPYSPTQTPEQF

SEQ ID NO: 2328731 - protein, 9 aa, Cryptosporidium parvum
IPGKDSSQC

SEQ ID NO: 2328732 - protein, 6 aa, Cryptosporidium parvum
IPGVGT

SEQ ID NO: 2328733 - protein, 12 aa, Cryptosporidium parvum
IPHTGRKGLTQE

SEQ ID NO: 2328734 - protein, 7 aa, Cryptosporidium parvum
IPKGAKI

SEQ ID NO: 2328735 - protein, 11 aa, Cryptosporidium parvum
IPKGQTNNTNI

SEQ ID NO: 2328736 - protein, 5 aa, Cryptosporidium parvum
IPKIG

SEQ ID NO: 2328737 - protein, 17 aa, Cryptosporidium parvum
IPKKQADVRPKKPTIAS

SEQ ID NO: 2328738 - protein, 4 aa, Cryptosporidium parvum
IPKQ

SEQ ID NO: 2328739 - protein, 5 aa, Cryptosporidium parvum
IPKSC

SEQ ID NO: 2328740 - protein, 5 aa, Cryptosporidium parvum
IPKSR

SEQ ID NO: 2328741 - protein, 21 aa, Cryptosporidium parvum
IPLSTQSQTQSEKDEPSVVPN

SEQ ID NO: 2328742 - protein, 6 aa, Cryptosporidium parvum
IPNETI

SEQ ID NO: 2328743 - protein, 6 aa, Cryptosporidium parvum
IPNEYG

SEQ ID NO: 2328744 - protein, 12 aa, Cryptosporidium parvum
IPNPTASSTTVD

SEQ ID NO: 2328745 - protein, 26 aa, Cryptosporidium parvum
IPNRNNNPLLASKGQDNDDSQIEKDS

SEQ ID NO: 2328746 - protein, 4 aa, Cryptosporidium parvum
IPPG

SEQ ID NO: 2328747 - protein, 10 aa, Cryptosporidium parvum
IPPPAAGRGP

SEQ ID NO: 2328748 - protein, 12 aa, Cryptosporidium parvum
IPPPSQDPPFGG

SEQ ID NO: 2328749 - protein, 4 aa, Cryptosporidium parvum
IPPT

SEQ ID NO: 2328750 - protein, 6 aa, Cryptosporidium parvum
IPPYQG

SEQ ID NO: 2328751 - protein, 5 aa, Cryptosporidium parvum
IPQPS

SEQ ID NO: 2328752 - protein, 6 aa, Cryptosporidium parvum
IPSKDE

SEQ ID NO: 2328753 - protein, 4 aa, Cryptosporidium parvum
IPSS

SEQ ID NO: 2328754 - protein, 7 aa, Cryptosporidium parvum
IPSSSSY

SEQ ID NO: 2328755 - protein, 12 aa, Cryptosporidium parvum
IPTEVNNGTFGS

SEQ ID NO: 2328756 - protein, 6 aa, Cryptosporidium parvum
IPTSTD

SEQ ID NO: 2328757 - protein, 11 aa, Cryptosporidium parvum
IPTSVSEKNDF

SEQ ID NO: 2328758 - protein, 12 aa, Cryptosporidium parvum
IPTYTPDSSPNF

SEQ ID NO: 2328759 - protein, 9 aa, Cryptosporidium parvum
IQDNETTEF

SEQ ID NO: 2328760 - protein, 21 aa, Cryptosporidium parvum
IQESSVDAKSSDSARDRSEFS

SEQ ID NO: 2328761 - protein, 5 aa, Cryptosporidium parvum
IQGKN

SEQ ID NO: 2328762 - protein, 13 aa, Cryptosporidium parvum
IQKDNAEVITNDS

SEQ ID NO: 2328763 - protein, 57 aa, Cryptosporidium parvum
IQKTGNKEYSSSELSSDAEQGKGVASRKHGKKGAGRKKSRSDKKQKAKTNGKKRRLG

SEQ ID NO: 2328764 - protein, 4 aa, Cryptosporidium parvum
IQLE

SEQ ID NO: 2328765 - protein, 5 aa, Cryptosporidium parvum
IQMPN

SEQ ID NO: 2328766 - protein, 4 aa, Cryptosporidium parvum
IQNP

SEQ ID NO: 2328767 - protein, 11 aa, Cryptosporidium parvum
IQNQAPTSKEI

SEQ ID NO: 2328768 - protein, 12 aa, Cryptosporidium parvum
IQNRNSQNNRYY

SEQ ID NO: 2328769 - protein, 13 aa, Cryptosporidium parvum
IQPAPSIEPDAPG

SEQ ID NO: 2328770 - protein, 11 aa, Cryptosporidium parvum
IQPENGCPEDY

SEQ ID NO: 2328771 - protein, 8 aa, Cryptosporidium parvum
IQPNNTDN

SEQ ID NO: 2328772 - protein, 12 aa, Cryptosporidium parvum
IQPPPEAKKGKN

SEQ ID NO: 2328773 - protein, 19 aa, Cryptosporidium parvum
IQPTEVATTTTTTTKTPWQ

SEQ ID NO: 2328774 - protein, 7 aa, Cryptosporidium parvum
IQQDKSF

SEQ ID NO: 2328775 - protein, 4 aa, Cryptosporidium parvum
IQSN

SEQ ID NO: 2328776 - protein, 39 aa, Cryptosporidium parvum
IQSQSQSQEQNQSQIQSQDQGQIQSQNQGQKQGQNHHSQ

SEQ ID NO: 2328777 - protein, 15 aa, Cryptosporidium parvum
IQSSRKKGKKPSRFD

SEQ ID NO: 2328778 - protein, 7 aa, Cryptosporidium parvum
IRARTRE

SEQ ID NO: 2328779 - protein, 10 aa, Cryptosporidium parvum
IRDPNNVNNN

SEQ ID NO: 2328780 - protein, 5 aa, Cryptosporidium parvum
IREEY

SEQ ID NO: 2328781 - protein, 5 aa, Cryptosporidium parvum
IRGGA

SEQ ID NO: 2328782 - protein, 95 aa, Cryptosporidium parvum
IRGGEQNKLESETPEETTTTTTTTAQPDSTSDEDTTTTTTTTTTTTTTTTTTTTTTEAPEPVETKEGEETDENTDETTTTTTTASPKPKSPSYKD

SEQ ID NO: 2328783 - protein, 14 aa, Cryptosporidium parvum
IRGGPHQKNCPQDL

SEQ ID NO: 2328784 - protein, 4 aa, Cryptosporidium parvum
IRGN

SEQ ID NO: 2328785 - protein, 6 aa, Cryptosporidium parvum
IRGSNV

SEQ ID NO: 2328786 - protein, 32 aa, Cryptosporidium parvum
IRPGGNEMNQLNGRSSSASSVNSNKSGNGKGG

SEQ ID NO: 2328787 - protein, 9 aa, Cryptosporidium parvum
IRPQKRQDE

SEQ ID NO: 2328788 - protein, 6 aa, Cryptosporidium parvum
IRSSER

SEQ ID NO: 2328789 - protein, 11 aa, Cryptosporidium parvum
IRTNSDQAIDN

SEQ ID NO: 2328790 - protein, 6 aa, Cryptosporidium parvum
ISADNT

SEQ ID NO: 2328791 - protein, 9 aa, Cryptosporidium parvum
ISDDPGYDV

SEQ ID NO: 2328792 - protein, 11 aa, Cryptosporidium parvum
ISDEQNSSIVN

SEQ ID NO: 2328793 - protein, 10 aa, Cryptosporidium parvum
ISDPNLSNDF

SEQ ID NO: 2328794 - protein, 7 aa, Cryptosporidium parvum
ISDRSSS

SEQ ID NO: 2328795 - protein, 17 aa, Cryptosporidium parvum
ISDSRKDTGAKASAPDF

SEQ ID NO: 2328796 - protein, 8 aa, Cryptosporidium parvum
ISDSSETM

SEQ ID NO: 2328797 - protein, 12 aa, Cryptosporidium parvum
ISEEGRKECPED

SEQ ID NO: 2328798 - protein, 13 aa, Cryptosporidium parvum
ISEGEDEDTSNIS

SEQ ID NO: 2328799 - protein, 8 aa, Cryptosporidium parvum
ISENRNNY

SEQ ID NO: 2328800 - protein, 7 aa, Cryptosporidium parvum
ISEPRPV

SEQ ID NO: 2328801 - protein, 12 aa, Cryptosporidium parvum
ISETNVNNGTWG

SEQ ID NO: 2328802 - protein, 7 aa, Cryptosporidium parvum
ISETVSS

SEQ ID NO: 2328803 - protein, 5 aa, Cryptosporidium parvum
ISFSE

SEQ ID NO: 2328804 - protein, 13 aa, Cryptosporidium parvum
ISGENKETGKNRE

SEQ ID NO: 2328805 - protein, 7 aa, Cryptosporidium parvum
ISGISGA

SEQ ID NO: 2328806 - protein, 5 aa, Cryptosporidium parvum
ISGKQ

SEQ ID NO: 2328807 - protein, 44 aa, Cryptosporidium parvum
ISGPAGTPPAPTPISTPTISTPTLPTLPPTPPSPSSPPSPTLPK

SEQ ID NO: 2328808 - protein, 34 aa, Cryptosporidium parvum
ISGPQDFPQENTSNQDSSGNNSNTQDNVGTANSN

SEQ ID NO: 2328809 - protein, 12 aa, Cryptosporidium parvum
ISGSRKNEEDSL

SEQ ID NO: 2328810 - protein, 17 aa, Cryptosporidium parvum
ISISPSSTDKTAFDSSI

SEQ ID NO: 2328811 - protein, 11 aa, Cryptosporidium parvum
ISKASEGSISP

SEQ ID NO: 2328812 - protein, 20 aa, Cryptosporidium parvum
ISKCSKKTSEPKPERNESDK

SEQ ID NO: 2328813 - protein, 13 aa, Cryptosporidium parvum
ISKEAEPTDEGRI

SEQ ID NO: 2328814 - protein, 11 aa, Cryptosporidium parvum
ISKGGYGPDGN

SEQ ID NO: 2328815 - protein, 7 aa, Cryptosporidium parvum
ISKNPED

SEQ ID NO: 2328816 - protein, 8 aa, Cryptosporidium parvum
ISLTDSED

SEQ ID NO: 2328817 - protein, 5 aa, Cryptosporidium parvum
ISNDS

SEQ ID NO: 2328818 - protein, 4 aa, Cryptosporidium parvum
ISNE

SEQ ID NO: 2328819 - protein, 5 aa, Cryptosporidium parvum
ISNEN

SEQ ID NO: 2328820 - protein, 10 aa, Cryptosporidium parvum
ISNKDGSPKM

SEQ ID NO: 2328821 - protein, 6 aa, Cryptosporidium parvum
ISNPNL

SEQ ID NO: 2328822 - protein, 46 aa, Cryptosporidium parvum
ISNTINKASNAVGSSKKDKKKQKEPKEEEEKEKVKEKKKNTIEGGL

SEQ ID NO: 2328823 - protein, 12 aa, Cryptosporidium parvum
ISPEQADYDGKQ

SEQ ID NO: 2328824 - protein, 5 aa, Cryptosporidium parvum
ISPNS

SEQ ID NO: 2328825 - protein, 7 aa, Cryptosporidium parvum
ISPPKNR

SEQ ID NO: 2328826 - protein, 6 aa, Cryptosporidium parvum
ISQDDK

SEQ ID NO: 2328827 - protein, 11 aa, Cryptosporidium parvum
ISQTNINNGTW

SEQ ID NO: 2328828 - protein, 5 aa, Cryptosporidium parvum
ISRKD

SEQ ID NO: 2328829 - protein, 4 aa, Cryptosporidium parvum
ISRN

SEQ ID NO: 2328830 - protein, 4 aa, Cryptosporidium parvum
ISSC

SEQ ID NO: 2328831 - protein, 17 aa, Cryptosporidium parvum
ISSDSGAIYPNDPKFSE

SEQ ID NO: 2328832 - protein, 5 aa, Cryptosporidium parvum
ISSEN

SEQ ID NO: 2328833 - protein, 9 aa, Cryptosporidium parvum
ISSETQFRE

SEQ ID NO: 2328834 - protein, 11 aa, Cryptosporidium parvum
ISSGDDNNSSM

SEQ ID NO: 2328835 - protein, 6 aa, Cryptosporidium parvum
ISSGGF

SEQ ID NO: 2328836 - protein, 67 aa, Cryptosporidium parvum
ISSISTKSKYDTSTTTSTTNSNIKRTVTSSPKAKDEETRTSTSTAKMSKTSTTTNSITTTNSFNSTT

SEQ ID NO: 2328837 - protein, 15 aa, Cryptosporidium parvum
ISSKNLNEIDKSDLG

SEQ ID NO: 2328838 - protein, 12 aa, Cryptosporidium parvum
ISSPTKTDNSSY

SEQ ID NO: 2328839 - protein, 6 aa, Cryptosporidium parvum
ISSTIE

SEQ ID NO: 2328840 - protein, 10 aa, Cryptosporidium parvum
ISSVDKPIGD

SEQ ID NO: 2328841 - protein, 23 aa, Cryptosporidium parvum
ISTGARARYGGKYASVSSSQEAE

SEQ ID NO: 2328842 - protein, 10 aa, Cryptosporidium parvum
ISTNGNIQGE

SEQ ID NO: 2328843 - protein, 14 aa, Cryptosporidium parvum
ISTTTTTTTSPPWD

SEQ ID NO: 2328844 - protein, 17 aa, Cryptosporidium parvum
ISYTPRSEYLSNKSYTL

SEQ ID NO: 2328845 - protein, 14 aa, Cryptosporidium parvum
ITGEEDVVGSPQCG

SEQ ID NO: 2328846 - protein, 5 aa, Cryptosporidium parvum
ITGPP

SEQ ID NO: 2328847 - protein, 5 aa, Cryptosporidium parvum
ITGTI

SEQ ID NO: 2328848 - protein, 9 aa, Cryptosporidium parvum
ITKSGPMET

SEQ ID NO: 2328849 - protein, 5 aa, Cryptosporidium parvum
ITNTP

SEQ ID NO: 2328850 - protein, 10 aa, Cryptosporidium parvum
ITPKDKSKQL

SEQ ID NO: 2328851 - protein, 6 aa, Cryptosporidium parvum
ITPKDV

SEQ ID NO: 2328852 - protein, 33 aa, Cryptosporidium parvum
ITPKRKTKPASSSKPKKKKPAQDKPPALETPTE

SEQ ID NO: 2328853 - protein, 4 aa, Cryptosporidium parvum
ITQD

SEQ ID NO: 2328854 - protein, 6 aa, Cryptosporidium parvum
ITQQAN

SEQ ID NO: 2328855 - protein, 7 aa, Cryptosporidium parvum
ITRNTAF

SEQ ID NO: 2328856 - protein, 12 aa, Cryptosporidium parvum
ITSETSTSELET

SEQ ID NO: 2328857 - protein, 4 aa, Cryptosporidium parvum
ITSG

SEQ ID NO: 2328858 - protein, 5 aa, Cryptosporidium parvum
ITSKT

SEQ ID NO: 2328859 - protein, 5 aa, Cryptosporidium parvum
ITSNE

SEQ ID NO: 2328860 - protein, 19 aa, Cryptosporidium parvum
ITSSEVSPLSEASDSLSTE

SEQ ID NO: 2328861 - protein, 12 aa, Cryptosporidium parvum
ITSSNDENKNDK

SEQ ID NO: 2328862 - protein, 8 aa, Cryptosporidium parvum
ITSSSSCR

SEQ ID NO: 2328863 - protein, 6 aa, Cryptosporidium parvum
ITSTES

SEQ ID NO: 2328864 - protein, 15 aa, Cryptosporidium parvum
ITTKQGTKSNTGSIL

SEQ ID NO: 2328865 - protein, 140 aa, Cryptosporidium parvum
IVTPDQDSNSENSENLDEGEKKEDGDKKEEGDNKEEGEKKEGDKNEDGEKKEGDKNEEGEKKEEGEKKEEGDKKEDGDNKEEGEKKEEGEKKEEGDNKEEGEKKEGDKNEDGEKKEEDKKENGEKKDGIEKFGENSDIEN

SEQ ID NO: 2328866 - protein, 8 aa, Cryptosporidium parvum
IYDPSKST

SEQ ID NO: 2328867 - protein, 6 aa, Cryptosporidium parvum
IYNSGD

SEQ ID NO: 2328868 - protein, 11 aa, Cryptosporidium parvum
IYPKGKNLSFG

SEQ ID NO: 2328869 - protein, 6 aa, Cryptosporidium parvum
KADPHP

SEQ ID NO: 2328870 - protein, 6 aa, Cryptosporidium parvum
KADSWQ

SEQ ID NO: 2328871 - protein, 15 aa, Cryptosporidium parvum
KADYYRQTNTTKDAD

SEQ ID NO: 2328872 - protein, 11 aa, Cryptosporidium parvum
KAEGAEGGDLA

SEQ ID NO: 2328873 - protein, 26 aa, Cryptosporidium parvum
KAEGDSISDNSPKGTQNNGELNTNGF

SEQ ID NO: 2328874 - protein, 7 aa, Cryptosporidium parvum
KAELKPE

SEQ ID NO: 2328875 - protein, 12 aa, Cryptosporidium parvum
KAFGKKQTKGGV

SEQ ID NO: 2328876 - protein, 6 aa, Cryptosporidium parvum
KAFSPL

SEQ ID NO: 2328877 - protein, 8 aa, Cryptosporidium parvum
KAGGNLPS

SEQ ID NO: 2328878 - protein, 8 aa, Cryptosporidium parvum
KAGRPSAE

SEQ ID NO: 2328879 - protein, 7 aa, Cryptosporidium parvum
KAGSRHP

SEQ ID NO: 2328880 - protein, 4 aa, Cryptosporidium parvum
KAIE

SEQ ID NO: 2328881 - protein, 9 aa, Cryptosporidium parvum
KAINSEGLG

SEQ ID NO: 2328882 - protein, 16 aa, Cryptosporidium parvum
KAKKNQRNKRNSFVRN

SEQ ID NO: 2328883 - protein, 4 aa, Cryptosporidium parvum
KAKS

SEQ ID NO: 2328884 - protein, 7 aa, Cryptosporidium parvum
KAKTPRD

SEQ ID NO: 2328885 - protein, 6 aa, Cryptosporidium parvum
KALETP

SEQ ID NO: 2328886 - protein, 12 aa, Cryptosporidium parvum
KALRNAKKEFTK

SEQ ID NO: 2328887 - protein, 8 aa, Cryptosporidium parvum
KAMEPSKG

SEQ ID NO: 2328888 - protein, 8 aa, Cryptosporidium parvum
KAMGTLSK

SEQ ID NO: 2328889 - protein, 8 aa, Cryptosporidium parvum
KANEKSSI

SEQ ID NO: 2328890 - protein, 7 aa, Cryptosporidium parvum
KANGPRS

SEQ ID NO: 2328891 - protein, 11 aa, Cryptosporidium parvum
KANSKSIRENY

SEQ ID NO: 2328892 - protein, 7 aa, Cryptosporidium parvum
KAPPRCV

SEQ ID NO: 2328893 - protein, 8 aa, Cryptosporidium parvum
KAQEKPEM

SEQ ID NO: 2328894 - protein, 13 aa, Cryptosporidium parvum
KARELGDEKKMDP

SEQ ID NO: 2328895 - protein, 8 aa, Cryptosporidium parvum
KASEDEKI

SEQ ID NO: 2328896 - protein, 5 aa, Cryptosporidium parvum
KASES

SEQ ID NO: 2328897 - protein, 7 aa, Cryptosporidium parvum
KASETDI

SEQ ID NO: 2328898 - protein, 7 aa, Cryptosporidium parvum
KASFENA

SEQ ID NO: 2328899 - protein, 8 aa, Cryptosporidium parvum
KASKRASK

SEQ ID NO: 2328900 - protein, 8 aa, Cryptosporidium parvum
KASPLSSH

SEQ ID NO: 2328901 - protein, 9 aa, Cryptosporidium parvum
KASSNSTLE

SEQ ID NO: 2328902 - protein, 6 aa, Cryptosporidium parvum
KASYSE

SEQ ID NO: 2328903 - protein, 13 aa, Cryptosporidium parvum
KATIPKNRPDGLP

SEQ ID NO: 2328904 - protein, 18 aa, Cryptosporidium parvum
KATKVSKKEAKKNKPKRA

SEQ ID NO: 2328905 - protein, 5 aa, Cryptosporidium parvum
KATMK

SEQ ID NO: 2328906 - protein, 5 aa, Cryptosporidium parvum
KATSR

SEQ ID NO: 2328907 - protein, 9 aa, Cryptosporidium parvum
KAVEGSSEK

SEQ ID NO: 2328908 - protein, 8 aa, Cryptosporidium parvum
KAYGNGEK

SEQ ID NO: 2328909 - protein, 11 aa, Cryptosporidium parvum
KCESDPKCPEG

SEQ ID NO: 2328910 - protein, 5 aa, Cryptosporidium parvum
KCKQV

SEQ ID NO: 2328911 - protein, 8 aa, Cryptosporidium parvum
KCNGNEYD

SEQ ID NO: 2328912 - protein, 46 aa, Cryptosporidium parvum
KCNSLDPSKKKYKSSRKKNRGGRKKRTVAEGRNEHSQSDADQSNDR

SEQ ID NO: 2328913 - protein, 6 aa, Cryptosporidium parvum
KCPNDD

SEQ ID NO: 2328914 - protein, 11 aa, Cryptosporidium parvum
KCSDSLTEKPA

SEQ ID NO: 2328915 - protein, 10 aa, Cryptosporidium parvum
KCSKASSHIK

SEQ ID NO: 2328916 - protein, 5 aa, Cryptosporidium parvum
KCSKI

SEQ ID NO: 2328917 - protein, 16 aa, Cryptosporidium parvum
KCTGSYQDLRDGTTDL

SEQ ID NO: 2328918 - protein, 24 aa, Cryptosporidium parvum
KCTSSKRQSCCSHKSKKYKLSRDE

SEQ ID NO: 2328919 - protein, 12 aa, Cryptosporidium parvum
KCTSYDTETGID

SEQ ID NO: 2328920 - protein, 17 aa, Cryptosporidium parvum
KDAEKINTNSFSRYPQN

SEQ ID NO: 2328921 - protein, 5 aa, Cryptosporidium parvum
KDAPY

SEQ ID NO: 2328922 - protein, 6 aa, Cryptosporidium parvum
KDDADS

SEQ ID NO: 2328923 - protein, 5 aa, Cryptosporidium parvum
KDDAS

SEQ ID NO: 2328924 - protein, 7 aa, Cryptosporidium parvum
KDDENEL

SEQ ID NO: 2328925 - protein, 10 aa, Cryptosporidium parvum
KDDNSDANLK

SEQ ID NO: 2328926 - protein, 7 aa, Cryptosporidium parvum
KDEESQT

SEQ ID NO: 2328927 - protein, 7 aa, Cryptosporidium parvum
KDEKRST

SEQ ID NO: 2328928 - protein, 14 aa, Cryptosporidium parvum
KDEYEKYKSGTPID

SEQ ID NO: 2328929 - protein, 5 aa, Cryptosporidium parvum
KDFQT

SEQ ID NO: 2328930 - protein, 22 aa, Cryptosporidium parvum
KDGFPNGGYESTSDPTNSNGDF

SEQ ID NO: 2328931 - protein, 8 aa, Cryptosporidium parvum
KDGGPSEI

SEQ ID NO: 2328932 - protein, 14 aa, Cryptosporidium parvum
KDGKGYASSGDGEC

SEQ ID NO: 2328933 - protein, 18 aa, Cryptosporidium parvum
KDGRDDGMAICRNNHLYI

SEQ ID NO: 2328934 - protein, 10 aa, Cryptosporidium parvum
KDGRRGNAID

SEQ ID NO: 2328935 - protein, 5 aa, Cryptosporidium parvum
KDGSF

SEQ ID NO: 2328936 - protein, 6 aa, Cryptosporidium parvum
KDGSWS

SEQ ID NO: 2328937 - protein, 6 aa, Cryptosporidium parvum
KDGYTF

SEQ ID NO: 2328938 - protein, 6 aa, Cryptosporidium parvum
KDHIDE

SEQ ID NO: 2328939 - protein, 6 aa, Cryptosporidium parvum
KDINNG

SEQ ID NO: 2328940 - protein, 6 aa, Cryptosporidium parvum
KDIPNE

SEQ ID NO: 2328941 - protein, 13 aa, Cryptosporidium parvum
KDITTCKTPLKKN

SEQ ID NO: 2328942 - protein, 6 aa, Cryptosporidium parvum
KDKIDT

SEQ ID NO: 2328943 - protein, 10 aa, Cryptosporidium parvum
KDKNSKFENN

SEQ ID NO: 2328944 - protein, 4 aa, Cryptosporidium parvum
KDLE

SEQ ID NO: 2328945 - protein, 13 aa, Cryptosporidium parvum
KDLEPEPATEISG

SEQ ID NO: 2328946 - protein, 33 aa, Cryptosporidium parvum
KDLKNNNLESDGPPAIESPPLPGQGLDSSDFKD

SEQ ID NO: 2328947 - protein, 6 aa, Cryptosporidium parvum
KDLRRS

SEQ ID NO: 2328948 - protein, 5 aa, Cryptosporidium parvum
KDLTE

SEQ ID NO: 2328949 - protein, 4 aa, Cryptosporidium parvum
KDND

SEQ ID NO: 2328950 - protein, 6 aa, Cryptosporidium parvum
KDNEKH

SEQ ID NO: 2328951 - protein, 8 aa, Cryptosporidium parvum
KDNFSGEK

SEQ ID NO: 2328952 - protein, 17 aa, Cryptosporidium parvum
KDNGIKESTADNKNEEE

SEQ ID NO: 2328953 - protein, 5 aa, Cryptosporidium parvum
KDNNS

SEQ ID NO: 2328954 - protein, 6 aa, Cryptosporidium parvum
KDNSKI

SEQ ID NO: 2328955 - protein, 8 aa, Cryptosporidium parvum
KDNSKNTA

SEQ ID NO: 2328956 - protein, 25 aa, Cryptosporidium parvum
KDNTDNKGNSIAKDADNGEISEKGD

SEQ ID NO: 2328957 - protein, 6 aa, Cryptosporidium parvum
KDPATR

SEQ ID NO: 2328958 - protein, 94 aa, Cryptosporidium parvum
KDPDDPEQNPSDMPSDEPHHSDDEEELCDDDDDDDDDDDEICDDEEEEKRQKEKEREEMENKHDQIDSGRKRQHKRKVRKNKNKSRPRGSGKHF

SEQ ID NO: 2328959 - protein, 91 aa, Cryptosporidium parvum
KDPDDPEQNPSDMPSDEPHNSDDEESCDDEDADEQPCDDEKEEEEKYQKEKEKEEMENKHDQVDSGRKRQHKRKIRKNKNNSRPRGSGKHF

SEQ ID NO: 2328960 - protein, 102 aa, Cryptosporidium parvum
KDPDDPSSYPSDMPSDEPSHNPDDDEESCDDDDDDYNDDDDDDDEEQCDDEEEEEERYQREKEKEEHENKHDQLDSGKKRRRKRKARKSKSNLRSRGSGKHF

SEQ ID NO: 2328961 - protein, 10 aa, Cryptosporidium parvum
KDPKPTPPYY

SEQ ID NO: 2328962 - protein, 5 aa, Cryptosporidium parvum
KDQEY

SEQ ID NO: 2328963 - protein, 10 aa, Cryptosporidium parvum
KDQNKASKVL

SEQ ID NO: 2328964 - protein, 8 aa, Cryptosporidium parvum
KDQNSSKE

SEQ ID NO: 2328965 - protein, 4 aa, Cryptosporidium parvum
KDQS

SEQ ID NO: 2328966 - protein, 5 aa, Cryptosporidium parvum
KDRAL

SEQ ID NO: 2328967 - protein, 4 aa, Cryptosporidium parvum
KDRH

SEQ ID NO: 2328968 - protein, 11 aa, Cryptosporidium parvum
KDRPSEYGDKG

SEQ ID NO: 2328969 - protein, 10 aa, Cryptosporidium parvum
KDSDRPRQKG

SEQ ID NO: 2328970 - protein, 7 aa, Cryptosporidium parvum
KDSGNPI

SEQ ID NO: 2328971 - protein, 6 aa, Cryptosporidium parvum
KDSNRF

SEQ ID NO: 2328972 - protein, 19 aa, Cryptosporidium parvum
KDSNTRPEKVSQYDRMENK

SEQ ID NO: 2328973 - protein, 6 aa, Cryptosporidium parvum
KDSSKI

SEQ ID NO: 2328974 - protein, 25 aa, Cryptosporidium parvum
KDSSSNTKEETKTQDGKNLTTTTSE

SEQ ID NO: 2328975 - protein, 9 aa, Cryptosporidium parvum
KDSTKEPFK

SEQ ID NO: 2328976 - protein, 6 aa, Cryptosporidium parvum
KDSTLV

SEQ ID NO: 2328977 - protein, 14 aa, Cryptosporidium parvum
KDTESRRSELASQL

SEQ ID NO: 2328978 - protein, 7 aa, Cryptosporidium parvum
KDTGNEE

SEQ ID NO: 2328979 - protein, 4 aa, Cryptosporidium parvum
KDTM

SEQ ID NO: 2328980 - protein, 6 aa, Cryptosporidium parvum
KDTTVS

SEQ ID NO: 2328981 - protein, 9 aa, Cryptosporidium parvum
KDYDLSKEK

SEQ ID NO: 2328982 - protein, 11 aa, Cryptosporidium parvum
KDYNKIPKSFS

SEQ ID NO: 2328983 - protein, 5 aa, Cryptosporidium parvum
KEADH

SEQ ID NO: 2328984 - protein, 11 aa, Cryptosporidium parvum
KEAEKSSAKEE

SEQ ID NO: 2328985 - protein, 17 aa, Cryptosporidium parvum
KEANEKLNEEVKSQAQK

SEQ ID NO: 2328986 - protein, 8 aa, Cryptosporidium parvum
KEATCKSD

SEQ ID NO: 2328987 - protein, 4 aa, Cryptosporidium parvum
KECP

SEQ ID NO: 2328988 - protein, 10 aa, Cryptosporidium parvum
KEDRDLEEEK

SEQ ID NO: 2328989 - protein, 20 aa, Cryptosporidium parvum
KEECSKGECVKGECKKGKCV

SEQ ID NO: 2328990 - protein, 4 aa, Cryptosporidium parvum
KEED

SEQ ID NO: 2328991 - protein, 12 aa, Cryptosporidium parvum
KEEEKSLQREEV

SEQ ID NO: 2328992 - protein, 7 aa, Cryptosporidium parvum
KEEGTDN

SEQ ID NO: 2328993 - protein, 5 aa, Cryptosporidium parvum
KEELE

SEQ ID NO: 2328994 - protein, 6 aa, Cryptosporidium parvum
KEEQKK

SEQ ID NO: 2328995 - protein, 8 aa, Cryptosporidium parvum
KEEQKPAR

SEQ ID NO: 2328996 - protein, 8 aa, Cryptosporidium parvum
KEETDNLV

SEQ ID NO: 2328997 - protein, 5 aa, Cryptosporidium parvum
KEFNN

SEQ ID NO: 2328998 - protein, 8 aa, Cryptosporidium parvum
KEGDSKKI

SEQ ID NO: 2328999 - protein, 30 aa, Cryptosporidium parvum
KEGDSRASQLGESSQLTSGISEASEPSSGN

SEQ ID NO: 2329000 - protein, 13 aa, Cryptosporidium parvum
KEGESTFNDEEYR

SEQ ID NO: 2329001 - protein, 10 aa, Cryptosporidium parvum
KEGNNGANKD

SEQ ID NO: 2329002 - protein, 62 aa, Cryptosporidium parvum
KEITERSNQPKKESNTEQEESTEKHLENKKVEQDSEEKEVSKKKTESGSSSLGRKERVSSPL

SEQ ID NO: 2329003 - protein, 12 aa, Cryptosporidium parvum
KEITGRSKPTVI

SEQ ID NO: 2329004 - protein, 6 aa, Cryptosporidium parvum
KEKAEE

SEQ ID NO: 2329005 - protein, 8 aa, Cryptosporidium parvum
KEKEAEIS

SEQ ID NO: 2329006 - protein, 9 aa, Cryptosporidium parvum
KEKENDSNM

SEQ ID NO: 2329007 - protein, 9 aa, Cryptosporidium parvum
KEKENGDDD

SEQ ID NO: 2329008 - protein, 10 aa, Cryptosporidium parvum
KEKKNNGEKI

SEQ ID NO: 2329009 - protein, 7 aa, Cryptosporidium parvum
KEKPKCV

SEQ ID NO: 2329010 - protein, 9 aa, Cryptosporidium parvum
KEKSEEEKF

SEQ ID NO: 2329011 - protein, 7 aa, Cryptosporidium parvum
KEKTEQL

SEQ ID NO: 2329012 - protein, 15 aa, Cryptosporidium parvum
KEKTQYQSQEQNQNQ

SEQ ID NO: 2329013 - protein, 5 aa, Cryptosporidium parvum
KEKVA

SEQ ID NO: 2329014 - protein, 5 aa, Cryptosporidium parvum
KELDS

SEQ ID NO: 2329015 - protein, 11 aa, Cryptosporidium parvum
KELGDEQDLDQ

SEQ ID NO: 2329016 - protein, 6 aa, Cryptosporidium parvum
KELKRK

SEQ ID NO: 2329017 - protein, 6 aa, Cryptosporidium parvum
KELREK

SEQ ID NO: 2329018 - protein, 5 aa, Cryptosporidium parvum
KELSP

SEQ ID NO: 2329019 - protein, 14 aa, Cryptosporidium parvum
KEMRQSKSDKRKKL

SEQ ID NO: 2329020 - protein, 13 aa, Cryptosporidium parvum
KENARNVPAPIGV

SEQ ID NO: 2329021 - protein, 8 aa, Cryptosporidium parvum
KENCESSQ

SEQ ID NO: 2329022 - protein, 17 aa, Cryptosporidium parvum
KENDDDDDLLNNEPSIS

SEQ ID NO: 2329023 - protein, 8 aa, Cryptosporidium parvum
KENDDGPI

SEQ ID NO: 2329024 - protein, 6 aa, Cryptosporidium parvum
KENNKD

SEQ ID NO: 2329025 - protein, 16 aa, Cryptosporidium parvum
KENNSSKPRSKRSDKP

SEQ ID NO: 2329026 - protein, 4 aa, Cryptosporidium parvum
KENR

SEQ ID NO: 2329027 - protein, 16 aa, Cryptosporidium parvum
KENSLTKNKKASSNID

SEQ ID NO: 2329028 - protein, 38 aa, Cryptosporidium parvum; identical to SEQ ID NO: 2147180

SEQ ID NO: 2329029 - protein, 6 aa, Cryptosporidium parvum
KEPNTI

SEQ ID NO: 2329030 - protein, 10 aa, Cryptosporidium parvum
KEPTPSGYDD

SEQ ID NO: 2329031 - protein, 32 aa, Cryptosporidium parvum
KEQPTKKIKDKTSSQVKSADLSSKSRGAFKQN

SEQ ID NO: 2329032 - protein, 6 aa, Cryptosporidium parvum
KEQYRE

SEQ ID NO: 2329033 - protein, 8 aa, Cryptosporidium parvum
KEREISSK

SEQ ID NO: 2329034 - protein, 9 aa, Cryptosporidium parvum
KERGEDDLA

SEQ ID NO: 2329035 - protein, 12 aa, Cryptosporidium parvum
KESAEKYVNENE

SEQ ID NO: 2329036 - protein, 5 aa, Cryptosporidium parvum
KESAR

SEQ ID NO: 2329037 - protein, 16 aa, Cryptosporidium parvum
KESCPGSCNLMKIVRC

SEQ ID NO: 2329038 - protein, 5 aa, Cryptosporidium parvum
KESDS

SEQ ID NO: 2329039 - protein, 18 aa, Cryptosporidium parvum
KESDSNNSNSKKLFKQNS

SEQ ID NO: 2329040 - protein, 12 aa, Cryptosporidium parvum
KESETNQPETEE

SEQ ID NO: 2329041 - protein, 6 aa, Cryptosporidium parvum
KESGKK

SEQ ID NO: 2329042 - protein, 6 aa, Cryptosporidium parvum
KESGMD

SEQ ID NO: 2329043 - protein, 7 aa, Cryptosporidium parvum
KESIGGS

SEQ ID NO: 2329044 - protein, 5 aa, Cryptosporidium parvum
KESKE

SEQ ID NO: 2329045 - protein, 10 aa, Cryptosporidium parvum
KESKFKNNKE

SEQ ID NO: 2329046 - protein, 11 aa, Cryptosporidium parvum
KESKPTLEIPE

SEQ ID NO: 2329047 - protein, 8 aa, Cryptosporidium parvum
KESNAKDG

SEQ ID NO: 2329048 - protein, 7 aa, Cryptosporidium parvum
KESTGTF

SEQ ID NO: 2329049 - protein, 10 aa, Cryptosporidium parvum
KESVGSKGPY

SEQ ID NO: 2329050 - protein, 5 aa, Cryptosporidium parvum
KESVV

SEQ ID NO: 2329051 - protein, 5 aa, Cryptosporidium parvum
KETAY

SEQ ID NO: 2329052 - protein, 8 aa, Cryptosporidium parvum
KETDEVKY

SEQ ID NO: 2329053 - protein, 8 aa, Cryptosporidium parvum
KETDKYEK

SEQ ID NO: 2329054 - protein, 6 aa, Cryptosporidium parvum
KETEER

SEQ ID NO: 2329055 - protein, 6 aa, Cryptosporidium parvum
KETENI

SEQ ID NO: 2329056 - protein, 7 aa, Cryptosporidium parvum
KETLQQR

SEQ ID NO: 2329057 - protein, 7 aa, Cryptosporidium parvum
KETLSQE

SEQ ID NO: 2329058 - protein, 8 aa, Cryptosporidium parvum
KETSEQFE

SEQ ID NO: 2329059 - protein, 8 aa, Cryptosporidium parvum
KEYGKNKV

SEQ ID NO: 2329060 - protein, 5 aa, Cryptosporidium parvum
KEYHE

SEQ ID NO: 2329061 - protein, 12 aa, Cryptosporidium parvum
KEYKNSTKNITA

SEQ ID NO: 2329062 - protein, 21 aa, Cryptosporidium parvum
KEYQKGNELSQDDDQFMYLMS

SEQ ID NO: 2329063 - protein, 5 aa, Cryptosporidium parvum
KEYQT

SEQ ID NO: 2329064 - protein, 8 aa, Cryptosporidium parvum
KEYSGNVS

SEQ ID NO: 2329065 - protein, 6 aa, Cryptosporidium parvum
KEYSGT

SEQ ID NO: 2329066 - protein, 5 aa, Cryptosporidium parvum
KFDTS

SEQ ID NO: 2329067 - protein, 9 aa, Cryptosporidium parvum
KFEEQKEQF

SEQ ID NO: 2329068 - protein, 8 aa, Cryptosporidium parvum
KFENEADS

SEQ ID NO: 2329069 - protein, 14 aa, Cryptosporidium parvum
KFGSNKRNSSRSVT

SEQ ID NO: 2329070 - protein, 7 aa, Cryptosporidium parvum
KFKNGKK

SEQ ID NO: 2329071 - protein, 19 aa, Cryptosporidium parvum
KFKSSQENKWKNFAKKVNS

SEQ ID NO: 2329072 - protein, 10 aa, Cryptosporidium parvum
KFNEREENEI

SEQ ID NO: 2329073 - protein, 5 aa, Cryptosporidium parvum
KFPKE

SEQ ID NO: 2329074 - protein, 8 aa, Cryptosporidium parvum
KFSTQYKA

SEQ ID NO: 2329075 - protein, 17 aa, Cryptosporidium parvum
KFTGSVDKYPSKYDPYD

SEQ ID NO: 2329076 - protein, 4 aa, Cryptosporidium parvum
KFTS

SEQ ID NO: 2329077 - protein, 7 aa, Cryptosporidium parvum
KGAEGEL

SEQ ID NO: 2329078 - protein, 15 aa, Cryptosporidium parvum
KGCEGNEICHVSFLF

SEQ ID NO: 2329079 - protein, 6 aa, Cryptosporidium parvum
KGDEEK

SEQ ID NO: 2329080 - protein, 9 aa, Cryptosporidium parvum
KGDKTNTKF

SEQ ID NO: 2329081 - protein, 10 aa, Cryptosporidium parvum
KGDPKNPDLA

SEQ ID NO: 2329082 - protein, 5 aa, Cryptosporidium parvum
KGDPS

SEQ ID NO: 2329083 - protein, 5 aa, Cryptosporidium parvum
KGDTF

SEQ ID NO: 2329084 - protein, 25 aa, Cryptosporidium parvum
KGEADASSLATTYTDSTPFISPTSD

SEQ ID NO: 2329085 - protein, 9 aa, Cryptosporidium parvum
KGEIRPNTE

SEQ ID NO: 2329086 - protein, 11 aa, Cryptosporidium parvum
KGEKKQLAPEE

SEQ ID NO: 2329087 - protein, 6 aa, Cryptosporidium parvum
KGEQVE

SEQ ID NO: 2329088 - protein, 12 aa, Cryptosporidium parvum
KGEVRKNVIRRK

SEQ ID NO: 2329089 - protein, 8 aa, Cryptosporidium parvum
KGFPTNDK

SEQ ID NO: 2329090 - protein, 6 aa, Cryptosporidium parvum
KGGDEI

SEQ ID NO: 2329091 - protein, 4 aa, Cryptosporidium parvum
KGGH

SEQ ID NO: 2329092 - protein, 24 aa, Cryptosporidium parvum
KGGMSSSSSSFSSNKISAKSTKIP

SEQ ID NO: 2329093 - protein, 6 aa, Cryptosporidium parvum
KGGNDL

SEQ ID NO: 2329094 - protein, 15 aa, Cryptosporidium parvum
KGGNEISKKKSYGPT

SEQ ID NO: 2329095 - protein, 4 aa, Cryptosporidium parvum
KGHQ

SEQ ID NO: 2329096 - protein, 4 aa, Cryptosporidium parvum
KGIE

SEQ ID NO: 2329097 - protein, 6 aa, Cryptosporidium parvum
KGIPIP

SEQ ID NO: 2329098 - protein, 6 aa, Cryptosporidium parvum
KGISTK

SEQ ID NO: 2329099 - protein, 10 aa, Cryptosporidium parvum
KGKNRDEPFG

SEQ ID NO: 2329100 - protein, 12 aa, Cryptosporidium parvum
KGKQEYYSPYTN

SEQ ID NO: 2329101 - protein, 8 aa, Cryptosporidium parvum
KGKSKEKN

SEQ ID NO: 2329102 - protein, 7 aa, Cryptosporidium parvum
KGLEERV

SEQ ID NO: 2329103 - protein, 11 aa, Cryptosporidium parvum
KGMPIRNTNEY

SEQ ID NO: 2329104 - protein, 9 aa, Cryptosporidium parvum
KGNPTTGYS

SEQ ID NO: 2329105 - protein, 6 aa, Cryptosporidium parvum
KGPEIR

SEQ ID NO: 2329106 - protein, 9 aa, Cryptosporidium parvum
KGPKSKRLC

SEQ ID NO: 2329107 - protein, 5 aa, Cryptosporidium parvum
KGPRA

SEQ ID NO: 2329108 - protein, 5 aa, Cryptosporidium parvum
KGQDS

SEQ ID NO: 2329109 - protein, 6 aa, Cryptosporidium parvum
KGQYNT

SEQ ID NO: 2329110 - protein, 13 aa, Cryptosporidium parvum
KGREIAKKEWESR

SEQ ID NO: 2329111 - protein, 10 aa, Cryptosporidium parvum
KGRHGQKDKK

SEQ ID NO: 2329112 - protein, 10 aa, Cryptosporidium parvum
KGRVNDTKKV

SEQ ID NO: 2329113 - protein, 4 aa, Cryptosporidium parvum
KGSI

SEQ ID NO: 2329114 - protein, 24 aa, Cryptosporidium parvum
KGSIASKQLGPNEPNSSSKNPVSS

SEQ ID NO: 2329115 - protein, 4 aa, Cryptosporidium parvum
KGSK

SEQ ID NO: 2329116 - protein, 15 aa, Cryptosporidium parvum
KGSLPTASSEVSESD

SEQ ID NO: 2329117 - protein, 6 aa, Cryptosporidium parvum
KGSNMI

SEQ ID NO: 2329118 - protein, 10 aa, Cryptosporidium parvum
KGSPDCPSNC

SEQ ID NO: 2329119 - protein, 6 aa, Cryptosporidium parvum
KGSYGE

SEQ ID NO: 2329120 - protein, 14 aa, Cryptosporidium parvum
KGTFRSDINDETRK

SEQ ID NO: 2329121 - protein, 5 aa, Cryptosporidium parvum
KGTGK

SEQ ID NO: 2329122 - protein, 5 aa, Cryptosporidium parvum
KGTGN

SEQ ID NO: 2329123 - protein, 6 aa, Cryptosporidium parvum
KGVEND

SEQ ID NO: 2329124 - protein, 10 aa, Cryptosporidium parvum
KGVRPSTVTP

SEQ ID NO: 2329125 - protein, 8 aa, Cryptosporidium parvum
KGYEKEQE

SEQ ID NO: 2329126 - protein, 8 aa, Cryptosporidium parvum
KGYTKSDI

SEQ ID NO: 2329127 - protein, 6 aa, Cryptosporidium parvum
KHCHGK

SEQ ID NO: 2329128 - protein, 11 aa, Cryptosporidium parvum
KHGKSLPDSAK

SEQ ID NO: 2329129 - protein, 13 aa, Cryptosporidium parvum
KHHGKNTRTANSH

SEQ ID NO: 2329130 - protein, 6 aa, Cryptosporidium parvum
KHLNNK

SEQ ID NO: 2329131 - protein, 8 aa, Cryptosporidium parvum
KHRTPNGN

SEQ ID NO: 2329132 - protein, 11 aa, Cryptosporidium parvum
KHSKRQKELEE

SEQ ID NO: 2329133 - protein, 6 aa, Cryptosporidium parvum
KHSRRQ

SEQ ID NO: 2329134 - protein, 4 aa, Cryptosporidium parvum
KHTS

SEQ ID NO: 2329135 - protein, 5 aa, Cryptosporidium parvum
KHVGP

SEQ ID NO: 2329136 - protein, 10 aa, Cryptosporidium parvum
KIASKFGKDS

SEQ ID NO: 2329137 - protein, 6 aa, Cryptosporidium parvum
KIDGST

SEQ ID NO: 2329138 - protein, 5 aa, Cryptosporidium parvum
KIDSF

SEQ ID NO: 2329139 - protein, 8 aa, Cryptosporidium parvum
KIEDGKET

SEQ ID NO: 2329140 - protein, 11 aa, Cryptosporidium parvum
KIEGDSGLNEN

SEQ ID NO: 2329141 - protein, 5 aa, Cryptosporidium parvum
KIEPR

SEQ ID NO: 2329142 - protein, 5 aa, Cryptosporidium parvum
KIERE

SEQ ID NO: 2329143 - protein, 5 aa, Cryptosporidium parvum
KIETR

SEQ ID NO: 2329144 - protein, 17 aa, Cryptosporidium parvum
KIGPTSGDETEGFQPPE

SEQ ID NO: 2329145 - protein, 55 aa, Cryptosporidium parvum
KIHESAKGKNRKSSESFAGEYESERIESPTLKYDETSRSGEKEQSISSIQEDQQY

SEQ ID NO: 2329146 - protein, 4 aa, Cryptosporidium parvum
KIHN

SEQ ID NO: 2329147 - protein, 5 aa, Cryptosporidium parvum
KIKGK

SEQ ID NO: 2329148 - protein, 7 aa, Cryptosporidium parvum
KIKNNPG

SEQ ID NO: 2329149 - protein, 4 aa, Cryptosporidium parvum
KIKT

SEQ ID NO: 2329150 - protein, 7 aa, Cryptosporidium parvum
KINEKQY

SEQ ID NO: 2329151 - protein, 5 aa, Cryptosporidium parvum
KINPE

SEQ ID NO: 2329152 - protein, 7 aa, Cryptosporidium parvum
KINSKHN

SEQ ID NO: 2329153 - protein, 6 aa, Cryptosporidium parvum
KIPKIN

SEQ ID NO: 2329154 - protein, 18 aa, Cryptosporidium parvum
KIPPPGELPIKSGNGACD

SEQ ID NO: 2329155 - protein, 8 aa, Cryptosporidium parvum
KIPTRPLP

SEQ ID NO: 2329156 - protein, 8 aa, Cryptosporidium parvum
KIQGSKNY

SEQ ID NO: 2329157 - protein, 15 aa, Cryptosporidium parvum
KIRELKQEIQILMDL

SEQ ID NO: 2329158 - protein, 6 aa, Cryptosporidium parvum
KISDGV

SEQ ID NO: 2329159 - protein, 13 aa, Cryptosporidium parvum
KISGDTSESRRRP

SEQ ID NO: 2329160 - protein, 11 aa, Cryptosporidium parvum
KISKKASEDAE

SEQ ID NO: 2329161 - protein, 12 aa, Cryptosporidium parvum
KISPSKGSVQRR

SEQ ID NO: 2329162 - protein, 6 aa, Cryptosporidium parvum
KISSGF

SEQ ID NO: 2329163 - protein, 6 aa, Cryptosporidium parvum
KISTHA

SEQ ID NO: 2329164 - protein, 12 aa, Cryptosporidium parvum
KISTRGTENNFD

SEQ ID NO: 2329165 - protein, 14 aa, Cryptosporidium parvum
KITPKTCTKADSVP

SEQ ID NO: 2329166 - protein, 8 aa, Cryptosporidium parvum
KIYSGKNE

SEQ ID NO: 2329167 - protein, 9 aa, Cryptosporidium parvum
KKAEDELSR

SEQ ID NO: 2329168 - protein, 6 aa, Cryptosporidium parvum
KKAEKS

SEQ ID NO: 2329169 - protein, 5 aa, Cryptosporidium parvum
KKAIN

SEQ ID NO: 2329170 - protein, 8 aa, Cryptosporidium parvum
KKCSKGEL

SEQ ID NO: 2329171 - protein, 7 aa, Cryptosporidium parvum
KKCSPGL

SEQ ID NO: 2329172 - protein, 6 aa, Cryptosporidium parvum
KKDDKK

SEQ ID NO: 2329173 - protein, 8 aa, Cryptosporidium parvum
KKDDTGNI

SEQ ID NO: 2329174 - protein, 10 aa, Cryptosporidium parvum
KKDDVESTNE

SEQ ID NO: 2329175 - protein, 23 aa, Cryptosporidium parvum
KKDLPSIEEEELDSEKARDLKQL

SEQ ID NO: 2329176 - protein, 8 aa, Cryptosporidium parvum
KKDPSSLE

SEQ ID NO: 2329177 - protein, 9 aa, Cryptosporidium parvum
KKDSESQAK

SEQ ID NO: 2329178 - protein, 8 aa, Cryptosporidium parvum
KKDSSTQE

SEQ ID NO: 2329179 - protein, 16 aa, Cryptosporidium parvum
KKDSYWRKTDDSKAVN

SEQ ID NO: 2329180 - protein, 6 aa, Cryptosporidium parvum
KKEGHY

SEQ ID NO: 2329181 - protein, 15 aa, Cryptosporidium parvum
KKEGPYDMTKNTRNN

SEQ ID NO: 2329182 - protein, 8 aa, Cryptosporidium parvum
KKENSSEK

SEQ ID NO: 2329183 - protein, 28 aa, Cryptosporidium parvum
KKEQKEKRLKEKREREEREKADRERSNI

SEQ ID NO: 2329184 - protein, 7 aa, Cryptosporidium parvum
KKESSFN

SEQ ID NO: 2329185 - protein, 10 aa, Cryptosporidium parvum
KKFPDASQRE

SEQ ID NO: 2329186 - protein, 76 aa, Cryptosporidium parvum
KKGKKFESKKSKIKEIKQQEGDNQEYDQEHDQEHDQEHEQEHEQEHEQEHEQEHEREHDQEQGQKHDQKYQDDYKD

SEQ ID NO: 2329187 - protein, 8 aa, Cryptosporidium parvum
KKGKKSLA

SEQ ID NO: 2329188 - protein, 15 aa, Cryptosporidium parvum
KKGPSGGSQSQTPSF

SEQ ID NO: 2329189 - protein, 10 aa, Cryptosporidium parvum
KKGRRPNGDF

SEQ ID NO: 2329190 - protein, 6 aa, Cryptosporidium parvum
KKGVNR

SEQ ID NO: 2329191 - protein, 7 aa, Cryptosporidium parvum
KKGWDKN

SEQ ID NO: 2329192 - protein, 9 aa, Cryptosporidium parvum
KKGYKKKRN

SEQ ID NO: 2329193 - protein, 6 aa, Cryptosporidium parvum
KKHSHN

SEQ ID NO: 2329194 - protein, 5 aa, Cryptosporidium parvum
KKIAD

SEQ ID NO: 2329195 - protein, 5 aa, Cryptosporidium parvum
KKIDP

SEQ ID NO: 2329196 - protein, 32 aa, Cryptosporidium parvum
KKIENSSNMNSSGVDPSGSSDLELSAESIGIS

SEQ ID NO: 2329197 - protein, 8 aa, Cryptosporidium parvum
KKINDSNK

SEQ ID NO: 2329198 - protein, 4 aa, Cryptosporidium parvum
KKIP

SEQ ID NO: 2329199 - protein, 5 aa, Cryptosporidium parvum
KKIST

SEQ ID NO: 2329200 - protein, 11 aa, Cryptosporidium parvum
KKKKQPRHPGK

SEQ ID NO: 2329201 - protein, 7 aa, Cryptosporidium parvum
KKKLRNS

SEQ ID NO: 2329202 - protein, 14 aa, Cryptosporidium parvum
KKKNATPDEVRSSI

SEQ ID NO: 2329203 - protein, 16 aa, Cryptosporidium parvum
KKKNKPDENQATQFKK

SEQ ID NO: 2329204 - protein, 10 aa, Cryptosporidium parvum
KKKPREVPGR

SEQ ID NO: 2329205 - protein, 7 aa, Cryptosporidium parvum
KKKQDEF

SEQ ID NO: 2329206 - protein, 10 aa, Cryptosporidium parvum
KKKQEEEEME

SEQ ID NO: 2329207 - protein, 11 aa, Cryptosporidium parvum
KKKQKEHENRK

SEQ ID NO: 2329208 - protein, 9 aa, Cryptosporidium parvum
KKKRDNKLD

SEQ ID NO: 2329209 - protein, 7 aa, Cryptosporidium parvum
KKKREDE

SEQ ID NO: 2329210 - protein, 8 aa, Cryptosporidium parvum
KKKSASSI

SEQ ID NO: 2329211 - protein, 38 aa, Cryptosporidium parvum
KKKSNNNNDEVKDLEKEDDVDENNKKNDNKKSNQNGGK

SEQ ID NO: 2329212 - protein, 8 aa, Cryptosporidium parvum
KKKYPEAY

SEQ ID NO: 2329213 - protein, 5 aa, Cryptosporidium parvum
KKLPK

SEQ ID NO: 2329214 - protein, 10 aa, Cryptosporidium parvum
KKLRKEEESK

SEQ ID NO: 2329215 - protein, 12 aa, Cryptosporidium parvum
KKLSGTSKIQTQ

SEQ ID NO: 2329216 - protein, 9 aa, Cryptosporidium parvum
KKNDSDENI

SEQ ID NO: 2329217 - protein, 74 aa, Cryptosporidium parvum
KKNKSSKKKIQKRKSSLGSIATRPSSSRPGFIGETSTGTGGSTQATSEFPPSASSRPTPIRQPSCSDKGVSYKT

SEQ ID NO: 2329218 - protein, 12 aa, Cryptosporidium parvum
KKNLSRSKELEP

SEQ ID NO: 2329219 - protein, 7 aa, Cryptosporidium parvum
KKNNDWR

SEQ ID NO: 2329220 - protein, 9 aa, Cryptosporidium parvum
KKNTGQTID

SEQ ID NO: 2329221 - protein, 7 aa, Cryptosporidium parvum
KKNTTPL

SEQ ID NO: 2329222 - protein, 26 aa, Cryptosporidium parvum
KKPRKLPREMNDDDREKARNKNSNEV

SEQ ID NO: 2329223 - protein, 8 aa, Cryptosporidium parvum
KKPSSVNL

SEQ ID NO: 2329224 - protein, 7 aa, Cryptosporidium parvum
KKPVKGC

SEQ ID NO: 2329225 - protein, 13 aa, Cryptosporidium parvum
KKPVNEGKKGQEV

SEQ ID NO: 2329226 - protein, 6 aa, Cryptosporidium parvum
KKQEIS

SEQ ID NO: 2329227 - protein, 77 aa, Cryptosporidium parvum
KKQEKEKQKRLREEEKEEQRRLKEQKRLEKEKKKQKLPKDNEKQKLSKEEKQRQKQLEKEERQRQKQLQKEEKQRQK

SEQ ID NO: 2329228 - protein, 59 aa, Cryptosporidium parvum
KKRKSPSLKSLDSAQKQDSEQESDRVTPRPQSSQSEARRRENASESERRSLSPASRSVS

SEQ ID NO: 2329229 - protein, 48 aa, Cryptosporidium parvum
KKRNQLNEEEEPINEGSRSEYQEMGTDEPENSVEPEETDKKNASTEMD

SEQ ID NO: 2329230 - protein, 12 aa, Cryptosporidium parvum
KKSDNSNGGLEE

SEQ ID NO: 2329231 - protein, 8 aa, Cryptosporidium parvum
KKSERDGE

SEQ ID NO: 2329232 - protein, 10 aa, Cryptosporidium parvum
KKSGISKGKY

SEQ ID NO: 2329233 - protein, 20 aa, Cryptosporidium parvum
KKSKKSSPTVNEGEKTQERK

SEQ ID NO: 2329234 - protein, 7 aa, Cryptosporidium parvum
KKSNCSS

SEQ ID NO: 2329235 - protein, 8 aa, Cryptosporidium parvum
KKSNDEYI

SEQ ID NO: 2329236 - protein, 7 aa, Cryptosporidium parvum
KKSQGLT

SEQ ID NO: 2329237 - protein, 7 aa, Cryptosporidium parvum
KKSRKTK

SEQ ID NO: 2329238 - protein, 20 aa, Cryptosporidium parvum
KKSSKEDLASSDQIKGNQDQ

SEQ ID NO: 2329239 - protein, 11 aa, Cryptosporidium parvum
KKSSKTSYNPD

SEQ ID NO: 2329240 - protein, 5 aa, Cryptosporidium parvum
KKSSL

SEQ ID NO: 2329241 - protein, 33 aa, Cryptosporidium parvum
KKSSNESSIDNSKTNDFNVGGGDYLENKEREFQ

SEQ ID NO: 2329242 - protein, 21 aa, Cryptosporidium parvum
KKSTASNNFGRVKPKTSYTQD

SEQ ID NO: 2329243 - protein, 4 aa, Cryptosporidium parvum
KKSV

SEQ ID NO: 2329244 - protein, 20 aa, Cryptosporidium parvum
KKTGQNSQSQEGNQGVSPKR

SEQ ID NO: 2329245 - protein, 9 aa, Cryptosporidium parvum
KKTNVSESS

SEQ ID NO: 2329246 - protein, 6 aa, Cryptosporidium parvum
KKTRKV

SEQ ID NO: 2329247 - protein, 7 aa, Cryptosporidium parvum
KKTTDGL

SEQ ID NO: 2329248 - protein, 6 aa, Cryptosporidium parvum
KKVFNG

SEQ ID NO: 2329249 - protein, 8 aa, Cryptosporidium parvum
KKVSNKTD

SEQ ID NO: 2329250 - protein, 17 aa, Cryptosporidium parvum
KKYGRKLEESKNQGFDE

SEQ ID NO: 2329251 - protein, 10 aa, Cryptosporidium parvum
KKYKNSSSTL

SEQ ID NO: 2329252 - protein, 13 aa, Cryptosporidium parvum
KKYQKQLSDENDE

SEQ ID NO: 2329253 - protein, 13 aa, Cryptosporidium parvum
KKYRGQSVNYPPS

SEQ ID NO: 2329254 - protein, 10 aa, Cryptosporidium parvum
KKYSKSSGYE

SEQ ID NO: 2329255 - protein, 10 aa, Cryptosporidium parvum
KKYSQEFRDS

SEQ ID NO: 2329256 - protein, 19 aa, Cryptosporidium parvum
KLAESDDAKIAKKKKKKGI

SEQ ID NO: 2329257 - protein, 8 aa, Cryptosporidium parvum
KLDQAKER

SEQ ID NO: 2329258 - protein, 40 aa, Cryptosporidium parvum
KLEASNADEGSSRGKNSTHKKHTSKKKHLQSRPDGPQPQA

SEQ ID NO: 2329259 - protein, 16 aa, Cryptosporidium parvum
KLEETRAALDERSKEA

SEQ ID NO: 2329260 - protein, 12 aa, Cryptosporidium parvum
KLEKEKLKKEKK

SEQ ID NO: 2329261 - protein, 4 aa, Cryptosporidium parvum
KLER

SEQ ID NO: 2329262 - protein, 8 aa, Cryptosporidium parvum
KLFGRKSS

SEQ ID NO: 2329263 - protein, 12 aa, Cryptosporidium parvum
KLGDPGTEVPGI

SEQ ID NO: 2329264 - protein, 7 aa, Cryptosporidium parvum
KLGGEKA

SEQ ID NO: 2329265 - protein, 11 aa, Cryptosporidium parvum
KLISGDKKIEI

SEQ ID NO: 2329266 - protein, 17 aa, Cryptosporidium parvum
KLKERSKSKQKKSYPEV

SEQ ID NO: 2329267 - protein, 7 aa, Cryptosporidium parvum
KLKPKKK

SEQ ID NO: 2329268 - protein, 7 aa, Cryptosporidium parvum
KLNDDLS

SEQ ID NO: 2329269 - protein, 6 aa, Cryptosporidium parvum
KLNDDN

SEQ ID NO: 2329270 - protein, 5 aa, Cryptosporidium parvum
KLNDN

SEQ ID NO: 2329271 - protein, 6 aa, Cryptosporidium parvum
KLNEHQ

SEQ ID NO: 2329272 - protein, 43 aa, Cryptosporidium parvum
KLNNGDSNGDSNNDGNSGGNGGRGGPPNPYAGYTGSSNPTFTT

SEQ ID NO: 2329273 - protein, 10 aa, Cryptosporidium parvum
KLNSEKYKEI

SEQ ID NO: 2329274 - protein, 9 aa, Cryptosporidium parvum
KLNSTNSNQ

SEQ ID NO: 2329275 - protein, 7 aa, Cryptosporidium parvum
KLPDNFS

SEQ ID NO: 2329276 - protein, 13 aa, Cryptosporidium parvum
KLPSTKDESAIGG

SEQ ID NO: 2329277 - protein, 9 aa, Cryptosporidium parvum
KLPTPEKCS

SEQ ID NO: 2329278 - protein, 5 aa, Cryptosporidium parvum
KLPVT

SEQ ID NO: 2329279 - protein, 21 aa, Cryptosporidium parvum
KLQKQKQRKERREQLKAEGKL

SEQ ID NO: 2329280 - protein, 13 aa, Cryptosporidium parvum
KLSASLQAPTDMN

SEQ ID NO: 2329281 - protein, 6 aa, Cryptosporidium parvum
KLSKNY

SEQ ID NO: 2329282 - protein, 9 aa, Cryptosporidium parvum
KLSSEPNSL

SEQ ID NO: 2329283 - protein, 9 aa, Cryptosporidium parvum
KLSSGTAGE

SEQ ID NO: 2329284 - protein, 10 aa, Cryptosporidium parvum
KLSTDERQSI

SEQ ID NO: 2329285 - protein, 7 aa, Cryptosporidium parvum
KLTASEK

SEQ ID NO: 2329286 - protein, 9 aa, Cryptosporidium parvum
KLTPFKRTP

SEQ ID NO: 2329287 - protein, 12 aa, Cryptosporidium parvum
KLTPRDSQNQIT

SEQ ID NO: 2329288 - protein, 5 aa, Cryptosporidium parvum
KLTSD

SEQ ID NO: 2329289 - protein, 13 aa, Cryptosporidium parvum
KLVGDDKTLSELG

SEQ ID NO: 2329290 - protein, 6 aa, Cryptosporidium parvum
KMGNNK

SEQ ID NO: 2329291 - protein, 7 aa, Cryptosporidium parvum
KMISPSR

SEQ ID NO: 2329292 - protein, 14 aa, Cryptosporidium parvum
KMNDKSEEDAKISD

SEQ ID NO: 2329293 - protein, 5 aa, Cryptosporidium parvum
KMRKN

SEQ ID NO: 2329294 - protein, 4 aa, Cryptosporidium parvum
KNAK

SEQ ID NO: 2329295 - protein, 9 aa, Cryptosporidium parvum
KNASENQNI

SEQ ID NO: 2329296 - protein, 8 aa, Cryptosporidium parvum
KNASNSAS

SEQ ID NO: 2329297 - protein, 6 aa, Cryptosporidium parvum
KNDEAV

SEQ ID NO: 2329298 - protein, 9 aa, Cryptosporidium parvum
KNDEEISDF

SEQ ID NO: 2329299 - protein, 7 aa, Cryptosporidium parvum
KNDEKRI

SEQ ID NO: 2329300 - protein, 7 aa, Cryptosporidium parvum
KNDGLSN

SEQ ID NO: 2329301 - protein, 11 aa, Cryptosporidium parvum
KNDNKKENSEI

SEQ ID NO: 2329302 - protein, 6 aa, Cryptosporidium parvum
KNDPRI

SEQ ID NO: 2329303 - protein, 7 aa, Cryptosporidium parvum
KNDPSTV

SEQ ID NO: 2329304 - protein, 38 aa, Cryptosporidium parvum
KNDQISQDISEKSVKKIDNGLGSQYETTSLPENEDLEN

SEQ ID NO: 2329305 - protein, 7 aa, Cryptosporidium parvum
KNDSTYI

SEQ ID NO: 2329306 - protein, 5 aa, Cryptosporidium parvum
KNEIE

SEQ ID NO: 2329307 - protein, 6 aa, Cryptosporidium parvum
KNEKRW

SEQ ID NO: 2329308 - protein, 7 aa, Cryptosporidium parvum
KNEPAKN

SEQ ID NO: 2329309 - protein, 7 aa, Cryptosporidium parvum
KNESESI

SEQ ID NO: 2329310 - protein, 4 aa, Cryptosporidium parvum
KNEY

SEQ ID NO: 2329311 - protein, 4 aa, Cryptosporidium parvum
KNGI

SEQ ID NO: 2329312 - protein, 6 aa, Cryptosporidium parvum
KNGIER

SEQ ID NO: 2329313 - protein, 19 aa, Cryptosporidium parvum
KNGISHKKGTKSSEIKDGP

SEQ ID NO: 2329314 - protein, 17 aa, Cryptosporidium parvum
KNGKKGKNSKSNKSEQW

SEQ ID NO: 2329315 - protein, 39 aa, Cryptosporidium parvum
KNGLDEGGYLPSSTPNTGFYNPEKDDNGIYKPSEKYGES

SEQ ID NO: 2329316 - protein, 6 aa, Cryptosporidium parvum
KNGNEI

SEQ ID NO: 2329317 - protein, 8 aa, Cryptosporidium parvum
KNGQYPKL

SEQ ID NO: 2329318 - protein, 4 aa, Cryptosporidium parvum
KNGR

SEQ ID NO: 2329319 - protein, 8 aa, Cryptosporidium parvum
KNGTPPKI

SEQ ID NO: 2329320 - protein, 18 aa, Cryptosporidium parvum
KNHGKNDDQTYIANLLKQ

SEQ ID NO: 2329321 - protein, 5 aa, Cryptosporidium parvum
KNHPK

SEQ ID NO: 2329322 - protein, 11 aa, Cryptosporidium parvum
KNHQKNREAIN

SEQ ID NO: 2329323 - protein, 4 aa, Cryptosporidium parvum
KNHS

SEQ ID NO: 2329324 - protein, 5 aa, Cryptosporidium parvum
KNIED

SEQ ID NO: 2329325 - protein, 12 aa, Cryptosporidium parvum
KNIKKKKELSKK

SEQ ID NO: 2329326 - protein, 13 aa, Cryptosporidium parvum
KNINNEPSSEYDN

SEQ ID NO: 2329327 - protein, 10 aa, Cryptosporidium parvum
KNKDGKLSNE

SEQ ID NO: 2329328 - protein, 38 aa, Cryptosporidium parvum
KNKDGTPIKTNNTDDSEEVSTSIDNNSSIEASQVEEEE

SEQ ID NO: 2329329 - protein, 13 aa, Cryptosporidium parvum
KNKDRKGVITTSS

SEQ ID NO: 2329330 - protein, 10 aa, Cryptosporidium parvum
KNKDSTDNKM

SEQ ID NO: 2329331 - protein, 4 aa, Cryptosporidium parvum
KNKE

SEQ ID NO: 2329332 - protein, 17 aa, Cryptosporidium parvum
KNKENKDSKEDLNTSSK

SEQ ID NO: 2329333 - protein, 9 aa, Cryptosporidium parvum
KNKKELESL

SEQ ID NO: 2329334 - protein, 9 aa, Cryptosporidium parvum
KNKQNNQGI

SEQ ID NO: 2329335 - protein, 7 aa, Cryptosporidium parvum
KNKRNLE

SEQ ID NO: 2329336 - protein, 6 aa, Cryptosporidium parvum
KNKSPI

SEQ ID NO: 2329337 - protein, 4 aa, Cryptosporidium parvum
KNKT

SEQ ID NO: 2329338 - protein, 25 aa, Cryptosporidium parvum
KNLEENSKENKVINPESCTKYENGT

SEQ ID NO: 2329339 - protein, 12 aa, Cryptosporidium parvum
KNLSKDDTISGL

SEQ ID NO: 2329340 - protein, 19 aa, Cryptosporidium parvum
KNLSSTDNTSVEKISPNEY

SEQ ID NO: 2329341 - protein, 9 aa, Cryptosporidium parvum
KNNDSGLEC

SEQ ID NO: 2329342 - protein, 46 aa, Cryptosporidium parvum
KNNFGTNNVPPAPIPTSIPAPSQIPSSVPPVAPPPMPNSNNSSIIG

SEQ ID NO: 2329343 - protein, 6 aa, Cryptosporidium parvum
KNNGIT

SEQ ID NO: 2329344 - protein, 12 aa, Cryptosporidium parvum
KNNIHTKNGEIN

SEQ ID NO: 2329345 - protein, 12 aa, Cryptosporidium parvum
KNNKKNGHFSTG

SEQ ID NO: 2329346 - protein, 12 aa, Cryptosporidium parvum
KNNKPKNFKQGN

SEQ ID NO: 2329347 - protein, 7 aa, Cryptosporidium parvum
KNNNNIN

SEQ ID NO: 2329348 - protein, 6 aa, Cryptosporidium parvum
KNNRSA

SEQ ID NO: 2329349 - protein, 7 aa, Cryptosporidium parvum
KNNSFQD

SEQ ID NO: 2329350 - protein, 5 aa, Cryptosporidium parvum
KNPDI

SEQ ID NO: 2329351 - protein, 9 aa, Cryptosporidium parvum
KNPDPTKSL

SEQ ID NO: 2329352 - protein, 8 aa, Cryptosporidium parvum
KNPELSNL

SEQ ID NO: 2329353 - protein, 9 aa, Cryptosporidium parvum
KNPGDRETL

SEQ ID NO: 2329354 - protein, 9 aa, Cryptosporidium parvum
KNPIETSKE

SEQ ID NO: 2329355 - protein, 7 aa, Cryptosporidium parvum
KNPKLTI

SEQ ID NO: 2329356 - protein, 7 aa, Cryptosporidium parvum
KNPLGPV

SEQ ID NO: 2329357 - protein, 6 aa, Cryptosporidium parvum
KNPYSI

SEQ ID NO: 2329358 - protein, 10 aa, Cryptosporidium parvum
KNQTESREFE

SEQ ID NO: 2329359 - protein, 5 aa, Cryptosporidium parvum
KNRDP

SEQ ID NO: 2329360 - protein, 26 aa, Cryptosporidium parvum
KNREEKNLNEKVRNEKVEKEEIPESY

SEQ ID NO: 2329361 - protein, 10 aa, Cryptosporidium parvum
KNRENAMSDA

SEQ ID NO: 2329362 - protein, 7 aa, Cryptosporidium parvum
KNRNELK

SEQ ID NO: 2329363 - protein, 10 aa, Cryptosporidium parvum
KNRSDCAAAG

SEQ ID NO: 2329364 - protein, 17 aa, Cryptosporidium parvum
KNSCSDPAAGLAGKPLG

SEQ ID NO: 2329365 - protein, 4 aa, Cryptosporidium parvum
KNSE

SEQ ID NO: 2329366 - protein, 7 aa, Cryptosporidium parvum
KNSKDEV

SEQ ID NO: 2329367 - protein, 6 aa, Cryptosporidium parvum
KNSKLS

SEQ ID NO: 2329368 - protein, 5 aa, Cryptosporidium parvum
KNSNT

SEQ ID NO: 2329369 - protein, 13 aa, Cryptosporidium parvum
KNSSTGFNSSLSD

SEQ ID NO: 2329370 - protein, 13 aa, Cryptosporidium parvum
KNTDSKPRASYPI

SEQ ID NO: 2329371 - protein, 9 aa, Cryptosporidium parvum
KNTKTKEQI

SEQ ID NO: 2329372 - protein, 22 aa, Cryptosporidium parvum
KNVSVSKNDEKKSLDESKFTSD

SEQ ID NO: 2329373 - protein, 7 aa, Cryptosporidium parvum
KNYEKQL

SEQ ID NO: 2329374 - protein, 8 aa, Cryptosporidium parvum
KNYPGQLQ

SEQ ID NO: 2329375 - protein, 12 aa, Cryptosporidium parvum
KPALGGSELYPG

SEQ ID NO: 2329376 - protein, 4 aa, Cryptosporidium parvum
KPAP

SEQ ID NO: 2329377 - protein, 9 aa, Cryptosporidium parvum
KPAPGYQKP

SEQ ID NO: 2329378 - protein, 17 aa, Cryptosporidium parvum
KPAPIDGDENNTPPGYH

SEQ ID NO: 2329379 - protein, 17 aa, Cryptosporidium parvum
KPAPIDGDENNTPPNYH

SEQ ID NO: 2329380 - protein, 17 aa, Cryptosporidium parvum
KPAPIDGDESNTPPGYH

SEQ ID NO: 2329381 - protein, 14 aa, Cryptosporidium parvum
KPAYNSSTQEYDPE

SEQ ID NO: 2329382 - protein, 14 aa, Cryptosporidium parvum
KPAYSRVDKQLNNL

SEQ ID NO: 2329383 - protein, 4 aa, Cryptosporidium parvum
KPCE

SEQ ID NO: 2329384 - protein, 13 aa, Cryptosporidium parvum
KPCPSDQKFEDPT

SEQ ID NO: 2329385 - protein, 16 aa, Cryptosporidium parvum
KPCRGKDGNLDSPFEK

SEQ ID NO: 2329386 - protein, 4 aa, Cryptosporidium parvum
KPCT

SEQ ID NO: 2329387 - protein, 6 aa, Cryptosporidium parvum
KPDESP

SEQ ID NO: 2329388 - protein, 5 aa, Cryptosporidium parvum
KPEAT

SEQ ID NO: 2329389 - protein, 12 aa, Cryptosporidium parvum
KPEEPIERPPLG

SEQ ID NO: 2329390 - protein, 6 aa, Cryptosporidium parvum
KPEGVS

SEQ ID NO: 2329391 - protein, 7 aa, Cryptosporidium parvum
KPEIPGE

SEQ ID NO: 2329392 - protein, 8 aa, Cryptosporidium parvum
KPELGGNT

SEQ ID NO: 2329393 - protein, 6 aa, Cryptosporidium parvum
KPEVAR

SEQ ID NO: 2329394 - protein, 7 aa, Cryptosporidium parvum
KPGENWE

SEQ ID NO: 2329395 - protein, 6 aa, Cryptosporidium parvum
KPGINE

SEQ ID NO: 2329396 - protein, 7 aa, Cryptosporidium parvum
KPGNTHW

SEQ ID NO: 2329397 - protein, 9 aa, Cryptosporidium parvum
KPGTKRTDV

SEQ ID NO: 2329398 - protein, 8 aa, Cryptosporidium parvum
KPIHRTAP

SEQ ID NO: 2329399 - protein, 6 aa, Cryptosporidium parvum
KPISDQ

SEQ ID NO: 2329400 - protein, 90 aa, Cryptosporidium parvum
KPITEELSAEENSQKVDEPKTEQDLKDESSAEPPVESPIESPIDSPAESPIESPVESPVESPVESPAESPAESATVAPTTETAEEAKEEE

SEQ ID NO: 2329401 - protein, 12 aa, Cryptosporidium parvum
KPKIQSSKSSYM

SEQ ID NO: 2329402 - protein, 10 aa, Cryptosporidium parvum
KPKTDDRSYK

SEQ ID NO: 2329403 - protein, 9 aa, Cryptosporidium parvum
KPLNPVGST

SEQ ID NO: 2329404 - protein, 5 aa, Cryptosporidium parvum
KPLNQ

SEQ ID NO: 2329405 - protein, 4 aa, Cryptosporidium parvum
KPLS

SEQ ID NO: 2329406 - protein, 9 aa, Cryptosporidium parvum
KPLSRKELD

SEQ ID NO: 2329407 - protein, 6 aa, Cryptosporidium parvum
KPNEEQ

SEQ ID NO: 2329408 - protein, 6 aa, Cryptosporidium parvum
KPNETI

SEQ ID NO: 2329409 - protein, 7 aa, Cryptosporidium parvum
KPNSMST

SEQ ID NO: 2329410 - protein, 5 aa, Cryptosporidium parvum
KPPFF

SEQ ID NO: 2329411 - protein, 6 aa, Cryptosporidium parvum
KPPFSY

SEQ ID NO: 2329412 - protein, 20 aa, Cryptosporidium parvum
KPPGGPPKPPTRSSSLSSLL

SEQ ID NO: 2329413 - protein, 16 aa, Cryptosporidium parvum
KPPKPGQAGDREDYGN

SEQ ID NO: 2329414 - protein, 9 aa, Cryptosporidium parvum
KPPPETYTK

SEQ ID NO: 2329415 - protein, 5 aa, Cryptosporidium parvum
KPPTL

SEQ ID NO: 2329416 - protein, 10 aa, Cryptosporidium parvum
KPQDAPATDI

SEQ ID NO: 2329417 - protein, 8 aa, Cryptosporidium parvum
KPRDKGKK

SEQ ID NO: 2329418 - protein, 60 aa, Cryptosporidium parvum
KPRNRSNPDRISQEPRKKIRSNRSKGSRSSDASVAEGEPPEGSLEEKTLTKEELASSRLA

SEQ ID NO: 2329419 - protein, 6 aa, Cryptosporidium parvum
KPRNSY

SEQ ID NO: 2329420 - protein, 12 aa, Cryptosporidium parvum
KPRSKNKPLTKK

SEQ ID NO: 2329421 - protein, 5 aa, Cryptosporidium parvum
KPSEL

SEQ ID NO: 2329422 - protein, 5 aa, Cryptosporidium parvum
KPSNQ

SEQ ID NO: 2329423 - protein, 6 aa, Cryptosporidium parvum
KPSNSN

SEQ ID NO: 2329424 - protein, 15 aa, Cryptosporidium parvum
KPTGQAKVTRSQCTS

SEQ ID NO: 2329425 - protein, 6 aa, Cryptosporidium parvum
KPTGSL

SEQ ID NO: 2329426 - protein, 10 aa, Cryptosporidium parvum
KPTNTEPEGK

SEQ ID NO: 2329427 - protein, 12 aa, Cryptosporidium parvum
KPTNTSNSCNRN

SEQ ID NO: 2329428 - protein, 5 aa, Cryptosporidium parvum
KPVED

SEQ ID NO: 2329429 - protein, 8 aa, Cryptosporidium parvum
KPVTTPNS

SEQ ID NO: 2329430 - protein, 6 aa, Cryptosporidium parvum
KPWGGF

SEQ ID NO: 2329431 - protein, 12 aa, Cryptosporidium parvum
KQCPNGPTELET

SEQ ID NO: 2329432 - protein, 8 aa, Cryptosporidium parvum
KQCPPGYE

SEQ ID NO: 2329433 - protein, 5 aa, Cryptosporidium parvum
KQDDE

SEQ ID NO: 2329434 - protein, 4 aa, Cryptosporidium parvum
KQDT

SEQ ID NO: 2329435 - protein, 19 aa, Cryptosporidium parvum
KQDTETPSLDQGETIETQT

SEQ ID NO: 2329436 - protein, 21 aa, Cryptosporidium parvum
KQEEKQRQKQLQKEEKQKQKL

SEQ ID NO: 2329437 - protein, 9 aa, Cryptosporidium parvum
KQEEQAGTP

SEQ ID NO: 2329438 - protein, 5 aa, Cryptosporidium parvum
KQGEL

SEQ ID NO: 2329439 - protein, 12 aa, Cryptosporidium parvum
KQGNSSHESYNN

SEQ ID NO: 2329440 - protein, 15 aa, Cryptosporidium parvum
KQGPQNPQKGPIPIG

SEQ ID NO: 2329441 - protein, 7 aa, Cryptosporidium parvum
KQGSDKI

SEQ ID NO: 2329442 - protein, 7 aa, Cryptosporidium parvum
KQHDINE

SEQ ID NO: 2329443 - protein, 8 aa, Cryptosporidium parvum
KQHSNEQK

SEQ ID NO: 2329444 - protein, 6 aa, Cryptosporidium parvum
KQIKTQ

SEQ ID NO: 2329445 - protein, 8 aa, Cryptosporidium parvum
KQKGGSEK

SEQ ID NO: 2329446 - protein, 14 aa, Cryptosporidium parvum
KQKKYGTQITPSGQ

SEQ ID NO: 2329447 - protein, 8 aa, Cryptosporidium parvum
KQKSHSPR

SEQ ID NO: 2329448 - protein, 70 aa, Cryptosporidium parvum
KQKSNEIPTDTKDVEVKSHDTTDKNPPEKNEEKSLSSENQTEPTKEENNDEKKESETETENHEQKSNQEL

SEQ ID NO: 2329449 - protein, 6 aa, Cryptosporidium parvum
KQLENG

SEQ ID NO: 2329450 - protein, 9 aa, Cryptosporidium parvum
KQLKEGLGA

SEQ ID NO: 2329451 - protein, 4 aa, Cryptosporidium parvum
KQMG

SEQ ID NO: 2329452 - protein, 4 aa, Cryptosporidium parvum
KQNE

SEQ ID NO: 2329453 - protein, 11 aa, Cryptosporidium parvum
KQPKETAEAID

SEQ ID NO: 2329454 - protein, 5 aa, Cryptosporidium parvum
KQPMS

SEQ ID NO: 2329455 - protein, 6 aa, Cryptosporidium parvum
KQPSSC

SEQ ID NO: 2329456 - protein, 4 aa, Cryptosporidium parvum
KQQI

SEQ ID NO: 2329457 - protein, 14 aa, Cryptosporidium parvum
KQQKKEASNNGLKD

SEQ ID NO: 2329458 - protein, 5 aa, Cryptosporidium parvum
KQQLN

SEQ ID NO: 2329459 - protein, 4 aa, Cryptosporidium parvum
KQQS

SEQ ID NO: 2329460 - protein, 8 aa, Cryptosporidium parvum
KQRNKELK

SEQ ID NO: 2329461 - protein, 5 aa, Cryptosporidium parvum
KQRSD

SEQ ID NO: 2329462 - protein, 12 aa, Cryptosporidium parvum
KQSLEDTTFDTQ

SEQ ID NO: 2329463 - protein, 6 aa, Cryptosporidium parvum
KQSQKS

SEQ ID NO: 2329464 - protein, 5 aa, Cryptosporidium parvum
KQSSA

SEQ ID NO: 2329465 - protein, 10 aa, Cryptosporidium parvum
KQSSFQNAKQ

SEQ ID NO: 2329466 - protein, 9 aa, Cryptosporidium parvum
KQSTDQEEF

SEQ ID NO: 2329467 - protein, 4 aa, Cryptosporidium parvum
KQSV

SEQ ID NO: 2329468 - protein, 5 aa, Cryptosporidium parvum
KQSVR

SEQ ID NO: 2329469 - protein, 12 aa, Cryptosporidium parvum
KQTKEEKKATTN

SEQ ID NO: 2329470 - protein, 21 aa, Cryptosporidium parvum
KQTPKSISTTTTTTTTPPWDK

SEQ ID NO: 2329471 - protein, 13 aa, Cryptosporidium parvum
KRDSSIQGAYPTL

SEQ ID NO: 2329472 - protein, 9 aa, Cryptosporidium parvum
KRDSSSKWS

SEQ ID NO: 2329473 - protein, 6 aa, Cryptosporidium parvum
KREFET

SEQ ID NO: 2329474 - protein, 11 aa, Cryptosporidium parvum
KREKNNTSETV

SEQ ID NO: 2329475 - protein, 11 aa, Cryptosporidium parvum
KRESNLEKKES

SEQ ID NO: 2329476 - protein, 5 aa, Cryptosporidium parvum
KRGHV

SEQ ID NO: 2329477 - protein, 10 aa, Cryptosporidium parvum
KRGPSREKCR

SEQ ID NO: 2329478 - protein, 4 aa, Cryptosporidium parvum
KRGV

SEQ ID NO: 2329479 - protein, 10 aa, Cryptosporidium parvum
KRHKSSKSGL

SEQ ID NO: 2329480 - protein, 6 aa, Cryptosporidium parvum
KRHNPN

SEQ ID NO: 2329481 - protein, 6 aa, Cryptosporidium parvum
KRIEEE

SEQ ID NO: 2329482 - protein, 21 aa, Cryptosporidium parvum
KRKEEEKRKKLEQKKIEEEKK

SEQ ID NO: 2329483 - protein, 25 aa, Cryptosporidium parvum
KRKIKNKAKKRYKMNRDRKSKKPNI

SEQ ID NO: 2329484 - protein, 22 aa, Cryptosporidium parvum
KRKKKKSNLKKKKFKSKAKRIN

SEQ ID NO: 2329485 - protein, 10 aa, Cryptosporidium parvum
KRKPKTEREL

SEQ ID NO: 2329486 - protein, 7 aa, Cryptosporidium parvum
KRKRDSA

SEQ ID NO: 2329487 - protein, 7 aa, Cryptosporidium parvum
KRLNRKK

SEQ ID NO: 2329488 - protein, 6 aa, Cryptosporidium parvum
KRNGIK

SEQ ID NO: 2329489 - protein, 11 aa, Cryptosporidium parvum
KRPGQGYYPTG

SEQ ID NO: 2329490 - protein, 5 aa, Cryptosporidium parvum
KRPRK

SEQ ID NO: 2329491 - protein, 12 aa, Cryptosporidium parvum
KRPTAYSSPAII

SEQ ID NO: 2329492 - protein, 4 aa, Cryptosporidium parvum
KRQE

SEQ ID NO: 2329493 - protein, 4 aa, Cryptosporidium parvum
KRQR

SEQ ID NO: 2329494 - protein, 5 aa, Cryptosporidium parvum
KRQSI

SEQ ID NO: 2329495 - protein, 8 aa, Cryptosporidium parvum
KRRKNRTP

SEQ ID NO: 2329496 - protein, 10 aa, Cryptosporidium parvum
KRSETSADGI

SEQ ID NO: 2329497 - protein, 18 aa, Cryptosporidium parvum
KRSGESFVSSGGCGGGKC

SEQ ID NO: 2329498 - protein, 9 aa, Cryptosporidium parvum
KRSKLGENS

SEQ ID NO: 2329499 - protein, 8 aa, Cryptosporidium parvum
KRSLTDQE

SEQ ID NO: 2329500 - protein, 6 aa, Cryptosporidium parvum
KRSQNS

SEQ ID NO: 2329501 - protein, 6 aa, Cryptosporidium parvum
KRSRVE

SEQ ID NO: 2329502 - protein, 4 aa, Cryptosporidium parvum
KRSS

SEQ ID NO: 2329503 - protein, 7 aa, Cryptosporidium parvum
KRTDKER

SEQ ID NO: 2329504 - protein, 5 aa, Cryptosporidium parvum
KRTHP

SEQ ID NO: 2329505 - protein, 13 aa, Cryptosporidium parvum
KRVNSKVRSTGIE

SEQ ID NO: 2329506 - protein, 12 aa, Cryptosporidium parvum
KRWSKQKELKKR

SEQ ID NO: 2329507 - protein, 7 aa, Cryptosporidium parvum
KSADAFS

SEQ ID NO: 2329508 - protein, 7 aa, Cryptosporidium parvum
KSAEENT

SEQ ID NO: 2329509 - protein, 4 aa, Cryptosporidium parvum
KSAF

SEQ ID NO: 2329510 - protein, 7 aa, Cryptosporidium parvum
KSAQISK

SEQ ID NO: 2329511 - protein, 7 aa, Cryptosporidium parvum
KSARKSI

SEQ ID NO: 2329512 - protein, 15 aa, Cryptosporidium parvum
KSASDTEIKKAYRQK

SEQ ID NO: 2329513 - protein, 9 aa, Cryptosporidium parvum
KSCKDKSEL

SEQ ID NO: 2329514 - protein, 5 aa, Cryptosporidium parvum
KSCPP

SEQ ID NO: 2329515 - protein, 10 aa, Cryptosporidium parvum
KSCQGTPDSE

SEQ ID NO: 2329516 - protein, 15 aa, Cryptosporidium parvum
KSDIESDSESSNGFD

SEQ ID NO: 2329517 - protein, 9 aa, Cryptosporidium parvum
KSDQPIEVD

SEQ ID NO: 2329518 - protein, 9 aa, Cryptosporidium parvum
KSDSTSSDD

SEQ ID NO: 2329519 - protein, 5 aa, Cryptosporidium parvum
KSDVR

SEQ ID NO: 2329520 - protein, 7 aa, Cryptosporidium parvum
KSDVTRE

SEQ ID NO: 2329521 - protein, 7 aa, Cryptosporidium parvum
KSEDDSE

SEQ ID NO: 2329522 - protein, 8 aa, Cryptosporidium parvum
KSEFPSSG

SEQ ID NO: 2329523 - protein, 9 aa, Cryptosporidium parvum
KSEKSSGIQ

SEQ ID NO: 2329524 - protein, 11 aa, Cryptosporidium parvum
KSELSQTEKEF

SEQ ID NO: 2329525 - protein, 6 aa, Cryptosporidium parvum
KSENDN

SEQ ID NO: 2329526 - protein, 5 aa, Cryptosporidium parvum
KSEPN

SEQ ID NO: 2329527 - protein, 18 aa, Cryptosporidium parvum
KSEPSTNSDAETEPEEMK

SEQ ID NO: 2329528 - protein, 7 aa, Cryptosporidium parvum
KSEQKYE

SEQ ID NO: 2329529 - protein, 7 aa, Cryptosporidium parvum
KSFNDNS

SEQ ID NO: 2329530 - protein, 9 aa, Cryptosporidium parvum
KSFQSSTSI

SEQ ID NO: 2329531 - protein, 8 aa, Cryptosporidium parvum
KSGGDGNL

SEQ ID NO: 2329532 - protein, 5 aa, Cryptosporidium parvum
KSGGH

SEQ ID NO: 2329533 - protein, 6 aa, Cryptosporidium parvum
KSGKGK

SEQ ID NO: 2329534 - protein, 46 aa, Cryptosporidium parvum
KSGNQDLNSNSESDDKKGSESNSGASEAALTSQPPPPPPPPSLPPP

SEQ ID NO: 2329535 - protein, 6 aa, Cryptosporidium parvum
KSGSIF

SEQ ID NO: 2329536 - protein, 6 aa, Cryptosporidium parvum
KSGTSH

SEQ ID NO: 2329537 - protein, 7 aa, Cryptosporidium parvum
KSGTVPN

SEQ ID NO: 2329538 - protein, 4 aa, Cryptosporidium parvum
KSHK

SEQ ID NO: 2329539 - protein, 6 aa, Cryptosporidium parvum
KSHTSL

SEQ ID NO: 2329540 - protein, 11 aa, Cryptosporidium parvum
KSHYEKNTSSL

SEQ ID NO: 2329541 - protein, 11 aa, Cryptosporidium parvum
KSIDKTNRTPG

SEQ ID NO: 2329542 - protein, 9 aa, Cryptosporidium parvum
KSIDNSKGF

SEQ ID NO: 2329543 - protein, 7 aa, Cryptosporidium parvum
KSIGNSF

SEQ ID NO: 2329544 - protein, 9 aa, Cryptosporidium parvum
KSIKEAREI

SEQ ID NO: 2329545 - protein, 4 aa, Cryptosporidium parvum
KSIQ

SEQ ID NO: 2329546 - protein, 5 aa, Cryptosporidium parvum
KSISE

SEQ ID NO: 2329547 - protein, 9 aa, Cryptosporidium parvum
KSISPKTVQ

SEQ ID NO: 2329548 - protein, 9 aa, Cryptosporidium parvum
KSKDSSQDI

SEQ ID NO: 2329549 - protein, 16 aa, Cryptosporidium parvum
KSKESISKLRTADDRQ

SEQ ID NO: 2329550 - protein, 7 aa, Cryptosporidium parvum
KSKGEKE

SEQ ID NO: 2329551 - protein, 58 aa, Cryptosporidium parvum
KSKKGRSRGKNKRNRGSKSKKRSGKNGGKKGGGSSKKKQEFASNSSETESESSEEITK

SEQ ID NO: 2329552 - protein, 43 aa, Cryptosporidium parvum
KSKRNKKQTSSIEESDSTSDSEIENKNQDSVDKEKKKKRSKFR

SEQ ID NO: 2329553 - protein, 22 aa, Cryptosporidium parvum
KSKSSRCSARDDSYVSGTIPTS

SEQ ID NO: 2329554 - protein, 10 aa, Cryptosporidium parvum
KSKSTSCESQ

SEQ ID NO: 2329555 - protein, 6 aa, Cryptosporidium parvum
KSKSVL

SEQ ID NO: 2329556 - protein, 12 aa, Cryptosporidium parvum
KSKTNSRIKGNT

SEQ ID NO: 2329557 - protein, 6 aa, Cryptosporidium parvum
KSKVPV

SEQ ID NO: 2329558 - protein, 8 aa, Cryptosporidium parvum
KSLPKKRK

SEQ ID NO: 2329559 - protein, 13 aa, Cryptosporidium parvum
KSLPQKPCSQCPS

SEQ ID NO: 2329560 - protein, 5 aa, Cryptosporidium parvum
KSLRY

SEQ ID NO: 2329561 - protein, 9 aa, Cryptosporidium parvum
KSMKNSQQD

SEQ ID NO: 2329562 - protein, 23 aa, Cryptosporidium parvum
KSMVESSTSKGLHTSKKMKPGRF

SEQ ID NO: 2329563 - protein, 6 aa, Cryptosporidium parvum
KSNDKL

SEQ ID NO: 2329564 - protein, 6 aa, Cryptosporidium parvum
KSNDPR

SEQ ID NO: 2329565 - protein, 5 aa, Cryptosporidium parvum
KSNEI

SEQ ID NO: 2329566 - protein, 7 aa, Cryptosporidium parvum
KSNGYDK

SEQ ID NO: 2329567 - protein, 8 aa, Cryptosporidium parvum
KSNKKTEL

SEQ ID NO: 2329568 - protein, 12 aa, Cryptosporidium parvum
KSNMSRNGNKDK

SEQ ID NO: 2329569 - protein, 6 aa, Cryptosporidium parvum
KSNNEL

SEQ ID NO: 2329570 - protein, 7 aa, Cryptosporidium parvum
KSNQSIK

SEQ ID NO: 2329571 - protein, 6 aa, Cryptosporidium parvum
KSNREG

SEQ ID NO: 2329572 - protein, 7 aa, Cryptosporidium parvum
KSNSKEL

SEQ ID NO: 2329573 - protein, 31 aa, Cryptosporidium parvum
KSNSQINDDINATTKYSDYNGYNLPENSSVF

SEQ ID NO: 2329574 - protein, 8 aa, Cryptosporidium parvum
KSNSSRNG

SEQ ID NO: 2329575 - protein, 7 aa, Cryptosporidium parvum
KSNYDSH

SEQ ID NO: 2329576 - protein, 6 aa, Cryptosporidium parvum
KSPEEF

SEQ ID NO: 2329577 - protein, 22 aa, Cryptosporidium parvum
KSPEKVDKNTPDFGAAGDGDCD

SEQ ID NO: 2329578 - protein, 12 aa, Cryptosporidium parvum
KSPSTSSGSNEP

SEQ ID NO: 2329579 - protein, 9 aa, Cryptosporidium parvum
KSPTRATSI

SEQ ID NO: 2329580 - protein, 8 aa, Cryptosporidium parvum
KSQAPSLG

SEQ ID NO: 2329581 - protein, 7 aa, Cryptosporidium parvum
KSQDFSI

SEQ ID NO: 2329582 - protein, 14 aa, Cryptosporidium parvum
KSQKQEKNSTTEVR

SEQ ID NO: 2329583 - protein, 4 aa, Cryptosporidium parvum
KSQL

SEQ ID NO: 2329584 - protein, 8 aa, Cryptosporidium parvum
KSQTHNKM

SEQ ID NO: 2329585 - protein, 5 aa, Cryptosporidium parvum
KSREA

SEQ ID NO: 2329586 - protein, 9 aa, Cryptosporidium parvum
KSREGEVGY

SEQ ID NO: 2329587 - protein, 6 aa, Cryptosporidium parvum
KSRGSI

SEQ ID NO: 2329588 - protein, 11 aa, Cryptosporidium parvum
KSRKPAERKIR

SEQ ID NO: 2329589 - protein, 8 aa, Cryptosporidium parvum
KSRNDYFG

SEQ ID NO: 2329590 - protein, 8 aa, Cryptosporidium parvum
KSRNTLEV

SEQ ID NO: 2329591 - protein, 10 aa, Cryptosporidium parvum
KSRRDEEKDD

SEQ ID NO: 2329592 - protein, 18 aa, Cryptosporidium parvum
KSRRTKTIRKSKDCDADP

SEQ ID NO: 2329593 - protein, 7 aa, Cryptosporidium parvum
KSSEHDY

SEQ ID NO: 2329594 - protein, 8 aa, Cryptosporidium parvum
KSSELKNK

SEQ ID NO: 2329595 - protein, 14 aa, Cryptosporidium parvum
KSSFKSKYPISERG

SEQ ID NO: 2329596 - protein, 16 aa, Cryptosporidium parvum
KSSIDNQQEKNAGFSS

SEQ ID NO: 2329597 - protein, 6 aa, Cryptosporidium parvum
KSSIES

SEQ ID NO: 2329598 - protein, 8 aa, Cryptosporidium parvum
KSSLSEED

SEQ ID NO: 2329599 - protein, 6 aa, Cryptosporidium parvum
KSSNKY

SEQ ID NO: 2329600 - protein, 6 aa, Cryptosporidium parvum
KSSQDL

SEQ ID NO: 2329601 - protein, 15 aa, Cryptosporidium parvum
KSSQEGSSIDESSSD

SEQ ID NO: 2329602 - protein, 8 aa, Cryptosporidium parvum
KSSSFSGY

SEQ ID NO: 2329603 - protein, 20 aa, Cryptosporidium parvum
KSSSISNNNNNNNNNNNNKL

SEQ ID NO: 2329604 - protein, 7 aa, Cryptosporidium parvum
KSSSSES

SEQ ID NO: 2329605 - protein, 8 aa, Cryptosporidium parvum
KSSSSPEL

SEQ ID NO: 2329606 - protein, 9 aa, Cryptosporidium parvum
KSSSTCISS

SEQ ID NO: 2329607 - protein, 53 aa, Cryptosporidium parvum
KSSTTTTTTTAPVSSEDNKPEDSEDEKESESESDSSNEGSSNSEDSEEKTRKT

SEQ ID NO: 2329608 - protein, 9 aa, Cryptosporidium parvum
KSSYGPKNK

SEQ ID NO: 2329609 - protein, 15 aa, Cryptosporidium parvum
KSTDDTSKPEERSSR

SEQ ID NO: 2329610 - protein, 8 aa, Cryptosporidium parvum
KSTEVESA

SEQ ID NO: 2329611 - protein, 6 aa, Cryptosporidium parvum
KSTGYY

SEQ ID NO: 2329612 - protein, 9 aa, Cryptosporidium parvum
KSTNLNNGT

SEQ ID NO: 2329613 - protein, 9 aa, Cryptosporidium parvum
KSTSKSIKS

SEQ ID NO: 2329614 - protein, 9 aa, Cryptosporidium parvum
KSTSSWKSC

SEQ ID NO: 2329615 - protein, 7 aa, Cryptosporidium parvum
KSVEDGV

SEQ ID NO: 2329616 - protein, 20 aa, Cryptosporidium parvum
KSVEESIKRTPTKSDIYSAP

SEQ ID NO: 2329617 - protein, 6 aa, Cryptosporidium parvum
KSVESL

SEQ ID NO: 2329618 - protein, 5 aa, Cryptosporidium parvum
KSVKE

SEQ ID NO: 2329619 - protein, 25 aa, Cryptosporidium parvum
KSVPPHQKCPEGTEYEESSSSCKVK

SEQ ID NO: 2329620 - protein, 7 aa, Cryptosporidium parvum
KSVQGNY

SEQ ID NO: 2329621 - protein, 7 aa, Cryptosporidium parvum
KSVSEYR

SEQ ID NO: 2329622 - protein, 5 aa, Cryptosporidium parvum
KSVSR

SEQ ID NO: 2329623 - protein, 13 aa, Cryptosporidium parvum
KSVSSKSSTGFSE

SEQ ID NO: 2329624 - protein, 8 aa, Cryptosporidium parvum
KSYENPLG

SEQ ID NO: 2329625 - protein, 4 aa, Cryptosporidium parvum
KSYK

SEQ ID NO: 2329626 - protein, 12 aa, Cryptosporidium parvum
KSYNLTVNVTIE

SEQ ID NO: 2329627 - protein, 5 aa, Cryptosporidium parvum
KSYPI

SEQ ID NO: 2329628 - protein, 4 aa, Cryptosporidium parvum
KSYS

SEQ ID NO: 2329629 - protein, 13 aa, Cryptosporidium parvum
KSYSKTGKNLSEG

SEQ ID NO: 2329630 - protein, 6 aa, Cryptosporidium parvum
KSYSSA

SEQ ID NO: 2329631 - protein, 9 aa, Cryptosporidium parvum
KTAGHPRHE

SEQ ID NO: 2329632 - protein, 20 aa, Cryptosporidium parvum
KTALPEANPPQGKREVGVQV

SEQ ID NO: 2329633 - protein, 5 aa, Cryptosporidium parvum
KTARY

SEQ ID NO: 2329634 - protein, 6 aa, Cryptosporidium parvum
KTASIQ

SEQ ID NO: 2329635 - protein, 25 aa, Cryptosporidium parvum
KTASKNSISKTRSTETNTKKKSGFT

SEQ ID NO: 2329636 - protein, 6 aa, Cryptosporidium parvum
KTASNA

SEQ ID NO: 2329637 - protein, 20 aa, Cryptosporidium parvum
KTASSTGNPSIQGGGIGANT

SEQ ID NO: 2329638 - protein, 7 aa, Cryptosporidium parvum
KTCETTE

SEQ ID NO: 2329639 - protein, 7 aa, Cryptosporidium parvum
KTDAFSD

SEQ ID NO: 2329640 - protein, 6 aa, Cryptosporidium parvum
KTDQVN

SEQ ID NO: 2329641 - protein, 6 aa, Cryptosporidium parvum
KTEDEL

SEQ ID NO: 2329642 - protein, 5 aa, Cryptosporidium parvum
KTELE

SEQ ID NO: 2329643 - protein, 15 aa, Cryptosporidium parvum
KTESQSGSSSPASRI

SEQ ID NO: 2329644 - protein, 19 aa, Cryptosporidium parvum
KTEVPQSLSNTQNNKRKNR

SEQ ID NO: 2329645 - protein, 5 aa, Cryptosporidium parvum
KTFSD

SEQ ID NO: 2329646 - protein, 8 aa, Cryptosporidium parvum
KTFSGGGV

SEQ ID NO: 2329647 - protein, 6 aa, Cryptosporidium parvum
KTGAIS

SEQ ID NO: 2329648 - protein, 8 aa, Cryptosporidium parvum
KTGLHDKP

SEQ ID NO: 2329649 - protein, 9 aa, Cryptosporidium parvum
KTGQEEDGL

SEQ ID NO: 2329650 - protein, 4 aa, Cryptosporidium parvum
KTHL

SEQ ID NO: 2329651 - protein, 4 aa, Cryptosporidium parvum
KTHT

SEQ ID NO: 2329652 - protein, 50 aa, Cryptosporidium parvum
KTIKEQKSSNTSTRKRKQDERRTKNETRREREERERVEERERERERERER

SEQ ID NO: 2329653 - protein, 11 aa, Cryptosporidium parvum
KTIPQSKKIDV

SEQ ID NO: 2329654 - protein, 6 aa, Cryptosporidium parvum
KTIPSR

SEQ ID NO: 2329655 - protein, 8 aa, Cryptosporidium parvum
KTKAKTTL

SEQ ID NO: 2329656 - protein, 6 aa, Cryptosporidium parvum
KTKKEL

SEQ ID NO: 2329657 - protein, 10 aa, Cryptosporidium parvum
KTKLGSSMGD

SEQ ID NO: 2329658 - protein, 8 aa, Cryptosporidium parvum
KTKSDRLD

SEQ ID NO: 2329659 - protein, 10 aa, Cryptosporidium parvum
KTKSKKNSHC

SEQ ID NO: 2329660 - protein, 7 aa, Cryptosporidium parvum
KTKSSQG

SEQ ID NO: 2329661 - protein, 5 aa, Cryptosporidium parvum
KTLDE

SEQ ID NO: 2329662 - protein, 8 aa, Cryptosporidium parvum
KTLDEQTS

SEQ ID NO: 2329663 - protein, 7 aa, Cryptosporidium parvum
KTLNEKN

SEQ ID NO: 2329664 - protein, 18 aa, Cryptosporidium parvum
KTLPKDPTVPASAPAKEA

SEQ ID NO: 2329665 - protein, 7 aa, Cryptosporidium parvum
KTLPRNN

SEQ ID NO: 2329666 - protein, 12 aa, Cryptosporidium parvum
KTLYTTQAKAAQ

SEQ ID NO: 2329667 - protein, 8 aa, Cryptosporidium parvum
KTNDSTWK

SEQ ID NO: 2329668 - protein, 14 aa, Cryptosporidium parvum
KTNEEEVVGSPQCG

SEQ ID NO: 2329669 - protein, 19 aa, Cryptosporidium parvum
KTNEHDLSNKLTKKEERIE

SEQ ID NO: 2329670 - protein, 10 aa, Cryptosporidium parvum
KTNINNGTWG

SEQ ID NO: 2329671 - protein, 8 aa, Cryptosporidium parvum
KTNKRTNP

SEQ ID NO: 2329672 - protein, 5 aa, Cryptosporidium parvum
KTNQN

SEQ ID NO: 2329673 - protein, 15 aa, Cryptosporidium parvum
KTNVQDNEAGGITQQ

SEQ ID NO: 2329674 - protein, 6 aa, Cryptosporidium parvum
KTPNLE

SEQ ID NO: 2329675 - protein, 14 aa, Cryptosporidium parvum
KTPPTLKCPPGSVD

SEQ ID NO: 2329676 - protein, 9 aa, Cryptosporidium parvum
KTQGENNNY

SEQ ID NO: 2329677 - protein, 14 aa, Cryptosporidium parvum
KTQREKLSNLSASV

SEQ ID NO: 2329678 - protein, 7 aa, Cryptosporidium parvum
KTRGDGL

SEQ ID NO: 2329679 - protein, 9 aa, Cryptosporidium parvum
KTRSKSKID

SEQ ID NO: 2329680 - protein, 91 aa, Cryptosporidium parvum
KTRVNRNLTGGNPLSRDKSLGDEKRTPSPNIPPPPSFPAPPPPSIPSGTPSHTPIPKDKNLTSDPTMGKTNHQGFPRKEPKSKRKPLTKKE

SEQ ID NO: 2329681 - protein, 25 aa, Cryptosporidium parvum
KTSAKRYQERERVPSRLPPPREEPP

SEQ ID NO: 2329682 - protein, 6 aa, Cryptosporidium parvum
KTSGHN

SEQ ID NO: 2329683 - protein, 6 aa, Cryptosporidium parvum
KTSGIS

SEQ ID NO: 2329684 - protein, 10 aa, Cryptosporidium parvum
KTSIDGNGEN

SEQ ID NO: 2329685 - protein, 18 aa, Cryptosporidium parvum
KTSKAGKLRESNRNNKSL

SEQ ID NO: 2329686 - protein, 9 aa, Cryptosporidium parvum
KTSKAYTEA

SEQ ID NO: 2329687 - protein, 8 aa, Cryptosporidium parvum
KTSPEFKK

SEQ ID NO: 2329688 - protein, 6 aa, Cryptosporidium parvum
KTSPTG

SEQ ID NO: 2329689 - protein, 16 aa, Cryptosporidium parvum
KTSTLTSSNDLTAISS

SEQ ID NO: 2329690 - protein, 5 aa, Cryptosporidium parvum
KTTES

SEQ ID NO: 2329691 - protein, 11 aa, Cryptosporidium parvum
KTTKEKKFSAN

SEQ ID NO: 2329692 - protein, 6 aa, Cryptosporidium parvum
KTTLDN

SEQ ID NO: 2329693 - protein, 13 aa, Cryptosporidium parvum
KTTNKTKTTNKTK

SEQ ID NO: 2329694 - protein, 8 aa, Cryptosporidium parvum
KTTTLNDY

SEQ ID NO: 2329695 - protein, 9 aa, Cryptosporidium parvum
KTVGSPQCG

SEQ ID NO: 2329696 - protein, 4 aa, Cryptosporidium parvum
KTVN

SEQ ID NO: 2329697 - protein, 10 aa, Cryptosporidium parvum
KVACSGPYPN

SEQ ID NO: 2329698 - protein, 8 aa, Cryptosporidium parvum
KVAEEAQS

SEQ ID NO: 2329699 - protein, 7 aa, Cryptosporidium parvum
KVANEKK

SEQ ID NO: 2329700 - protein, 4 aa, Cryptosporidium parvum
KVAT

SEQ ID NO: 2329701 - protein, 5 aa, Cryptosporidium parvum
KVEGC

SEQ ID NO: 2329702 - protein, 12 aa, Cryptosporidium parvum
KVEGNPSNTTLN

SEQ ID NO: 2329703 - protein, 13 aa, Cryptosporidium parvum
KVESGNNEFDRDP

SEQ ID NO: 2329704 - protein, 7 aa, Cryptosporidium parvum
KVGNNET

SEQ ID NO: 2329705 - protein, 7 aa, Cryptosporidium parvum
KVGTTGN

SEQ ID NO: 2329706 - protein, 6 aa, Cryptosporidium parvum
KVKQGR

SEQ ID NO: 2329707 - protein, 11 aa, Cryptosporidium parvum
KVLSSQGLSEY

SEQ ID NO: 2329708 - protein, 17 aa, Cryptosporidium parvum
KVNEDSKQAKNRLGKEY

SEQ ID NO: 2329709 - protein, 16 aa, Cryptosporidium parvum
KVNKESPRLESKASAV

SEQ ID NO: 2329710 - protein, 4 aa, Cryptosporidium parvum
KVNQ

SEQ ID NO: 2329711 - protein, 13 aa, Cryptosporidium parvum
KVPDPKQSDVAPP

SEQ ID NO: 2329712 - protein, 8 aa, Cryptosporidium parvum
KVPEASEL

SEQ ID NO: 2329713 - protein, 18 aa, Cryptosporidium parvum
KVPGPDSPKSRYPKNTSH

SEQ ID NO: 2329714 - protein, 7 aa, Cryptosporidium parvum
KVPKGKD

SEQ ID NO: 2329715 - protein, 6 aa, Cryptosporidium parvum
KVRSSN

SEQ ID NO: 2329716 - protein, 11 aa, Cryptosporidium parvum
KVSAENNLNDK

SEQ ID NO: 2329717 - protein, 5 aa, Cryptosporidium parvum
KVSAS

SEQ ID NO: 2329718 - protein, 8 aa, Cryptosporidium parvum
KVSGDLKE

SEQ ID NO: 2329719 - protein, 4 aa, Cryptosporidium parvum
KVSN

SEQ ID NO: 2329720 - protein, 19 aa, Cryptosporidium parvum
KVSSKLSKINKKLQQPNIS

SEQ ID NO: 2329721 - protein, 19 aa, Cryptosporidium parvum
KVTPTLSDWPSPDFNSPKN

SEQ ID NO: 2329722 - protein, 14 aa, Cryptosporidium parvum
KVYGSDGVYSEKSS

SEQ ID NO: 2329723 - protein, 10 aa, Cryptosporidium parvum
KWYEKRDPIT

SEQ ID NO: 2329724 - protein, 11 aa, Cryptosporidium parvum
KYAFNSEDTTY

SEQ ID NO: 2329725 - protein, 4 aa, Cryptosporidium parvum
KYDL

SEQ ID NO: 2329726 - protein, 9 aa, Cryptosporidium parvum
KYEKKQQVD

SEQ ID NO: 2329727 - protein, 10 aa, Cryptosporidium parvum
KYETKGTESL

SEQ ID NO: 2329728 - protein, 12 aa, Cryptosporidium parvum
KYFEENTNTPLR

SEQ ID NO: 2329729 - protein, 7 aa, Cryptosporidium parvum
KYGEDSN

SEQ ID NO: 2329730 - protein, 5 aa, Cryptosporidium parvum
KYGGY

SEQ ID NO: 2329731 - protein, 8 aa, Cryptosporidium parvum
KYHDSGKK

SEQ ID NO: 2329732 - protein, 37 aa, Cryptosporidium parvum
KYLNNSSKICKDKETNRTSTKGKKLTRERKTNEKKIS

SEQ ID NO: 2329733 - protein, 18 aa, Cryptosporidium parvum
KYMDNNDLTETSKDNDSY

SEQ ID NO: 2329734 - protein, 6 aa, Cryptosporidium parvum
KYNDIT

SEQ ID NO: 2329735 - protein, 7 aa, Cryptosporidium parvum
KYNGNTK

SEQ ID NO: 2329736 - protein, 7 aa, Cryptosporidium parvum
KYNGTIS

SEQ ID NO: 2329737 - protein, 4 aa, Cryptosporidium parvum
KYNI

SEQ ID NO: 2329738 - protein, 8 aa, Cryptosporidium parvum
KYPAPESY

SEQ ID NO: 2329739 - protein, 17 aa, Cryptosporidium parvum
KYPGHQKDGVGSRFSET

SEQ ID NO: 2329740 - protein, 4 aa, Cryptosporidium parvum
KYPN

SEQ ID NO: 2329741 - protein, 10 aa, Cryptosporidium parvum
KYPPESRKRP

SEQ ID NO: 2329742 - protein, 7 aa, Cryptosporidium parvum
KYPTNRR

SEQ ID NO: 2329743 - protein, 5 aa, Cryptosporidium parvum
KYQPR

SEQ ID NO: 2329744 - protein, 6 aa, Cryptosporidium parvum
KYQSKI

SEQ ID NO: 2329745 - protein, 13 aa, Cryptosporidium parvum
KYSADSHTYSAGD

SEQ ID NO: 2329746 - protein, 6 aa, Cryptosporidium parvum
KYSKEE

SEQ ID NO: 2329747 - protein, 4 aa, Cryptosporidium parvum
KYSN

SEQ ID NO: 2329748 - protein, 4 aa, Cryptosporidium parvum
KYSP

SEQ ID NO: 2329749 - protein, 7 aa, Cryptosporidium parvum
KYSPELG

SEQ ID NO: 2329750 - protein, 100 aa, Cryptosporidium parvum
KYSQEDGSFVENKKGSKKESKAIDNTETAEEAVQSNSESDVNKTSIKDDGEKTKESSEQLELEQNDDKKKNKGKKRKLDEKKGEDKGKNKKKKLAKNKKN

SEQ ID NO: 2329751 - protein, 13 aa, Cryptosporidium parvum
KYSRDYSSEELER

SEQ ID NO: 2329752 - protein, 10 aa, Cryptosporidium parvum
KYSSLSNKHY

SEQ ID NO: 2329753 - protein, 8 aa, Cryptosporidium parvum
KYSTRNLK

SEQ ID NO: 2329754 - protein, 9 aa, Cryptosporidium parvum
KYYPDPPNI

SEQ ID NO: 2329755 - protein, 16 aa, Cryptosporidium parvum
LAADQNQTSQSDEESE

SEQ ID NO: 2329756 - protein, 8 aa, Cryptosporidium parvum
LAEKTNEM

SEQ ID NO: 2329757 - protein, 7 aa, Cryptosporidium parvum
LAPELSP

SEQ ID NO: 2329758 - protein, 4 aa, Cryptosporidium parvum
LASE

SEQ ID NO: 2329759 - protein, 99 aa, Cryptosporidium parvum
LASPSGESTITNRGPENRINEPSSSVEESSISEPPVSESGQLQTVEGSSQSTRNEQPPSQEGPNTEDTSHISAQTSSNDQSQLPSSSKQLHNKGRKTGI

SEQ ID NO: 2329760 - protein, 6 aa, Cryptosporidium parvum
LASYKR

SEQ ID NO: 2329761 - protein, 11 aa, Cryptosporidium parvum
LAYSKNNLKEK

SEQ ID NO: 2329762 - protein, 14 aa, Cryptosporidium parvum
LCENPDSSSPLGKF

SEQ ID NO: 2329763 - protein, 12 aa, Cryptosporidium parvum
LCETTSNNERFN

SEQ ID NO: 2329764 - protein, 6 aa, Cryptosporidium parvum
LCGTKS

SEQ ID NO: 2329765 - protein, 7 aa, Cryptosporidium parvum
LCPSDSS

SEQ ID NO: 2329766 - protein, 15 aa, Cryptosporidium parvum
LDDENGTGKENSSKS

SEQ ID NO: 2329767 - protein, 33 aa, Cryptosporidium parvum
LDEASEGTIGLPSQKGDDAAEKSHEGDVSVSDE

SEQ ID NO: 2329768 - protein, 14 aa, Cryptosporidium parvum
LDEKQDRSASPTFP

SEQ ID NO: 2329769 - protein, 22 aa, Cryptosporidium parvum
LDEQESSDYRENAERKGEDSAH

SEQ ID NO: 2329770 - protein, 11 aa, Cryptosporidium parvum
LDGGNVQAKTD

SEQ ID NO: 2329771 - protein, 17 aa, Cryptosporidium parvum
LDGKGNRLENKIPKPTL

SEQ ID NO: 2329772 - protein, 8 aa, Cryptosporidium parvum
LDGNGSRV

SEQ ID NO: 2329773 - protein, 20 aa, Cryptosporidium parvum
LDGSSSNQGYSGSRAGSGWT

SEQ ID NO: 2329774 - protein, 67 aa, Cryptosporidium parvum
LDGTDGGRKPNCPLGRRGGVRGRDNGPKKDPSQSSDSSSSSSSSSSSSSNSSPDGPVSSSGDGSSGK

SEQ ID NO: 2329775 - protein, 4 aa, Cryptosporidium parvum
LDKA

SEQ ID NO: 2329776 - protein, 17 aa, Cryptosporidium parvum
LDKERNSNKSSGSKDKN

SEQ ID NO: 2329777 - protein, 7 aa, Cryptosporidium parvum
LDKKTQK

SEQ ID NO: 2329778 - protein, 8 aa, Cryptosporidium parvum
LDNSTSTI

SEQ ID NO: 2329779 - protein, 6 aa, Cryptosporidium parvum
LDPEKA

SEQ ID NO: 2329780 - protein, 7 aa, Cryptosporidium parvum
LDPNSDS

SEQ ID NO: 2329781 - protein, 16 aa, Cryptosporidium parvum
LDPQNSRNRVDSNDNT

SEQ ID NO: 2329782 - protein, 5 aa, Cryptosporidium parvum
LDPSN

SEQ ID NO: 2329783 - protein, 15 aa, Cryptosporidium parvum
LDPTRSSKIGSRMPT

SEQ ID NO: 2329784 - protein, 6 aa, Cryptosporidium parvum
LDQDQN

SEQ ID NO: 2329785 - protein, 16 aa, Cryptosporidium parvum
LDQKSRKVSSQKASAW

SEQ ID NO: 2329786 - protein, 9 aa, Cryptosporidium parvum
LDQTPPSSE

SEQ ID NO: 2329787 - protein, 11 aa, Cryptosporidium parvum
LDSEDNAVSKE

SEQ ID NO: 2329788 - protein, 4 aa, Cryptosporidium parvum
LDSN

SEQ ID NO: 2329789 - protein, 13 aa, Cryptosporidium parvum
LDSNRRKKMEEDR

SEQ ID NO: 2329790 - protein, 5 aa, Cryptosporidium parvum
LDSPV

SEQ ID NO: 2329791 - protein, 18 aa, Cryptosporidium parvum
LDSSDTLDESTPSSNSDL

SEQ ID NO: 2329792 - protein, 16 aa, Cryptosporidium parvum
LDSSNDSTRNKANKAK

SEQ ID NO: 2329793 - protein, 6 aa, Cryptosporidium parvum
LDSTGT

SEQ ID NO: 2329794 - protein, 11 aa, Cryptosporidium parvum
LDTDKTVGPDN

SEQ ID NO: 2329795 - protein, 17 aa, Cryptosporidium parvum
LDTNDGFEEVKDSSFQN

SEQ ID NO: 2329796 - protein, 14 aa, Cryptosporidium parvum
LDTRVKGGSKHSTW

SEQ ID NO: 2329797 - protein, 4 aa, Cryptosporidium parvum
LDYD

SEQ ID NO: 2329798 - protein, 5 aa, Cryptosporidium parvum
LEDAN

SEQ ID NO: 2329799 - protein, 6 aa, Cryptosporidium parvum
LEDEVT

SEQ ID NO: 2329800 - protein, 7 aa, Cryptosporidium parvum
LEEERAN

SEQ ID NO: 2329801 - protein, 28 aa, Cryptosporidium parvum
LEEKERKKALKEANKKSSSDKNEANDAK

SEQ ID NO: 2329802 - protein, 8 aa, Cryptosporidium parvum
LEEKERSE

SEQ ID NO: 2329803 - protein, 4 aa, Cryptosporidium parvum
LEER

SEQ ID NO: 2329804 - protein, 9 aa, Cryptosporidium parvum
LEGGDSVSQ

SEQ ID NO: 2329805 - protein, 14 aa, Cryptosporidium parvum
LEGPENNHKKKNPV

SEQ ID NO: 2329806 - protein, 10 aa, Cryptosporidium parvum
LEKAKSSSNF

SEQ ID NO: 2329807 - protein, 8 aa, Cryptosporidium parvum
LEKERLEK

SEQ ID NO: 2329808 - protein, 5 aa, Cryptosporidium parvum
LEKHG

SEQ ID NO: 2329809 - protein, 13 aa, Cryptosporidium parvum
LEKIEENALTDEK

SEQ ID NO: 2329810 - protein, 18 aa, Cryptosporidium parvum
LEKKEKKLKKQKEKERLR

SEQ ID NO: 2329811 - protein, 6 aa, Cryptosporidium parvum
LEKKPL

SEQ ID NO: 2329812 - protein, 11 aa, Cryptosporidium parvum
LEKSEENKELA

SEQ ID NO: 2329813 - protein, 6 aa, Cryptosporidium parvum
LENNNS

SEQ ID NO: 2329814 - protein, 7 aa, Cryptosporidium parvum
LENRPED

SEQ ID NO: 2329815 - protein, 6 aa, Cryptosporidium parvum
LENSSL

SEQ ID NO: 2329816 - protein, 7 aa, Cryptosporidium parvum
LENTVAT

SEQ ID NO: 2329817 - protein, 12 aa, Cryptosporidium parvum
LEPHPGKTSISD

SEQ ID NO: 2329818 - protein, 21 aa, Cryptosporidium parvum
LEPQPNISTIEKNSESNEELD

SEQ ID NO: 2329819 - protein, 4 aa, Cryptosporidium parvum
LESA

SEQ ID NO: 2329820 - protein, 5 aa, Cryptosporidium parvum
LESCP

SEQ ID NO: 2329821 - protein, 10 aa, Cryptosporidium parvum
LESDQAIPDD

SEQ ID NO: 2329822 - protein, 12 aa, Cryptosporidium parvum
LESEADNSEPGV

SEQ ID NO: 2329823 - protein, 16 aa, Cryptosporidium parvum
LESEEISTGEDEFGEV

SEQ ID NO: 2329824 - protein, 40 aa, Cryptosporidium parvum
LESKPAKSKSGKKKSKTEKGNRKKSQKKKGLEKSKEEKEA

SEQ ID NO: 2329825 - protein, 7 aa, Cryptosporidium parvum
LESNGTL

SEQ ID NO: 2329826 - protein, 9 aa, Cryptosporidium parvum
LESRNEDIT

SEQ ID NO: 2329827 - protein, 6 aa, Cryptosporidium parvum
LESSEL

SEQ ID NO: 2329828 - protein, 5 aa, Cryptosporidium parvum
LESSS

SEQ ID NO: 2329829 - protein, 14 aa, Cryptosporidium parvum
LETDDSQIESEFEN

SEQ ID NO: 2329830 - protein, 10 aa, Cryptosporidium parvum
LETENTNSRL

SEQ ID NO: 2329831 - protein, 9 aa, Cryptosporidium parvum
LETTNNALN

SEQ ID NO: 2329832 - protein, 7 aa, Cryptosporidium parvum
LFGPNNR

SEQ ID NO: 2329833 - protein, 84 aa, Cryptosporidium parvum
LFPPPSPPMPGYPLPSSPIPTPPSSSPIPPKPEYQPPPPPIPTLSPSPPAPPMPAFPSSPPPTAPGVPSPTLPSPLSPTPEEVE

SEQ ID NO: 2329834 - protein, 8 aa, Cryptosporidium parvum
LGANNSTG

SEQ ID NO: 2329835 - protein, 9 aa, Cryptosporidium parvum
LGCSQTDND

SEQ ID NO: 2329836 - protein, 23 aa, Cryptosporidium parvum
LGDEETDSSRSQAESGLSQENSA

SEQ ID NO: 2329837 - protein, 4 aa, Cryptosporidium parvum
LGDG

SEQ ID NO: 2329838 - protein, 12 aa, Cryptosporidium parvum
LGDKNRANKNED

SEQ ID NO: 2329839 - protein, 17 aa, Cryptosporidium parvum
LGDNSGSNSTVLEPAHN

SEQ ID NO: 2329840 - protein, 6 aa, Cryptosporidium parvum
LGEEEK

SEQ ID NO: 2329841 - protein, 13 aa, Cryptosporidium parvum
LGEQGGDVGTNTE

SEQ ID NO: 2329842 - protein, 8 aa, Cryptosporidium parvum
LGGEGDDI

SEQ ID NO: 2329843 - protein, 38 aa, Cryptosporidium parvum
LGGEGDDIKGIDTSASSLDLTKEKEKATKKEKTKRGIT

SEQ ID NO: 2329844 - protein, 57 aa, Cryptosporidium parvum
LGGEGDDIKGIDTSASSLDLTKEKENAIKEEMDRKKGEVGKENAELEDNKTEGSSES

SEQ ID NO: 2329845 - protein, 9 aa, Cryptosporidium parvum
LGGGRTVEG

SEQ ID NO: 2329846 - protein, 6 aa, Cryptosporidium parvum
LGGNGI

SEQ ID NO: 2329847 - protein, 18 aa, Cryptosporidium parvum
LGGNPPKGLGKAPVPTPR

SEQ ID NO: 2329848 - protein, 4 aa, Cryptosporidium parvum
LGGP

SEQ ID NO: 2329849 - protein, 7 aa, Cryptosporidium parvum
LGGSHAE

SEQ ID NO: 2329850 - protein, 74 aa, Cryptosporidium parvum
LGHSASSSSRVVSGATQGPSKRNNQPKPNESGATGDPSDKSVGTPSTGLSTPKEGQSGVQPPCGEPSQEGIPSP

SEQ ID NO: 2329851 - protein, 4 aa, Cryptosporidium parvum
LGIH

SEQ ID NO: 2329852 - protein, 8 aa, Cryptosporidium parvum
LGKDAENE

SEQ ID NO: 2329853 - protein, 13 aa, Cryptosporidium parvum
LGKGISNKASNII

SEQ ID NO: 2329854 - protein, 110 aa, Cryptosporidium parvum
LGKNSEMGFSSQNSKNFVEPKDGAGEDLVGGSSTLEENLGSEQGTQSFNIPPPPSFPAPPPPSIPSGTSSPAPIPKDGNLTSDPTMSKTNHQDSFQNEPKSKRKPLTKKE

SEQ ID NO: 2329855 - protein, 24 aa, Cryptosporidium parvum
LGNGDDDDEDDDIEEDEDNDQDFD

SEQ ID NO: 2329856 - protein, 36 aa, Cryptosporidium parvum
LGNNEEDEKNTEKEKLEKEKLEKEQLEKEKLERERI

SEQ ID NO: 2329857 - protein, 6 aa, Cryptosporidium parvum
LGPDGV

SEQ ID NO: 2329858 - protein, 15 aa, Cryptosporidium parvum
LGPFDRKRGPNCKQE

SEQ ID NO: 2329859 - protein, 4 aa, Cryptosporidium parvum
LGRS

SEQ ID NO: 2329860 - protein, 11 aa, Cryptosporidium parvum
LGSDGSDFISD

SEQ ID NO: 2329861 - protein, 45 aa, Cryptosporidium parvum
LGTEIGESPLTKSSSKTLQKAEKKSEIKKSNKNKPSSDLPSSISR

SEQ ID NO: 2329862 - protein, 5 aa, Cryptosporidium parvum
LGTGW

SEQ ID NO: 2329863 - protein, 5 aa, Cryptosporidium parvum
LGTSL

SEQ ID NO: 2329864 - protein, 13 aa, Cryptosporidium parvum
LGVSDESNNLSYD

SEQ ID NO: 2329865 - protein, 17 aa, Cryptosporidium parvum
LGVSSSKSKSNSGNSLT

SEQ ID NO: 2329866 - protein, 4 aa, Cryptosporidium parvum
LHKE

SEQ ID NO: 2329867 - protein, 12 aa, Cryptosporidium parvum
LHPPSQHSAALT

SEQ ID NO: 2329868 - protein, 5 aa, Cryptosporidium parvum
LHSEE

SEQ ID NO: 2329869 - protein, 9 aa, Cryptosporidium parvum
LIPKPERKS

SEQ ID NO: 2329870 - protein, 9 aa, Cryptosporidium parvum
LIQSRSNSF

SEQ ID NO: 2329871 - protein, 4 aa, Cryptosporidium parvum
LISG

SEQ ID NO: 2329872 - protein, 14 aa, Cryptosporidium parvum
LISSDEDSNLTDDQ

SEQ ID NO: 2329873 - protein, 7 aa, Cryptosporidium parvum
LKDEKTM

SEQ ID NO: 2329874 - protein, 10 aa, Cryptosporidium parvum
LKDENKLTGE

SEQ ID NO: 2329875 - protein, 7 aa, Cryptosporidium parvum
LKDREKQ

SEQ ID NO: 2329876 - protein, 30 aa, Cryptosporidium parvum
LKDSGINQSNFSSSKSSSLGIANSQNSPQE

SEQ ID NO: 2329877 - protein, 26 aa, Cryptosporidium parvum
LKDSVDEDPALGKGALSDDASEDQTE

SEQ ID NO: 2329878 - protein, 8 aa, Cryptosporidium parvum
LKDTPVNT

SEQ ID NO: 2329879 - protein, 16 aa, Cryptosporidium parvum
LKECPTGFKPTNDSAT

SEQ ID NO: 2329880 - protein, 6 aa, Cryptosporidium parvum
LKECTS

SEQ ID NO: 2329881 - protein, 17 aa, Cryptosporidium parvum
LKEENQDENNGSKTLPT

SEQ ID NO: 2329882 - protein, 12 aa, Cryptosporidium parvum
LKEKAKSEALNY

SEQ ID NO: 2329883 - protein, 11 aa, Cryptosporidium parvum
LKELKDNKSVL

SEQ ID NO: 2329884 - protein, 6 aa, Cryptosporidium parvum
LKENEG

SEQ ID NO: 2329885 - protein, 4 aa, Cryptosporidium parvum
LKEQ

SEQ ID NO: 2329886 - protein, 10 aa, Cryptosporidium parvum
LKGDSGYSAS

SEQ ID NO: 2329887 - protein, 10 aa, Cryptosporidium parvum
LKGESTVTNE

SEQ ID NO: 2329888 - protein, 11 aa, Cryptosporidium parvum
LKGQNSTREDL

SEQ ID NO: 2329889 - protein, 26 aa, Cryptosporidium parvum
LKGQSQAKKQQKSSLIRENEEKDDMA

SEQ ID NO: 2329890 - protein, 7 aa, Cryptosporidium parvum
LKGSEKS

SEQ ID NO: 2329891 - protein, 10 aa, Cryptosporidium parvum
LKGTNPESVT

SEQ ID NO: 2329892 - protein, 9 aa, Cryptosporidium parvum
LKKAKNPWD

SEQ ID NO: 2329893 - protein, 7 aa, Cryptosporidium parvum
LKKGSKQ

SEQ ID NO: 2329894 - protein, 12 aa, Cryptosporidium parvum
LKKSSKKENYKR

SEQ ID NO: 2329895 - protein, 12 aa, Cryptosporidium parvum
LKNAFDSKGNNH

SEQ ID NO: 2329896 - protein, 7 aa, Cryptosporidium parvum
LKNEKTN

SEQ ID NO: 2329897 - protein, 18 aa, Cryptosporidium parvum
LKNEKTSTESVVGSPQCG

SEQ ID NO: 2329898 - protein, 7 aa, Cryptosporidium parvum
LKNTHQT

SEQ ID NO: 2329899 - protein, 12 aa, Cryptosporidium parvum
LKPKKSSLDSFS

SEQ ID NO: 2329900 - protein, 9 aa, Cryptosporidium parvum
LKPQQGGYD

SEQ ID NO: 2329901 - protein, 7 aa, Cryptosporidium parvum
LKPSDLE

SEQ ID NO: 2329902 - protein, 12 aa, Cryptosporidium parvum
LKPTGSSASSEI

SEQ ID NO: 2329903 - protein, 28 aa, Cryptosporidium parvum
LKQAEEKKLGKAKKGYGTFAEKSPLEES

SEQ ID NO: 2329904 - protein, 11 aa, Cryptosporidium parvum
LKQATSIPTAY

SEQ ID NO: 2329905 - protein, 6 aa, Cryptosporidium parvum
LKQTGK

SEQ ID NO: 2329906 - protein, 4 aa, Cryptosporidium parvum
LKRQ

SEQ ID NO: 2329907 - protein, 4 aa, Cryptosporidium parvum
LKSL

SEQ ID NO: 2329908 - protein, 24 aa, Cryptosporidium parvum
LKSNEMPIKQNKDENLKRRRSRGV

SEQ ID NO: 2329909 - protein, 57 aa, Cryptosporidium parvum
LKSPRLGRRRPRGRGNQGGSSNSGSDSGGDTSQFGDPSPRPPSPYKTTPRCSKLKGR

SEQ ID NO: 2329910 - protein, 7 aa, Cryptosporidium parvum
LKSRNTH

SEQ ID NO: 2329911 - protein, 8 aa, Cryptosporidium parvum
LKSTQTGF

SEQ ID NO: 2329912 - protein, 7 aa, Cryptosporidium parvum
LKTEKSN

SEQ ID NO: 2329913 - protein, 6 aa, Cryptosporidium parvum
LKTNPP

SEQ ID NO: 2329914 - protein, 12 aa, Cryptosporidium parvum
LKTRSKASNHKS

SEQ ID NO: 2329915 - protein, 11 aa, Cryptosporidium parvum
LKTSENASKAF

SEQ ID NO: 2329916 - protein, 13 aa, Cryptosporidium parvum
LKTSKSDRKAMDK

SEQ ID NO: 2329917 - protein, 12 aa, Cryptosporidium parvum
LLNSSEDSFSKC

SEQ ID NO: 2329918 - protein, 10 aa, Cryptosporidium parvum
LLPPPEESNI

SEQ ID NO: 2329919 - protein, 5 aa, Cryptosporidium parvum
LLQPT

SEQ ID NO: 2329920 - protein, 4 aa, Cryptosporidium parvum
LLST

SEQ ID NO: 2329921 - protein, 12 aa, Cryptosporidium parvum
LMDEQQKKKAIE

SEQ ID NO: 2329922 - protein, 7 aa, Cryptosporidium parvum
LNATDTE

SEQ ID NO: 2329923 - protein, 7 aa, Cryptosporidium parvum
LNDENDP

SEQ ID NO: 2329924 - protein, 5 aa, Cryptosporidium parvum
LNDRE

SEQ ID NO: 2329925 - protein, 9 aa, Cryptosporidium parvum
LNDRKSNKT

SEQ ID NO: 2329926 - protein, 9 aa, Cryptosporidium parvum
LNDSNKEYS

SEQ ID NO: 2329927 - protein, 5 aa, Cryptosporidium parvum
LNGNE

SEQ ID NO: 2329928 - protein, 7 aa, Cryptosporidium parvum
LNGRKST

SEQ ID NO: 2329929 - protein, 11 aa, Cryptosporidium parvum
LNKEKSKSELE

SEQ ID NO: 2329930 - protein, 7 aa, Cryptosporidium parvum
LNKKQEI

SEQ ID NO: 2329931 - protein, 11 aa, Cryptosporidium parvum
LNKLQGKNGLT

SEQ ID NO: 2329932 - protein, 11 aa, Cryptosporidium parvum
LNKRNGDINDA

SEQ ID NO: 2329933 - protein, 9 aa, Cryptosporidium parvum
LNNDSGDLE

SEQ ID NO: 2329934 - protein, 17 aa, Cryptosporidium parvum
LNNETGLYEPEKKYNSS

SEQ ID NO: 2329935 - protein, 22 aa, Cryptosporidium parvum
LNRGQNNVRKQYTTTTTNNPES

SEQ ID NO: 2329936 - protein, 26 aa, Cryptosporidium parvum
LNSPSLGITASNEVSQINSNSSQEIA

SEQ ID NO: 2329937 - protein, 7 aa, Cryptosporidium parvum
LNSSSRQ

SEQ ID NO: 2329938 - protein, 8 aa, Cryptosporidium parvum
LNTPPNYH

SEQ ID NO: 2329939 - protein, 12 aa, Cryptosporidium parvum
LNTQPRIEPPIS

SEQ ID NO: 2329940 - protein, 8 aa, Cryptosporidium parvum
LPAEERNT

SEQ ID NO: 2329941 - protein, 4 aa, Cryptosporidium parvum
LPAS

SEQ ID NO: 2329942 - protein, 5 aa, Cryptosporidium parvum
LPASF

SEQ ID NO: 2329943 - protein, 5 aa, Cryptosporidium parvum
LPASH

SEQ ID NO: 2329944 - protein, 5 aa, Cryptosporidium parvum
LPATS

SEQ ID NO: 2329945 - protein, 4 aa, Cryptosporidium parvum
LPDD

SEQ ID NO: 2329946 - protein, 7 aa, Cryptosporidium parvum
LPDKADS

SEQ ID NO: 2329947 - protein, 27 aa, Cryptosporidium parvum
LPDTYRSSQAASRLPSPFEDQYSKTQI

SEQ ID NO: 2329948 - protein, 5 aa, Cryptosporidium parvum
LPEEK

SEQ ID NO: 2329949 - protein, 8 aa, Cryptosporidium parvum
LPEGSYKG

SEQ ID NO: 2329950 - protein, 7 aa, Cryptosporidium parvum
LPGGENK

SEQ ID NO: 2329951 - protein, 9 aa, Cryptosporidium parvum
LPGGGASCR

SEQ ID NO: 2329952 - protein, 7 aa, Cryptosporidium parvum
LPGGSKL

SEQ ID NO: 2329953 - protein, 6 aa, Cryptosporidium parvum
LPGTKE

SEQ ID NO: 2329954 - protein, 7 aa, Cryptosporidium parvum
LPHRPRA

SEQ ID NO: 2329955 - protein, 8 aa, Cryptosporidium parvum
LPKEVPGG

SEQ ID NO: 2329956 - protein, 42 aa, Cryptosporidium parvum
LPKNKTGENGSGKPATPKVGSRPSAVGGSTTSGSSSKPRVTI

SEQ ID NO: 2329957 - protein, 14 aa, Cryptosporidium parvum
LPKPKSKKKPLTRR

SEQ ID NO: 2329958 - protein, 15 aa, Cryptosporidium parvum
LPKPNKGEDKERPKE

SEQ ID NO: 2329959 - protein, 9 aa, Cryptosporidium parvum
LPKRRPNSS

SEQ ID NO: 2329960 - protein, 6 aa, Cryptosporidium parvum
LPKTNA

SEQ ID NO: 2329961 - protein, 4 aa, Cryptosporidium parvum
LPPD

SEQ ID NO: 2329962 - protein, 10 aa, Cryptosporidium parvum
LPPEETKESL

SEQ ID NO: 2329963 - protein, 4 aa, Cryptosporidium parvum
LPPK

SEQ ID NO: 2329964 - protein, 8 aa, Cryptosporidium parvum
LPPPPTST

SEQ ID NO: 2329965 - protein, 8 aa, Cryptosporidium parvum
LPPSSKRS

SEQ ID NO: 2329966 - protein, 14 aa, Cryptosporidium parvum
LPPYPTPSSPTPMP

SEQ ID NO: 2329967 - protein, 14 aa, Cryptosporidium parvum
LPRENERERSTTIP

SEQ ID NO: 2329968 - protein, 5 aa, Cryptosporidium parvum
LPRKS

SEQ ID NO: 2329969 - protein, 5 aa, Cryptosporidium parvum
LPRSN

SEQ ID NO: 2329970 - protein, 20 aa, Cryptosporidium parvum
LPSNTSDKNKTNNSDSVSNV

SEQ ID NO: 2329971 - protein, 4 aa, Cryptosporidium parvum
LPSQ

SEQ ID NO: 2329972 - protein, 21 aa, Cryptosporidium parvum
LPTVDQPSLGIEEGNEIGGPT

SEQ ID NO: 2329973 - protein, 7 aa, Cryptosporidium parvum
LPVGTTS

SEQ ID NO: 2329974 - protein, 11 aa, Cryptosporidium parvum
LPVSRTDTLSE

SEQ ID NO: 2329975 - protein, 4 aa, Cryptosporidium parvum
LPYT

SEQ ID NO: 2329976 - protein, 6 aa, Cryptosporidium parvum
LQEANQ

SEQ ID NO: 2329977 - protein, 4 aa, Cryptosporidium parvum
LQEE

SEQ ID NO: 2329978 - protein, 12 aa, Cryptosporidium parvum
LQEEKIKRRREI

SEQ ID NO: 2329979 - protein, 13 aa, Cryptosporidium parvum
LQGNAHASNGGAV

SEQ ID NO: 2329980 - protein, 6 aa, Cryptosporidium parvum
LQGTPI

SEQ ID NO: 2329981 - protein, 10 aa, Cryptosporidium parvum
LQKGNTWSAK

SEQ ID NO: 2329982 - protein, 6 aa, Cryptosporidium parvum
LQKKDV

SEQ ID NO: 2329983 - protein, 4 aa, Cryptosporidium parvum
LQKS

SEQ ID NO: 2329984 - protein, 7 aa, Cryptosporidium parvum
LQNEPNC

SEQ ID NO: 2329985 - protein, 4 aa, Cryptosporidium parvum
LQNP

SEQ ID NO: 2329986 - protein, 8 aa, Cryptosporidium parvum
LQNQENSL

SEQ ID NO: 2329987 - protein, 8 aa, Cryptosporidium parvum
LQSNKSNR

SEQ ID NO: 2329988 - protein, 43 aa, Cryptosporidium parvum
LQTPPQSPPPPPPPPPPPPPPPTYPAPTLPSTFPRPQPLQRPL

SEQ ID NO: 2329989 - protein, 16 aa, Cryptosporidium parvum
LQTSSTTSFSQPCRGH

SEQ ID NO: 2329990 - protein, 4 aa, Cryptosporidium parvum
LRAN

SEQ ID NO: 2329991 - protein, 9 aa, Cryptosporidium parvum
LRASQRAAE

SEQ ID NO: 2329992 - protein, 11 aa, Cryptosporidium parvum
LRDETNRLKNE

SEQ ID NO: 2329993 - protein, 7 aa, Cryptosporidium parvum
LREDSEE

SEQ ID NO: 2329994 - protein, 19 aa, Cryptosporidium parvum
LREEIRNTATGNGDAVPSI

SEQ ID NO: 2329995 - protein, 20 aa, Cryptosporidium parvum
LRHGKSAQSICNDEDSERVK

SEQ ID NO: 2329996 - protein, 10 aa, Cryptosporidium parvum
LRKQRKEGKL

SEQ ID NO: 2329997 - protein, 6 aa, Cryptosporidium parvum
LRNPYS

SEQ ID NO: 2329998 - protein, 5 aa, Cryptosporidium parvum
LRNSK

SEQ ID NO: 2329999 - protein, 6 aa, Cryptosporidium parvum
LRNTPK

SEQ ID NO: 2330000 - protein, 7 aa, Cryptosporidium parvum
LRPGRMQ

SEQ ID NO: 2330001 - protein, 29 aa, Cryptosporidium parvum
LRPRTYESYDRYGSSSDKPLRKVVWWMAD

SEQ ID NO: 2330002 - protein, 23 aa, Cryptosporidium parvum
LRQEEVKKRKKARPKKTKTFPEA

SEQ ID NO: 2330003 - protein, 6 aa, Cryptosporidium parvum
LRSESN

SEQ ID NO: 2330004 - protein, 33 aa, Cryptosporidium parvum
LRSGSKKSTSKDLKSDNNNQIGKPNGATHTNTY

SEQ ID NO: 2330005 - protein, 8 aa, Cryptosporidium parvum
LRSKSPCN

SEQ ID NO: 2330006 - protein, 7 aa, Cryptosporidium parvum
LRSRGSS

SEQ ID NO: 2330007 - protein, 8 aa, Cryptosporidium parvum
LRSRSKRT

SEQ ID NO: 2330008 - protein, 11 aa, Cryptosporidium parvum
LRSSTPCKSEK

SEQ ID NO: 2330009 - protein, 18 aa, Cryptosporidium parvum
LRTSTTTVSSPISTGPSR

SEQ ID NO: 2330010 - protein, 22 aa, Cryptosporidium parvum
LSAPISSQNPAIKPSKKEAATI

SEQ ID NO: 2330011 - protein, 5 aa, Cryptosporidium parvum
LSDEG

SEQ ID NO: 2330012 - protein, 24 aa, Cryptosporidium parvum
LSDHGASFKTRNQKLTENSSDGHG

SEQ ID NO: 2330013 - protein, 5 aa, Cryptosporidium parvum
LSDLR

SEQ ID NO: 2330014 - protein, 5 aa, Cryptosporidium parvum
LSDPT

SEQ ID NO: 2330015 - protein, 10 aa, Cryptosporidium parvum
LSDSEEGYKN

SEQ ID NO: 2330016 - protein, 7 aa, Cryptosporidium parvum
LSDSHRD

SEQ ID NO: 2330017 - protein, 6 aa, Cryptosporidium parvum
LSDTGA

SEQ ID NO: 2330018 - protein, 9 aa, Cryptosporidium parvum
LSEDATEEA

SEQ ID NO: 2330019 - protein, 8 aa, Cryptosporidium parvum
LSEEEDRE

SEQ ID NO: 2330020 - protein, 6 aa, Cryptosporidium parvum
LSEEQA

SEQ ID NO: 2330021 - protein, 4 aa, Cryptosporidium parvum
LSEG

SEQ ID NO: 2330022 - protein, 10 aa, Cryptosporidium parvum
LSEPLPFSSD

SEQ ID NO: 2330023 - protein, 11 aa, Cryptosporidium parvum
LSERQKKSEGL

SEQ ID NO: 2330024 - protein, 7 aa, Cryptosporidium parvum
LSESADE

SEQ ID NO: 2330025 - protein, 9 aa, Cryptosporidium parvum
LSESGNVDK

SEQ ID NO: 2330026 - protein, 9 aa, Cryptosporidium parvum
LSGEASNYY

SEQ ID NO: 2330027 - protein, 7 aa, Cryptosporidium parvum
LSGIPTR

SEQ ID NO: 2330028 - protein, 18 aa, Cryptosporidium parvum
LSGQKKSKNISSARTKLR

SEQ ID NO: 2330029 - protein, 10 aa, Cryptosporidium parvum
LSGQSNKYES

SEQ ID NO: 2330030 - protein, 7 aa, Cryptosporidium parvum
LSGSPRT

SEQ ID NO: 2330031 - protein, 5 aa, Cryptosporidium parvum
LSGVS

SEQ ID NO: 2330032 - protein, 7 aa, Cryptosporidium parvum
LSKDARD

SEQ ID NO: 2330033 - protein, 7 aa, Cryptosporidium parvum
LSKDELS

SEQ ID NO: 2330034 - protein, 6 aa, Cryptosporidium parvum
LSKDTL

SEQ ID NO: 2330035 - protein, 5 aa, Cryptosporidium parvum
LSKQI

SEQ ID NO: 2330036 - protein, 25 aa, Cryptosporidium parvum
LSKSKSSSKSKSPQKKIPSKDKKRP

SEQ ID NO: 2330037 - protein, 13 aa, Cryptosporidium parvum
LSKTPLPSSTSKI

SEQ ID NO: 2330038 - protein, 38 aa, Cryptosporidium parvum
LSNADTDEYSASDIDEKESDLEEEEFKTTEKKEAKRQW

SEQ ID NO: 2330039 - protein, 9 aa, Cryptosporidium parvum
LSNDGPSNW

SEQ ID NO: 2330040 - protein, 12 aa, Cryptosporidium parvum
LSNEDGKSCSSS

SEQ ID NO: 2330041 - protein, 10 aa, Cryptosporidium parvum
LSNEVKEDSA

SEQ ID NO: 2330042 - protein, 199 aa, Cryptosporidium parvum
LSNFEERGRSLTRTRSRARNRSRTTAKGSSNRDKGASKNKTSRNTSRSASRNRSRGRNVTRGRSKSRNVSRSTSRNRDRSTSRNRDRSTSRNVSRSRSASRNRGRSKNVSRNRTGSRAGSRAGSRTRSRTRSRTRSRTRSRTRSRTGSRARSRNGGRARSRGRSRSYSKNSNSTSGGENPSTSAYSHEENQQEEQVQSE

SEQ ID NO: 2330043 - protein, 17 aa, Cryptosporidium parvum
LSNGNQNNDLQNSNESL

SEQ ID NO: 2330044 - protein, 5 aa, Cryptosporidium parvum
LSNNS

SEQ ID NO: 2330045 - protein, 12 aa, Cryptosporidium parvum
LSNPNRRIGDPS

SEQ ID NO: 2330046 - protein, 8 aa, Cryptosporidium parvum
LSNSEKEN

SEQ ID NO: 2330047 - protein, 9 aa, Cryptosporidium parvum
LSNSNSDIS

SEQ ID NO: 2330048 - protein, 12 aa, Cryptosporidium parvum
LSPETKNKIGEE

SEQ ID NO: 2330049 - protein, 7 aa, Cryptosporidium parvum
LSPGDDL

SEQ ID NO: 2330050 - protein, 7 aa, Cryptosporidium parvum
LSPGTKE

SEQ ID NO: 2330051 - protein, 4 aa, Cryptosporidium parvum
LSPP

SEQ ID NO: 2330052 - protein, 13 aa, Cryptosporidium parvum
LSPQSSYYYPGSS

SEQ ID NO: 2330053 - protein, 12 aa, Cryptosporidium parvum
LSQGPSTQQSLE

SEQ ID NO: 2330054 - protein, 15 aa, Cryptosporidium parvum
LSQNETALKEAENMG

SEQ ID NO: 2330055 - protein, 21 aa, Cryptosporidium parvum
LSRLSKESNVLNTNKGEKSHG

SEQ ID NO: 2330056 - protein, 6 aa, Cryptosporidium parvum
LSRNYA

SEQ ID NO: 2330057 - protein, 6 aa, Cryptosporidium parvum
LSRRTK

SEQ ID NO: 2330058 - protein, 8 aa, Cryptosporidium parvum
LSRSQKKR

SEQ ID NO: 2330059 - protein, 5 aa, Cryptosporidium parvum
LSSGD

SEQ ID NO: 2330060 - protein, 5 aa, Cryptosporidium parvum
LSSKS

SEQ ID NO: 2330061 - protein, 14 aa, Cryptosporidium parvum
LSSNPDADAQEIKD

SEQ ID NO: 2330062 - protein, 9 aa, Cryptosporidium parvum
LSSNSEKML

SEQ ID NO: 2330063 - protein, 9 aa, Cryptosporidium parvum
LSSNSSKIL

SEQ ID NO: 2330064 - protein, 89 aa, Cryptosporidium parvum
LSSPNTSETGRDSSRDNSRDNSRNNSRDNSRYNSRDNSRDNSRDNSRNNSRDNSRSSSNSSYRSRNNNLGESRATSNDKNNRRKSSLNA

SEQ ID NO: 2330065 - protein, 12 aa, Cryptosporidium parvum
LSSPRPRRRNPW

SEQ ID NO: 2330066 - protein, 6 aa, Cryptosporidium parvum
LSSQGF

SEQ ID NO: 2330067 - protein, 12 aa, Cryptosporidium parvum
LSSSGRHNSPSS

SEQ ID NO: 2330068 - protein, 9 aa, Cryptosporidium parvum
LSSSSAHSR

SEQ ID NO: 2330069 - protein, 6 aa, Cryptosporidium parvum
LSTKGY

SEQ ID NO: 2330070 - protein, 7 aa, Cryptosporidium parvum
LSTPQRL

SEQ ID NO: 2330071 - protein, 6 aa, Cryptosporidium parvum
LSTSMP

SEQ ID NO: 2330072 - protein, 11 aa, Cryptosporidium parvum
LSTSPATTLES

SEQ ID NO: 2330073 - protein, 7 aa, Cryptosporidium parvum
LTATQQE

SEQ ID NO: 2330074 - protein, 9 aa, Cryptosporidium parvum
LTDGSSKIP

SEQ ID NO: 2330075 - protein, 10 aa, Cryptosporidium parvum
LTEGSQVESL

SEQ ID NO: 2330076 - protein, 7 aa, Cryptosporidium parvum
LTEKESK

SEQ ID NO: 2330077 - protein, 9 aa, Cryptosporidium parvum
LTESAKQAR

SEQ ID NO: 2330078 - protein, 12 aa, Cryptosporidium parvum
LTGKNGGIIEDG

SEQ ID NO: 2330079 - protein, 26 aa, Cryptosporidium parvum
LTKEKEKAIKEEKYKEKKGKIPKGEV

SEQ ID NO: 2330080 - protein, 9 aa, Cryptosporidium parvum
LTNGASREE

SEQ ID NO: 2330081 - protein, 16 aa, Cryptosporidium parvum
LTNGSLSNITEKITSR

SEQ ID NO: 2330082 - protein, 5 aa, Cryptosporidium parvum
LTNPK

SEQ ID NO: 2330083 - protein, 4 aa, Cryptosporidium parvum
LTNS

SEQ ID NO: 2330084 - protein, 4 aa, Cryptosporidium parvum
LTPK

SEQ ID NO: 2330085 - protein, 4 aa, Cryptosporidium parvum
LTPT

SEQ ID NO: 2330086 - protein, 7 aa, Cryptosporidium parvum
LTRSTSD

SEQ ID NO: 2330087 - protein, 5 aa, Cryptosporidium parvum
LTSGK

SEQ ID NO: 2330088 - protein, 4 aa, Cryptosporidium parvum
LTSN

SEQ ID NO: 2330089 - protein, 5 aa, Cryptosporidium parvum
LTSPQ

SEQ ID NO: 2330090 - protein, 16 aa, Cryptosporidium parvum
LTSPRGSGAPCPKTRE

SEQ ID NO: 2330091 - protein, 4 aa, Cryptosporidium parvum
LTSS

SEQ ID NO: 2330092 - protein, 10 aa, Cryptosporidium parvum
LTSSPPSLPR

SEQ ID NO: 2330093 - protein, 11 aa, Cryptosporidium parvum
LTTPKSNFEEE

SEQ ID NO: 2330094 - protein, 6 aa, Cryptosporidium parvum
LVSKAK

SEQ ID NO: 2330095 - protein, 40 aa, Cryptosporidium parvum
LVSSSNEQEETEANEDTGADKINYSTGTSTGTSTSTSTVT

SEQ ID NO: 2330096 - protein, 4 aa, Cryptosporidium parvum
LWSR

SEQ ID NO: 2330097 - protein, 12 aa, Cryptosporidium parvum
LYGRPGVDDDMN

SEQ ID NO: 2330098 - protein, 9 aa, Cryptosporidium parvum
LYGSSQPLD

SEQ ID NO: 2330099 - protein, 6 aa, Cryptosporidium parvum
LYQDET

SEQ ID NO: 2330100 - protein, 11 aa, Cryptosporidium parvum
LYSPGEGSLVD

SEQ ID NO: 2330101 - protein, 5 aa, Cryptosporidium parvum
LYSQL

SEQ ID NO: 2330102 - protein, 12 aa, Cryptosporidium parvum
MAGNSFPAGLGP

SEQ ID NO: 2330103 - protein, 5 aa, Cryptosporidium parvum
MANNR

SEQ ID NO: 2330104 - protein, 9 aa, Cryptosporidium parvum
MAPKAKMSN

SEQ ID NO: 2330105 - protein, 5 aa, Cryptosporidium parvum
MASDS

SEQ ID NO: 2330106 - protein, 10 aa, Cryptosporidium parvum
MCSGSKTVAP

SEQ ID NO: 2330107 - protein, 8 aa, Cryptosporidium parvum
MDEAQGKT

SEQ ID NO: 2330108 - protein, 10 aa, Cryptosporidium parvum
MDNQRRSTLD

SEQ ID NO: 2330109 - protein, 9 aa, Cryptosporidium parvum
MDSEEGKNK

SEQ ID NO: 2330110 - protein, 5 aa, Cryptosporidium parvum
MDSSS

SEQ ID NO: 2330111 - protein, 9 aa, Cryptosporidium parvum
MESDQGPKL

SEQ ID NO: 2330112 - protein, 10 aa, Cryptosporidium parvum
METESTDIEC

SEQ ID NO: 2330113 - protein, 4 aa, Cryptosporidium parvum
MGDP

SEQ ID NO: 2330114 - protein, 7 aa, Cryptosporidium parvum
MGNSGQP

SEQ ID NO: 2330115 - protein, 36 aa, Cryptosporidium parvum
MGPMGGPIGGPIGSSMGPMGPMGGPLGSMGGQMGPM

SEQ ID NO: 2330116 - protein, 16 aa, Cryptosporidium parvum
MGPSGIRGYAGAGGKV

SEQ ID NO: 2330117 - protein, 4 aa, Cryptosporidium parvum
MGQR

SEQ ID NO: 2330118 - protein, 5 aa, Cryptosporidium parvum
MGTDI

SEQ ID NO: 2330119 - protein, 7 aa, Cryptosporidium parvum
MGTGDDH

SEQ ID NO: 2330120 - protein, 12 aa, Cryptosporidium parvum
MGTPWPEKGPYE

SEQ ID NO: 2330121 - protein, 6 aa, Cryptosporidium parvum
MHDPSN

SEQ ID NO: 2330122 - protein, 14 aa, Cryptosporidium parvum
MHPSPPPPPPSSIH

SEQ ID NO: 2330123 - protein, 13 aa, Cryptosporidium parvum
MHSEATEQQKKEI

SEQ ID NO: 2330124 - protein, 6 aa, Cryptosporidium parvum
MHSKYD

SEQ ID NO: 2330125 - protein, 6 aa, Cryptosporidium parvum
MKAARP

SEQ ID NO: 2330126 - protein, 20 aa, Cryptosporidium parvum
MKASKNTTDNAENSYQPPNA

SEQ ID NO: 2330127 - protein, 10 aa, Cryptosporidium parvum
MKDKDGKEMS

SEQ ID NO: 2330128 - protein, 96 aa, Cryptosporidium parvum
MKDPDDPRPNPSDMPSDEPSHNPDDEEPCDDDDPSHNTDDEEPCDDDDPNHNTDDEDEEEEKYQREKEKEKNENKHDQVDSGQKRRKKKEKKKVET

SEQ ID NO: 2330129 - protein, 93 aa, Cryptosporidium parvum
MKDTSEDQDSKHTSSSNLISTSESKSGHKSKSRSRSKSRTRSKSRTRTRSKSRTRSRSRTRSRSRSRSSSRTRSRSRSRSSSRSSSGHGSESW

SEQ ID NO: 2330130 - protein, 7 aa, Cryptosporidium parvum
MKIPKSS

SEQ ID NO: 2330131 - protein, 15 aa, Cryptosporidium parvum
MKKKGKRRKKIKLSR

SEQ ID NO: 2330132 - protein, 18 aa, Cryptosporidium parvum
MKKTEQNYLESKKAAERS

SEQ ID NO: 2330133 - protein, 7 aa, Cryptosporidium parvum
MKNDSKP

SEQ ID NO: 2330134 - protein, 11 aa, Cryptosporidium parvum
MKNNSNPEVQQ

SEQ ID NO: 2330135 - protein, 5 aa, Cryptosporidium parvum
MKPAS

SEQ ID NO: 2330136 - protein, 10 aa, Cryptosporidium parvum
MKQDQSELSD

SEQ ID NO: 2330137 - protein, 12 aa, Cryptosporidium parvum
MKQNKKAPNMPQ

SEQ ID NO: 2330138 - protein, 11 aa, Cryptosporidium parvum
MKSPPKSPDDF

SEQ ID NO: 2330139 - protein, 13 aa, Cryptosporidium parvum
MNDATNNKLKQRD

SEQ ID NO: 2330140 - protein, 13 aa, Cryptosporidium parvum
MNESKDQERGEFP

SEQ ID NO: 2330141 - protein, 12 aa, Cryptosporidium parvum
MNKLDSSTRMIL

SEQ ID NO: 2330142 - protein, 11 aa, Cryptosporidium parvum
MNNMKKQENYA

SEQ ID NO: 2330143 - protein, 8 aa, Cryptosporidium parvum
MNSPPKSD

SEQ ID NO: 2330144 - protein, 10 aa, Cryptosporidium parvum
MNTGNQRNDQ

SEQ ID NO: 2330145 - protein, 8 aa, Cryptosporidium parvum
MPEDTTFN

SEQ ID NO: 2330146 - protein, 18 aa, Cryptosporidium parvum
MPKYPSQDVATEEEPEDL

SEQ ID NO: 2330147 - protein, 9 aa, Cryptosporidium parvum
MPNTTSTGI

SEQ ID NO: 2330148 - protein, 9 aa, Cryptosporidium parvum
MPPMKRPQA

SEQ ID NO: 2330149 - protein, 5 aa, Cryptosporidium parvum
MPPQM

SEQ ID NO: 2330150 - protein, 7 aa, Cryptosporidium parvum
MPPQPQD

SEQ ID NO: 2330151 - protein, 6 aa, Cryptosporidium parvum
MPTDSS

SEQ ID NO: 2330152 - protein, 8 aa, Cryptosporidium parvum
MQCPPGYS

SEQ ID NO: 2330153 - protein, 4 aa, Cryptosporidium parvum
MQND

SEQ ID NO: 2330154 - protein, 9 aa, Cryptosporidium parvum
MREANKKIK

SEQ ID NO: 2330155 - protein, 24 aa, Cryptosporidium parvum
MRPPPRPPRPSRPPPPVPQRPIGP

SEQ ID NO: 2330156 - protein, 6 aa, Cryptosporidium parvum
MRPPTY

SEQ ID NO: 2330157 - protein, 19 aa, Cryptosporidium parvum
MRSTSNKISVKSPCNGTMH

SEQ ID NO: 2330158 - protein, 5 aa, Cryptosporidium parvum
MSGPE

SEQ ID NO: 2330159 - protein, 6 aa, Cryptosporidium parvum
MSGSNR

SEQ ID NO: 2330160 - protein, 7 aa, Cryptosporidium parvum
MSQKENL

SEQ ID NO: 2330161 - protein, 5 aa, Cryptosporidium parvum
MSSKL

SEQ ID NO: 2330162 - protein, 6 aa, Cryptosporidium parvum
MSSSKK

SEQ ID NO: 2330163 - protein, 74 aa, Cryptosporidium parvum
MSTPTSEFKSEDNLENKADSKGSLVSENKGEKNDIEDPQDTQNRNDTSKTTIDTEKLTKSTPRSINTLSSGKDR

SEQ ID NO: 2330164 - protein, 24 aa, Cryptosporidium parvum
MTENTASSHLKGSNQYNNKSTRKN

SEQ ID NO: 2330165 - protein, 26 aa, Cryptosporidium parvum
MTESESEEENENLSNLPKSNKSRSKG

SEQ ID NO: 2330166 - protein, 6 aa, Cryptosporidium parvum
MTESGY

SEQ ID NO: 2330167 - protein, 9 aa, Cryptosporidium parvum
MTGRKVNKQ

SEQ ID NO: 2330168 - protein, 7 aa, Cryptosporidium parvum
NAARAKL

SEQ ID NO: 2330169 - protein, 47 aa, Cryptosporidium parvum
NADFSTNEVESDVDDSSAREPSPVVTPNRKLAEATSDIEEDDDEMPN

SEQ ID NO: 2330170 - protein, 7 aa, Cryptosporidium parvum
NAFEEKI

SEQ ID NO: 2330171 - protein, 7 aa, Cryptosporidium parvum
NAGEITQ

SEQ ID NO: 2330172 - protein, 15 aa, Cryptosporidium parvum
NAGFTGEELAPVTSV

SEQ ID NO: 2330173 - protein, 7 aa, Cryptosporidium parvum
NAHANIS

SEQ ID NO: 2330174 - protein, 7 aa, Cryptosporidium parvum
NAKKEDV

SEQ ID NO: 2330175 - protein, 11 aa, Cryptosporidium parvum
NAKKKKDSNDL

SEQ ID NO: 2330176 - protein, 8 aa, Cryptosporidium parvum
NALGSKTI

SEQ ID NO: 2330177 - protein, 6 aa, Cryptosporidium parvum
NANPVQ

SEQ ID NO: 2330178 - protein, 4 aa, Cryptosporidium parvum
NANS

SEQ ID NO: 2330179 - protein, 42 aa, Cryptosporidium parvum
NANSMTSAKQRKKRKKRKKIKKKNKNKKERGISPTEEYEISS

SEQ ID NO: 2330180 - protein, 23 aa, Cryptosporidium parvum
NAPWPNRNKSCNCDSSSNSDSAD

SEQ ID NO: 2330181 - protein, 5 aa, Cryptosporidium parvum
NAQHG

SEQ ID NO: 2330182 - protein, 5 aa, Cryptosporidium parvum
NAQLG

SEQ ID NO: 2330183 - protein, 16 aa, Cryptosporidium parvum
NAQTGRLRSKNPSESS

SEQ ID NO: 2330184 - protein, 9 aa, Cryptosporidium parvum
NARFSSKAN

SEQ ID NO: 2330185 - protein, 9 aa, Cryptosporidium parvum
NASEVGPCS

SEQ ID NO: 2330186 - protein, 17 aa, Cryptosporidium parvum
NASFPASRTQYPADPNH

SEQ ID NO: 2330187 - protein, 11 aa, Cryptosporidium parvum
NASKNKGKRIE

SEQ ID NO: 2330188 - protein, 5 aa, Cryptosporidium parvum
NASKR

SEQ ID NO: 2330189 - protein, 4 aa, Cryptosporidium parvum
NASS

SEQ ID NO: 2330190 - protein, 8 aa, Cryptosporidium parvum
NASTTANQ

SEQ ID NO: 2330191 - protein, 4 aa, Cryptosporidium parvum
NATD

SEQ ID NO: 2330192 - protein, 4 aa, Cryptosporidium parvum
NATP

SEQ ID NO: 2330193 - protein, 10 aa, Cryptosporidium parvum
NCGTEKPVKN

SEQ ID NO: 2330194 - protein, 6 aa, Cryptosporidium parvum
NCPSQT

SEQ ID NO: 2330195 - protein, 8 aa, Cryptosporidium parvum
NCPTNPSA

SEQ ID NO: 2330196 - protein, 10 aa, Cryptosporidium parvum
NCVDEKRNTA

SEQ ID NO: 2330197 - protein, 12 aa, Cryptosporidium parvum
NDAIRNEKIKSN

SEQ ID NO: 2330198 - protein, 5 aa, Cryptosporidium parvum
NDAKL

SEQ ID NO: 2330199 - protein, 26 aa, Cryptosporidium parvum
NDAPIEKTSDSSILESSKSASSRNVP

SEQ ID NO: 2330200 - protein, 9 aa, Cryptosporidium parvum
NDATNSTLG

SEQ ID NO: 2330201 - protein, 4 aa, Cryptosporidium parvum
NDCR

SEQ ID NO: 2330202 - protein, 8 aa, Cryptosporidium parvum
NDDGSIGK

SEQ ID NO: 2330203 - protein, 9 aa, Cryptosporidium parvum
NDDSKQLEY

SEQ ID NO: 2330204 - protein, 5 aa, Cryptosporidium parvum
NDEDT

SEQ ID NO: 2330205 - protein, 5 aa, Cryptosporidium parvum
NDEEG

SEQ ID NO: 2330206 - protein, 6 aa, Cryptosporidium parvum
NDEIEK

SEQ ID NO: 2330207 - protein, 9 aa, Cryptosporidium parvum
NDENSNCKN

SEQ ID NO: 2330208 - protein, 15 aa, Cryptosporidium parvum
NDEPSKLDDQSQSYS

SEQ ID NO: 2330209 - protein, 14 aa, Cryptosporidium parvum
NDGQYNSAVENDKN

SEQ ID NO: 2330210 - protein, 21 aa, Cryptosporidium parvum
NDHKQAEDNNQESQKPSSEKV

SEQ ID NO: 2330211 - protein, 9 aa, Cryptosporidium parvum
NDKIKPESC

SEQ ID NO: 2330212 - protein, 9 aa, Cryptosporidium parvum
NDKKKQITK

SEQ ID NO: 2330213 - protein, 15 aa, Cryptosporidium parvum
NDKPDSEDTSTFDYK

SEQ ID NO: 2330214 - protein, 6 aa, Cryptosporidium parvum
NDKQKV

SEQ ID NO: 2330215 - protein, 8 aa, Cryptosporidium parvum
NDKRTITI

SEQ ID NO: 2330216 - protein, 8 aa, Cryptosporidium parvum
NDKSNKTL

SEQ ID NO: 2330217 - protein, 8 aa, Cryptosporidium parvum
NDKTQEAI

SEQ ID NO: 2330218 - protein, 8 aa, Cryptosporidium parvum
NDLKKNSF

SEQ ID NO: 2330219 - protein, 4 aa, Cryptosporidium parvum
NDND

SEQ ID NO: 2330220 - protein, 4 aa, Cryptosporidium parvum
NDNE

SEQ ID NO: 2330221 - protein, 7 aa, Cryptosporidium parvum
NDNGEND

SEQ ID NO: 2330222 - protein, 8 aa, Cryptosporidium parvum
NDNGPNRM

SEQ ID NO: 2330223 - protein, 4 aa, Cryptosporidium parvum
NDNI

SEQ ID NO: 2330224 - protein, 16 aa, Cryptosporidium parvum
NDNSTQISESSSISKA

SEQ ID NO: 2330225 - protein, 6 aa, Cryptosporidium parvum
NDPAIN

SEQ ID NO: 2330226 - protein, 6 aa, Cryptosporidium parvum
NDPLTN

SEQ ID NO: 2330227 - protein, 12 aa, Cryptosporidium parvum
NDPRKKMDAQKR

SEQ ID NO: 2330228 - protein, 13 aa, Cryptosporidium parvum
NDPVDGSVTKNQG

SEQ ID NO: 2330229 - protein, 6 aa, Cryptosporidium parvum
NDQSYD

SEQ ID NO: 2330230 - protein, 4 aa, Cryptosporidium parvum
NDQV

SEQ ID NO: 2330231 - protein, 11 aa, Cryptosporidium parvum
NDRESTNINTI

SEQ ID NO: 2330232 - protein, 6 aa, Cryptosporidium parvum
NDSCDK

SEQ ID NO: 2330233 - protein, 9 aa, Cryptosporidium parvum
NDSDHRKEQ

SEQ ID NO: 2330234 - protein, 5 aa, Cryptosporidium parvum
NDSKK

SEQ ID NO: 2330235 - protein, 9 aa, Cryptosporidium parvum
NDSNNNKTE

SEQ ID NO: 2330236 - protein, 14 aa, Cryptosporidium parvum
NDSPRMRNRRRRRG

SEQ ID NO: 2330237 - protein, 7 aa, Cryptosporidium parvum
NDSSNTI

SEQ ID NO: 2330238 - protein, 8 aa, Cryptosporidium parvum
NDSTVKSS

SEQ ID NO: 2330239 - protein, 13 aa, Cryptosporidium parvum
NDSYKRSASDFGS

SEQ ID NO: 2330240 - protein, 5 aa, Cryptosporidium parvum
NDTEM

SEQ ID NO: 2330241 - protein, 12 aa, Cryptosporidium parvum
NDVKKSISSAKE

SEQ ID NO: 2330242 - protein, 5 aa, Cryptosporidium parvum
NDVSI

SEQ ID NO: 2330243 - protein, 6 aa, Cryptosporidium parvum
NDYSDL

SEQ ID NO: 2330244 - protein, 12 aa, Cryptosporidium parvum
NEADASNPLTRN

SEQ ID NO: 2330245 - protein, 12 aa, Cryptosporidium parvum
NEAEKNMRNAAE

SEQ ID NO: 2330246 - protein, 6 aa, Cryptosporidium parvum
NEAQES

SEQ ID NO: 2330247 - protein, 5 aa, Cryptosporidium parvum
NEDGG

SEQ ID NO: 2330248 - protein, 4 aa, Cryptosporidium parvum
NEDK

SEQ ID NO: 2330249 - protein, 8 aa, Cryptosporidium parvum
NEDPKADM

SEQ ID NO: 2330250 - protein, 6 aa, Cryptosporidium parvum
NEDQLG

SEQ ID NO: 2330251 - protein, 11 aa, Cryptosporidium parvum
NEDSNTNINQD

SEQ ID NO: 2330252 - protein, 7 aa, Cryptosporidium parvum
NEDSSVG

SEQ ID NO: 2330253 - protein, 11 aa, Cryptosporidium parvum
NEDYTDGPIEE

SEQ ID NO: 2330254 - protein, 8 aa, Cryptosporidium parvum
NEEERDDG

SEQ ID NO: 2330255 - protein, 12 aa, Cryptosporidium parvum
NEEKLTSYKNDL

SEQ ID NO: 2330256 - protein, 7 aa, Cryptosporidium parvum
NEEQEEG

SEQ ID NO: 2330257 - protein, 6 aa, Cryptosporidium parvum
NEESIR

SEQ ID NO: 2330258 - protein, 6 aa, Cryptosporidium parvum
NEESVD

SEQ ID NO: 2330259 - protein, 8 aa, Cryptosporidium parvum
NEFGQEDP

SEQ ID NO: 2330260 - protein, 11 aa, Cryptosporidium parvum
NEFNPEDNDSL

SEQ ID NO: 2330261 - protein, 7 aa, Cryptosporidium parvum
NEIEKKE

SEQ ID NO: 2330262 - protein, 6 aa, Cryptosporidium parvum
NEIERN

SEQ ID NO: 2330263 - protein, 7 aa, Cryptosporidium parvum
NEINDSP

SEQ ID NO: 2330264 - protein, 12 aa, Cryptosporidium parvum
NEINKSNISNEA

SEQ ID NO: 2330265 - protein, 34 aa, Cryptosporidium parvum
NEIQKQNQTFDKENLESKNTQNLQKSKNPTSQLS

SEQ ID NO: 2330266 - protein, 4 aa, Cryptosporidium parvum
NEIS

SEQ ID NO: 2330267 - protein, 15 aa, Cryptosporidium parvum
NEITGEKAVSVSPQC

SEQ ID NO: 2330268 - protein, 18 aa, Cryptosporidium parvum
NEKDILSKSEKTITPVTN

SEQ ID NO: 2330269 - protein, 32 aa, Cryptosporidium parvum
NEKFSEKSDEENEFDTDEFDTDDNNPNDDVEI

SEQ ID NO: 2330270 - protein, 10 aa, Cryptosporidium parvum
NEKIKSVTDY

SEQ ID NO: 2330271 - protein, 4 aa, Cryptosporidium parvum
NEKL

SEQ ID NO: 2330272 - protein, 9 aa, Cryptosporidium parvum
NEKMEQSNH

SEQ ID NO: 2330273 - protein, 7 aa, Cryptosporidium parvum
NEKQEDA

SEQ ID NO: 2330274 - protein, 4 aa, Cryptosporidium parvum
NEKS

SEQ ID NO: 2330275 - protein, 7 aa, Cryptosporidium parvum
NEKSGNY

SEQ ID NO: 2330276 - protein, 17 aa, Cryptosporidium parvum
NEKTGDSSIAGSPQCGP

SEQ ID NO: 2330277 - protein, 16 aa, Cryptosporidium parvum
NEKTNEEEVVGSPQCG

SEQ ID NO: 2330278 - protein, 6 aa, Cryptosporidium parvum
NELETG

SEQ ID NO: 2330279 - protein, 8 aa, Cryptosporidium parvum
NEMKNENN

SEQ ID NO: 2330280 - protein, 8 aa, Cryptosporidium parvum
NENDEHTQ

SEQ ID NO: 2330281 - protein, 22 aa, Cryptosporidium parvum
NENDKNSNNKQILNDNNNSTDI

SEQ ID NO: 2330282 - protein, 23 aa, Cryptosporidium parvum
NENFETSSLPASRVKAPSNPNHS

SEQ ID NO: 2330283 - protein, 5 aa, Cryptosporidium parvum
NENGE

SEQ ID NO: 2330284 - protein, 8 aa, Cryptosporidium parvum
NENHNRAS

SEQ ID NO: 2330285 - protein, 16 aa, Cryptosporidium parvum
NENKKPDNEISSASDE

SEQ ID NO: 2330286 - protein, 4 aa, Cryptosporidium parvum
NENP

SEQ ID NO: 2330287 - protein, 4 aa, Cryptosporidium parvum
NENS

SEQ ID NO: 2330288 - protein, 5 aa, Cryptosporidium parvum
NENSD

SEQ ID NO: 2330289 - protein, 9 aa, Cryptosporidium parvum
NENSKNNPV

SEQ ID NO: 2330290 - protein, 21 aa, Cryptosporidium parvum
NENYTNKEKDNKIPKSNHPRN

SEQ ID NO: 2330291 - protein, 4 aa, Cryptosporidium parvum
NEPD

SEQ ID NO: 2330292 - protein, 7 aa, Cryptosporidium parvum
NEPESKR

SEQ ID NO: 2330293 - protein, 10 aa, Cryptosporidium parvum
NEPNSTDNEH

SEQ ID NO: 2330294 - protein, 8 aa, Cryptosporidium parvum
NEQETTNR

SEQ ID NO: 2330295 - protein, 6 aa, Cryptosporidium parvum
NERDSA

SEQ ID NO: 2330296 - protein, 14 aa, Cryptosporidium parvum
NEREDRSKNNEPSL

SEQ ID NO: 2330297 - protein, 6 aa, Cryptosporidium parvum
NERNKK

SEQ ID NO: 2330298 - protein, 9 aa, Cryptosporidium parvum
NERPPSSGI

SEQ ID NO: 2330299 - protein, 9 aa, Cryptosporidium parvum
NERTSCATI

SEQ ID NO: 2330300 - protein, 9 aa, Cryptosporidium parvum
NESESNERK

SEQ ID NO: 2330301 - protein, 9 aa, Cryptosporidium parvum
NESETSVPK

SEQ ID NO: 2330302 - protein, 4 aa, Cryptosporidium parvum
NESI

SEQ ID NO: 2330303 - protein, 5 aa, Cryptosporidium parvum
NESKS

SEQ ID NO: 2330304 - protein, 19 aa, Cryptosporidium parvum
NETASFPASRTKLPANTEH

SEQ ID NO: 2330305 - protein, 6 aa, Cryptosporidium parvum
NETESF

SEQ ID NO: 2330306 - protein, 8 aa, Cryptosporidium parvum
NETNRSSA

SEQ ID NO: 2330307 - protein, 7 aa, Cryptosporidium parvum
NETNTFG

SEQ ID NO: 2330308 - protein, 8 aa, Cryptosporidium parvum
NETPGARA

SEQ ID NO: 2330309 - protein, 35 aa, Cryptosporidium parvum
NETPNEGSSSSGNKNSEGLSRGGGEGGGDRGKKKP

SEQ ID NO: 2330310 - protein, 33 aa, Cryptosporidium parvum
NETPNEGSSSSGNKNSEGSSRGGGGRGKKKPEL

SEQ ID NO: 2330311 - protein, 5 aa, Cryptosporidium parvum
NETVS

SEQ ID NO: 2330312 - protein, 7 aa, Cryptosporidium parvum
NEYDGDG

SEQ ID NO: 2330313 - protein, 9 aa, Cryptosporidium parvum
NEYEDENMK

SEQ ID NO: 2330314 - protein, 5 aa, Cryptosporidium parvum
NEYNN

SEQ ID NO: 2330315 - protein, 21 aa, Cryptosporidium parvum
NEYNQDTNESNQINPVIYLFK

SEQ ID NO: 2330316 - protein, 9 aa, Cryptosporidium parvum
NEYNTGEIR

SEQ ID NO: 2330317 - protein, 31 aa, Cryptosporidium parvum
NFANKTSNESNSTEIESYASSNSTSNSGLKK

SEQ ID NO: 2330318 - protein, 9 aa, Cryptosporidium parvum
NFDNTNNEI

SEQ ID NO: 2330319 - protein, 13 aa, Cryptosporidium parvum
NFEINGKKNYSKK

SEQ ID NO: 2330320 - protein, 35 aa, Cryptosporidium parvum
NFESSKKDATVEESRSSLDKSLKEPEPLTEEESEG

SEQ ID NO: 2330321 - protein, 8 aa, Cryptosporidium parvum
NFGPNDSF

SEQ ID NO: 2330322 - protein, 4 aa, Cryptosporidium parvum
NFGS

SEQ ID NO: 2330323 - protein, 12 aa, Cryptosporidium parvum
NFPEKANIPSDN

SEQ ID NO: 2330324 - protein, 26 aa, Cryptosporidium parvum
NFRSAQELEENTSNSEEENQNSPKNF

SEQ ID NO: 2330325 - protein, 28 aa, Cryptosporidium parvum
NFSSSNNSNLNIENSQAVGNFNSEKENE

SEQ ID NO: 2330326 - protein, 7 aa, Cryptosporidium parvum
NFTERKG

SEQ ID NO: 2330327 - protein, 7 aa, Cryptosporidium parvum
NFTTEKS

SEQ ID NO: 2330328 - protein, 14 aa, Cryptosporidium parvum
NGASRNKNNSINES

SEQ ID NO: 2330329 - protein, 8 aa, Cryptosporidium parvum
NGDDHPQS

SEQ ID NO: 2330330 - protein, 8 aa, Cryptosporidium parvum
NGDNIDKI

SEQ ID NO: 2330331 - protein, 6 aa, Cryptosporidium parvum
NGDPLD

SEQ ID NO: 2330332 - protein, 10 aa, Cryptosporidium parvum
NGEFDPSNAL

SEQ ID NO: 2330333 - protein, 13 aa, Cryptosporidium parvum
NGEIEKKMKESNM

SEQ ID NO: 2330334 - protein, 9 aa, Cryptosporidium parvum
NGEISTTKH

SEQ ID NO: 2330335 - protein, 8 aa, Cryptosporidium parvum
NGENKQIP

SEQ ID NO: 2330336 - protein, 6 aa, Cryptosporidium parvum
NGENSI

SEQ ID NO: 2330337 - protein, 6 aa, Cryptosporidium parvum
NGEQNK

SEQ ID NO: 2330338 - protein, 6 aa, Cryptosporidium parvum
NGFESS

SEQ ID NO: 2330339 - protein, 20 aa, Cryptosporidium parvum
NGFPKGGFQSSVSNSSLNGY

SEQ ID NO: 2330340 - protein, 52 aa, Cryptosporidium parvum
NGGDPDETEYEYTGNDSDGSETSEGEVSENENGKRNNKRHSKRRPKKPKLPK

SEQ ID NO: 2330341 - protein, 5 aa, Cryptosporidium parvum
NGGRT

SEQ ID NO: 2330342 - protein, 10 aa, Cryptosporidium parvum
NGGYEKSTSI

SEQ ID NO: 2330343 - protein, 17 aa, Cryptosporidium parvum
NGGYESTSDPTNNNGGF

SEQ ID NO: 2330344 - protein, 6 aa, Cryptosporidium parvum
NGIEKN

SEQ ID NO: 2330345 - protein, 13 aa, Cryptosporidium parvum
NGIQQQQNTGNEM

SEQ ID NO: 2330346 - protein, 5 aa, Cryptosporidium parvum
NGKNS

SEQ ID NO: 2330347 - protein, 13 aa, Cryptosporidium parvum
NGLENEDSVKQRQ

SEQ ID NO: 2330348 - protein, 5 aa, Cryptosporidium parvum
NGLPT

SEQ ID NO: 2330349 - protein, 8 aa, Cryptosporidium parvum
NGLSSNGP

SEQ ID NO: 2330350 - protein, 7 aa, Cryptosporidium parvum
NGNCEKV

SEQ ID NO: 2330351 - protein, 7 aa, Cryptosporidium parvum
NGNCQKD

SEQ ID NO: 2330352 - protein, 8 aa, Cryptosporidium parvum
NGNDLSTQ

SEQ ID NO: 2330353 - protein, 8 aa, Cryptosporidium parvum
NGNDQKSC

SEQ ID NO: 2330354 - protein, 9 aa, Cryptosporidium parvum
NGNEESENC

SEQ ID NO: 2330355 - protein, 10 aa, Cryptosporidium parvum
NGNEYHDGTK

SEQ ID NO: 2330356 - protein, 6 aa, Cryptosporidium parvum
NGNKSQ

SEQ ID NO: 2330357 - protein, 8 aa, Cryptosporidium parvum
NGNNNTGM

SEQ ID NO: 2330358 - protein, 9 aa, Cryptosporidium parvum
NGNPLKDNK

SEQ ID NO: 2330359 - protein, 12 aa, Cryptosporidium parvum
NGNSGILGPGST

SEQ ID NO: 2330360 - protein, 7 aa, Cryptosporidium parvum
NGPLNQN

SEQ ID NO: 2330361 - protein, 10 aa, Cryptosporidium parvum
NGPQNDIPYE

SEQ ID NO: 2330362 - protein, 9 aa, Cryptosporidium parvum
NGQGLSSTI

SEQ ID NO: 2330363 - protein, 9 aa, Cryptosporidium parvum
NGQYNTGST

SEQ ID NO: 2330364 - protein, 12 aa, Cryptosporidium parvum
NGRNGNTVSQAL

SEQ ID NO: 2330365 - protein, 5 aa, Cryptosporidium parvum
NGSLI

SEQ ID NO: 2330366 - protein, 10 aa, Cryptosporidium parvum
NGSNKINQQI

SEQ ID NO: 2330367 - protein, 8 aa, Cryptosporidium parvum
NGSNTLVK

SEQ ID NO: 2330368 - protein, 10 aa, Cryptosporidium parvum
NGSQSTDKRK

SEQ ID NO: 2330369 - protein, 10 aa, Cryptosporidium parvum
NGSSYNSSDA

SEQ ID NO: 2330370 - protein, 10 aa, Cryptosporidium parvum
NGSTSDGKHL

SEQ ID NO: 2330371 - protein, 4 aa, Cryptosporidium parvum
NGSV

SEQ ID NO: 2330372 - protein, 9 aa, Cryptosporidium parvum
NGTKRKRKS

SEQ ID NO: 2330373 - protein, 4 aa, Cryptosporidium parvum
NGTM

SEQ ID NO: 2330374 - protein, 9 aa, Cryptosporidium parvum
NGTQVNDGI

SEQ ID NO: 2330375 - protein, 5 aa, Cryptosporidium parvum
NGTSA

SEQ ID NO: 2330376 - protein, 10 aa, Cryptosporidium parvum
NGVSDPRDCL

SEQ ID NO: 2330377 - protein, 14 aa, Cryptosporidium parvum
NGWNNGGEKLKDEQ

SEQ ID NO: 2330378 - protein, 15 aa, Cryptosporidium parvum
NGYGQSKKKTSEESL

SEQ ID NO: 2330379 - protein, 6 aa, Cryptosporidium parvum
NGYTNK

SEQ ID NO: 2330380 - protein, 8 aa, Cryptosporidium parvum
NHKDDGSL

SEQ ID NO: 2330381 - protein, 9 aa, Cryptosporidium parvum
NHKSRTVKR

SEQ ID NO: 2330382 - protein, 19 aa, Cryptosporidium parvum
NHPKSRPELENKKDKKNKY

SEQ ID NO: 2330383 - protein, 12 aa, Cryptosporidium parvum
NHPQESGAEHSC

SEQ ID NO: 2330384 - protein, 19 aa, Cryptosporidium parvum
NHQKNQSNPHSKKAESIEN

SEQ ID NO: 2330385 - protein, 93 aa, Cryptosporidium parvum
NHREGPNPSSSVEDSHSGRRDSNSRKDSKSRRDSKSRKDSKSRKDSKSRTTSRSRSGSRSRSGSKSRSGSRSRSQSPKDSKEQTTSTTTQHPL

SEQ ID NO: 2330386 - protein, 18 aa, Cryptosporidium parvum
NHRKSKRNNQYSAPKQLS

SEQ ID NO: 2330387 - protein, 8 aa, Cryptosporidium parvum
NHSQNEQY

SEQ ID NO: 2330388 - protein, 5 aa, Cryptosporidium parvum
NHSST

SEQ ID NO: 2330389 - protein, 6 aa, Cryptosporidium parvum
NHTDED

SEQ ID NO: 2330390 - protein, 7 aa, Cryptosporidium parvum
NIDKQFD

SEQ ID NO: 2330391 - protein, 5 aa, Cryptosporidium parvum
NIDRN

SEQ ID NO: 2330392 - protein, 18 aa, Cryptosporidium parvum
NIEEKSNEIDHENSDEDL

SEQ ID NO: 2330393 - protein, 10 aa, Cryptosporidium parvum
NIEKEANIEA

SEQ ID NO: 2330394 - protein, 11 aa, Cryptosporidium parvum
NIEKPKEVKTE

SEQ ID NO: 2330395 - protein, 4 aa, Cryptosporidium parvum
NIES

SEQ ID NO: 2330396 - protein, 38 aa, Cryptosporidium parvum
NIFPEDSVGNTEWNKYSDGRNRIRSGNAKETNAKYPQY

SEQ ID NO: 2330397 - protein, 8 aa, Cryptosporidium parvum
NIGDNTNF

SEQ ID NO: 2330398 - protein, 10 aa, Cryptosporidium parvum
NIGDRNRSIP

SEQ ID NO: 2330399 - protein, 13 aa, Cryptosporidium parvum
NIGKEKNSHSTEA

SEQ ID NO: 2330400 - protein, 7 aa, Cryptosporidium parvum
NIPDQGF

SEQ ID NO: 2330401 - protein, 6 aa, Cryptosporidium parvum
NIPDVG

SEQ ID NO: 2330402 - protein, 31 aa, Cryptosporidium parvum; identical to SEQ ID NO: 2203766

SEQ ID NO: 2330403 - protein, 8 aa, Cryptosporidium parvum
NIPKPVET

SEQ ID NO: 2330404 - protein, 6 aa, Cryptosporidium parvum
NIQGTE

SEQ ID NO: 2330405 - protein, 12 aa, Cryptosporidium parvum
NISEKSQTVKLN

SEQ ID NO: 2330406 - protein, 5 aa, Cryptosporidium parvum
NISKN

SEQ ID NO: 2330407 - protein, 7 aa, Cryptosporidium parvum
NISKSSI

SEQ ID NO: 2330408 - protein, 11 aa, Cryptosporidium parvum
NISQRRGGKIS

SEQ ID NO: 2330409 - protein, 8 aa, Cryptosporidium parvum
NISSNTEK

SEQ ID NO: 2330410 - protein, 5 aa, Cryptosporidium parvum
NITTI

SEQ ID NO: 2330411 - protein, 6 aa, Cryptosporidium parvum
NKAKKF

SEQ ID NO: 2330412 - protein, 21 aa, Cryptosporidium parvum
NKAKMAPSVPRNSSNQEKDGD

SEQ ID NO: 2330413 - protein, 6 aa, Cryptosporidium parvum
NKAPQA

SEQ ID NO: 2330414 - protein, 56 aa, Cryptosporidium parvum
NKDGGKDGKPRGGTPSAPDLSDPPNSGARPKVRSGGSTSPQSSLRRGTGGDPPQSF

SEQ ID NO: 2330415 - protein, 7 aa, Cryptosporidium parvum
NKDLGVP

SEQ ID NO: 2330416 - protein, 9 aa, Cryptosporidium parvum
NKDSSSPLL

SEQ ID NO: 2330417 - protein, 542 aa, Cryptosporidium parvum
NKEDDDSFPEEEENPELGDESNDDLEEGQENIESHEGDNMENEDNGENTNAEELGDEGKKDDLDTRQDELDGDSGNGEDLGHNGEGEDENDDKDDTDGSDQDGNNEEDTPDGGDIGGTDQEDSDSGGEAKGTDYDGEEGKELDSDSGDGEGGGGEDNDEVDDEESNSGDGDHGGDDGGDNDEGEDGESNSGDGEESGSGENNGEREEEESTSGDGGFGGDVGGDGGGDGGGDDGGDGGGDNDGGDEESSSGDGGGGEDNDEGEDKESSSGDGDHGGDDGGDNDEREDGESNTGDREGGEEGDSDSGGYGGDKDEEGGDLDSDSGDGGNDGGDKDGEGGDLDSDLEDGGDDIGGGGGGEGEEGDLDSGGDGGDYMGDSNKDSDLGDRAEVGGGGDEGEDGGLDSGGGGLDNFEGNTGDSYSESNDAFGIGGGDYRRDSDEDSDLGSAEEVGSSKTKGKGEGDDFDRDLDSNSMEAGGISGNFGGGNTNQNDLEYSTGNSGSGGLGNNEFEGDPLSGSGDKGGFDDSYSSSVGNNDKGGGFGKE

SEQ ID NO: 2330418 - protein, 14 aa, Cryptosporidium parvum
NKENFTESYLDFMD

SEQ ID NO: 2330419 - protein, 9 aa, Cryptosporidium parvum
NKEQDERMD

SEQ ID NO: 2330420 - protein, 12 aa, Cryptosporidium parvum
NKEYSENYHKGE

SEQ ID NO: 2330421 - protein, 13 aa, Cryptosporidium parvum
NKFRDKNGPNKLN

SEQ ID NO: 2330422 - protein, 12 aa, Cryptosporidium parvum
NKGNTDSVSSVD

SEQ ID NO: 2330423 - protein, 14 aa, Cryptosporidium parvum
NKIGKNGLDSSIAE

SEQ ID NO: 2330424 - protein, 7 aa, Cryptosporidium parvum
NKIKNDN

SEQ ID NO: 2330425 - protein, 6 aa, Cryptosporidium parvum
NKISDL

SEQ ID NO: 2330426 - protein, 10 aa, Cryptosporidium parvum
NKKAEENRRA

SEQ ID NO: 2330427 - protein, 15 aa, Cryptosporidium parvum
NKKGKVKDSKCENKK

SEQ ID NO: 2330428 - protein, 10 aa, Cryptosporidium parvum
NKKLEKPKDV

SEQ ID NO: 2330429 - protein, 10 aa, Cryptosporidium parvum
NKKNKNDLTI

SEQ ID NO: 2330430 - protein, 7 aa, Cryptosporidium parvum
NKKNSEV

SEQ ID NO: 2330431 - protein, 18 aa, Cryptosporidium parvum
NKKSIVGSRVDSKHKRQP

SEQ ID NO: 2330432 - protein, 7 aa, Cryptosporidium parvum
NKKTRRL

SEQ ID NO: 2330433 - protein, 70 aa, Cryptosporidium parvum
NKLGNNNAENGANKKRNRNRNRKNRDGNVNSKENICQTPHSNIQPNQQDEDGRFEGASSSNTSDVRTQAS

SEQ ID NO: 2330434 - protein, 6 aa, Cryptosporidium parvum
NKMDSI

SEQ ID NO: 2330435 - protein, 32 aa, Cryptosporidium parvum
NKNEASGSENLNEANLGETNGGNKNKNSSKYV

SEQ ID NO: 2330436 - protein, 8 aa, Cryptosporidium parvum
NKNEELSN

SEQ ID NO: 2330437 - protein, 4 aa, Cryptosporidium parvum
NKNI

SEQ ID NO: 2330438 - protein, 42 aa, Cryptosporidium parvum
NKNKTKANGKHKRNRRHKTEKSASIEEESPDQANKRVRQPET

SEQ ID NO: 2330439 - protein, 8 aa, Cryptosporidium parvum
NKNKVESL

SEQ ID NO: 2330440 - protein, 7 aa, Cryptosporidium parvum
NKNNDWY

SEQ ID NO: 2330441 - protein, 10 aa, Cryptosporidium parvum
NKNSSDEDLA

SEQ ID NO: 2330442 - protein, 12 aa, Cryptosporidium parvum
NKPAQPSQAPVG

SEQ ID NO: 2330443 - protein, 6 aa, Cryptosporidium parvum
NKPHPG

SEQ ID NO: 2330444 - protein, 22 aa, Cryptosporidium parvum
NKPRSGIKSTVGGLPSSSSPPL

SEQ ID NO: 2330445 - protein, 5 aa, Cryptosporidium parvum
NKPSV

SEQ ID NO: 2330446 - protein, 9 aa, Cryptosporidium parvum
NKQAPPSIT

SEQ ID NO: 2330447 - protein, 6 aa, Cryptosporidium parvum
NKQGIL

SEQ ID NO: 2330448 - protein, 8 aa, Cryptosporidium parvum
NKQKSTIS

SEQ ID NO: 2330449 - protein, 8 aa, Cryptosporidium parvum
NKRNETKN

SEQ ID NO: 2330450 - protein, 8 aa, Cryptosporidium parvum
NKSDEFSN

SEQ ID NO: 2330451 - protein, 6 aa, Cryptosporidium parvum
NKSDTV

SEQ ID NO: 2330452 - protein, 7 aa, Cryptosporidium parvum
NKSELRS

SEQ ID NO: 2330453 - protein, 7 aa, Cryptosporidium parvum
NKSETCV

SEQ ID NO: 2330454 - protein, 13 aa, Cryptosporidium parvum
NKSGISQVTEDVN

SEQ ID NO: 2330455 - protein, 4 aa, Cryptosporidium parvum
NKSK

SEQ ID NO: 2330456 - protein, 8 aa, Cryptosporidium parvum
NKSKIQEG

SEQ ID NO: 2330457 - protein, 4 aa, Cryptosporidium parvum
NKSL

SEQ ID NO: 2330458 - protein, 7 aa, Cryptosporidium parvum
NKSNAKL

SEQ ID NO: 2330459 - protein, 7 aa, Cryptosporidium parvum
NKSSSEF

SEQ ID NO: 2330460 - protein, 6 aa, Cryptosporidium parvum
NKSTPW

SEQ ID NO: 2330461 - protein, 27 aa, Cryptosporidium parvum
NKTGNNETISNNSQNNSTNTQSTSSFH

SEQ ID NO: 2330462 - protein, 13 aa, Cryptosporidium parvum
NKTHTKTISQGIR

SEQ ID NO: 2330463 - protein, 23 aa, Cryptosporidium parvum
NKTNKMKDNGVNSNQEKKEEDNL

SEQ ID NO: 2330464 - protein, 5 aa, Cryptosporidium parvum
NKVSS

SEQ ID NO: 2330465 - protein, 15 aa, Cryptosporidium parvum
NKYKPSLKNRSYRNK

SEQ ID NO: 2330466 - protein, 7 aa, Cryptosporidium parvum
NKYRTNL

SEQ ID NO: 2330467 - protein, 5 aa, Cryptosporidium parvum
NKYSD

SEQ ID NO: 2330468 - protein, 5 aa, Cryptosporidium parvum
NLASH

SEQ ID NO: 2330469 - protein, 10 aa, Cryptosporidium parvum
NLDGVDTGKF

SEQ ID NO: 2330470 - protein, 4 aa, Cryptosporidium parvum
NLDR

SEQ ID NO: 2330471 - protein, 8 aa, Cryptosporidium parvum
NLDSNDTY

SEQ ID NO: 2330472 - protein, 7 aa, Cryptosporidium parvum
NLEGDNQ

SEQ ID NO: 2330473 - protein, 40 aa, Cryptosporidium parvum
NLESSASSSDISQPELTPDDKSENDQVKSTKKTKKRKGPL

SEQ ID NO: 2330474 - protein, 6 aa, Cryptosporidium parvum
NLETEL

SEQ ID NO: 2330475 - protein, 4 aa, Cryptosporidium parvum
NLGI

SEQ ID NO: 2330476 - protein, 7 aa, Cryptosporidium parvum
NLGRTSL

SEQ ID NO: 2330477 - protein, 4 aa, Cryptosporidium parvum
NLGS

SEQ ID NO: 2330478 - protein, 67 aa, Cryptosporidium parvum
NLGSSGPSNDEESLKGTGDRPDGTGCNDSSSSSSSLNNPEGDEENDPEGDEGNDPEGDEGNDPNPFA

SEQ ID NO: 2330479 - protein, 4 aa, Cryptosporidium parvum
NLKN

SEQ ID NO: 2330480 - protein, 6 aa, Cryptosporidium parvum
NLNDTA

SEQ ID NO: 2330481 - protein, 9 aa, Cryptosporidium parvum
NLPGGDRIS

SEQ ID NO: 2330482 - protein, 10 aa, Cryptosporidium parvum
NLPSNSSTNC

SEQ ID NO: 2330483 - protein, 6 aa, Cryptosporidium parvum
NLPSTD

SEQ ID NO: 2330484 - protein, 11 aa, Cryptosporidium parvum
NLQSKESTFST

SEQ ID NO: 2330485 - protein, 11 aa, Cryptosporidium parvum
NLSNSKNFSKS

SEQ ID NO: 2330486 - protein, 6 aa, Cryptosporidium parvum
NLSSGN

SEQ ID NO: 2330487 - protein, 9 aa, Cryptosporidium parvum
NLSSPRALS

SEQ ID NO: 2330488 - protein, 4 aa, Cryptosporidium parvum
NLTE

SEQ ID NO: 2330489 - protein, 5 aa, Cryptosporidium parvum
NLTEE

SEQ ID NO: 2330490 - protein, 6 aa, Cryptosporidium parvum
NLTNED

SEQ ID NO: 2330491 - protein, 37 aa, Cryptosporidium parvum
NLTPDGPLSTRKSSLNSAPDESQKKDPLLTQQNPSSA

SEQ ID NO: 2330492 - protein, 7 aa, Cryptosporidium parvum
NMEDQQT

SEQ ID NO: 2330493 - protein, 6 aa, Cryptosporidium parvum
NMGDTV

SEQ ID NO: 2330494 - protein, 5 aa, Cryptosporidium parvum
NMPTT

SEQ ID NO: 2330495 - protein, 10 aa, Cryptosporidium parvum
NNAQTKDQIT

SEQ ID NO: 2330496 - protein, 4 aa, Cryptosporidium parvum
NNAS

SEQ ID NO: 2330497 - protein, 14 aa, Cryptosporidium parvum
NNASSKPQESKENK

SEQ ID NO: 2330498 - protein, 12 aa, Cryptosporidium parvum
NNDAKSSEKSTC

SEQ ID NO: 2330499 - protein, 5 aa, Cryptosporidium parvum
NNDKD

SEQ ID NO: 2330500 - protein, 6 aa, Cryptosporidium parvum
NNDKNK

SEQ ID NO: 2330501 - protein, 7 aa, Cryptosporidium parvum
NNDKQDF

SEQ ID NO: 2330502 - protein, 7 aa, Cryptosporidium parvum
NNDPVYS

SEQ ID NO: 2330503 - protein, 7 aa, Cryptosporidium parvum
NNDVNGN

SEQ ID NO: 2330504 - protein, 30 aa, Cryptosporidium parvum
NNEELTEQSKKIKSRSKSRSRSRSTSPGGH

SEQ ID NO: 2330505 - protein, 6 aa, Cryptosporidium parvum
NNEERK

SEQ ID NO: 2330506 - protein, 5 aa, Cryptosporidium parvum
NNENE

SEQ ID NO: 2330507 - protein, 4 aa, Cryptosporidium parvum
NNEQ

SEQ ID NO: 2330508 - protein, 10 aa, Cryptosporidium parvum
NNESSSSLQS

SEQ ID NO: 2330509 - protein, 20 aa, Cryptosporidium parvum
NNETASFPASRTSHPSDPNH

SEQ ID NO: 2330510 - protein, 44 aa, Cryptosporidium parvum
NNFANSASIASDYEISDPNYDLQNNTNINHDNSSYVNNETISNP

SEQ ID NO: 2330511 - protein, 17 aa, Cryptosporidium parvum
NNGKDIQNIGTSSLNSR

SEQ ID NO: 2330512 - protein, 5 aa, Cryptosporidium parvum
NNGKN

SEQ ID NO: 2330513 - protein, 9 aa, Cryptosporidium parvum
NNGMPGGIQ

SEQ ID NO: 2330514 - protein, 6 aa, Cryptosporidium parvum
NNGTHN

SEQ ID NO: 2330515 - protein, 6 aa, Cryptosporidium parvum
NNGTWG

SEQ ID NO: 2330516 - protein, 12 aa, Cryptosporidium parvum
NNGVSREDVSSE

SEQ ID NO: 2330517 - protein, 7 aa, Cryptosporidium parvum
NNHETLS

SEQ ID NO: 2330518 - protein, 4 aa, Cryptosporidium parvum
NNHK

SEQ ID NO: 2330519 - protein, 7 aa, Cryptosporidium parvum
NNIKAQN

SEQ ID NO: 2330520 - protein, 7 aa, Cryptosporidium parvum
NNIKSPS

SEQ ID NO: 2330521 - protein, 6 aa, Cryptosporidium parvum
NNIPFS

SEQ ID NO: 2330522 - protein, 13 aa, Cryptosporidium parvum
NNKDYSSPLTNSS

SEQ ID NO: 2330523 - protein, 12 aa, Cryptosporidium parvum
NNKEKRRNNRIP

SEQ ID NO: 2330524 - protein, 14 aa, Cryptosporidium parvum
NNKELNKGNDENIS

SEQ ID NO: 2330525 - protein, 8 aa, Cryptosporidium parvum
NNKNQVRK

SEQ ID NO: 2330526 - protein, 7 aa, Cryptosporidium parvum
NNKRPKI

SEQ ID NO: 2330527 - protein, 12 aa, Cryptosporidium parvum
NNKSYNESINDE

SEQ ID NO: 2330528 - protein, 15 aa, Cryptosporidium parvum
NNKYEDHNQYQNSLS

SEQ ID NO: 2330529 - protein, 49 aa, Cryptosporidium parvum
NNLEKNNEVEPEKSETSTSLKEEVKEKEKMDLSEQTPKKEPSADVSPET

SEQ ID NO: 2330530 - protein, 15 aa, Cryptosporidium parvum
NNNDSDGKGNKSDKK

SEQ ID NO: 2330531 - protein, 4 aa, Cryptosporidium parvum
NNNF

SEQ ID NO: 2330532 - protein, 5 aa, Cryptosporidium parvum
NNNFS

SEQ ID NO: 2330533 - protein, 4 aa, Cryptosporidium parvum
NNNG

SEQ ID NO: 2330534 - protein, 6 aa, Cryptosporidium parvum
NNNGPK

SEQ ID NO: 2330535 - protein, 10 aa, Cryptosporidium parvum
NNNKSDHNSV

SEQ ID NO: 2330536 - protein, 7 aa, Cryptosporidium parvum
NNNNKEY

SEQ ID NO: 2330537 - protein, 16 aa, Cryptosporidium parvum
NNNNQQHHEIGFGGCS

SEQ ID NO: 2330538 - protein, 8 aa, Cryptosporidium parvum
NNNPISND

SEQ ID NO: 2330539 - protein, 9 aa, Cryptosporidium parvum
NNNRAEGYK

SEQ ID NO: 2330540 - protein, 5 aa, Cryptosporidium parvum
NNNRL

SEQ ID NO: 2330541 - protein, 11 aa, Cryptosporidium parvum
NNNSNKGPLGS

SEQ ID NO: 2330542 - protein, 9 aa, Cryptosporidium parvum
NNNSSKLDG

SEQ ID NO: 2330543 - protein, 5 aa, Cryptosporidium parvum
NNPIK

SEQ ID NO: 2330544 - protein, 6 aa, Cryptosporidium parvum
NNPQES

SEQ ID NO: 2330545 - protein, 5 aa, Cryptosporidium parvum
NNPYS

SEQ ID NO: 2330546 - protein, 15 aa, Cryptosporidium parvum
NNRGAPVDDEGHGTH

SEQ ID NO: 2330547 - protein, 7 aa, Cryptosporidium parvum
NNRKITE

SEQ ID NO: 2330548 - protein, 14 aa, Cryptosporidium parvum
NNSAKNDATQQKKE

SEQ ID NO: 2330549 - protein, 10 aa, Cryptosporidium parvum
NNSELEGATR

SEQ ID NO: 2330550 - protein, 26 aa, Cryptosporidium parvum
NNSGKKDKASKESDLGFEKSDYSAQL

SEQ ID NO: 2330551 - protein, 4 aa, Cryptosporidium parvum
NNSK

SEQ ID NO: 2330552 - protein, 5 aa, Cryptosporidium parvum
NNSKK

SEQ ID NO: 2330553 - protein, 6 aa, Cryptosporidium parvum
NNSLNS

SEQ ID NO: 2330554 - protein, 20 aa, Cryptosporidium parvum
NNSLSGNNSENSSKPPEKKN

SEQ ID NO: 2330555 - protein, 7 aa, Cryptosporidium parvum
NNSLSYS

SEQ ID NO: 2330556 - protein, 15 aa, Cryptosporidium parvum
NNSNEYSSEGSIETG

SEQ ID NO: 2330557 - protein, 7 aa, Cryptosporidium parvum
NNSNNYD

SEQ ID NO: 2330558 - protein, 10 aa, Cryptosporidium parvum
NNSQVSRNDY

SEQ ID NO: 2330559 - protein, 7 aa, Cryptosporidium parvum
NNSSNPF

SEQ ID NO: 2330560 - protein, 6 aa, Cryptosporidium parvum
NNSTHK

SEQ ID NO: 2330561 - protein, 15 aa, Cryptosporidium parvum
NNSTTQDSLQNDPEI

SEQ ID NO: 2330562 - protein, 15 aa, Cryptosporidium parvum
NNTAHPNSNSNSNYT

SEQ ID NO: 2330563 - protein, 15 aa, Cryptosporidium parvum
NNTENAASPASRTRF

SEQ ID NO: 2330564 - protein, 8 aa, Cryptosporidium parvum
NNTETYQF

SEQ ID NO: 2330565 - protein, 4 aa, Cryptosporidium parvum
NNTF

SEQ ID NO: 2330566 - protein, 6 aa, Cryptosporidium parvum
NNVEAK

SEQ ID NO: 2330567 - protein, 38 aa, Cryptosporidium parvum
NNVEDSPESRHESKRSKRRKRKNRKRRQRENASRRPYD

SEQ ID NO: 2330568 - protein, 5 aa, Cryptosporidium parvum
NNYGK

SEQ ID NO: 2330569 - protein, 6 aa, Cryptosporidium parvum
NNYPVE

SEQ ID NO: 2330570 - protein, 9 aa, Cryptosporidium parvum
NNYYNENNS

SEQ ID NO: 2330571 - protein, 11 aa, Cryptosporidium parvum
NPADQSATPEV

SEQ ID NO: 2330572 - protein, 5 aa, Cryptosporidium parvum
NPESL

SEQ ID NO: 2330573 - protein, 6 aa, Cryptosporidium parvum
NPFQPG

SEQ ID NO: 2330574 - protein, 10 aa, Cryptosporidium parvum
NPGKTSASDT

SEQ ID NO: 2330575 - protein, 9 aa, Cryptosporidium parvum
NPGKTTLSF

SEQ ID NO: 2330576 - protein, 12 aa, Cryptosporidium parvum
NPGSGKPSPIGN

SEQ ID NO: 2330577 - protein, 11 aa, Cryptosporidium parvum
NPGSSLSNGVI

SEQ ID NO: 2330578 - protein, 5 aa, Cryptosporidium parvum
NPIIP

SEQ ID NO: 2330579 - protein, 11 aa, Cryptosporidium parvum
NPKKEKDIDVP

SEQ ID NO: 2330580 - protein, 7 aa, Cryptosporidium parvum
NPKNNFN

SEQ ID NO: 2330581 - protein, 13 aa, Cryptosporidium parvum
NPKNPTSADYSAS

SEQ ID NO: 2330582 - protein, 6 aa, Cryptosporidium parvum
NPKSFE

SEQ ID NO: 2330583 - protein, 4 aa, Cryptosporidium parvum
NPLK

SEQ ID NO: 2330584 - protein, 8 aa, Cryptosporidium parvum
NPMNSSKK

SEQ ID NO: 2330585 - protein, 7 aa, Cryptosporidium parvum
NPNFPEY

SEQ ID NO: 2330586 - protein, 4 aa, Cryptosporidium parvum
NPNI

SEQ ID NO: 2330587 - protein, 4 aa, Cryptosporidium parvum
NPNL

SEQ ID NO: 2330588 - protein, 5 aa, Cryptosporidium parvum
NPNNF

SEQ ID NO: 2330589 - protein, 8 aa, Cryptosporidium parvum
NPPKELGQ

SEQ ID NO: 2330590 - protein, 9 aa, Cryptosporidium parvum
NPQEVQTNC

SEQ ID NO: 2330591 - protein, 6 aa, Cryptosporidium parvum
NPQQSV

SEQ ID NO: 2330592 - protein, 4 aa, Cryptosporidium parvum
NPSF

SEQ ID NO: 2330593 - protein, 14 aa, Cryptosporidium parvum
NPSPGSKNPYSESN

SEQ ID NO: 2330594 - protein, 6 aa, Cryptosporidium parvum
NPSPSS

SEQ ID NO: 2330595 - protein, 13 aa, Cryptosporidium parvum
NPSSEDEEEEEKI

SEQ ID NO: 2330596 - protein, 5 aa, Cryptosporidium parvum
NPSSS

SEQ ID NO: 2330597 - protein, 30 aa, Cryptosporidium parvum
NQEKLREKMEEEHKKKQEELKKEMKDSVNQ

SEQ ID NO: 2330598 - protein, 5 aa, Cryptosporidium parvum
NQGIS

SEQ ID NO: 2330599 - protein, 13 aa, Cryptosporidium parvum
NQGNYSQNSTIII

SEQ ID NO: 2330600 - protein, 14 aa, Cryptosporidium parvum
NQIESLSRNSTFSE

SEQ ID NO: 2330601 - protein, 6 aa, Cryptosporidium parvum
NQINNK

SEQ ID NO: 2330602 - protein, 8 aa, Cryptosporidium parvum
NQIPTAPI

SEQ ID NO: 2330603 - protein, 9 aa, Cryptosporidium parvum
NQKFNDNDD

SEQ ID NO: 2330604 - protein, 7 aa, Cryptosporidium parvum
NQKNNHI

SEQ ID NO: 2330605 - protein, 6 aa, Cryptosporidium parvum
NQKSIS

SEQ ID NO: 2330606 - protein, 7 aa, Cryptosporidium parvum
NQLNSPE

SEQ ID NO: 2330607 - protein, 6 aa, Cryptosporidium parvum
NQMGPK

SEQ ID NO: 2330608 - protein, 4 aa, Cryptosporidium parvum
NQND

SEQ ID NO: 2330609 - protein, 7 aa, Cryptosporidium parvum
NQNLDNN

SEQ ID NO: 2330610 - protein, 8 aa, Cryptosporidium parvum
NQNPSKNR

SEQ ID NO: 2330611 - protein, 6 aa, Cryptosporidium parvum
NQNQSI

SEQ ID NO: 2330612 - protein, 5 aa, Cryptosporidium parvum
NQPRM

SEQ ID NO: 2330613 - protein, 4 aa, Cryptosporidium parvum
NQPT

SEQ ID NO: 2330614 - protein, 8 aa, Cryptosporidium parvum
NQQQQQQQ

SEQ ID NO: 2330615 - protein, 7 aa, Cryptosporidium parvum
NQSLDPE

SEQ ID NO: 2330616 - protein, 6 aa, Cryptosporidium parvum
NQSLNK

SEQ ID NO: 2330617 - protein, 19 aa, Cryptosporidium parvum
NQSNSLANTYSKISAADST

SEQ ID NO: 2330618 - protein, 7 aa, Cryptosporidium parvum
NQSSKVY

SEQ ID NO: 2330619 - protein, 7 aa, Cryptosporidium parvum
NQSTKFR

SEQ ID NO: 2330620 - protein, 10 aa, Cryptosporidium parvum
NQSWEGESQE

SEQ ID NO: 2330621 - protein, 7 aa, Cryptosporidium parvum
NQTDITT

SEQ ID NO: 2330622 - protein, 11 aa, Cryptosporidium parvum
NQTKENTDDDN

SEQ ID NO: 2330623 - protein, 9 aa, Cryptosporidium parvum
NQTLGYSGR

SEQ ID NO: 2330624 - protein, 9 aa, Cryptosporidium parvum
NQYASSVTS

SEQ ID NO: 2330625 - protein, 10 aa, Cryptosporidium parvum
NRDETKVGDP

SEQ ID NO: 2330626 - protein, 13 aa, Cryptosporidium parvum
NRDGKNANFKSSS

SEQ ID NO: 2330627 - protein, 6 aa, Cryptosporidium parvum
NRERAK

SEQ ID NO: 2330628 - protein, 8 aa, Cryptosporidium parvum
NRETPKCE

SEQ ID NO: 2330629 - protein, 7 aa, Cryptosporidium parvum
NRGGGTM

SEQ ID NO: 2330630 - protein, 9 aa, Cryptosporidium parvum
NRGPNTNGS

SEQ ID NO: 2330631 - protein, 9 aa, Cryptosporidium parvum
NRKEDERRE

SEQ ID NO: 2330632 - protein, 8 aa, Cryptosporidium parvum
NRLDDAKG

SEQ ID NO: 2330633 - protein, 5 aa, Cryptosporidium parvum
NRLNN

SEQ ID NO: 2330634 - protein, 11 aa, Cryptosporidium parvum
NRNQDDQSNQL

SEQ ID NO: 2330635 - protein, 19 aa, Cryptosporidium parvum
NRPQAIQTTHSNNNRHHNG

SEQ ID NO: 2330636 - protein, 8 aa, Cryptosporidium parvum
NRQNGGCR

SEQ ID NO: 2330637 - protein, 4 aa, Cryptosporidium parvum
NRRI

SEQ ID NO: 2330638 - protein, 4 aa, Cryptosporidium parvum
NRSE

SEQ ID NO: 2330639 - protein, 8 aa, Cryptosporidium parvum
NRSTSRIR

SEQ ID NO: 2330640 - protein, 6 aa, Cryptosporidium parvum
NRSVSS

SEQ ID NO: 2330641 - protein, 6 aa, Cryptosporidium parvum
NRTDPV

SEQ ID NO: 2330642 - protein, 5 aa, Cryptosporidium parvum
NRVNN

SEQ ID NO: 2330643 - protein, 14 aa, Cryptosporidium parvum
NRYGRPEKMRRNGR

SEQ ID NO: 2330644 - protein, 38 aa, Cryptosporidium parvum
NSAAGSTSGSGQSPPNERKRKLSSDEHDSSSSGHRPSR

SEQ ID NO: 2330645 - protein, 10 aa, Cryptosporidium parvum
NSAASSTSVV

SEQ ID NO: 2330646 - protein, 7 aa, Cryptosporidium parvum
NSADALE

SEQ ID NO: 2330647 - protein, 5 aa, Cryptosporidium parvum
NSAGE

SEQ ID NO: 2330648 - protein, 15 aa, Cryptosporidium parvum
NSAPQVNSSKTTAKL

SEQ ID NO: 2330649 - protein, 5 aa, Cryptosporidium parvum
NSAQI

SEQ ID NO: 2330650 - protein, 14 aa, Cryptosporidium parvum
NSAYQTPSSGNNCQ

SEQ ID NO: 2330651 - protein, 15 aa, Cryptosporidium parvum
NSCNNKDCNYDGGDC

SEQ ID NO: 2330652 - protein, 13 aa, Cryptosporidium parvum
NSDDEPPRQSNHK

SEQ ID NO: 2330653 - protein, 7 aa, Cryptosporidium parvum
NSDEPSY

SEQ ID NO: 2330654 - protein, 8 aa, Cryptosporidium parvum
NSDFPDNS

SEQ ID NO: 2330655 - protein, 6 aa, Cryptosporidium parvum
NSDGSC

SEQ ID NO: 2330656 - protein, 44 aa, Cryptosporidium parvum
NSDISKNGGAEPIKEVASSNGTMNSTSITESSEENLGNKLSNPE

SEQ ID NO: 2330657 - protein, 4 aa, Cryptosporidium parvum
NSDS

SEQ ID NO: 2330658 - protein, 12 aa, Cryptosporidium parvum
NSDSDLSNEVNP

SEQ ID NO: 2330659 - protein, 22 aa, Cryptosporidium parvum
NSDTNLSSNTISRTITSTTTVN

SEQ ID NO: 2330660 - protein, 12 aa, Cryptosporidium parvum
NSEEKDENSFNN

SEQ ID NO: 2330661 - protein, 5 aa, Cryptosporidium parvum
NSEGN

SEQ ID NO: 2330662 - protein, 8 aa, Cryptosporidium parvum
NSEIQSNN

SEQ ID NO: 2330663 - protein, 24 aa, Cryptosporidium parvum
NSEISPEELENSEPITTDSQDSHF

SEQ ID NO: 2330664 - protein, 11 aa, Cryptosporidium parvum
NSEKLSNHDLP

SEQ ID NO: 2330665 - protein, 8 aa, Cryptosporidium parvum
NSENKEYC

SEQ ID NO: 2330666 - protein, 9 aa, Cryptosporidium parvum
NSENSKGYL

SEQ ID NO: 2330667 - protein, 12 aa, Cryptosporidium parvum
NSEVSSSVSGQD

SEQ ID NO: 2330668 - protein, 22 aa, Cryptosporidium parvum
NSFDSDSFSSDDSDDDNLAGSS

SEQ ID NO: 2330669 - protein, 15 aa, Cryptosporidium parvum
NSFSTKDKIERDNGL

SEQ ID NO: 2330670 - protein, 7 aa, Cryptosporidium parvum
NSFTNNE

SEQ ID NO: 2330671 - protein, 10 aa, Cryptosporidium parvum
NSGETEESAN

SEQ ID NO: 2330672 - protein, 24 aa, Cryptosporidium parvum
NSGGGGGGGGGYSRQSYNVNSRQE

SEQ ID NO: 2330673 - protein, 5 aa, Cryptosporidium parvum
NSGIG

SEQ ID NO: 2330674 - protein, 6 aa, Cryptosporidium parvum
NSGKET

SEQ ID NO: 2330675 - protein, 13 aa, Cryptosporidium parvum
NSGLGSSAKRLED

SEQ ID NO: 2330676 - protein, 9 aa, Cryptosporidium parvum
NSGNGPDCE

SEQ ID NO: 2330677 - protein, 25 aa, Cryptosporidium parvum
NSGTISSNNNNNSDKKNKSSSTPIN

SEQ ID NO: 2330678 - protein, 11 aa, Cryptosporidium parvum
NSGYKKETYPY

SEQ ID NO: 2330679 - protein, 7 aa, Cryptosporidium parvum
NSIEQKQ

SEQ ID NO: 2330680 - protein, 6 aa, Cryptosporidium parvum
NSIKEN

SEQ ID NO: 2330681 - protein, 5 aa, Cryptosporidium parvum
NSINE

SEQ ID NO: 2330682 - protein, 4 aa, Cryptosporidium parvum
NSIQ

SEQ ID NO: 2330683 - protein, 10 aa, Cryptosporidium parvum
NSKASEMVKS

SEQ ID NO: 2330684 - protein, 6 aa, Cryptosporidium parvum
NSKDID

SEQ ID NO: 2330685 - protein, 5 aa, Cryptosporidium parvum
NSKEE

SEQ ID NO: 2330686 - protein, 6 aa, Cryptosporidium parvum
NSKEEE

SEQ ID NO: 2330687 - protein, 4 aa, Cryptosporidium parvum
NSKK

SEQ ID NO: 2330688 - protein, 7 aa, Cryptosporidium parvum
NSKLSTQ

SEQ ID NO: 2330689 - protein, 11 aa, Cryptosporidium parvum
NSKPGNGEKNY

SEQ ID NO: 2330690 - protein, 16 aa, Cryptosporidium parvum
NSKQVKERYNNKLSNL

SEQ ID NO: 2330691 - protein, 15 aa, Cryptosporidium parvum
NSKTEANSKTSQHID

SEQ ID NO: 2330692 - protein, 9 aa, Cryptosporidium parvum
NSKTTPNNE

SEQ ID NO: 2330693 - protein, 8 aa, Cryptosporidium parvum
NSLEDADD

SEQ ID NO: 2330694 - protein, 13 aa, Cryptosporidium parvum
NSLPPNEYNPYSN

SEQ ID NO: 2330695 - protein, 12 aa, Cryptosporidium parvum
NSLPSPYDPIEG

SEQ ID NO: 2330696 - protein, 4 aa, Cryptosporidium parvum
NSLQ

SEQ ID NO: 2330697 - protein, 14 aa, Cryptosporidium parvum
NSLSDSNDQRVESK

SEQ ID NO: 2330698 - protein, 10 aa, Cryptosporidium parvum
NSNEENREIK

SEQ ID NO: 2330699 - protein, 4 aa, Cryptosporidium parvum
NSNG

SEQ ID NO: 2330700 - protein, 15 aa, Cryptosporidium parvum
NSNGNITELDKNSSM

SEQ ID NO: 2330701 - protein, 8 aa, Cryptosporidium parvum
NSNINEQS

SEQ ID NO: 2330702 - protein, 6 aa, Cryptosporidium parvum
NSNKEC

SEQ ID NO: 2330703 - protein, 4 aa, Cryptosporidium parvum
NSNN

SEQ ID NO: 2330704 - protein, 10 aa, Cryptosporidium parvum
NSNNGEKKVE

SEQ ID NO: 2330705 - protein, 4 aa, Cryptosporidium parvum
NSNQ

SEQ ID NO: 2330706 - protein, 8 aa, Cryptosporidium parvum
NSNQEDGL

SEQ ID NO: 2330707 - protein, 7 aa, Cryptosporidium parvum
NSNQPRA

SEQ ID NO: 2330708 - protein, 14 aa, Cryptosporidium parvum
NSNSKKISDHNSLP

SEQ ID NO: 2330709 - protein, 6 aa, Cryptosporidium parvum
NSNTQF

SEQ ID NO: 2330710 - protein, 7 aa, Cryptosporidium parvum
NSNTSRA

SEQ ID NO: 2330711 - protein, 6 aa, Cryptosporidium parvum
NSPARK

SEQ ID NO: 2330712 - protein, 4 aa, Cryptosporidium parvum
NSPS

SEQ ID NO: 2330713 - protein, 5 aa, Cryptosporidium parvum
NSQIC

SEQ ID NO: 2330714 - protein, 6 aa, Cryptosporidium parvum
NSQISS

SEQ ID NO: 2330715 - protein, 7 aa, Cryptosporidium parvum
NSQPNHV

SEQ ID NO: 2330716 - protein, 9 aa, Cryptosporidium parvum
NSQYGNNHE

SEQ ID NO: 2330717 - protein, 15 aa, Cryptosporidium parvum
NSRAASKTAAEAVTK

SEQ ID NO: 2330718 - protein, 7 aa, Cryptosporidium parvum
NSRNGLS

SEQ ID NO: 2330719 - protein, 8 aa, Cryptosporidium parvum
NSRNKIPH

SEQ ID NO: 2330720 - protein, 6 aa, Cryptosporidium parvum
NSRREP

SEQ ID NO: 2330721 - protein, 4 aa, Cryptosporidium parvum
NSSD

SEQ ID NO: 2330722 - protein, 9 aa, Cryptosporidium parvum
NSSDFSDPM

SEQ ID NO: 2330723 - protein, 6 aa, Cryptosporidium parvum
NSSGNL

SEQ ID NO: 2330724 - protein, 5 aa, Cryptosporidium parvum
NSSID

SEQ ID NO: 2330725 - protein, 5 aa, Cryptosporidium parvum
NSSIE

SEQ ID NO: 2330726 - protein, 29 aa, Cryptosporidium parvum
NSSISSKSKFTHSNTYHPNTSNNSHSHNY

SEQ ID NO: 2330727 - protein, 6 aa, Cryptosporidium parvum
NSSKLD

SEQ ID NO: 2330728 - protein, 13 aa, Cryptosporidium parvum
NSSKSKSERRREK

SEQ ID NO: 2330729 - protein, 4 aa, Cryptosporidium parvum
NSSL

SEQ ID NO: 2330730 - protein, 73 aa, Cryptosporidium parvum
NSSLDSSSGQISESAAAEEAGLDKEQKLDLTGESSPTVEAERVTEEVKADETSNEVVTQQTSEEIAEKVDSTL

SEQ ID NO: 2330731 - protein, 9 aa, Cryptosporidium parvum
NSSPIESIP

SEQ ID NO: 2330732 - protein, 21 aa, Cryptosporidium parvum
NSSPPYNNLPNNGELNKKNSG

SEQ ID NO: 2330733 - protein, 18 aa, Cryptosporidium parvum
NSSSINNDTKTMESLDGK

SEQ ID NO: 2330734 - protein, 6 aa, Cryptosporidium parvum
NSSSKC

SEQ ID NO: 2330735 - protein, 6 aa, Cryptosporidium parvum
NSTAIN

SEQ ID NO: 2330736 - protein, 10 aa, Cryptosporidium parvum
NSTCGSQQSI

SEQ ID NO: 2330737 - protein, 6 aa, Cryptosporidium parvum
NSTEVD

SEQ ID NO: 2330738 - protein, 10 aa, Cryptosporidium parvum
NSTKQKTCNQ

SEQ ID NO: 2330739 - protein, 39 aa, Cryptosporidium parvum
NSTKVEEGNSASSSNSTGNSTQNGSVSNGDKKSSTKTIY

SEQ ID NO: 2330740 - protein, 9 aa, Cryptosporidium parvum
NSTSNDAEY

SEQ ID NO: 2330741 - protein, 10 aa, Cryptosporidium parvum
NSYESNENIS

SEQ ID NO: 2330742 - protein, 6 aa, Cryptosporidium parvum
NSYKDI

SEQ ID NO: 2330743 - protein, 7 aa, Cryptosporidium parvum
NSYPSKT

SEQ ID NO: 2330744 - protein, 8 aa, Cryptosporidium parvum
NTANKAYE

SEQ ID NO: 2330745 - protein, 10 aa, Cryptosporidium parvum
NTAPVSINQG

SEQ ID NO: 2330746 - protein, 11 aa, Cryptosporidium parvum
NTDNRLEDNTF

SEQ ID NO: 2330747 - protein, 4 aa, Cryptosporidium parvum
NTEI

SEQ ID NO: 2330748 - protein, 7 aa, Cryptosporidium parvum
NTENDYA

SEQ ID NO: 2330749 - protein, 6 aa, Cryptosporidium parvum
NTESLN

SEQ ID NO: 2330750 - protein, 10 aa, Cryptosporidium parvum
NTESVDPLSS

SEQ ID NO: 2330751 - protein, 8 aa, Cryptosporidium parvum
NTGLSQNE

SEQ ID NO: 2330752 - protein, 5 aa, Cryptosporidium parvum
NTGPK

SEQ ID NO: 2330753 - protein, 6 aa, Cryptosporidium parvum
NTGQYG

SEQ ID NO: 2330754 - protein, 14 aa, Cryptosporidium parvum
NTINKSSNNDQSLD

SEQ ID NO: 2330755 - protein, 21 aa, Cryptosporidium parvum
NTKAAQSNNSEELKSLSEESA

SEQ ID NO: 2330756 - protein, 7 aa, Cryptosporidium parvum
NTKDENG

SEQ ID NO: 2330757 - protein, 8 aa, Cryptosporidium parvum
NTKDENTY

SEQ ID NO: 2330758 - protein, 8 aa, Cryptosporidium parvum
NTKENSSF

SEQ ID NO: 2330759 - protein, 11 aa, Cryptosporidium parvum
NTKRFNPPRGS

SEQ ID NO: 2330760 - protein, 5 aa, Cryptosporidium parvum
NTLGT

SEQ ID NO: 2330761 - protein, 9 aa, Cryptosporidium parvum
NTMNGTDNN

SEQ ID NO: 2330762 - protein, 10 aa, Cryptosporidium parvum
NTNLKHESNA

SEQ ID NO: 2330763 - protein, 18 aa, Cryptosporidium parvum
NTNNNVSEDESDEGTAEE

SEQ ID NO: 2330764 - protein, 13 aa, Cryptosporidium parvum
NTNNPDKQRRDAE

SEQ ID NO: 2330765 - protein, 8 aa, Cryptosporidium parvum
NTNSKSLP

SEQ ID NO: 2330766 - protein, 19 aa, Cryptosporidium parvum
NTNSMNSRKQYDDLSSSTP

SEQ ID NO: 2330767 - protein, 8 aa, Cryptosporidium parvum
NTNSQSGF

SEQ ID NO: 2330768 - protein, 6 aa, Cryptosporidium parvum
NTPDTF

SEQ ID NO: 2330769 - protein, 6 aa, Cryptosporidium parvum
NTPIIN

SEQ ID NO: 2330770 - protein, 9 aa, Cryptosporidium parvum
NTPKTPTLG

SEQ ID NO: 2330771 - protein, 5 aa, Cryptosporidium parvum
NTPPG

SEQ ID NO: 2330772 - protein, 6 aa, Cryptosporidium parvum
NTPSGY

SEQ ID NO: 2330773 - protein, 11 aa, Cryptosporidium parvum
NTQGGNSEGSQ

SEQ ID NO: 2330774 - protein, 5 aa, Cryptosporidium parvum
NTRKS

SEQ ID NO: 2330775 - protein, 8 aa, Cryptosporidium parvum
NTSESNYA

SEQ ID NO: 2330776 - protein, 4 aa, Cryptosporidium parvum
NTSI

SEQ ID NO: 2330777 - protein, 13 aa, Cryptosporidium parvum
NTSKTSNENNTVK

SEQ ID NO: 2330778 - protein, 10 aa, Cryptosporidium parvum
NTSPKPNPFT

SEQ ID NO: 2330779 - protein, 7 aa, Cryptosporidium parvum
NTSTTLV

SEQ ID NO: 2330780 - protein, 12 aa, Cryptosporidium parvum
NTTDENRDPYSL

SEQ ID NO: 2330781 - protein, 16 aa, Cryptosporidium parvum
NTTNTTNTSNTTNNNI

SEQ ID NO: 2330782 - protein, 16 aa, Cryptosporidium parvum
NTTTGQFEKNEDHPNL

SEQ ID NO: 2330783 - protein, 22 aa, Cryptosporidium parvum
NTTTGQFEKNEDHSDPDEINPF

SEQ ID NO: 2330784 - protein, 5 aa, Cryptosporidium parvum
NTVEG

SEQ ID NO: 2330785 - protein, 12 aa, Cryptosporidium parvum
NTVTSKSKRTKL

SEQ ID NO: 2330786 - protein, 9 aa, Cryptosporidium parvum
NTYDSGDEF

SEQ ID NO: 2330787 - protein, 8 aa, Cryptosporidium parvum
NVCTPKGY

SEQ ID NO: 2330788 - protein, 7 aa, Cryptosporidium parvum
NVDSTNY

SEQ ID NO: 2330789 - protein, 11 aa, Cryptosporidium parvum
NVEGKKKLPIS

SEQ ID NO: 2330790 - protein, 15 aa, Cryptosporidium parvum
NVEKETNHDNETPKI

SEQ ID NO: 2330791 - protein, 5 aa, Cryptosporidium parvum
NVGGP

SEQ ID NO: 2330792 - protein, 8 aa, Cryptosporidium parvum
NVKPGNEF

SEQ ID NO: 2330793 - protein, 15 aa, Cryptosporidium parvum
NVLAGSNVGELKPSG

SEQ ID NO: 2330794 - protein, 6 aa, Cryptosporidium parvum
NVNNGT

SEQ ID NO: 2330795 - protein, 12 aa, Cryptosporidium parvum
NVNTGSKASASL

SEQ ID NO: 2330796 - protein, 10 aa, Cryptosporidium parvum
NVPDSGNHYA

SEQ ID NO: 2330797 - protein, 6 aa, Cryptosporidium parvum
NVPSEV

SEQ ID NO: 2330798 - protein, 9 aa, Cryptosporidium parvum
NVPSHGKSI

SEQ ID NO: 2330799 - protein, 15 aa, Cryptosporidium parvum
NVQNGGSTSLDSVPS

SEQ ID NO: 2330800 - protein, 5 aa, Cryptosporidium parvum
NVQSK

SEQ ID NO: 2330801 - protein, 7 aa, Cryptosporidium parvum
NVRIPSS

SEQ ID NO: 2330802 - protein, 25 aa, Cryptosporidium parvum
NVRRDERGVPITSGPVVGSKVGEKA

SEQ ID NO: 2330803 - protein, 6 aa, Cryptosporidium parvum
NVTGKN

SEQ ID NO: 2330804 - protein, 9 aa, Cryptosporidium parvum
NWDGETRTT

SEQ ID NO: 2330805 - protein, 15 aa, Cryptosporidium parvum
NWEKYTTTPLDSDCK

SEQ ID NO: 2330806 - protein, 7 aa, Cryptosporidium parvum
NWPETSN

SEQ ID NO: 2330807 - protein, 10 aa, Cryptosporidium parvum
NYATPGSGMT

SEQ ID NO: 2330808 - protein, 9 aa, Cryptosporidium parvum
NYDNYGKRS

SEQ ID NO: 2330809 - protein, 8 aa, Cryptosporidium parvum
NYETKDEE

SEQ ID NO: 2330810 - protein, 10 aa, Cryptosporidium parvum
NYETTSSTDT

SEQ ID NO: 2330811 - protein, 14 aa, Cryptosporidium parvum
NYGASQVEEYDEAD

SEQ ID NO: 2330812 - protein, 7 aa, Cryptosporidium parvum
NYGDPDF

SEQ ID NO: 2330813 - protein, 4 aa, Cryptosporidium parvum
NYHP

SEQ ID NO: 2330814 - protein, 14 aa, Cryptosporidium parvum
NYKLSGDKKRLSVS

SEQ ID NO: 2330815 - protein, 9 aa, Cryptosporidium parvum
NYKNNEIDE

SEQ ID NO: 2330816 - protein, 4 aa, Cryptosporidium parvum
NYPE

SEQ ID NO: 2330817 - protein, 5 aa, Cryptosporidium parvum
NYQEQ

SEQ ID NO: 2330818 - protein, 7 aa, Cryptosporidium parvum
NYSREGL

SEQ ID NO: 2330819 - protein, 4 aa, Cryptosporidium parvum
NYTV

SEQ ID NO: 2330820 - protein, 5 aa, Cryptosporidium parvum
NYYGE

SEQ ID NO: 2330821 - protein, 8 aa, Cryptosporidium parvum
NYYTRNGR

SEQ ID NO: 2330822 - protein, 9 aa, Cryptosporidium parvum
PAAASDEEY

SEQ ID NO: 2330823 - protein, 4 aa, Cryptosporidium parvum
PAET

SEQ ID NO: 2330824 - protein, 55 aa, Cryptosporidium parvum
PAFNSNDESSESSSSNSMESVPNPDPSNIPVPSSGPVVSSTSQYSGYSSTSEPIP

SEQ ID NO: 2330825 - protein, 13 aa, Cryptosporidium parvum
PAGKKISSKNREQ

SEQ ID NO: 2330826 - protein, 4 aa, Cryptosporidium parvum
PAKS

SEQ ID NO: 2330827 - protein, 7 aa, Cryptosporidium parvum
PANEGSN

SEQ ID NO: 2330828 - protein, 4 aa, Cryptosporidium parvum
PAPD

SEQ ID NO: 2330829 - protein, 16 aa, Cryptosporidium parvum
PAPIDGDESNTPPGYH

SEQ ID NO: 2330830 - protein, 16 aa, Cryptosporidium parvum
PAPKMETLKGGNPIKS

SEQ ID NO: 2330831 - protein, 9 aa, Cryptosporidium parvum
PAPRSPRCS

SEQ ID NO: 2330832 - protein, 6 aa, Cryptosporidium parvum
PASAVP

SEQ ID NO: 2330833 - protein, 5 aa, Cryptosporidium parvum
PASNI

SEQ ID NO: 2330834 - protein, 10 aa, Cryptosporidium parvum
PATDSNLRSG

SEQ ID NO: 2330835 - protein, 19 aa, Cryptosporidium parvum
PATHTSVEAPGLGSQQPGI

SEQ ID NO: 2330836 - protein, 4 aa, Cryptosporidium parvum
PATP

SEQ ID NO: 2330837 - protein, 11 aa, Cryptosporidium parvum
PATTPRKSKNL

SEQ ID NO: 2330838 - protein, 5 aa, Cryptosporidium parvum
PCKGH

SEQ ID NO: 2330839 - protein, 5 aa, Cryptosporidium parvum
PCKGI

SEQ ID NO: 2330840 - protein, 7 aa, Cryptosporidium parvum
PCNNPDQ

SEQ ID NO: 2330841 - protein, 4 aa, Cryptosporidium parvum
PCNS

SEQ ID NO: 2330842 - protein, 7 aa, Cryptosporidium parvum
PCRGNDS

SEQ ID NO: 2330843 - protein, 22 aa, Cryptosporidium parvum
PDCKKPCSSLDSPVYGSDGKEY

SEQ ID NO: 2330844 - protein, 4 aa, Cryptosporidium parvum
PDDT

SEQ ID NO: 2330845 - protein, 14 aa, Cryptosporidium parvum
PDEDPKKTKEISEN

SEQ ID NO: 2330846 - protein, 29 aa, Cryptosporidium parvum
PDGGFKPTSTEPDSLYNPPYDKTTKTYHP

SEQ ID NO: 2330847 - protein, 4 aa, Cryptosporidium parvum
PDGN

SEQ ID NO: 2330848 - protein, 12 aa, Cryptosporidium parvum
PDGSQCAKTEHT

SEQ ID NO: 2330849 - protein, 6 aa, Cryptosporidium parvum
PDGWDR

SEQ ID NO: 2330850 - protein, 6 aa, Cryptosporidium parvum
PDHSFD

SEQ ID NO: 2330851 - protein, 23 aa, Cryptosporidium parvum
PDIKDSPQGSEKVNVEIVNGGVD

SEQ ID NO: 2330852 - protein, 53 aa, Cryptosporidium parvum
PDLGSEKVVGSGRPESKRPESRKPESKIPESRKPESKRPESKSNSCNCSSGRC

SEQ ID NO: 2330853 - protein, 9 aa, Cryptosporidium parvum
PDMSPSPKF

SEQ ID NO: 2330854 - protein, 10 aa, Cryptosporidium parvum
PDMTGASEAL

SEQ ID NO: 2330855 - protein, 5 aa, Cryptosporidium parvum
PDNKI

SEQ ID NO: 2330856 - protein, 25 aa, Cryptosporidium parvum
PDPDYGNSDFQDSIERSRELRESSS

SEQ ID NO: 2330857 - protein, 6 aa, Cryptosporidium parvum
PDPNLT

SEQ ID NO: 2330858 - protein, 10 aa, Cryptosporidium parvum
PDPNNENNGV

SEQ ID NO: 2330859 - protein, 4 aa, Cryptosporidium parvum
PDQI

SEQ ID NO: 2330860 - protein, 5 aa, Cryptosporidium parvum
PDRRE

SEQ ID NO: 2330861 - protein, 16 aa, Cryptosporidium parvum
PDSRCPDNTEKTSTGC

SEQ ID NO: 2330862 - protein, 6 aa, Cryptosporidium parvum
PDSSSF

SEQ ID NO: 2330863 - protein, 4 aa, Cryptosporidium parvum
PDSY

SEQ ID NO: 2330864 - protein, 10 aa, Cryptosporidium parvum
PDTIGPQSSS

SEQ ID NO: 2330865 - protein, 8 aa, Cryptosporidium parvum
PDVGRETP

SEQ ID NO: 2330866 - protein, 9 aa, Cryptosporidium parvum
PEDGGDVEY

SEQ ID NO: 2330867 - protein, 5 aa, Cryptosporidium parvum
PEDHS

SEQ ID NO: 2330868 - protein, 30 aa, Cryptosporidium parvum
PEDKMEGKKSSCCSSSCSSSSDKASDEELK

SEQ ID NO: 2330869 - protein, 7 aa, Cryptosporidium parvum
PEDLPKN

SEQ ID NO: 2330870 - protein, 8 aa, Cryptosporidium parvum
PEEKPDFT

SEQ ID NO: 2330871 - protein, 8 aa, Cryptosporidium parvum
PEESIESV

SEQ ID NO: 2330872 - protein, 5 aa, Cryptosporidium parvum
PEESS

SEQ ID NO: 2330873 - protein, 32 aa, Cryptosporidium parvum
PEEVSTDEGVEGSDQEKGFDDEEDEKNEKRDE

SEQ ID NO: 2330874 - protein, 5 aa, Cryptosporidium parvum
PEEYD

SEQ ID NO: 2330875 - protein, 6 aa, Cryptosporidium parvum
PEGGYP

SEQ ID NO: 2330876 - protein, 10 aa, Cryptosporidium parvum
PEGKYSDINT

SEQ ID NO: 2330877 - protein, 18 aa, Cryptosporidium parvum
PEGSSDNGKGSCNQKSRP

SEQ ID NO: 2330878 - protein, 4 aa, Cryptosporidium parvum
PEIG

SEQ ID NO: 2330879 - protein, 4 aa, Cryptosporidium parvum
PEKD

SEQ ID NO: 2330880 - protein, 14 aa, Cryptosporidium parvum
PEKETKEEEKIRND

SEQ ID NO: 2330881 - protein, 29 aa, Cryptosporidium parvum
PEKFPQPSNSLRRTKSLSSINVGSRRQST

SEQ ID NO: 2330882 - protein, 14 aa, Cryptosporidium parvum
PEKSEDGEKDSQSP

SEQ ID NO: 2330883 - protein, 11 aa, Cryptosporidium parvum
PEKTVEESKIT

SEQ ID NO: 2330884 - protein, 5 aa, Cryptosporidium parvum
PENAN

SEQ ID NO: 2330885 - protein, 5 aa, Cryptosporidium parvum
PENDS

SEQ ID NO: 2330886 - protein, 5 aa, Cryptosporidium parvum
PENSV

SEQ ID NO: 2330887 - protein, 10 aa, Cryptosporidium parvum
PENTRYDKRT

SEQ ID NO: 2330888 - protein, 4 aa, Cryptosporidium parvum
PERF

SEQ ID NO: 2330889 - protein, 7 aa, Cryptosporidium parvum
PESDPTQ

SEQ ID NO: 2330890 - protein, 4 aa, Cryptosporidium parvum
PESG

SEQ ID NO: 2330891 - protein, 6 aa, Cryptosporidium parvum
PESHPS

SEQ ID NO: 2330892 - protein, 12 aa, Cryptosporidium parvum
PESTDKTEENEE

SEQ ID NO: 2330893 - protein, 4 aa, Cryptosporidium parvum
PESY

SEQ ID NO: 2330894 - protein, 4 aa, Cryptosporidium parvum
PETG

SEQ ID NO: 2330895 - protein, 7 aa, Cryptosporidium parvum
PETNFSR

SEQ ID NO: 2330896 - protein, 7 aa, Cryptosporidium parvum
PETRRKY

SEQ ID NO: 2330897 - protein, 4 aa, Cryptosporidium parvum
PEVE

SEQ ID NO: 2330898 - protein, 13 aa, Cryptosporidium parvum
PEVNGSEETVTSI

SEQ ID NO: 2330899 - protein, 14 aa, Cryptosporidium parvum
PEVSCPPGSTPHGH

SEQ ID NO: 2330900 - protein, 4 aa, Cryptosporidium parvum
PEVT

SEQ ID NO: 2330901 - protein, 8 aa, Cryptosporidium parvum
PEYGGRGR

SEQ ID NO: 2330902 - protein, 7 aa, Cryptosporidium parvum
PEYSEEE

SEQ ID NO: 2330903 - protein, 12 aa, Cryptosporidium parvum
PFENSSAQQCAE

SEQ ID NO: 2330904 - protein, 6 aa, Cryptosporidium parvum
PFGPQA

SEQ ID NO: 2330905 - protein, 11 aa, Cryptosporidium parvum
PFQQDSSSLNK

SEQ ID NO: 2330906 - protein, 43 aa, Cryptosporidium parvum
PFSAPDSGAIPKVRSSGSTTAQSSLHKATKKRSDHKNMSKASR

SEQ ID NO: 2330907 - protein, 12 aa, Cryptosporidium parvum
PFSDKSGTIGNI

SEQ ID NO: 2330908 - protein, 8 aa, Cryptosporidium parvum
PFSETPEG

SEQ ID NO: 2330909 - protein, 5 aa, Cryptosporidium parvum
PFSKS

SEQ ID NO: 2330910 - protein, 10 aa, Cryptosporidium parvum
PFTPDQSDAI

SEQ ID NO: 2330911 - protein, 12 aa, Cryptosporidium parvum
PGAGKRQHCKYC

SEQ ID NO: 2330912 - protein, 11 aa, Cryptosporidium parvum
PGDLPSDSNPQ

SEQ ID NO: 2330913 - protein, 4 aa, Cryptosporidium parvum
PGEE

SEQ ID NO: 2330914 - protein, 7 aa, Cryptosporidium parvum
PGESSGK

SEQ ID NO: 2330915 - protein, 10 aa, Cryptosporidium parvum
PGFRGGKNDF

SEQ ID NO: 2330916 - protein, 12 aa, Cryptosporidium parvum
PGFSSSKPIQPI

SEQ ID NO: 2330917 - protein, 4 aa, Cryptosporidium parvum
PGGF

SEQ ID NO: 2330918 - protein, 11 aa, Cryptosporidium parvum
PGGNRTDTSFQ

SEQ ID NO: 2330919 - protein, 7 aa, Cryptosporidium parvum
PGGPTGK

SEQ ID NO: 2330920 - protein, 5 aa, Cryptosporidium parvum
PGHES

SEQ ID NO: 2330921 - protein, 22 aa, Cryptosporidium parvum
PGIPSSSGLPPPPPPPSTTSSI

SEQ ID NO: 2330922 - protein, 6 aa, Cryptosporidium parvum
PGKHTY

SEQ ID NO: 2330923 - protein, 8 aa, Cryptosporidium parvum
PGKTSGKK

SEQ ID NO: 2330924 - protein, 5 aa, Cryptosporidium parvum
PGQRD

SEQ ID NO: 2330925 - protein, 27 aa, Cryptosporidium parvum
PGRDPYKRGFEKPDQSPPPLPPRDPSI

SEQ ID NO: 2330926 - protein, 28 aa, Cryptosporidium parvum
PGSAARKPVRSSRGQKTEVSSSIKPQNR

SEQ ID NO: 2330927 - protein, 14 aa, Cryptosporidium parvum
PGSSIQESDPPDHS

SEQ ID NO: 2330928 - protein, 9 aa, Cryptosporidium parvum
PGSTNFESR

SEQ ID NO: 2330929 - protein, 5 aa, Cryptosporidium parvum
PGTEI

SEQ ID NO: 2330930 - protein, 8 aa, Cryptosporidium parvum
PGTQQPDL

SEQ ID NO: 2330931 - protein, 11 aa, Cryptosporidium parvum
PGTTVKDGEIE

SEQ ID NO: 2330932 - protein, 5 aa, Cryptosporidium parvum
PGYPY

SEQ ID NO: 2330933 - protein, 8 aa, Cryptosporidium parvum
PGYTDSGD

SEQ ID NO: 2330934 - protein, 8 aa, Cryptosporidium parvum
PHEGLPPE

SEQ ID NO: 2330935 - protein, 5 aa, Cryptosporidium parvum
PHGCE

SEQ ID NO: 2330936 - protein, 8 aa, Cryptosporidium parvum
PHKSPTTD

SEQ ID NO: 2330937 - protein, 24 aa, Cryptosporidium parvum
PHPLPSSGSYSNGEPKKSFSSESL

SEQ ID NO: 2330938 - protein, 12 aa, Cryptosporidium parvum
PHPNPSPPKGKW

SEQ ID NO: 2330939 - protein, 8 aa, Cryptosporidium parvum
PHPRYGKY

SEQ ID NO: 2330940 - protein, 11 aa, Cryptosporidium parvum
PIASKARVREA

SEQ ID NO: 2330941 - protein, 6 aa, Cryptosporidium parvum
PIEGID

SEQ ID NO: 2330942 - protein, 5 aa, Cryptosporidium parvum
PIFTD

SEQ ID NO: 2330943 - protein, 12 aa, Cryptosporidium parvum
PIKDEQENSEFS

SEQ ID NO: 2330944 - protein, 14 aa, Cryptosporidium parvum
PIKEDDDSNFDYNT

SEQ ID NO: 2330945 - protein, 6 aa, Cryptosporidium parvum
PIKSPS

SEQ ID NO: 2330946 - protein, 10 aa, Cryptosporidium parvum
PINNNDKLSK

SEQ ID NO: 2330947 - protein, 5 aa, Cryptosporidium parvum
PINTQ

SEQ ID NO: 2330948 - protein, 6 aa, Cryptosporidium parvum
PIPNCP

SEQ ID NO: 2330949 - protein, 46 aa, Cryptosporidium parvum
PIPPSISASEPSAKEVVTEESQKKEFSPESPPSEESEVEGTSTNEI

SEQ ID NO: 2330950 - protein, 180 aa, Cryptosporidium parvum
PIQGKEKEKSEKKTDDEKKTENEKKDEKEKDEKKMEEEKERKKKVEEGKKTENEKYKKKVEDEKMAENEKDEKKTDEEKKTDNEKDEKKVEDEKMAENEKDEKKTEEEKKTDEEKKTENEKKDEKKTENEKDEKKVEDKKMAENEKKYEKKTEEEKDKKEMDEKVEEKKKTEKEDEKKRK

SEQ ID NO: 2330951 - protein, 12 aa, Cryptosporidium parvum
PIRTGKKSGKEI

SEQ ID NO: 2330952 - protein, 17 aa, Cryptosporidium parvum
PISNISSQSNQENNDYS

SEQ ID NO: 2330953 - protein, 4 aa, Cryptosporidium parvum
PITG

SEQ ID NO: 2330954 - protein, 13 aa, Cryptosporidium parvum
PITPGSNKSGSIQ

SEQ ID NO: 2330955 - protein, 22 aa, Cryptosporidium parvum
PITSETGNENEGTEDSVTEDFE

SEQ ID NO: 2330956 - protein, 6 aa, Cryptosporidium parvum
PIYPEG

SEQ ID NO: 2330957 - protein, 6 aa, Cryptosporidium parvum
PIYTPT

SEQ ID NO: 2330958 - protein, 12 aa, Cryptosporidium parvum
PKALSEEGSISP

SEQ ID NO: 2330959 - protein, 5 aa, Cryptosporidium parvum
PKATD

SEQ ID NO: 2330960 - protein, 7 aa, Cryptosporidium parvum
PKCTTKE

SEQ ID NO: 2330961 - protein, 10 aa, Cryptosporidium parvum
PKEPDCSSSI

SEQ ID NO: 2330962 - protein, 5 aa, Cryptosporidium parvum
PKETK

SEQ ID NO: 2330963 - protein, 19 aa, Cryptosporidium parvum
PKFQDGGYESTSKPDNGYY

SEQ ID NO: 2330964 - protein, 10 aa, Cryptosporidium parvum
PKGAEKESLK

SEQ ID NO: 2330965 - protein, 11 aa, Cryptosporidium parvum
PKGEENPREKK

SEQ ID NO: 2330966 - protein, 16 aa, Cryptosporidium parvum
PKGGFEPTSNNSKSGF

SEQ ID NO: 2330967 - protein, 7 aa, Cryptosporidium parvum
PKGSKYN

SEQ ID NO: 2330968 - protein, 13 aa, Cryptosporidium parvum
PKGSPNNGTYSNL

SEQ ID NO: 2330969 - protein, 6 aa, Cryptosporidium parvum
PKGTVS

SEQ ID NO: 2330970 - protein, 8 aa, Cryptosporidium parvum
PKKEDVNI

SEQ ID NO: 2330971 - protein, 5 aa, Cryptosporidium parvum
PKKKD

SEQ ID NO: 2330972 - protein, 9 aa, Cryptosporidium parvum
PKKLENNKS

SEQ ID NO: 2330973 - protein, 5 aa, Cryptosporidium parvum
PKKNG

SEQ ID NO: 2330974 - protein, 68 aa, Cryptosporidium parvum
PKKRASFSQDEEEESQERTPKISPIPKSDSKNLPKPSKDTNEEVSQTTDGRIPSTPTAKIVPPKPAAR

SEQ ID NO: 2330975 - protein, 14 aa, Cryptosporidium parvum
PKKTCEGGIEPDSD

SEQ ID NO: 2330976 - protein, 8 aa, Cryptosporidium parvum
PKMDPQDY

SEQ ID NO: 2330977 - protein, 9 aa, Cryptosporidium parvum
PKNAFDGNN

SEQ ID NO: 2330978 - protein, 8 aa, Cryptosporidium parvum
PKNGNVEK

SEQ ID NO: 2330979 - protein, 15 aa, Cryptosporidium parvum
PKNKSREKKRGITPS

SEQ ID NO: 2330980 - protein, 13 aa, Cryptosporidium parvum
PKNPGCPCDKEPK

SEQ ID NO: 2330981 - protein, 11 aa, Cryptosporidium parvum
PKQIEKEPKDL

SEQ ID NO: 2330982 - protein, 4 aa, Cryptosporidium parvum
PKQV

SEQ ID NO: 2330983 - protein, 14 aa, Cryptosporidium parvum
PKRTGILEDTGSPS

SEQ ID NO: 2330984 - protein, 7 aa, Cryptosporidium parvum
PKSEFQC

SEQ ID NO: 2330985 - protein, 6 aa, Cryptosporidium parvum
PKSERQ

SEQ ID NO: 2330986 - protein, 13 aa, Cryptosporidium parvum
PKSSSIYTQPSQR

SEQ ID NO: 2330987 - protein, 5 aa, Cryptosporidium parvum
PKTAN

SEQ ID NO: 2330988 - protein, 5 aa, Cryptosporidium parvum
PKTRD

SEQ ID NO: 2330989 - protein, 5 aa, Cryptosporidium parvum
PKTVS

SEQ ID NO: 2330990 - protein, 5 aa, Cryptosporidium parvum
PKYKE

SEQ ID NO: 2330991 - protein, 8 aa, Cryptosporidium parvum
PLEDSTPS

SEQ ID NO: 2330992 - protein, 7 aa, Cryptosporidium parvum
PLEESDP

SEQ ID NO: 2330993 - protein, 12 aa, Cryptosporidium parvum
PLESDDSISGYK

SEQ ID NO: 2330994 - protein, 7 aa, Cryptosporidium parvum
PLESRSK

SEQ ID NO: 2330995 - protein, 4 aa, Cryptosporidium parvum
PLGS

SEQ ID NO: 2330996 - protein, 107 aa, Cryptosporidium parvum
PLGSGVTSKPSAPSRLSKPLGPGSGVKPLGSGVTPKPSAPSRPSKPLGPGSGVKPLGTGVTPKPSAPSSSSKPLKPGSTGASRASATGVAPRVSATGLTKPTSSGLS

SEQ ID NO: 2330997 - protein, 6 aa, Cryptosporidium parvum
PLISTQ

SEQ ID NO: 2330998 - protein, 10 aa, Cryptosporidium parvum
PLNNSHGQNR

SEQ ID NO: 2330999 - protein, 4 aa, Cryptosporidium parvum
PLNP

SEQ ID NO: 2331000 - protein, 5 aa, Cryptosporidium parvum
PLSAS

SEQ ID NO: 2331001 - protein, 4 aa, Cryptosporidium parvum
PLSG

SEQ ID NO: 2331002 - protein, 4 aa, Cryptosporidium parvum
PLSI

SEQ ID NO: 2331003 - protein, 5 aa, Cryptosporidium parvum
PLSIS

SEQ ID NO: 2331004 - protein, 4 aa, Cryptosporidium parvum
PLTT

SEQ ID NO: 2331005 - protein, 5 aa, Cryptosporidium parvum
PLTTK

SEQ ID NO: 2331006 - protein, 12 aa, Cryptosporidium parvum
PMSGDNKDINSE

SEQ ID NO: 2331007 - protein, 8 aa, Cryptosporidium parvum
PMTGESYY

SEQ ID NO: 2331008 - protein, 5 aa, Cryptosporidium parvum
PNCSA

SEQ ID NO: 2331009 - protein, 10 aa, Cryptosporidium parvum
PNDGQSYKKR

SEQ ID NO: 2331010 - protein, 6 aa, Cryptosporidium parvum
PNEENV

SEQ ID NO: 2331011 - protein, 14 aa, Cryptosporidium parvum
PNEISSDHSNLSND

SEQ ID NO: 2331012 - protein, 10 aa, Cryptosporidium parvum
PNEQGNRITP

SEQ ID NO: 2331013 - protein, 8 aa, Cryptosporidium parvum
PNESSELA

SEQ ID NO: 2331014 - protein, 6 aa, Cryptosporidium parvum
PNFGSD

SEQ ID NO: 2331015 - protein, 18 aa, Cryptosporidium parvum
PNFRSGSSTLTSKTAIVR

SEQ ID NO: 2331016 - protein, 9 aa, Cryptosporidium parvum
PNFSQSQKE

SEQ ID NO: 2331017 - protein, 8 aa, Cryptosporidium parvum
PNGKESKN

SEQ ID NO: 2331018 - protein, 4 aa, Cryptosporidium parvum
PNGN

SEQ ID NO: 2331019 - protein, 4 aa, Cryptosporidium parvum
PNGQ

SEQ ID NO: 2331020 - protein, 5 aa, Cryptosporidium parvum
PNKID

SEQ ID NO: 2331021 - protein, 24 aa, Cryptosporidium parvum
PNKRSSRRERSKHSKQPNQRAGRA

SEQ ID NO: 2331022 - protein, 11 aa, Cryptosporidium parvum
PNKSNFTNSTL

SEQ ID NO: 2331023 - protein, 5 aa, Cryptosporidium parvum
PNKYT

SEQ ID NO: 2331024 - protein, 11 aa, Cryptosporidium parvum
PNNISNEDYTE

SEQ ID NO: 2331025 - protein, 8 aa, Cryptosporidium parvum
PNNTSNEL

SEQ ID NO: 2331026 - protein, 11 aa, Cryptosporidium parvum
PNPESKGRKDL

SEQ ID NO: 2331027 - protein, 6 aa, Cryptosporidium parvum
PNPYDR

SEQ ID NO: 2331028 - protein, 7 aa, Cryptosporidium parvum
PNPYSEG

SEQ ID NO: 2331029 - protein, 7 aa, Cryptosporidium parvum
PNPYSQN

SEQ ID NO: 2331030 - protein, 4 aa, Cryptosporidium parvum
PNQI

SEQ ID NO: 2331031 - protein, 5 aa, Cryptosporidium parvum
PNQSK

SEQ ID NO: 2331032 - protein, 20 aa, Cryptosporidium parvum
PNRKLEKDQVTEESENEELG

SEQ ID NO: 2331033 - protein, 19 aa, Cryptosporidium parvum
PNSAGEDLSEKTEDSDSND

SEQ ID NO: 2331034 - protein, 11 aa, Cryptosporidium parvum
PNSDQENLSRE

SEQ ID NO: 2331035 - protein, 5 aa, Cryptosporidium parvum
PNSSE

SEQ ID NO: 2331036 - protein, 29 aa, Cryptosporidium parvum
PNSSSGGTNGGIGGGNNGNNGNNNGNTIP

SEQ ID NO: 2331037 - protein, 7 aa, Cryptosporidium parvum
PNSSTIE

SEQ ID NO: 2331038 - protein, 15 aa, Cryptosporidium parvum
PNTKSFNPSQIYNYN

SEQ ID NO: 2331039 - protein, 13 aa, Cryptosporidium parvum
PNTNCTKKNPCKK

SEQ ID NO: 2331040 - protein, 4 aa, Cryptosporidium parvum
PNTP

SEQ ID NO: 2331041 - protein, 5 aa, Cryptosporidium parvum
PNVDE

SEQ ID NO: 2331042 - protein, 5 aa, Cryptosporidium parvum
PNYGS

SEQ ID NO: 2331043 - protein, 5 aa, Cryptosporidium parvum
PNYNS

SEQ ID NO: 2331044 - protein, 11 aa, Cryptosporidium parvum
PNYPGGRYPPY

SEQ ID NO: 2331045 - protein, 4 aa, Cryptosporidium parvum
PPAG

SEQ ID NO: 2331046 - protein, 8 aa, Cryptosporidium parvum
PPCSNGKV

SEQ ID NO: 2331047 - protein, 16 aa, Cryptosporidium parvum
PPDGWDANDDSVYPKN

SEQ ID NO: 2331048 - protein, 5 aa, Cryptosporidium parvum
PPDSV

SEQ ID NO: 2331049 - protein, 6 aa, Cryptosporidium parvum
PPENFE

SEQ ID NO: 2331050 - protein, 13 aa, Cryptosporidium parvum
PPEPTGPQYEDGN

SEQ ID NO: 2331051 - protein, 4 aa, Cryptosporidium parvum
PPES

SEQ ID NO: 2331052 - protein, 4 aa, Cryptosporidium parvum
PPFV

SEQ ID NO: 2331053 - protein, 4 aa, Cryptosporidium parvum
PPGF

SEQ ID NO: 2331054 - protein, 10 aa, Cryptosporidium parvum
PPGSGKGTQC

SEQ ID NO: 2331055 - protein, 6 aa, Cryptosporidium parvum
PPIDPI

SEQ ID NO: 2331056 - protein, 10 aa, Cryptosporidium parvum
PPKKVDGIAD

SEQ ID NO: 2331057 - protein, 108 aa, Cryptosporidium parvum
PPLPPLPPLPPTPKAPTIPPPTLPPTPISTPTIPPPTLPPPTLPPPTLPPPTLPPPTLPPTPTPTPPTPPQAPGQTITSGYPSDLNQQPSTNIDITTDEGDYQSDSDD

SEQ ID NO: 2331058 - protein, 8 aa, Cryptosporidium parvum
PPLRRPEG

SEQ ID NO: 2331059 - protein, 5 aa, Cryptosporidium parvum
PPNGE

SEQ ID NO: 2331060 - protein, 19 aa, Cryptosporidium parvum
PPPLSSHGVPPSGPSSIHS

SEQ ID NO: 2331061 - protein, 14 aa, Cryptosporidium parvum
PPPPPFPAPQAPVE

SEQ ID NO: 2331062 - protein, 14 aa, Cryptosporidium parvum
PPQTQSQSIRPPPV

SEQ ID NO: 2331063 - protein, 11 aa, Cryptosporidium parvum
PPSENLSSPKL

SEQ ID NO: 2331064 - protein, 11 aa, Cryptosporidium parvum
PPSHNGEEYYS

SEQ ID NO: 2331065 - protein, 24 aa, Cryptosporidium parvum
PPSQLQPYDVGDTASRALSPADQL

SEQ ID NO: 2331066 - protein, 10 aa, Cryptosporidium parvum
PPSVAARQGL

SEQ ID NO: 2331067 - protein, 4 aa, Cryptosporidium parvum
PPSY

SEQ ID NO: 2331068 - protein, 9 aa, Cryptosporidium parvum
PPSYTLPKS

SEQ ID NO: 2331069 - protein, 14 aa, Cryptosporidium parvum
PPTDSNSETVPLPP

SEQ ID NO: 2331070 - protein, 4 aa, Cryptosporidium parvum
PPTH

SEQ ID NO: 2331071 - protein, 5 aa, Cryptosporidium parvum
PPTME

SEQ ID NO: 2331072 - protein, 4 aa, Cryptosporidium parvum
PPYA

SEQ ID NO: 2331073 - protein, 4 aa, Cryptosporidium parvum
PQCG

SEQ ID NO: 2331074 - protein, 13 aa, Cryptosporidium parvum
PQGYRNANGIQTA

SEQ ID NO: 2331075 - protein, 18 aa, Cryptosporidium parvum
PQNETRSQKNKNVRRPST

SEQ ID NO: 2331076 - protein, 18 aa, Cryptosporidium parvum
PQNISKPINRSVEASTSQ

SEQ ID NO: 2331077 - protein, 10 aa, Cryptosporidium parvum
PQNKYGQSYE

SEQ ID NO: 2331078 - protein, 9 aa, Cryptosporidium parvum
PQNSQEEEF

SEQ ID NO: 2331079 - protein, 13 aa, Cryptosporidium parvum
PQPSSGDASSERA

SEQ ID NO: 2331080 - protein, 15 aa, Cryptosporidium parvum
PQPTQLNTGAAGYGY

SEQ ID NO: 2331081 - protein, 14 aa, Cryptosporidium parvum
PQSAQPPPVNPPNS

SEQ ID NO: 2331082 - protein, 6 aa, Cryptosporidium parvum
PQSSDL

SEQ ID NO: 2331083 - protein, 8 aa, Cryptosporidium parvum
PQVSTPEE

SEQ ID NO: 2331084 - protein, 7 aa, Cryptosporidium parvum
PRESKSP

SEQ ID NO: 2331085 - protein, 9 aa, Cryptosporidium parvum
PRETEISEI

SEQ ID NO: 2331086 - protein, 17 aa, Cryptosporidium parvum
PRGGYKSSSSSNSNPNL

SEQ ID NO: 2331087 - protein, 10 aa, Cryptosporidium parvum
PRIGPDPRDP

SEQ ID NO: 2331088 - protein, 7 aa, Cryptosporidium parvum
PRNDIPN

SEQ ID NO: 2331089 - protein, 7 aa, Cryptosporidium parvum
PRNGKEI

SEQ ID NO: 2331090 - protein, 7 aa, Cryptosporidium parvum
PRNQNNL

SEQ ID NO: 2331091 - protein, 10 aa, Cryptosporidium parvum
PRNSMNGNNI

SEQ ID NO: 2331092 - protein, 5 aa, Cryptosporidium parvum
PRPYC

SEQ ID NO: 2331093 - protein, 4 aa, Cryptosporidium parvum
PRQI

SEQ ID NO: 2331094 - protein, 6 aa, Cryptosporidium parvum
PRQKEK

SEQ ID NO: 2331095 - protein, 5 aa, Cryptosporidium parvum
PRRPK

SEQ ID NO: 2331096 - protein, 10 aa, Cryptosporidium parvum
PRRSFSSEIP

SEQ ID NO: 2331097 - protein, 6 aa, Cryptosporidium parvum
PRSKWR

SEQ ID NO: 2331098 - protein, 6 aa, Cryptosporidium parvum
PRSTPG

SEQ ID NO: 2331099 - protein, 5 aa, Cryptosporidium parvum
PRSVP

SEQ ID NO: 2331100 - protein, 4 aa, Cryptosporidium parvum
PRTK

SEQ ID NO: 2331101 - protein, 7 aa, Cryptosporidium parvum
PRTSTVD

SEQ ID NO: 2331102 - protein, 7 aa, Cryptosporidium parvum
PRVNRSN

SEQ ID NO: 2331103 - protein, 11 aa, Cryptosporidium parvum
PRYIPSNEEMR

SEQ ID NO: 2331104 - protein, 4 aa, Cryptosporidium parvum
PSAP

SEQ ID NO: 2331105 - protein, 9 aa, Cryptosporidium parvum
PSAPPTAPV

SEQ ID NO: 2331106 - protein, 15 aa, Cryptosporidium parvum
PSAPSIPPSIPPPIR

SEQ ID NO: 2331107 - protein, 5 aa, Cryptosporidium parvum
PSCRN

SEQ ID NO: 2331108 - protein, 15 aa, Cryptosporidium parvum
PSDEQIPNGKPNSDL

SEQ ID NO: 2331109 - protein, 5 aa, Cryptosporidium parvum
PSDQN

SEQ ID NO: 2331110 - protein, 8 aa, Cryptosporidium parvum
PSEESRNS

SEQ ID NO: 2331111 - protein, 10 aa, Cryptosporidium parvum
PSESEKVPEI

SEQ ID NO: 2331112 - protein, 5 aa, Cryptosporidium parvum
PSESG

SEQ ID NO: 2331113 - protein, 5 aa, Cryptosporidium parvum
PSETF

SEQ ID NO: 2331114 - protein, 8 aa, Cryptosporidium parvum
PSEVKSAM

SEQ ID NO: 2331115 - protein, 14 aa, Cryptosporidium parvum
PSEVSISKSQTQKI

SEQ ID NO: 2331116 - protein, 4 aa, Cryptosporidium parvum
PSFN

SEQ ID NO: 2331117 - protein, 6 aa, Cryptosporidium parvum
PSFNPE

SEQ ID NO: 2331118 - protein, 23 aa, Cryptosporidium parvum
PSGDFPAPKEYSQADQGTSTETH

SEQ ID NO: 2331119 - protein, 5 aa, Cryptosporidium parvum
PSGSA

SEQ ID NO: 2331120 - protein, 8 aa, Cryptosporidium parvum
PSGSGKKT

SEQ ID NO: 2331121 - protein, 17 aa, Cryptosporidium parvum
PSGSSNSGSTALSQSKL

SEQ ID NO: 2331122 - protein, 10 aa, Cryptosporidium parvum
PSGTSDGHGK

SEQ ID NO: 2331123 - protein, 21 aa, Cryptosporidium parvum
PSISTKSHREYNTRAGGYPAL

SEQ ID NO: 2331124 - protein, 24 aa, Cryptosporidium parvum
PSKGLGSGAPRPGKSPKKDKFGNP

SEQ ID NO: 2331125 - protein, 8 aa, Cryptosporidium parvum
PSKKPDYY

SEQ ID NO: 2331126 - protein, 4 aa, Cryptosporidium parvum
PSKM

SEQ ID NO: 2331127 - protein, 10 aa, Cryptosporidium parvum
PSKPKGKNTI

SEQ ID NO: 2331128 - protein, 8 aa, Cryptosporidium parvum
PSKSFSSN

SEQ ID NO: 2331129 - protein, 6 aa, Cryptosporidium parvum
PSKSSI

SEQ ID NO: 2331130 - protein, 8 aa, Cryptosporidium parvum
PSKSTKYR

SEQ ID NO: 2331131 - protein, 7 aa, Cryptosporidium parvum
PSLDGKE

SEQ ID NO: 2331132 - protein, 8 aa, Cryptosporidium parvum
PSLGPSNN

SEQ ID NO: 2331133 - protein, 92 aa, Cryptosporidium parvum
PSLGTSGPDFSNEGYQSGDEDNNEGNDDTSSVTSSSSSSSSSSSSSSSSSSSSSSSSSSGSSSSGSSSSGSSSSGSSSSSSPPVNGNEYDTK

SEQ ID NO: 2331134 - protein, 11 aa, Cryptosporidium parvum
PSLKPEPSSKF

SEQ ID NO: 2331135 - protein, 13 aa, Cryptosporidium parvum
PSLRSDEKINVES

SEQ ID NO: 2331136 - protein, 13 aa, Cryptosporidium parvum
PSNFPKTGYRGCG

SEQ ID NO: 2331137 - protein, 7 aa, Cryptosporidium parvum
PSNSKLD

SEQ ID NO: 2331138 - protein, 27 aa, Cryptosporidium parvum
PSPISTTTTTTTATTTTTTTTTTTTTA

SEQ ID NO: 2331139 - protein, 46 aa, Cryptosporidium parvum
PSPPPPPPSIAPEHEPEHPPSSSPPPPPPPPPPPPSGCSCGNEKPL

SEQ ID NO: 2331140 - protein, 9 aa, Cryptosporidium parvum
PSQDETGKY

SEQ ID NO: 2331141 - protein, 5 aa, Cryptosporidium parvum
PSQPV

SEQ ID NO: 2331142 - protein, 8 aa, Cryptosporidium parvum
PSRLPEQT

SEQ ID NO: 2331143 - protein, 8 aa, Cryptosporidium parvum
PSSDLSTT

SEQ ID NO: 2331144 - protein, 7 aa, Cryptosporidium parvum
PSSGGIS

SEQ ID NO: 2331145 - protein, 6 aa, Cryptosporidium parvum
PSSIPD

SEQ ID NO: 2331146 - protein, 18 aa, Cryptosporidium parvum
PSSIPEDTCSTSTSGSQE

SEQ ID NO: 2331147 - protein, 5 aa, Cryptosporidium parvum
PSSNI

SEQ ID NO: 2331148 - protein, 10 aa, Cryptosporidium parvum
PSSNPTNYKS

SEQ ID NO: 2331149 - protein, 9 aa, Cryptosporidium parvum
PSSTNSGFA

SEQ ID NO: 2331150 - protein, 33 aa, Cryptosporidium parvum
PSSTSTTTTTTTTTTTTTTTTTTTTTTSTTTHG

SEQ ID NO: 2331151 - protein, 11 aa, Cryptosporidium parvum
PSTIPESGFTR

SEQ ID NO: 2331152 - protein, 6 aa, Cryptosporidium parvum
PSTKPF

SEQ ID NO: 2331153 - protein, 8 aa, Cryptosporidium parvum
PSTQGTKW

SEQ ID NO: 2331154 - protein, 7 aa, Cryptosporidium parvum
PSTSFKE

SEQ ID NO: 2331155 - protein, 12 aa, Cryptosporidium parvum
PSVLKEKASSAW

SEQ ID NO: 2331156 - protein, 12 aa, Cryptosporidium parvum
PSYQEKKISNLN

SEQ ID NO: 2331157 - protein, 6 aa, Cryptosporidium parvum
PSYREE

SEQ ID NO: 2331158 - protein, 5 aa, Cryptosporidium parvum
PTEAP

SEQ ID NO: 2331159 - protein, 12 aa, Cryptosporidium parvum
PTEASLATTQCS

SEQ ID NO: 2331160 - protein, 7 aa, Cryptosporidium parvum
PTEITES

SEQ ID NO: 2331161 - protein, 4 aa, Cryptosporidium parvum
PTER

SEQ ID NO: 2331162 - protein, 13 aa, Cryptosporidium parvum
PTFAKEGSSINYK

SEQ ID NO: 2331163 - protein, 8 aa, Cryptosporidium parvum
PTGRNPGG

SEQ ID NO: 2331164 - protein, 4 aa, Cryptosporidium parvum
PTKR

SEQ ID NO: 2331165 - protein, 9 aa, Cryptosporidium parvum
PTKSEYNQE

SEQ ID NO: 2331166 - protein, 10 aa, Cryptosporidium parvum
PTKSNNQMLN

SEQ ID NO: 2331167 - protein, 13 aa, Cryptosporidium parvum
PTKTTQIRKTTID

SEQ ID NO: 2331168 - protein, 10 aa, Cryptosporidium parvum
PTLSRNSRLD

SEQ ID NO: 2331169 - protein, 8 aa, Cryptosporidium parvum
PTNKNGKL

SEQ ID NO: 2331170 - protein, 16 aa, Cryptosporidium parvum
PTNTTDERDTSKKSST

SEQ ID NO: 2331171 - protein, 5 aa, Cryptosporidium parvum
PTPNA

SEQ ID NO: 2331172 - protein, 12 aa, Cryptosporidium parvum
PTPNNRADSPRI

SEQ ID NO: 2331173 - protein, 5 aa, Cryptosporidium parvum
PTPTP

SEQ ID NO: 2331174 - protein, 10 aa, Cryptosporidium parvum
PTQNITQNSL

SEQ ID NO: 2331175 - protein, 6 aa, Cryptosporidium parvum
PTQTYT

SEQ ID NO: 2331176 - protein, 8 aa, Cryptosporidium parvum
PTSDDTRP

SEQ ID NO: 2331177 - protein, 5 aa, Cryptosporidium parvum
PTSPV

SEQ ID NO: 2331178 - protein, 7 aa, Cryptosporidium parvum
PTSREEI

SEQ ID NO: 2331179 - protein, 17 aa, Cryptosporidium parvum
PTSSDQSKVNIKDESQI

SEQ ID NO: 2331180 - protein, 5 aa, Cryptosporidium parvum
PTSSF

SEQ ID NO: 2331181 - protein, 13 aa, Cryptosporidium parvum
PTTAPKLVKPPSS

SEQ ID NO: 2331182 - protein, 15 aa, Cryptosporidium parvum
PTYEGRNASFPASRT

SEQ ID NO: 2331183 - protein, 11 aa, Cryptosporidium parvum
PVCGPPEEREE

SEQ ID NO: 2331184 - protein, 6 aa, Cryptosporidium parvum
PVDISE

SEQ ID NO: 2331185 - protein, 9 aa, Cryptosporidium parvum
PVGSPNSQW

SEQ ID NO: 2331186 - protein, 5 aa, Cryptosporidium parvum
PVKAD

SEQ ID NO: 2331187 - protein, 21 aa, Cryptosporidium parvum
PVNKQSSSHDTASLPASRTGA

SEQ ID NO: 2331188 - protein, 14 aa, Cryptosporidium parvum
PVPAPTVPTPAQAT

SEQ ID NO: 2331189 - protein, 44 aa, Cryptosporidium parvum
PVTTPVATPIPAPRTTTTTTTTTTTTTTTTTTTTTTSPTESPKF

SEQ ID NO: 2331190 - protein, 7 aa, Cryptosporidium parvum
PVYSPSG

SEQ ID NO: 2331191 - protein, 6 aa, Cryptosporidium parvum
PYATPA

SEQ ID NO: 2331192 - protein, 4 aa, Cryptosporidium parvum
PYKE

SEQ ID NO: 2331193 - protein, 6 aa, Cryptosporidium parvum
PYKNKT

SEQ ID NO: 2331194 - protein, 7 aa, Cryptosporidium parvum
PYKPEDL

SEQ ID NO: 2331195 - protein, 124 aa, Cryptosporidium parvum
PYPAQNSSLTPISNQTQYSTNNTTNGITLEPNSNKNATERSKSQNPDQSSEMSHSKKQDFSPSYRESSITSSRKEKKRSKSGSKSRSKPRSRSRSQNSKEKQEFQNNKKVKKRSQNSPNPKQSF

SEQ ID NO: 2331196 - protein, 4 aa, Cryptosporidium parvum
PYPI

SEQ ID NO: 2331197 - protein, 5 aa, Cryptosporidium parvum
PYPNP

SEQ ID NO: 2331198 - protein, 6 aa, Cryptosporidium parvum
PYPSTF

SEQ ID NO: 2331199 - protein, 9 aa, Cryptosporidium parvum
PYRGGESEV

SEQ ID NO: 2331200 - protein, 4 aa, Cryptosporidium parvum
PYSP

SEQ ID NO: 2331201 - protein, 8 aa, Cryptosporidium parvum
PYTDPYAG

SEQ ID NO: 2331202 - protein, 16 aa, Cryptosporidium parvum
PYTNESLSYSGREENI

SEQ ID NO: 2331203 - protein, 10 aa, Cryptosporidium parvum
PYTPGKNSSN

SEQ ID NO: 2331204 - protein, 4 aa, Cryptosporidium parvum
PYTT

SEQ ID NO: 2331205 - protein, 16 aa, Cryptosporidium parvum
QAEIDPKKNPEKAAAI

SEQ ID NO: 2331206 - protein, 4 aa, Cryptosporidium parvum
QAGI

SEQ ID NO: 2331207 - protein, 6 aa, Cryptosporidium parvum
QAGSEV

SEQ ID NO: 2331208 - protein, 4 aa, Cryptosporidium parvum
QAIQ

SEQ ID NO: 2331209 - protein, 15 aa, Cryptosporidium parvum
QAKEEMKRQRKRTRF

SEQ ID NO: 2331210 - protein, 6 aa, Cryptosporidium parvum
QAKENI

SEQ ID NO: 2331211 - protein, 5 aa, Cryptosporidium parvum
QAKNL

SEQ ID NO: 2331212 - protein, 14 aa, Cryptosporidium parvum
QANQPNVSEYNSEQ

SEQ ID NO: 2331213 - protein, 4 aa, Cryptosporidium parvum
QAPS

SEQ ID NO: 2331214 - protein, 7 aa, Cryptosporidium parvum
QAPSFPD

SEQ ID NO: 2331215 - protein, 6 aa, Cryptosporidium parvum
QAQPIV

SEQ ID NO: 2331216 - protein, 5 aa, Cryptosporidium parvum
QASIN

SEQ ID NO: 2331217 - protein, 8 aa, Cryptosporidium parvum
QATASSVG

SEQ ID NO: 2331218 - protein, 11 aa, Cryptosporidium parvum
QATSGPNSPFG

SEQ ID NO: 2331219 - protein, 4 aa, Cryptosporidium parvum
QAVS

SEQ ID NO: 2331220 - protein, 8 aa, Cryptosporidium parvum
QAVTEGDS

SEQ ID NO: 2331221 - protein, 79 aa, Cryptosporidium parvum
QAVTSNPRRRSSSSPPSLPSSPWKHSSSSSSPSRRPIRQRSSSLPPRTSRKHEHTPTTSTSESFQSSQSKQKPPRPPLP

SEQ ID NO: 2331222 - protein, 6 aa, Cryptosporidium parvum
QCDDEG

SEQ ID NO: 2331223 - protein, 6 aa, Cryptosporidium parvum
QCDNSN

SEQ ID NO: 2331224 - protein, 6 aa, Cryptosporidium parvum
QCEDEN

SEQ ID NO: 2331225 - protein, 24 aa, Cryptosporidium parvum
QCQQEGTKKQKGNRCNTCEKRANA

SEQ ID NO: 2331226 - protein, 5 aa, Cryptosporidium parvum
QCQSI

SEQ ID NO: 2331227 - protein, 5 aa, Cryptosporidium parvum
QCSQT

SEQ ID NO: 2331228 - protein, 14 aa, Cryptosporidium parvum
QDASSSPESKTLGE

SEQ ID NO: 2331229 - protein, 9 aa, Cryptosporidium parvum
QDDFNPDNY

SEQ ID NO: 2331230 - protein, 29 aa, Cryptosporidium parvum
QDEDDYEGKSDSEQEKLDDLDPGSEEQKK

SEQ ID NO: 2331231 - protein, 4 aa, Cryptosporidium parvum
QDEH

SEQ ID NO: 2331232 - protein, 5 aa, Cryptosporidium parvum
QDEIT

SEQ ID NO: 2331233 - protein, 17 aa, Cryptosporidium parvum
QDEKITNRNSNFSENKR

SEQ ID NO: 2331234 - protein, 6 aa, Cryptosporidium parvum
QDELPQ

SEQ ID NO: 2331235 - protein, 20 aa, Cryptosporidium parvum
QDENRELSTRIRDGSCGNHE

SEQ ID NO: 2331236 - protein, 21 aa, Cryptosporidium parvum
QDFKPTPSKQPKLPSKDVESR

SEQ ID NO: 2331237 - protein, 4 aa, Cryptosporidium parvum
QDFN

SEQ ID NO: 2331238 - protein, 5 aa, Cryptosporidium parvum
QDFSE

SEQ ID NO: 2331239 - protein, 16 aa, Cryptosporidium parvum
QDGSHTYDKSKLNELN

SEQ ID NO: 2331240 - protein, 9 aa, Cryptosporidium parvum
QDGTRSKEC

SEQ ID NO: 2331241 - protein, 4 aa, Cryptosporidium parvum
QDKQ

SEQ ID NO: 2331242 - protein, 8 aa, Cryptosporidium parvum
QDKRGNYR

SEQ ID NO: 2331243 - protein, 9 aa, Cryptosporidium parvum
QDLSNNGAD

SEQ ID NO: 2331244 - protein, 16 aa, Cryptosporidium parvum
QDPSNPGGNSPNNNTY

SEQ ID NO: 2331245 - protein, 8 aa, Cryptosporidium parvum
QDQGSAEI

SEQ ID NO: 2331246 - protein, 12 aa, Cryptosporidium parvum
QDQTNNSNVNNK

SEQ ID NO: 2331247 - protein, 8 aa, Cryptosporidium parvum
QDRGSVGI

SEQ ID NO: 2331248 - protein, 8 aa, Cryptosporidium parvum
QDSKYSNL

SEQ ID NO: 2331249 - protein, 9 aa, Cryptosporidium parvum
QDSPNPTEI

SEQ ID NO: 2331250 - protein, 9 aa, Cryptosporidium parvum
QDTPANEGK

SEQ ID NO: 2331251 - protein, 14 aa, Cryptosporidium parvum
QDTPRWESTSSGLS

SEQ ID NO: 2331252 - protein, 12 aa, Cryptosporidium parvum
QDYKGYSKDLPA

SEQ ID NO: 2331253 - protein, 12 aa, Cryptosporidium parvum
QEDHEPPEVPKR

SEQ ID NO: 2331254 - protein, 7 aa, Cryptosporidium parvum
QEEALEK

SEQ ID NO: 2331255 - protein, 31 aa, Cryptosporidium parvum
QEEASEKKSAISETIKEQKMSNQKQSKRDKI

SEQ ID NO: 2331256 - protein, 22 aa, Cryptosporidium parvum
QEECKKKSKKISGNKSGNKLAK

SEQ ID NO: 2331257 - protein, 4 aa, Cryptosporidium parvum
QEEE

SEQ ID NO: 2331258 - protein, 4 aa, Cryptosporidium parvum
QEEK

SEQ ID NO: 2331259 - protein, 10 aa, Cryptosporidium parvum
QEEKSLEGSQ

SEQ ID NO: 2331260 - protein, 74 aa, Cryptosporidium parvum
QEEPSQPSQPSQPSQPSQPSQPLQPLQPSQPLQPSQPLQPLKPSQHSQDSQLRTHTRTRRRADEPLQNAPTRPT

SEQ ID NO: 2331261 - protein, 6 aa, Cryptosporidium parvum
QEFSGT

SEQ ID NO: 2331262 - protein, 6 aa, Cryptosporidium parvum
QEGNNL

SEQ ID NO: 2331263 - protein, 9 aa, Cryptosporidium parvum
QEGSNAPVP

SEQ ID NO: 2331264 - protein, 23 aa, Cryptosporidium parvum
QEHAAKPASRTGAPAPGAPAGNL

SEQ ID NO: 2331265 - protein, 5 aa, Cryptosporidium parvum
QEHSE

SEQ ID NO: 2331266 - protein, 13 aa, Cryptosporidium parvum
QEHYKKDKKLNTT

SEQ ID NO: 2331267 - protein, 6 aa, Cryptosporidium parvum
QEINEE

SEQ ID NO: 2331268 - protein, 23 aa, Cryptosporidium parvum
QEKTNDELKEDELGYEGDSEGIG

SEQ ID NO: 2331269 - protein, 8 aa, Cryptosporidium parvum
QEKTSSQP

SEQ ID NO: 2331270 - protein, 12 aa, Cryptosporidium parvum
QELSSKKRSFWR

SEQ ID NO: 2331271 - protein, 27 aa, Cryptosporidium parvum
QENEQELKRREEEEKKKEEERRRLEEE

SEQ ID NO: 2331272 - protein, 6 aa, Cryptosporidium parvum
QENKRA

SEQ ID NO: 2331273 - protein, 11 aa, Cryptosporidium parvum
QENNKNSLSEE

SEQ ID NO: 2331274 - protein, 21 aa, Cryptosporidium parvum
QENNQTGFNSNSKATRISDRH

SEQ ID NO: 2331275 - protein, 8 aa, Cryptosporidium parvum
QENSGLGP

SEQ ID NO: 2331276 - protein, 5 aa, Cryptosporidium parvum
QEPEY

SEQ ID NO: 2331277 - protein, 54 aa, Cryptosporidium parvum
QEQDSESEKEFEQESEGEPEQDTEKESEREFDKSKETSSKIEESSKPSEKSTGI

SEQ ID NO: 2331278 - protein, 23 aa, Cryptosporidium parvum
QEQEQEQEQEREQGQEQEQEQVQ

SEQ ID NO: 2331279 - protein, 4 aa, Cryptosporidium parvum
QEQK

SEQ ID NO: 2331280 - protein, 11 aa, Cryptosporidium parvum
QEQSGMTETEL

SEQ ID NO: 2331281 - protein, 28 aa, Cryptosporidium parvum
QEQTGFTGYDSPIQETSGLEATNYEARD

SEQ ID NO: 2331282 - protein, 9 aa, Cryptosporidium parvum
QERMEGERE

SEQ ID NO: 2331283 - protein, 18 aa, Cryptosporidium parvum
QESASSGGADSKLSLGTT

SEQ ID NO: 2331284 - protein, 7 aa, Cryptosporidium parvum
QESNPQV

SEQ ID NO: 2331285 - protein, 10 aa, Cryptosporidium parvum
QESRDQSIGN

SEQ ID NO: 2331286 - protein, 6 aa, Cryptosporidium parvum
QETPEG

SEQ ID NO: 2331287 - protein, 9 aa, Cryptosporidium parvum
QEVSSSQNM

SEQ ID NO: 2331288 - protein, 5 aa, Cryptosporidium parvum
QEWNR

SEQ ID NO: 2331289 - protein, 20 aa, Cryptosporidium parvum
QEYESTSHEYNTNNNKDSCY

SEQ ID NO: 2331290 - protein, 4 aa, Cryptosporidium parvum
QEYG

SEQ ID NO: 2331291 - protein, 21 aa, Cryptosporidium parvum
QEYPENRESKKSLLKKRSDEF

SEQ ID NO: 2331292 - protein, 6 aa, Cryptosporidium parvum
QEYPSE

SEQ ID NO: 2331293 - protein, 8 aa, Cryptosporidium parvum
QFNQPVTS

SEQ ID NO: 2331294 - protein, 11 aa, Cryptosporidium parvum
QFPMSSSKNYG

SEQ ID NO: 2331295 - protein, 8 aa, Cryptosporidium parvum
QGALGKNS

SEQ ID NO: 2331296 - protein, 6 aa, Cryptosporidium parvum
QGCEGG

SEQ ID NO: 2331297 - protein, 5 aa, Cryptosporidium parvum
QGCGG

SEQ ID NO: 2331298 - protein, 11 aa, Cryptosporidium parvum
QGDANKASENC

SEQ ID NO: 2331299 - protein, 14 aa, Cryptosporidium parvum
QGDLEEVDQGIKKS

SEQ ID NO: 2331300 - protein, 5 aa, Cryptosporidium parvum
QGEAL

SEQ ID NO: 2331301 - protein, 12 aa, Cryptosporidium parvum
QGEENDNGEGIE

SEQ ID NO: 2331302 - protein, 11 aa, Cryptosporidium parvum
QGEGIENNNIK

SEQ ID NO: 2331303 - protein, 5 aa, Cryptosporidium parvum
QGGAL

SEQ ID NO: 2331304 - protein, 4 aa, Cryptosporidium parvum
QGGG

SEQ ID NO: 2331305 - protein, 7 aa, Cryptosporidium parvum
QGMGSQE

SEQ ID NO: 2331306 - protein, 5 aa, Cryptosporidium parvum
QGNQC

SEQ ID NO: 2331307 - protein, 8 aa, Cryptosporidium parvum
QGPQGCRD

SEQ ID NO: 2331308 - protein, 18 aa, Cryptosporidium parvum
QGPSDFAKPRGESSRSEV

SEQ ID NO: 2331309 - protein, 5 aa, Cryptosporidium parvum
QGPSW

SEQ ID NO: 2331310 - protein, 16 aa, Cryptosporidium parvum
QGPSYSLSEHPSPFKT

SEQ ID NO: 2331311 - protein, 11 aa, Cryptosporidium parvum
QGQSNKIEYSS

SEQ ID NO: 2331312 - protein, 25 aa, Cryptosporidium parvum
QGRCSSEQLNSSTKYKSPFYPPPKK

SEQ ID NO: 2331313 - protein, 13 aa, Cryptosporidium parvum
QGSQTKMSASVQN

SEQ ID NO: 2331314 - protein, 7 aa, Cryptosporidium parvum
QGSSARQ

SEQ ID NO: 2331315 - protein, 14 aa, Cryptosporidium parvum
QGVSTGLAEQQNKR

SEQ ID NO: 2331316 - protein, 11 aa, Cryptosporidium parvum
QHANEPEHNSG

SEQ ID NO: 2331317 - protein, 7 aa, Cryptosporidium parvum
QHEVSPK

SEQ ID NO: 2331318 - protein, 7 aa, Cryptosporidium parvum
QHPNQQQ

SEQ ID NO: 2331319 - protein, 8 aa, Cryptosporidium parvum
QIEGNGRF

SEQ ID NO: 2331320 - protein, 4 aa, Cryptosporidium parvum
QIES

SEQ ID NO: 2331321 - protein, 18 aa, Cryptosporidium parvum
QIGGGEQITPSSKKGNKF

SEQ ID NO: 2331322 - protein, 5 aa, Cryptosporidium parvum
QIIGQ

SEQ ID NO: 2331323 - protein, 11 aa, Cryptosporidium parvum
QINNDGHTNID

SEQ ID NO: 2331324 - protein, 7 aa, Cryptosporidium parvum
QINPYQP

SEQ ID NO: 2331325 - protein, 4 aa, Cryptosporidium parvum
QINQ

SEQ ID NO: 2331326 - protein, 10 aa, Cryptosporidium parvum
QIPSPGGTPC

SEQ ID NO: 2331327 - protein, 5 aa, Cryptosporidium parvum
QIRNH

SEQ ID NO: 2331328 - protein, 6 aa, Cryptosporidium parvum
QIYGSA

SEQ ID NO: 2331329 - protein, 10 aa, Cryptosporidium parvum
QKAHAREKRR

SEQ ID NO: 2331330 - protein, 7 aa, Cryptosporidium parvum
QKDITRK

SEQ ID NO: 2331331 - protein, 5 aa, Cryptosporidium parvum
QKDRD

SEQ ID NO: 2331332 - protein, 7 aa, Cryptosporidium parvum
QKEADAL

SEQ ID NO: 2331333 - protein, 8 aa, Cryptosporidium parvum
QKEDNETM

SEQ ID NO: 2331334 - protein, 8 aa, Cryptosporidium parvum
QKEKAQDE

SEQ ID NO: 2331335 - protein, 5 aa, Cryptosporidium parvum
QKEMR

SEQ ID NO: 2331336 - protein, 4 aa, Cryptosporidium parvum
QKES

SEQ ID NO: 2331337 - protein, 5 aa, Cryptosporidium parvum
QKGIE

SEQ ID NO: 2331338 - protein, 18 aa, Cryptosporidium parvum
QKGISGGGELKGKRHTID

SEQ ID NO: 2331339 - protein, 6 aa, Cryptosporidium parvum
QKHEYN

SEQ ID NO: 2331340 - protein, 11 aa, Cryptosporidium parvum
QKIESKHDQAR

SEQ ID NO: 2331341 - protein, 15 aa, Cryptosporidium parvum
QKIPRSLSTTTTTTT

SEQ ID NO: 2331342 - protein, 18 aa, Cryptosporidium parvum
QKKDGLPTGGFETTSIPN

SEQ ID NO: 2331343 - protein, 8 aa, Cryptosporidium parvum
QKKKTENI

SEQ ID NO: 2331344 - protein, 6 aa, Cryptosporidium parvum
QKKSKK

SEQ ID NO: 2331345 - protein, 12 aa, Cryptosporidium parvum
QKLSQESKGITK

SEQ ID NO: 2331346 - protein, 12 aa, Cryptosporidium parvum
QKNDKLNNFDSS

SEQ ID NO: 2331347 - protein, 8 aa, Cryptosporidium parvum
QKPDGTDL

SEQ ID NO: 2331348 - protein, 6 aa, Cryptosporidium parvum
QKPNGK

SEQ ID NO: 2331349 - protein, 9 aa, Cryptosporidium parvum
QKPPEEDYE

SEQ ID NO: 2331350 - protein, 9 aa, Cryptosporidium parvum
QKQKQRDTD

SEQ ID NO: 2331351 - protein, 6 aa, Cryptosporidium parvum
QKQREM

SEQ ID NO: 2331352 - protein, 6 aa, Cryptosporidium parvum
QKRNEL

SEQ ID NO: 2331353 - protein, 9 aa, Cryptosporidium parvum
QKRPPLKKE

SEQ ID NO: 2331354 - protein, 8 aa, Cryptosporidium parvum
QKSAARQA

SEQ ID NO: 2331355 - protein, 7 aa, Cryptosporidium parvum
QKSTAIY

SEQ ID NO: 2331356 - protein, 14 aa, Cryptosporidium parvum
QKTGECTNSGREVK

SEQ ID NO: 2331357 - protein, 16 aa, Cryptosporidium parvum
QKTKKETIGNNNYGEP

SEQ ID NO: 2331358 - protein, 8 aa, Cryptosporidium parvum
QKTPGLYP

SEQ ID NO: 2331359 - protein, 5 aa, Cryptosporidium parvum
QKVSQ

SEQ ID NO: 2331360 - protein, 17 aa, Cryptosporidium parvum
QKYNNNKLGNKDFNNEN

SEQ ID NO: 2331361 - protein, 8 aa, Cryptosporidium parvum
QKYPGGYK

SEQ ID NO: 2331362 - protein, 5 aa, Cryptosporidium parvum
QLNKT

SEQ ID NO: 2331363 - protein, 9 aa, Cryptosporidium parvum
QLPDGSQKL

SEQ ID NO: 2331364 - protein, 9 aa, Cryptosporidium parvum
QLPPPPSQN

SEQ ID NO: 2331365 - protein, 11 aa, Cryptosporidium parvum
QLSNTSKITEN

SEQ ID NO: 2331366 - protein, 5 aa, Cryptosporidium parvum
QLSPS

SEQ ID NO: 2331367 - protein, 13 aa, Cryptosporidium parvum
QLSPSPSPYPSPA

SEQ ID NO: 2331368 - protein, 20 aa, Cryptosporidium parvum
QLSTESNTPSYIPSEPQKAN

SEQ ID NO: 2331369 - protein, 5 aa, Cryptosporidium parvum
QMQPG

SEQ ID NO: 2331370 - protein, 12 aa, Cryptosporidium parvum
QMRDSDGRLTSR

SEQ ID NO: 2331371 - protein, 34 aa, Cryptosporidium parvum
QMTPSHGCTSKTLGENSAVVESTKSHSPSSIETN

SEQ ID NO: 2331372 - protein, 11 aa, Cryptosporidium parvum
QNAKNNTVIET

SEQ ID NO: 2331373 - protein, 20 aa, Cryptosporidium parvum
QNALTTPKGEESEEDSVEIP

SEQ ID NO: 2331374 - protein, 8 aa, Cryptosporidium parvum
QNASKLNG

SEQ ID NO: 2331375 - protein, 5 aa, Cryptosporidium parvum
QNCES

SEQ ID NO: 2331376 - protein, 9 aa, Cryptosporidium parvum
QNEQGREVD

SEQ ID NO: 2331377 - protein, 10 aa, Cryptosporidium parvum
QNGETSNLNQ

SEQ ID NO: 2331378 - protein, 19 aa, Cryptosporidium parvum
QNHSYPRTQVDEESQNEDF

SEQ ID NO: 2331379 - protein, 6 aa, Cryptosporidium parvum
QNIGKE

SEQ ID NO: 2331380 - protein, 6 aa, Cryptosporidium parvum
QNIGNG

SEQ ID NO: 2331381 - protein, 15 aa, Cryptosporidium parvum
QNKEDLKNNIETPTH

SEQ ID NO: 2331382 - protein, 7 aa, Cryptosporidium parvum
QNKLDGK

SEQ ID NO: 2331383 - protein, 9 aa, Cryptosporidium parvum
QNKNEYQST

SEQ ID NO: 2331384 - protein, 7 aa, Cryptosporidium parvum
QNKNGGF

SEQ ID NO: 2331385 - protein, 13 aa, Cryptosporidium parvum
QNKNTKLEKSRDE

SEQ ID NO: 2331386 - protein, 10 aa, Cryptosporidium parvum
QNKVKSENIH

SEQ ID NO: 2331387 - protein, 8 aa, Cryptosporidium parvum
QNLDDGYQ

SEQ ID NO: 2331388 - protein, 11 aa, Cryptosporidium parvum
QNLNESNSKTK

SEQ ID NO: 2331389 - protein, 14 aa, Cryptosporidium parvum
QNNNSTQLKNSSSD

SEQ ID NO: 2331390 - protein, 16 aa, Cryptosporidium parvum
QNNNTIDTNPELSSSI

SEQ ID NO: 2331391 - protein, 7 aa, Cryptosporidium parvum
QNPSSSF

SEQ ID NO: 2331392 - protein, 12 aa, Cryptosporidium parvum
QNQNSERNAHEA

SEQ ID NO: 2331393 - protein, 7 aa, Cryptosporidium parvum
QNQNYGH

SEQ ID NO: 2331394 - protein, 6 aa, Cryptosporidium parvum
QNQPSI

SEQ ID NO: 2331395 - protein, 7 aa, Cryptosporidium parvum
QNQQENM

SEQ ID NO: 2331396 - protein, 7 aa, Cryptosporidium parvum
QNQYYSD

SEQ ID NO: 2331397 - protein, 12 aa, Cryptosporidium parvum
QNSINKETSQIN

SEQ ID NO: 2331398 - protein, 8 aa, Cryptosporidium parvum
QNSTGNNF

SEQ ID NO: 2331399 - protein, 5 aa, Cryptosporidium parvum
QNTSF

SEQ ID NO: 2331400 - protein, 4 aa, Cryptosporidium parvum
QNYD

SEQ ID NO: 2331401 - protein, 16 aa, Cryptosporidium parvum
QNYQQADDGGSSSQVN

SEQ ID NO: 2331402 - protein, 10 aa, Cryptosporidium parvum
QNYSGARSKD

SEQ ID NO: 2331403 - protein, 8 aa, Cryptosporidium parvum
QPEGATAK

SEQ ID NO: 2331404 - protein, 4 aa, Cryptosporidium parvum
QPET

SEQ ID NO: 2331405 - protein, 6 aa, Cryptosporidium parvum
QPFSGR

SEQ ID NO: 2331406 - protein, 21 aa, Cryptosporidium parvum
QPINIPPPNCPPNNSNITQGT

SEQ ID NO: 2331407 - protein, 4 aa, Cryptosporidium parvum
QPIQ

SEQ ID NO: 2331408 - protein, 17 aa, Cryptosporidium parvum
QPMDGVTEDSKADEASL

SEQ ID NO: 2331409 - protein, 4 aa, Cryptosporidium parvum
QPNG

SEQ ID NO: 2331410 - protein, 8 aa, Cryptosporidium parvum
QPQHPSDY

SEQ ID NO: 2331411 - protein, 5 aa, Cryptosporidium parvum
QPQIT

SEQ ID NO: 2331412 - protein, 5 aa, Cryptosporidium parvum
QPSRA

SEQ ID NO: 2331413 - protein, 6 aa, Cryptosporidium parvum
QPSSEI

SEQ ID NO: 2331414 - protein, 16 aa, Cryptosporidium parvum
QPSSSYSTSSLNPSVQ

SEQ ID NO: 2331415 - protein, 29 aa, Cryptosporidium parvum
QQELQKEQLEQQQQLQSQQQQQQQKLQKQ

SEQ ID NO: 2331416 - protein, 13 aa, Cryptosporidium parvum
QQFPTKPTATYGV

SEQ ID NO: 2331417 - protein, 6 aa, Cryptosporidium parvum
QQHDPR

SEQ ID NO: 2331418 - protein, 4 aa, Cryptosporidium parvum
QQLE

SEQ ID NO: 2331419 - protein, 5 aa, Cryptosporidium parvum
QQNSG

SEQ ID NO: 2331420 - protein, 4 aa, Cryptosporidium parvum
QQPE

SEQ ID NO: 2331421 - protein, 7 aa, Cryptosporidium parvum
QQPRSYA

SEQ ID NO: 2331422 - protein, 14 aa, Cryptosporidium parvum
QQSNATLSGNATHT

SEQ ID NO: 2331423 - protein, 7 aa, Cryptosporidium parvum
QQTIQQN

SEQ ID NO: 2331424 - protein, 66 aa, Cryptosporidium parvum
QRDSKGDNSIMSKNNDKEYTKSQEFTSNDLSNSSINSSSLEVPDTFEESSISRSVSKTNKKQYENS

SEQ ID NO: 2331425 - protein, 4 aa, Cryptosporidium parvum
QRLS

SEQ ID NO: 2331426 - protein, 24 aa, Cryptosporidium parvum
QRLTRKSKKNLSSGERRSKSHSME

SEQ ID NO: 2331427 - protein, 14 aa, Cryptosporidium parvum
QRNQTSSSGNNPVN

SEQ ID NO: 2331428 - protein, 5 aa, Cryptosporidium parvum
QRQEV

SEQ ID NO: 2331429 - protein, 15 aa, Cryptosporidium parvum
QRQKEEFSEIEKTRR

SEQ ID NO: 2331430 - protein, 39 aa, Cryptosporidium parvum
QRSGSVSVDSAHRGTGTNSQRRSSSVASGAHSNEAASAH

SEQ ID NO: 2331431 - protein, 6 aa, Cryptosporidium parvum
QRSKID

SEQ ID NO: 2331432 - protein, 7 aa, Cryptosporidium parvum
QRYLESD

SEQ ID NO: 2331433 - protein, 23 aa, Cryptosporidium parvum
QSALSGSGVSGSSPTTSSSAALG

SEQ ID NO: 2331434 - protein, 6 aa, Cryptosporidium parvum
QSATFR

SEQ ID NO: 2331435 - protein, 9 aa, Cryptosporidium parvum
QSDEHSKSL

SEQ ID NO: 2331436 - protein, 5 aa, Cryptosporidium parvum
QSDEL

SEQ ID NO: 2331437 - protein, 10 aa, Cryptosporidium parvum
QSDMGKSIPK

SEQ ID NO: 2331438 - protein, 8 aa, Cryptosporidium parvum
QSEDGESI

SEQ ID NO: 2331439 - protein, 7 aa, Cryptosporidium parvum
QSEIEDL

SEQ ID NO: 2331440 - protein, 17 aa, Cryptosporidium parvum
QSELETRSSFDSNRESL

SEQ ID NO: 2331441 - protein, 13 aa, Cryptosporidium parvum
QSFHTETSSFDTG

SEQ ID NO: 2331442 - protein, 4 aa, Cryptosporidium parvum
QSFN

SEQ ID NO: 2331443 - protein, 7 aa, Cryptosporidium parvum
QSGETIS

SEQ ID NO: 2331444 - protein, 14 aa, Cryptosporidium parvum
QSHSNNTNLPPNLN

SEQ ID NO: 2331445 - protein, 31 aa, Cryptosporidium parvum
QSIQSGTTPAPTPAPTPAPTPIPAPTPVPLP

SEQ ID NO: 2331446 - protein, 9 aa, Cryptosporidium parvum
QSIRGNSDI

SEQ ID NO: 2331447 - protein, 42 aa, Cryptosporidium parvum
QSKRKDNKKGILKKGTKSKDSRSLSRKERPRHSSEYDSEDYS

SEQ ID NO: 2331448 - protein, 8 aa, Cryptosporidium parvum
QSMSPNVD

SEQ ID NO: 2331449 - protein, 5 aa, Cryptosporidium parvum
QSNDP

SEQ ID NO: 2331450 - protein, 10 aa, Cryptosporidium parvum
QSNKSSKSMI

SEQ ID NO: 2331451 - protein, 13 aa, Cryptosporidium parvum
QSPESSTELSGGS

SEQ ID NO: 2331452 - protein, 6 aa, Cryptosporidium parvum
QSPKEN

SEQ ID NO: 2331453 - protein, 45 aa, Cryptosporidium parvum
QSPLQNKDKISPTKGESKRKKSFKNNIEKGINSDFDSDFSSSDSD

SEQ ID NO: 2331454 - protein, 7 aa, Cryptosporidium parvum
QSPTKNI

SEQ ID NO: 2331455 - protein, 15 aa, Cryptosporidium parvum
QSRDEKLTSKALERY

SEQ ID NO: 2331456 - protein, 11 aa, Cryptosporidium parvum
QSRRNEGPTYT

SEQ ID NO: 2331457 - protein, 9 aa, Cryptosporidium parvum
QSSQRLPLE

SEQ ID NO: 2331458 - protein, 9 aa, Cryptosporidium parvum
QSSSCFSGN

SEQ ID NO: 2331459 - protein, 11 aa, Cryptosporidium parvum
QSSTGGSSSIE

SEQ ID NO: 2331460 - protein, 6 aa, Cryptosporidium parvum
QSSVHA

SEQ ID NO: 2331461 - protein, 4 aa, Cryptosporidium parvum
QSTA

SEQ ID NO: 2331462 - protein, 11 aa, Cryptosporidium parvum
QSTAKVCPNNN

SEQ ID NO: 2331463 - protein, 6 aa, Cryptosporidium parvum
QSTLEE

SEQ ID NO: 2331464 - protein, 4 aa, Cryptosporidium parvum
QSTN

SEQ ID NO: 2331465 - protein, 13 aa, Cryptosporidium parvum
QSTTSEGRTGRRG

SEQ ID NO: 2331466 - protein, 12 aa, Cryptosporidium parvum
QSTVSGSTSMGD

SEQ ID NO: 2331467 - protein, 47 aa, Cryptosporidium parvum
QSVPTGGVAVSGGAAAASGGAAQDSAPAEKKKEEEEEEEGDLGFSLF

SEQ ID NO: 2331468 - protein, 8 aa, Cryptosporidium parvum
QSVSNKEN

SEQ ID NO: 2331469 - protein, 16 aa, Cryptosporidium parvum
QSYESFDPRSPNGGVT

SEQ ID NO: 2331470 - protein, 13 aa, Cryptosporidium parvum
QSYKYENNTRNAL

SEQ ID NO: 2331471 - protein, 17 aa, Cryptosporidium parvum
QTEKDNLTSAGKNDQYL

SEQ ID NO: 2331472 - protein, 11 aa, Cryptosporidium parvum
QTETSSLPASR

SEQ ID NO: 2331473 - protein, 32 aa, Cryptosporidium parvum
QTGEKDDDKDEKTSENETIKETFQTNNPPFQN

SEQ ID NO: 2331474 - protein, 6 aa, Cryptosporidium parvum
QTHDKS

SEQ ID NO: 2331475 - protein, 7 aa, Cryptosporidium parvum
QTKAERK

SEQ ID NO: 2331476 - protein, 4 aa, Cryptosporidium parvum
QTLK

SEQ ID NO: 2331477 - protein, 7 aa, Cryptosporidium parvum
QTNGEYT

SEQ ID NO: 2331478 - protein, 5 aa, Cryptosporidium parvum
QTNKN

SEQ ID NO: 2331479 - protein, 12 aa, Cryptosporidium parvum
QTNPDLPSSKEL

SEQ ID NO: 2331480 - protein, 19 aa, Cryptosporidium parvum
QTPIPQTKPEKSKSHPPQI

SEQ ID NO: 2331481 - protein, 10 aa, Cryptosporidium parvum
QTQDESLTNE

SEQ ID NO: 2331482 - protein, 7 aa, Cryptosporidium parvum
QTQGCTS

SEQ ID NO: 2331483 - protein, 10 aa, Cryptosporidium parvum
QTQGESEESF

SEQ ID NO: 2331484 - protein, 6 aa, Cryptosporidium parvum
QTSGLE

SEQ ID NO: 2331485 - protein, 15 aa, Cryptosporidium parvum
QTSISEVSRNKRPLT

SEQ ID NO: 2331486 - protein, 9 aa, Cryptosporidium parvum
QTSSNSGCS

SEQ ID NO: 2331487 - protein, 13 aa, Cryptosporidium parvum
QTSTAKPLSKSEL

SEQ ID NO: 2331488 - protein, 14 aa, Cryptosporidium parvum
QTSTTVPGDSDEAD

SEQ ID NO: 2331489 - protein, 6 aa, Cryptosporidium parvum
QTSYEK

SEQ ID NO: 2331490 - protein, 34 aa, Cryptosporidium parvum
QTVEETDQGDGNDGEDDDEDDDEDDDDEDGTRYD

SEQ ID NO: 2331491 - protein, 5 aa, Cryptosporidium parvum
QTYGN

SEQ ID NO: 2331492 - protein, 25 aa, Cryptosporidium parvum
QVAPPSNRSSITTAPHSGATPPIPG

SEQ ID NO: 2331493 - protein, 16 aa, Cryptosporidium parvum
QVEGKDQAMEEETSKV

SEQ ID NO: 2331494 - protein, 17 aa, Cryptosporidium parvum
QVQRNNNNNNNNNNNIQ

SEQ ID NO: 2331495 - protein, 4 aa, Cryptosporidium parvum
QVTY

SEQ ID NO: 2331496 - protein, 4 aa, Cryptosporidium parvum
QYES

SEQ ID NO: 2331497 - protein, 6 aa, Cryptosporidium parvum
QYPELS

SEQ ID NO: 2331498 - protein, 10 aa, Cryptosporidium parvum
QYPSSLPSNE

SEQ ID NO: 2331499 - protein, 17 aa, Cryptosporidium parvum
QYSANKSHDSIRNTRET

SEQ ID NO: 2331500 - protein, 22 aa, Cryptosporidium parvum
QYTGAAGKNNIVSTDENTPQTR

SEQ ID NO: 2331501 - protein, 11 aa, Cryptosporidium parvum
RADEEEAELEK

SEQ ID NO: 2331502 - protein, 9 aa, Cryptosporidium parvum
RADPQTSLS

SEQ ID NO: 2331503 - protein, 9 aa, Cryptosporidium parvum
RADSSDIPL

SEQ ID NO: 2331504 - protein, 11 aa, Cryptosporidium parvum
RAEDGDKEAER

SEQ ID NO: 2331505 - protein, 16 aa, Cryptosporidium parvum
RAFSSGSSKPSTGGLS

SEQ ID NO: 2331506 - protein, 5 aa, Cryptosporidium parvum
RAGSQ

SEQ ID NO: 2331507 - protein, 9 aa, Cryptosporidium parvum
RAKEASSAT

SEQ ID NO: 2331508 - protein, 9 aa, Cryptosporidium parvum
RAKKEQRKY

SEQ ID NO: 2331509 - protein, 9 aa, Cryptosporidium parvum
RAKKNINDA

SEQ ID NO: 2331510 - protein, 4 aa, Cryptosporidium parvum
RANA

SEQ ID NO: 2331511 - protein, 7 aa, Cryptosporidium parvum
RANENGL

SEQ ID NO: 2331512 - protein, 36 aa, Cryptosporidium parvum
RAQTGSSSRSSSPRPCTSSGVQIGSSSRSPSPRPHV

SEQ ID NO: 2331513 - protein, 7 aa, Cryptosporidium parvum
RASRQPS

SEQ ID NO: 2331514 - protein, 9 aa, Cryptosporidium parvum
RASSHESSL

SEQ ID NO: 2331515 - protein, 8 aa, Cryptosporidium parvum
RASSSDPF

SEQ ID NO: 2331516 - protein, 9 aa, Cryptosporidium parvum
RAVGSCSNN

SEQ ID NO: 2331517 - protein, 4 aa, Cryptosporidium parvum
RAYS

SEQ ID NO: 2331518 - protein, 34 aa, Cryptosporidium parvum
RCQPGSCTPGTCTTGSCNVGESQTGCEKGSCKGG

SEQ ID NO: 2331519 - protein, 6 aa, Cryptosporidium parvum
RCRDPT

SEQ ID NO: 2331520 - protein, 47 aa, Cryptosporidium parvum
RDEEEDDDENEDNNRDKNIKNNPLYNETSISSDGKRYNDTASPIKTP

SEQ ID NO: 2331521 - protein, 5 aa, Cryptosporidium parvum
RDEEL

SEQ ID NO: 2331522 - protein, 7 aa, Cryptosporidium parvum
RDENDDF

SEQ ID NO: 2331523 - protein, 14 aa, Cryptosporidium parvum
RDESSKGENNNESE

SEQ ID NO: 2331524 - protein, 5 aa, Cryptosporidium parvum
RDGPI

SEQ ID NO: 2331525 - protein, 7 aa, Cryptosporidium parvum
RDGSKTD

SEQ ID NO: 2331526 - protein, 4 aa, Cryptosporidium parvum
RDIH

SEQ ID NO: 2331527 - protein, 9 aa, Cryptosporidium parvum
RDISPNNSK

SEQ ID NO: 2331528 - protein, 14 aa, Cryptosporidium parvum
RDKRYDKHRKESNN

SEQ ID NO: 2331529 - protein, 9 aa, Cryptosporidium parvum
RDKVTKDEI

SEQ ID NO: 2331530 - protein, 7 aa, Cryptosporidium parvum
RDPEKEG

SEQ ID NO: 2331531 - protein, 6 aa, Cryptosporidium parvum
RDPGTL

SEQ ID NO: 2331532 - protein, 4 aa, Cryptosporidium parvum
RDPN

SEQ ID NO: 2331533 - protein, 32 aa, Cryptosporidium parvum
RDPSSTGFERESKRKDYSRSNTSIKDLSPSKS

SEQ ID NO: 2331534 - protein, 7 aa, Cryptosporidium parvum
RDQTKDP

SEQ ID NO: 2331535 - protein, 6 aa, Cryptosporidium parvum
RDSSEL

SEQ ID NO: 2331536 - protein, 5 aa, Cryptosporidium parvum
RDTAR

SEQ ID NO: 2331537 - protein, 16 aa, Cryptosporidium parvum
RDYESNSIISSNRSRL

SEQ ID NO: 2331538 - protein, 8 aa, Cryptosporidium parvum
RDYSGTSI

SEQ ID NO: 2331539 - protein, 6 aa, Cryptosporidium parvum
REATRE

SEQ ID NO: 2331540 - protein, 6 aa, Cryptosporidium parvum
RECGPS

SEQ ID NO: 2331541 - protein, 9 aa, Cryptosporidium parvum
REDEKYPGS

SEQ ID NO: 2331542 - protein, 9 aa, Cryptosporidium parvum
REDIGPRAA

SEQ ID NO: 2331543 - protein, 14 aa, Cryptosporidium parvum
REFDGANPGHEEYM

SEQ ID NO: 2331544 - protein, 5 aa, Cryptosporidium parvum
REGGI

SEQ ID NO: 2331545 - protein, 14 aa, Cryptosporidium parvum
REGSANESNPISQI

SEQ ID NO: 2331546 - protein, 14 aa, Cryptosporidium parvum
REHPDRLPKFNIDA

SEQ ID NO: 2331547 - protein, 13 aa, Cryptosporidium parvum
REKAESRRRSANI

SEQ ID NO: 2331548 - protein, 15 aa, Cryptosporidium parvum
REKDYKEKKDGKSEN

SEQ ID NO: 2331549 - protein, 8 aa, Cryptosporidium parvum
REKPEEVC

SEQ ID NO: 2331550 - protein, 27 aa, Cryptosporidium parvum
RENARKRRGESDGADATPSTSSGFDED

SEQ ID NO: 2331551 - protein, 5 aa, Cryptosporidium parvum
REPDK

SEQ ID NO: 2331552 - protein, 7 aa, Cryptosporidium parvum
REPEIPT

SEQ ID NO: 2331553 - protein, 5 aa, Cryptosporidium parvum
RERAY

SEQ ID NO: 2331554 - protein, 19 aa, Cryptosporidium parvum
RERDENLRNSITNIRTNLN

SEQ ID NO: 2331555 - protein, 17 aa, Cryptosporidium parvum
REREKLESDLAQKRREY

SEQ ID NO: 2331556 - protein, 23 aa, Cryptosporidium parvum
RERRESSKSSETSLSSKEEEITK

SEQ ID NO: 2331557 - protein, 10 aa, Cryptosporidium parvum
RERTKTRERI

SEQ ID NO: 2331558 - protein, 7 aa, Cryptosporidium parvum
RERTTNY

SEQ ID NO: 2331559 - protein, 17 aa, Cryptosporidium parvum
RESAKIANQLDNQASRL

SEQ ID NO: 2331560 - protein, 10 aa, Cryptosporidium parvum
RESEKSLGSL

SEQ ID NO: 2331561 - protein, 12 aa, Cryptosporidium parvum
RETGCSSTCDSG

SEQ ID NO: 2331562 - protein, 5 aa, Cryptosporidium parvum
RETNA

SEQ ID NO: 2331563 - protein, 7 aa, Cryptosporidium parvum
RETSEDQ

SEQ ID NO: 2331564 - protein, 12 aa, Cryptosporidium parvum
RETSPENQMGEE

SEQ ID NO: 2331565 - protein, 16 aa, Cryptosporidium parvum
REVEKSKRALSSAPQV

SEQ ID NO: 2331566 - protein, 5 aa, Cryptosporidium parvum
REVPN

SEQ ID NO: 2331567 - protein, 11 aa, Cryptosporidium parvum
RFGKKKGKVEQ

SEQ ID NO: 2331568 - protein, 10 aa, Cryptosporidium parvum
RFNGNDENIT

SEQ ID NO: 2331569 - protein, 4 aa, Cryptosporidium parvum
RFSE

SEQ ID NO: 2331570 - protein, 5 aa, Cryptosporidium parvum
RFTGG

SEQ ID NO: 2331571 - protein, 6 aa, Cryptosporidium parvum
RGEGDC

SEQ ID NO: 2331572 - protein, 5 aa, Cryptosporidium parvum
RGGFA

SEQ ID NO: 2331573 - protein, 24 aa, Cryptosporidium parvum
RGGIAKKSRITSRNSGDDPAYTPK

SEQ ID NO: 2331574 - protein, 11 aa, Cryptosporidium parvum
RGGPREKHPKT

SEQ ID NO: 2331575 - protein, 8 aa, Cryptosporidium parvum
RGGSLNSA

SEQ ID NO: 2331576 - protein, 13 aa, Cryptosporidium parvum
RGKKPDNHGKNPF

SEQ ID NO: 2331577 - protein, 6 aa, Cryptosporidium parvum
RGLKNE

SEQ ID NO: 2331578 - protein, 11 aa, Cryptosporidium parvum
RGNFGKGISAD

SEQ ID NO: 2331579 - protein, 8 aa, Cryptosporidium parvum
RGNNVNNS

SEQ ID NO: 2331580 - protein, 6 aa, Cryptosporidium parvum
RGPDCK

SEQ ID NO: 2331581 - protein, 11 aa, Cryptosporidium parvum
RGPGCKTPCTR

SEQ ID NO: 2331582 - protein, 8 aa, Cryptosporidium parvum
RGPGCRTP

SEQ ID NO: 2331583 - protein, 6 aa, Cryptosporidium parvum
RGPNCK

SEQ ID NO: 2331584 - protein, 7 aa, Cryptosporidium parvum
RGPTQRL

SEQ ID NO: 2331585 - protein, 4 aa, Cryptosporidium parvum
RGRF

SEQ ID NO: 2331586 - protein, 4 aa, Cryptosporidium parvum
RGRR

SEQ ID NO: 2331587 - protein, 23 aa, Cryptosporidium parvum
RGRRAASPQGSINRGTLPSRKAY

SEQ ID NO: 2331588 - protein, 4 aa, Cryptosporidium parvum
RGSE

SEQ ID NO: 2331589 - protein, 23 aa, Cryptosporidium parvum
RGTEEESEDIVSRPSRFPRLVRV

SEQ ID NO: 2331590 - protein, 6 aa, Cryptosporidium parvum
RGTPLR

SEQ ID NO: 2331591 - protein, 18 aa, Cryptosporidium parvum
RHNEDKRKKERSKGIPSR

SEQ ID NO: 2331592 - protein, 8 aa, Cryptosporidium parvum
RHNTNRKI

SEQ ID NO: 2331593 - protein, 86 aa, Cryptosporidium parvum
RHSSSSSSLSSSSTSSSSYSSSSSSSEDEDRETSTNKESGKRGHRGRKTGKKSRSRSKSRSRSKFKSRSKSRSRSPSPVFKFDEEL

SEQ ID NO: 2331594 - protein, 11 aa, Cryptosporidium parvum
RIGSSAPEECK

SEQ ID NO: 2331595 - protein, 9 aa, Cryptosporidium parvum
RIPQPTTSN

SEQ ID NO: 2331596 - protein, 13 aa, Cryptosporidium parvum
RIPSDTKTPISSK

SEQ ID NO: 2331597 - protein, 12 aa, Cryptosporidium parvum
RIQETNEAHNEL

SEQ ID NO: 2331598 - protein, 4 aa, Cryptosporidium parvum
RIRE

SEQ ID NO: 2331599 - protein, 5 aa, Cryptosporidium parvum
RISDL

SEQ ID NO: 2331600 - protein, 8 aa, Cryptosporidium parvum
RKAADTNS

SEQ ID NO: 2331601 - protein, 8 aa, Cryptosporidium parvum
RKALGSYK

SEQ ID NO: 2331602 - protein, 33 aa, Cryptosporidium parvum
RKARANKNLNRRNSSDLDDEKEEEEEDEENMTS

SEQ ID NO: 2331603 - protein, 8 aa, Cryptosporidium parvum
RKASDGSG

SEQ ID NO: 2331604 - protein, 9 aa, Cryptosporidium parvum
RKATGGEKM

SEQ ID NO: 2331605 - protein, 11 aa, Cryptosporidium parvum
RKDENKVVPSW

SEQ ID NO: 2331606 - protein, 8 aa, Cryptosporidium parvum
RKDPGSYY

SEQ ID NO: 2331607 - protein, 9 aa, Cryptosporidium parvum
RKDRNEKIS

SEQ ID NO: 2331608 - protein, 10 aa, Cryptosporidium parvum
RKEKSGGFED

SEQ ID NO: 2331609 - protein, 9 aa, Cryptosporidium parvum
RKENEKTGK

SEQ ID NO: 2331610 - protein, 13 aa, Cryptosporidium parvum
RKENLESSEGIQG

SEQ ID NO: 2331611 - protein, 7 aa, Cryptosporidium parvum
RKEPRRM

SEQ ID NO: 2331612 - protein, 11 aa, Cryptosporidium parvum
RKERSQGSSDI

SEQ ID NO: 2331613 - protein, 8 aa, Cryptosporidium parvum
RKGDQWDG

SEQ ID NO: 2331614 - protein, 5 aa, Cryptosporidium parvum
RKGGY

SEQ ID NO: 2331615 - protein, 6 aa, Cryptosporidium parvum
RKIEDN

SEQ ID NO: 2331616 - protein, 13 aa, Cryptosporidium parvum
RKKDEFNKTMKPY

SEQ ID NO: 2331617 - protein, 6 aa, Cryptosporidium parvum
RKKDGE

SEQ ID NO: 2331618 - protein, 8 aa, Cryptosporidium parvum
RKKNYSKL

SEQ ID NO: 2331619 - protein, 9 aa, Cryptosporidium parvum
RKKPDNKCE

SEQ ID NO: 2331620 - protein, 7 aa, Cryptosporidium parvum
RKKSDGV

SEQ ID NO: 2331621 - protein, 16 aa, Cryptosporidium parvum
RKLGGNLNKKTRECQE

SEQ ID NO: 2331622 - protein, 11 aa, Cryptosporidium parvum
RKLKGKKKKLL

SEQ ID NO: 2331623 - protein, 9 aa, Cryptosporidium parvum
RKLPPKSQL

SEQ ID NO: 2331624 - protein, 10 aa, Cryptosporidium parvum
RKNRSGVDDN

SEQ ID NO: 2331625 - protein, 8 aa, Cryptosporidium parvum
RKNTKSNI

SEQ ID NO: 2331626 - protein, 8 aa, Cryptosporidium parvum
RKNYKDSK

SEQ ID NO: 2331627 - protein, 8 aa, Cryptosporidium parvum
RKPKQSQV

SEQ ID NO: 2331628 - protein, 9 aa, Cryptosporidium parvum
RKPTSTVLP

SEQ ID NO: 2331629 - protein, 7 aa, Cryptosporidium parvum
RKPYINQ

SEQ ID NO: 2331630 - protein, 7 aa, Cryptosporidium parvum
RKRRGIP

SEQ ID NO: 2331631 - protein, 7 aa, Cryptosporidium parvum
RKRTSEV

SEQ ID NO: 2331632 - protein, 9 aa, Cryptosporidium parvum
RKSDLNDSF

SEQ ID NO: 2331633 - protein, 12 aa, Cryptosporidium parvum
RKSKKNGNIPDQ

SEQ ID NO: 2331634 - protein, 10 aa, Cryptosporidium parvum
RKSKSKSISN

SEQ ID NO: 2331635 - protein, 11 aa, Cryptosporidium parvum
RKSSFGETGTE

SEQ ID NO: 2331636 - protein, 9 aa, Cryptosporidium parvum
RKTDEVKLP

SEQ ID NO: 2331637 - protein, 6 aa, Cryptosporidium parvum
RKTGYT

SEQ ID NO: 2331638 - protein, 4 aa, Cryptosporidium parvum
RKTN

SEQ ID NO: 2331639 - protein, 11 aa, Cryptosporidium parvum
RKTSDGRDNTL

SEQ ID NO: 2331640 - protein, 11 aa, Cryptosporidium parvum
RKYGDNTVPLT

SEQ ID NO: 2331641 - protein, 6 aa, Cryptosporidium parvum
RLASNK

SEQ ID NO: 2331642 - protein, 6 aa, Cryptosporidium parvum
RLKQEQ

SEQ ID NO: 2331643 - protein, 12 aa, Cryptosporidium parvum
RLLGDNPKTGII

SEQ ID NO: 2331644 - protein, 4 aa, Cryptosporidium parvum
RLQE

SEQ ID NO: 2331645 - protein, 6 aa, Cryptosporidium parvum
RLQEEE

SEQ ID NO: 2331646 - protein, 7 aa, Cryptosporidium parvum
RLTGGYN

SEQ ID NO: 2331647 - protein, 9 aa, Cryptosporidium parvum
RMKQPNNKG

SEQ ID NO: 2331648 - protein, 13 aa, Cryptosporidium parvum
RNAGKSSVDSQED

SEQ ID NO: 2331649 - protein, 5 aa, Cryptosporidium parvum
RNAKG

SEQ ID NO: 2331650 - protein, 29 aa, Cryptosporidium parvum
RNANENFKKHPEKKVERKHNEIGSVKTGG

SEQ ID NO: 2331651 - protein, 9 aa, Cryptosporidium parvum
RNANENQIK

SEQ ID NO: 2331652 - protein, 19 aa, Cryptosporidium parvum
RNDDSNPISAPYGEKEANR

SEQ ID NO: 2331653 - protein, 9 aa, Cryptosporidium parvum
RNDNNENIE

SEQ ID NO: 2331654 - protein, 9 aa, Cryptosporidium parvum
RNEDNSREK

SEQ ID NO: 2331655 - protein, 4 aa, Cryptosporidium parvum
RNEQ

SEQ ID NO: 2331656 - protein, 14 aa, Cryptosporidium parvum
RNESNNLPELKTSN

SEQ ID NO: 2331657 - protein, 11 aa, Cryptosporidium parvum
RNFNSENGDNN

SEQ ID NO: 2331658 - protein, 7 aa, Cryptosporidium parvum
RNHNESS

SEQ ID NO: 2331659 - protein, 5 aa, Cryptosporidium parvum
RNISP

SEQ ID NO: 2331660 - protein, 4 aa, Cryptosporidium parvum
RNIV

SEQ ID NO: 2331661 - protein, 8 aa, Cryptosporidium parvum
RNKAERRR

SEQ ID NO: 2331662 - protein, 14 aa, Cryptosporidium parvum
RNKDTESNNIDSDL

SEQ ID NO: 2331663 - protein, 6 aa, Cryptosporidium parvum
RNLQVG

SEQ ID NO: 2331664 - protein, 9 aa, Cryptosporidium parvum
RNNNPLDRP

SEQ ID NO: 2331665 - protein, 10 aa, Cryptosporidium parvum
RNPGENTNPN

SEQ ID NO: 2331666 - protein, 5 aa, Cryptosporidium parvum
RNPVL

SEQ ID NO: 2331667 - protein, 8 aa, Cryptosporidium parvum
RNQDGTPL

SEQ ID NO: 2331668 - protein, 8 aa, Cryptosporidium parvum
RNRDEEKW

SEQ ID NO: 2331669 - protein, 4 aa, Cryptosporidium parvum
RNSF

SEQ ID NO: 2331670 - protein, 6 aa, Cryptosporidium parvum
RNSISR

SEQ ID NO: 2331671 - protein, 14 aa, Cryptosporidium parvum
RNSPQQSVKSLGYG

SEQ ID NO: 2331672 - protein, 5 aa, Cryptosporidium parvum
RNSPS

SEQ ID NO: 2331673 - protein, 12 aa, Cryptosporidium parvum
RNSQYKNNEAIK

SEQ ID NO: 2331674 - protein, 19 aa, Cryptosporidium parvum
RNSSKKRKKSSKINDESLE

SEQ ID NO: 2331675 - protein, 9 aa, Cryptosporidium parvum
RNSSKSSYI

SEQ ID NO: 2331676 - protein, 9 aa, Cryptosporidium parvum
RNSSTHTRY

SEQ ID NO: 2331677 - protein, 6 aa, Cryptosporidium parvum
RNSTKV

SEQ ID NO: 2331678 - protein, 12 aa, Cryptosporidium parvum
RNTEGSSEKKNI

SEQ ID NO: 2331679 - protein, 7 aa, Cryptosporidium parvum
RNTNPKK

SEQ ID NO: 2331680 - protein, 7 aa, Cryptosporidium parvum
RNTTTDG

SEQ ID NO: 2331681 - protein, 18 aa, Cryptosporidium parvum
RNTYGIETYNDNDQVPSG

SEQ ID NO: 2331682 - protein, 17 aa, Cryptosporidium parvum
RNWGKMGSSELNDENSA

SEQ ID NO: 2331683 - protein, 5 aa, Cryptosporidium parvum
RNYHD

SEQ ID NO: 2331684 - protein, 5 aa, Cryptosporidium parvum
RPDEA

SEQ ID NO: 2331685 - protein, 4 aa, Cryptosporidium parvum
RPDL

SEQ ID NO: 2331686 - protein, 17 aa, Cryptosporidium parvum
RPDTTKNEDNSEEIETK

SEQ ID NO: 2331687 - protein, 5 aa, Cryptosporidium parvum
RPEDP

SEQ ID NO: 2331688 - protein, 7 aa, Cryptosporidium parvum
RPESDPD

SEQ ID NO: 2331689 - protein, 24 aa, Cryptosporidium parvum
RPGITTRSSAEGLGRTYDKGVKDT

SEQ ID NO: 2331690 - protein, 6 aa, Cryptosporidium parvum
RPIPIG

SEQ ID NO: 2331691 - protein, 4 aa, Cryptosporidium parvum
RPIR

SEQ ID NO: 2331692 - protein, 7 aa, Cryptosporidium parvum
RPLNSRE

SEQ ID NO: 2331693 - protein, 7 aa, Cryptosporidium parvum
RPLSQNK

SEQ ID NO: 2331694 - protein, 14 aa, Cryptosporidium parvum
RPNDQISTGSTEYQ

SEQ ID NO: 2331695 - protein, 4 aa, Cryptosporidium parvum
RPNF

SEQ ID NO: 2331696 - protein, 4 aa, Cryptosporidium parvum
RPPS

SEQ ID NO: 2331697 - protein, 16 aa, Cryptosporidium parvum
RPRPATLAQKQNEMES

SEQ ID NO: 2331698 - protein, 8 aa, Cryptosporidium parvum
RPSSVEQN

SEQ ID NO: 2331699 - protein, 12 aa, Cryptosporidium parvum
RQASGGIPPDPY

SEQ ID NO: 2331700 - protein, 6 aa, Cryptosporidium parvum
RQDGKI

SEQ ID NO: 2331701 - protein, 6 aa, Cryptosporidium parvum
RQGEAP

SEQ ID NO: 2331702 - protein, 7 aa, Cryptosporidium parvum
RQGGNLE

SEQ ID NO: 2331703 - protein, 5 aa, Cryptosporidium parvum
RQGSQ

SEQ ID NO: 2331704 - protein, 12 aa, Cryptosporidium parvum
RQIGTTLEPSAA

SEQ ID NO: 2331705 - protein, 11 aa, Cryptosporidium parvum
RQKTNRKEEKL

SEQ ID NO: 2331706 - protein, 6 aa, Cryptosporidium parvum
RQLTEK

SEQ ID NO: 2331707 - protein, 15 aa, Cryptosporidium parvum
RQNITKSRQNERPSI

SEQ ID NO: 2331708 - protein, 15 aa, Cryptosporidium parvum
RRAEITAANPSLRSQ

SEQ ID NO: 2331709 - protein, 10 aa, Cryptosporidium parvum
RRATQNEKEF

SEQ ID NO: 2331710 - protein, 6 aa, Cryptosporidium parvum
RRDGDN

SEQ ID NO: 2331711 - protein, 6 aa, Cryptosporidium parvum
RRDGRR

SEQ ID NO: 2331712 - protein, 8 aa, Cryptosporidium parvum
RREPAEVN

SEQ ID NO: 2331713 - protein, 21 aa, Cryptosporidium parvum
RRGDSMMDNENSSLYNNDDLK

SEQ ID NO: 2331714 - protein, 6 aa, Cryptosporidium parvum
RRGDSN

SEQ ID NO: 2331715 - protein, 6 aa, Cryptosporidium parvum
RRGSTC

SEQ ID NO: 2331716 - protein, 16 aa, Cryptosporidium parvum
RRHEPGEQFNEEEEPI

SEQ ID NO: 2331717 - protein, 9 aa, Cryptosporidium parvum
RRKHRINDK

SEQ ID NO: 2331718 - protein, 7 aa, Cryptosporidium parvum
RRKLKGA

SEQ ID NO: 2331719 - protein, 21 aa, Cryptosporidium parvum
RRKTEKEQKESVAHKGEGENQ

SEQ ID NO: 2331720 - protein, 9 aa, Cryptosporidium parvum
RRLQKTERR

SEQ ID NO: 2331721 - protein, 14 aa, Cryptosporidium parvum
RRNDSSIIGQEEYD

SEQ ID NO: 2331722 - protein, 4 aa, Cryptosporidium parvum
RRNI

SEQ ID NO: 2331723 - protein, 5 aa, Cryptosporidium parvum
RRNPK

SEQ ID NO: 2331724 - protein, 16 aa, Cryptosporidium parvum
RRRRGRRQREDNPDDD

SEQ ID NO: 2331725 - protein, 4 aa, Cryptosporidium parvum
RRRS

SEQ ID NO: 2331726 - protein, 5 aa, Cryptosporidium parvum
RRSDG

SEQ ID NO: 2331727 - protein, 6 aa, Cryptosporidium parvum
RRSSFD

SEQ ID NO: 2331728 - protein, 7 aa, Cryptosporidium parvum
RRSTSLN

SEQ ID NO: 2331729 - protein, 10 aa, Cryptosporidium parvum
RRTSGKELNE

SEQ ID NO: 2331730 - protein, 34 aa, Cryptosporidium parvum
RSASRTYELTSRSSSSGNRAGIGSQGNKGKAVHR

SEQ ID NO: 2331731 - protein, 15 aa, Cryptosporidium parvum
RSCPNTSATISSYTY

SEQ ID NO: 2331732 - protein, 5 aa, Cryptosporidium parvum
RSDEL

SEQ ID NO: 2331733 - protein, 8 aa, Cryptosporidium parvum
RSDQAKKK

SEQ ID NO: 2331734 - protein, 8 aa, Cryptosporidium parvum
RSEDIKNT

SEQ ID NO: 2331735 - protein, 5 aa, Cryptosporidium parvum
RSEEA

SEQ ID NO: 2331736 - protein, 4 aa, Cryptosporidium parvum
RSEI

SEQ ID NO: 2331737 - protein, 7 aa, Cryptosporidium parvum
RSESDGF

SEQ ID NO: 2331738 - protein, 7 aa, Cryptosporidium parvum
RSFGPKE

SEQ ID NO: 2331739 - protein, 12 aa, Cryptosporidium parvum
RSFTEKKLPNSF

SEQ ID NO: 2331740 - protein, 6 aa, Cryptosporidium parvum
RSGFNK

SEQ ID NO: 2331741 - protein, 5 aa, Cryptosporidium parvum
RSGLS

SEQ ID NO: 2331742 - protein, 9 aa, Cryptosporidium parvum
RSGSVPGNT

SEQ ID NO: 2331743 - protein, 7 aa, Cryptosporidium parvum
RSIYKNN

SEQ ID NO: 2331744 - protein, 7 aa, Cryptosporidium parvum
RSKDKNF

SEQ ID NO: 2331745 - protein, 7 aa, Cryptosporidium parvum
RSKEPNE

SEQ ID NO: 2331746 - protein, 4 aa, Cryptosporidium parvum
RSKK

SEQ ID NO: 2331747 - protein, 10 aa, Cryptosporidium parvum
RSKTSSRNRL

SEQ ID NO: 2331748 - protein, 7 aa, Cryptosporidium parvum
RSNDDDW

SEQ ID NO: 2331749 - protein, 8 aa, Cryptosporidium parvum
RSNGDDEF

SEQ ID NO: 2331750 - protein, 13 aa, Cryptosporidium parvum
RSNKNRKLKHPSF

SEQ ID NO: 2331751 - protein, 44 aa, Cryptosporidium parvum
RSNLDEPTSNDDDKLSSGDETRNINDSQNNDELEIDNKSEIPEF

SEQ ID NO: 2331752 - protein, 8 aa, Cryptosporidium parvum
RSNPSKAL

SEQ ID NO: 2331753 - protein, 8 aa, Cryptosporidium parvum
RSNQEEIT

SEQ ID NO: 2331754 - protein, 5 aa, Cryptosporidium parvum
RSQRK

SEQ ID NO: 2331755 - protein, 16 aa, Cryptosporidium parvum
RSRGSNEQQTDNEVTG

SEQ ID NO: 2331756 - protein, 9 aa, Cryptosporidium parvum
RSRTATEPL

SEQ ID NO: 2331757 - protein, 11 aa, Cryptosporidium parvum
RSSDEKKYDGP

SEQ ID NO: 2331758 - protein, 8 aa, Cryptosporidium parvum
RSSDSDSE

SEQ ID NO: 2331759 - protein, 8 aa, Cryptosporidium parvum
RSSEREDQ

SEQ ID NO: 2331760 - protein, 4 aa, Cryptosporidium parvum
RSSI

SEQ ID NO: 2331761 - protein, 5 aa, Cryptosporidium parvum
RSSLD

SEQ ID NO: 2331762 - protein, 7 aa, Cryptosporidium parvum
RSSLKEV

SEQ ID NO: 2331763 - protein, 36 aa, Cryptosporidium parvum
RSSSRGSGGAGGRGRNGLSSEDEDEDEDEDEDERRR

SEQ ID NO: 2331764 - protein, 7 aa, Cryptosporidium parvum
RSTAWNA

SEQ ID NO: 2331765 - protein, 6 aa, Cryptosporidium parvum
RSTPMS

SEQ ID NO: 2331766 - protein, 5 aa, Cryptosporidium parvum
RSYET

SEQ ID NO: 2331767 - protein, 10 aa, Cryptosporidium parvum
RTCSRSESVP

SEQ ID NO: 2331768 - protein, 16 aa, Cryptosporidium parvum
RTDHSGKISKANSILD

SEQ ID NO: 2331769 - protein, 5 aa, Cryptosporidium parvum
RTDKN

SEQ ID NO: 2331770 - protein, 9 aa, Cryptosporidium parvum
RTENNERVE

SEQ ID NO: 2331771 - protein, 4 aa, Cryptosporidium parvum
RTGL

SEQ ID NO: 2331772 - protein, 6 aa, Cryptosporidium parvum
RTGSIS

SEQ ID NO: 2331773 - protein, 80 aa, Cryptosporidium parvum
RTGYNRNSERRNSSYLEDEDLRNGHRTPSPSVSPSSTPSPLPPPLPPRPSPSPTPTPHSYTSPSSGAPSHAPIPKGEDLN

SEQ ID NO: 2331774 - protein, 5 aa, Cryptosporidium parvum
RTIGN

SEQ ID NO: 2331775 - protein, 11 aa, Cryptosporidium parvum
RTISPEKSEIE

SEQ ID NO: 2331776 - protein, 6 aa, Cryptosporidium parvum
RTLENT

SEQ ID NO: 2331777 - protein, 5 aa, Cryptosporidium parvum
RTLSS

SEQ ID NO: 2331778 - protein, 13 aa, Cryptosporidium parvum
RTNGRKKSNPEFK

SEQ ID NO: 2331779 - protein, 9 aa, Cryptosporidium parvum
RTNNSPSYL

SEQ ID NO: 2331780 - protein, 5 aa, Cryptosporidium parvum
RTNQG

SEQ ID NO: 2331781 - protein, 15 aa, Cryptosporidium parvum
RTPELYPKPNPPERY

SEQ ID NO: 2331782 - protein, 8 aa, Cryptosporidium parvum
RTPTAQGL

SEQ ID NO: 2331783 - protein, 19 aa, Cryptosporidium parvum
RTPYIPPKAQKALEGSKGI

SEQ ID NO: 2331784 - protein, 11 aa, Cryptosporidium parvum
RTQRGPSDWGY

SEQ ID NO: 2331785 - protein, 12 aa, Cryptosporidium parvum
RTSAEEKNINKR

SEQ ID NO: 2331786 - protein, 12 aa, Cryptosporidium parvum
RTSATAGKVSPR

SEQ ID NO: 2331787 - protein, 10 aa, Cryptosporidium parvum
RTSKDYQPFK

SEQ ID NO: 2331788 - protein, 7 aa, Cryptosporidium parvum
RTSSPYA

SEQ ID NO: 2331789 - protein, 7 aa, Cryptosporidium parvum
RTSTGAS

SEQ ID NO: 2331790 - protein, 6 aa, Cryptosporidium parvum
RTTELP

SEQ ID NO: 2331791 - protein, 6 aa, Cryptosporidium parvum
RTTNQP

SEQ ID NO: 2331792 - protein, 4 aa, Cryptosporidium parvum
RTTS

SEQ ID NO: 2331793 - protein, 13 aa, Cryptosporidium parvum
RTYKGGKFATDFT

SEQ ID NO: 2331794 - protein, 4 aa, Cryptosporidium parvum
RVEN

SEQ ID NO: 2331795 - protein, 4 aa, Cryptosporidium parvum
RVEP

SEQ ID NO: 2331796 - protein, 5 aa, Cryptosporidium parvum
RVPDD

SEQ ID NO: 2331797 - protein, 16 aa, Cryptosporidium parvum
RVSNGTEKSGHEPLPI

SEQ ID NO: 2331798 - protein, 9 aa, Cryptosporidium parvum
RVTTKDRVP

SEQ ID NO: 2331799 - protein, 5 aa, Cryptosporidium parvum
RVTYS

SEQ ID NO: 2331800 - protein, 12 aa, Cryptosporidium parvum
RWGKEGPADSEK

SEQ ID NO: 2331801 - protein, 9 aa, Cryptosporidium parvum
RYLSESQKS

SEQ ID NO: 2331802 - protein, 10 aa, Cryptosporidium parvum
RYNDTTNENL

SEQ ID NO: 2331803 - protein, 7 aa, Cryptosporidium parvum
RYPKSHK

SEQ ID NO: 2331804 - protein, 13 aa, Cryptosporidium parvum
RYSGKSIRTNEKG

SEQ ID NO: 2331805 - protein, 5 aa, Cryptosporidium parvum
RYSKK

SEQ ID NO: 2331806 - protein, 6 aa, Cryptosporidium parvum
RYTNSS

SEQ ID NO: 2331807 - protein, 11 aa, Cryptosporidium parvum
RYTTTSHHGHG

SEQ ID NO: 2331808 - protein, 5 aa, Cryptosporidium parvum
SAAEQ

SEQ ID NO: 2331809 - protein, 17 aa, Cryptosporidium parvum
SAAFPASRTSFPADPKH

SEQ ID NO: 2331810 - protein, 8 aa, Cryptosporidium parvum
SADDDDDV

SEQ ID NO: 2331811 - protein, 9 aa, Cryptosporidium parvum
SADGPLEED

SEQ ID NO: 2331812 - protein, 41 aa, Cryptosporidium parvum
SAEESNIIGDDDGKSESEEEEEFGNNKDTRNIQSTKKEEKI

SEQ ID NO: 2331813 - protein, 10 aa, Cryptosporidium parvum
SAEGNGELDV

SEQ ID NO: 2331814 - protein, 6 aa, Cryptosporidium parvum
SAGDGR

SEQ ID NO: 2331815 - protein, 10 aa, Cryptosporidium parvum
SAGEIKDKIK

SEQ ID NO: 2331816 - protein, 6 aa, Cryptosporidium parvum
SAGESI

SEQ ID NO: 2331817 - protein, 5 aa, Cryptosporidium parvum
SAGGN

SEQ ID NO: 2331818 - protein, 9 aa, Cryptosporidium parvum
SAHDPKGID

SEQ ID NO: 2331819 - protein, 5 aa, Cryptosporidium parvum
SAHDV

SEQ ID NO: 2331820 - protein, 10 aa, Cryptosporidium parvum
SAHKARGPSV

SEQ ID NO: 2331821 - protein, 5 aa, Cryptosporidium parvum
SAHQK

SEQ ID NO: 2331822 - protein, 6 aa, Cryptosporidium parvum
SAITES

SEQ ID NO: 2331823 - protein, 12 aa, Cryptosporidium parvum
SAKEKAVKQKRE

SEQ ID NO: 2331824 - protein, 9 aa, Cryptosporidium parvum
SAKNATNVD

SEQ ID NO: 2331825 - protein, 8 aa, Cryptosporidium parvum
SALNESKK

SEQ ID NO: 2331826 - protein, 7 aa, Cryptosporidium parvum
SALQTEL

SEQ ID NO: 2331827 - protein, 8 aa, Cryptosporidium parvum
SALSSKSV

SEQ ID NO: 2331828 - protein, 10 aa, Cryptosporidium parvum
SALSTKSNEY

SEQ ID NO: 2331829 - protein, 9 aa, Cryptosporidium parvum
SANNQTEQS

SEQ ID NO: 2331830 - protein, 16 aa, Cryptosporidium parvum
SANRMSRSKMGAYSTE

SEQ ID NO: 2331831 - protein, 9 aa, Cryptosporidium parvum
SANRTTKEQ

SEQ ID NO: 2331832 - protein, 8 aa, Cryptosporidium parvum
SAPNGKLK

SEQ ID NO: 2331833 - protein, 4 aa, Cryptosporidium parvum
SAPP

SEQ ID NO: 2331834 - protein, 9 aa, Cryptosporidium parvum
SAPSAFSPA

SEQ ID NO: 2331835 - protein, 21 aa, Cryptosporidium parvum
SAQDSFSAQKQISKNSASEKI

SEQ ID NO: 2331836 - protein, 10 aa, Cryptosporidium parvum
SAQKKSRSIP

SEQ ID NO: 2331837 - protein, 6 aa, Cryptosporidium parvum
SAQYQN

SEQ ID NO: 2331838 - protein, 39 aa, Cryptosporidium parvum
SARGSNLQGPSFQSSSVMSNKKSSSKRRAPSPPACPPYS

SEQ ID NO: 2331839 - protein, 79 aa, Cryptosporidium parvum
SARRSSRTRQKSESTHTNRSKSRSNSRSRSRRVSRSNSRTRSRRVSRSSSRTRSRRVSRSNSRPRKASSPTDTSPIKTE

SEQ ID NO: 2331840 - protein, 7 aa, Cryptosporidium parvum
SARTPQI

SEQ ID NO: 2331841 - protein, 5 aa, Cryptosporidium parvum
SARVP

SEQ ID NO: 2331842 - protein, 4 aa, Cryptosporidium parvum
SASE

SEQ ID NO: 2331843 - protein, 5 aa, Cryptosporidium parvum
SASGF

SEQ ID NO: 2331844 - protein, 14 aa, Cryptosporidium parvum
SASISRSPSTKMSK

SEQ ID NO: 2331845 - protein, 6 aa, Cryptosporidium parvum
SASKVT

SEQ ID NO: 2331846 - protein, 10 aa, Cryptosporidium parvum
SASNQEVGSS

SEQ ID NO: 2331847 - protein, 10 aa, Cryptosporidium parvum
SASPLAKGVD

SEQ ID NO: 2331848 - protein, 13 aa, Cryptosporidium parvum
SASSNLQNAPTLR

SEQ ID NO: 2331849 - protein, 10 aa, Cryptosporidium parvum
SASSPTLPNT

SEQ ID NO: 2331850 - protein, 4 aa, Cryptosporidium parvum
SASV

SEQ ID NO: 2331851 - protein, 16 aa, Cryptosporidium parvum
SASYQKEANTPGSAAY

SEQ ID NO: 2331852 - protein, 7 aa, Cryptosporidium parvum
SASYSQM

SEQ ID NO: 2331853 - protein, 11 aa, Cryptosporidium parvum
SATCGSKKCKS

SEQ ID NO: 2331854 - protein, 6 aa, Cryptosporidium parvum
SATLTG

SEQ ID NO: 2331855 - protein, 10 aa, Cryptosporidium parvum
SATPRDNSET

SEQ ID NO: 2331856 - protein, 12 aa, Cryptosporidium parvum
SAVTADPTSSTK

SEQ ID NO: 2331857 - protein, 23 aa, Cryptosporidium parvum
SAYPNDSSFEADHKYETSQFSQG

SEQ ID NO: 2331858 - protein, 24 aa, Cryptosporidium parvum
SCDSDSEDELNSSSNTSEEQGHSN

SEQ ID NO: 2331859 - protein, 9 aa, Cryptosporidium parvum
SCNNENGDF

SEQ ID NO: 2331860 - protein, 21 aa, Cryptosporidium parvum
SCSNGGNNISNNSKSSTSELA

SEQ ID NO: 2331861 - protein, 7 aa, Cryptosporidium parvum
SCSPDLK

SEQ ID NO: 2331862 - protein, 19 aa, Cryptosporidium parvum
SCSSDDSCCSSSSNRGSIE

SEQ ID NO: 2331863 - protein, 22 aa, Cryptosporidium parvum
SCSSSNKKKKEKKQVNGNEMSN

SEQ ID NO: 2331864 - protein, 33 aa, Cryptosporidium parvum
SCSSSNKKKSKNEKKDKKQKKGKDEQDKKEEKF

SEQ ID NO: 2331865 - protein, 5 aa, Cryptosporidium parvum
SDAEY

SEQ ID NO: 2331866 - protein, 7 aa, Cryptosporidium parvum
SDANYNN

SEQ ID NO: 2331867 - protein, 8 aa, Cryptosporidium parvum
SDAPNYEE

SEQ ID NO: 2331868 - protein, 4 aa, Cryptosporidium parvum
SDAT

SEQ ID NO: 2331869 - protein, 11 aa, Cryptosporidium parvum
SDATPTHSKSN

SEQ ID NO: 2331870 - protein, 7 aa, Cryptosporidium parvum
SDDDDSV

SEQ ID NO: 2331871 - protein, 8 aa, Cryptosporidium parvum
SDDDSLNK

SEQ ID NO: 2331872 - protein, 27 aa, Cryptosporidium parvum
SDDPNFQRRNSISTDPSGVSDDSAQSN

SEQ ID NO: 2331873 - protein, 7 aa, Cryptosporidium parvum
SDDPSNS

SEQ ID NO: 2331874 - protein, 6 aa, Cryptosporidium parvum
SDDYSS

SEQ ID NO: 2331875 - protein, 9 aa, Cryptosporidium parvum
SDEAKEDLG

SEQ ID NO: 2331876 - protein, 27 aa, Cryptosporidium parvum
SDEDSDISQDKEKKRKRRVKSRKIYDS

SEQ ID NO: 2331877 - protein, 7 aa, Cryptosporidium parvum
SDEEKSN

SEQ ID NO: 2331878 - protein, 7 aa, Cryptosporidium parvum
SDEERNE

SEQ ID NO: 2331879 - protein, 6 aa, Cryptosporidium parvum
SDEGMH

SEQ ID NO: 2331880 - protein, 7 aa, Cryptosporidium parvum
SDEINDE

SEQ ID NO: 2331881 - protein, 9 aa, Cryptosporidium parvum
SDELTNPGS

SEQ ID NO: 2331882 - protein, 9 aa, Cryptosporidium parvum
SDFADADAA

SEQ ID NO: 2331883 - protein, 39 aa, Cryptosporidium parvum
SDFSPSSSNESSELGHNVDESQQEKEIVSEESRSAPAPV

SEQ ID NO: 2331884 - protein, 13 aa, Cryptosporidium parvum
SDGAKASQKTDNI

SEQ ID NO: 2331885 - protein, 13 aa, Cryptosporidium parvum
SDGKAYSKRTRPI

SEQ ID NO: 2331886 - protein, 12 aa, Cryptosporidium parvum
SDGKIKEKSIGI

SEQ ID NO: 2331887 - protein, 5 aa, Cryptosporidium parvum
SDGKT

SEQ ID NO: 2331888 - protein, 9 aa, Cryptosporidium parvum
SDGKTYSNI

SEQ ID NO: 2331889 - protein, 7 aa, Cryptosporidium parvum
SDGNTYD

SEQ ID NO: 2331890 - protein, 7 aa, Cryptosporidium parvum
SDGSVEE

SEQ ID NO: 2331891 - protein, 4 aa, Cryptosporidium parvum
SDGT

SEQ ID NO: 2331892 - protein, 6 aa, Cryptosporidium parvum
SDGTVE

SEQ ID NO: 2331893 - protein, 7 aa, Cryptosporidium parvum
SDHAGKP

SEQ ID NO: 2331894 - protein, 8 aa, Cryptosporidium parvum
SDIDNKEE

SEQ ID NO: 2331895 - protein, 19 aa, Cryptosporidium parvum
SDIENQTDIETTDDETNAI

SEQ ID NO: 2331896 - protein, 12 aa, Cryptosporidium parvum
SDIENSGSAIEN

SEQ ID NO: 2331897 - protein, 11 aa, Cryptosporidium parvum
SDINNSTQKAT

SEQ ID NO: 2331898 - protein, 4 aa, Cryptosporidium parvum
SDIS

SEQ ID NO: 2331899 - protein, 14 aa, Cryptosporidium parvum
SDKLADSEGLAPVG

SEQ ID NO: 2331900 - protein, 9 aa, Cryptosporidium parvum
SDKLSSKEI

SEQ ID NO: 2331901 - protein, 7 aa, Cryptosporidium parvum
SDKNQKV

SEQ ID NO: 2331902 - protein, 9 aa, Cryptosporidium parvum
SDKSDDLRG

SEQ ID NO: 2331903 - protein, 11 aa, Cryptosporidium parvum
SDKSRKPVSPY

SEQ ID NO: 2331904 - protein, 4 aa, Cryptosporidium parvum
SDLK

SEQ ID NO: 2331905 - protein, 11 aa, Cryptosporidium parvum
SDLKKSRKETL

SEQ ID NO: 2331906 - protein, 6 aa, Cryptosporidium parvum
SDLPPN

SEQ ID NO: 2331907 - protein, 9 aa, Cryptosporidium parvum
SDLPSSPEE

SEQ ID NO: 2331908 - protein, 24 aa, Cryptosporidium parvum
SDLYGTTTTYSSNSNYGSQSGSSN

SEQ ID NO: 2331909 - protein, 6 aa, Cryptosporidium parvum
SDNHFS

SEQ ID NO: 2331910 - protein, 7 aa, Cryptosporidium parvum
SDNKAVE

SEQ ID NO: 2331911 - protein, 7 aa, Cryptosporidium parvum
SDNRDFT

SEQ ID NO: 2331912 - protein, 4 aa, Cryptosporidium parvum
SDNS

SEQ ID NO: 2331913 - protein, 4 aa, Cryptosporidium parvum
SDNV

SEQ ID NO: 2331914 - protein, 18 aa, Cryptosporidium parvum
SDPASNQIGNTESHTEDL

SEQ ID NO: 2331915 - protein, 7 aa, Cryptosporidium parvum
SDPEDNL

SEQ ID NO: 2331916 - protein, 8 aa, Cryptosporidium parvum
SDPENIPG

SEQ ID NO: 2331917 - protein, 6 aa, Cryptosporidium parvum
SDPEPK

SEQ ID NO: 2331918 - protein, 7 aa, Cryptosporidium parvum
SDPKLTS

SEQ ID NO: 2331919 - protein, 9 aa, Cryptosporidium parvum
SDPKVEING

SEQ ID NO: 2331920 - protein, 7 aa, Cryptosporidium parvum
SDPKYGG

SEQ ID NO: 2331921 - protein, 10 aa, Cryptosporidium parvum
SDPKYSNSPF

SEQ ID NO: 2331922 - protein, 9 aa, Cryptosporidium parvum
SDPNLNPKA

SEQ ID NO: 2331923 - protein, 8 aa, Cryptosporidium parvum
SDPVVSSS

SEQ ID NO: 2331924 - protein, 7 aa, Cryptosporidium parvum
SDQNFNG

SEQ ID NO: 2331925 - protein, 5 aa, Cryptosporidium parvum
SDQNR

SEQ ID NO: 2331926 - protein, 6 aa, Cryptosporidium parvum
SDQQFG

SEQ ID NO: 2331927 - protein, 9 aa, Cryptosporidium parvum
SDQVQNSGF

SEQ ID NO: 2331928 - protein, 5 aa, Cryptosporidium parvum
SDQVR

SEQ ID NO: 2331929 - protein, 4 aa, Cryptosporidium parvum
SDRD

SEQ ID NO: 2331930 - protein, 4 aa, Cryptosporidium parvum
SDRY

SEQ ID NO: 2331931 - protein, 4 aa, Cryptosporidium parvum
SDSK

SEQ ID NO: 2331932 - protein, 8 aa, Cryptosporidium parvum
SDSKGSFN

SEQ ID NO: 2331933 - protein, 9 aa, Cryptosporidium parvum
SDSKKNKDI

SEQ ID NO: 2331934 - protein, 5 aa, Cryptosporidium parvum
SDSLN

SEQ ID NO: 2331935 - protein, 9 aa, Cryptosporidium parvum
SDSNGSAPT

SEQ ID NO: 2331936 - protein, 7 aa, Cryptosporidium parvum
SDSNHGK

SEQ ID NO: 2331937 - protein, 9 aa, Cryptosporidium parvum
SDSQAPSPY

SEQ ID NO: 2331938 - protein, 8 aa, Cryptosporidium parvum
SDSSEFDL

SEQ ID NO: 2331939 - protein, 45 aa, Cryptosporidium parvum
SDSSIEDYSSAQSHISESGRSSSADNNVESRANTDEYEGSTEENL

SEQ ID NO: 2331940 - protein, 7 aa, Cryptosporidium parvum
SDSSVNR

SEQ ID NO: 2331941 - protein, 8 aa, Cryptosporidium parvum
SDSTGEII

SEQ ID NO: 2331942 - protein, 7 aa, Cryptosporidium parvum
SDSTKID

SEQ ID NO: 2331943 - protein, 7 aa, Cryptosporidium parvum
SDSVPED

SEQ ID NO: 2331944 - protein, 4 aa, Cryptosporidium parvum
SDTA

SEQ ID NO: 2331945 - protein, 5 aa, Cryptosporidium parvum
SDTEA

SEQ ID NO: 2331946 - protein, 11 aa, Cryptosporidium parvum
SDTEKEQSVKE

SEQ ID NO: 2331947 - protein, 7 aa, Cryptosporidium parvum
SDTPDVN

SEQ ID NO: 2331948 - protein, 7 aa, Cryptosporidium parvum
SDTPGKI

SEQ ID NO: 2331949 - protein, 9 aa, Cryptosporidium parvum
SDTPKNEEP

SEQ ID NO: 2331950 - protein, 34 aa, Cryptosporidium parvum
SDTSASTSSDGINVDAPKNSGYGAEQATSKNKQG

SEQ ID NO: 2331951 - protein, 19 aa, Cryptosporidium parvum
SDTSSKKGVTSQKDNSISE

SEQ ID NO: 2331952 - protein, 11 aa, Cryptosporidium parvum
SDTVSTSYAPA

SEQ ID NO: 2331953 - protein, 12 aa, Cryptosporidium parvum
SDVAGKEFETGV

SEQ ID NO: 2331954 - protein, 5 aa, Cryptosporidium parvum
SDYNK

SEQ ID NO: 2331955 - protein, 8 aa, Cryptosporidium parvum
SDYPESIP

SEQ ID NO: 2331956 - protein, 6 aa, Cryptosporidium parvum
SDYSDY

SEQ ID NO: 2331957 - protein, 5 aa, Cryptosporidium parvum
SDYSQ

SEQ ID NO: 2331958 - protein, 13 aa, Cryptosporidium parvum
SEAGDDGSPETET

SEQ ID NO: 2331959 - protein, 10 aa, Cryptosporidium parvum
SEAITTSNGT

SEQ ID NO: 2331960 - protein, 5 aa, Cryptosporidium parvum
SEALQ

SEQ ID NO: 2331961 - protein, 7 aa, Cryptosporidium parvum
SEAPNEF

SEQ ID NO: 2331962 - protein, 41 aa, Cryptosporidium parvum
SEASHSERSKSRSPSRSSSKSRSKSRSRSELSKSRTGYGGE

SEQ ID NO: 2331963 - protein, 10 aa, Cryptosporidium parvum
SEASNNSTDF

SEQ ID NO: 2331964 - protein, 6 aa, Cryptosporidium parvum
SECDNK

SEQ ID NO: 2331965 - protein, 20 aa, Cryptosporidium parvum
SEDNDQAEQNISPDSQIRDE

SEQ ID NO: 2331966 - protein, 6 aa, Cryptosporidium parvum
SEEEEA

SEQ ID NO: 2331967 - protein, 12 aa, Cryptosporidium parvum
SEEELKSKDLQE

SEQ ID NO: 2331968 - protein, 6 aa, Cryptosporidium parvum
SEEFDS

SEQ ID NO: 2331969 - protein, 4 aa, Cryptosporidium parvum
SEEK

SEQ ID NO: 2331970 - protein, 4 aa, Cryptosporidium parvum
SEEN

SEQ ID NO: 2331971 - protein, 13 aa, Cryptosporidium parvum
SEENNINQVNIRQ

SEQ ID NO: 2331972 - protein, 14 aa, Cryptosporidium parvum
SEEPPSEEDNDGPV

SEQ ID NO: 2331973 - protein, 45 aa, Cryptosporidium parvum
SEESGKSSEYVGGEEQKSAVPEQSEVEESNKEDILRSSDSQILGE

SEQ ID NO: 2331974 - protein, 8 aa, Cryptosporidium parvum
SEEVEDSD

SEQ ID NO: 2331975 - protein, 30 aa, Cryptosporidium parvum
SEFDEDSSSIYTSESESSNLSQSEDEESQS

SEQ ID NO: 2331976 - protein, 4 aa, Cryptosporidium parvum
SEFQ

SEQ ID NO: 2331977 - protein, 9 aa, Cryptosporidium parvum
SEGEIDDGT

SEQ ID NO: 2331978 - protein, 19 aa, Cryptosporidium parvum
SEGEKNENIQKKSQSLQTK

SEQ ID NO: 2331979 - protein, 7 aa, Cryptosporidium parvum
SEGKHEL

SEQ ID NO: 2331980 - protein, 4 aa, Cryptosporidium parvum
SEGL

SEQ ID NO: 2331981 - protein, 8 aa, Cryptosporidium parvum
SEGNPDGQ

SEQ ID NO: 2331982 - protein, 24 aa, Cryptosporidium parvum
SEGQSEGTEYEYKGDSEGFGPSDM

SEQ ID NO: 2331983 - protein, 13 aa, Cryptosporidium parvum
SEGQSQYYSGLPN

SEQ ID NO: 2331984 - protein, 6 aa, Cryptosporidium parvum
SEGSGI

SEQ ID NO: 2331985 - protein, 6 aa, Cryptosporidium parvum
SEHSSH

SEQ ID NO: 2331986 - protein, 10 aa, Cryptosporidium parvum
SEIPNNENSR

SEQ ID NO: 2331987 - protein, 27 aa, Cryptosporidium parvum
SEISESNQYDLENENISKRPEGATSIP

SEQ ID NO: 2331988 - protein, 12 aa, Cryptosporidium parvum
SEISPGRFPESQ

SEQ ID NO: 2331989 - protein, 5 aa, Cryptosporidium parvum
SEKAG

SEQ ID NO: 2331990 - protein, 7 aa, Cryptosporidium parvum
SEKAKLR

SEQ ID NO: 2331991 - protein, 7 aa, Cryptosporidium parvum
SEKAREA

SEQ ID NO: 2331992 - protein, 9 aa, Cryptosporidium parvum
SEKDSDQTL

SEQ ID NO: 2331993 - protein, 11 aa, Cryptosporidium parvum
SEKLKNKSDIQ

SEQ ID NO: 2331994 - protein, 7 aa, Cryptosporidium parvum
SEKPVTS

SEQ ID NO: 2331995 - protein, 7 aa, Cryptosporidium parvum
SEKSDKT

SEQ ID NO: 2331996 - protein, 7 aa, Cryptosporidium parvum
SEKSEEI

SEQ ID NO: 2331997 - protein, 5 aa, Cryptosporidium parvum
SEKSV

SEQ ID NO: 2331998 - protein, 10 aa, Cryptosporidium parvum
SELDDANYNN

SEQ ID NO: 2331999 - protein, 5 aa, Cryptosporidium parvum
SELDS

SEQ ID NO: 2332000 - protein, 17 aa, Cryptosporidium parvum
SELNDAQKQLIRQAILD

SEQ ID NO: 2332001 - protein, 9 aa, Cryptosporidium parvum
SENFSTDSL

SEQ ID NO: 2332002 - protein, 11 aa, Cryptosporidium parvum
SENGKEYQTQV

SEQ ID NO: 2332003 - protein, 37 aa, Cryptosporidium parvum
SENGKVCEPREEKSKVELSRQNSFSNQGNQKNNQLNE

SEQ ID NO: 2332004 - protein, 15 aa, Cryptosporidium parvum
SENGLDNEQNNKFKS

SEQ ID NO: 2332005 - protein, 7 aa, Cryptosporidium parvum
SENGRPI

SEQ ID NO: 2332006 - protein, 8 aa, Cryptosporidium parvum
SENHYSPA

SEQ ID NO: 2332007 - protein, 8 aa, Cryptosporidium parvum
SENISKSM

SEQ ID NO: 2332008 - protein, 10 aa, Cryptosporidium parvum
SENPSEELDK

SEQ ID NO: 2332009 - protein, 5 aa, Cryptosporidium parvum
SENSI

SEQ ID NO: 2332010 - protein, 6 aa, Cryptosporidium parvum
SENTET

SEQ ID NO: 2332011 - protein, 5 aa, Cryptosporidium parvum
SENTQ

SEQ ID NO: 2332012 - protein, 5 aa, Cryptosporidium parvum
SEPAN

SEQ ID NO: 2332013 - protein, 5 aa, Cryptosporidium parvum
SEPIP

SEQ ID NO: 2332014 - protein, 12 aa, Cryptosporidium parvum
SEPIPAEQSGPV

SEQ ID NO: 2332015 - protein, 12 aa, Cryptosporidium parvum
SEPLSTAKHSSQ

SEQ ID NO: 2332016 - protein, 42 aa, Cryptosporidium parvum
SEPPLRNKPSSNLKTRAKSIPRTRSRSRSRSRKRRKSTSRSK

SEQ ID NO: 2332017 - protein, 8 aa, Cryptosporidium parvum
SEQEPNME

SEQ ID NO: 2332018 - protein, 17 aa, Cryptosporidium parvum
SEQRNIDQTKNIKNRNG

SEQ ID NO: 2332019 - protein, 9 aa, Cryptosporidium parvum
SEQSRNEKP

SEQ ID NO: 2332020 - protein, 7 aa, Cryptosporidium parvum
SERIKNR

SEQ ID NO: 2332021 - protein, 44 aa, Cryptosporidium parvum
SERKSNASEKARKMNERKERQKACRERQRMEREEEERRKGDAHH

SEQ ID NO: 2332022 - protein, 27 aa, Cryptosporidium parvum
SESAKSIDEELDTRKSPNLGIESSEIE

SEQ ID NO: 2332023 - protein, 4 aa, Cryptosporidium parvum
SESD

SEQ ID NO: 2332024 - protein, 7 aa, Cryptosporidium parvum
SESDEKM

SEQ ID NO: 2332025 - protein, 5 aa, Cryptosporidium parvum
SESFN

SEQ ID NO: 2332026 - protein, 4 aa, Cryptosporidium parvum
SESL

SEQ ID NO: 2332027 - protein, 24 aa, Cryptosporidium parvum
SESPLEGGDTGSLGNSSKKEIVPR

SEQ ID NO: 2332028 - protein, 8 aa, Cryptosporidium parvum
SESQETVN

SEQ ID NO: 2332029 - protein, 7 aa, Cryptosporidium parvum
SESSIGS

SEQ ID NO: 2332030 - protein, 17 aa, Cryptosporidium parvum
SESTGVPSGATFDESQL

SEQ ID NO: 2332031 - protein, 7 aa, Cryptosporidium parvum
SESTSAA

SEQ ID NO: 2332032 - protein, 4 aa, Cryptosporidium parvum
SETI

SEQ ID NO: 2332033 - protein, 7 aa, Cryptosporidium parvum
SETISEP

SEQ ID NO: 2332034 - protein, 7 aa, Cryptosporidium parvum
SETKVRN

SEQ ID NO: 2332035 - protein, 21 aa, Cryptosporidium parvum
SETLPKMDSNYTTDGISRDFP

SEQ ID NO: 2332036 - protein, 9 aa, Cryptosporidium parvum
SETLQNGAS

SEQ ID NO: 2332037 - protein, 7 aa, Cryptosporidium parvum
SETNLNP

SEQ ID NO: 2332038 - protein, 53 aa, Cryptosporidium parvum
SETQRSIKSPTTTTTTTTTTTTTTTTTTTTTTTTTTTTTTTTTTTTTTTTTKS

SEQ ID NO: 2332039 - protein, 8 aa, Cryptosporidium parvum
SETRDITE

SEQ ID NO: 2332040 - protein, 6 aa, Cryptosporidium parvum
SETWKT

SEQ ID NO: 2332041 - protein, 7 aa, Cryptosporidium parvum
SEVKSES

SEQ ID NO: 2332042 - protein, 6 aa, Cryptosporidium parvum
SEYNVG

SEQ ID NO: 2332043 - protein, 8 aa, Cryptosporidium parvum
SEYSNSNE

SEQ ID NO: 2332044 - protein, 13 aa, Cryptosporidium parvum
SEYSSERKASCGD

SEQ ID NO: 2332045 - protein, 10 aa, Cryptosporidium parvum
SEYSTSSQKR

SEQ ID NO: 2332046 - protein, 16 aa, Cryptosporidium parvum
SFDNDGESKYNSENGL

SEQ ID NO: 2332047 - protein, 6 aa, Cryptosporidium parvum
SFDSKY

SEQ ID NO: 2332048 - protein, 5 aa, Cryptosporidium parvum
SFEST

SEQ ID NO: 2332049 - protein, 8 aa, Cryptosporidium parvum
SFGSTKKN

SEQ ID NO: 2332050 - protein, 4 aa, Cryptosporidium parvum
SFKT

SEQ ID NO: 2332051 - protein, 5 aa, Cryptosporidium parvum
SFNSN

SEQ ID NO: 2332052 - protein, 6 aa, Cryptosporidium parvum
SFPESL

SEQ ID NO: 2332053 - protein, 4 aa, Cryptosporidium parvum
SFPK

SEQ ID NO: 2332054 - protein, 14 aa, Cryptosporidium parvum
SFSAPNRECPPGYT

SEQ ID NO: 2332055 - protein, 9 aa, Cryptosporidium parvum
SFSDGGKSK

SEQ ID NO: 2332056 - protein, 14 aa, Cryptosporidium parvum
SFSGAAPATPPSGV

SEQ ID NO: 2332057 - protein, 9 aa, Cryptosporidium parvum
SFSGEESSL

SEQ ID NO: 2332058 - protein, 8 aa, Cryptosporidium parvum
SFSTSSPS

SEQ ID NO: 2332059 - protein, 24 aa, Cryptosporidium parvum
SFSTTENSKSEKGDSSMGSIFEGS

SEQ ID NO: 2332060 - protein, 10 aa, Cryptosporidium parvum
SFTAEQARAL

SEQ ID NO: 2332061 - protein, 14 aa, Cryptosporidium parvum
SFTPGPKTTSTEST

SEQ ID NO: 2332062 - protein, 13 aa, Cryptosporidium parvum
SFTSSSSSFSSSY

SEQ ID NO: 2332063 - protein, 14 aa, Cryptosporidium parvum
SGAEDEAVSGPSNS

SEQ ID NO: 2332064 - protein, 24 aa, Cryptosporidium parvum
SGAIKGSVVPDSSGTTVVTSGNPI

SEQ ID NO: 2332065 - protein, 40 aa, Cryptosporidium parvum
SGAQGITQPTTSRRNVNKSLEEKQDNKKKTAEKEKKNRKL

SEQ ID NO: 2332066 - protein, 8 aa, Cryptosporidium parvum
SGASPPIE

SEQ ID NO: 2332067 - protein, 9 aa, Cryptosporidium parvum
SGATSATDE

SEQ ID NO: 2332068 - protein, 11 aa, Cryptosporidium parvum
SGCETNESGYS

SEQ ID NO: 2332069 - protein, 17 aa, Cryptosporidium parvum
SGCSSPCKSSTNDLDST

SEQ ID NO: 2332070 - protein, 56 aa, Cryptosporidium parvum
SGDDEVETSENSSEDSVSDASSSQDESSNLEGESEAPETSKSESESESDEEDEDFE

SEQ ID NO: 2332071 - protein, 4 aa, Cryptosporidium parvum
SGDE

SEQ ID NO: 2332072 - protein, 7 aa, Cryptosporidium parvum
SGDEDMR

SEQ ID NO: 2332073 - protein, 9 aa, Cryptosporidium parvum
SGDKDDSEI

SEQ ID NO: 2332074 - protein, 6 aa, Cryptosporidium parvum
SGDPKS

SEQ ID NO: 2332075 - protein, 9 aa, Cryptosporidium parvum
SGEAGQSDK

SEQ ID NO: 2332076 - protein, 12 aa, Cryptosporidium parvum
SGEASSDPISKS

SEQ ID NO: 2332077 - protein, 4 aa, Cryptosporidium parvum
SGEC

SEQ ID NO: 2332078 - protein, 7 aa, Cryptosporidium parvum
SGEEEKN

SEQ ID NO: 2332079 - protein, 6 aa, Cryptosporidium parvum
SGEFEK

SEQ ID NO: 2332080 - protein, 9 aa, Cryptosporidium parvum
SGEHGDNSD

SEQ ID NO: 2332081 - protein, 6 aa, Cryptosporidium parvum
SGEKEL

SEQ ID NO: 2332082 - protein, 12 aa, Cryptosporidium parvum
SGEPENPTQPID

SEQ ID NO: 2332083 - protein, 15 aa, Cryptosporidium parvum
SGEPEQHKDLSPVGE

SEQ ID NO: 2332084 - protein, 4 aa, Cryptosporidium parvum
SGEY

SEQ ID NO: 2332085 - protein, 6 aa, Cryptosporidium parvum
SGEYPE

SEQ ID NO: 2332086 - protein, 4 aa, Cryptosporidium parvum
SGFG

SEQ ID NO: 2332087 - protein, 8 aa, Cryptosporidium parvum
SGFGGETP

SEQ ID NO: 2332088 - protein, 7 aa, Cryptosporidium parvum
SGFPGSS

SEQ ID NO: 2332089 - protein, 6 aa, Cryptosporidium parvum
SGGEAS

SEQ ID NO: 2332090 - protein, 10 aa, Cryptosporidium parvum
SGGIKDAAPL

SEQ ID NO: 2332091 - protein, 13 aa, Cryptosporidium parvum
SGGQATEEEQRRL

SEQ ID NO: 2332092 - protein, 8 aa, Cryptosporidium parvum
SGGSFETK

SEQ ID NO: 2332093 - protein, 6 aa, Cryptosporidium parvum
SGHREH

SEQ ID NO: 2332094 - protein, 7 aa, Cryptosporidium parvum
SGIDEKD

SEQ ID NO: 2332095 - protein, 12 aa, Cryptosporidium parvum
SGIDTEKSDWGT

SEQ ID NO: 2332096 - protein, 6 aa, Cryptosporidium parvum
SGIETK

SEQ ID NO: 2332097 - protein, 18 aa, Cryptosporidium parvum
SGISNYQGFGSTGNGELS

SEQ ID NO: 2332098 - protein, 8 aa, Cryptosporidium parvum
SGKASRIK

SEQ ID NO: 2332099 - protein, 9 aa, Cryptosporidium parvum
SGKDEELCG

SEQ ID NO: 2332100 - protein, 6 aa, Cryptosporidium parvum
SGKEIS

SEQ ID NO: 2332101 - protein, 10 aa, Cryptosporidium parvum
SGKEQPTASD

SEQ ID NO: 2332102 - protein, 17 aa, Cryptosporidium parvum
SGKTIQSGTSLPSNSYI

SEQ ID NO: 2332103 - protein, 12 aa, Cryptosporidium parvum
SGLGDMDDKGGS

SEQ ID NO: 2332104 - protein, 7 aa, Cryptosporidium parvum
SGLNSQE

SEQ ID NO: 2332105 - protein, 16 aa, Cryptosporidium parvum
SGLQKEKLLQKLTRYV

SEQ ID NO: 2332106 - protein, 11 aa, Cryptosporidium parvum
SGLSTSDPRVE

SEQ ID NO: 2332107 - protein, 8 aa, Cryptosporidium parvum
SGNEPDLR

SEQ ID NO: 2332108 - protein, 11 aa, Cryptosporidium parvum
SGNQSNEDHYA

SEQ ID NO: 2332109 - protein, 8 aa, Cryptosporidium parvum
SGNSETII

SEQ ID NO: 2332110 - protein, 9 aa, Cryptosporidium parvum
SGNSKRIEN

SEQ ID NO: 2332111 - protein, 10 aa, Cryptosporidium parvum
SGNSTVPSGS

SEQ ID NO: 2332112 - protein, 32 aa, Cryptosporidium parvum
SGNTPTSDDDNESETRSQNTPTITTSTQSIES

SEQ ID NO: 2332113 - protein, 8 aa, Cryptosporidium parvum
SGPASWSK

SEQ ID NO: 2332114 - protein, 9 aa, Cryptosporidium parvum
SGPLPGAKE

SEQ ID NO: 2332115 - protein, 10 aa, Cryptosporidium parvum
SGPLSKSISA

SEQ ID NO: 2332116 - protein, 10 aa, Cryptosporidium parvum
SGPRRRKRRD

SEQ ID NO: 2332117 - protein, 13 aa, Cryptosporidium parvum
SGPSSTGIGANSA

SEQ ID NO: 2332118 - protein, 7 aa, Cryptosporidium parvum
SGPYPES

SEQ ID NO: 2332119 - protein, 9 aa, Cryptosporidium parvum
SGPYPGNQI

SEQ ID NO: 2332120 - protein, 7 aa, Cryptosporidium parvum
SGPYPNG

SEQ ID NO: 2332121 - protein, 13 aa, Cryptosporidium parvum
SGQAKKKPTENIE

SEQ ID NO: 2332122 - protein, 6 aa, Cryptosporidium parvum
SGQDEM

SEQ ID NO: 2332123 - protein, 15 aa, Cryptosporidium parvum
SGQPPYVSSSKPGQY

SEQ ID NO: 2332124 - protein, 8 aa, Cryptosporidium parvum
SGRCEQQN

SEQ ID NO: 2332125 - protein, 4 aa, Cryptosporidium parvum
SGRP

SEQ ID NO: 2332126 - protein, 9 aa, Cryptosporidium parvum
SGRVAGPDK

SEQ ID NO: 2332127 - protein, 11 aa, Cryptosporidium parvum
SGSDSSQIAEA

SEQ ID NO: 2332128 - protein, 7 aa, Cryptosporidium parvum
SGSFSKK

SEQ ID NO: 2332129 - protein, 21 aa, Cryptosporidium parvum
SGSGDPTGNGAYLSEKSPSIL

SEQ ID NO: 2332130 - protein, 9 aa, Cryptosporidium parvum
SGSKDKRYA

SEQ ID NO: 2332131 - protein, 9 aa, Cryptosporidium parvum
SGSKGKEIS

SEQ ID NO: 2332132 - protein, 18 aa, Cryptosporidium parvum
SGSKYRGLPKAHQNERGN

SEQ ID NO: 2332133 - protein, 23 aa, Cryptosporidium parvum
SGSMSEESNSEDSEHYQPSDEKF

SEQ ID NO: 2332134 - protein, 9 aa, Cryptosporidium parvum
SGSNKGPWQ

SEQ ID NO: 2332135 - protein, 14 aa, Cryptosporidium parvum
SGSNPIKGRNDSID

SEQ ID NO: 2332136 - protein, 7 aa, Cryptosporidium parvum
SGSNYGG

SEQ ID NO: 2332137 - protein, 22 aa, Cryptosporidium parvum
SGSQCEQIKEAPPVSECPPGYK

SEQ ID NO: 2332138 - protein, 9 aa, Cryptosporidium parvum
SGSQEKASH

SEQ ID NO: 2332139 - protein, 8 aa, Cryptosporidium parvum
SGSQITSS

SEQ ID NO: 2332140 - protein, 6 aa, Cryptosporidium parvum
SGSSQI

SEQ ID NO: 2332141 - protein, 6 aa, Cryptosporidium parvum
SGSTNK

SEQ ID NO: 2332142 - protein, 7 aa, Cryptosporidium parvum
SGTCESK

SEQ ID NO: 2332143 - protein, 4 aa, Cryptosporidium parvum
SGTE

SEQ ID NO: 2332144 - protein, 4 aa, Cryptosporidium parvum
SGTI

SEQ ID NO: 2332145 - protein, 6 aa, Cryptosporidium parvum
SGTINQ

SEQ ID NO: 2332146 - protein, 11 aa, Cryptosporidium parvum
SGTKKEKGQKK

SEQ ID NO: 2332147 - protein, 5 aa, Cryptosporidium parvum
SGTSK

SEQ ID NO: 2332148 - protein, 13 aa, Cryptosporidium parvum
SGTTGVPKGAIHT

SEQ ID NO: 2332149 - protein, 13 aa, Cryptosporidium parvum
SGTYSTSSGTSQS

SEQ ID NO: 2332150 - protein, 7 aa, Cryptosporidium parvum
SGVGKTS

SEQ ID NO: 2332151 - protein, 18 aa, Cryptosporidium parvum
SGVGSKEDIQISSPGIKN

SEQ ID NO: 2332152 - protein, 10 aa, Cryptosporidium parvum
SGVSPSNTKD

SEQ ID NO: 2332153 - protein, 7 aa, Cryptosporidium parvum
SGYKENI

SEQ ID NO: 2332154 - protein, 6 aa, Cryptosporidium parvum
SGYSRG

SEQ ID NO: 2332155 - protein, 9 aa, Cryptosporidium parvum
SGYTQSEGK

SEQ ID NO: 2332156 - protein, 9 aa, Cryptosporidium parvum
SHASQASGE

SEQ ID NO: 2332157 - protein, 8 aa, Cryptosporidium parvum
SHEAKADK

SEQ ID NO: 2332158 - protein, 6 aa, Cryptosporidium parvum
SHGNSF

SEQ ID NO: 2332159 - protein, 11 aa, Cryptosporidium parvum
SHGYQEGNNQF

SEQ ID NO: 2332160 - protein, 5 aa, Cryptosporidium parvum
SHLTD

SEQ ID NO: 2332161 - protein, 8 aa, Cryptosporidium parvum
SHNDPEYI

SEQ ID NO: 2332162 - protein, 9 aa, Cryptosporidium parvum
SHNPGGIDE

SEQ ID NO: 2332163 - protein, 10 aa, Cryptosporidium parvum
SHNSSTKYGN

SEQ ID NO: 2332164 - protein, 5 aa, Cryptosporidium parvum
SHPHA

SEQ ID NO: 2332165 - protein, 9 aa, Cryptosporidium parvum
SHRGGGGCH

SEQ ID NO: 2332166 - protein, 10 aa, Cryptosporidium parvum
SHRNPKRERG

SEQ ID NO: 2332167 - protein, 38 aa, Cryptosporidium parvum
SHSEEVPAPSNSTESSLSSEDLVSDTQEQTSTNETAVE

SEQ ID NO: 2332168 - protein, 7 aa, Cryptosporidium parvum
SHSHEKK

SEQ ID NO: 2332169 - protein, 7 aa, Cryptosporidium parvum
SHSKPFS

SEQ ID NO: 2332170 - protein, 8 aa, Cryptosporidium parvum
SHSSTTTY

SEQ ID NO: 2332171 - protein, 11 aa, Cryptosporidium parvum
SHYNNTSPGYP

SEQ ID NO: 2332172 - protein, 7 aa, Cryptosporidium parvum
SIADSTR

SEQ ID NO: 2332173 - protein, 40 aa, Cryptosporidium parvum
SIAPGEDTPIPSSVESSLQTEQSLGKGETSTSNPLENSVS

SEQ ID NO: 2332174 - protein, 13 aa, Cryptosporidium parvum
SIEASNSPGIDDV

SEQ ID NO: 2332175 - protein, 14 aa, Cryptosporidium parvum
SIENPSSISNEKFE

SEQ ID NO: 2332176 - protein, 8 aa, Cryptosporidium parvum
SIENSGNE

SEQ ID NO: 2332177 - protein, 28 aa, Cryptosporidium parvum
SIETGNKTAIQSKAARPASISSSPKRLE

SEQ ID NO: 2332178 - protein, 25 aa, Cryptosporidium parvum
SIGGRSGNVNMQKKETKKSPTNNEI

SEQ ID NO: 2332179 - protein, 12 aa, Cryptosporidium parvum
SIGKSKAVRGRG

SEQ ID NO: 2332180 - protein, 5 aa, Cryptosporidium parvum
SIGNQ

SEQ ID NO: 2332181 - protein, 4 aa, Cryptosporidium parvum
SIGS

SEQ ID NO: 2332182 - protein, 6 aa, Cryptosporidium parvum
SIIQET

SEQ ID NO: 2332183 - protein, 13 aa, Cryptosporidium parvum
SIKDSTQNSNQDR

SEQ ID NO: 2332184 - protein, 7 aa, Cryptosporidium parvum
SIKEEQD

SEQ ID NO: 2332185 - protein, 18 aa, Cryptosporidium parvum
SIKGEKSQAIEIDPNSQL

SEQ ID NO: 2332186 - protein, 12 aa, Cryptosporidium parvum
SIKKGTKDIDRE

SEQ ID NO: 2332187 - protein, 15 aa, Cryptosporidium parvum
SIKNETEQNSSIQTG

SEQ ID NO: 2332188 - protein, 12 aa, Cryptosporidium parvum
SILSTKYDGGYV

SEQ ID NO: 2332189 - protein, 24 aa, Cryptosporidium parvum
SINDRENNRKQNRLGNKGRQIKNS

SEQ ID NO: 2332190 - protein, 5 aa, Cryptosporidium parvum
SINDS

SEQ ID NO: 2332191 - protein, 50 aa, Cryptosporidium parvum
SINESNKSHQQSKGEGISEESEGACSSHVTEKRVSKKRLANEKPGDTPLV

SEQ ID NO: 2332192 - protein, 15 aa, Cryptosporidium parvum
SINGSCNHKNIGSSL

SEQ ID NO: 2332193 - protein, 13 aa, Cryptosporidium parvum
SINNQEGKNSLSN

SEQ ID NO: 2332194 - protein, 6 aa, Cryptosporidium parvum
SINPAD

SEQ ID NO: 2332195 - protein, 4 aa, Cryptosporidium parvum
SINQ

SEQ ID NO: 2332196 - protein, 6 aa, Cryptosporidium parvum
SINTSN

SEQ ID NO: 2332197 - protein, 17 aa, Cryptosporidium parvum
SIPASISGVADSPSISL

SEQ ID NO: 2332198 - protein, 24 aa, Cryptosporidium parvum
SIPEKSELDTDVTDEETNKENDFS

SEQ ID NO: 2332199 - protein, 5 aa, Cryptosporidium parvum
SIPNP

SEQ ID NO: 2332200 - protein, 16 aa, Cryptosporidium parvum
SIPQEASVSSPESSSL

SEQ ID NO: 2332201 - protein, 13 aa, Cryptosporidium parvum
SIPQGQENQTSHD

SEQ ID NO: 2332202 - protein, 7 aa, Cryptosporidium parvum
SIPSVGS

SEQ ID NO: 2332203 - protein, 15 aa, Cryptosporidium parvum
SIPTHDEKGRPLPDD

SEQ ID NO: 2332204 - protein, 4 aa, Cryptosporidium parvum
SIQN

SEQ ID NO: 2332205 - protein, 8 aa, Cryptosporidium parvum
SISGPPNI

SEQ ID NO: 2332206 - protein, 13 aa, Cryptosporidium parvum
SISGSENSPAQDI

SEQ ID NO: 2332207 - protein, 28 aa, Cryptosporidium parvum
SISHSEKQLKYSQDHSKLPKNEIPKLNT

SEQ ID NO: 2332208 - protein, 29 aa, Cryptosporidium parvum
SISKSPSAFPNQSQQYSPVYEQSPSKNSR

SEQ ID NO: 2332209 - protein, 8 aa, Cryptosporidium parvum
SISLKPKD

SEQ ID NO: 2332210 - protein, 12 aa, Cryptosporidium parvum
SISPDSKDEPSI

SEQ ID NO: 2332211 - protein, 10 aa, Cryptosporidium parvum
SISPGNKNVS

SEQ ID NO: 2332212 - protein, 6 aa, Cryptosporidium parvum
SISPTN

SEQ ID NO: 2332213 - protein, 8 aa, Cryptosporidium parvum
SISRDNSR

SEQ ID NO: 2332214 - protein, 9 aa, Cryptosporidium parvum
SISSNKDSN

SEQ ID NO: 2332215 - protein, 7 aa, Cryptosporidium parvum
SISTSEC

SEQ ID NO: 2332216 - protein, 9 aa, Cryptosporidium parvum
SITQQQGKQ

SEQ ID NO: 2332217 - protein, 6 aa, Cryptosporidium parvum
SKAGIE

SEQ ID NO: 2332218 - protein, 10 aa, Cryptosporidium parvum
SKAPSRLKTK

SEQ ID NO: 2332219 - protein, 7 aa, Cryptosporidium parvum
SKASEYI

SEQ ID NO: 2332220 - protein, 6 aa, Cryptosporidium parvum
SKASPL

SEQ ID NO: 2332221 - protein, 4 aa, Cryptosporidium parvum
SKCG

SEQ ID NO: 2332222 - protein, 6 aa, Cryptosporidium parvum
SKDDIL

SEQ ID NO: 2332223 - protein, 6 aa, Cryptosporidium parvum
SKDDNI

SEQ ID NO: 2332224 - protein, 4 aa, Cryptosporidium parvum
SKDL

SEQ ID NO: 2332225 - protein, 7 aa, Cryptosporidium parvum
SKDLDSE

SEQ ID NO: 2332226 - protein, 7 aa, Cryptosporidium parvum
SKDLKRR

SEQ ID NO: 2332227 - protein, 10 aa, Cryptosporidium parvum
SKDSSKDMSN

SEQ ID NO: 2332228 - protein, 7 aa, Cryptosporidium parvum
SKEDEVS

SEQ ID NO: 2332229 - protein, 5 aa, Cryptosporidium parvum
SKEDK

SEQ ID NO: 2332230 - protein, 4 aa, Cryptosporidium parvum
SKEE

SEQ ID NO: 2332231 - protein, 9 aa, Cryptosporidium parvum
SKEIGSGCN

SEQ ID NO: 2332232 - protein, 21 aa, Cryptosporidium parvum
SKEKQISEREKEEIERLGDKE

SEQ ID NO: 2332233 - protein, 6 aa, Cryptosporidium parvum
SKELTK

SEQ ID NO: 2332234 - protein, 9 aa, Cryptosporidium parvum
SKERTRSHS

SEQ ID NO: 2332235 - protein, 9 aa, Cryptosporidium parvum
SKESEDAKK

SEQ ID NO: 2332236 - protein, 7 aa, Cryptosporidium parvum
SKFSNKL

SEQ ID NO: 2332237 - protein, 5 aa, Cryptosporidium parvum
SKGAE

SEQ ID NO: 2332238 - protein, 9 aa, Cryptosporidium parvum
SKGEENEKL

SEQ ID NO: 2332239 - protein, 6 aa, Cryptosporidium parvum
SKGEKA

SEQ ID NO: 2332240 - protein, 11 aa, Cryptosporidium parvum
SKHTSSNPIGT

SEQ ID NO: 2332241 - protein, 14 aa, Cryptosporidium parvum
SKISTQGTHALSEE

SEQ ID NO: 2332242 - protein, 10 aa, Cryptosporidium parvum
SKKENIDDIS

SEQ ID NO: 2332243 - protein, 10 aa, Cryptosporidium parvum
SKKESDINNS

SEQ ID NO: 2332244 - protein, 14 aa, Cryptosporidium parvum
SKKKSGSSPQSGLL

SEQ ID NO: 2332245 - protein, 5 aa, Cryptosporidium parvum
SKKKT

SEQ ID NO: 2332246 - protein, 17 aa, Cryptosporidium parvum
SKKLKEEDNDKTSDDLK

SEQ ID NO: 2332247 - protein, 15 aa, Cryptosporidium parvum
SKKQSKKQKSNNKKS

SEQ ID NO: 2332248 - protein, 6 aa, Cryptosporidium parvum
SKKQTD

SEQ ID NO: 2332249 - protein, 5 aa, Cryptosporidium parvum
SKKRA

SEQ ID NO: 2332250 - protein, 18 aa, Cryptosporidium parvum
SKKRGCVSGRKDESYENS

SEQ ID NO: 2332251 - protein, 9 aa, Cryptosporidium parvum
SKKRPSGAS

SEQ ID NO: 2332252 - protein, 10 aa, Cryptosporidium parvum
SKKTKNNDRY

SEQ ID NO: 2332253 - protein, 4 aa, Cryptosporidium parvum
SKLP

SEQ ID NO: 2332254 - protein, 5 aa, Cryptosporidium parvum
SKLPE

SEQ ID NO: 2332255 - protein, 6 aa, Cryptosporidium parvum
SKLRER

SEQ ID NO: 2332256 - protein, 12 aa, Cryptosporidium parvum
SKLSEDDEIYFV

SEQ ID NO: 2332257 - protein, 14 aa, Cryptosporidium parvum
SKMGENDHIPDENE

SEQ ID NO: 2332258 - protein, 10 aa, Cryptosporidium parvum
SKNDEPKYSS

SEQ ID NO: 2332259 - protein, 17 aa, Cryptosporidium parvum
SKNDRQIIGSNKDETNK

SEQ ID NO: 2332260 - protein, 4 aa, Cryptosporidium parvum
SKNE

SEQ ID NO: 2332261 - protein, 7 aa, Cryptosporidium parvum
SKNESII

SEQ ID NO: 2332262 - protein, 8 aa, Cryptosporidium parvum
SKNISSNL

SEQ ID NO: 2332263 - protein, 7 aa, Cryptosporidium parvum
SKNNDGI

SEQ ID NO: 2332264 - protein, 47 aa, Cryptosporidium parvum
SKNNDGKKTIISSSSNNSNNNNNNNNSTNDKNSTKSNKNKHSDLDEE

SEQ ID NO: 2332265 - protein, 8 aa, Cryptosporidium parvum
SKNNEDKQ

SEQ ID NO: 2332266 - protein, 6 aa, Cryptosporidium parvum
SKNNGF

SEQ ID NO: 2332267 - protein, 4 aa, Cryptosporidium parvum
SKNS

SEQ ID NO: 2332268 - protein, 9 aa, Cryptosporidium parvum
SKNSEEIST

SEQ ID NO: 2332269 - protein, 37 aa, Cryptosporidium parvum
SKNSGIPESKNDDYNNNNNNNSNNNNSNNKQNNNIDS

SEQ ID NO: 2332270 - protein, 7 aa, Cryptosporidium parvum
SKNSKDN

SEQ ID NO: 2332271 - protein, 10 aa, Cryptosporidium parvum
SKNSTPEEIE

SEQ ID NO: 2332272 - protein, 8 aa, Cryptosporidium parvum
SKNVPSKA

SEQ ID NO: 2332273 - protein, 9 aa, Cryptosporidium parvum
SKPDFGGLH

SEQ ID NO: 2332274 - protein, 7 aa, Cryptosporidium parvum
SKPDVSG

SEQ ID NO: 2332275 - protein, 9 aa, Cryptosporidium parvum
SKPEVVRPG

SEQ ID NO: 2332276 - protein, 4 aa, Cryptosporidium parvum
SKPF

SEQ ID NO: 2332277 - protein, 7 aa, Cryptosporidium parvum
SKPITNN

SEQ ID NO: 2332278 - protein, 6 aa, Cryptosporidium parvum
SKPKLE

SEQ ID NO: 2332279 - protein, 9 aa, Cryptosporidium parvum
SKPKSSKSI

SEQ ID NO: 2332280 - protein, 7 aa, Cryptosporidium parvum
SKPPFEA

SEQ ID NO: 2332281 - protein, 7 aa, Cryptosporidium parvum
SKPSEIV

SEQ ID NO: 2332282 - protein, 10 aa, Cryptosporidium parvum
SKPSSALASE

SEQ ID NO: 2332283 - protein, 21 aa, Cryptosporidium parvum
SKQFSTGKTWERPSGAQGNNN

SEQ ID NO: 2332284 - protein, 6 aa, Cryptosporidium parvum
SKQGNK

SEQ ID NO: 2332285 - protein, 10 aa, Cryptosporidium parvum
SKQKGTSIDP

SEQ ID NO: 2332286 - protein, 5 aa, Cryptosporidium parvum
SKQKN

SEQ ID NO: 2332287 - protein, 8 aa, Cryptosporidium parvum
SKQSSGLS

SEQ ID NO: 2332288 - protein, 9 aa, Cryptosporidium parvum
SKRDSEGKI

SEQ ID NO: 2332289 - protein, 7 aa, Cryptosporidium parvum
SKRIEKN

SEQ ID NO: 2332290 - protein, 6 aa, Cryptosporidium parvum
SKRIES

SEQ ID NO: 2332291 - protein, 6 aa, Cryptosporidium parvum
SKRKGS

SEQ ID NO: 2332292 - protein, 21 aa, Cryptosporidium parvum
SKRKKSLTKNNDQRTKISNTT

SEQ ID NO: 2332293 - protein, 5 aa, Cryptosporidium parvum
SKRSD

SEQ ID NO: 2332294 - protein, 4 aa, Cryptosporidium parvum
SKRY

SEQ ID NO: 2332295 - protein, 8 aa, Cryptosporidium parvum
SKSCPKNC

SEQ ID NO: 2332296 - protein, 4 aa, Cryptosporidium parvum
SKSE

SEQ ID NO: 2332297 - protein, 7 aa, Cryptosporidium parvum
SKSEIEE

SEQ ID NO: 2332298 - protein, 10 aa, Cryptosporidium parvum
SKSEKTLTTE

SEQ ID NO: 2332299 - protein, 164 aa, Cryptosporidium parvum
SKSGNTKEPKPEKESKSSCACSKSDKTKEPKPEKESKSSCACSKSDKTKEPKPEKESKSSCACSKSDKTKEPKPEKESKSSCACSKSDKTKEPKPEKESKSSCACSKSNKTKEPKPEKESKSSCACSKSEKTKKSKLEEEDSGSSCASCSSKKSKKRSGRDDNS

SEQ ID NO: 2332300 - protein, 6 aa, Cryptosporidium parvum
SKSINS

SEQ ID NO: 2332301 - protein, 7 aa, Cryptosporidium parvum
SKSKNLN

SEQ ID NO: 2332302 - protein, 30 aa, Cryptosporidium parvum
SKSKQSLRSQQGSTTKTETSHSEKPHTSEL

SEQ ID NO: 2332303 - protein, 7 aa, Cryptosporidium parvum
SKSLENK

SEQ ID NO: 2332304 - protein, 323 aa, Cryptosporidium parvum
SKSNDEQAKEQSSSKSGESKPEESNLDKTKPKEPSPDEKKPEESKSDEAKPGESKSDETKPGESKSDETKPGESKSDEAKPGESKSDETKPGESKSDETKPGESKSDESKPEETKPDETKPEEAKSEEAKPEETKPDEKNPEESKPEETKPEEAKHDEENSGKGNSTEPKSLESIENSKDDLKKEDKSEDSSAKESTEENSNKSSDSEADANKDFSSSEVAQEEDLASESTDNLNDQTGNSDGAENTSEEKSSEENDEKSMKTDTNDQSNGDVKNDEVKNEDSKNDTSLSDASKDTSKEGNNSEIKANGDDKLEDNVEKTIQE

SEQ ID NO: 2332305 - protein, 8 aa, Cryptosporidium parvum
SKSSSDNL

SEQ ID NO: 2332306 - protein, 8 aa, Cryptosporidium parvum
SKSSSSLN

SEQ ID NO: 2332307 - protein, 6 aa, Cryptosporidium parvum
SKTAAI

SEQ ID NO: 2332308 - protein, 6 aa, Cryptosporidium parvum
SKTFSS

SEQ ID NO: 2332309 - protein, 14 aa, Cryptosporidium parvum
SKTGKDVKSDKRAL

SEQ ID NO: 2332310 - protein, 8 aa, Cryptosporidium parvum
SKTKNANY

SEQ ID NO: 2332311 - protein, 30 aa, Cryptosporidium parvum
SKTQSTTAPPSPFPPPSPPPSPLPPPLPPK

SEQ ID NO: 2332312 - protein, 4 aa, Cryptosporidium parvum
SKTR

SEQ ID NO: 2332313 - protein, 8 aa, Cryptosporidium parvum
SKTSGNCG

SEQ ID NO: 2332314 - protein, 6 aa, Cryptosporidium parvum
SKTSLA

SEQ ID NO: 2332315 - protein, 6 aa, Cryptosporidium parvum
SKTVDS

SEQ ID NO: 2332316 - protein, 6 aa, Cryptosporidium parvum
SKTYRH

SEQ ID NO: 2332317 - protein, 19 aa, Cryptosporidium parvum
SKVGKRRADETHKKPLAAS

SEQ ID NO: 2332318 - protein, 14 aa, Cryptosporidium parvum
SKVKKKSDKKEETL

SEQ ID NO: 2332319 - protein, 7 aa, Cryptosporidium parvum
SKVMPTT

SEQ ID NO: 2332320 - protein, 5 aa, Cryptosporidium parvum
SKVNT

SEQ ID NO: 2332321 - protein, 5 aa, Cryptosporidium parvum
SKVQP

SEQ ID NO: 2332322 - protein, 5 aa, Cryptosporidium parvum
SKVSK

SEQ ID NO: 2332323 - protein, 9 aa, Cryptosporidium parvum
SKYFNDSND

SEQ ID NO: 2332324 - protein, 10 aa, Cryptosporidium parvum
SKYGDNKLDT

SEQ ID NO: 2332325 - protein, 8 aa, Cryptosporidium parvum
SKYPSVEL

SEQ ID NO: 2332326 - protein, 17 aa, Cryptosporidium parvum
SKYSKLEQRDVDGKIGS

SEQ ID NO: 2332327 - protein, 6 aa, Cryptosporidium parvum
SLADKL

SEQ ID NO: 2332328 - protein, 13 aa, Cryptosporidium parvum
SLAPKKPKPTNED

SEQ ID NO: 2332329 - protein, 8 aa, Cryptosporidium parvum
SLAPLPPE

SEQ ID NO: 2332330 - protein, 27 aa, Cryptosporidium parvum
SLDATNSNQGTVDNKKATAKPTHPEPI

SEQ ID NO: 2332331 - protein, 14 aa, Cryptosporidium parvum
SLDDGKDIDSDNIA

SEQ ID NO: 2332332 - protein, 15 aa, Cryptosporidium parvum
SLDEITKSKSISSPN

SEQ ID NO: 2332333 - protein, 24 aa, Cryptosporidium parvum
SLDENNDEIKSEYNYGYDQNEIDD

SEQ ID NO: 2332334 - protein, 55 aa, Cryptosporidium parvum
SLDESALGAVGGQPLDGSSLESRSSGSTSSLDSTSSSLLENSESSVRPDPEKVPV

SEQ ID NO: 2332335 - protein, 8 aa, Cryptosporidium parvum
SLDNEIDE

SEQ ID NO: 2332336 - protein, 11 aa, Cryptosporidium parvum
SLDWKGKESGI

SEQ ID NO: 2332337 - protein, 10 aa, Cryptosporidium parvum
SLEESSSRVC

SEQ ID NO: 2332338 - protein, 4 aa, Cryptosporidium parvum
SLEG

SEQ ID NO: 2332339 - protein, 4 aa, Cryptosporidium parvum
SLEN

SEQ ID NO: 2332340 - protein, 4 aa, Cryptosporidium parvum
SLES

SEQ ID NO: 2332341 - protein, 6 aa, Cryptosporidium parvum
SLESNS

SEQ ID NO: 2332342 - protein, 13 aa, Cryptosporidium parvum
SLESTNSRKWSGE

SEQ ID NO: 2332343 - protein, 23 aa, Cryptosporidium parvum
SLETGSEGEPVALPQQDAQKPQF

SEQ ID NO: 2332344 - protein, 9 aa, Cryptosporidium parvum
SLETTSCNS

SEQ ID NO: 2332345 - protein, 6 aa, Cryptosporidium parvum
SLGAQY

SEQ ID NO: 2332346 - protein, 15 aa, Cryptosporidium parvum
SLGETETLSKKQQQI

SEQ ID NO: 2332347 - protein, 6 aa, Cryptosporidium parvum
SLGKES

SEQ ID NO: 2332348 - protein, 45 aa, Cryptosporidium parvum
SLGNTGSNSNDSDPEDEGPPSFVPPPPPGKKGASGSSPDGRPVPL

SEQ ID NO: 2332349 - protein, 6 aa, Cryptosporidium parvum
SLHEQK

SEQ ID NO: 2332350 - protein, 9 aa, Cryptosporidium parvum
SLKDGNNNI

SEQ ID NO: 2332351 - protein, 5 aa, Cryptosporidium parvum
SLKPS

SEQ ID NO: 2332352 - protein, 8 aa, Cryptosporidium parvum
SLKPSSKH

SEQ ID NO: 2332353 - protein, 75 aa, Cryptosporidium parvum
SLKSNPLGNENNYQAYSDRNHYSSNKKVGPKGIVSPGGLGSNRANYSYNSQSVNNGGALSHSRTVHSRSSLSPGN

SEQ ID NO: 2332354 - protein, 36 aa, Cryptosporidium parvum
SLKSSSSSSKIETLSGSDSKLGSSTSISFTPYQGMI

SEQ ID NO: 2332355 - protein, 7 aa, Cryptosporidium parvum
SLNNGAS

SEQ ID NO: 2332356 - protein, 31 aa, Cryptosporidium parvum
SLNPPRKIRDNKNKVSNSNIKRDNSIVNSQH

SEQ ID NO: 2332357 - protein, 9 aa, Cryptosporidium parvum
SLNQEGKDG

SEQ ID NO: 2332358 - protein, 7 aa, Cryptosporidium parvum
SLQEGLP

SEQ ID NO: 2332359 - protein, 7 aa, Cryptosporidium parvum
SLQKNET

SEQ ID NO: 2332360 - protein, 9 aa, Cryptosporidium parvum
SLQSKTLAE

SEQ ID NO: 2332361 - protein, 29 aa, Cryptosporidium parvum
SLRDNINQSLSKEPLNKNRSLGKGGKKHL

SEQ ID NO: 2332362 - protein, 16 aa, Cryptosporidium parvum
SLRGNNESKDNHDGIT

SEQ ID NO: 2332363 - protein, 15 aa, Cryptosporidium parvum
SLRNNQRNEIKNSAN

SEQ ID NO: 2332364 - protein, 8 aa, Cryptosporidium parvum
SLRQSKTE

SEQ ID NO: 2332365 - protein, 8 aa, Cryptosporidium parvum
SLRSSEEG

SEQ ID NO: 2332366 - protein, 10 aa, Cryptosporidium parvum
SLSDNKESGY

SEQ ID NO: 2332367 - protein, 8 aa, Cryptosporidium parvum
SLSEEKRN

SEQ ID NO: 2332368 - protein, 6 aa, Cryptosporidium parvum
SLSNKQ

SEQ ID NO: 2332369 - protein, 15 aa, Cryptosporidium parvum
SLSNNDKNEAADEKI

SEQ ID NO: 2332370 - protein, 9 aa, Cryptosporidium parvum
SLSQKAASP

SEQ ID NO: 2332371 - protein, 12 aa, Cryptosporidium parvum
SLSSLSDSNVQN

SEQ ID NO: 2332372 - protein, 10 aa, Cryptosporidium parvum
SLSSNEPIDT

SEQ ID NO: 2332373 - protein, 20 aa, Cryptosporidium parvum
SLSSNQKNLEESVKTAEQDL

SEQ ID NO: 2332374 - protein, 8 aa, Cryptosporidium parvum
SLSSPSSF

SEQ ID NO: 2332375 - protein, 8 aa, Cryptosporidium parvum
SLSSYDKK

SEQ ID NO: 2332376 - protein, 10 aa, Cryptosporidium parvum
SLTPGKDSAN

SEQ ID NO: 2332377 - protein, 6 aa, Cryptosporidium parvum
SLTPSR

SEQ ID NO: 2332378 - protein, 7 aa, Cryptosporidium parvum
SLTSASS

SEQ ID NO: 2332379 - protein, 6 aa, Cryptosporidium parvum
SLTTSG

SEQ ID NO: 2332380 - protein, 14 aa, Cryptosporidium parvum
SLYSSDGNTKTSNI

SEQ ID NO: 2332381 - protein, 9 aa, Cryptosporidium parvum
SMASSIGSN

SEQ ID NO: 2332382 - protein, 19 aa, Cryptosporidium parvum
SMDTRSEDLEEKKYKSPFE

SEQ ID NO: 2332383 - protein, 5 aa, Cryptosporidium parvum
SMGPM

SEQ ID NO: 2332384 - protein, 5 aa, Cryptosporidium parvum
SMIPR

SEQ ID NO: 2332385 - protein, 7 aa, Cryptosporidium parvum
SMNEPSA

SEQ ID NO: 2332386 - protein, 62 aa, Cryptosporidium parvum
SMQRSRSRSRSRSRSRSSKSRTSRSRTSRSRSRSRAMEESSCAASSSRSSLLSTRQSSVSAS

SEQ ID NO: 2332387 - protein, 10 aa, Cryptosporidium parvum
SMSGDTNGQL

SEQ ID NO: 2332388 - protein, 5 aa, Cryptosporidium parvum
SMTEE

SEQ ID NO: 2332389 - protein, 5 aa, Cryptosporidium parvum
SNAEL

SEQ ID NO: 2332390 - protein, 6 aa, Cryptosporidium parvum
SNDADK

SEQ ID NO: 2332391 - protein, 7 aa, Cryptosporidium parvum
SNDADKI

SEQ ID NO: 2332392 - protein, 9 aa, Cryptosporidium parvum
SNDAHGSSS

SEQ ID NO: 2332393 - protein, 22 aa, Cryptosporidium parvum
SNDESYSETNSTRKISTTDYSE

SEQ ID NO: 2332394 - protein, 7 aa, Cryptosporidium parvum
SNDIRSL

SEQ ID NO: 2332395 - protein, 7 aa, Cryptosporidium parvum
SNDREVT

SEQ ID NO: 2332396 - protein, 9 aa, Cryptosporidium parvum
SNEDINVST

SEQ ID NO: 2332397 - protein, 7 aa, Cryptosporidium parvum
SNEESGS

SEQ ID NO: 2332398 - protein, 6 aa, Cryptosporidium parvum
SNEGFR

SEQ ID NO: 2332399 - protein, 5 aa, Cryptosporidium parvum
SNEII

SEQ ID NO: 2332400 - protein, 9 aa, Cryptosporidium parvum
SNEKNSGIV

SEQ ID NO: 2332401 - protein, 12 aa, Cryptosporidium parvum
SNETCSGKANRA

SEQ ID NO: 2332402 - protein, 10 aa, Cryptosporidium parvum
SNETSTVRGP

SEQ ID NO: 2332403 - protein, 7 aa, Cryptosporidium parvum
SNEYNER

SEQ ID NO: 2332404 - protein, 10 aa, Cryptosporidium parvum
SNFDNTSRGF

SEQ ID NO: 2332405 - protein, 4 aa, Cryptosporidium parvum
SNGD

SEQ ID NO: 2332406 - protein, 22 aa, Cryptosporidium parvum
SNGEVDSSTSGGESSSDIGSQR

SEQ ID NO: 2332407 - protein, 5 aa, Cryptosporidium parvum
SNGGS

SEQ ID NO: 2332408 - protein, 31 aa, Cryptosporidium parvum
SNGGTCTLQNGDRNCKTNSATVISGNPNVAV

SEQ ID NO: 2332409 - protein, 7 aa, Cryptosporidium parvum
SNGIDSS

SEQ ID NO: 2332410 - protein, 8 aa, Cryptosporidium parvum
SNGNDPPI

SEQ ID NO: 2332411 - protein, 29 aa, Cryptosporidium parvum
SNGSISSTNNNSETNSLNGEIPNNSSEFP

SEQ ID NO: 2332412 - protein, 9 aa, Cryptosporidium parvum
SNGSSNNSL

SEQ ID NO: 2332413 - protein, 19 aa, Cryptosporidium parvum
SNGSSSNLNSSSGTGSSRK

SEQ ID NO: 2332414 - protein, 8 aa, Cryptosporidium parvum
SNHGESLN

SEQ ID NO: 2332415 - protein, 7 aa, Cryptosporidium parvum
SNHTKSV

SEQ ID NO: 2332416 - protein, 7 aa, Cryptosporidium parvum
SNIKLGS

SEQ ID NO: 2332417 - protein, 12 aa, Cryptosporidium parvum
SNINKEREVSTL

SEQ ID NO: 2332418 - protein, 11 aa, Cryptosporidium parvum
SNISPSKQESK

SEQ ID NO: 2332419 - protein, 4 aa, Cryptosporidium parvum
SNIV

SEQ ID NO: 2332420 - protein, 17 aa, Cryptosporidium parvum
SNKDVENSTDKEKTDSI

SEQ ID NO: 2332421 - protein, 8 aa, Cryptosporidium parvum
SNKGDQDL

SEQ ID NO: 2332422 - protein, 4 aa, Cryptosporidium parvum
SNKK

SEQ ID NO: 2332423 - protein, 5 aa, Cryptosporidium parvum
SNKYL

SEQ ID NO: 2332424 - protein, 11 aa, Cryptosporidium parvum
SNLEQKEHSEL

SEQ ID NO: 2332425 - protein, 6 aa, Cryptosporidium parvum
SNLEST

SEQ ID NO: 2332426 - protein, 11 aa, Cryptosporidium parvum
SNLNNNPQLNG

SEQ ID NO: 2332427 - protein, 9 aa, Cryptosporidium parvum
SNLPSNNKI

SEQ ID NO: 2332428 - protein, 5 aa, Cryptosporidium parvum
SNNDY

SEQ ID NO: 2332429 - protein, 5 aa, Cryptosporidium parvum
SNNED

SEQ ID NO: 2332430 - protein, 17 aa, Cryptosporidium parvum
SNNENTKEEYNESSMRQ

SEQ ID NO: 2332431 - protein, 8 aa, Cryptosporidium parvum
SNNGTSKH

SEQ ID NO: 2332432 - protein, 8 aa, Cryptosporidium parvum
SNNNGTGE

SEQ ID NO: 2332433 - protein, 21 aa, Cryptosporidium parvum
SNNNNNKPSKSILNTSTTTTT

SEQ ID NO: 2332434 - protein, 19 aa, Cryptosporidium parvum
SNNPESAKEELKKSAKKLG

SEQ ID NO: 2332435 - protein, 9 aa, Cryptosporidium parvum
SNNSAFPSG

SEQ ID NO: 2332436 - protein, 12 aa, Cryptosporidium parvum
SNNTDNSTLSGS

SEQ ID NO: 2332437 - protein, 6 aa, Cryptosporidium parvum
SNPESP

SEQ ID NO: 2332438 - protein, 6 aa, Cryptosporidium parvum
SNPIDS

SEQ ID NO: 2332439 - protein, 6 aa, Cryptosporidium parvum
SNPNNV

SEQ ID NO: 2332440 - protein, 20 aa, Cryptosporidium parvum
SNPPKQSATTTTTKTPWDQD

SEQ ID NO: 2332441 - protein, 9 aa, Cryptosporidium parvum
SNPQPNTNE

SEQ ID NO: 2332442 - protein, 6 aa, Cryptosporidium parvum
SNPTAG

SEQ ID NO: 2332443 - protein, 8 aa, Cryptosporidium parvum
SNQATSQY

SEQ ID NO: 2332444 - protein, 14 aa, Cryptosporidium parvum
SNQESNRQRNSNKT

SEQ ID NO: 2332445 - protein, 41 aa, Cryptosporidium parvum
SNQVGSGSAPITDRNTPWGHANANGDVSTGDEYSCEEGTKL

SEQ ID NO: 2332446 - protein, 13 aa, Cryptosporidium parvum
SNRGKKKRKAKKY

SEQ ID NO: 2332447 - protein, 8 aa, Cryptosporidium parvum
SNRKEGKL

SEQ ID NO: 2332448 - protein, 7 aa, Cryptosporidium parvum
SNRLNSK

SEQ ID NO: 2332449 - protein, 20 aa, Cryptosporidium parvum
SNRNGIQSQSTGYYIRSFKI

SEQ ID NO: 2332450 - protein, 9 aa, Cryptosporidium parvum
SNRPTRAEM

SEQ ID NO: 2332451 - protein, 15 aa, Cryptosporidium parvum
SNSCSGPYPENSQVN

SEQ ID NO: 2332452 - protein, 9 aa, Cryptosporidium parvum
SNSDDGVQK

SEQ ID NO: 2332453 - protein, 8 aa, Cryptosporidium parvum
SNSDVGSG

SEQ ID NO: 2332454 - protein, 30 aa, Cryptosporidium parvum
SNSDYESSDNKLQGSTNECNTNKASTSFDD

SEQ ID NO: 2332455 - protein, 4 aa, Cryptosporidium parvum
SNSE

SEQ ID NO: 2332456 - protein, 7 aa, Cryptosporidium parvum
SNSESNV

SEQ ID NO: 2332457 - protein, 6 aa, Cryptosporidium parvum
SNSETY

SEQ ID NO: 2332458 - protein, 6 aa, Cryptosporidium parvum
SNSLKS

SEQ ID NO: 2332459 - protein, 6 aa, Cryptosporidium parvum
SNSNED

SEQ ID NO: 2332460 - protein, 6 aa, Cryptosporidium parvum
SNSNMQ

SEQ ID NO: 2332461 - protein, 17 aa, Cryptosporidium parvum
SNSNNFGKNDINNGNNS

SEQ ID NO: 2332462 - protein, 7 aa, Cryptosporidium parvum
SNSNSNP

SEQ ID NO: 2332463 - protein, 15 aa, Cryptosporidium parvum
SNSQAVEQEDDESLE

SEQ ID NO: 2332464 - protein, 9 aa, Cryptosporidium parvum
SNSQKSVTC

SEQ ID NO: 2332465 - protein, 25 aa, Cryptosporidium parvum
SNSSLDNIKGQDDDELTSSEYLSEE

SEQ ID NO: 2332466 - protein, 9 aa, Cryptosporidium parvum
SNSSNANSF

SEQ ID NO: 2332467 - protein, 23 aa, Cryptosporidium parvum
SNSTNNNSSNNRFTTTTTTTTTV

SEQ ID NO: 2332468 - protein, 6 aa, Cryptosporidium parvum
SNSTSN

SEQ ID NO: 2332469 - protein, 9 aa, Cryptosporidium parvum
SNTEQDEGF

SEQ ID NO: 2332470 - protein, 4 aa, Cryptosporidium parvum
SNTG

SEQ ID NO: 2332471 - protein, 11 aa, Cryptosporidium parvum
SNTLDRYGSSN

SEQ ID NO: 2332472 - protein, 6 aa, Cryptosporidium parvum
SNTNAK

SEQ ID NO: 2332473 - protein, 9 aa, Cryptosporidium parvum
SNTNGNLED

SEQ ID NO: 2332474 - protein, 4 aa, Cryptosporidium parvum
SNTS

SEQ ID NO: 2332475 - protein, 12 aa, Cryptosporidium parvum
SNTSAKSVDGGR

SEQ ID NO: 2332476 - protein, 8 aa, Cryptosporidium parvum
SNTSKTKF

SEQ ID NO: 2332477 - protein, 4 aa, Cryptosporidium parvum
SNTT

SEQ ID NO: 2332478 - protein, 10 aa, Cryptosporidium parvum
SNVNDTTNLE

SEQ ID NO: 2332479 - protein, 6 aa, Cryptosporidium parvum
SNVPNY

SEQ ID NO: 2332480 - protein, 9 aa, Cryptosporidium parvum
SNYGTFTSN

SEQ ID NO: 2332481 - protein, 6 aa, Cryptosporidium parvum
SNYKKD

SEQ ID NO: 2332482 - protein, 13 aa, Cryptosporidium parvum
SNYLPNPRECTTD

SEQ ID NO: 2332483 - protein, 12 aa, Cryptosporidium parvum
SPAENPYNISGY

SEQ ID NO: 2332484 - protein, 8 aa, Cryptosporidium parvum
SPDIKKPI

SEQ ID NO: 2332485 - protein, 4 aa, Cryptosporidium parvum
SPDL

SEQ ID NO: 2332486 - protein, 6 aa, Cryptosporidium parvum
SPDSEI

SEQ ID NO: 2332487 - protein, 5 aa, Cryptosporidium parvum
SPDVN

SEQ ID NO: 2332488 - protein, 6 aa, Cryptosporidium parvum
SPENNS

SEQ ID NO: 2332489 - protein, 4 aa, Cryptosporidium parvum
SPEY

SEQ ID NO: 2332490 - protein, 5 aa, Cryptosporidium parvum
SPFKF

SEQ ID NO: 2332491 - protein, 9 aa, Cryptosporidium parvum
SPGDPRHSN

SEQ ID NO: 2332492 - protein, 6 aa, Cryptosporidium parvum
SPGKTL

SEQ ID NO: 2332493 - protein, 6 aa, Cryptosporidium parvum
SPGYEN

SEQ ID NO: 2332494 - protein, 16 aa, Cryptosporidium parvum
SPHSDHSRSRPTSGQK

SEQ ID NO: 2332495 - protein, 5 aa, Cryptosporidium parvum
SPIGQ

SEQ ID NO: 2332496 - protein, 8 aa, Cryptosporidium parvum
SPIQTGPI

SEQ ID NO: 2332497 - protein, 16 aa, Cryptosporidium parvum
SPISQAPSSIGGFNDN

SEQ ID NO: 2332498 - protein, 10 aa, Cryptosporidium parvum
SPISTCPSPD

SEQ ID NO: 2332499 - protein, 9 aa, Cryptosporidium parvum
SPISTNSEI

SEQ ID NO: 2332500 - protein, 12 aa, Cryptosporidium parvum
SPKENSSPEEIQ

SEQ ID NO: 2332501 - protein, 9 aa, Cryptosporidium parvum
SPKNENSKY

SEQ ID NO: 2332502 - protein, 7 aa, Cryptosporidium parvum
SPKTTLG

SEQ ID NO: 2332503 - protein, 5 aa, Cryptosporidium parvum
SPKTW

SEQ ID NO: 2332504 - protein, 18 aa, Cryptosporidium parvum
SPLGLPPDHPVNAQNPTI

SEQ ID NO: 2332505 - protein, 13 aa, Cryptosporidium parvum
SPLPHTKGQVPTY

SEQ ID NO: 2332506 - protein, 13 aa, Cryptosporidium parvum
SPMTNNENNSTKQ

SEQ ID NO: 2332507 - protein, 4 aa, Cryptosporidium parvum
SPNE

SEQ ID NO: 2332508 - protein, 4 aa, Cryptosporidium parvum
SPNF

SEQ ID NO: 2332509 - protein, 7 aa, Cryptosporidium parvum
SPNREAY

SEQ ID NO: 2332510 - protein, 7 aa, Cryptosporidium parvum
SPNTTVP

SEQ ID NO: 2332511 - protein, 15 aa, Cryptosporidium parvum
SPPASNEASAQQDTS

SEQ ID NO: 2332512 - protein, 5 aa, Cryptosporidium parvum
SPPLS

SEQ ID NO: 2332513 - protein, 4 aa, Cryptosporidium parvum
SPPN

SEQ ID NO: 2332514 - protein, 7 aa, Cryptosporidium parvum
SPPPDGR

SEQ ID NO: 2332515 - protein, 7 aa, Cryptosporidium parvum
SPPPREI

SEQ ID NO: 2332516 - protein, 17 aa, Cryptosporidium parvum
SPPTTQTATSVAVPTPE

SEQ ID NO: 2332517 - protein, 8 aa, Cryptosporidium parvum
SPPTTQTV

SEQ ID NO: 2332518 - protein, 4 aa, Cryptosporidium parvum
SPPV

SEQ ID NO: 2332519 - protein, 7 aa, Cryptosporidium parvum
SPQGQTL

SEQ ID NO: 2332520 - protein, 12 aa, Cryptosporidium parvum
SPQLHSADPRTV

SEQ ID NO: 2332521 - protein, 4 aa, Cryptosporidium parvum
SPQY

SEQ ID NO: 2332522 - protein, 4 aa, Cryptosporidium parvum
SPRE

SEQ ID NO: 2332523 - protein, 12 aa, Cryptosporidium parvum
SPRIRSSNLTSP

SEQ ID NO: 2332524 - protein, 7 aa, Cryptosporidium parvum
SPRNNGL

SEQ ID NO: 2332525 - protein, 6 aa, Cryptosporidium parvum
SPRRSS

SEQ ID NO: 2332526 - protein, 11 aa, Cryptosporidium parvum
SPSGFKPNNSV

SEQ ID NO: 2332527 - protein, 8 aa, Cryptosporidium parvum
SPSILSST

SEQ ID NO: 2332528 - protein, 8 aa, Cryptosporidium parvum
SPSKIRSG

SEQ ID NO: 2332529 - protein, 12 aa, Cryptosporidium parvum
SPSLSQEDRSLT

SEQ ID NO: 2332530 - protein, 5 aa, Cryptosporidium parvum
SPSNI

SEQ ID NO: 2332531 - protein, 16 aa, Cryptosporidium parvum
SPSPIPGKSPKTPRNL

SEQ ID NO: 2332532 - protein, 6 aa, Cryptosporidium parvum
SPSRIR

SEQ ID NO: 2332533 - protein, 5 aa, Cryptosporidium parvum
SPSVS

SEQ ID NO: 2332534 - protein, 6 aa, Cryptosporidium parvum
SPSVTP

SEQ ID NO: 2332535 - protein, 16 aa, Cryptosporidium parvum
SPTFSQNSPIQAIPPK

SEQ ID NO: 2332536 - protein, 6 aa, Cryptosporidium parvum
SPTHSK

SEQ ID NO: 2332537 - protein, 4 aa, Cryptosporidium parvum
SPTL

SEQ ID NO: 2332538 - protein, 15 aa, Cryptosporidium parvum
SPTSIPASVPNSAPG

SEQ ID NO: 2332539 - protein, 7 aa, Cryptosporidium parvum
SPTYPKC

SEQ ID NO: 2332540 - protein, 6 aa, Cryptosporidium parvum
SPVEST

SEQ ID NO: 2332541 - protein, 4 aa, Cryptosporidium parvum
SPVS

SEQ ID NO: 2332542 - protein, 19 aa, Cryptosporidium parvum
SPVTQESGVTVRSTNYRQS

SEQ ID NO: 2332543 - protein, 11 aa, Cryptosporidium parvum
SPYSGRSQQDL

SEQ ID NO: 2332544 - protein, 6 aa, Cryptosporidium parvum
SQCEDP

SEQ ID NO: 2332545 - protein, 10 aa, Cryptosporidium parvum
SQCPAGSIPR

SEQ ID NO: 2332546 - protein, 21 aa, Cryptosporidium parvum
SQEARKLEEDKTGVNKGSAEL

SEQ ID NO: 2332547 - protein, 7 aa, Cryptosporidium parvum
SQEFSQP

SEQ ID NO: 2332548 - protein, 9 aa, Cryptosporidium parvum
SQEGNKAYG

SEQ ID NO: 2332549 - protein, 4 aa, Cryptosporidium parvum
SQER

SEQ ID NO: 2332550 - protein, 9 aa, Cryptosporidium parvum
SQETRSESG

SEQ ID NO: 2332551 - protein, 5 aa, Cryptosporidium parvum
SQFNK

SEQ ID NO: 2332552 - protein, 5 aa, Cryptosporidium parvum
SQGEK

SEQ ID NO: 2332553 - protein, 8 aa, Cryptosporidium parvum
SQGKEAST

SEQ ID NO: 2332554 - protein, 8 aa, Cryptosporidium parvum
SQHSLNGS

SEQ ID NO: 2332555 - protein, 27 aa, Cryptosporidium parvum
SQIDGSEGQTDQSEYPNYNKEASISYS

SEQ ID NO: 2332556 - protein, 9 aa, Cryptosporidium parvum
SQIQKNKES

SEQ ID NO: 2332557 - protein, 16 aa, Cryptosporidium parvum
SQISNPNQKNNSEQIN

SEQ ID NO: 2332558 - protein, 6 aa, Cryptosporidium parvum
SQLKPT

SEQ ID NO: 2332559 - protein, 4 aa, Cryptosporidium parvum
SQLP

SEQ ID NO: 2332560 - protein, 8 aa, Cryptosporidium parvum
SQLQVKGT

SEQ ID NO: 2332561 - protein, 11 aa, Cryptosporidium parvum
SQLSRKPRKVP

SEQ ID NO: 2332562 - protein, 13 aa, Cryptosporidium parvum
SQLSSTSNGVNGR

SEQ ID NO: 2332563 - protein, 10 aa, Cryptosporidium parvum
SQNDKNGDGI

SEQ ID NO: 2332564 - protein, 6 aa, Cryptosporidium parvum
SQNGEY

SEQ ID NO: 2332565 - protein, 9 aa, Cryptosporidium parvum
SQNPSKLAT

SEQ ID NO: 2332566 - protein, 7 aa, Cryptosporidium parvum
SQNQQSL

SEQ ID NO: 2332567 - protein, 12 aa, Cryptosporidium parvum
SQNRSGSPNSKV

SEQ ID NO: 2332568 - protein, 16 aa, Cryptosporidium parvum
SQNSPNSKDSHSNSFS

SEQ ID NO: 2332569 - protein, 6 aa, Cryptosporidium parvum
SQNSSK

SEQ ID NO: 2332570 - protein, 6 aa, Cryptosporidium parvum
SQNTNY

SEQ ID NO: 2332571 - protein, 8 aa, Cryptosporidium parvum
SQPEKECP

SEQ ID NO: 2332572 - protein, 5 aa, Cryptosporidium parvum
SQPIV

SEQ ID NO: 2332573 - protein, 7 aa, Cryptosporidium parvum
SQPPQPV

SEQ ID NO: 2332574 - protein, 8 aa, Cryptosporidium parvum
SQQEELQK

SEQ ID NO: 2332575 - protein, 9 aa, Cryptosporidium parvum
SQQVSTTIE

SEQ ID NO: 2332576 - protein, 11 aa, Cryptosporidium parvum
SQSDKEGYSPN

SEQ ID NO: 2332577 - protein, 11 aa, Cryptosporidium parvum
SQSISREEFDR

SEQ ID NO: 2332578 - protein, 14 aa, Cryptosporidium parvum
SQSPTDIPSHSGPI

SEQ ID NO: 2332579 - protein, 5 aa, Cryptosporidium parvum
SQSRV

SEQ ID NO: 2332580 - protein, 9 aa, Cryptosporidium parvum
SQSSTPSCK

SEQ ID NO: 2332581 - protein, 5 aa, Cryptosporidium parvum
SQTEK

SEQ ID NO: 2332582 - protein, 8 aa, Cryptosporidium parvum
SQTKDEVT

SEQ ID NO: 2332583 - protein, 18 aa, Cryptosporidium parvum
SQVGSSLRSHSQSRGTFA

SEQ ID NO: 2332584 - protein, 9 aa, Cryptosporidium parvum
SQVKPEKKY

SEQ ID NO: 2332585 - protein, 4 aa, Cryptosporidium parvum
SRAQ

SEQ ID NO: 2332586 - protein, 7 aa, Cryptosporidium parvum
SRASLGQ

SEQ ID NO: 2332587 - protein, 14 aa, Cryptosporidium parvum
SRDVETKPGISASH

SEQ ID NO: 2332588 - protein, 8 aa, Cryptosporidium parvum
SREDLDSK

SEQ ID NO: 2332589 - protein, 7 aa, Cryptosporidium parvum
SREKPES

SEQ ID NO: 2332590 - protein, 6 aa, Cryptosporidium parvum
SREQNV

SEQ ID NO: 2332591 - protein, 6 aa, Cryptosporidium parvum
SRFSDK

SEQ ID NO: 2332592 - protein, 22 aa, Cryptosporidium parvum
SRFSKTNSSSWSIGNPKFFINQ

SEQ ID NO: 2332593 - protein, 5 aa, Cryptosporidium parvum
SRGER

SEQ ID NO: 2332594 - protein, 6 aa, Cryptosporidium parvum
SRGIPA

SEQ ID NO: 2332595 - protein, 7 aa, Cryptosporidium parvum
SRGKNER

SEQ ID NO: 2332596 - protein, 5 aa, Cryptosporidium parvum
SRHSR

SEQ ID NO: 2332597 - protein, 10 aa, Cryptosporidium parvum
SRIKDDQSQL

SEQ ID NO: 2332598 - protein, 6 aa, Cryptosporidium parvum
SRIPGS

SEQ ID NO: 2332599 - protein, 24 aa, Cryptosporidium parvum
SRISGHYNPESKENHSNLGQKTRL

SEQ ID NO: 2332600 - protein, 9 aa, Cryptosporidium parvum
SRKDETSEL

SEQ ID NO: 2332601 - protein, 6 aa, Cryptosporidium parvum
SRKDIT

SEQ ID NO: 2332602 - protein, 7 aa, Cryptosporidium parvum
SRKYEGP

SEQ ID NO: 2332603 - protein, 10 aa, Cryptosporidium parvum
SRLDSDQKIQ

SEQ ID NO: 2332604 - protein, 16 aa, Cryptosporidium parvum
SRLKKEGSDKGNQTNN

SEQ ID NO: 2332605 - protein, 18 aa, Cryptosporidium parvum
SRLVSDDEEVETDKQKSM

SEQ ID NO: 2332606 - protein, 8 aa, Cryptosporidium parvum
SRNARSFE

SEQ ID NO: 2332607 - protein, 10 aa, Cryptosporidium parvum
SRNEIRPYGY

SEQ ID NO: 2332608 - protein, 15 aa, Cryptosporidium parvum
SRNITSTITAKRRKG

SEQ ID NO: 2332609 - protein, 10 aa, Cryptosporidium parvum
SRNKNGEIIS

SEQ ID NO: 2332610 - protein, 9 aa, Cryptosporidium parvum
SRNNNKESF

SEQ ID NO: 2332611 - protein, 16 aa, Cryptosporidium parvum
SRNNQGENSDQESKDE

SEQ ID NO: 2332612 - protein, 7 aa, Cryptosporidium parvum
SRNPNAI

SEQ ID NO: 2332613 - protein, 10 aa, Cryptosporidium parvum
SRNRNQSLNN

SEQ ID NO: 2332614 - protein, 4 aa, Cryptosporidium parvum
SRNS

SEQ ID NO: 2332615 - protein, 7 aa, Cryptosporidium parvum
SRNSYRE

SEQ ID NO: 2332616 - protein, 7 aa, Cryptosporidium parvum
SRPARSV

SEQ ID NO: 2332617 - protein, 4 aa, Cryptosporidium parvum
SRPE

SEQ ID NO: 2332618 - protein, 17 aa, Cryptosporidium parvum
SRPKCYNSQGFDGKDTV

SEQ ID NO: 2332619 - protein, 7 aa, Cryptosporidium parvum
SRPKGSC

SEQ ID NO: 2332620 - protein, 4 aa, Cryptosporidium parvum
SRPL

SEQ ID NO: 2332621 - protein, 9 aa, Cryptosporidium parvum
SRPMNPGKQ

SEQ ID NO: 2332622 - protein, 5 aa, Cryptosporidium parvum
SRPNI

SEQ ID NO: 2332623 - protein, 9 aa, Cryptosporidium parvum
SRQEEEDSE

SEQ ID NO: 2332624 - protein, 9 aa, Cryptosporidium parvum
SRRKLNEKH

SEQ ID NO: 2332625 - protein, 25 aa, Cryptosporidium parvum
SRRPKEGKKGSKKGIKKGSKGSEDE

SEQ ID NO: 2332626 - protein, 9 aa, Cryptosporidium parvum
SRSADSTAL

SEQ ID NO: 2332627 - protein, 7 aa, Cryptosporidium parvum
SRSETPK

SEQ ID NO: 2332628 - protein, 8 aa, Cryptosporidium parvum
SRSGNIAR

SEQ ID NO: 2332629 - protein, 19 aa, Cryptosporidium parvum
SRSSSNTNTNPNPNPNNTT

SEQ ID NO: 2332630 - protein, 10 aa, Cryptosporidium parvum
SRSTDELKDP

SEQ ID NO: 2332631 - protein, 6 aa, Cryptosporidium parvum
SRTDDF

SEQ ID NO: 2332632 - protein, 6 aa, Cryptosporidium parvum
SRTPEA

SEQ ID NO: 2332633 - protein, 8 aa, Cryptosporidium parvum
SRTSEKMP

SEQ ID NO: 2332634 - protein, 13 aa, Cryptosporidium parvum
SRTTNESSGGRSL

SEQ ID NO: 2332635 - protein, 6 aa, Cryptosporidium parvum
SRVPPQ

SEQ ID NO: 2332636 - protein, 12 aa, Cryptosporidium parvum
SRVTNYKKANYQ

SEQ ID NO: 2332637 - protein, 12 aa, Cryptosporidium parvum
SRYDGERDLKDY

SEQ ID NO: 2332638 - protein, 8 aa, Cryptosporidium parvum
SRYRESSA

SEQ ID NO: 2332639 - protein, 17 aa, Cryptosporidium parvum
SSAATNKFNEETQKLKS

SEQ ID NO: 2332640 - protein, 7 aa, Cryptosporidium parvum
SSADGSF

SEQ ID NO: 2332641 - protein, 8 aa, Cryptosporidium parvum
SSANDNKV

SEQ ID NO: 2332642 - protein, 9 aa, Cryptosporidium parvum
SSANPIGKE

SEQ ID NO: 2332643 - protein, 7 aa, Cryptosporidium parvum
SSAPESV

SEQ ID NO: 2332644 - protein, 7 aa, Cryptosporidium parvum
SSAPTLR

SEQ ID NO: 2332645 - protein, 11 aa, Cryptosporidium parvum
SSATSSSGRGV

SEQ ID NO: 2332646 - protein, 8 aa, Cryptosporidium parvum
SSATTTTE

SEQ ID NO: 2332647 - protein, 6 aa, Cryptosporidium parvum
SSDCEK

SEQ ID NO: 2332648 - protein, 21 aa, Cryptosporidium parvum
SSDEEFSDEEIKEREERNRKS

SEQ ID NO: 2332649 - protein, 6 aa, Cryptosporidium parvum
SSDENL

SEQ ID NO: 2332650 - protein, 53 aa, Cryptosporidium parvum
SSDMSENDEQKTDDSEGSQDYDDNDDDDDDDDDDDDDSDRENAAGINRGYPSK

SEQ ID NO: 2332651 - protein, 6 aa, Cryptosporidium parvum
SSDNIG

SEQ ID NO: 2332652 - protein, 4 aa, Cryptosporidium parvum
SSDQ

SEQ ID NO: 2332653 - protein, 7 aa, Cryptosporidium parvum
SSDQKGI

SEQ ID NO: 2332654 - protein, 5 aa, Cryptosporidium parvum
SSDSI

SEQ ID NO: 2332655 - protein, 11 aa, Cryptosporidium parvum
SSDSSQRATNF

SEQ ID NO: 2332656 - protein, 8 aa, Cryptosporidium parvum
SSDTQRTI

SEQ ID NO: 2332657 - protein, 8 aa, Cryptosporidium parvum
SSEASSSF

SEQ ID NO: 2332658 - protein, 14 aa, Cryptosporidium parvum
SSEERLSFDEVDNK

SEQ ID NO: 2332659 - protein, 6 aa, Cryptosporidium parvum
SSEISG

SEQ ID NO: 2332660 - protein, 18 aa, Cryptosporidium parvum
SSEKRSLPSIRGTKTDTL

SEQ ID NO: 2332661 - protein, 45 aa, Cryptosporidium parvum
SSELSNDQNETNSYGNFSSEFGNNARPTGNMNRRSRTCSSTEIKR

SEQ ID NO: 2332662 - protein, 6 aa, Cryptosporidium parvum
SSENFE

SEQ ID NO: 2332663 - protein, 6 aa, Cryptosporidium parvum
SSEQAI

SEQ ID NO: 2332664 - protein, 25 aa, Cryptosporidium parvum
SSFKSSTDMSVNNKKSGIDSAVNNG

SEQ ID NO: 2332665 - protein, 6 aa, Cryptosporidium parvum
SSFKTT

SEQ ID NO: 2332666 - protein, 7 aa, Cryptosporidium parvum
SSFNRNS

SEQ ID NO: 2332667 - protein, 12 aa, Cryptosporidium parvum
SSFPQEKESRDE

SEQ ID NO: 2332668 - protein, 10 aa, Cryptosporidium parvum
SSFSGKRGQL

SEQ ID NO: 2332669 - protein, 7 aa, Cryptosporidium parvum
SSGDTKV

SEQ ID NO: 2332670 - protein, 5 aa, Cryptosporidium parvum
SSGDY

SEQ ID NO: 2332671 - protein, 4 aa, Cryptosporidium parvum
SSGF

SEQ ID NO: 2332672 - protein, 8 aa, Cryptosporidium parvum
SSGGIGAT

SEQ ID NO: 2332673 - protein, 7 aa, Cryptosporidium parvum
SSGGSVE

SEQ ID NO: 2332674 - protein, 8 aa, Cryptosporidium parvum
SSGKDGKT

SEQ ID NO: 2332675 - protein, 6 aa, Cryptosporidium parvum
SSGPQN

SEQ ID NO: 2332676 - protein, 5 aa, Cryptosporidium parvum
SSGRT

SEQ ID NO: 2332677 - protein, 9 aa, Cryptosporidium parvum
SSGSCNNSS

SEQ ID NO: 2332678 - protein, 12 aa, Cryptosporidium parvum
SSGSTHKSKNNY

SEQ ID NO: 2332679 - protein, 16 aa, Cryptosporidium parvum
SSGVEKNISSKDISGD

SEQ ID NO: 2332680 - protein, 4 aa, Cryptosporidium parvum
SSGW

SEQ ID NO: 2332681 - protein, 12 aa, Cryptosporidium parvum
SSHTKTKSSKEI

SEQ ID NO: 2332682 - protein, 28 aa, Cryptosporidium parvum
SSIETSSSSANSEPEREDKEKEREKIQN

SEQ ID NO: 2332683 - protein, 4 aa, Cryptosporidium parvum
SSIG

SEQ ID NO: 2332684 - protein, 4 aa, Cryptosporidium parvum
SSIP

SEQ ID NO: 2332685 - protein, 9 aa, Cryptosporidium parvum
SSIPDECTS

SEQ ID NO: 2332686 - protein, 6 aa, Cryptosporidium parvum
SSIPEQ

SEQ ID NO: 2332687 - protein, 11 aa, Cryptosporidium parvum
SSIQETKTAKE

SEQ ID NO: 2332688 - protein, 18 aa, Cryptosporidium parvum
SSISASFPSAADPTNKNK

SEQ ID NO: 2332689 - protein, 12 aa, Cryptosporidium parvum
SSISKNLAKNGY

SEQ ID NO: 2332690 - protein, 8 aa, Cryptosporidium parvum
SSITGTVR

SEQ ID NO: 2332691 - protein, 11 aa, Cryptosporidium parvum
SSITSQEPEPV

SEQ ID NO: 2332692 - protein, 12 aa, Cryptosporidium parvum
SSIVSEAEISIL

SEQ ID NO: 2332693 - protein, 8 aa, Cryptosporidium parvum
SSKDESEL

SEQ ID NO: 2332694 - protein, 14 aa, Cryptosporidium parvum
SSKEFDKSTVNQKL

SEQ ID NO: 2332695 - protein, 7 aa, Cryptosporidium parvum
SSKGALE

SEQ ID NO: 2332696 - protein, 5 aa, Cryptosporidium parvum
SSKGI

SEQ ID NO: 2332697 - protein, 16 aa, Cryptosporidium parvum
SSKHTAGTHHYSTPSA

SEQ ID NO: 2332698 - protein, 4 aa, Cryptosporidium parvum
SSKM

SEQ ID NO: 2332699 - protein, 9 aa, Cryptosporidium parvum
SSKRSREYY

SEQ ID NO: 2332700 - protein, 18 aa, Cryptosporidium parvum
SSKRTKTKKGENSQPPKL

SEQ ID NO: 2332701 - protein, 9 aa, Cryptosporidium parvum
SSKSTGGVP

SEQ ID NO: 2332702 - protein, 7 aa, Cryptosporidium parvum
SSKYTNE

SEQ ID NO: 2332703 - protein, 10 aa, Cryptosporidium parvum
SSLEEDGEGI

SEQ ID NO: 2332704 - protein, 51 aa, Cryptosporidium parvum
SSLETSQDSEQMSNELEKSDNESEVSLSEDSQENSKEGDPLGDNNGKSNLK

SEQ ID NO: 2332705 - protein, 12 aa, Cryptosporidium parvum
SSLGNGGKTAKC

SEQ ID NO: 2332706 - protein, 23 aa, Cryptosporidium parvum
SSLGSRPGIKGSYKQEGREEKKT

SEQ ID NO: 2332707 - protein, 12 aa, Cryptosporidium parvum
SSLLDKKTSTTS

SEQ ID NO: 2332708 - protein, 8 aa, Cryptosporidium parvum
SSLLPEGT

SEQ ID NO: 2332709 - protein, 6 aa, Cryptosporidium parvum
SSLNKK

SEQ ID NO: 2332710 - protein, 4 aa, Cryptosporidium parvum
SSLP

SEQ ID NO: 2332711 - protein, 21 aa, Cryptosporidium parvum
SSLPQQGSSFQPNSGGNMDSF

SEQ ID NO: 2332712 - protein, 5 aa, Cryptosporidium parvum
SSLTQ

SEQ ID NO: 2332713 - protein, 9 aa, Cryptosporidium parvum
SSMEPKKFP

SEQ ID NO: 2332714 - protein, 8 aa, Cryptosporidium parvum
SSMSGTET

SEQ ID NO: 2332715 - protein, 6 aa, Cryptosporidium parvum
SSMTEE

SEQ ID NO: 2332716 - protein, 13 aa, Cryptosporidium parvum
SSNEDKIKMPSNH

SEQ ID NO: 2332717 - protein, 6 aa, Cryptosporidium parvum
SSNEEP

SEQ ID NO: 2332718 - protein, 7 aa, Cryptosporidium parvum
SSNFNAN

SEQ ID NO: 2332719 - protein, 10 aa, Cryptosporidium parvum
SSNGRIPPKI

SEQ ID NO: 2332720 - protein, 8 aa, Cryptosporidium parvum
SSNNGKVN

SEQ ID NO: 2332721 - protein, 10 aa, Cryptosporidium parvum
SSNNISNKAT

SEQ ID NO: 2332722 - protein, 5 aa, Cryptosporidium parvum
SSNNY

SEQ ID NO: 2332723 - protein, 9 aa, Cryptosporidium parvum
SSNPDRISE

SEQ ID NO: 2332724 - protein, 6 aa, Cryptosporidium parvum
SSNPGV

SEQ ID NO: 2332725 - protein, 4 aa, Cryptosporidium parvum
SSNQ

SEQ ID NO: 2332726 - protein, 6 aa, Cryptosporidium parvum
SSNRGL

SEQ ID NO: 2332727 - protein, 16 aa, Cryptosporidium parvum
SSNSETNFGEKLAESG

SEQ ID NO: 2332728 - protein, 13 aa, Cryptosporidium parvum
SSNSQSKDNHGQT

SEQ ID NO: 2332729 - protein, 29 aa, Cryptosporidium parvum
SSNTALGKTRFGDPITDKNNQSSGSAPTV

SEQ ID NO: 2332730 - protein, 6 aa, Cryptosporidium parvum
SSNTSL

SEQ ID NO: 2332731 - protein, 18 aa, Cryptosporidium parvum
SSNTYENLQSSRTGNYSP

SEQ ID NO: 2332732 - protein, 4 aa, Cryptosporidium parvum
SSPC

SEQ ID NO: 2332733 - protein, 5 aa, Cryptosporidium parvum
SSPDE

SEQ ID NO: 2332734 - protein, 31 aa, Cryptosporidium parvum
SSPEISPVKTEKSRSKSRKESSKRPSTPESE

SEQ ID NO: 2332735 - protein, 7 aa, Cryptosporidium parvum
SSPGEVR

SEQ ID NO: 2332736 - protein, 8 aa, Cryptosporidium parvum
SSPMHSTS

SEQ ID NO: 2332737 - protein, 6 aa, Cryptosporidium parvum
SSPQNI

SEQ ID NO: 2332738 - protein, 9 aa, Cryptosporidium parvum
SSPRETQIQ

SEQ ID NO: 2332739 - protein, 6 aa, Cryptosporidium parvum
SSPSSY

SEQ ID NO: 2332740 - protein, 6 aa, Cryptosporidium parvum
SSPSTQ

SEQ ID NO: 2332741 - protein, 5 aa, Cryptosporidium parvum
SSPSY

SEQ ID NO: 2332742 - protein, 6 aa, Cryptosporidium parvum
SSPVNQ

SEQ ID NO: 2332743 - protein, 6 aa, Cryptosporidium parvum
SSQKHP

SEQ ID NO: 2332744 - protein, 6 aa, Cryptosporidium parvum
SSQPNT

SEQ ID NO: 2332745 - protein, 10 aa, Cryptosporidium parvum
SSQQNALSSQ

SEQ ID NO: 2332746 - protein, 7 aa, Cryptosporidium parvum
SSQTEAD

SEQ ID NO: 2332747 - protein, 6 aa, Cryptosporidium parvum
SSQTGF

SEQ ID NO: 2332748 - protein, 10 aa, Cryptosporidium parvum
SSRAASSACA

SEQ ID NO: 2332749 - protein, 6 aa, Cryptosporidium parvum
SSSAEN

SEQ ID NO: 2332750 - protein, 6 aa, Cryptosporidium parvum
SSSEGY

SEQ ID NO: 2332751 - protein, 16 aa, Cryptosporidium parvum
SSSEYARSTIPKGAGY

SEQ ID NO: 2332752 - protein, 57 aa, Cryptosporidium parvum
SSSHNGSSQKKERAQVIGSESSMVDDDYPSYNTGIAEGGITRHQSQAARGFGSGIPG

SEQ ID NO: 2332753 - protein, 25 aa, Cryptosporidium parvum
SSSKRTTTTTAELTGVGDSIPPLGP

SEQ ID NO: 2332754 - protein, 8 aa, Cryptosporidium parvum
SSSKSMSS

SEQ ID NO: 2332755 - protein, 11 aa, Cryptosporidium parvum
SSSLPSTGNGM

SEQ ID NO: 2332756 - protein, 16 aa, Cryptosporidium parvum
SSSPISDSSIKNDFES

SEQ ID NO: 2332757 - protein, 7 aa, Cryptosporidium parvum
SSSPQCG

SEQ ID NO: 2332758 - protein, 11 aa, Cryptosporidium parvum
SSSPTEETEEM

SEQ ID NO: 2332759 - protein, 16 aa, Cryptosporidium parvum
SSSQIKNDLDSTEFAP

SEQ ID NO: 2332760 - protein, 10 aa, Cryptosporidium parvum
SSSRKVTREE

SEQ ID NO: 2332761 - protein, 5 aa, Cryptosporidium parvum
SSSRN

SEQ ID NO: 2332762 - protein, 9 aa, Cryptosporidium parvum
SSSSNGTTA

SEQ ID NO: 2332763 - protein, 8 aa, Cryptosporidium parvum
SSSSSRHD

SEQ ID NO: 2332764 - protein, 12 aa, Cryptosporidium parvum
SSSSSSSFPVGT

SEQ ID NO: 2332765 - protein, 7 aa, Cryptosporidium parvum
SSSTKLP

SEQ ID NO: 2332766 - protein, 15 aa, Cryptosporidium parvum
SSSTSKRNIPTLEKK

SEQ ID NO: 2332767 - protein, 11 aa, Cryptosporidium parvum
SSSTSLPSKAI

SEQ ID NO: 2332768 - protein, 6 aa, Cryptosporidium parvum
SSSVSV

SEQ ID NO: 2332769 - protein, 23 aa, Cryptosporidium parvum
SSSYYSNSSPMISPKTKNNCGNK

SEQ ID NO: 2332770 - protein, 5 aa, Cryptosporidium parvum
SSTDE

SEQ ID NO: 2332771 - protein, 11 aa, Cryptosporidium parvum
SSTDKSPDHGV

SEQ ID NO: 2332772 - protein, 26 aa, Cryptosporidium parvum
SSTEENTETGSSMSSSENFDDFCKTK

SEQ ID NO: 2332773 - protein, 4 aa, Cryptosporidium parvum
SSTN

SEQ ID NO: 2332774 - protein, 6 aa, Cryptosporidium parvum
SSTNSC

SEQ ID NO: 2332775 - protein, 5 aa, Cryptosporidium parvum
SSTNV

SEQ ID NO: 2332776 - protein, 13 aa, Cryptosporidium parvum
SSTPYFQNTTSTE

SEQ ID NO: 2332777 - protein, 43 aa, Cryptosporidium parvum
SSTSVPASAPTPGPAPVPAPNPSLATYPTPVPHPVPGPTLAPT

SEQ ID NO: 2332778 - protein, 7 aa, Cryptosporidium parvum
SSTTSKN

SEQ ID NO: 2332779 - protein, 13 aa, Cryptosporidium parvum
SSTYGASKSKLHP

SEQ ID NO: 2332780 - protein, 8 aa, Cryptosporidium parvum
SSVAVPSN

SEQ ID NO: 2332781 - protein, 30 aa, Cryptosporidium parvum
SSVSSIDNDAVKESQHSENNEASTSPKLES

SEQ ID NO: 2332782 - protein, 8 aa, Cryptosporidium parvum
SSVTDEQI

SEQ ID NO: 2332783 - protein, 7 aa, Cryptosporidium parvum
SSWDPSN

SEQ ID NO: 2332784 - protein, 4 aa, Cryptosporidium parvum
SSYN

SEQ ID NO: 2332785 - protein, 7 aa, Cryptosporidium parvum
SSYSKLS

SEQ ID NO: 2332786 - protein, 5 aa, Cryptosporidium parvum
SSYTD

SEQ ID NO: 2332787 - protein, 5 aa, Cryptosporidium parvum
STDDE

SEQ ID NO: 2332788 - protein, 23 aa, Cryptosporidium parvum
STDESGNSKVSCSNRKSPCSQMQ

SEQ ID NO: 2332789 - protein, 13 aa, Cryptosporidium parvum
STDLSGKIKGQNL

SEQ ID NO: 2332790 - protein, 11 aa, Cryptosporidium parvum
STDPKKSEMGT

SEQ ID NO: 2332791 - protein, 13 aa, Cryptosporidium parvum
STDPLESCPPGFE

SEQ ID NO: 2332792 - protein, 4 aa, Cryptosporidium parvum
STDT

SEQ ID NO: 2332793 - protein, 4 aa, Cryptosporidium parvum
STEI

SEQ ID NO: 2332794 - protein, 24 aa, Cryptosporidium parvum
STEIDNGNFGDSSGNDGRAPIPPM

SEQ ID NO: 2332795 - protein, 7 aa, Cryptosporidium parvum
STEQAQE

SEQ ID NO: 2332796 - protein, 22 aa, Cryptosporidium parvum
STEQDNRENNIPTKGDINSTSN

SEQ ID NO: 2332797 - protein, 11 aa, Cryptosporidium parvum
STESDLASSSY

SEQ ID NO: 2332798 - protein, 9 aa, Cryptosporidium parvum
STESSPKFK

SEQ ID NO: 2332799 - protein, 16 aa, Cryptosporidium parvum
STETAALPASRTRYPS

SEQ ID NO: 2332800 - protein, 4 aa, Cryptosporidium parvum
STFS

SEQ ID NO: 2332801 - protein, 6 aa, Cryptosporidium parvum
STGDEV

SEQ ID NO: 2332802 - protein, 5 aa, Cryptosporidium parvum
STGEA

SEQ ID NO: 2332803 - protein, 11 aa, Cryptosporidium parvum
STGSEIPTETP

SEQ ID NO: 2332804 - protein, 5 aa, Cryptosporidium parvum
STGSP

SEQ ID NO: 2332805 - protein, 5 aa, Cryptosporidium parvum
STGTI

SEQ ID NO: 2332806 - protein, 5 aa, Cryptosporidium parvum
STGTV

SEQ ID NO: 2332807 - protein, 36 aa, Cryptosporidium parvum
STGVKTSGSNRSSEKKKNDSNERNKQKLSKNSELSE

SEQ ID NO: 2332808 - protein, 4 aa, Cryptosporidium parvum
STGW

SEQ ID NO: 2332809 - protein, 11 aa, Cryptosporidium parvum
STHENNSKQGF

SEQ ID NO: 2332810 - protein, 5 aa, Cryptosporidium parvum
STHNQ

SEQ ID NO: 2332811 - protein, 8 aa, Cryptosporidium parvum
STIGRAQR

SEQ ID NO: 2332812 - protein, 10 aa, Cryptosporidium parvum
STINTGGKNV

SEQ ID NO: 2332813 - protein, 6 aa, Cryptosporidium parvum
STISER

SEQ ID NO: 2332814 - protein, 8 aa, Cryptosporidium parvum
STKANSNL

SEQ ID NO: 2332815 - protein, 8 aa, Cryptosporidium parvum
STKKTSTR

SEQ ID NO: 2332816 - protein, 15 aa, Cryptosporidium parvum
STKLESTDSDNATYP

SEQ ID NO: 2332817 - protein, 9 aa, Cryptosporidium parvum
STKNETSQF

SEQ ID NO: 2332818 - protein, 9 aa, Cryptosporidium parvum
STKNGSSTQ

SEQ ID NO: 2332819 - protein, 9 aa, Cryptosporidium parvum
STKNSRDLQ

SEQ ID NO: 2332820 - protein, 11 aa, Cryptosporidium parvum
STKQVNSDINE

SEQ ID NO: 2332821 - protein, 4 aa, Cryptosporidium parvum
STLA

SEQ ID NO: 2332822 - protein, 9 aa, Cryptosporidium parvum
STLAENNEE

SEQ ID NO: 2332823 - protein, 5 aa, Cryptosporidium parvum
STLGN

SEQ ID NO: 2332824 - protein, 6 aa, Cryptosporidium parvum
STLKET

SEQ ID NO: 2332825 - protein, 6 aa, Cryptosporidium parvum
STLNSL

SEQ ID NO: 2332826 - protein, 4 aa, Cryptosporidium parvum
STLQ

SEQ ID NO: 2332827 - protein, 7 aa, Cryptosporidium parvum
STLTNKT

SEQ ID NO: 2332828 - protein, 8 aa, Cryptosporidium parvum
STNAPESQ

SEQ ID NO: 2332829 - protein, 8 aa, Cryptosporidium parvum
STNNYGKT

SEQ ID NO: 2332830 - protein, 6 aa, Cryptosporidium parvum
STNQNN

SEQ ID NO: 2332831 - protein, 12 aa, Cryptosporidium parvum
STNSNTGGGTLS

SEQ ID NO: 2332832 - protein, 8 aa, Cryptosporidium parvum
STNTSNFK

SEQ ID NO: 2332833 - protein, 5 aa, Cryptosporidium parvum
STPGE

SEQ ID NO: 2332834 - protein, 5 aa, Cryptosporidium parvum
STPLN

SEQ ID NO: 2332835 - protein, 7 aa, Cryptosporidium parvum
STPSNSG

SEQ ID NO: 2332836 - protein, 6 aa, Cryptosporidium parvum
STPYPI

SEQ ID NO: 2332837 - protein, 4 aa, Cryptosporidium parvum
STQF

SEQ ID NO: 2332838 - protein, 9 aa, Cryptosporidium parvum
STQSASISD

SEQ ID NO: 2332839 - protein, 5 aa, Cryptosporidium parvum
STQTE

SEQ ID NO: 2332840 - protein, 6 aa, Cryptosporidium parvum
STQTGG

SEQ ID NO: 2332841 - protein, 5 aa, Cryptosporidium parvum
STRIP

SEQ ID NO: 2332842 - protein, 5 aa, Cryptosporidium parvum
STSAT

SEQ ID NO: 2332843 - protein, 65 aa, Cryptosporidium parvum
STSETSSHSSDCEYESETDASSPFNGETNSITNTPEIHSSVSPKSTVSPETKRGYSSAPNDSIQS

SEQ ID NO: 2332844 - protein, 8 aa, Cryptosporidium parvum
STSISSER

SEQ ID NO: 2332845 - protein, 5 aa, Cryptosporidium parvum
STSLP

SEQ ID NO: 2332846 - protein, 6 aa, Cryptosporidium parvum
STSLTE

SEQ ID NO: 2332847 - protein, 5 aa, Cryptosporidium parvum
STSNN

SEQ ID NO: 2332848 - protein, 7 aa, Cryptosporidium parvum
STSRKNL

SEQ ID NO: 2332849 - protein, 5 aa, Cryptosporidium parvum
STSRL

SEQ ID NO: 2332850 - protein, 7 aa, Cryptosporidium parvum
STSRSTL

SEQ ID NO: 2332851 - protein, 12 aa, Cryptosporidium parvum
STSSSNVDSEEF

SEQ ID NO: 2332852 - protein, 4 aa, Cryptosporidium parvum
STST

SEQ ID NO: 2332853 - protein, 8 aa, Cryptosporidium parvum
STSTSERE

SEQ ID NO: 2332854 - protein, 28 aa, Cryptosporidium parvum
STSTTTISTREDINKDEDISNGNSVSSL

SEQ ID NO: 2332855 - protein, 63 aa, Cryptosporidium parvum
STSTTTTTTTTTTTTTTTTTTTTTTTTTTSTTTTTTTTTTTTTTTTTTIATTTEIENSNRDNM

SEQ ID NO: 2332856 - protein, 8 aa, Cryptosporidium parvum
STTEPTLG

SEQ ID NO: 2332857 - protein, 5 aa, Cryptosporidium parvum
STTET

SEQ ID NO: 2332858 - protein, 4 aa, Cryptosporidium parvum
STTG

SEQ ID NO: 2332859 - protein, 9 aa, Cryptosporidium parvum
STTGSSASL

SEQ ID NO: 2332860 - protein, 4 aa, Cryptosporidium parvum
STTI

SEQ ID NO: 2332861 - protein, 8 aa, Cryptosporidium parvum
STTNSAQK

SEQ ID NO: 2332862 - protein, 14 aa, Cryptosporidium parvum
STTSITKSLDKKEV

SEQ ID NO: 2332863 - protein, 13 aa, Cryptosporidium parvum
STTTKTTTTEPVK

SEQ ID NO: 2332864 - protein, 8 aa, Cryptosporidium parvum
STTTTTTL

SEQ ID NO: 2332865 - protein, 20 aa, Cryptosporidium parvum
STTTTTTTTTITTNTITNSK

SEQ ID NO: 2332866 - protein, 4 aa, Cryptosporidium parvum
STTV

SEQ ID NO: 2332867 - protein, 25 aa, Cryptosporidium parvum
STVSQESQISKDNLEPNEARSSLRS

SEQ ID NO: 2332868 - protein, 14 aa, Cryptosporidium parvum
STYEGGNASLPASR

SEQ ID NO: 2332869 - protein, 7 aa, Cryptosporidium parvum
STYIPND

SEQ ID NO: 2332870 - protein, 4 aa, Cryptosporidium parvum
STYV

SEQ ID NO: 2332871 - protein, 4 aa, Cryptosporidium parvum
SVDE

SEQ ID NO: 2332872 - protein, 22 aa, Cryptosporidium parvum
SVDGDNVAKEAIQGISSTTGVN

SEQ ID NO: 2332873 - protein, 8 aa, Cryptosporidium parvum
SVDQGDSS

SEQ ID NO: 2332874 - protein, 4 aa, Cryptosporidium parvum
SVDS

SEQ ID NO: 2332875 - protein, 7 aa, Cryptosporidium parvum
SVEATKT

SEQ ID NO: 2332876 - protein, 7 aa, Cryptosporidium parvum
SVEDPNG

SEQ ID NO: 2332877 - protein, 11 aa, Cryptosporidium parvum
SVEESISDTQK

SEQ ID NO: 2332878 - protein, 8 aa, Cryptosporidium parvum
SVEGEKAA

SEQ ID NO: 2332879 - protein, 8 aa, Cryptosporidium parvum
SVETEKAD

SEQ ID NO: 2332880 - protein, 46 aa, Cryptosporidium parvum
SVETSSKTSSSSDQRPFTDSDFDSSVSSFDSSDYEFDTDSDSPINA

SEQ ID NO: 2332881 - protein, 4 aa, Cryptosporidium parvum
SVGA

SEQ ID NO: 2332882 - protein, 8 aa, Cryptosporidium parvum
SVGNTIGE

SEQ ID NO: 2332883 - protein, 22 aa, Cryptosporidium parvum
SVKNEQKNRDQLEKEYKKNLEE

SEQ ID NO: 2332884 - protein, 5 aa, Cryptosporidium parvum
SVKQN

SEQ ID NO: 2332885 - protein, 5 aa, Cryptosporidium parvum
SVNAN

SEQ ID NO: 2332886 - protein, 5 aa, Cryptosporidium parvum
SVNCN

SEQ ID NO: 2332887 - protein, 9 aa, Cryptosporidium parvum
SVNKIDTSE

SEQ ID NO: 2332888 - protein, 7 aa, Cryptosporidium parvum
SVPGTPF

SEQ ID NO: 2332889 - protein, 30 aa, Cryptosporidium parvum
SVPINENDQVDLTSKATGSSKTKKSKSMRK

SEQ ID NO: 2332890 - protein, 10 aa, Cryptosporidium parvum
SVPTSQDSTR

SEQ ID NO: 2332891 - protein, 16 aa, Cryptosporidium parvum
SVPVSGPASAMPSRVQ

SEQ ID NO: 2332892 - protein, 13 aa, Cryptosporidium parvum
SVREDLEKSATTI

SEQ ID NO: 2332893 - protein, 4 aa, Cryptosporidium parvum
SVRS

SEQ ID NO: 2332894 - protein, 7 aa, Cryptosporidium parvum
SVRTSGT

SEQ ID NO: 2332895 - protein, 9 aa, Cryptosporidium parvum
SVSSPSSIV

SEQ ID NO: 2332896 - protein, 7 aa, Cryptosporidium parvum
SVSSQLN

SEQ ID NO: 2332897 - protein, 8 aa, Cryptosporidium parvum
SVSTMDSP

SEQ ID NO: 2332898 - protein, 7 aa, Cryptosporidium parvum
SVTPGDY

SEQ ID NO: 2332899 - protein, 9 aa, Cryptosporidium parvum
SVTSKQNEE

SEQ ID NO: 2332900 - protein, 9 aa, Cryptosporidium parvum
SVTSPTKFT

SEQ ID NO: 2332901 - protein, 4 aa, Cryptosporidium parvum
SVTT

SEQ ID NO: 2332902 - protein, 8 aa, Cryptosporidium parvum
SWEDGGVK

SEQ ID NO: 2332903 - protein, 12 aa, Cryptosporidium parvum
SWGGGSFSQATY

SEQ ID NO: 2332904 - protein, 6 aa, Cryptosporidium parvum
SYAPPH

SEQ ID NO: 2332905 - protein, 6 aa, Cryptosporidium parvum
SYDSPP

SEQ ID NO: 2332906 - protein, 6 aa, Cryptosporidium parvum
SYDTEN

SEQ ID NO: 2332907 - protein, 13 aa, Cryptosporidium parvum
SYEYTGLNRINHN

SEQ ID NO: 2332908 - protein, 10 aa, Cryptosporidium parvum
SYGASIKNGI

SEQ ID NO: 2332909 - protein, 9 aa, Cryptosporidium parvum
SYGDGWNSG

SEQ ID NO: 2332910 - protein, 7 aa, Cryptosporidium parvum
SYGPDGR

SEQ ID NO: 2332911 - protein, 9 aa, Cryptosporidium parvum
SYKSGSFGG

SEQ ID NO: 2332912 - protein, 11 aa, Cryptosporidium parvum
SYNRGEEPSKL

SEQ ID NO: 2332913 - protein, 11 aa, Cryptosporidium parvum
SYPIPKNHTNN

SEQ ID NO: 2332914 - protein, 4 aa, Cryptosporidium parvum
SYPN

SEQ ID NO: 2332915 - protein, 13 aa, Cryptosporidium parvum
SYPSEVENGMETP

SEQ ID NO: 2332916 - protein, 12 aa, Cryptosporidium parvum
SYPSSRASPLRT

SEQ ID NO: 2332917 - protein, 6 aa, Cryptosporidium parvum
SYPTKD

SEQ ID NO: 2332918 - protein, 6 aa, Cryptosporidium parvum
SYPTPF

SEQ ID NO: 2332919 - protein, 6 aa, Cryptosporidium parvum
SYQSKY

SEQ ID NO: 2332920 - protein, 7 aa, Cryptosporidium parvum
SYSRTES

SEQ ID NO: 2332921 - protein, 15 aa, Cryptosporidium parvum
SYSSERVSETKHSTQ

SEQ ID NO: 2332922 - protein, 12 aa, Cryptosporidium parvum
SYSSSKDQSLYS

SEQ ID NO: 2332923 - protein, 6 aa, Cryptosporidium parvum
SYTPQN

SEQ ID NO: 2332924 - protein, 6 aa, Cryptosporidium parvum
SYTQNE

SEQ ID NO: 2332925 - protein, 9 aa, Cryptosporidium parvum
SYTSPSKGI

SEQ ID NO: 2332926 - protein, 4 aa, Cryptosporidium parvum
TAAK

SEQ ID NO: 2332927 - protein, 14 aa, Cryptosporidium parvum
TAAKLSESKLAKPR

SEQ ID NO: 2332928 - protein, 8 aa, Cryptosporidium parvum
TAAQNSLE

SEQ ID NO: 2332929 - protein, 4 aa, Cryptosporidium parvum
TADT

SEQ ID NO: 2332930 - protein, 29 aa, Cryptosporidium parvum
TADTIQKSIQNENKDQRVRASGAEVGQEN

SEQ ID NO: 2332931 - protein, 11 aa, Cryptosporidium parvum
TAEYNENQPYK

SEQ ID NO: 2332932 - protein, 18 aa, Cryptosporidium parvum
TAFDDYSSNNVKKSLDSD

SEQ ID NO: 2332933 - protein, 6 aa, Cryptosporidium parvum
TAINGR

SEQ ID NO: 2332934 - protein, 9 aa, Cryptosporidium parvum
TAKTGDEIT

SEQ ID NO: 2332935 - protein, 31 aa, Cryptosporidium parvum
TALNSSPKKNGSGSGSGSGSGSDSGSSSSSI

SEQ ID NO: 2332936 - protein, 6 aa, Cryptosporidium parvum
TANEVT

SEQ ID NO: 2332937 - protein, 7 aa, Cryptosporidium parvum
TANNSSF

SEQ ID NO: 2332938 - protein, 8 aa, Cryptosporidium parvum
TANTTLNI

SEQ ID NO: 2332939 - protein, 11 aa, Cryptosporidium parvum
TAPAKPPSFLP

SEQ ID NO: 2332940 - protein, 5 aa, Cryptosporidium parvum
TAPPS

SEQ ID NO: 2332941 - protein, 12 aa, Cryptosporidium parvum
TAPSAYPTSTYD

SEQ ID NO: 2332942 - protein, 8 aa, Cryptosporidium parvum
TAPSSNSD

SEQ ID NO: 2332943 - protein, 5 aa, Cryptosporidium parvum
TAPYP

SEQ ID NO: 2332944 - protein, 6 aa, Cryptosporidium parvum
TAQGTY

SEQ ID NO: 2332945 - protein, 4 aa, Cryptosporidium parvum
TARP

SEQ ID NO: 2332946 - protein, 6 aa, Cryptosporidium parvum
TASNAV

SEQ ID NO: 2332947 - protein, 6 aa, Cryptosporidium parvum
TASYAR

SEQ ID NO: 2332948 - protein, 32 aa, Cryptosporidium parvum; identical to SEQ ID NO: 2205509

SEQ ID NO: 2332949 - protein, 8 aa, Cryptosporidium parvum
TATTGKPF

SEQ ID NO: 2332950 - protein, 20 aa, Cryptosporidium parvum
TATTLNQQAKQGQKLQNPVK

SEQ ID NO: 2332951 - protein, 7 aa, Cryptosporidium parvum
TCNNPGK

SEQ ID NO: 2332952 - protein, 6 aa, Cryptosporidium parvum
TCNRNM

SEQ ID NO: 2332953 - protein, 6 aa, Cryptosporidium parvum
TCPATT

SEQ ID NO: 2332954 - protein, 9 aa, Cryptosporidium parvum
TCSSSNCPD

SEQ ID NO: 2332955 - protein, 13 aa, Cryptosporidium parvum
TDAPPEQDTGNNP

SEQ ID NO: 2332956 - protein, 7 aa, Cryptosporidium parvum
TDEKGDN

SEQ ID NO: 2332957 - protein, 6 aa, Cryptosporidium parvum
TDENKE

SEQ ID NO: 2332958 - protein, 5 aa, Cryptosporidium parvum
TDFEE

SEQ ID NO: 2332959 - protein, 10 aa, Cryptosporidium parvum
TDGEVSAKVK

SEQ ID NO: 2332960 - protein, 8 aa, Cryptosporidium parvum
TDGNCTKQ

SEQ ID NO: 2332961 - protein, 5 aa, Cryptosporidium parvum
TDGRI

SEQ ID NO: 2332962 - protein, 5 aa, Cryptosporidium parvum
TDGSY

SEQ ID NO: 2332963 - protein, 8 aa, Cryptosporidium parvum
TDHRGSLT

SEQ ID NO: 2332964 - protein, 6 aa, Cryptosporidium parvum
TDISTN

SEQ ID NO: 2332965 - protein, 14 aa, Cryptosporidium parvum
TDKTDSSKAVETQT

SEQ ID NO: 2332966 - protein, 21 aa, Cryptosporidium parvum
TDKTKEKKEKEINSDIESPRT

SEQ ID NO: 2332967 - protein, 6 aa, Cryptosporidium parvum
TDPDYY

SEQ ID NO: 2332968 - protein, 14 aa, Cryptosporidium parvum
TDPPHYDGSSELSE

SEQ ID NO: 2332969 - protein, 6 aa, Cryptosporidium parvum
TDRGTL

SEQ ID NO: 2332970 - protein, 9 aa, Cryptosporidium parvum
TDRHGASEL

SEQ ID NO: 2332971 - protein, 17 aa, Cryptosporidium parvum
TDRSSEKQLRSRVTKEA

SEQ ID NO: 2332972 - protein, 5 aa, Cryptosporidium parvum
TDSAK

SEQ ID NO: 2332973 - protein, 8 aa, Cryptosporidium parvum
TDSANSDD

SEQ ID NO: 2332974 - protein, 9 aa, Cryptosporidium parvum
TDSKNNVRE

SEQ ID NO: 2332975 - protein, 9 aa, Cryptosporidium parvum
TDSNEYEKN

SEQ ID NO: 2332976 - protein, 6 aa, Cryptosporidium parvum
TDSNKY

SEQ ID NO: 2332977 - protein, 6 aa, Cryptosporidium parvum
TDSSQI

SEQ ID NO: 2332978 - protein, 9 aa, Cryptosporidium parvum
TDSSSVDLN

SEQ ID NO: 2332979 - protein, 10 aa, Cryptosporidium parvum
TDSTDDADFV

SEQ ID NO: 2332980 - protein, 9 aa, Cryptosporidium parvum
TDSVNSKYQ

SEQ ID NO: 2332981 - protein, 12 aa, Cryptosporidium parvum
TDTQINNGTWGP

SEQ ID NO: 2332982 - protein, 9 aa, Cryptosporidium parvum
TDVSSGNRV

SEQ ID NO: 2332983 - protein, 12 aa, Cryptosporidium parvum
TDYQRKTRKKKG

SEQ ID NO: 2332984 - protein, 4 aa, Cryptosporidium parvum
TEAA

SEQ ID NO: 2332985 - protein, 10 aa, Cryptosporidium parvum
TEAGDKHNRN

SEQ ID NO: 2332986 - protein, 4 aa, Cryptosporidium parvum
TEAK

SEQ ID NO: 2332987 - protein, 9 aa, Cryptosporidium parvum
TEAKPNRIT

SEQ ID NO: 2332988 - protein, 5 aa, Cryptosporidium parvum
TEDGK

SEQ ID NO: 2332989 - protein, 23 aa, Cryptosporidium parvum
TEEDEEDFGGGFGSGVGSRYRRE

SEQ ID NO: 2332990 - protein, 35 aa, Cryptosporidium parvum
TEENVESPNVDVGGRGLPGPLDRERGPNCKTPCTR

SEQ ID NO: 2332991 - protein, 7 aa, Cryptosporidium parvum
TEESNKY

SEQ ID NO: 2332992 - protein, 56 aa, Cryptosporidium parvum
TEETDDEQIKGAGATDRTRTISNTGGKTLNSFKGEESDEEKKTRQDPFRRSKSQLS

SEQ ID NO: 2332993 - protein, 12 aa, Cryptosporidium parvum
TEETSSEPNSGL

SEQ ID NO: 2332994 - protein, 4 aa, Cryptosporidium parvum
TEFQ

SEQ ID NO: 2332995 - protein, 6 aa, Cryptosporidium parvum
TEGTDY

SEQ ID NO: 2332996 - protein, 9 aa, Cryptosporidium parvum
TEGTEEPNL

SEQ ID NO: 2332997 - protein, 4 aa, Cryptosporidium parvum
TEGW

SEQ ID NO: 2332998 - protein, 12 aa, Cryptosporidium parvum
TEINNKKKTAEL

SEQ ID NO: 2332999 - protein, 4 aa, Cryptosporidium parvum
TEIS

SEQ ID NO: 2333000 - protein, 19 aa, Cryptosporidium parvum
TEITESPSINCPSGTFQKE

SEQ ID NO: 2333001 - protein, 6 aa, Cryptosporidium parvum
TENENY

SEQ ID NO: 2333002 - protein, 7 aa, Cryptosporidium parvum
TENLSSD

SEQ ID NO: 2333003 - protein, 16 aa, Cryptosporidium parvum
TENPIGTKSMGGRADR

SEQ ID NO: 2333004 - protein, 7 aa, Cryptosporidium parvum
TENPNSV

SEQ ID NO: 2333005 - protein, 9 aa, Cryptosporidium parvum
TENSHPGIK

SEQ ID NO: 2333006 - protein, 8 aa, Cryptosporidium parvum
TEPQRQPC

SEQ ID NO: 2333007 - protein, 24 aa, Cryptosporidium parvum
TEQLNAEKEEANKPDEEKKKDAAL

SEQ ID NO: 2333008 - protein, 8 aa, Cryptosporidium parvum
TEQQREEF

SEQ ID NO: 2333009 - protein, 5 aa, Cryptosporidium parvum
TEQSE

SEQ ID NO: 2333010 - protein, 14 aa, Cryptosporidium parvum
TESENTRNDREKSL

SEQ ID NO: 2333011 - protein, 8 aa, Cryptosporidium parvum
TESGSITN

SEQ ID NO: 2333012 - protein, 17 aa, Cryptosporidium parvum
TESNEYVANTKSKSRNR

SEQ ID NO: 2333013 - protein, 8 aa, Cryptosporidium parvum
TESQNAKH

SEQ ID NO: 2333014 - protein, 12 aa, Cryptosporidium parvum
TESRLNSDLSSE

SEQ ID NO: 2333015 - protein, 5 aa, Cryptosporidium parvum
TESSE

SEQ ID NO: 2333016 - protein, 9 aa, Cryptosporidium parvum
TESSTEEEI

SEQ ID NO: 2333017 - protein, 45 aa, Cryptosporidium parvum
TETSAISGPNQVSQSAQVEPSKTASISVEPPSPPTSAIEERTVGN

SEQ ID NO: 2333018 - protein, 4 aa, Cryptosporidium parvum
TEVS

SEQ ID NO: 2333019 - protein, 31 aa, Cryptosporidium parvum
TEVTKKKRKYGKSFNHRNKKKSNKKKRTKLG

SEQ ID NO: 2333020 - protein, 5 aa, Cryptosporidium parvum
TEWEN

SEQ ID NO: 2333021 - protein, 5 aa, Cryptosporidium parvum
TEYPF

SEQ ID NO: 2333022 - protein, 11 aa, Cryptosporidium parvum
TEYTNSTNLDS

SEQ ID NO: 2333023 - protein, 13 aa, Cryptosporidium parvum
TFDADQAREPLGP

SEQ ID NO: 2333024 - protein, 5 aa, Cryptosporidium parvum
TFSGN

SEQ ID NO: 2333025 - protein, 8 aa, Cryptosporidium parvum
TFSPETSF

SEQ ID NO: 2333026 - protein, 11 aa, Cryptosporidium parvum
TFTQRQRKSLV

SEQ ID NO: 2333027 - protein, 4 aa, Cryptosporidium parvum
TFTR

SEQ ID NO: 2333028 - protein, 13 aa, Cryptosporidium parvum
TGCSSCRASRSYQ

SEQ ID NO: 2333029 - protein, 8 aa, Cryptosporidium parvum
TGDDKADP

SEQ ID NO: 2333030 - protein, 7 aa, Cryptosporidium parvum
TGDYTTP

SEQ ID NO: 2333031 - protein, 5 aa, Cryptosporidium parvum
TGETI

SEQ ID NO: 2333032 - protein, 4 aa, Cryptosporidium parvum
TGEY

SEQ ID NO: 2333033 - protein, 8 aa, Cryptosporidium parvum
TGGEQQFS

SEQ ID NO: 2333034 - protein, 4 aa, Cryptosporidium parvum
TGGG

SEQ ID NO: 2333035 - protein, 8 aa, Cryptosporidium parvum
TGHPKYSK

SEQ ID NO: 2333036 - protein, 19 aa, Cryptosporidium parvum
TGIPESEQISSSSTNTGTY

SEQ ID NO: 2333037 - protein, 15 aa, Cryptosporidium parvum
TGIPNKGSESDPSNY

SEQ ID NO: 2333038 - protein, 23 aa, Cryptosporidium parvum
TGKKGRMKNKLKRGNKSGKEELD

SEQ ID NO: 2333039 - protein, 5 aa, Cryptosporidium parvum
TGKNC

SEQ ID NO: 2333040 - protein, 4 aa, Cryptosporidium parvum
TGKP

SEQ ID NO: 2333041 - protein, 14 aa, Cryptosporidium parvum
TGKSGEAGTKGGVE

SEQ ID NO: 2333042 - protein, 8 aa, Cryptosporidium parvum
TGKSYTSS

SEQ ID NO: 2333043 - protein, 33 aa, Cryptosporidium parvum
TGKVEESKRIRDQLREEAKLKQKKVEAERAELG

SEQ ID NO: 2333044 - protein, 19 aa, Cryptosporidium parvum
TGNPETQEIPGENNLKRQN

SEQ ID NO: 2333045 - protein, 9 aa, Cryptosporidium parvum
TGNPRQPLK

SEQ ID NO: 2333046 - protein, 5 aa, Cryptosporidium parvum
TGPAV

SEQ ID NO: 2333047 - protein, 9 aa, Cryptosporidium parvum
TGPEENRLD

SEQ ID NO: 2333048 - protein, 7 aa, Cryptosporidium parvum
TGPERGD

SEQ ID NO: 2333049 - protein, 7 aa, Cryptosporidium parvum
TGQSIKR

SEQ ID NO: 2333050 - protein, 8 aa, Cryptosporidium parvum
TGRNPDVK

SEQ ID NO: 2333051 - protein, 9 aa, Cryptosporidium parvum
TGSESPIKE

SEQ ID NO: 2333052 - protein, 9 aa, Cryptosporidium parvum
TGSRNIKSS

SEQ ID NO: 2333053 - protein, 12 aa, Cryptosporidium parvum
TGSSSSCPASRS

SEQ ID NO: 2333054 - protein, 5 aa, Cryptosporidium parvum
TGSTL

SEQ ID NO: 2333055 - protein, 7 aa, Cryptosporidium parvum
TGTGTSP

SEQ ID NO: 2333056 - protein, 5 aa, Cryptosporidium parvum
TGTTT

SEQ ID NO: 2333057 - protein, 10 aa, Cryptosporidium parvum
TGVDLKPDNT

SEQ ID NO: 2333058 - protein, 11 aa, Cryptosporidium parvum
TGVPSRTGAGR

SEQ ID NO: 2333059 - protein, 14 aa, Cryptosporidium parvum
TGVRSGKLPAISKK

SEQ ID NO: 2333060 - protein, 7 aa, Cryptosporidium parvum
TGYHSSG

SEQ ID NO: 2333061 - protein, 4 aa, Cryptosporidium parvum
THGY

SEQ ID NO: 2333062 - protein, 14 aa, Cryptosporidium parvum
THPIESGKGPFEKA

SEQ ID NO: 2333063 - protein, 27 aa, Cryptosporidium parvum
THQSGRGVTSTRGRSTRMRHRRRRRTL

SEQ ID NO: 2333064 - protein, 10 aa, Cryptosporidium parvum
THQSLDGQGE

SEQ ID NO: 2333065 - protein, 11 aa, Cryptosporidium parvum
TIETGTSKTID

SEQ ID NO: 2333066 - protein, 18 aa, Cryptosporidium parvum
TIGQPSKSTSISKPGEIG

SEQ ID NO: 2333067 - protein, 6 aa, Cryptosporidium parvum
TIGTGR

SEQ ID NO: 2333068 - protein, 10 aa, Cryptosporidium parvum
TINEQTHSSN

SEQ ID NO: 2333069 - protein, 9 aa, Cryptosporidium parvum
TINESYKSE

SEQ ID NO: 2333070 - protein, 13 aa, Cryptosporidium parvum
TINKPENKNRPNS

SEQ ID NO: 2333071 - protein, 6 aa, Cryptosporidium parvum
TIPEEY

SEQ ID NO: 2333072 - protein, 5 aa, Cryptosporidium parvum
TIRDS

SEQ ID NO: 2333073 - protein, 14 aa, Cryptosporidium parvum
TIRSSKSEGGGRGK

SEQ ID NO: 2333074 - protein, 7 aa, Cryptosporidium parvum
TISNEEL

SEQ ID NO: 2333075 - protein, 13 aa, Cryptosporidium parvum
TISPPAESNSNSL

SEQ ID NO: 2333076 - protein, 10 aa, Cryptosporidium parvum
TISSPSNPGL

SEQ ID NO: 2333077 - protein, 5 aa, Cryptosporidium parvum
TISYD

SEQ ID NO: 2333078 - protein, 6 aa, Cryptosporidium parvum
TKAADL

SEQ ID NO: 2333079 - protein, 8 aa, Cryptosporidium parvum
TKAKNLKE

SEQ ID NO: 2333080 - protein, 4 aa, Cryptosporidium parvum
TKDE

SEQ ID NO: 2333081 - protein, 7 aa, Cryptosporidium parvum
TKDITTN

SEQ ID NO: 2333082 - protein, 9 aa, Cryptosporidium parvum
TKDSQSEIE

SEQ ID NO: 2333083 - protein, 8 aa, Cryptosporidium parvum
TKECPPGF

SEQ ID NO: 2333084 - protein, 16 aa, Cryptosporidium parvum
TKEDAKKFGSSIQRES

SEQ ID NO: 2333085 - protein, 7 aa, Cryptosporidium parvum
TKEGKTH

SEQ ID NO: 2333086 - protein, 6 aa, Cryptosporidium parvum
TKEGNQ

SEQ ID NO: 2333087 - protein, 9 aa, Cryptosporidium parvum
TKEGRKMSR

SEQ ID NO: 2333088 - protein, 9 aa, Cryptosporidium parvum
TKEIPGQSK

SEQ ID NO: 2333089 - protein, 5 aa, Cryptosporidium parvum
TKFNS

SEQ ID NO: 2333090 - protein, 9 aa, Cryptosporidium parvum
TKGAPGVIT

SEQ ID NO: 2333091 - protein, 5 aa, Cryptosporidium parvum
TKGID

SEQ ID NO: 2333092 - protein, 6 aa, Cryptosporidium parvum
TKGTAE

SEQ ID NO: 2333093 - protein, 12 aa, Cryptosporidium parvum
TKIKSTDKDSLN

SEQ ID NO: 2333094 - protein, 10 aa, Cryptosporidium parvum
TKILDSSKTL

SEQ ID NO: 2333095 - protein, 8 aa, Cryptosporidium parvum
TKISEKES

SEQ ID NO: 2333096 - protein, 6 aa, Cryptosporidium parvum
TKITES

SEQ ID NO: 2333097 - protein, 20 aa, Cryptosporidium parvum
TKITNNSTNDSIINQTKKVN

SEQ ID NO: 2333098 - protein, 27 aa, Cryptosporidium parvum
TKKINESGIKKKPTKNTKIDKTFSELI

SEQ ID NO: 2333099 - protein, 27 aa, Cryptosporidium parvum
TKKKARSLLPERTNTSNMGDSNLSSHI

SEQ ID NO: 2333100 - protein, 8 aa, Cryptosporidium parvum
TKKPPSPK

SEQ ID NO: 2333101 - protein, 10 aa, Cryptosporidium parvum
TKKTTSTNTW

SEQ ID NO: 2333102 - protein, 17 aa, Cryptosporidium parvum
TKLKSRKKVKYQRKFNL

SEQ ID NO: 2333103 - protein, 5 aa, Cryptosporidium parvum
TKPLP

SEQ ID NO: 2333104 - protein, 4 aa, Cryptosporidium parvum
TKPP

SEQ ID NO: 2333105 - protein, 5 aa, Cryptosporidium parvum
TKPST

SEQ ID NO: 2333106 - protein, 8 aa, Cryptosporidium parvum
TKQKENFD

SEQ ID NO: 2333107 - protein, 17 aa, Cryptosporidium parvum
TKQNENQEQGVNKESIS

SEQ ID NO: 2333108 - protein, 7 aa, Cryptosporidium parvum
TKRRVEN

SEQ ID NO: 2333109 - protein, 9 aa, Cryptosporidium parvum
TKRSGTNLR

SEQ ID NO: 2333110 - protein, 7 aa, Cryptosporidium parvum
TKRSIAG

SEQ ID NO: 2333111 - protein, 12 aa, Cryptosporidium parvum
TKSQKKKLEKER

SEQ ID NO: 2333112 - protein, 8 aa, Cryptosporidium parvum
TKSQSPKI

SEQ ID NO: 2333113 - protein, 8 aa, Cryptosporidium parvum
TKTNGKLE

SEQ ID NO: 2333114 - protein, 14 aa, Cryptosporidium parvum
TKTNWSSTSTVATA

SEQ ID NO: 2333115 - protein, 8 aa, Cryptosporidium parvum
TLDKNQQD

SEQ ID NO: 2333116 - protein, 36 aa, Cryptosporidium parvum
TLEQNSDRVSSALSSITSSTSQTSSSSSPAKSRKHS

SEQ ID NO: 2333117 - protein, 6 aa, Cryptosporidium parvum
TLGPTV

SEQ ID NO: 2333118 - protein, 42 aa, Cryptosporidium parvum
TLGSSPKKAVDQSTQTGSGNQESSMTEEADSSEGENEQSPDI

SEQ ID NO: 2333119 - protein, 4 aa, Cryptosporidium parvum
TLKD

SEQ ID NO: 2333120 - protein, 4 aa, Cryptosporidium parvum
TLNF

SEQ ID NO: 2333121 - protein, 4 aa, Cryptosporidium parvum
TLNN

SEQ ID NO: 2333122 - protein, 8 aa, Cryptosporidium parvum
TLNRSTGL

SEQ ID NO: 2333123 - protein, 10 aa, Cryptosporidium parvum
TLNSATENRS

SEQ ID NO: 2333124 - protein, 5 aa, Cryptosporidium parvum
TLPPG

SEQ ID NO: 2333125 - protein, 84 aa, Cryptosporidium parvum
TLPTPPPQTTESTEVTGGGGGGGNGNGGGFPNTSTSVPTETTTGSGGSGGGSGGGSGGGNGGGSGGGNGGGSGGSGGDGDQNQV

SEQ ID NO: 2333126 - protein, 4 aa, Cryptosporidium parvum
TLSK

SEQ ID NO: 2333127 - protein, 11 aa, Cryptosporidium parvum
TLSSLKGREQL

SEQ ID NO: 2333128 - protein, 7 aa, Cryptosporidium parvum
TMASQQQ

SEQ ID NO: 2333129 - protein, 11 aa, Cryptosporidium parvum
TMESEKSNGLK

SEQ ID NO: 2333130 - protein, 18 aa, Cryptosporidium parvum
TNAEATIYEEDASSKTNF

SEQ ID NO: 2333131 - protein, 5 aa, Cryptosporidium parvum
TNDKV

SEQ ID NO: 2333132 - protein, 7 aa, Cryptosporidium parvum
TNDRDSG

SEQ ID NO: 2333133 - protein, 15 aa, Cryptosporidium parvum
TNEEPDGSIKNYPRN

SEQ ID NO: 2333134 - protein, 15 aa, Cryptosporidium parvum
TNEQDYFNEPPNENM

SEQ ID NO: 2333135 - protein, 7 aa, Cryptosporidium parvum
TNEQNGI

SEQ ID NO: 2333136 - protein, 10 aa, Cryptosporidium parvum
TNFKGKDSLT

SEQ ID NO: 2333137 - protein, 8 aa, Cryptosporidium parvum
TNGGAGVD

SEQ ID NO: 2333138 - protein, 8 aa, Cryptosporidium parvum
TNGKTYEN

SEQ ID NO: 2333139 - protein, 6 aa, Cryptosporidium parvum
TNHAST

SEQ ID NO: 2333140 - protein, 7 aa, Cryptosporidium parvum
TNHQYDH

SEQ ID NO: 2333141 - protein, 12 aa, Cryptosporidium parvum
TNIGSSKEKRKT

SEQ ID NO: 2333142 - protein, 12 aa, Cryptosporidium parvum
TNIQKSKKKSKI

SEQ ID NO: 2333143 - protein, 6 aa, Cryptosporidium parvum
TNITPI

SEQ ID NO: 2333144 - protein, 7 aa, Cryptosporidium parvum
TNKIQRP

SEQ ID NO: 2333145 - protein, 10 aa, Cryptosporidium parvum
TNKKDKGYSI

SEQ ID NO: 2333146 - protein, 8 aa, Cryptosporidium parvum
TNKPMSQF

SEQ ID NO: 2333147 - protein, 15 aa, Cryptosporidium parvum
TNKSREQLLKLFINK

SEQ ID NO: 2333148 - protein, 4 aa, Cryptosporidium parvum
TNLA

SEQ ID NO: 2333149 - protein, 9 aa, Cryptosporidium parvum
TNLREKKEC

SEQ ID NO: 2333150 - protein, 13 aa, Cryptosporidium parvum
TNNEKAQANDEEI

SEQ ID NO: 2333151 - protein, 4 aa, Cryptosporidium parvum
TNNF

SEQ ID NO: 2333152 - protein, 10 aa, Cryptosporidium parvum
TNNNNNNNET

SEQ ID NO: 2333153 - protein, 4 aa, Cryptosporidium parvum
TNNT

SEQ ID NO: 2333154 - protein, 7 aa, Cryptosporidium parvum
TNNYPNF

SEQ ID NO: 2333155 - protein, 12 aa, Cryptosporidium parvum
TNNYTNKVNATI

SEQ ID NO: 2333156 - protein, 6 aa, Cryptosporidium parvum
TNPEIT

SEQ ID NO: 2333157 - protein, 6 aa, Cryptosporidium parvum
TNPPSF

SEQ ID NO: 2333158 - protein, 18 aa, Cryptosporidium parvum
TNQDNNLESFNSGAPEYF

SEQ ID NO: 2333159 - protein, 8 aa, Cryptosporidium parvum
TNQINENT

SEQ ID NO: 2333160 - protein, 9 aa, Cryptosporidium parvum
TNRLPSKEF

SEQ ID NO: 2333161 - protein, 4 aa, Cryptosporidium parvum
TNSH

SEQ ID NO: 2333162 - protein, 6 aa, Cryptosporidium parvum
TNSNDK

SEQ ID NO: 2333163 - protein, 7 aa, Cryptosporidium parvum
TNSNDSE

SEQ ID NO: 2333164 - protein, 10 aa, Cryptosporidium parvum
TNSRSENDER

SEQ ID NO: 2333165 - protein, 10 aa, Cryptosporidium parvum
TNSTSDGLTS

SEQ ID NO: 2333166 - protein, 5 aa, Cryptosporidium parvum
TNTGG

SEQ ID NO: 2333167 - protein, 9 aa, Cryptosporidium parvum
TNTPGTSRR

SEQ ID NO: 2333168 - protein, 30 aa, Cryptosporidium parvum
TNTTGSSNQDSTIDNSSFEGKKDKSKQEFS

SEQ ID NO: 2333169 - protein, 11 aa, Cryptosporidium parvum
TNYKTRGANNY

SEQ ID NO: 2333170 - protein, 5 aa, Cryptosporidium parvum
TNYNG

SEQ ID NO: 2333171 - protein, 8 aa, Cryptosporidium parvum
TNYNSGGY

SEQ ID NO: 2333172 - protein, 23 aa, Cryptosporidium parvum
TNYSDHNASFPASRTHYPADPNH

SEQ ID NO: 2333173 - protein, 25 aa, Cryptosporidium parvum
TPAPLPELSNDDEAAIQKTSESYEF

SEQ ID NO: 2333174 - protein, 7 aa, Cryptosporidium parvum
TPDSQNQ

SEQ ID NO: 2333175 - protein, 7 aa, Cryptosporidium parvum
TPEHPGL

SEQ ID NO: 2333176 - protein, 4 aa, Cryptosporidium parvum
TPHL

SEQ ID NO: 2333177 - protein, 5 aa, Cryptosporidium parvum
TPIDS

SEQ ID NO: 2333178 - protein, 5 aa, Cryptosporidium parvum
TPIEN

SEQ ID NO: 2333179 - protein, 5 aa, Cryptosporidium parvum
TPINN

SEQ ID NO: 2333180 - protein, 5 aa, Cryptosporidium parvum
TPINP

SEQ ID NO: 2333181 - protein, 7 aa, Cryptosporidium parvum
TPKDPNS

SEQ ID NO: 2333182 - protein, 10 aa, Cryptosporidium parvum
TPKKPSLDAF

SEQ ID NO: 2333183 - protein, 8 aa, Cryptosporidium parvum
TPKNTYSA

SEQ ID NO: 2333184 - protein, 8 aa, Cryptosporidium parvum
TPLEPLPS

SEQ ID NO: 2333185 - protein, 8 aa, Cryptosporidium parvum
TPLPNNSA

SEQ ID NO: 2333186 - protein, 4 aa, Cryptosporidium parvum
TPLQ

SEQ ID NO: 2333187 - protein, 9 aa, Cryptosporidium parvum
TPNEQGKCK

SEQ ID NO: 2333188 - protein, 6 aa, Cryptosporidium parvum
TPNIPG

SEQ ID NO: 2333189 - protein, 10 aa, Cryptosporidium parvum
TPNKELNSQL

SEQ ID NO: 2333190 - protein, 14 aa, Cryptosporidium parvum
TPNNGSLNINNQTS

SEQ ID NO: 2333191 - protein, 8 aa, Cryptosporidium parvum
TPPGTSDE

SEQ ID NO: 2333192 - protein, 19 aa, Cryptosporidium parvum
TPPKTSGHRHPAPPTVYPQ

SEQ ID NO: 2333193 - protein, 9 aa, Cryptosporidium parvum
TPPSSDEIE

SEQ ID NO: 2333194 - protein, 14 aa, Cryptosporidium parvum
TPQRDLPISKPTPL

SEQ ID NO: 2333195 - protein, 5 aa, Cryptosporidium parvum
TPSGG

SEQ ID NO: 2333196 - protein, 16 aa, Cryptosporidium parvum
TPSKFSNRNPELTERD

SEQ ID NO: 2333197 - protein, 4 aa, Cryptosporidium parvum
TPSN

SEQ ID NO: 2333198 - protein, 4 aa, Cryptosporidium parvum
TPST

SEQ ID NO: 2333199 - protein, 5 aa, Cryptosporidium parvum
TPTGK

SEQ ID NO: 2333200 - protein, 51 aa, Cryptosporidium parvum
TPTISNKATPTHIPAPTPTHTPTPTPTPNPNPNPNPNPNPSELNNSETNMV

SEQ ID NO: 2333201 - protein, 45 aa, Cryptosporidium parvum
TPTLPQTHKSYSTSSPKTLDNLAEEEEELGIPGTNPEKGPSESPI

SEQ ID NO: 2333202 - protein, 4 aa, Cryptosporidium parvum
TPTS

SEQ ID NO: 2333203 - protein, 13 aa, Cryptosporidium parvum
TPVETRKVQNDPK

SEQ ID NO: 2333204 - protein, 4 aa, Cryptosporidium parvum
TPVY

SEQ ID NO: 2333205 - protein, 8 aa, Cryptosporidium parvum
TPVYTPDE

SEQ ID NO: 2333206 - protein, 12 aa, Cryptosporidium parvum
TQANKTSISGNS

SEQ ID NO: 2333207 - protein, 17 aa, Cryptosporidium parvum
TQDLGESNDTKKLNETQ

SEQ ID NO: 2333208 - protein, 11 aa, Cryptosporidium parvum
TQEPDDAFPEE

SEQ ID NO: 2333209 - protein, 13 aa, Cryptosporidium parvum
TQESDYSKNDIDK

SEQ ID NO: 2333210 - protein, 8 aa, Cryptosporidium parvum
TQGQGERG

SEQ ID NO: 2333211 - protein, 119 aa, Cryptosporidium parvum
TQISSSVPESPTATGTPIATGSPMTPESPTVAGTPIAAGSPTVPASQVSGVASPAEVSPIAGTPIPTPPFSPPPPSVPAPAPPSFPPPSPPMPGRSPPSSPIPTPPSFSPPPPPVPAPP

SEQ ID NO: 2333212 - protein, 6 aa, Cryptosporidium parvum
TQKEEY

SEQ ID NO: 2333213 - protein, 5 aa, Cryptosporidium parvum
TQKKL

SEQ ID NO: 2333214 - protein, 5 aa, Cryptosporidium parvum
TQLPP

SEQ ID NO: 2333215 - protein, 5 aa, Cryptosporidium parvum
TQLTT

SEQ ID NO: 2333216 - protein, 7 aa, Cryptosporidium parvum
TQNAQQI

SEQ ID NO: 2333217 - protein, 8 aa, Cryptosporidium parvum
TQNCNSPF

SEQ ID NO: 2333218 - protein, 11 aa, Cryptosporidium parvum
TQNSPQSDNSP

SEQ ID NO: 2333219 - protein, 9 aa, Cryptosporidium parvum
TQNVSNSNT

SEQ ID NO: 2333220 - protein, 4 aa, Cryptosporidium parvum
TQPI

SEQ ID NO: 2333221 - protein, 10 aa, Cryptosporidium parvum
TQSNTTVDEN

SEQ ID NO: 2333222 - protein, 4 aa, Cryptosporidium parvum
TQTS

SEQ ID NO: 2333223 - protein, 6 aa, Cryptosporidium parvum
TQTSSI

SEQ ID NO: 2333224 - protein, 7 aa, Cryptosporidium parvum
TQTVPGE

SEQ ID NO: 2333225 - protein, 16 aa, Cryptosporidium parvum
TQVKPEESTERPPLGP

SEQ ID NO: 2333226 - protein, 38 aa, Cryptosporidium parvum
TRAASISRRTPSGASRRTTSSPSTKDHSGSQSPYPSLQ

SEQ ID NO: 2333227 - protein, 19 aa, Cryptosporidium parvum
TRATADKKHHEEKEKGKKV

SEQ ID NO: 2333228 - protein, 4 aa, Cryptosporidium parvum
TRDT

SEQ ID NO: 2333229 - protein, 4 aa, Cryptosporidium parvum
TREG

SEQ ID NO: 2333230 - protein, 6 aa, Cryptosporidium parvum
TRELTN

SEQ ID NO: 2333231 - protein, 20 aa, Cryptosporidium parvum
TRESIENKTHSPENKSVSKP

SEQ ID NO: 2333232 - protein, 10 aa, Cryptosporidium parvum
TRFSARNEEY

SEQ ID NO: 2333233 - protein, 6 aa, Cryptosporidium parvum
TRGELA

SEQ ID NO: 2333234 - protein, 19 aa, Cryptosporidium parvum
TRGIKTGHQNNNDESRIST

SEQ ID NO: 2333235 - protein, 8 aa, Cryptosporidium parvum
TRGRRENT

SEQ ID NO: 2333236 - protein, 8 aa, Cryptosporidium parvum
TRIDKTHS

SEQ ID NO: 2333237 - protein, 16 aa, Cryptosporidium parvum
TRKDAKPEDSKSSSIP

SEQ ID NO: 2333238 - protein, 5 aa, Cryptosporidium parvum
TRNEN

SEQ ID NO: 2333239 - protein, 15 aa, Cryptosporidium parvum
TRNIRGTRGFGQGVT

SEQ ID NO: 2333240 - protein, 8 aa, Cryptosporidium parvum
TRNKKRDE

SEQ ID NO: 2333241 - protein, 4 aa, Cryptosporidium parvum
TRNP

SEQ ID NO: 2333242 - protein, 13 aa, Cryptosporidium parvum
TRNRSTGAEVPRK

SEQ ID NO: 2333243 - protein, 12 aa, Cryptosporidium parvum
TRPSSPNVAYSQ

SEQ ID NO: 2333244 - protein, 7 aa, Cryptosporidium parvum
TRSNSNL

SEQ ID NO: 2333245 - protein, 11 aa, Cryptosporidium parvum
TRSRPCGGYSE

SEQ ID NO: 2333246 - protein, 8 aa, Cryptosporidium parvum
TRSSDGKS

SEQ ID NO: 2333247 - protein, 19 aa, Cryptosporidium parvum
TRSSNERRAPSPPSTRPYS

SEQ ID NO: 2333248 - protein, 6 aa, Cryptosporidium parvum
TRTSAD

SEQ ID NO: 2333249 - protein, 13 aa, Cryptosporidium parvum
TSANKGYKRLSGT

SEQ ID NO: 2333250 - protein, 23 aa, Cryptosporidium parvum
TSANNTRYSYTSSSSKKSGPAPF

SEQ ID NO: 2333251 - protein, 9 aa, Cryptosporidium parvum
TSAVTGEGV

SEQ ID NO: 2333252 - protein, 9 aa, Cryptosporidium parvum
TSCNPENGG

SEQ ID NO: 2333253 - protein, 5 aa, Cryptosporidium parvum
TSDEI

SEQ ID NO: 2333254 - protein, 11 aa, Cryptosporidium parvum
TSDIEDNGYEY

SEQ ID NO: 2333255 - protein, 7 aa, Cryptosporidium parvum
TSDNESR

SEQ ID NO: 2333256 - protein, 16 aa, Cryptosporidium parvum
TSDSDSSGNEQGPSGS

SEQ ID NO: 2333257 - protein, 16 aa, Cryptosporidium parvum
TSDVQTSDASRDSEIG

SEQ ID NO: 2333258 - protein, 8 aa, Cryptosporidium parvum
TSEAAQEK

SEQ ID NO: 2333259 - protein, 4 aa, Cryptosporidium parvum
TSED

SEQ ID NO: 2333260 - protein, 14 aa, Cryptosporidium parvum
TSEDTDQSTSGELD

SEQ ID NO: 2333261 - protein, 8 aa, Cryptosporidium parvum
TSESRNKE

SEQ ID NO: 2333262 - protein, 21 aa, Cryptosporidium parvum
TSFSTPEPTITRESTGNCLNP

SEQ ID NO: 2333263 - protein, 5 aa, Cryptosporidium parvum
TSFYP

SEQ ID NO: 2333264 - protein, 12 aa, Cryptosporidium parvum
TSGDTHLGGEDF

SEQ ID NO: 2333265 - protein, 6 aa, Cryptosporidium parvum
TSGESR

SEQ ID NO: 2333266 - protein, 7 aa, Cryptosporidium parvum
TSGLYNN

SEQ ID NO: 2333267 - protein, 8 aa, Cryptosporidium parvum
TSGPWGQS

SEQ ID NO: 2333268 - protein, 4 aa, Cryptosporidium parvum
TSGR

SEQ ID NO: 2333269 - protein, 6 aa, Cryptosporidium parvum
TSIDSN

SEQ ID NO: 2333270 - protein, 5 aa, Cryptosporidium parvum
TSITQ

SEQ ID NO: 2333271 - protein, 18 aa, Cryptosporidium parvum
TSITTQYSNGRIYSEGDD

SEQ ID NO: 2333272 - protein, 8 aa, Cryptosporidium parvum
TSKDSAEY

SEQ ID NO: 2333273 - protein, 13 aa, Cryptosporidium parvum
TSKNEENSELSDK

SEQ ID NO: 2333274 - protein, 13 aa, Cryptosporidium parvum
TSKPTDAATEITG

SEQ ID NO: 2333275 - protein, 8 aa, Cryptosporidium parvum
TSKSGDST

SEQ ID NO: 2333276 - protein, 8 aa, Cryptosporidium parvum
TSKSGQEI

SEQ ID NO: 2333277 - protein, 8 aa, Cryptosporidium parvum
TSKYNTVT

SEQ ID NO: 2333278 - protein, 5 aa, Cryptosporidium parvum
TSKYT

SEQ ID NO: 2333279 - protein, 11 aa, Cryptosporidium parvum
TSLNSEGSGFQ

SEQ ID NO: 2333280 - protein, 5 aa, Cryptosporidium parvum
TSNLE

SEQ ID NO: 2333281 - protein, 10 aa, Cryptosporidium parvum
TSNLNGKSEY

SEQ ID NO: 2333282 - protein, 49 aa, Cryptosporidium parvum
TSNSAAGGVSESKSSTSSPKLTTKPAPLGVAPKPSAPSRPTKPSGPLAG

SEQ ID NO: 2333283 - protein, 5 aa, Cryptosporidium parvum
TSNTL

SEQ ID NO: 2333284 - protein, 9 aa, Cryptosporidium parvum
TSNTTEDID

SEQ ID NO: 2333285 - protein, 10 aa, Cryptosporidium parvum
TSPDISESQI

SEQ ID NO: 2333286 - protein, 10 aa, Cryptosporidium parvum
TSPGDKPGVA

SEQ ID NO: 2333287 - protein, 6 aa, Cryptosporidium parvum
TSPHRD

SEQ ID NO: 2333288 - protein, 9 aa, Cryptosporidium parvum
TSQPTKPYD

SEQ ID NO: 2333289 - protein, 12 aa, Cryptosporidium parvum
TSQVTKNETHTN

SEQ ID NO: 2333290 - protein, 5 aa, Cryptosporidium parvum
TSRSY

SEQ ID NO: 2333291 - protein, 11 aa, Cryptosporidium parvum
TSSAPTQPVCP

SEQ ID NO: 2333292 - protein, 7 aa, Cryptosporidium parvum
TSSGKYQ

SEQ ID NO: 2333293 - protein, 5 aa, Cryptosporidium parvum
TSSGN

SEQ ID NO: 2333294 - protein, 8 aa, Cryptosporidium parvum
TSSGSFVG

SEQ ID NO: 2333295 - protein, 8 aa, Cryptosporidium parvum
TSSPEENI

SEQ ID NO: 2333296 - protein, 6 aa, Cryptosporidium parvum
TSSSFE

SEQ ID NO: 2333297 - protein, 26 aa, Cryptosporidium parvum
TSSTLDNNNISNTTAINGTNSGLNIN

SEQ ID NO: 2333298 - protein, 7 aa, Cryptosporidium parvum
TSSVNEV

SEQ ID NO: 2333299 - protein, 8 aa, Cryptosporidium parvum
TSSYTLPS

SEQ ID NO: 2333300 - protein, 9 aa, Cryptosporidium parvum
TSTKNNFPT

SEQ ID NO: 2333301 - protein, 4 aa, Cryptosporidium parvum
TSTP

SEQ ID NO: 2333302 - protein, 20 aa, Cryptosporidium parvum
TSTSTHKTTTTTTISTTTSN

SEQ ID NO: 2333303 - protein, 4 aa, Cryptosporidium parvum
TSVG

SEQ ID NO: 2333304 - protein, 10 aa, Cryptosporidium parvum
TSVSKGSGVY

SEQ ID NO: 2333305 - protein, 6 aa, Cryptosporidium parvum
TSVSRT

SEQ ID NO: 2333306 - protein, 8 aa, Cryptosporidium parvum
TSYGPESI

SEQ ID NO: 2333307 - protein, 12 aa, Cryptosporidium parvum
TSYKSPNPISEP

SEQ ID NO: 2333308 - protein, 10 aa, Cryptosporidium parvum
TTDSKSPELE

SEQ ID NO: 2333309 - protein, 29 aa, Cryptosporidium parvum
TTDYQKKARKRSRSRTEKSKISLRSKYSF

SEQ ID NO: 2333310 - protein, 4 aa, Cryptosporidium parvum
TTEF

SEQ ID NO: 2333311 - protein, 12 aa, Cryptosporidium parvum
TTESNSGSNTDF

SEQ ID NO: 2333312 - protein, 4 aa, Cryptosporidium parvum
TTFK

SEQ ID NO: 2333313 - protein, 10 aa, Cryptosporidium parvum
TTFQKDDNTR

SEQ ID NO: 2333314 - protein, 9 aa, Cryptosporidium parvum
TTGRQQKLG

SEQ ID NO: 2333315 - protein, 5 aa, Cryptosporidium parvum
TTGSI

SEQ ID NO: 2333316 - protein, 16 aa, Cryptosporidium parvum
TTGYTSENMQTAPATT

SEQ ID NO: 2333317 - protein, 6 aa, Cryptosporidium parvum
TTIEAT

SEQ ID NO: 2333318 - protein, 7 aa, Cryptosporidium parvum
TTKAPPK

SEQ ID NO: 2333319 - protein, 11 aa, Cryptosporidium parvum
TTKEKKREITD

SEQ ID NO: 2333320 - protein, 20 aa, Cryptosporidium parvum
TTKIPGTACSTKPTTSEMAR

SEQ ID NO: 2333321 - protein, 22 aa, Cryptosporidium parvum
TTKNDENAAFPASRTQYPTNPN

SEQ ID NO: 2333322 - protein, 5 aa, Cryptosporidium parvum
TTLKD

SEQ ID NO: 2333323 - protein, 4 aa, Cryptosporidium parvum
TTLP

SEQ ID NO: 2333324 - protein, 13 aa, Cryptosporidium parvum
TTNKFNKETGLSI

SEQ ID NO: 2333325 - protein, 6 aa, Cryptosporidium parvum
TTNMSE

SEQ ID NO: 2333326 - protein, 6 aa, Cryptosporidium parvum
TTNSEG

SEQ ID NO: 2333327 - protein, 5 aa, Cryptosporidium parvum
TTNSN

SEQ ID NO: 2333328 - protein, 8 aa, Cryptosporidium parvum
TTPGLVDS

SEQ ID NO: 2333329 - protein, 7 aa, Cryptosporidium parvum
TTPGPKY

SEQ ID NO: 2333330 - protein, 6 aa, Cryptosporidium parvum
TTPLSQ

SEQ ID NO: 2333331 - protein, 4 aa, Cryptosporidium parvum
TTPS

SEQ ID NO: 2333332 - protein, 6 aa, Cryptosporidium parvum
TTPSVY

SEQ ID NO: 2333333 - protein, 12 aa, Cryptosporidium parvum
TTQTEKGKQAIK

SEQ ID NO: 2333334 - protein, 13 aa, Cryptosporidium parvum
TTQVETKAPLSES

SEQ ID NO: 2333335 - protein, 7 aa, Cryptosporidium parvum
TTRLDSP

SEQ ID NO: 2333336 - protein, 4 aa, Cryptosporidium parvum
TTSD

SEQ ID NO: 2333337 - protein, 18 aa, Cryptosporidium parvum
TTSEYSSKEYNSNTSNSF

SEQ ID NO: 2333338 - protein, 20 aa, Cryptosporidium parvum
TTSGSNNKSSTSDNDELEKK

SEQ ID NO: 2333339 - protein, 6 aa, Cryptosporidium parvum
TTSKRV

SEQ ID NO: 2333340 - protein, 21 aa, Cryptosporidium parvum
TTSQYEPLGSAEDSNSLRPPV

SEQ ID NO: 2333341 - protein, 5 aa, Cryptosporidium parvum
TTSSA

SEQ ID NO: 2333342 - protein, 99 aa, Cryptosporidium parvum
TTSTSTSTSTTTTTTTSTSTSTTENTSTNFESDSSSESTSEYTSTSTSTSSTITSDIEPTSTSTSTSASTSTSTSTSASTSALPTSTTTIATSTKSSRK

SEQ ID NO: 2333343 - protein, 21 aa, Cryptosporidium parvum
TTSTTKATHTLKSNNQSTSEE

SEQ ID NO: 2333344 - protein, 50 aa, Cryptosporidium parvum
TTTTATTTTTTTTTTTTTMTTTTTTTTMTTTTTTTTTTTTTTTTTTTTTT

SEQ ID NO: 2333345 - protein, 22 aa, Cryptosporidium parvum
TTTTNNNNNNNNNNKNNTSNTF

SEQ ID NO: 2333346 - protein, 22 aa, Cryptosporidium parvum
TTTTSCNSPYLPKSPYNQSRKD

SEQ ID NO: 2333347 - protein, 15 aa, Cryptosporidium parvum
TTTTTSTTSTTTEQP

SEQ ID NO: 2333348 - protein, 43 aa, Cryptosporidium parvum
TTTTTTTPRPTKIPPPRPPLPKFTGNKDASRPAPSSSTFTSSH

SEQ ID NO: 2333349 - protein, 364 aa, Cryptosporidium parvum
TTTTTTTTTTTTTTTTTTTTTTTTTTTTTTTTTTTTTTTTTSTTTTTTTTTSTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTNPPW

SEQ ID NO: 2333350 - protein, 167 aa, Cryptosporidium parvum
  misc_feature (96)..(96): Xaa can be any naturally occurring amino acid
  misc_feature (106)..(106): Xaa can be any naturally occurring amino acid
TTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTXTTTHHTTTTXHYTTTTTTTTTTTTTTTTTTTTTTTTTTTTTTTTTTTTTTTTTTTTTTTTTTTTTTTTAES

SEQ ID NO: 2333351 - protein, 48 aa, Cryptosporidium parvum
TTTTTTVKTGTSTTTTTTTTTTTTTTTTTTTTTTTTTTTTPNKKTTTT

SEQ ID NO: 2333352 - protein, 35 aa, Cryptosporidium parvum
TTTTVTTTTTTTTNTNTTTTTTTATTTTSTSTTST

SEQ ID NO: 2333353 - protein, 14 aa, Cryptosporidium parvum
TVAETSPQSTNPFA

SEQ ID NO: 2333354 - protein, 12 aa, Cryptosporidium parvum
TVDERTQGSGLK

SEQ ID NO: 2333355 - protein, 11 aa, Cryptosporidium parvum
TVEPSTSQQRS

SEQ ID NO: 2333356 - protein, 21 aa, Cryptosporidium parvum
TVEQDSSSSPDESSPKEQSRL

SEQ ID NO: 2333357 - protein, 12 aa, Cryptosporidium parvum
TVGNRKEDKLES

SEQ ID NO: 2333358 - protein, 10 aa, Cryptosporidium parvum
TVGNVSREKA

SEQ ID NO: 2333359 - protein, 6 aa, Cryptosporidium parvum
TVGPTF

SEQ ID NO: 2333360 - protein, 18 aa, Cryptosporidium parvum
TVKHSEKSLDIEDEKQYK

SEQ ID NO: 2333361 - protein, 10 aa, Cryptosporidium parvum
TVNSGANAKS

SEQ ID NO: 2333362 - protein, 11 aa, Cryptosporidium parvum
TVNSTDDSEKI

SEQ ID NO: 2333363 - protein, 11 aa, Cryptosporidium parvum
TVPKQETCPSN

SEQ ID NO: 2333364 - protein, 8 aa, Cryptosporidium parvum
TVRNPEKE

SEQ ID NO: 2333365 - protein, 5 aa, Cryptosporidium parvum
TVSAN

SEQ ID NO: 2333366 - protein, 9 aa, Cryptosporidium parvum
TVSEVESSS

SEQ ID NO: 2333367 - protein, 12 aa, Cryptosporidium parvum
TVSGPSGPQQKH

SEQ ID NO: 2333368 - protein, 9 aa, Cryptosporidium parvum
TVSKKRSAR

SEQ ID NO: 2333369 - protein, 7 aa, Cryptosporidium parvum
TVSKSCE

SEQ ID NO: 2333370 - protein, 5 aa, Cryptosporidium parvum
TVSNG

SEQ ID NO: 2333371 - protein, 10 aa, Cryptosporidium parvum
TVSSNYNSNF

SEQ ID NO: 2333372 - protein, 7 aa, Cryptosporidium parvum
TVTECTN

SEQ ID NO: 2333373 - protein, 8 aa, Cryptosporidium parvum
TVTQEDAE

SEQ ID NO: 2333374 - protein, 5 aa, Cryptosporidium parvum
TWEGE

SEQ ID NO: 2333375 - protein, 10 aa, Cryptosporidium parvum
TYEPNNTNSI

SEQ ID NO: 2333376 - protein, 4 aa, Cryptosporidium parvum
TYFQ

SEQ ID NO: 2333377 - protein, 20 aa, Cryptosporidium parvum
TYNEAKASIEESQSSGTPFS

SEQ ID NO: 2333378 - protein, 4 aa, Cryptosporidium parvum
TYPE

SEQ ID NO: 2333379 - protein, 25 aa, Cryptosporidium parvum
TYSENKSEAWNSELGGNQITPSNID

SEQ ID NO: 2333380 - protein, 6 aa, Cryptosporidium parvum
TYTKSE

SEQ ID NO: 2333381 - protein, 4 aa, Cryptosporidium parvum
VAEK

SEQ ID NO: 2333382 - protein, 13 aa, Cryptosporidium parvum
VAESSEEANEQEM

SEQ ID NO: 2333383 - protein, 9 aa, Cryptosporidium parvum
VAGSPQCGP

SEQ ID NO: 2333384 - protein, 9 aa, Cryptosporidium parvum
VAKGGDANV

SEQ ID NO: 2333385 - protein, 8 aa, Cryptosporidium parvum
VAKSGTAN

SEQ ID NO: 2333386 - protein, 6 aa, Cryptosporidium parvum
VANSEK

SEQ ID NO: 2333387 - protein, 5 aa, Cryptosporidium parvum
VAPYT

SEQ ID NO: 2333388 - protein, 21 aa, Cryptosporidium parvum
VAQGTRRSLGTASNHPHHSSG

SEQ ID NO: 2333389 - protein, 8 aa, Cryptosporidium parvum
VASQGSKN

SEQ ID NO: 2333390 - protein, 14 aa, Cryptosporidium parvum
VASQQPSIRPSTQA

SEQ ID NO: 2333391 - protein, 5 aa, Cryptosporidium parvum
VATQA

SEQ ID NO: 2333392 - protein, 50 aa, Cryptosporidium parvum
VCENSDTGSGSSDLESSGNSDNETESDAASQGSHGSNASSGGESSTNSQR

SEQ ID NO: 2333393 - protein, 6 aa, Cryptosporidium parvum
VCPNES

SEQ ID NO: 2333394 - protein, 6 aa, Cryptosporidium parvum
VCPNGD

SEQ ID NO: 2333395 - protein, 11 aa, Cryptosporidium parvum
VCPTNSKLNTI

SEQ ID NO: 2333396 - protein, 7 aa, Cryptosporidium parvum
VDAKNAL

SEQ ID NO: 2333397 - protein, 8 aa, Cryptosporidium parvum
VDDSPGYK

SEQ ID NO: 2333398 - protein, 4 aa, Cryptosporidium parvum
VDEH

SEQ ID NO: 2333399 - protein, 6 aa, Cryptosporidium parvum
VDENER

SEQ ID NO: 2333400 - protein, 6 aa, Cryptosporidium parvum
VDGEMK

SEQ ID NO: 2333401 - protein, 8 aa, Cryptosporidium parvum
VDGKDTSY

SEQ ID NO: 2333402 - protein, 6 aa, Cryptosporidium parvum
VDGRTN

SEQ ID NO: 2333403 - protein, 8 aa, Cryptosporidium parvum
VDKTSKEL

SEQ ID NO: 2333404 - protein, 7 aa, Cryptosporidium parvum
VDLAGQD

SEQ ID NO: 2333405 - protein, 31 aa, Cryptosporidium parvum
VDLTDSDYSIPTESSSDGRLTGMSRGRSRNR

SEQ ID NO: 2333406 - protein, 9 aa, Cryptosporidium parvum
VDNEEVNQE

SEQ ID NO: 2333407 - protein, 9 aa, Cryptosporidium parvum
VDNTQTSLE

SEQ ID NO: 2333408 - protein, 141 aa, Cryptosporidium parvum
VDPSIEPHVSSTSDSTVDSGEPDKKAEKGKKNKKQKKQKKEKKEKKAKKGKKVKESKAGEEGAQEGVKEGAQEGAQEGAQEGAQEGAQEGPVEEAEGKKDKDKKAKKEKKAKKEKKAKKEKKVKTQEGATDEEEVAAAEQE

SEQ ID NO: 2333409 - protein, 18 aa, Cryptosporidium parvum
VDRNISGNSQTMNATPSL

SEQ ID NO: 2333410 - protein, 7 aa, Cryptosporidium parvum
VDRPSIP

SEQ ID NO: 2333411 - protein, 7 aa, Cryptosporidium parvum
VDRTGNG

SEQ ID NO: 2333412 - protein, 11 aa, Cryptosporidium parvum
VDSEEFTDEEE

SEQ ID NO: 2333413 - protein, 9 aa, Cryptosporidium parvum
VDSPDAGIA

SEQ ID NO: 2333414 - protein, 4 aa, Cryptosporidium parvum
VDSR

SEQ ID NO: 2333415 - protein, 20 aa, Cryptosporidium parvum
VDSVDKKKSLKSAAKAKSRE

SEQ ID NO: 2333416 - protein, 8 aa, Cryptosporidium parvum
VDTDKDGY

SEQ ID NO: 2333417 - protein, 6 aa, Cryptosporidium parvum
VDTKYK

SEQ ID NO: 2333418 - protein, 12 aa, Cryptosporidium parvum
VDTVTESGEIDI

SEQ ID NO: 2333419 - protein, 11 aa, Cryptosporidium parvum
VECPEKTEPLG

SEQ ID NO: 2333420 - protein, 7 aa, Cryptosporidium parvum
VECPPGL

SEQ ID NO: 2333421 - protein, 7 aa, Cryptosporidium parvum
VEEITKK

SEQ ID NO: 2333422 - protein, 4 aa, Cryptosporidium parvum
VEEQ

SEQ ID NO: 2333423 - protein, 13 aa, Cryptosporidium parvum
VEESPESGEEREA

SEQ ID NO: 2333424 - protein, 51 aa, Cryptosporidium parvum
VEEVDEEEGEGRDEGKESDEGKKSKEEEGKEGKEEGKDEGKEKEEKEKKER

SEQ ID NO: 2333425 - protein, 14 aa, Cryptosporidium parvum
VEGSEKSARESEEK

SEQ ID NO: 2333426 - protein, 22 aa, Cryptosporidium parvum
VEKKKEKMKEEKEKQEKLEAEK

SEQ ID NO: 2333427 - protein, 5 aa, Cryptosporidium parvum
VEKQL

SEQ ID NO: 2333428 - protein, 8 aa, Cryptosporidium parvum
VEKSDQEN

SEQ ID NO: 2333429 - protein, 9 aa, Cryptosporidium parvum
VEKSKSPNF

SEQ ID NO: 2333430 - protein, 10 aa, Cryptosporidium parvum
VELSPEQEKE

SEQ ID NO: 2333431 - protein, 9 aa, Cryptosporidium parvum
VENPKNPSF

SEQ ID NO: 2333432 - protein, 9 aa, Cryptosporidium parvum
VEPSRDPSL

SEQ ID NO: 2333433 - protein, 10 aa, Cryptosporidium parvum
VEPSRDPSLS

SEQ ID NO: 2333434 - protein, 12 aa, Cryptosporidium parvum
VEPSRDPSLSQT

SEQ ID NO: 2333435 - protein, 6 aa, Cryptosporidium parvum
VEQGEL

SEQ ID NO: 2333436 - protein, 9 aa, Cryptosporidium parvum
VERDKTTWK

SEQ ID NO: 2333437 - protein, 7 aa, Cryptosporidium parvum
VESNSTK

SEQ ID NO: 2333438 - protein, 11 aa, Cryptosporidium parvum
VESQSQNIDEI

SEQ ID NO: 2333439 - protein, 7 aa, Cryptosporidium parvum
VESVKAK

SEQ ID NO: 2333440 - protein, 8 aa, Cryptosporidium parvum
VEYDSSEM

SEQ ID NO: 2333441 - protein, 5 aa, Cryptosporidium parvum
VFSPD

SEQ ID NO: 2333442 - protein, 13 aa, Cryptosporidium parvum
VGAESTNQEVNEQ

SEQ ID NO: 2333443 - protein, 7 aa, Cryptosporidium parvum
VGENHEK

SEQ ID NO: 2333444 - protein, 6 aa, Cryptosporidium parvum
VGENSG

SEQ ID NO: 2333445 - protein, 13 aa, Cryptosporidium parvum
VGESNPLPAQTKS

SEQ ID NO: 2333446 - protein, 13 aa, Cryptosporidium parvum
VGGNHEEQEPEEI

SEQ ID NO: 2333447 - protein, 8 aa, Cryptosporidium parvum
VGGRSEDS

SEQ ID NO: 2333448 - protein, 6 aa, Cryptosporidium parvum
VGHPSD

SEQ ID NO: 2333449 - protein, 49 aa, Cryptosporidium parvum
VGLGSDSKSGTESGSESKPELEPEPEPVPGSGSEPKAEEGIRSSQGELS

SEQ ID NO: 2333450 - protein, 13 aa, Cryptosporidium parvum
VGNEPGDEPNLPA

SEQ ID NO: 2333451 - protein, 11 aa, Cryptosporidium parvum
VGNTALQTAKG

SEQ ID NO: 2333452 - protein, 28 aa, Cryptosporidium parvum
VGNTEYEKNVNQHNHPLENTNKSDGDSF

SEQ ID NO: 2333453 - protein, 6 aa, Cryptosporidium parvum
VGPIGT

SEQ ID NO: 2333454 - protein, 7 aa, Cryptosporidium parvum
VGPPRGQ

SEQ ID NO: 2333455 - protein, 32 aa, Cryptosporidium parvum
VGQRGAMEGTAKSSSLRETSNSPSSVSQIESI

SEQ ID NO: 2333456 - protein, 38 aa, Cryptosporidium parvum
VGQSSYRKDSDRSYDKNKQKPLTNLGYNDSKKQWREQK

SEQ ID NO: 2333457 - protein, 4 aa, Cryptosporidium parvum
VGSQ

SEQ ID NO: 2333458 - protein, 16 aa, Cryptosporidium parvum
VGSRPESDTTTGVKGE

SEQ ID NO: 2333459 - protein, 7 aa, Cryptosporidium parvum
VGSVDNY

SEQ ID NO: 2333460 - protein, 5 aa, Cryptosporidium parvum
VGTKQ

SEQ ID NO: 2333461 - protein, 10 aa, Cryptosporidium parvum
VHGSKGSGKI

SEQ ID NO: 2333462 - protein, 6 aa, Cryptosporidium parvum
VHTNSS

SEQ ID NO: 2333463 - protein, 55 aa, Cryptosporidium parvum
VKAEETVSSQTLKNRLKKQKKKQAKSHALATEDVGSEAITKPKPISAAAKAAAER

SEQ ID NO: 2333464 - protein, 9 aa, Cryptosporidium parvum
VKAGNVKPI

SEQ ID NO: 2333465 - protein, 24 aa, Cryptosporidium parvum
VKAKNGAETNDNLNIGPEGLQDDS

SEQ ID NO: 2333466 - protein, 8 aa, Cryptosporidium parvum
VKAPSSEY

SEQ ID NO: 2333467 - protein, 7 aa, Cryptosporidium parvum
VKDPSTI

SEQ ID NO: 2333468 - protein, 7 aa, Cryptosporidium parvum
VKDSNKY

SEQ ID NO: 2333469 - protein, 38 aa, Cryptosporidium parvum
VKEDGSLNATQMPSRKSSGTSESVSARPYTPVDEGSEF

SEQ ID NO: 2333470 - protein, 14 aa, Cryptosporidium parvum
VKGNEEKDQNTNQK

SEQ ID NO: 2333471 - protein, 8 aa, Cryptosporidium parvum
VKGSNPVT

SEQ ID NO: 2333472 - protein, 7 aa, Cryptosporidium parvum
VKHQSQR

SEQ ID NO: 2333473 - protein, 12 aa, Cryptosporidium parvum
VKIEKDNGKGFG

SEQ ID NO: 2333474 - protein, 9 aa, Cryptosporidium parvum
VKKEGDSLE

SEQ ID NO: 2333475 - protein, 6 aa, Cryptosporidium parvum
VKKGAY

SEQ ID NO: 2333476 - protein, 14 aa, Cryptosporidium parvum
VKNPQEFEKTTQQA

SEQ ID NO: 2333477 - protein, 6 aa, Cryptosporidium parvum
VKPSKS

SEQ ID NO: 2333478 - protein, 7 aa, Cryptosporidium parvum
VKPSSSL

SEQ ID NO: 2333479 - protein, 8 aa, Cryptosporidium parvum
VKPVQKST

SEQ ID NO: 2333480 - protein, 4 aa, Cryptosporidium parvum
VKQS

SEQ ID NO: 2333481 - protein, 7 aa, Cryptosporidium parvum
VKSGAGH

SEQ ID NO: 2333482 - protein, 10 aa, Cryptosporidium parvum
VKSNPSKPNI

SEQ ID NO: 2333483 - protein, 21 aa, Cryptosporidium parvum
VKSRSADRSPSLPYSQEPSME

SEQ ID NO: 2333484 - protein, 12 aa, Cryptosporidium parvum
VKSSSSQSPEYD

SEQ ID NO: 2333485 - protein, 12 aa, Cryptosporidium parvum
VKSTKVSKTLGD

SEQ ID NO: 2333486 - protein, 8 aa, Cryptosporidium parvum
VKSTPEIE

SEQ ID NO: 2333487 - protein, 67 aa, Cryptosporidium parvum
VKTEAQKPLKRRAPPPPAHPSYSVKTEAQKPRKRRAPPPPAHPPHSVKTETKNPQIRRTPSPPTNPP

SEQ ID NO: 2333488 - protein, 8 aa, Cryptosporidium parvum
VKYSEDES

SEQ ID NO: 2333489 - protein, 7 aa, Cryptosporidium parvum
VLKGEGK

SEQ ID NO: 2333490 - protein, 20 aa, Cryptosporidium parvum
VLKNGEKELNEGKSNSNDTH

SEQ ID NO: 2333491 - protein, 8 aa, Cryptosporidium parvum
VMDEQSKK

SEQ ID NO: 2333492 - protein, 4 aa, Cryptosporidium parvum
VNDR

SEQ ID NO: 2333493 - protein, 15 aa, Cryptosporidium parvum
VNDSESGIQSKSITK

SEQ ID NO: 2333494 - protein, 7 aa, Cryptosporidium parvum
VNESNPT

SEQ ID NO: 2333495 - protein, 4 aa, Cryptosporidium parvum
VNFG

SEQ ID NO: 2333496 - protein, 7 aa, Cryptosporidium parvum
VNGDAPK

SEQ ID NO: 2333497 - protein, 9 aa, Cryptosporidium parvum
VNGKNDSKF

SEQ ID NO: 2333498 - protein, 8 aa, Cryptosporidium parvum
VNKDPTEL

SEQ ID NO: 2333499 - protein, 7 aa, Cryptosporidium parvum
VNNETAL

SEQ ID NO: 2333500 - protein, 8 aa, Cryptosporidium parvum
VNNGTWGS

SEQ ID NO: 2333501 - protein, 10 aa, Cryptosporidium parvum
VNNNKDIDNH

SEQ ID NO: 2333502 - protein, 9 aa, Cryptosporidium parvum
VNPADEGID

SEQ ID NO: 2333503 - protein, 5 aa, Cryptosporidium parvum
VNPYT

SEQ ID NO: 2333504 - protein, 6 aa, Cryptosporidium parvum
VNQTSS

SEQ ID NO: 2333505 - protein, 5 aa, Cryptosporidium parvum
VNSTS

SEQ ID NO: 2333506 - protein, 10 aa, Cryptosporidium parvum
VNTKLNSGYY

SEQ ID NO: 2333507 - protein, 5 aa, Cryptosporidium parvum
VNTTN

SEQ ID NO: 2333508 - protein, 14 aa, Cryptosporidium parvum
VNVSSIDNNHKKAI

SEQ ID NO: 2333509 - protein, 13 aa, Cryptosporidium parvum
VPAKTDSSQASFE

SEQ ID NO: 2333510 - protein, 24 aa, Cryptosporidium parvum
VPASVPASVPASVPASASAPGSYI

SEQ ID NO: 2333511 - protein, 7 aa, Cryptosporidium parvum
VPDMKKT

SEQ ID NO: 2333512 - protein, 11 aa, Cryptosporidium parvum
VPDYDETKYNG

SEQ ID NO: 2333513 - protein, 13 aa, Cryptosporidium parvum
VPDYDPNNVNNNY

SEQ ID NO: 2333514 - protein, 5 aa, Cryptosporidium parvum
VPGNP

SEQ ID NO: 2333515 - protein, 10 aa, Cryptosporidium parvum
VPGTNSHGTD

SEQ ID NO: 2333516 - protein, 15 aa, Cryptosporidium parvum
VPKDKKSDKYHQTQE

SEQ ID NO: 2333517 - protein, 10 aa, Cryptosporidium parvum
VPKEKNPSNV

SEQ ID NO: 2333518 - protein, 5 aa, Cryptosporidium parvum
VPKKE

SEQ ID NO: 2333519 - protein, 6 aa, Cryptosporidium parvum
VPKPVA

SEQ ID NO: 2333520 - protein, 8 aa, Cryptosporidium parvum
VPKTPSSI

SEQ ID NO: 2333521 - protein, 5 aa, Cryptosporidium parvum
VPNAL

SEQ ID NO: 2333522 - protein, 6 aa, Cryptosporidium parvum
VPNPGN

SEQ ID NO: 2333523 - protein, 8 aa, Cryptosporidium parvum
VPNQESSK

SEQ ID NO: 2333524 - protein, 8 aa, Cryptosporidium parvum
VPPDDDEA

SEQ ID NO: 2333525 - protein, 5 aa, Cryptosporidium parvum
VPPRH

SEQ ID NO: 2333526 - protein, 8 aa, Cryptosporidium parvum
VPQTTALG

SEQ ID NO: 2333527 - protein, 9 aa, Cryptosporidium parvum
VPSGSYDKS

SEQ ID NO: 2333528 - protein, 9 aa, Cryptosporidium parvum
VPSKSCPSG

SEQ ID NO: 2333529 - protein, 11 aa, Cryptosporidium parvum
VPSNPPKEFSC

SEQ ID NO: 2333530 - protein, 8 aa, Cryptosporidium parvum
VPSSSKDP

SEQ ID NO: 2333531 - protein, 8 aa, Cryptosporidium parvum
VPTETPAV

SEQ ID NO: 2333532 - protein, 5 aa, Cryptosporidium parvum
VPTLG

SEQ ID NO: 2333533 - protein, 11 aa, Cryptosporidium parvum
VPTPAQTPDIE

SEQ ID NO: 2333534 - protein, 5 aa, Cryptosporidium parvum
VPTQK

SEQ ID NO: 2333535 - protein, 10 aa, Cryptosporidium parvum
VPVKSRDLSD

SEQ ID NO: 2333536 - protein, 8 aa, Cryptosporidium parvum
VQDEEENV

SEQ ID NO: 2333537 - protein, 9 aa, Cryptosporidium parvum
VQESYQKHT

SEQ ID NO: 2333538 - protein, 31 aa, Cryptosporidium parvum
VQKQEQAQEQEKRIETNPSSKLISSKDKDIE

SEQ ID NO: 2333539 - protein, 4 aa, Cryptosporidium parvum
VQNS

SEQ ID NO: 2333540 - protein, 9 aa, Cryptosporidium parvum
VQPQTINQP

SEQ ID NO: 2333541 - protein, 7 aa, Cryptosporidium parvum
VQQYDGP

SEQ ID NO: 2333542 - protein, 15 aa, Cryptosporidium parvum
VQSDTAPPNPECPPG

SEQ ID NO: 2333543 - protein, 24 aa, Cryptosporidium parvum
VQSGKLPSLEASPNVGKSKFPNGA

SEQ ID NO: 2333544 - protein, 10 aa, Cryptosporidium parvum
VQSSSDSSSI

SEQ ID NO: 2333545 - protein, 12 aa, Cryptosporidium parvum
VQSTSQKGYSHG

SEQ ID NO: 2333546 - protein, 10 aa, Cryptosporidium parvum
VQTNEERVDK

SEQ ID NO: 2333547 - protein, 23 aa, Cryptosporidium parvum
VQTTTSPKTPECPPGSALDGDSC

SEQ ID NO: 2333548 - protein, 17 aa, Cryptosporidium parvum
VREEEQISGSKNNTDEP

SEQ ID NO: 2333549 - protein, 20 aa, Cryptosporidium parvum
VRENSSKQESLVSEKNQLEA

SEQ ID NO: 2333550 - protein, 8 aa, Cryptosporidium parvum
VRGTTNLK

SEQ ID NO: 2333551 - protein, 12 aa, Cryptosporidium parvum
VRNPGEHGHPDS

SEQ ID NO: 2333552 - protein, 26 aa, Cryptosporidium parvum
VRPGSNQGQSTPSFPSPCSPSASASK

SEQ ID NO: 2333553 - protein, 11 aa, Cryptosporidium parvum
VRSDSQKEFER

SEQ ID NO: 2333554 - protein, 8 aa, Cryptosporidium parvum
VRSPTQSQ

SEQ ID NO: 2333555 - protein, 8 aa, Cryptosporidium parvum
VRSSQPAA

SEQ ID NO: 2333556 - protein, 8 aa, Cryptosporidium parvum
VSASKVNK

SEQ ID NO: 2333557 - protein, 20 aa, Cryptosporidium parvum
VSASPHTSLPPQSVSDLSPA

SEQ ID NO: 2333558 - protein, 7 aa, Cryptosporidium parvum
VSDDKAI

SEQ ID NO: 2333559 - protein, 54 aa, Cryptosporidium parvum
VSDETTTTTTKSTTTTTTAVTTASPSPRTPSSDYSPSPLSESPLIDTPESESQV

SEQ ID NO: 2333560 - protein, 21 aa, Cryptosporidium parvum
VSDGNVEDSEDGAPKKPPLPA

SEQ ID NO: 2333561 - protein, 8 aa, Cryptosporidium parvum
VSDKIGRT

SEQ ID NO: 2333562 - protein, 25 aa, Cryptosporidium parvum
VSDSEITSSRSRSKSLRSTRSENQI

SEQ ID NO: 2333563 - protein, 17 aa, Cryptosporidium parvum
VSDSGKIIAPKDATSVP

SEQ ID NO: 2333564 - protein, 6 aa, Cryptosporidium parvum
VSDSNT

SEQ ID NO: 2333565 - protein, 5 aa, Cryptosporidium parvum
VSEKY

SEQ ID NO: 2333566 - protein, 8 aa, Cryptosporidium parvum
VSEPDNKK

SEQ ID NO: 2333567 - protein, 7 aa, Cryptosporidium parvum
VSEYRTG

SEQ ID NO: 2333568 - protein, 9 aa, Cryptosporidium parvum
VSGNELENN

SEQ ID NO: 2333569 - protein, 8 aa, Cryptosporidium parvum
VSGTPSVS

SEQ ID NO: 2333570 - protein, 4 aa, Cryptosporidium parvum
VSGY

SEQ ID NO: 2333571 - protein, 34 aa, Cryptosporidium parvum
VSIPKSQATTTTTTTTTTSTASTESTTTTKTPWE

SEQ ID NO: 2333572 - protein, 26 aa, Cryptosporidium parvum
VSKQNGMKTNGSSDEQKDEEDKEIDN

SEQ ID NO: 2333573 - protein, 4 aa, Cryptosporidium parvum
VSNA

SEQ ID NO: 2333574 - protein, 20 aa, Cryptosporidium parvum
VSNDIDQNVQDEENKSFGSD

SEQ ID NO: 2333575 - protein, 8 aa, Cryptosporidium parvum
VSNDPIKT

SEQ ID NO: 2333576 - protein, 6 aa, Cryptosporidium parvum
VSNEKS

SEQ ID NO: 2333577 - protein, 5 aa, Cryptosporidium parvum
VSNES

SEQ ID NO: 2333578 - protein, 10 aa, Cryptosporidium parvum
VSNNPKDNPD

SEQ ID NO: 2333579 - protein, 7 aa, Cryptosporidium parvum
VSNTQVQ

SEQ ID NO: 2333580 - protein, 5 aa, Cryptosporidium parvum
VSPDG

SEQ ID NO: 2333581 - protein, 7 aa, Cryptosporidium parvum
VSPEPRC

SEQ ID NO: 2333582 - protein, 4 aa, Cryptosporidium parvum
VSPL

SEQ ID NO: 2333583 - protein, 6 aa, Cryptosporidium parvum
VSPQCG

SEQ ID NO: 2333584 - protein, 10 aa, Cryptosporidium parvum
VSPQRSVSDP

SEQ ID NO: 2333585 - protein, 4 aa, Cryptosporidium parvum
VSPR

SEQ ID NO: 2333586 - protein, 9 aa, Cryptosporidium parvum
VSPRPDKEP

SEQ ID NO: 2333587 - protein, 21 aa, Cryptosporidium parvum
VSPSNRVEASNIEASASPSTL

SEQ ID NO: 2333588 - protein, 21 aa, Cryptosporidium parvum
VSPTSVPASAPASASAPGSYI

SEQ ID NO: 2333589 - protein, 8 aa, Cryptosporidium parvum
VSQAPEDV

SEQ ID NO: 2333590 - protein, 4 aa, Cryptosporidium parvum
VSQI

SEQ ID NO: 2333591 - protein, 19 aa, Cryptosporidium parvum
VSQPGPHQPPTKPTPPYPL

SEQ ID NO: 2333592 - protein, 8 aa, Cryptosporidium parvum
VSQPNNLE

SEQ ID NO: 2333593 - protein, 10 aa, Cryptosporidium parvum
VSQRLNGDEA

SEQ ID NO: 2333594 - protein, 8 aa, Cryptosporidium parvum
VSRETDKQ

SEQ ID NO: 2333595 - protein, 16 aa, Cryptosporidium parvum
VSRNDDPNSNHGDKVP

SEQ ID NO: 2333596 - protein, 9 aa, Cryptosporidium parvum
VSSNKEESL

SEQ ID NO: 2333597 - protein, 7 aa, Cryptosporidium parvum
VSSNNTQ

SEQ ID NO: 2333598 - protein, 4 aa, Cryptosporidium parvum
VSSP

SEQ ID NO: 2333599 - protein, 4 aa, Cryptosporidium parvum
VSSS

SEQ ID NO: 2333600 - protein, 7 aa, Cryptosporidium parvum
VSSSNTR

SEQ ID NO: 2333601 - protein, 7 aa, Cryptosporidium parvum
VSSSSSG

SEQ ID NO: 2333602 - protein, 6 aa, Cryptosporidium parvum
VSSTGE

SEQ ID NO: 2333603 - protein, 30 aa, Cryptosporidium parvum
VSTIDSEKVEIDKNEYSSREYPTLNNDTDN

SEQ ID NO: 2333604 - protein, 11 aa, Cryptosporidium parvum
VSTKNSFASSK

SEQ ID NO: 2333605 - protein, 4 aa, Cryptosporidium parvum
VTDD

SEQ ID NO: 2333606 - protein, 6 aa, Cryptosporidium parvum
VTESLS

SEQ ID NO: 2333607 - protein, 5 aa, Cryptosporidium parvum
VTESN

SEQ ID NO: 2333608 - protein, 17 aa, Cryptosporidium parvum
VTESSIEASQSKINECN

SEQ ID NO: 2333609 - protein, 30 aa, Cryptosporidium parvum
VTESSSNLDNRSLRGSSISKKDSDKTSENV

SEQ ID NO: 2333610 - protein, 6 aa, Cryptosporidium parvum
VTETGK

SEQ ID NO: 2333611 - protein, 23 aa, Cryptosporidium parvum
VTGSPLKTPRTDSISEASAQGAH

SEQ ID NO: 2333612 - protein, 6 aa, Cryptosporidium parvum
VTGSSI

SEQ ID NO: 2333613 - protein, 127 aa, Cryptosporidium parvum
VTGTTKSSAGLGARPKSSLPTTRASQPKTKLGTTTTRTRSRSRSRSRSRDRSSGGHHPLESTKPGCSGETGDKGGSGEDRSSGGSSGGASGGGEGGSGESGSYGGSGSGGGDDKGDKGNNSGRGRYG

SEQ ID NO: 2333614 - protein, 7 aa, Cryptosporidium parvum
VTKKSSP

SEQ ID NO: 2333615 - protein, 17 aa, Cryptosporidium parvum
VTKTTGELKSETTLPNG

SEQ ID NO: 2333616 - protein, 6 aa, Cryptosporidium parvum
VTNKEI

SEQ ID NO: 2333617 - protein, 4 aa, Cryptosporidium parvum
VTPE

SEQ ID NO: 2333618 - protein, 8 aa, Cryptosporidium parvum
VTPEESEK

SEQ ID NO: 2333619 - protein, 13 aa, Cryptosporidium parvum
VTPNDDIQSFNST

SEQ ID NO: 2333620 - protein, 15 aa, Cryptosporidium parvum
VTSARKSESLPTSAE

SEQ ID NO: 2333621 - protein, 25 aa, Cryptosporidium parvum
VTSENEEEQERKDVDEEDEDEDAEP

SEQ ID NO: 2333622 - protein, 9 aa, Cryptosporidium parvum
VTSTESSKI

SEQ ID NO: 2333623 - protein, 7 aa, Cryptosporidium parvum
VTTLSGG

SEQ ID NO: 2333624 - protein, 7 aa, Cryptosporidium parvum
VTTNEYN

SEQ ID NO: 2333625 - protein, 12 aa, Cryptosporidium parvum
VTTPRKDYSPDF

SEQ ID NO: 2333626 - protein, 4 aa, Cryptosporidium parvum
VVGG

SEQ ID NO: 2333627 - protein, 7 aa, Cryptosporidium parvum
VVGSNGD

SEQ ID NO: 2333628 - protein, 7 aa, Cryptosporidium parvum
VVPTKKS

SEQ ID NO: 2333629 - protein, 8 aa, Cryptosporidium parvum
VYDENNQK

SEQ ID NO: 2333630 - protein, 9 aa, Cryptosporidium parvum
VYKSNSKSE

SEQ ID NO: 2333631 - protein, 9 aa, Cryptosporidium parvum
VYSEEDNSF

SEQ ID NO: 2333632 - protein, 7 aa, Cryptosporidium parvum
VYSPKSS

SEQ ID NO: 2333633 - protein, 13 aa, Cryptosporidium parvum
WDEESQSDEASPL

SEQ ID NO: 2333634 - protein, 9 aa, Cryptosporidium parvum
WDGPNSKIT

SEQ ID NO: 2333635 - protein, 11 aa, Cryptosporidium parvum
WDNGDCKGNNF

SEQ ID NO: 2333636 - protein, 14 aa, Cryptosporidium parvum
WDSSRKKKAKFTKS

SEQ ID NO: 2333637 - protein, 5 aa, Cryptosporidium parvum
WGQRK

SEQ ID NO: 2333638 - protein, 4 aa, Cryptosporidium parvum
WKEV

SEQ ID NO: 2333639 - protein, 9 aa, Cryptosporidium parvum
WKGSNKGTK

SEQ ID NO: 2333640 - protein, 30 aa, Cryptosporidium parvum
WKKKREKEEDERRKEREEEAKKKKEKEEKV

SEQ ID NO: 2333641 - protein, 8 aa, Cryptosporidium parvum
WNPTGPFG

SEQ ID NO: 2333642 - protein, 7 aa, Cryptosporidium parvum
WPSREKE

SEQ ID NO: 2333643 - protein, 4 aa, Cryptosporidium parvum
WSPN

SEQ ID NO: 2333644 - protein, 21 aa, Cryptosporidium parvum
WSSSRSTLSIQNESTRDEFDT

SEQ ID NO: 2333645 - protein, 5 aa, Cryptosporidium parvum
WTGNS

SEQ ID NO: 2333646 - protein, 6 aa, Cryptosporidium parvum
WTPTQN

SEQ ID NO: 2333647 - protein, 6 aa, Cryptosporidium parvum
YAESSN

SEQ ID NO: 2333648 - protein, 13 aa, Cryptosporidium parvum
YAKENEESVSKSD

SEQ ID NO: 2333649 - protein, 14 aa, Cryptosporidium parvum
YASEPKESKTVRGI

SEQ ID NO: 2333650 - protein, 9 aa, Cryptosporidium parvum
YDDDLDPNI

SEQ ID NO: 2333651 - protein, 14 aa, Cryptosporidium parvum
YDENKNSHSTNVRS

SEQ ID NO: 2333652 - protein, 7 aa, Cryptosporidium parvum
YDISDGE

SEQ ID NO: 2333653 - protein, 9 aa, Cryptosporidium parvum
YDKSSSSNI

SEQ ID NO: 2333654 - protein, 4 aa, Cryptosporidium parvum
YDPD

SEQ ID NO: 2333655 - protein, 4 aa, Cryptosporidium parvum
YDPK

SEQ ID NO: 2333656 - protein, 13 aa, Cryptosporidium parvum
YDPSEVGLDSPEA

SEQ ID NO: 2333657 - protein, 7 aa, Cryptosporidium parvum
YDSDLTS

SEQ ID NO: 2333658 - protein, 8 aa, Cryptosporidium parvum
YDSEGQKL

SEQ ID NO: 2333659 - protein, 5 aa, Cryptosporidium parvum
YDSET

SEQ ID NO: 2333660 - protein, 9 aa, Cryptosporidium parvum
YDSNRKDGE

SEQ ID NO: 2333661 - protein, 13 aa, Cryptosporidium parvum
YDSPFTKDEPNPL

SEQ ID NO: 2333662 - protein, 8 aa, Cryptosporidium parvum
YDSPSLKE

SEQ ID NO: 2333663 - protein, 5 aa, Cryptosporidium parvum
YEARQ

SEQ ID NO: 2333664 - protein, 8 aa, Cryptosporidium parvum
YECQSGSP

SEQ ID NO: 2333665 - protein, 6 aa, Cryptosporidium parvum
YEDDER

SEQ ID NO: 2333666 - protein, 11 aa, Cryptosporidium parvum
YEDESKLADNC

SEQ ID NO: 2333667 - protein, 11 aa, Cryptosporidium parvum
YEDPKNEIDDE

SEQ ID NO: 2333668 - protein, 5 aa, Cryptosporidium parvum
YEDPP

SEQ ID NO: 2333669 - protein, 5 aa, Cryptosporidium parvum
YEDSE

SEQ ID NO: 2333670 - protein, 15 aa, Cryptosporidium parvum
YEEASSNFQEGNKQH

SEQ ID NO: 2333671 - protein, 11 aa, Cryptosporidium parvum
YEEATKKCAKQ

SEQ ID NO: 2333672 - protein, 10 aa, Cryptosporidium parvum
YEEKRNEYIR

SEQ ID NO: 2333673 - protein, 15 aa, Cryptosporidium parvum
YEERKIKNELKNASL

SEQ ID NO: 2333674 - protein, 4 aa, Cryptosporidium parvum
YEET

SEQ ID NO: 2333675 - protein, 8 aa, Cryptosporidium parvum
YEGSESED

SEQ ID NO: 2333676 - protein, 16 aa, Cryptosporidium parvum
YEIQDKENDIISTSET

SEQ ID NO: 2333677 - protein, 8 aa, Cryptosporidium parvum
YENDPCRK

SEQ ID NO: 2333678 - protein, 5 aa, Cryptosporidium parvum
YENEW

SEQ ID NO: 2333679 - protein, 14 aa, Cryptosporidium parvum
YEPGKENKHGDSDV

SEQ ID NO: 2333680 - protein, 51 aa, Cryptosporidium parvum
YEPTGETSKTEPSNSSKYLPKEDDDPSEEETKEHSEEGDTRFSDKEKPIKK

SEQ ID NO: 2333681 - protein, 6 aa, Cryptosporidium parvum
YEQRGD

SEQ ID NO: 2333682 - protein, 10 aa, Cryptosporidium parvum
YERNNGTIPI

SEQ ID NO: 2333683 - protein, 7 aa, Cryptosporidium parvum
YERRPYE

SEQ ID NO: 2333684 - protein, 11 aa, Cryptosporidium parvum
YESDYSESGDI

SEQ ID NO: 2333685 - protein, 5 aa, Cryptosporidium parvum
YESNT

SEQ ID NO: 2333686 - protein, 5 aa, Cryptosporidium parvum
YETKQ

SEQ ID NO: 2333687 - protein, 5 aa, Cryptosporidium parvum
YETPQ

SEQ ID NO: 2333688 - protein, 4 aa, Cryptosporidium parvum
YETT

SEQ ID NO: 2333689 - protein, 12 aa, Cryptosporidium parvum
YEYGSSENDPQI

SEQ ID NO: 2333690 - protein, 4 aa, Cryptosporidium parvum
YGAD

SEQ ID NO: 2333691 - protein, 10 aa, Cryptosporidium parvum
YGDQSTALGY

SEQ ID NO: 2333692 - protein, 17 aa, Cryptosporidium parvum
YGDSDDENSSDNEELGH

SEQ ID NO: 2333693 - protein, 6 aa, Cryptosporidium parvum
YGEMPE

SEQ ID NO: 2333694 - protein, 11 aa, Cryptosporidium parvum
YGEQGAGELIG

SEQ ID NO: 2333695 - protein, 4 aa, Cryptosporidium parvum
YGES

SEQ ID NO: 2333696 - protein, 5 aa, Cryptosporidium parvum
YGKKA

SEQ ID NO: 2333697 - protein, 20 aa, Cryptosporidium parvum
YGKNDSLNLSEETNQSWDNM

SEQ ID NO: 2333698 - protein, 4 aa, Cryptosporidium parvum
YGKS

SEQ ID NO: 2333699 - protein, 5 aa, Cryptosporidium parvum
YGLSD

SEQ ID NO: 2333700 - protein, 24 aa, Cryptosporidium parvum
YGNKGKPTHSNSESDGKLGPFDGA

SEQ ID NO: 2333701 - protein, 4 aa, Cryptosporidium parvum
YGNR

SEQ ID NO: 2333702 - protein, 24 aa, Cryptosporidium parvum
YGNRNQGSGRITDKNSDERSESSL

SEQ ID NO: 2333703 - protein, 11 aa, Cryptosporidium parvum
YGQRAPKSLNI

SEQ ID NO: 2333704 - protein, 6 aa, Cryptosporidium parvum
YGQSET

SEQ ID NO: 2333705 - protein, 5 aa, Cryptosporidium parvum
YGREP

SEQ ID NO: 2333706 - protein, 5 aa, Cryptosporidium parvum
YGTTE

SEQ ID NO: 2333707 - protein, 5 aa, Cryptosporidium parvum
YGVDP

SEQ ID NO: 2333708 - protein, 6 aa, Cryptosporidium parvum
YHENTF

SEQ ID NO: 2333709 - protein, 11 aa, Cryptosporidium parvum
YHNSSKKEIKA

SEQ ID NO: 2333710 - protein, 15 aa, Cryptosporidium parvum
YHPDRNPSPDASEKF

SEQ ID NO: 2333711 - protein, 5 aa, Cryptosporidium parvum
YHSTT

SEQ ID NO: 2333712 - protein, 9 aa, Cryptosporidium parvum
YIEDGNGDC

SEQ ID NO: 2333713 - protein, 12 aa, Cryptosporidium parvum
YIEKQKDNSLTS

SEQ ID NO: 2333714 - protein, 4 aa, Cryptosporidium parvum
YIKG

SEQ ID NO: 2333715 - protein, 17 aa, Cryptosporidium parvum
YINSSRRERSKQYVSSR

SEQ ID NO: 2333716 - protein, 8 aa, Cryptosporidium parvum
YITNSNSV

SEQ ID NO: 2333717 - protein, 10 aa, Cryptosporidium parvum
YKANSKTPEV

SEQ ID NO: 2333718 - protein, 11 aa, Cryptosporidium parvum
YKDSNYKPKEF

SEQ ID NO: 2333719 - protein, 17 aa, Cryptosporidium parvum
YKGGKTVDEVEDQCGDA

SEQ ID NO: 2333720 - protein, 10 aa, Cryptosporidium parvum
YKGKDGSWYQ

SEQ ID NO: 2333721 - protein, 6 aa, Cryptosporidium parvum
YKGRTN

SEQ ID NO: 2333722 - protein, 6 aa, Cryptosporidium parvum
YKIPES

SEQ ID NO: 2333723 - protein, 22 aa, Cryptosporidium parvum
YKNNLSSVEDNINNSQKDRSSF

SEQ ID NO: 2333724 - protein, 10 aa, Cryptosporidium parvum
YKNTKSYRDD

SEQ ID NO: 2333725 - protein, 6 aa, Cryptosporidium parvum
YKPINT

SEQ ID NO: 2333726 - protein, 64 aa, Cryptosporidium parvum
YKPPFSEKSRSSKSVEDEMSNLSENTVSEKEKTAVVPSENTISAGNQVSQEEQSSDEEVKGQVE

SEQ ID NO: 2333727 - protein, 8 aa, Cryptosporidium parvum
YKPTEDTF

SEQ ID NO: 2333728 - protein, 7 aa, Cryptosporidium parvum
YKSGYNA

SEQ ID NO: 2333729 - protein, 10 aa, Cryptosporidium parvum
YKSSQPPKGF

SEQ ID NO: 2333730 - protein, 8 aa, Cryptosporidium parvum
YKTASNES

SEQ ID NO: 2333731 - protein, 5 aa, Cryptosporidium parvum
YKTEE

SEQ ID NO: 2333732 - protein, 13 aa, Cryptosporidium parvum
YKTNHKDIGATKA

SEQ ID NO: 2333733 - protein, 9 aa, Cryptosporidium parvum
YLKNSNNSL

SEQ ID NO: 2333734 - protein, 5 aa, Cryptosporidium parvum
YLNTP

SEQ ID NO: 2333735 - protein, 6 aa, Cryptosporidium parvum
YLPNGR

SEQ ID NO: 2333736 - protein, 48 aa, Cryptosporidium parvum
YLPSPQPIPQTIPQPIPQPIPQPIPQPISQYPDSYSGPRPPSGFPNQI

SEQ ID NO: 2333737 - protein, 4 aa, Cryptosporidium parvum
YMPG

SEQ ID NO: 2333738 - protein, 4 aa, Cryptosporidium parvum
YMYN

SEQ ID NO: 2333739 - protein, 5 aa, Cryptosporidium parvum
YNAQN

SEQ ID NO: 2333740 - protein, 23 aa, Cryptosporidium parvum
YNASEYEQFESEGTPISKYKTPK

SEQ ID NO: 2333741 - protein, 16 aa, Cryptosporidium parvum
YNGRKDDLQPACTKQQ

SEQ ID NO: 2333742 - protein, 4 aa, Cryptosporidium parvum
YNIE

SEQ ID NO: 2333743 - protein, 4 aa, Cryptosporidium parvum
YNKN

SEQ ID NO: 2333744 - protein, 5 aa, Cryptosporidium parvum
YNNKL

SEQ ID NO: 2333745 - protein, 6 aa, Cryptosporidium parvum
YNPQKV

SEQ ID NO: 2333746 - protein, 6 aa, Cryptosporidium parvum
YNQRMA

SEQ ID NO: 2333747 - protein, 8 aa, Cryptosporidium parvum
YNQVDSDS

SEQ ID NO: 2333748 - protein, 5 aa, Cryptosporidium parvum
YNRAS

SEQ ID NO: 2333749 - protein, 18 aa, Cryptosporidium parvum
YNSDRSDHNGNFRYYERR

SEQ ID NO: 2333750 - protein, 23 aa, Cryptosporidium parvum
YNSGIGPKSMDASSRKIKTGKVT

SEQ ID NO: 2333751 - protein, 20 aa, Cryptosporidium parvum
YNSNKSNNNNNNNNKSVNKD

SEQ ID NO: 2333752 - protein, 5 aa, Cryptosporidium parvum
YNSVS

SEQ ID NO: 2333753 - protein, 23 aa, Cryptosporidium parvum
YNTTTGQFEKNEDHPNPDEINPF

SEQ ID NO: 2333754 - protein, 23 aa, Cryptosporidium parvum
YNTTTGQFEKNEDHSDPDEINPF

SEQ ID NO: 2333755 - protein, 13 aa, Cryptosporidium parvum
YPAKDSSHYSGLS

SEQ ID NO: 2333756 - protein, 18 aa, Cryptosporidium parvum
YPDKDENTGEIKPEDKYG

SEQ ID NO: 2333757 - protein, 8 aa, Cryptosporidium parvum
YPEISGKD

SEQ ID NO: 2333758 - protein, 6 aa, Cryptosporidium parvum
YPESRS

SEQ ID NO: 2333759 - protein, 4 aa, Cryptosporidium parvum
YPGN

SEQ ID NO: 2333760 - protein, 12 aa, Cryptosporidium parvum
YPGTGNTVISSG

SEQ ID NO: 2333761 - protein, 4 aa, Cryptosporidium parvum
YPIS

SEQ ID NO: 2333762 - protein, 8 aa, Cryptosporidium parvum
YPKSGMTP

SEQ ID NO: 2333763 - protein, 4 aa, Cryptosporidium parvum
YPNE

SEQ ID NO: 2333764 - protein, 6 aa, Cryptosporidium parvum
YPNEPT

SEQ ID NO: 2333765 - protein, 4 aa, Cryptosporidium parvum
YPNN

SEQ ID NO: 2333766 - protein, 6 aa, Cryptosporidium parvum
YPNNTN

SEQ ID NO: 2333767 - protein, 5 aa, Cryptosporidium parvum
YPPQI

SEQ ID NO: 2333768 - protein, 8 aa, Cryptosporidium parvum
YPPYPDTQ

SEQ ID NO: 2333769 - protein, 9 aa, Cryptosporidium parvum
YPPYSGLEE

SEQ ID NO: 2333770 - protein, 13 aa, Cryptosporidium parvum
YPSGLDKNKQDEH

SEQ ID NO: 2333771 - protein, 12 aa, Cryptosporidium parvum
YPSLKPNVNPTG

SEQ ID NO: 2333772 - protein, 7 aa, Cryptosporidium parvum
YPTPTPY

SEQ ID NO: 2333773 - protein, 20 aa, Cryptosporidium parvum
YQASGETRSLRPNDQSSQIV

SEQ ID NO: 2333774 - protein, 6 aa, Cryptosporidium parvum
YQDNQP

SEQ ID NO: 2333775 - protein, 11 aa, Cryptosporidium parvum
YQKRECGDTPC

SEQ ID NO: 2333776 - protein, 12 aa, Cryptosporidium parvum
YQNSPTNMNGNN

SEQ ID NO: 2333777 - protein, 11 aa, Cryptosporidium parvum
YQNSTAYRTNL

SEQ ID NO: 2333778 - protein, 11 aa, Cryptosporidium parvum
YQPEEKGASIG

SEQ ID NO: 2333779 - protein, 5 aa, Cryptosporidium parvum
YRDDS

SEQ ID NO: 2333780 - protein, 38 aa, Cryptosporidium parvum
YRDYEQDSEHDHENDYDADIEDNIDDDDDDYDDDDHHH

SEQ ID NO: 2333781 - protein, 7 aa, Cryptosporidium parvum
YRGGSGE

SEQ ID NO: 2333782 - protein, 6 aa, Cryptosporidium parvum
YRKSGV

SEQ ID NO: 2333783 - protein, 7 aa, Cryptosporidium parvum
YRNETGL

SEQ ID NO: 2333784 - protein, 5 aa, Cryptosporidium parvum
YRPER

SEQ ID NO: 2333785 - protein, 4 aa, Cryptosporidium parvum
YRPN

SEQ ID NO: 2333786 - protein, 5 aa, Cryptosporidium parvum
YRPSQ

SEQ ID NO: 2333787 - protein, 14 aa, Cryptosporidium parvum
YRSSAGDGKIPPCY

SEQ ID NO: 2333788 - protein, 11 aa, Cryptosporidium parvum
YSADDTSPNER

SEQ ID NO: 2333789 - protein, 9 aa, Cryptosporidium parvum
YSDDATSEM

SEQ ID NO: 2333790 - protein, 5 aa, Cryptosporidium parvum
YSDNH

SEQ ID NO: 2333791 - protein, 7 aa, Cryptosporidium parvum
YSEFESK

SEQ ID NO: 2333792 - protein, 10 aa, Cryptosporidium parvum
YSENKTSTVQ

SEQ ID NO: 2333793 - protein, 9 aa, Cryptosporidium parvum
YSEQNDEYI

SEQ ID NO: 2333794 - protein, 18 aa, Cryptosporidium parvum
YSGNVDNMTSTSKNDDGE

SEQ ID NO: 2333795 - protein, 10 aa, Cryptosporidium parvum
YSGSETLSQD

SEQ ID NO: 2333796 - protein, 11 aa, Cryptosporidium parvum
YSGSSKSNKSI

SEQ ID NO: 2333797 - protein, 12 aa, Cryptosporidium parvum
YSKDDPDFSPRV

SEQ ID NO: 2333798 - protein, 11 aa, Cryptosporidium parvum
YSKDNNKSRNV

SEQ ID NO: 2333799 - protein, 6 aa, Cryptosporidium parvum
YSKGAS

SEQ ID NO: 2333800 - protein, 11 aa, Cryptosporidium parvum
YSKKSNTEEDW

SEQ ID NO: 2333801 - protein, 11 aa, Cryptosporidium parvum
YSKNDSTISRN

SEQ ID NO: 2333802 - protein, 14 aa, Cryptosporidium parvum
YSKNPKSIKSTKYP

SEQ ID NO: 2333803 - protein, 9 aa, Cryptosporidium parvum
YSLEGKKAR

SEQ ID NO: 2333804 - protein, 8 aa, Cryptosporidium parvum
YSLETGKQ

SEQ ID NO: 2333805 - protein, 16 aa, Cryptosporidium parvum
YSNIEGQEKVEQHKNY

SEQ ID NO: 2333806 - protein, 6 aa, Cryptosporidium parvum
YSNSED

SEQ ID NO: 2333807 - protein, 8 aa, Cryptosporidium parvum
YSPDGANK

SEQ ID NO: 2333808 - protein, 5 aa, Cryptosporidium parvum
YSPES

SEQ ID NO: 2333809 - protein, 5 aa, Cryptosporidium parvum
YSPGY

SEQ ID NO: 2333810 - protein, 9 aa, Cryptosporidium parvum
YSPLNPHRT

SEQ ID NO: 2333811 - protein, 5 aa, Cryptosporidium parvum
YSPYT

SEQ ID NO: 2333812 - protein, 6 aa, Cryptosporidium parvum
YSRTGS

SEQ ID NO: 2333813 - protein, 19 aa, Cryptosporidium parvum
YSSNETAGLPASRTHYPTD

SEQ ID NO: 2333814 - protein, 8 aa, Cryptosporidium parvum
YSSTPKKI

SEQ ID NO: 2333815 - protein, 7 aa, Cryptosporidium parvum
YSTGSDD

SEQ ID NO: 2333816 - protein, 4 aa, Cryptosporidium parvum
YSTL

SEQ ID NO: 2333817 - protein, 9 aa, Cryptosporidium parvum
YSTRSSIAD

SEQ ID NO: 2333818 - protein, 22 aa, Cryptosporidium parvum
YSYNQNPGNSANNLQNYNSNQR

SEQ ID NO: 2333819 - protein, 10 aa, Cryptosporidium parvum
YSYSGSGTCS

SEQ ID NO: 2333820 - protein, 6 aa, Cryptosporidium parvum
YSYSKT

SEQ ID NO: 2333821 - protein, 4 aa, Cryptosporidium parvum
YTEN

SEQ ID NO: 2333822 - protein, 7 aa, Cryptosporidium parvum
YTEPGKH

SEQ ID NO: 2333823 - protein, 5 aa, Cryptosporidium parvum
YTGKR

SEQ ID NO: 2333824 - protein, 8 aa, Cryptosporidium parvum
YTGSQKGE

SEQ ID NO: 2333825 - protein, 7 aa, Cryptosporidium parvum
YTKDGKK

SEQ ID NO: 2333826 - protein, 5 aa, Cryptosporidium parvum
YTKHT

SEQ ID NO: 2333827 - protein, 5 aa, Cryptosporidium parvum
YTKSL

SEQ ID NO: 2333828 - protein, 6 aa, Cryptosporidium parvum
YTMPQA

SEQ ID NO: 2333829 - protein, 11 aa, Cryptosporidium parvum
YTNESTAYSGR

SEQ ID NO: 2333830 - protein, 11 aa, Cryptosporidium parvum
YTNQTTSFPTK

SEQ ID NO: 2333831 - protein, 9 aa, Cryptosporidium parvum
YTPENHPKR

SEQ ID NO: 2333832 - protein, 9 aa, Cryptosporidium parvum
YTPQGTVQG

SEQ ID NO: 2333833 - protein, 4 aa, Cryptosporidium parvum
YTPR

SEQ ID NO: 2333834 - protein, 20 aa, Cryptosporidium parvum
YTPTPTPAPAYGESSGFNSP

SEQ ID NO: 2333835 - protein, 16 aa, Cryptosporidium parvum
YTQNGGGPKELDDSKK

SEQ ID NO: 2333836 - protein, 8 aa, Cryptosporidium parvum
YTQQNQQR

SEQ ID NO: 2333837 - protein, 7 aa, Cryptosporidium parvum
YTRRGDE

SEQ ID NO: 2333838 - protein, 4 aa, Cryptosporidium parvum
YTRS

SEQ ID NO: 2333839 - protein, 11 aa, Cryptosporidium parvum
YTRTTSRPGGV

SEQ ID NO: 2333840 - protein, 7 aa, Cryptosporidium parvum
YTSQNTS

SEQ ID NO: 2333841 - protein, 7 aa, Cryptosporidium parvum
YTTSKEV

SEQ ID NO: 2333842 - protein, 6 aa, Cryptosporidium parvum
YVEPDQ

SEQ ID NO: 2333843 - protein, 12 aa, Cryptosporidium parvum
YVPEPQNNGTTI

SEQ ID NO: 2333844 - protein, 9 aa, Cryptosporidium parvum
YYKKSEDVR

SEQ ID NO: 2333845 - protein, 6 aa, Cryptosporidium parvum
YYRPQA

SEQ ID NO: 2333846 - protein, 7 aa, Cryptosporidium parvum
YYSPKNY

SEQ ID NO: 2333847 - protein, 24 aa, Cryptosporidium parvum
VVGSPQCGPYCSTYPKGYFAFWLT

SEQ ID NO: 2333848 - protein, 24 aa, Cryptosporidium parvum
ADPNHGFIPLFMVENSTETAAFPA

SEQ ID NO: 2333849 - protein, 23 aa, Cryptosporidium parvum
ATFNEGWTLFVILSTGVPEYGDN

SEQ ID NO: 2333850 - protein, 23 aa, Cryptosporidium parvum
AGVDISKTFSIWQLTNIKEIPID

SEQ ID NO: 2333851 - protein, 24 aa, Cryptosporidium parvum
GPKSSRRPLTKRALDKLLKKHRTG

SEQ ID NO: 2333852 - protein, 19 aa, Cryptosporidium parvum
IITNIGPFGQRPPSPPHPP

SEQ ID NO: 2333853 - protein, 19 aa, Cryptosporidium parvum
KYGESYPFFPPGIKPAPID

SEQ ID NO: 2333854 - protein, 17 aa, Cryptosporidium parvum
LLFIYFMFLFENVTDDF

SEQ ID NO: 2333855 - protein, 20 aa, Cryptosporidium parvum
PQCGPYCSTYPKGYFAFWLT

SEQ ID NO: 2333856 - protein, 24 aa, Cryptosporidium parvum
TPSPNIPPPPSFPAPPPPSIPSGT

SEQ ID NO: 2333857 - protein, 25 aa, Cryptosporidium parvum
YCSTYPKGYFAFWLTYDSATSKYII

SEQ ID NO: 2333858 - protein, 24 aa, Cryptosporidium parvum
AADSFFGAIEWIWMYKLSNIDNIN

SEQ ID NO: 2333859 - protein, 20 aa, Cryptosporidium parvum
AAEYCYPIKGRLNVVKDYFT

SEQ ID NO: 2333860 - protein, 25 aa, Cryptosporidium parvum
AAIMRDIDWIFVIGHFPCYSSGEHG

SEQ ID NO: 2333861 - protein, 24 aa, Cryptosporidium parvum
AANGLEWWGASSWQECRERCRSNL

SEQ ID NO: 2333862 - protein, 17 aa, Cryptosporidium parvum
AANNLGIQDDECVENSN

SEQ ID NO: 2333863 - protein, 33 aa, Cryptosporidium parvum; identical to SEQ ID NO: 2168029

SEQ ID NO: 2333864 - protein, 20 aa, Cryptosporidium parvum
AARAKLGYYREINPFNKSEK

SEQ ID NO: 2333865 - protein, 37 aa, Cryptosporidium parvum; identical to SEQ ID NO: 2206135

SEQ ID NO: 2333866 - protein, 21 aa, Cryptosporidium parvum
ACLGLRILITMYDEMRNDVQC

SEQ ID NO: 2333867 - protein, 17 aa, Cryptosporidium parvum
ADCGARLFLGGRAIIID

SEQ ID NO: 2333868 - protein, 26 aa, Cryptosporidium parvum
ADCYKLIPEYSIILGLMEEYKSYLNF

SEQ ID NO: 2333869 - protein, 27 aa, Cryptosporidium parvum
ADERFKEFKELFISSIKSSYGPKNKHV

SEQ ID NO: 2333870 - protein, 24 aa, Cryptosporidium parvum
ADGVLPKYLLFDDMDKFDFDPEEA

SEQ ID NO: 2333871 - protein, 20 aa, Cryptosporidium parvum
ADLPSGFEGLKMLKSSSSPE

SEQ ID NO: 2333872 - protein, 19 aa, Cryptosporidium parvum
ADSEGLAPVGGFSKIQELQ

SEQ ID NO: 2333873 - protein, 20 aa, Cryptosporidium parvum
ADTNMQWKIVSILIPDIQSH

SEQ ID NO: 2333874 - protein, 23 aa, Cryptosporidium parvum
ADTSSLFRACVNALKTLFTTSNI

SEQ ID NO: 2333875 - protein, 24 aa, Cryptosporidium parvum
ADYELACPPGLIVISDKCAKYADK

SEQ ID NO: 2333876 - protein, 17 aa, Cryptosporidium parvum
ADYEYRKSIVSEFQADP

SEQ ID NO: 2333877 - protein, 25 aa, Cryptosporidium parvum
AEAVSPQCGPYCSTYPKGYFTFWLQ

SEQ ID NO: 2333878 - protein, 19 aa, Cryptosporidium parvum
AEDRLCPLSSAITILNEYV

SEQ ID NO: 2333879 - protein, 17 aa, Cryptosporidium parvum
AEGLPTVDQPSLGIEEG

SEQ ID NO: 2333880 - protein, 24 aa, Cryptosporidium parvum
AEIICSATRFWVMCGSHMDSEVDA

SEQ ID NO: 2333881 - protein, 23 aa, Cryptosporidium parvum
AEPFKSKFLKMFVKEPLEDSTPS

SEQ ID NO: 2333882 - protein, 26 aa, Cryptosporidium parvum
AERLEWPRELILLILSQDFSLSDSNV

SEQ ID NO: 2333883 - protein, 21 aa, Cryptosporidium parvum
AESKKNCKILASATPRDNSET

SEQ ID NO: 2333884 - protein, 22 aa, Cryptosporidium parvum
AETLLGTVTIEFTAELKNRDPI

SEQ ID NO: 2333885 - protein, 17 aa, Cryptosporidium parvum
AEVNCPEGFEWLSETLN

SEQ ID NO: 2333886 - protein, 22 aa, Cryptosporidium parvum
AFNDVLWYFGINDTSKYTYKFN

SEQ ID NO: 2333887 - protein, 18 aa, Cryptosporidium parvum
AFNYKYNFIKSYSTGSDD

SEQ ID NO: 2333888 - protein, 18 aa, Cryptosporidium parvum
AFQQWKAIILQMTIDESN

SEQ ID NO: 2333889 - protein, 28 aa, Cryptosporidium parvum
AFSPAGMKIPFYLRQELIQLSNITPKRK

SEQ ID NO: 2333890 - protein, 17 aa, Cryptosporidium parvum
AFTKQEWLATSSGSFVG

SEQ ID NO: 2333891 - protein, 21 aa, Cryptosporidium parvum
AGFRRLVRLFRSINISTLLVP

SEQ ID NO: 2333892 - protein, 17 aa, Cryptosporidium parvum
AGGILPGIFMSRNFSYQ

SEQ ID NO: 2333893 - protein, 17 aa, Cryptosporidium parvum
AGGLRRNYFNNLENVKS

SEQ ID NO: 2333894 - protein, 18 aa, Cryptosporidium parvum
AGIKEVIKYFDITDNTSN

SEQ ID NO: 2333895 - protein, 21 aa, Cryptosporidium parvum
AGIKSLLAILSLTLVGSNTLL

SEQ ID NO: 2333896 - protein, 26 aa, Cryptosporidium parvum
AGLRTSFREGCRFVHFLKNKGSLPTA

SEQ ID NO: 2333897 - protein, 18 aa, Cryptosporidium parvum
AGNLPYTILVSIPKAALP

SEQ ID NO: 2333898 - protein, 24 aa, Cryptosporidium parvum
AGNSFPAGLGPPLVRVQKVKGEVR

SEQ ID NO: 2333899 - protein, 26 aa, Cryptosporidium parvum
AGPDKHIGWQVTRRAIDVAARDKMIK

SEQ ID NO: 2333900 - protein, 17 aa, Cryptosporidium parvum
AGSLCFTDTMDSYPTSN

SEQ ID NO: 2333901 - protein, 26 aa, Cryptosporidium parvum
AGVEISKTFSVWHLFNKKIINNVVAT

SEQ ID NO: 2333902 - protein, 25 aa, Cryptosporidium parvum
AHRYMGRLVEWFNIIQASLDDDIIK

SEQ ID NO: 2333903 - protein, 19 aa, Cryptosporidium parvum
AHSAWCKATTPEGKCVATD

SEQ ID NO: 2333904 - protein, 17 aa, Cryptosporidium parvum
AHSRFSGMFSNTESVDP

SEQ ID NO: 2333905 - protein, 22 aa, Cryptosporidium parvum
AIDLRDICRFVGKVEPWIYTKR

SEQ ID NO: 2333906 - protein, 25 aa, Cryptosporidium parvum
AIDSLSFNDFIIWFSSSNQINLANN

SEQ ID NO: 2333907 - protein, 20 aa, Cryptosporidium parvum
AIEALKRFINSVGYSGNVDN

SEQ ID NO: 2333908 - protein, 17 aa, Cryptosporidium parvum
AIFICSSSLRWEKCPVK

SEQ ID NO: 2333909 - protein, 27 aa, Cryptosporidium parvum
AIGICKIPSLWYLELIYCMHRGVTHFT

SEQ ID NO: 2333910 - protein, 32 aa, Cryptosporidium parvum
AIHNQIWPLLQFIYKKCVELRFTVNNEDLNLD

SEQ ID NO: 2333911 - protein, 24 aa, Cryptosporidium parvum
AIKRREMLLRISINNSAGEILGRF

SEQ ID NO: 2333912 - protein, 25 aa, Cryptosporidium parvum
AIKSAKIYIPISVFKSAEQVVTDIQ

SEQ ID NO: 2333913 - protein, 23 aa, Cryptosporidium parvum
AILIICFCINYSFGASNQSKSGE

SEQ ID NO: 2333914 - protein, 20 aa, Cryptosporidium parvum
AINLLLRLVLKGCPNILDDV

SEQ ID NO: 2333915 - protein, 25 aa, Cryptosporidium parvum
AIVKILEITLSFLKLIKEVSISETI

SEQ ID NO: 2333916 - protein, 22 aa, Cryptosporidium parvum
AKARPHSTVGIMLDTKGPEIRT

SEQ ID NO: 2333917 - protein, 33 aa, Cryptosporidium parvum
AKECARVLYPTLLRLGYTVSQSRVEKVCVAIGI

SEQ ID NO: 2333918 - protein, 26 aa, Cryptosporidium parvum
AKFANLILKRIIIFWNPSLNFGVDIS

SEQ ID NO: 2333919 - protein, 22 aa, Cryptosporidium parvum
AKFKYLMQVLLRYKPNPYSQNA

SEQ ID NO: 2333920 - protein, 31 aa, Cryptosporidium parvum
AKICSNLLFGDFYDQFRVIRKAWNGVSSIMN

SEQ ID NO: 2333921 - protein, 20 aa, Cryptosporidium parvum
AKIQTFCLIYLKNMGLNELV

SEQ ID NO: 2333922 - protein, 21 aa, Cryptosporidium parvum
AKLAWLCIFLVLLFLTINQTL

SEQ ID NO: 2333923 - protein, 18 aa, Cryptosporidium parvum
AKLMGSFLVIPSLELPGG

SEQ ID NO: 2333924 - protein, 18 aa, Cryptosporidium parvum
AKMNRYVMASSYESLLKR

SEQ ID NO: 2333925 - protein, 24 aa, Cryptosporidium parvum
AKPEVARGLKIARGVKTYVLNSIH

SEQ ID NO: 2333926 - protein, 20 aa, Cryptosporidium parvum
AKSNIWLVYRYEGVSLGNLL

SEQ ID NO: 2333927 - protein, 17 aa, Cryptosporidium parvum
AKVEWIFSRQADAWLTN

SEQ ID NO: 2333928 - protein, 17 aa, Cryptosporidium parvum
AKVLLAQAYILEGKVLY

SEQ ID NO: 2333929 - protein, 27 aa, Cryptosporidium parvum
ALCQCKIRGSRQFEMLKLFSDLIFQIQ

SEQ ID NO: 2333930 - protein, 22 aa, Cryptosporidium parvum
ALDICAVINPWNSMECSGITGV

SEQ ID NO: 2333931 - protein, 20 aa, Cryptosporidium parvum
ALIEGIQFPPAEYDIVEVQP

SEQ ID NO: 2333932 - protein, 20 aa, Cryptosporidium parvum
ALKLCRRDLQNPVDFVNPNC

SEQ ID NO: 2333933 - protein, 20 aa, Cryptosporidium parvum
ALKVCPPEVPILSQEKTSSQ

SEQ ID NO: 2333934 - protein, 18 aa, Cryptosporidium parvum
ALLKGWPIGMEALNGNWD

SEQ ID NO: 2333935 - protein, 25 aa, Cryptosporidium parvum
ALLKLREFEKILSLKHSAARRLFHS

SEQ ID NO: 2333936 - protein, 22 aa, Cryptosporidium parvum
ALLVFFVATNAVRIRGGEQNKL

SEQ ID NO: 2333937 - protein, 17 aa, Cryptosporidium parvum
ALMREVYQREKIEQICK

SEQ ID NO: 2333938 - protein, 27 aa, Cryptosporidium parvum
ALNLIPNKFRIVNIWNEENPSLRGGNS

SEQ ID NO: 2333939 - protein, 24 aa, Cryptosporidium parvum
ALNSKSFIVRRWGKNVQSKLRKLR

SEQ ID NO: 2333940 - protein, 17 aa, Cryptosporidium parvum
ALQLLNVYRERSHEIYN

SEQ ID NO: 2333941 - protein, 17 aa, Cryptosporidium parvum
ALRKRIKKYLSNIKQDT

SEQ ID NO: 2333942 - protein, 17 aa, Cryptosporidium parvum
ALTAMFSKISFVMSKKV

SEQ ID NO: 2333943 - protein, 18 aa, Cryptosporidium parvum
ALTRPSSPNVAYSQNNVA

SEQ ID NO: 2333944 - protein, 23 aa, Cryptosporidium parvum
AMGTPWPEKGPYEFTKLFNNNDK

SEQ ID NO: 2333945 - protein, 18 aa, Cryptosporidium parvum
AMLFFNVRMPNFKHITES

SEQ ID NO: 2333946 - protein, 25 aa, Cryptosporidium parvum
ANGAFPFDAVNVMSRVCAQAETCID

SEQ ID NO: 2333947 - protein, 17 aa, Cryptosporidium parvum
ANIEAAIERCKEIKPGI

SEQ ID NO: 2333948 - protein, 24 aa, Cryptosporidium parvum
ANIECPEGFEVLKTDLSVECIHKT

SEQ ID NO: 2333949 - protein, 19 aa, Cryptosporidium parvum
ANIIYHLCDMFTKYYSDVQ

SEQ ID NO: 2333950 - protein, 20 aa, Cryptosporidium parvum
ANIYSPVWGCYQFMDPPSEN

SEQ ID NO: 2333951 - protein, 21 aa, Cryptosporidium parvum
ANLSRRTKLGSIYCVQSSAPE

SEQ ID NO: 2333952 - protein, 24 aa, Cryptosporidium parvum
ANNGIAYKNLCEFRNAQCDDQGLI

SEQ ID NO: 2333953 - protein, 25 aa, Cryptosporidium parvum
ANNYDLNSLFLITGRDYSGDRGIDF

SEQ ID NO: 2333954 - protein, 18 aa, Cryptosporidium parvum
ANRELLIEFLKFMHTNRM

SEQ ID NO: 2333955 - protein, 22 aa, Cryptosporidium parvum
ANSGRIVAAMKFLSSLASNDYS

SEQ ID NO: 2333956 - protein, 27 aa, Cryptosporidium parvum
ANSPGFKFLLLETIDLLVAVNGWDFIS

SEQ ID NO: 2333957 - protein, 21 aa, Cryptosporidium parvum
ANTEWKLPGFFSQKRFVDQLN

SEQ ID NO: 2333958 - protein, 20 aa, Cryptosporidium parvum
ANYLYVCIIELLKTPQRDLP

SEQ ID NO: 2333959 - protein, 19 aa, Cryptosporidium parvum
APCSCCGSKASCCENNLCV

SEQ ID NO: 2333960 - protein, 17 aa, Cryptosporidium parvum
APESGRYYFSIEADCGA

SEQ ID NO: 2333961 - protein, 20 aa, Cryptosporidium parvum
APSFFWKNYLEDVLDDSLIG

SEQ ID NO: 2333962 - protein, 17 aa, Cryptosporidium parvum
AQISKGTIIEWEASGSI

SEQ ID NO: 2333963 - protein, 17 aa, Cryptosporidium parvum
AQLLFSKQTEEIIMTGE

SEQ ID NO: 2333964 - protein, 21 aa, Cryptosporidium parvum
AQMHQIFKCLLRNVPSSSKDP

SEQ ID NO: 2333965 - protein, 23 aa, Cryptosporidium parvum
AQSRTGLTMTISDIWATAKDISS

SEQ ID NO: 2333966 - protein, 24 aa, Cryptosporidium parvum
AQTCNSINGPFCKYLNQISDSSEF

SEQ ID NO: 2333967 - protein, 30 aa, Cryptosporidium parvum; identical to SEQ ID NO: 2206220

SEQ ID NO: 2333968 - protein, 20 aa, Cryptosporidium parvum
ARKLLRELFLHRKHKQRLFF

SEQ ID NO: 2333969 - protein, 19 aa, Cryptosporidium parvum
ARLIPESKLAASELEPIKG

SEQ ID NO: 2333970 - protein, 18 aa, Cryptosporidium parvum
ARLISPVKQPLIYLSYIL

SEQ ID NO: 2333971 - protein, 18 aa, Cryptosporidium parvum
ARLTRSTSDFGLLEPQFL

SEQ ID NO: 2333972 - protein, 21 aa, Cryptosporidium parvum
ARMIGDFIYSVSFFIKQYFIQ

SEQ ID NO: 2333973 - protein, 20 aa, Cryptosporidium parvum
ARQLFIEHLGRMDAGKLNEH

SEQ ID NO: 2333974 - protein, 17 aa, Cryptosporidium parvum
ARTLTIKLLDTISLKDE

SEQ ID NO: 2333975 - protein, 25 aa, Cryptosporidium parvum
ARTPTKYHKCWEGLNQSWNCDELVT

SEQ ID NO: 2333976 - protein, 25 aa, Cryptosporidium parvum
ARTTIEGMVKTIPYTPGKNSSNILL

SEQ ID NO: 2333977 - protein, 20 aa, Cryptosporidium parvum
ASAPTSGFCEKCGSRIYRVG

SEQ ID NO: 2333978 - protein, 20 aa, Cryptosporidium parvum
ASASKLGFLGMRSPSVSSCV

SEQ ID NO: 2333979 - protein, 23 aa, Cryptosporidium parvum
ASCDSRWCKMRENPSEKFEDGTV

SEQ ID NO: 2333980 - protein, 17 aa, Cryptosporidium parvum
ASCRAARMLPIPTEMVD

SEQ ID NO: 2333981 - protein, 24 aa, Cryptosporidium parvum
ASEYPWGFCPFPCGGFGNITSIVQ

SEQ ID NO: 2333982 - protein, 26 aa, Cryptosporidium parvum
ASFKYRKCKYWSWRATDFSCSLKSKS

SEQ ID NO: 2333983 - protein, 18 aa, Cryptosporidium parvum
ASIPFCVVREKIDQIDEH

SEQ ID NO: 2333984 - protein, 24 aa, Cryptosporidium parvum
ASIRNIWDSFPLFGGINENNVIGF

SEQ ID NO: 2333985 - protein, 17 aa, Cryptosporidium parvum
ASISGFGQRRRLFGSVR

SEQ ID NO: 2333986 - protein, 17 aa, Cryptosporidium parvum
ASLNNCNKYLCDMESNP

SEQ ID NO: 2333987 - protein, 17 aa, Cryptosporidium parvum
ASMLPWGSFKIENNPIK

SEQ ID NO: 2333988 - protein, 18 aa, Cryptosporidium parvum
ASMTPVLVIRASTIISIK

SEQ ID NO: 2333989 - protein, 23 aa, Cryptosporidium parvum
ASNLFAIILSHFEWEHIQLRWRV

SEQ ID NO: 2333990 - protein, 21 aa, Cryptosporidium parvum
ASPESFIFTQYLKLIIENRLN

SEQ ID NO: 2333991 - protein, 17 aa, Cryptosporidium parvum
ASPYFVYERVIEIYNSD

SEQ ID NO: 2333992 - protein, 19 aa, Cryptosporidium parvum
ASRHQLLFILRQVLEVAIK

SEQ ID NO: 2333993 - protein, 21 aa, Cryptosporidium parvum
ASRYFSFSGFIQSIKTENPIG

SEQ ID NO: 2333994 - protein, 18 aa, Cryptosporidium parvum
ASSNSTLEISKLDNSTST

SEQ ID NO: 2333995 - protein, 17 aa, Cryptosporidium parvum
ASTIFAMIKSPVEEVDE

SEQ ID NO: 2333996 - protein, 18 aa, Cryptosporidium parvum
ASTSRWMSCNSGVGIDEK

SEQ ID NO: 2333997 - protein, 26 aa, Cryptosporidium parvum
ASYTILESCFNFWKDLHEYYVSSMFT

SEQ ID NO: 2333998 - protein, 24 aa, Cryptosporidium parvum
ATAKAIGLKIVWSSSPRETQIQVS

SEQ ID NO: 2333999 - protein, 22 aa, Cryptosporidium parvum
ATALKNFWALLKLMVNLTECSN

SEQ ID NO: 2334000 - protein, 19 aa, Cryptosporidium parvum
ATCAEISKLSPPVHCGSVD

SEQ ID NO: 2334001 - protein, 19 aa, Cryptosporidium parvum
ATLACKQLGYSFGSILPSC

SEQ ID NO: 2334002 - protein, 18 aa, Cryptosporidium parvum
ATLQKAVQQNHEWYLLAM

SEQ ID NO: 2334003 - protein, 18 aa, Cryptosporidium parvum
ATSAKIMPEDTIFKQDWT

SEQ ID NO: 2334004 - protein, 22 aa, Cryptosporidium parvum
ATSRRVLGWTIELPFPGSDESK

SEQ ID NO: 2334005 - protein, 18 aa, Cryptosporidium parvum
ATSTKFMPDGTIFKQGWT

SEQ ID NO: 2334006 - protein, 22 aa, Cryptosporidium parvum
AVAFPKNYLNYFGTMNSDTNLS

SEQ ID NO: 2334007 - protein, 23 aa, Cryptosporidium parvum
AVAKTKHRGSFRLPKPKSKKKPL

SEQ ID NO: 2334008 - protein, 22 aa, Cryptosporidium parvum
AVLTCRKKLAACEYPTIAEETI

SEQ ID NO: 2334009 - protein, 18 aa, Cryptosporidium parvum
AVSIAKEIHTLFPQIKFK

SEQ ID NO: 2334010 - protein, 18 aa, Cryptosporidium parvum
AVSSAAFINKLFRIGVIP

SEQ ID NO: 2334011 - protein, 22 aa, Cryptosporidium parvum
AWTTELVILWKMARQKDITTCK

SEQ ID NO: 2334012 - protein, 20 aa, Cryptosporidium parvum
AYFACLNAFLFNRQAKSECF

SEQ ID NO: 2334013 - protein, 25 aa, Cryptosporidium parvum
AYFEIKEWFDSAVKFEREYYGSSAL

SEQ ID NO: 2334014 - protein, 20 aa, Cryptosporidium parvum
AYISNYLEMRNCIGNLNSDY

SEQ ID NO: 2334015 - protein, 19 aa, Cryptosporidium parvum
AYLKAWEMLGKSNDKLRKV

SEQ ID NO: 2334016 - protein, 20 aa, Cryptosporidium parvum
AYPKEYYVSFLPEGGERCQE

SEQ ID NO: 2334017 - protein, 24 aa, Cryptosporidium parvum
AYRALSIPFSDYFLDTDKKTLKSL

SEQ ID NO: 2334018 - protein, 23 aa, Cryptosporidium parvum
AYTGKRWKKSFVTSKYEGLCPSD

SEQ ID NO: 2334019 - protein, 26 aa, Cryptosporidium parvum
CAAKIKDQWLTSACRTILTVSGSKGK

SEQ ID NO: 2334020 - protein, 20 aa, Cryptosporidium parvum
CADLAWPDFVLVDDIENRFR

SEQ ID NO: 2334021 - protein, 21 aa, Cryptosporidium parvum
CARNLRLMFRQKVVINGNVRL

SEQ ID NO: 2334022 - protein, 38 aa, Cryptosporidium parvum
CATDAETYENLCLFGVAKCMNRDLQLVANVTCPDLLIH

SEQ ID NO: 2334023 - protein, 21 aa, Cryptosporidium parvum
CDEDCKRLSFQSWLATSILDQ

SEQ ID NO: 2334024 - protein, 18 aa, Cryptosporidium parvum
CFDYLRYSTINQLNTESL

SEQ ID NO: 2334025 - protein, 18 aa, Cryptosporidium parvum
CFGWGKRYKMIVNCPEGT

SEQ ID NO: 2334026 - protein, 20 aa, Cryptosporidium parvum
CFILGFSGYGNRGMWSAAVA

SEQ ID NO: 2334027 - protein, 28 aa, Cryptosporidium parvum
CFYDSVYEMCLFDCTLLNKKDACEEYLE

SEQ ID NO: 2334028 - protein, 19 aa, Cryptosporidium parvum
CGLNPCLSVGLIDITNNGK

SEQ ID NO: 2334029 - protein, 23 aa, Cryptosporidium parvum
CGYDISKPFPFYFLVIVECDILY

SEQ ID NO: 2334030 - protein, 20 aa, Cryptosporidium parvum
CHILPLLLFIILAILFNSNV

SEQ ID NO: 2334031 - protein, 30 aa, Cryptosporidium parvum
CHLEGAKCVPARCRGVKAIPARIVGYDGRA

SEQ ID NO: 2334032 - protein, 17 aa, Cryptosporidium parvum
CHLELDQPCRGNDSILD

SEQ ID NO: 2334033 - protein, 17 aa, Cryptosporidium parvum
CHPSCNGCSCTTAKCTG

SEQ ID NO: 2334034 - protein, 29 aa, Cryptosporidium parvum
CIANRLKSYLALRLPDKFAQPSNSLRRNS

SEQ ID NO: 2334035 - protein, 17 aa, Cryptosporidium parvum
CINKLRTLLDYTNKKDK

SEQ ID NO: 2334036 - protein, 18 aa, Cryptosporidium parvum
CIRDRFYSSLSYGQLKCK

SEQ ID NO: 2334037 - protein, 20 aa, Cryptosporidium parvum
CKEFKNFPHFNTKYNFATFT

SEQ ID NO: 2334038 - protein, 17 aa, Cryptosporidium parvum
CKHIYHFNCIDEWVKIK

SEQ ID NO: 2334039 - protein, 17 aa, Cryptosporidium parvum
CKHKNCIELVPTEGKMQ

SEQ ID NO: 2334040 - protein, 20 aa, Cryptosporidium parvum
CKKGKLFLESFSLLPKISGE

SEQ ID NO: 2334041 - protein, 20 aa, Cryptosporidium parvum
CKMKGYTDFTIECPKGYKLD

SEQ ID NO: 2334042 - protein, 20 aa, Cryptosporidium parvum
CKNLFREIFDKSHSKIPVNT

SEQ ID NO: 2334043 - protein, 20 aa, Cryptosporidium parvum
CKNLPKEVPGGFYSHGETKF

SEQ ID NO: 2334044 - protein, 17 aa, Cryptosporidium parvum
CKQVEEMIDDQSFEKPI

SEQ ID NO: 2334045 - protein, 18 aa, Cryptosporidium parvum
CKTPCTREYNPVCGSNRV

SEQ ID NO: 2334046 - protein, 17 aa, Cryptosporidium parvum
CKYFHRFNEGSVISGKY

SEQ ID NO: 2334047 - protein, 29 aa, Cryptosporidium parvum
CKYPEMYPGIHLHFGYWDGFRGRGNLIRL

SEQ ID NO: 2334048 - protein, 20 aa, Cryptosporidium parvum
CLAMRMMLFLPHQLRNTLNC

SEQ ID NO: 2334049 - protein, 25 aa, Cryptosporidium parvum
CLECFTSSLCERIHLFRKHSYGKDL

SEQ ID NO: 2334050 - protein, 20 aa, Cryptosporidium parvum
CLGTYRFFDHSNFCNFIISI

SEQ ID NO: 2334051 - protein, 17 aa, Cryptosporidium parvum
CLICLLNYTTFNQLGRV

SEQ ID NO: 2334052 - protein, 24 aa, Cryptosporidium parvum
CLTALLLGPLFRWDYYPFEAAPEN

SEQ ID NO: 2334053 - protein, 17 aa, Cryptosporidium parvum
CMLEMFKKCKINDQVQL

SEQ ID NO: 2334054 - protein, 18 aa, Cryptosporidium parvum
CMLQEPYFAFSAGDEPLI

SEQ ID NO: 2334055 - protein, 18 aa, Cryptosporidium parvum
CMSLYLFRFKGLKQIMLA

SEQ ID NO: 2334056 - protein, 19 aa, Cryptosporidium parvum
CNHAGLTDPIWISTAFGSI

SEQ ID NO: 2334057 - protein, 17 aa, Cryptosporidium parvum
CNLYLFSTCNGTSAKIM

SEQ ID NO: 2334058 - protein, 17 aa, Cryptosporidium parvum
CNRKLLGGEKCKYFHRF

SEQ ID NO: 2334059 - protein, 18 aa, Cryptosporidium parvum
CNYYNEWSSWSACTNECG

SEQ ID NO: 2334060 - protein, 18 aa, Cryptosporidium parvum
CPEKLAILMFLFQNTLYD

SEQ ID NO: 2334061 - protein, 21 aa, Cryptosporidium parvum
CPSDSSLSMLISFVELENKGN

SEQ ID NO: 2334062 - protein, 17 aa, Cryptosporidium parvum
CPTGVPLTGLRLIMRKG

SEQ ID NO: 2334063 - protein, 24 aa, Cryptosporidium parvum
CQINLDRLRFEEEVAYQDDIIRAG

SEQ ID NO: 2334064 - protein, 17 aa, Cryptosporidium parvum
CQIYMTIFVDSASLRDN

SEQ ID NO: 2334065 - protein, 19 aa, Cryptosporidium parvum
CQMKSFLKNRRCISGCATA

SEQ ID NO: 2334066 - protein, 20 aa, Cryptosporidium parvum
CQTFHRYNEFNTRKSQIQCL

SEQ ID NO: 2334067 - protein, 17 aa, Cryptosporidium parvum
CRESLRVVSNGMKVSSF

SEQ ID NO: 2334068 - protein, 24 aa, Cryptosporidium parvum
CRNLCKGGQVFTPFLPPKEPDCSS

SEQ ID NO: 2334069 - protein, 19 aa, Cryptosporidium parvum
CSAAKLIHDGSVEKQPISR

SEQ ID NO: 2334070 - protein, 19 aa, Cryptosporidium parvum
CSCIKANVFKLCTSEEIRN

SEQ ID NO: 2334071 - protein, 20 aa, Cryptosporidium parvum
CSDLKSLISASAFEKQSKTR

SEQ ID NO: 2334072 - protein, 19 aa, Cryptosporidium parvum
CSDTASFIFQLPVGERELV

SEQ ID NO: 2334073 - protein, 24 aa, Cryptosporidium parvum
CSETDSRFCVILIMEKNDFRMDKR

SEQ ID NO: 2334074 - protein, 19 aa, Cryptosporidium parvum
CSGAYPGGVSISYGEKFIW

SEQ ID NO: 2334075 - protein, 19 aa, Cryptosporidium parvum
CSGIFKMPSLPAVDLRPLN

SEQ ID NO: 2334076 - protein, 18 aa, Cryptosporidium parvum
CSLIEYMRKIFKEMNSRF

SEQ ID NO: 2334077 - protein, 18 aa, Cryptosporidium parvum
CSRRINGRWTGWIPVSES

SEQ ID NO: 2334078 - protein, 39 aa, Cryptosporidium parvum
CSSGRCGKCSCAGSACAYGCAYGCSMGCGGKGGSSSSPV

SEQ ID NO: 2334079 - protein, 18 aa, Cryptosporidium parvum
CSSQRAKLMGSFLVIPSL

SEQ ID NO: 2334080 - protein, 23 aa, Cryptosporidium parvum
CSTYKGGYFTFWMSYDSLNEEIS

SEQ ID NO: 2334081 - protein, 25 aa, Cryptosporidium parvum
CSTYPKGYFTFWLQKKFSENKFVVG

SEQ ID NO: 2334082 - protein, 24 aa, Cryptosporidium parvum
CSTYPNGFFTFWLSYDYSSNNYII

SEQ ID NO: 2334083 - protein, 21 aa, Cryptosporidium parvum
CSVIYDLFLSKVFPHLSTNHY

SEQ ID NO: 2334084 - protein, 17 aa, Cryptosporidium parvum
CTEDIFLKIRNNIEYEA

SEQ ID NO: 2334085 - protein, 26 aa, Cryptosporidium parvum
CTTEVPRLEGCVARPAHCTGGSCSPA

SEQ ID NO: 2334086 - protein, 17 aa, Cryptosporidium parvum
CVFIIIFFGSLFSNILH

SEQ ID NO: 2334087 - protein, 31 aa, Cryptosporidium parvum
CVGGKCGRVHCDGCSSSLCHLEGAKCVPARC

SEQ ID NO: 2334088 - protein, 24 aa, Cryptosporidium parvum
CVHNYFWRVPCGEIVELDLLANSL

SEQ ID NO: 2334089 - protein, 26 aa, Cryptosporidium parvum
CVKALYKDHFGELASIIINKIDYLEV

SEQ ID NO: 2334090 - protein, 20 aa, Cryptosporidium parvum
CVKLASDVNIVFGSHRDEFQ

SEQ ID NO: 2334091 - protein, 23 aa, Cryptosporidium parvum
CWDNLNEWKRLKLVHKYNQMERE

SEQ ID NO: 2334092 - protein, 22 aa, Cryptosporidium parvum
CYIKAEIFHLVYVSIAKNSYII

SEQ ID NO: 2334093 - protein, 19 aa, Cryptosporidium parvum
CYRMKNTLVLFYLIFSSEP

SEQ ID NO: 2334094 - protein, 21 aa, Cryptosporidium parvum
DAESFSRRLATGFEDSDPSSM

SEQ ID NO: 2334095 - protein, 23 aa, Cryptosporidium parvum
DAFLRSGYVAEIKPIYSDSELKL

SEQ ID NO: 2334096 - protein, 17 aa, Cryptosporidium parvum
DAIKKCSDLTRKLSGNI

SEQ ID NO: 2334097 - protein, 18 aa, Cryptosporidium parvum
DALSEIYDELGIPKQNNL

SEQ ID NO: 2334098 - protein, 23 aa, Cryptosporidium parvum
DAQLPLIMCPEGYEQRGDDCILD

SEQ ID NO: 2334099 - protein, 20 aa, Cryptosporidium parvum
DARDKYFLNYVEDFNSKASE

SEQ ID NO: 2334100 - protein, 22 aa, Cryptosporidium parvum
DCCFNSCFGGLIPYDSDHHLAN

SEQ ID NO: 2334101 - protein, 20 aa, Cryptosporidium parvum
DCDRNMILGKGFFVTPSDSV

SEQ ID NO: 2334102 - protein, 29 aa, Cryptosporidium parvum
DCKTCSGNCRTWMIGNGICDNSCNNKDCN

SEQ ID NO: 2334103 - protein, 30 aa, Cryptosporidium parvum
DCLNCNDIFKCPNCDLEIFPSENEIEFNSL

SEQ ID NO: 2334104 - protein, 25 aa, Cryptosporidium parvum
DCPQSTRFLTYDLLMLQNVGEEPTD

SEQ ID NO: 2334105 - protein, 20 aa, Cryptosporidium parvum
DDHSKCFILGFSGYGNRGMW

SEQ ID NO: 2334106 - protein, 20 aa, Cryptosporidium parvum
DDKKVFSILFDELFISINIE

SEQ ID NO: 2334107 - protein, 24 aa, Cryptosporidium parvum
DDQGLVVPPGFYFNKTTSQYEPLG

SEQ ID NO: 2334108 - protein, 18 aa, Cryptosporidium parvum
DDSSICLAAMHANTLNRS

SEQ ID NO: 2334109 - protein, 23 aa, Cryptosporidium parvum
DDTCKPKAGTHLATMQLDVLTKA

SEQ ID NO: 2334110 - protein, 32 aa, Cryptosporidium parvum
DDTEVSKAFDFILKFNLKLFPKGSPNNGTYSN

SEQ ID NO: 2334111 - protein, 24 aa, Cryptosporidium parvum
DDTSWGELTAIYDYLERVMENKYV

SEQ ID NO: 2334112 - protein, 19 aa, Cryptosporidium parvum
DDYIVRQIIRIGRSKDKNF

SEQ ID NO: 2334113 - protein, 24 aa, Cryptosporidium parvum
DDYLKKLYLIFTIKILNINNFDAN

SEQ ID NO: 2334114 - protein, 17 aa, Cryptosporidium parvum
DECHLELDQPCRGNDSI

SEQ ID NO: 2334115 - protein, 23 aa, Cryptosporidium parvum
DECPLELNKPCRGINGKLDKPFN

SEQ ID NO: 2334116 - protein, 25 aa, Cryptosporidium parvum
DECPVKLEKPCRGLDAVINDPEFQL

SEQ ID NO: 2334117 - protein, 23 aa, Cryptosporidium parvum
DEFLLEYRLKILSNTTIRELIES

SEQ ID NO: 2334118 - protein, 23 aa, Cryptosporidium parvum
DEGKTRFSIPMLKLGELLEQNSL

SEQ ID NO: 2334119 - protein, 18 aa, Cryptosporidium parvum
DEGRISKIGRFYQINQNH

SEQ ID NO: 2334120 - protein, 23 aa, Cryptosporidium parvum
DEILRLAYNIGTSIWHWSGSVPL

SEQ ID NO: 2334121 - protein, 18 aa, Cryptosporidium parvum
DEILRRNFAYHLATSFVY

SEQ ID NO: 2334122 - protein, 27 aa, Cryptosporidium parvum
DEIRDAVSFAAIPSVTLFCREVINFVT

SEQ ID NO: 2334123 - protein, 23 aa, Cryptosporidium parvum
DEKLKFLHWGVCDSNDADKITAI

SEQ ID NO: 2334124 - protein, 23 aa, Cryptosporidium parvum
DELIPPLIFCVKILDKPTNTSNS

SEQ ID NO: 2334125 - protein, 28 aa, Cryptosporidium parvum
DENNKRPKIRLGLLEDINDLLILEAGFR

SEQ ID NO: 2334126 - protein, 21 aa, Cryptosporidium parvum
DFCERCVRLMDNWENSEPHMI

SEQ ID NO: 2334127 - protein, 17 aa, Cryptosporidium parvum
DFDEFLFPIVSRFPQEY

SEQ ID NO: 2334128 - protein, 19 aa, Cryptosporidium parvum
DFDVLRIIFYNNINKNFLL

SEQ ID NO: 2334129 - protein, 19 aa, Cryptosporidium parvum
DFEALMGMSSIKLKQILKE

SEQ ID NO: 2334130 - protein, 28 aa, Cryptosporidium parvum
DFNEKLLIKYPWLRDRVGEAIYSDDGLV

SEQ ID NO: 2334131 - protein, 21 aa, Cryptosporidium parvum
DFPPAFDRVRGPDCVVKCDDN

SEQ ID NO: 2334132 - protein, 18 aa, Cryptosporidium parvum
DFSKLYRKPIVFSVQNGY

SEQ ID NO: 2334133 - protein, 20 aa, Cryptosporidium parvum
DFSSFALCQCKIRGSRQFEM

SEQ ID NO: 2334134 - protein, 19 aa, Cryptosporidium parvum
DFYSYSIFLFRQFERTNGR

SEQ ID NO: 2334135 - protein, 17 aa, Cryptosporidium parvum
DGCKLYLYFDDNVGYTV

SEQ ID NO: 2334136 - protein, 18 aa, Cryptosporidium parvum
DGEIMLERICETNIYPSA

SEQ ID NO: 2334137 - protein, 33 aa, Cryptosporidium parvum; identical to SEQ ID NO: 2206337

SEQ ID NO: 2334138 - protein, 17 aa, Cryptosporidium parvum
DGIWCKTSRLKLDGRMT

SEQ ID NO: 2334139 - protein, 34 aa, Cryptosporidium parvum
DGKKVKVILVRKRRPAFNWLRKWRNKRKIKNKAK

SEQ ID NO: 2334140 - protein, 25 aa, Cryptosporidium parvum
DGLEIPGRGILMVHKGHRLIPLIIP

SEQ ID NO: 2334141 - protein, 25 aa, Cryptosporidium parvum
DGLVLPIQVLNEFIPSSVYNLARED

SEQ ID NO: 2334142 - protein, 20 aa, Cryptosporidium parvum
DGMIPEQLERPFIIETSQDL

SEQ ID NO: 2334143 - protein, 29 aa, Cryptosporidium parvum
DGSCKECIELKKSCSHCSNFVSSKRSREY

SEQ ID NO: 2334144 - protein, 19 aa, Cryptosporidium parvum
DGSKCKGSECVRPSTTTTT

SEQ ID NO: 2334145 - protein, 24 aa, Cryptosporidium parvum
DGSKFFPFFISKYIRSLQKSNYFG

SEQ ID NO: 2334146 - protein, 20 aa, Cryptosporidium parvum
DGSRIIFRISGTGSVGATIR

SEQ ID NO: 2334147 - protein, 18 aa, Cryptosporidium parvum
DGVQKFFFKILRRKVHSN

SEQ ID NO: 2334148 - protein, 19 aa, Cryptosporidium parvum
DHEIKSCVSITYADSVAFC

SEQ ID NO: 2334149 - protein, 25 aa, Cryptosporidium parvum
DHELFKFLEFKGIPILNKNSKDIDG

SEQ ID NO: 2334150 - protein, 22 aa, Cryptosporidium parvum
DHLTWSLGIDHSYLLYLNIHDI

SEQ ID NO: 2334151 - protein, 17 aa, Cryptosporidium parvum
DHQRFVLSFKKRLGELL

SEQ ID NO: 2334152 - protein, 19 aa, Cryptosporidium parvum
DIDLKIIFMQYIKSTLRCI

SEQ ID NO: 2334153 - protein, 19 aa, Cryptosporidium parvum
DIELRIVTLRNFYLSATRN

SEQ ID NO: 2334154 - protein, 20 aa, Cryptosporidium parvum
DIGDAYLFNGVYYLKKYGQS

SEQ ID NO: 2334155 - protein, 18 aa, Cryptosporidium parvum
DILGRFWLEETVKSVQVI

SEQ ID NO: 2334156 - protein, 28 aa, Cryptosporidium parvum
DILRYPEVVSTPGERLVSMFRKSKISKC

SEQ ID NO: 2334157 - protein, 24 aa, Cryptosporidium parvum
DILSRPQVIYGRRGYDFQDIKCDG

SEQ ID NO: 2334158 - protein, 25 aa, Cryptosporidium parvum
DILSVFIEACIRPYVSFKGNEIMYV

SEQ ID NO: 2334159 - protein, 18 aa, Cryptosporidium parvum
DINKCITINQSLCFSDPA

SEQ ID NO: 2334160 - protein, 18 aa, Cryptosporidium parvum
DINSELRADLKLFENLQI

SEQ ID NO: 2334161 - protein, 20 aa, Cryptosporidium parvum
DIPYLLKLVNVLSDSYGFSI

SEQ ID NO: 2334162 - protein, 21 aa, Cryptosporidium parvum
DIYFIIKLLKYVYIKEKNIHK

SEQ ID NO: 2334163 - protein, 22 aa, Cryptosporidium parvum
DIYPSIPTRLIFSVQNYQGYPF

SEQ ID NO: 2334164 - protein, 21 aa, Cryptosporidium parvum
DKAKETIKIFCRDATNRYFQE

SEQ ID NO: 2334165 - protein, 19 aa, Cryptosporidium parvum
DKGLCKSIVPSTLNCPSGT

SEQ ID NO: 2334166 - protein, 19 aa, Cryptosporidium parvum
DKIVDTCSSLPVSLIKSET

SEQ ID NO: 2334167 - protein, 23 aa, Cryptosporidium parvum
DKLKQIINWDGPVKFTPTQKRGP

SEQ ID NO: 2334168 - protein, 18 aa, Cryptosporidium parvum
DKLPMTRRPIIHPFTRKI

SEQ ID NO: 2334169 - protein, 23 aa, Cryptosporidium parvum
DKLSKPCAILLLGGIDQNLFEEE

SEQ ID NO: 2334170 - protein, 22 aa, Cryptosporidium parvum
DKSSRKQLLFLRASYTILESCF

SEQ ID NO: 2334171 - protein, 24 aa, Cryptosporidium parvum
DKYLIDTPCRIYRPDRREDIIELR

SEQ ID NO: 2334172 - protein, 21 aa, Cryptosporidium parvum
DLANSFSCLFDESTECVPVES

SEQ ID NO: 2334173 - protein, 23 aa, Cryptosporidium parvum
DLDEFRKTIGYKMLSKEDRDLEE

SEQ ID NO: 2334174 - protein, 18 aa, Cryptosporidium parvum
DLNWLYCQDLPKYLNKLD

SEQ ID NO: 2334175 - protein, 29 aa, Cryptosporidium parvum
DLSGGCKLSIGTACTGGFGYFDKTNDSTW

SEQ ID NO: 2334176 - protein, 17 aa, Cryptosporidium parvum
DLTKTALCTEISSIISK

SEQ ID NO: 2334177 - protein, 23 aa, Cryptosporidium parvum
DLVIPDLLGVYLINNGHIDISII

SEQ ID NO: 2334178 - protein, 22 aa, Cryptosporidium parvum
DLVRKLPCKHIYHFNCIDEWVK

SEQ ID NO: 2334179 - protein, 18 aa, Cryptosporidium parvum
DLWSPSSILNSNFQYGTD

SEQ ID NO: 2334180 - protein, 23 aa, Cryptosporidium parvum
DLYFSKKMVRYWISKPKKKDIII

SEQ ID NO: 2334181 - protein, 19 aa, Cryptosporidium parvum
DMGRMLSCNHNYMKETALC

SEQ ID NO: 2334182 - protein, 20 aa, Cryptosporidium parvum
DMKLDFYNRLISGFEYDLGS

SEQ ID NO: 2334183 - protein, 19 aa, Cryptosporidium parvum
DMSSPCKGINSTLTIPDKF

SEQ ID NO: 2334184 - protein, 18 aa, Cryptosporidium parvum
DMVVLPFKYKIDLPPEVL

SEQ ID NO: 2334185 - protein, 26 aa, Cryptosporidium parvum
DNERNRLESNLAFVLQIGTSIWGSNK

SEQ ID NO: 2334186 - protein, 21 aa, Cryptosporidium parvum
DNKHIIGMTFLEFTNTKRSIA

SEQ ID NO: 2334187 - protein, 30 aa, Cryptosporidium parvum; identical to SEQ ID NO: 2206370

SEQ ID NO: 2334188 - protein, 21 aa, Cryptosporidium parvum
DNLIFKQDWTLFVMVSTGIPE

SEQ ID NO: 2334189 - protein, 17 aa, Cryptosporidium parvum
DNLKLEKLFPININLLS

SEQ ID NO: 2334190 - protein, 19 aa, Cryptosporidium parvum
DNLLIWKNYFESIYSTAFE

SEQ ID NO: 2334191 - protein, 17 aa, Cryptosporidium parvum
DNMCVVEKLLPAEVECP

SEQ ID NO: 2334192 - protein, 22 aa, Cryptosporidium parvum
DNNSFFPAFGIFNKGDALALNN

SEQ ID NO: 2334193 - protein, 25 aa, Cryptosporidium parvum
DNNVPLRWDIVSGISSGGFNALVSS

SEQ ID NO: 2334194 - protein, 24 aa, Cryptosporidium parvum
DNPSMWPASLTMYIKQQVDEMHET

SEQ ID NO: 2334195 - protein, 21 aa, Cryptosporidium parvum
DNSINYCIYKYVDINMWSGFK

SEQ ID NO: 2334196 - protein, 27 aa, Cryptosporidium parvum
DPEITPLIQCNFDWVAFQSLEELKKSS

SEQ ID NO: 2334197 - protein, 23 aa, Cryptosporidium parvum
DPELQLFWNREVRTITDALVARD

SEQ ID NO: 2334198 - protein, 20 aa, Cryptosporidium parvum
DPENGKVVGRWTMVYDEGFE

SEQ ID NO: 2334199 - protein, 17 aa, Cryptosporidium parvum
DPNGFKIDFAIVKKSIN

SEQ ID NO: 2334200 - protein, 24 aa, Cryptosporidium parvum
DPRKKRIGFNLNTTARCKYEQNKT

SEQ ID NO: 2334201 - protein, 23 aa, Cryptosporidium parvum
DPSRIVKVDVDFHLPQKNLDTFI

SEQ ID NO: 2334202 - protein, 17 aa, Cryptosporidium parvum
DPYSLKKKVTAQCILGR

SEQ ID NO: 2334203 - protein, 26 aa, Cryptosporidium parvum
DQQCKDFGISSCRRALINILNIYSKV

SEQ ID NO: 2334204 - protein, 17 aa, Cryptosporidium parvum
DQSSQIVNPEWRFFTNV

SEQ ID NO: 2334205 - protein, 18 aa, Cryptosporidium parvum
DRERSSCISQVFSDPEPK

SEQ ID NO: 2334206 - protein, 21 aa, Cryptosporidium parvum
DRFSFKTFPNFVPPDIPKIAG

SEQ ID NO: 2334207 - protein, 19 aa, Cryptosporidium parvum
DRLLDLNIWCLALRQKVPD

SEQ ID NO: 2334208 - protein, 23 aa, Cryptosporidium parvum
DRSEFSDPVIMESFENVPAKTDS

SEQ ID NO: 2334209 - protein, 37 aa, Cryptosporidium parvum
DRVSFLKLRNGISFGPNLCRRLCCCRGNGNDLSTQDV

SEQ ID NO: 2334210 - protein, 28 aa, Cryptosporidium parvum
DSAIDVCVQRGFFAEALLLAVKFGGIYL

SEQ ID NO: 2334211 - protein, 23 aa, Cryptosporidium parvum
DSCAGCPNALICASGQAKKKPTE

SEQ ID NO: 2334212 - protein, 19 aa, Cryptosporidium parvum
DSELVKDIIIWVTIPTDEN

SEQ ID NO: 2334213 - protein, 26 aa, Cryptosporidium parvum
DSKISWRYEKDGSFNGMCLGIETING

SEQ ID NO: 2334214 - protein, 23 aa, Cryptosporidium parvum
DSKPRASYPISHTSVLVDSKHRY

SEQ ID NO: 2334215 - protein, 23 aa, Cryptosporidium parvum
DSKSSSIPIDFVRSNYVIYIQSI

SEQ ID NO: 2334216 - protein, 30 aa, Cryptosporidium parvum; identical to SEQ ID NO: 2206395

SEQ ID NO: 2334217 - protein, 22 aa, Cryptosporidium parvum
DSLPPTWHVYGIRPIQASIIRT

SEQ ID NO: 2334218 - protein, 25 aa, Cryptosporidium parvum
DSLREYRLPIGYIPIARRYQRVKES

SEQ ID NO: 2334219 - protein, 18 aa, Cryptosporidium parvum
DSNIRFIALKEIMDVCSP

SEQ ID NO: 2334220 - protein, 25 aa, Cryptosporidium parvum
DSNSLRPPVPFQLVQGIEECELEIY

SEQ ID NO: 2334221 - protein, 19 aa, Cryptosporidium parvum
DSRTRCMRIWTLLRNSVPN

SEQ ID NO: 2334222 - protein, 23 aa, Cryptosporidium parvum
DSSTLYWFGYQFLFDSNPIFSLL

SEQ ID NO: 2334223 - protein, 20 aa, Cryptosporidium parvum
DSTVFLSKYIEGMKPEQKSI

SEQ ID NO: 2334224 - protein, 33 aa, Cryptosporidium parvum
DSVPLIKLPNFNLPIFGIPPIPPQVLKTTSTST

SEQ ID NO: 2334225 - protein, 25 aa, Cryptosporidium parvum
DSVSQYDLLAILFVVKTRQGEAPLV

SEQ ID NO: 2334226 - protein, 22 aa, Cryptosporidium parvum
DSVYRLSLMRLCLLDISEGKLG

SEQ ID NO: 2334227 - protein, 27 aa, Cryptosporidium parvum
DSWSVGCLFSQMLFRLGTLKTNYFTRV

SEQ ID NO: 2334228 - protein, 24 aa, Cryptosporidium parvum
DSYSGPRPPSGFPNQITQKAVMVQ

SEQ ID NO: 2334229 - protein, 23 aa, Cryptosporidium parvum
DTDICFKSCMAFSTLDGQVHVAD

SEQ ID NO: 2334230 - protein, 17 aa, Cryptosporidium parvum
DTIALSIGYGPLSGLGE

SEQ ID NO: 2334231 - protein, 23 aa, Cryptosporidium parvum
DTNIIFRVRIVYRPISIAEDPEE

SEQ ID NO: 2334232 - protein, 20 aa, Cryptosporidium parvum
DVDVSWQYLRFLMEDDEKLE

SEQ ID NO: 2334233 - protein, 25 aa, Cryptosporidium parvum
DVEINWKGRVLVIGDIHGDLKSLIT

SEQ ID NO: 2334234 - protein, 23 aa, Cryptosporidium parvum
DVGKLPFDIPLGIVSGKLDLDLP

SEQ ID NO: 2334235 - protein, 17 aa, Cryptosporidium parvum
DVGTFAFTCPKGHVITH

SEQ ID NO: 2334236 - protein, 24 aa, Cryptosporidium parvum
DVLAFTGPHDIFWVGADEKEFLPM

SEQ ID NO: 2334237 - protein, 18 aa, Cryptosporidium parvum
DVRRASIMHERGFPEMAV

SEQ ID NO: 2334238 - protein, 36 aa, Cryptosporidium parvum
DVSYTWQKRFRRFGYWVCFRDCGGGGDCLYNSIISS

SEQ ID NO: 2334239 - protein, 26 aa, Cryptosporidium parvum
DVTALKWNPKVPHIMSSSSSNGTTAI

SEQ ID NO: 2334240 - protein, 25 aa, Cryptosporidium parvum
DVVGSPQCGPYCSTYPKGYFAFWLT

SEQ ID NO: 2334241 - protein, 20 aa, Cryptosporidium parvum
DWLYEIGDEITLELVEEKIK

SEQ ID NO: 2334242 - protein, 19 aa, Cryptosporidium parvum
DWRNSRMTGLRVYNDGDHI

SEQ ID NO: 2334243 - protein, 22 aa, Cryptosporidium parvum
DWSDEVRLLGEWGEEEAIRGIL

SEQ ID NO: 2334244 - protein, 19 aa, Cryptosporidium parvum
DWYRLELISRELTNYYQDV

SEQ ID NO: 2334245 - protein, 25 aa, Cryptosporidium parvum
DYGDTLKWSIGFDISNQMYLNVHNF

SEQ ID NO: 2334246 - protein, 21 aa, Cryptosporidium parvum
DYKRNNWFFKLLISQYNAISQ

SEQ ID NO: 2334247 - protein, 17 aa, Cryptosporidium parvum
DYMLPTFSLLNIQPYNA

SEQ ID NO: 2334248 - protein, 20 aa, Cryptosporidium parvum
DYSYEFLNLLLSKEETDNLV

SEQ ID NO: 2334249 - protein, 18 aa, Cryptosporidium parvum
DYTLKYYHSIDCNTPLPN

SEQ ID NO: 2334250 - protein, 25 aa, Cryptosporidium parvum
EADEIRFVLPDGFTFLKSNDNELIH

SEQ ID NO: 2334251 - protein, 18 aa, Cryptosporidium parvum
EAEFLRTTFCISAAVFCY

SEQ ID NO: 2334252 - protein, 20 aa, Cryptosporidium parvum
EAIKSYLERISCSELSEEKY

SEQ ID NO: 2334253 - protein, 22 aa, Cryptosporidium parvum
EAKILASILFYYSNLLNIPITT

SEQ ID NO: 2334254 - protein, 20 aa, Cryptosporidium parvum
EALLFELIKFYGSYYSSNLM

SEQ ID NO: 2334255 - protein, 17 aa, Cryptosporidium parvum
EAMFRKIIRKTAEYNEN

SEQ ID NO: 2334256 - protein, 22 aa, Cryptosporidium parvum
EANEFKHSLTIASDGSSIGILP

SEQ ID NO: 2334257 - protein, 20 aa, Cryptosporidium parvum
EARKLKIISAKSLIKISLDL

SEQ ID NO: 2334258 - protein, 21 aa, Cryptosporidium parvum
EAVANRFSFWSGPSQNLNYTG

SEQ ID NO: 2334259 - protein, 24 aa, Cryptosporidium parvum
EAVIWSHLMRKWIFLPRRVSFDEY

SEQ ID NO: 2334260 - protein, 27 aa, Cryptosporidium parvum
EAYLRGYLHLSFRISRLGLCLRTKITE

SEQ ID NO: 2334261 - protein, 21 aa, Cryptosporidium parvum
ECDLYILSICNSTIVNLKPTG

SEQ ID NO: 2334262 - protein, 25 aa, Cryptosporidium parvum
ECNFCSYNDCQKCYENSIKLKNLEN

SEQ ID NO: 2334263 - protein, 26 aa, Cryptosporidium parvum
ECNSCEYGLCNDCFYKFREINDKKKQ

SEQ ID NO: 2334264 - protein, 27 aa, Cryptosporidium parvum
ECVGTSWLPKPCGLDPFSETPEGWKVP

SEQ ID NO: 2334265 - protein, 18 aa, Cryptosporidium parvum
EDAICPPGYLDNGSDCVQ

SEQ ID NO: 2334266 - protein, 25 aa, Cryptosporidium parvum
EDALIETRGPFIIINEEGEENKTNS

SEQ ID NO: 2334267 - protein, 17 aa, Cryptosporidium parvum
EDEFKAFVTENGLENED

SEQ ID NO: 2334268 - protein, 22 aa, Cryptosporidium parvum
EDIIPVRLLLLGMSPKQIEKEP

SEQ ID NO: 2334269 - protein, 23 aa, Cryptosporidium parvum
EDKFAVLILPPFCNIAHWTYNSK

SEQ ID NO: 2334270 - protein, 24 aa, Cryptosporidium parvum
EDLKLNYLQGVYSFNGIFNGRPSY

SEQ ID NO: 2334271 - protein, 27 aa, Cryptosporidium parvum
EDMVNFISCGGPYPGGKTLSSSSNLEW

SEQ ID NO: 2334272 - protein, 23 aa, Cryptosporidium parvum
EDSEIKARILAGNESDFKTERIS

SEQ ID NO: 2334273 - protein, 25 aa, Cryptosporidium parvum
EDSMIRFGYLGGYLAVDFLPSRKKI

SEQ ID NO: 2334274 - protein, 23 aa, Cryptosporidium parvum
EDTIFKQDWTLFVIISTGIPEYD

SEQ ID NO: 2334275 - protein, 25 aa, Cryptosporidium parvum
EDVTFKEGWTLFVILSTGVPDYDET

SEQ ID NO: 2334276 - protein, 26 aa, Cryptosporidium parvum
EEALDRFSQSFIDPLFDEHFIEKEII

SEQ ID NO: 2334277 - protein, 25 aa, Cryptosporidium parvum
EEAQSVDIFSFFNIVNLDFLEITEV

SEQ ID NO: 2334278 - protein, 24 aa, Cryptosporidium parvum
EEEKFEKFEEEFPMDYSPKALSEE

SEQ ID NO: 2334279 - protein, 19 aa, Cryptosporidium parvum
EEFKYRSELITNVDKKLNY

SEQ ID NO: 2334280 - protein, 21 aa, Cryptosporidium parvum
EEFNEMYGLLQFPQIVDIATR

SEQ ID NO: 2334281 - protein, 20 aa, Cryptosporidium parvum
EEIDEIFKLDSILKDLNLIL

SEQ ID NO: 2334282 - protein, 23 aa, Cryptosporidium parvum
EEIPQQCPIGFVFVESVRKCIKK

SEQ ID NO: 2334283 - protein, 23 aa, Cryptosporidium parvum
EEISLKFNNLVTEFQLAKKEIEM

SEQ ID NO: 2334284 - protein, 27 aa, Cryptosporidium parvum
EEKEKKERFELFTGCVYELGKKSSLRV

SEQ ID NO: 2334285 - protein, 24 aa, Cryptosporidium parvum
EELLKFNLTNVIEVWLQILNASNS

SEQ ID NO: 2334286 - protein, 20 aa, Cryptosporidium parvum
EELRTAFNVLDRYGNGKVLV

SEQ ID NO: 2334287 - protein, 23 aa, Cryptosporidium parvum
EELSLPSSWFIKKLESNAESYLE

SEQ ID NO: 2334288 - protein, 30 aa, Cryptosporidium parvum
EENFLYPNIFLFKGYETCGLYEECSTSPVN

SEQ ID NO: 2334289 - protein, 22 aa, Cryptosporidium parvum
EENRRAKVWKGLKINSQPNHVN

SEQ ID NO: 2334290 - protein, 17 aa, Cryptosporidium parvum
EERRICEKIPLFSTSPM

SEQ ID NO: 2334291 - protein, 35 aa, Cryptosporidium parvum
EESIKFLKRKLLFSWPRTRLRKSLLDSNRRKKMEE

SEQ ID NO: 2334292 - protein, 23 aa, Cryptosporidium parvum
EESKLRIGLFGVEVPKTANNFYS

SEQ ID NO: 2334293 - protein, 25 aa, Cryptosporidium parvum
EETFCAPGSRLTGLLVHTSTKIPHS

SEQ ID NO: 2334294 - protein, 17 aa, Cryptosporidium parvum
EETRTSTSTAKMSKTST

SEQ ID NO: 2334295 - protein, 21 aa, Cryptosporidium parvum
EEYKGSLPNVWSKETDKYEKE

SEQ ID NO: 2334296 - protein, 23 aa, Cryptosporidium parvum
EEYSLVCSSGFVLLGDRCALFTN

SEQ ID NO: 2334297 - protein, 17 aa, Cryptosporidium parvum
EEYWTPFGIDPALLKKD

SEQ ID NO: 2334298 - protein, 21 aa, Cryptosporidium parvum
EEYYYFSLLCWDSNNGTSKHC

SEQ ID NO: 2334299 - protein, 17 aa, Cryptosporidium parvum
EFAFKKKIEPVGEAFFY

SEQ ID NO: 2334300 - protein, 20 aa, Cryptosporidium parvum
EFCDSPRNLFEIENDIWDNN

SEQ ID NO: 2334301 - protein, 22 aa, Cryptosporidium parvum
EFEIALKIFANMFINLNTNDNI

SEQ ID NO: 2334302 - protein, 18 aa, Cryptosporidium parvum
EFETRIANTYSHIPEKLG

SEQ ID NO: 2334303 - protein, 20 aa, Cryptosporidium parvum
EFIPRCMMRLLTYLGKLGSE

SEQ ID NO: 2334304 - protein, 24 aa, Cryptosporidium parvum
EFKNEVLDIIEIVKSKICQINIKL

SEQ ID NO: 2334305 - protein, 19 aa, Cryptosporidium parvum
EFLDNIYLLYSLNNKVSSY

SEQ ID NO: 2334306 - protein, 21 aa, Cryptosporidium parvum
EFQADPSFEVMLNRASEMIER

SEQ ID NO: 2334307 - protein, 23 aa, Cryptosporidium parvum
EFQIPCTFYSPIITVSVPKSYKI

SEQ ID NO: 2334308 - protein, 19 aa, Cryptosporidium parvum
EFQPQFPSQHWLRTELPDI

SEQ ID NO: 2334309 - protein, 23 aa, Cryptosporidium parvum
EFSDLPFKLTKSINDRENNRKQN

SEQ ID NO: 2334310 - protein, 19 aa, Cryptosporidium parvum
EFTCPGMLHSPRAQLLFSK

SEQ ID NO: 2334311 - protein, 19 aa, Cryptosporidium parvum
EFYVSAYLYCESIRRVSGT

SEQ ID NO: 2334312 - protein, 19 aa, Cryptosporidium parvum
EGAVKSLTGFGCLYTSTTE

SEQ ID NO: 2334313 - protein, 32 aa, Cryptosporidium parvum
EGEIEFKSLLFIPSHPPFDMFDTYMGKSGNIK

SEQ ID NO: 2334314 - protein, 24 aa, Cryptosporidium parvum
EGFREGWWGLSIDITRPVVINSMH

SEQ ID NO: 2334315 - protein, 21 aa, Cryptosporidium parvum
EGICKGSIFWETCSNKHLQPL

SEQ ID NO: 2334316 - protein, 22 aa, Cryptosporidium parvum
EGIKENPPRYELLPLAKPNEEQ

SEQ ID NO: 2334317 - protein, 26 aa, Cryptosporidium parvum
EGILVPWPWELSKYRVLDVISYNNNI

SEQ ID NO: 2334318 - protein, 19 aa, Cryptosporidium parvum
EGIMMVCDYLQNFMAENGV

SEQ ID NO: 2334319 - protein, 20 aa, Cryptosporidium parvum
EGKKKFFFLKCESDKNQKVV

SEQ ID NO: 2334320 - protein, 27 aa, Cryptosporidium parvum
EGKKRRWEFVIEWRNVFLKSEQYNSKS

SEQ ID NO: 2334321 - protein, 20 aa, Cryptosporidium parvum
EGKLSVLEECLLKILEKVVE

SEQ ID NO: 2334322 - protein, 21 aa, Cryptosporidium parvum
EGMEYCRKGILSLLKEGQIEL

SEQ ID NO: 2334323 - protein, 22 aa, Cryptosporidium parvum
EGNLIFKDEFILSDNEIKSLNS

SEQ ID NO: 2334324 - protein, 23 aa, Cryptosporidium parvum
EGREEKKTFGIEWGINETQSLYN

SEQ ID NO: 2334325 - protein, 21 aa, Cryptosporidium parvum
EGRHIRKLLNFIRADNMVISH

SEQ ID NO: 2334326 - protein, 19 aa, Cryptosporidium parvum
EGSKIKNLRSECMSYQSSL

SEQ ID NO: 2334327 - protein, 17 aa, Cryptosporidium parvum
EGSLKLDEDAVILGAER

SEQ ID NO: 2334328 - protein, 17 aa, Cryptosporidium parvum
EGVPDLIYLIAQLTQNY

SEQ ID NO: 2334329 - protein, 18 aa, Cryptosporidium parvum
EHNFDYESGYSFEIPLTE

SEQ ID NO: 2334330 - protein, 25 aa, Cryptosporidium parvum
EIARLKLRYQEAYGHFMSEKRKRDS

SEQ ID NO: 2334331 - protein, 19 aa, Cryptosporidium parvum
EIDIRNEIIRFYQNEYSSN

SEQ ID NO: 2334332 - protein, 17 aa, Cryptosporidium parvum
EIEFSKPDIKRCNQISG

SEQ ID NO: 2334333 - protein, 19 aa, Cryptosporidium parvum
EIEMLRYTIFKEYSNSNMQ

SEQ ID NO: 2334334 - protein, 31 aa, Cryptosporidium parvum
EIGNMKFNYDFRIIIKEKWIYITSPQGQTLV

SEQ ID NO: 2334335 - protein, 18 aa, Cryptosporidium parvum
EIHDKFRFQNEGMQSSYY

SEQ ID NO: 2334336 - protein, 17 aa, Cryptosporidium parvum
EIIDIVGIIDSKVSEKY

SEQ ID NO: 2334337 - protein, 25 aa, Cryptosporidium parvum
EIKESCPYLLLQITNLEHWPKIMLT

SEQ ID NO: 2334338 - protein, 17 aa, Cryptosporidium parvum
EILEMESLLSISMELLG

SEQ ID NO: 2334339 - protein, 31 aa, Cryptosporidium parvum
EILIKSSRLSNGFVCMGILNGTEIWSREFCE

SEQ ID NO: 2334340 - protein, 20 aa, Cryptosporidium parvum
EIMLAFELITFLLRSATDFE

SEQ ID NO: 2334341 - protein, 20 aa, Cryptosporidium parvum
EINKYFSPYSSIHYLTSSEI

SEQ ID NO: 2334342 - protein, 19 aa, Cryptosporidium parvum
EIPGEVKISQSIVRPNIFY

SEQ ID NO: 2334343 - protein, 23 aa, Cryptosporidium parvum
EISCNCKGSFIYSFAESRDQNRA

SEQ ID NO: 2334344 - protein, 19 aa, Cryptosporidium parvum
EISLSCSSSIWKSGYSVLK

SEQ ID NO: 2334345 - protein, 20 aa, Cryptosporidium parvum
EISPEVMKSIPISIKCTTVS

SEQ ID NO: 2334346 - protein, 19 aa, Cryptosporidium parvum
EITPRIKLAEEINKLQFAE

SEQ ID NO: 2334347 - protein, 17 aa, Cryptosporidium parvum
EKCKSLDMAKVILEEFC

SEQ ID NO: 2334348 - protein, 24 aa, Cryptosporidium parvum
EKDGLWAVLAWLSILAYKNPDPTK

SEQ ID NO: 2334349 - protein, 21 aa, Cryptosporidium parvum
EKEGNKGLCSHSISDEQNSSI

SEQ ID NO: 2334350 - protein, 18 aa, Cryptosporidium parvum
EKFSMTGVLDLEKLEYIL

SEQ ID NO: 2334351 - protein, 19 aa, Cryptosporidium parvum
EKGKMRFNYIPKFSEISQS

SEQ ID NO: 2334352 - protein, 20 aa, Cryptosporidium parvum
EKGSCKGGYCVGPKCNGNEY

SEQ ID NO: 2334353 - protein, 22 aa, Cryptosporidium parvum
EKHKKDALEFWKLESKIRNMDN

SEQ ID NO: 2334354 - protein, 26 aa, Cryptosporidium parvum
EKINLKLWEEWLLKLDRFQLEQLDNF

SEQ ID NO: 2334355 - protein, 23 aa, Cryptosporidium parvum
EKIQKVKCPVFVIHGTADTVIPF

SEQ ID NO: 2334356 - protein, 19 aa, Cryptosporidium parvum
EKKKLLILGQRQLATMELS

SEQ ID NO: 2334357 - protein, 26 aa, Cryptosporidium parvum
EKLAPSIECGRGLKWSESKNICVGVK

SEQ ID NO: 2334358 - protein, 25 aa, Cryptosporidium parvum
EKLRPHLRKCVSLFILSILVFNEPI

SEQ ID NO: 2334359 - protein, 17 aa, Cryptosporidium parvum
EKMVFKSFYNLSLFFLK

SEQ ID NO: 2334360 - protein, 21 aa, Cryptosporidium parvum
EKRSLNRCLLLIILLIILEIL

SEQ ID NO: 2334361 - protein, 20 aa, Cryptosporidium parvum
EKSHGLFTVAVQWKKTKGID

SEQ ID NO: 2334362 - protein, 21 aa, Cryptosporidium parvum
EKSLSNFLIKKGWISKMDAVT

SEQ ID NO: 2334363 - protein, 21 aa, Cryptosporidium parvum
EKSMLDRGWDFSKLYRKPIVF

SEQ ID NO: 2334364 - protein, 21 aa, Cryptosporidium parvum
EKVARRRSLGLSRETFSLMDE

SEQ ID NO: 2334365 - protein, 26 aa, Cryptosporidium parvum
EKVVELELEYLLPQVKSMACKFHPEL

SEQ ID NO: 2334366 - protein, 23 aa, Cryptosporidium parvum
EKYLNRKNECFIFESNAVSVQSR

SEQ ID NO: 2334367 - protein, 23 aa, Cryptosporidium parvum
EKYLSELFIKMNNMEWRAKPKNN

SEQ ID NO: 2334368 - protein, 22 aa, Cryptosporidium parvum
EKYPLKWIKQVQKYGLSDDCDW

SEQ ID NO: 2334369 - protein, 24 aa, Cryptosporidium parvum
ELAPNKYWHGFSFYNKQNEKVLSI

SEQ ID NO: 2334370 - protein, 24 aa, Cryptosporidium parvum
ELCSIKVIILTAFDVLKSSLFIVF

SEQ ID NO: 2334371 - protein, 19 aa, Cryptosporidium parvum
ELDQRIGYSNVLLNALIYD

SEQ ID NO: 2334372 - protein, 31 aa, Cryptosporidium parvum
ELEECPLEFKKPCKGHNAIIKDSQFNKGNLI

SEQ ID NO: 2334373 - protein, 19 aa, Cryptosporidium parvum
ELEINRFQNIVAFLNTALN

SEQ ID NO: 2334374 - protein, 24 aa, Cryptosporidium parvum
ELEVLRLMEKIEVLSANVRENSSK

SEQ ID NO: 2334375 - protein, 20 aa, Cryptosporidium parvum
ELFEPDFIRQVLKEELPQDI

SEQ ID NO: 2334376 - protein, 19 aa, Cryptosporidium parvum
ELFHCSKNQLDLSFKLLQK

SEQ ID NO: 2334377 - protein, 24 aa, Cryptosporidium parvum
ELGLSLFINFGIRFFGKLESDKYY

SEQ ID NO: 2334378 - protein, 18 aa, Cryptosporidium parvum
ELHILPVIREHYWQVELE

SEQ ID NO: 2334379 - protein, 17 aa, Cryptosporidium parvum
ELIKIVDQYLCRKKGVE

SEQ ID NO: 2334380 - protein, 23 aa, Cryptosporidium parvum
ELKCELGMVNKLFVVKLKIIKIL

SEQ ID NO: 2334381 - protein, 22 aa, Cryptosporidium parvum
ELKEILKVVCEPMYRMFVYSSQ

SEQ ID NO: 2334382 - protein, 19 aa, Cryptosporidium parvum
ELLELLLELWSDLANSKSS

SEQ ID NO: 2334383 - protein, 23 aa, Cryptosporidium parvum
ELLRQEFIFRRSLMNTINKEQDE

SEQ ID NO: 2334384 - protein, 31 aa, Cryptosporidium parvum
ELLRQYYNEYSFPDYMYIKDVGNLKNSVKIK

SEQ ID NO: 2334385 - protein, 17 aa, Cryptosporidium parvum
ELLTELEASLASVYNNY

SEQ ID NO: 2334386 - protein, 24 aa, Cryptosporidium parvum
ELMTKLNILLSFEANEGFAQLIFS

SEQ ID NO: 2334387 - protein, 17 aa, Cryptosporidium parvum
ELNGHYLDFLRRMVEGS

SEQ ID NO: 2334388 - protein, 17 aa, Cryptosporidium parvum
ELNNFYRELFKEVDTDK

SEQ ID NO: 2334389 - protein, 19 aa, Cryptosporidium parvum
ELQRLPFIYKDSELKEKIE

SEQ ID NO: 2334390 - protein, 22 aa, Cryptosporidium parvum
ELRKDRELLTKVILDLRDSKDL

SEQ ID NO: 2334391 - protein, 20 aa, Cryptosporidium parvum
ELSIRRELNELTRLLNKKHS

SEQ ID NO: 2334392 - protein, 24 aa, Cryptosporidium parvum
ELSKFKVILDRDLKLVKRISKYSN

SEQ ID NO: 2334393 - protein, 27 aa, Cryptosporidium parvum
ELSVDLSWYKVCAFSISIIDTKTSFMS

SEQ ID NO: 2334394 - protein, 19 aa, Cryptosporidium parvum
ELTNLAIKYFSKIQNKQLP

SEQ ID NO: 2334395 - protein, 25 aa, Cryptosporidium parvum
ELVRLSRIAGLEFRDMCEVAIQIAN

SEQ ID NO: 2334396 - protein, 17 aa, Cryptosporidium parvum
ELVTEMKIYLSNSIFGY

SEQ ID NO: 2334397 - protein, 19 aa, Cryptosporidium parvum
ELWSSFRTAPTILVVIQSN

SEQ ID NO: 2334398 - protein, 21 aa, Cryptosporidium parvum
EMIKRSYMGPMLMNTENKGNL

SEQ ID NO: 2334399 - protein, 17 aa, Cryptosporidium parvum
EMRRKLKPAEMLTKSQS

SEQ ID NO: 2334400 - protein, 19 aa, Cryptosporidium parvum
EMSKWRYNYNWKHESCNLI

SEQ ID NO: 2334401 - protein, 18 aa, Cryptosporidium parvum
ENALGLICTGMEDGNMSL

SEQ ID NO: 2334402 - protein, 17 aa, Cryptosporidium parvum
ENFKFYSPIVFVRSIIR

SEQ ID NO: 2334403 - protein, 25 aa, Cryptosporidium parvum
ENGDRLSLLYGFSIIGLRSAGGCGF

SEQ ID NO: 2334404 - protein, 18 aa, Cryptosporidium parvum
ENGIWLPLNEQLSAMNPQ

SEQ ID NO: 2334405 - protein, 26 aa, Cryptosporidium parvum
ENGNVLRLMLNFSKIGFWIWDNNLLS

SEQ ID NO: 2334406 - protein, 23 aa, Cryptosporidium parvum
ENGRKYWMGYNFHKDTKEVMKIR

SEQ ID NO: 2334407 - protein, 23 aa, Cryptosporidium parvum
ENISLLLKFERIIFTKRSDQAKK

SEQ ID NO: 2334408 - protein, 17 aa, Cryptosporidium parvum
ENIVCNGPYPKDISQNF

SEQ ID NO: 2334409 - protein, 23 aa, Cryptosporidium parvum
ENKLRILYKIDQSNWFRLTEVSG

SEQ ID NO: 2334410 - protein, 17 aa, Cryptosporidium parvum
ENLKILLSIYQGVASRK

SEQ ID NO: 2334411 - protein, 24 aa, Cryptosporidium parvum
ENLPKRMVQDLCRLEDQDEEFLKS

SEQ ID NO: 2334412 - protein, 26 aa, Cryptosporidium parvum
ENNRQFPCCLNTLGGFTCVEQIISGD

SEQ ID NO: 2334413 - protein, 33 aa, Cryptosporidium parvum
ENPAIKLYSFFRIKRTFISHILFGLASKYRIIF

SEQ ID NO: 2334414 - protein, 18 aa, Cryptosporidium parvum
ENPPFIPRSQFSKYKEWS

SEQ ID NO: 2334415 - protein, 17 aa, Cryptosporidium parvum
ENSFKPRIYLRFKSLRD

SEQ ID NO: 2334416 - protein, 18 aa, Cryptosporidium parvum
ENSIEVFCHDVSRRWFSK

SEQ ID NO: 2334417 - protein, 29 aa, Cryptosporidium parvum
ENWSIPVEEIINATFIYPGTQQPDLVPNQ

SEQ ID NO: 2334418 - protein, 40 aa, Cryptosporidium parvum
ENYPLSGGIPICLILQYPLECLRRSAAVFYFTSEPKSRGG

SEQ ID NO: 2334419 - protein, 23 aa, Cryptosporidium parvum
EPAKNTFIFKNRYEEMKNTQSTS

SEQ ID NO: 2334420 - protein, 19 aa, Cryptosporidium parvum
EPCISRVPELEGFKFTSIE

SEQ ID NO: 2334421 - protein, 25 aa, Cryptosporidium parvum
EPDCSSSISCKKCDYSSIIKNDPST

SEQ ID NO: 2334422 - protein, 23 aa, Cryptosporidium parvum
EPEEMKSPIPIIPVEEEVKPNNS

SEQ ID NO: 2334423 - protein, 24 aa, Cryptosporidium parvum
EPFALLECHALTWIDFSVVMDIKF

SEQ ID NO: 2334424 - protein, 17 aa, Cryptosporidium parvum
EPIPIPVRPGSNQGQST

SEQ ID NO: 2334425 - protein, 19 aa, Cryptosporidium parvum
EPLDCPLPLTKEIKQSISH

SEQ ID NO: 2334426 - protein, 17 aa, Cryptosporidium parvum
EPLKEIVDIIVEEKGIN

SEQ ID NO: 2334427 - protein, 19 aa, Cryptosporidium parvum
EPNIRFDFINVEIGGNNQQ

SEQ ID NO: 2334428 - protein, 27 aa, Cryptosporidium parvum
EPPISPKLLCPKGYDLVDESCFFSHII

SEQ ID NO: 2334429 - protein, 22 aa, Cryptosporidium parvum
EQLKISLFNVMFYNENINDNDM

SEQ ID NO: 2334430 - protein, 30 aa, Cryptosporidium parvum
ERDINGSCIFCFSIFLTLYSRIQCQYVEVG

SEQ ID NO: 2334431 - protein, 20 aa, Cryptosporidium parvum
ERDLRQALLCSKKTTDGLEI

SEQ ID NO: 2334432 - protein, 24 aa, Cryptosporidium parvum
ERELKIKSALIARRVKMLKKMSSQ

SEQ ID NO: 2334433 - protein, 17 aa, Cryptosporidium parvum
ERGEDDLATGFKMIQSL

SEQ ID NO: 2334434 - protein, 17 aa, Cryptosporidium parvum
ERIRSAFNNVDRTVYLE

SEQ ID NO: 2334435 - protein, 20 aa, Cryptosporidium parvum
ERKGFKIAAMKFLVATAQQI

SEQ ID NO: 2334436 - protein, 22 aa, Cryptosporidium parvum
ERLDIKTSLPFNSIQRIYTLVE

SEQ ID NO: 2334437 - protein, 19 aa, Cryptosporidium parvum
ERLNYWSTIHLYFLSFTMG

SEQ ID NO: 2334438 - protein, 18 aa, Cryptosporidium parvum
ERNSPLKIVDSWFSAEEV

SEQ ID NO: 2334439 - protein, 23 aa, Cryptosporidium parvum
ERQWFFLDSWYGGLGTAARKVHP

SEQ ID NO: 2334440 - protein, 18 aa, Cryptosporidium parvum
ERSSRMEFVITRNAEIAI

SEQ ID NO: 2334441 - protein, 18 aa, Cryptosporidium parvum
ERTLRFLTFQAEQVDRIK

SEQ ID NO: 2334442 - protein, 24 aa, Cryptosporidium parvum
ERTVRSRLRLFKKMRDRLVSTRDS

SEQ ID NO: 2334443 - protein, 20 aa, Cryptosporidium parvum
ERVTLFWKENTWICVNTLSN

SEQ ID NO: 2334444 - protein, 21 aa, Cryptosporidium parvum
ERYARVRFGSCNETENMVDPL

SEQ ID NO: 2334445 - protein, 17 aa, Cryptosporidium parvum
ESACMFASNLLKPNIIE

SEQ ID NO: 2334446 - protein, 18 aa, Cryptosporidium parvum
ESDYDLNSLMVFRHDDIK

SEQ ID NO: 2334447 - protein, 24 aa, Cryptosporidium parvum
ESELFWKVKTNLILTTDARFEGAQ

SEQ ID NO: 2334448 - protein, 19 aa, Cryptosporidium parvum
ESGFVFTLYNSIRYQTLSI

SEQ ID NO: 2334449 - protein, 18 aa, Cryptosporidium parvum
ESKIKFGSFDISENDLPK

SEQ ID NO: 2334450 - protein, 22 aa, Cryptosporidium parvum
ESKSCLSLGITELGNLTAICNG

SEQ ID NO: 2334451 - protein, 22 aa, Cryptosporidium parvum
ESLLSISMELLGLISANMFYFN

SEQ ID NO: 2334452 - protein, 17 aa, Cryptosporidium parvum
ESNERKMDVMIPMENMT

SEQ ID NO: 2334453 - protein, 21 aa, Cryptosporidium parvum
ESNKTFGSRCFDYDQNVEKET

SEQ ID NO: 2334454 - protein, 26 aa, Cryptosporidium parvum
ESNVWPVKMRFVYPSCHNMVKDKDEE

SEQ ID NO: 2334455 - protein, 32 aa, Cryptosporidium parvum; identical to SEQ ID NO: 2206537

SEQ ID NO: 2334456 - protein, 20 aa, Cryptosporidium parvum
ESQLLCEGHHSIHLETLPSE

SEQ ID NO: 2334457 - protein, 21 aa, Cryptosporidium parvum
ESRISTSYCVKELSSPYNLEC

SEQ ID NO: 2334458 - protein, 20 aa, Cryptosporidium parvum
ESRSAPAPVAEHFDGESSSE

SEQ ID NO: 2334459 - protein, 24 aa, Cryptosporidium parvum
ESSKFRLELISSLTNLHLQLAANM

SEQ ID NO: 2334460 - protein, 28 aa, Cryptosporidium parvum
ESSRRHCKRILSSIGIVSEEDLSQTLEQ

SEQ ID NO: 2334461 - protein, 23 aa, Cryptosporidium parvum
ESVRKCIKKESAIPRCNDGYIHR

SEQ ID NO: 2334462 - protein, 22 aa, Cryptosporidium parvum
ESVSKLKLILLYIDKHSRFSDK

SEQ ID NO: 2334463 - protein, 22 aa, Cryptosporidium parvum
ESYLMIHTEIWVHPEKQIREEY

SEQ ID NO: 2334464 - protein, 18 aa, Cryptosporidium parvum
ETAISDISCELERIYKDV

SEQ ID NO: 2334465 - protein, 19 aa, Cryptosporidium parvum
ETDCLKLIGAENLFILDEG

SEQ ID NO: 2334466 - protein, 19 aa, Cryptosporidium parvum
ETFVFKSGYLFLTNFWLDM

SEQ ID NO: 2334467 - protein, 20 aa, Cryptosporidium parvum
ETIPDFLKRRAQVKDSGSVT

SEQ ID NO: 2334468 - protein, 18 aa, Cryptosporidium parvum
ETITELFQFISRINQIKE

SEQ ID NO: 2334469 - protein, 19 aa, Cryptosporidium parvum
ETKADILFHIHKILEESSE

SEQ ID NO: 2334470 - protein, 22 aa, Cryptosporidium parvum
ETKGTESLKMMGNLANGSYVLR

SEQ ID NO: 2334471 - protein, 18 aa, Cryptosporidium parvum
ETNLDVLIVFYAPWCGHC

SEQ ID NO: 2334472 - protein, 17 aa, Cryptosporidium parvum
ETPEGLVSIGFLERKAN

SEQ ID NO: 2334473 - protein, 23 aa, Cryptosporidium parvum
ETRSLCFNNIYLSKFWSSLNKIT

SEQ ID NO: 2334474 - protein, 21 aa, Cryptosporidium parvum
ETWTASCPLSSWHDEFSDALV

SEQ ID NO: 2334475 - protein, 21 aa, Cryptosporidium parvum
ETWYPHSFCNVLPVLPVVPIS

SEQ ID NO: 2334476 - protein, 18 aa, Cryptosporidium parvum
EVCFNKKGGFECKCGIGF

SEQ ID NO: 2334477 - protein, 23 aa, Cryptosporidium parvum
EVFFLESLFSGFISLAYFACLNA

SEQ ID NO: 2334478 - protein, 20 aa, Cryptosporidium parvum
EVHSLLKVEEFKSFDLSTTS

SEQ ID NO: 2334479 - protein, 24 aa, Cryptosporidium parvum
EVIIFKLKLGKIIKNENKKPDNEI

SEQ ID NO: 2334480 - protein, 24 aa, Cryptosporidium parvum
EVIPAKSIEIMLMIPPNSAGEDLS

SEQ ID NO: 2334481 - protein, 21 aa, Cryptosporidium parvum
EVKNSLFVCRIRIGEPEQEFW

SEQ ID NO: 2334482 - protein, 19 aa, Cryptosporidium parvum
EVKSMFNVFAFNQKRFGKK

SEQ ID NO: 2334483 - protein, 19 aa, Cryptosporidium parvum
EVPTGWKYFGNLMDAKMID

SEQ ID NO: 2334484 - protein, 20 aa, Cryptosporidium parvum
EVQVGIFLGSPCIYENGNSG

SEQ ID NO: 2334485 - protein, 24 aa, Cryptosporidium parvum
EVTKFSVFQTIAWNELGELMKSSY

SEQ ID NO: 2334486 - protein, 22 aa, Cryptosporidium parvum
EVVAVKLLRLGPTSDLLEQFIN

SEQ ID NO: 2334487 - protein, 20 aa, Cryptosporidium parvum
EVVGFKFRITLVDKIGNSYF

SEQ ID NO: 2334488 - protein, 20 aa, Cryptosporidium parvum
EVVPKMALKFESLKYEDPKN

SEQ ID NO: 2334489 - protein, 18 aa, Cryptosporidium parvum
EVVVQCKSVAFPPNPKYN

SEQ ID NO: 2334490 - protein, 17 aa, Cryptosporidium parvum
EWCLPKFVENNPFDYNL

SEQ ID NO: 2334491 - protein, 20 aa, Cryptosporidium parvum
EWLEKTNAWELWNKAIYKLQ

SEQ ID NO: 2334492 - protein, 20 aa, Cryptosporidium parvum
EWTKQFVCFVDMCQMCCNTQ

SEQ ID NO: 2334493 - protein, 28 aa, Cryptosporidium parvum
EYLISFSMLLKRRFRKFIFKKYSPSRIR

SEQ ID NO: 2334494 - protein, 25 aa, Cryptosporidium parvum
EYLKKKIIFAESIHKKNLITLYLPF

SEQ ID NO: 2334495 - protein, 25 aa, Cryptosporidium parvum
EYSPEMVDFKLAKKYYADFPKDIYK

SEQ ID NO: 2334496 - protein, 18 aa, Cryptosporidium parvum
EYYIPVLMKLYPPSFDYQ

SEQ ID NO: 2334497 - protein, 17 aa, Cryptosporidium parvum
FAFSEPFIKQGKYPEIG

SEQ ID NO: 2334498 - protein, 19 aa, Cryptosporidium parvum
FAFTCPKGHVITHIHAKSN

SEQ ID NO: 2334499 - protein, 26 aa, Cryptosporidium parvum
FAGLKFLRQSHIPFLMAKEELNKLQG

SEQ ID NO: 2334500 - protein, 17 aa, Cryptosporidium parvum
FAIEICMIPSIWYLELI

SEQ ID NO: 2334501 - protein, 18 aa, Cryptosporidium parvum
FAILLLFGVFLTVSEASE

SEQ ID NO: 2334502 - protein, 17 aa, Cryptosporidium parvum
FALSFGKFRNIDLLQSG

SEQ ID NO: 2334503 - protein, 17 aa, Cryptosporidium parvum
FASFKLMSLYILKKIYK

SEQ ID NO: 2334504 - protein, 19 aa, Cryptosporidium parvum
FATFMGPFFITKRCIDLMH

SEQ ID NO: 2334505 - protein, 25 aa, Cryptosporidium parvum
FCEIKKARISLIEWAFNDIQSDLTR

SEQ ID NO: 2334506 - protein, 17 aa, Cryptosporidium parvum
FCNVLPVLPVVPISFPQ

SEQ ID NO: 2334507 - protein, 25 aa, Cryptosporidium parvum
FCQLMCLIKLLNLFNSLNVLFTTRQ

SEQ ID NO: 2334508 - protein, 20 aa, Cryptosporidium parvum
FDDFSGFDLLLGVYPSTTIK

SEQ ID NO: 2334509 - protein, 23 aa, Cryptosporidium parvum
FDEDKLGVIFLELLGDPEVTGLY

SEQ ID NO: 2334510 - protein, 23 aa, Cryptosporidium parvum
FDEDRRQFCSGKYSADSHTYSAG

SEQ ID NO: 2334511 - protein, 25 aa, Cryptosporidium parvum
FDGLKLSAQCNDCWAKTAHCGVKHC

SEQ ID NO: 2334512 - protein, 23 aa, Cryptosporidium parvum
FDGNEIHNLLGIIQSRNHNESSV

SEQ ID NO: 2334513 - protein, 17 aa, Cryptosporidium parvum
FDKKLKIWVRGNNNRIP

SEQ ID NO: 2334514 - protein, 21 aa, Cryptosporidium parvum
FDKTGFCPFSNVIIQHACTEL

SEQ ID NO: 2334515 - protein, 27 aa, Cryptosporidium parvum
FDLKLIYKPNCFERACFKKPEKVFFKN

SEQ ID NO: 2334516 - protein, 18 aa, Cryptosporidium parvum
FDLRFKHDVLSSYELYGF

SEQ ID NO: 2334517 - protein, 23 aa, Cryptosporidium parvum
FDNRNCPRCPIVGQYEVTIVSKS

SEQ ID NO: 2334518 - protein, 27 aa, Cryptosporidium parvum
FDRKSEFFKFFKPRSTPMSNLRVFFHG

SEQ ID NO: 2334519 - protein, 21 aa, Cryptosporidium parvum
FDVLKSSLFIVFFFEKSSLDT

SEQ ID NO: 2334520 - protein, 19 aa, Cryptosporidium parvum
FEDIQFLFNDFIARINLEF

SEQ ID NO: 2334521 - protein, 24 aa, Cryptosporidium parvum
FEFLRDIVRFLPFQWYSQYLTALA

SEQ ID NO: 2334522 - protein, 24 aa, Cryptosporidium parvum
FEFLYRMIDPRIKDAPYKISLMKY

SEQ ID NO: 2334523 - protein, 23 aa, Cryptosporidium parvum
FEHFKLSFTYTLHGDRNCTRLLL

SEQ ID NO: 2334524 - protein, 19 aa, Cryptosporidium parvum
FEIECMRELMKIGTQFTSE

SEQ ID NO: 2334525 - protein, 27 aa, Cryptosporidium parvum
FEIHHPPKLLFFFGSINKFEAYPSHLT

SEQ ID NO: 2334526 - protein, 18 aa, Cryptosporidium parvum
FEKFTYRYLSRVGIMVET

SEQ ID NO: 2334527 - protein, 20 aa, Cryptosporidium parvum
FEKLNLYGAGSRNEEVKSGQ

SEQ ID NO: 2334528 - protein, 25 aa, Cryptosporidium parvum
FEKRLSVCRRNEYNLKKIIYENKRG

SEQ ID NO: 2334529 - protein, 25 aa, Cryptosporidium parvum
FELFCKEIFSAGFIVDATIESYADP

SEQ ID NO: 2334530 - protein, 24 aa, Cryptosporidium parvum
FENWIKRFSKEYHENTFKNKKILA

SEQ ID NO: 2334531 - protein, 17 aa, Cryptosporidium parvum
FESFCSLVLALSKVEKK

SEQ ID NO: 2334532 - protein, 19 aa, Cryptosporidium parvum
FEVEVAKILYWRIKTDAEL

SEQ ID NO: 2334533 - protein, 26 aa, Cryptosporidium parvum
FFADVEPRLSVLYKLLVKISSTHNQV

SEQ ID NO: 2334534 - protein, 19 aa, Cryptosporidium parvum
FFDGTLIHWSLQYIFSQIY

SEQ ID NO: 2334535 - protein, 18 aa, Cryptosporidium parvum
FFDIYFLNPEKVFSKRDF

SEQ ID NO: 2334536 - protein, 17 aa, Cryptosporidium parvum
FFGCVFVSVYSGEEKAF

SEQ ID NO: 2334537 - protein, 19 aa, Cryptosporidium parvum
FFIGKSIFNLFLIPKIADL

SEQ ID NO: 2334538 - protein, 18 aa, Cryptosporidium parvum
FFKPKKRSFFHIHYYDIT

SEQ ID NO: 2334539 - protein, 20 aa, Cryptosporidium parvum
FFNRECVNALAAMSISKEYG

SEQ ID NO: 2334540 - protein, 29 aa, Cryptosporidium parvum
FFNSFFSNRVCLFETFKLIKENRNSQFMG

SEQ ID NO: 2334541 - protein, 23 aa, Cryptosporidium parvum
FFNSICWRILSTYPITFKTSIGI

SEQ ID NO: 2334542 - protein, 17 aa, Cryptosporidium parvum
FFVGKGIIIRNMKEIYK

SEQ ID NO: 2334543 - protein, 17 aa, Cryptosporidium parvum
FFYPNNILFIGYETCSL

SEQ ID NO: 2334544 - protein, 17 aa, Cryptosporidium parvum
FGASYYIWNDGGNPGSY

SEQ ID NO: 2334545 - protein, 23 aa, Cryptosporidium parvum
FGDWGEPTAILSAVSRSMANLAS

SEQ ID NO: 2334546 - protein, 18 aa, Cryptosporidium parvum
FGDWKDLWSPSSILNSNF

SEQ ID NO: 2334547 - protein, 24 aa, Cryptosporidium parvum
FGEDIPFVAVIPVGSKPGLNIFKQ

SEQ ID NO: 2334548 - protein, 21 aa, Cryptosporidium parvum
FGKIFESWDTPGLVNGVGNWR

SEQ ID NO: 2334549 - protein, 24 aa, Cryptosporidium parvum
FGLLILSCRAEEIEGEDIVKLVEN

SEQ ID NO: 2334550 - protein, 23 aa, Cryptosporidium parvum
FGLRLPPTHSKWYVFTRTADKWD

SEQ ID NO: 2334551 - protein, 17 aa, Cryptosporidium parvum
FGLVSVHSLSLRAGSQE

SEQ ID NO: 2334552 - protein, 18 aa, Cryptosporidium parvum
FGNMPFSYINTVKELPVG

SEQ ID NO: 2334553 - protein, 18 aa, Cryptosporidium parvum
FGNSSFKGLNNVDNDDFE

SEQ ID NO: 2334554 - protein, 19 aa, Cryptosporidium parvum
FGQVSDWLVKEHIKNSLNL

SEQ ID NO: 2334555 - protein, 18 aa, Cryptosporidium parvum
FGSTFGALLDSFALLVDS

SEQ ID NO: 2334556 - protein, 21 aa, Cryptosporidium parvum
FGVGFYASYLVSDRVTVISKN

SEQ ID NO: 2334557 - protein, 17 aa, Cryptosporidium parvum
FHNSCFGVLSFGLRGYL

SEQ ID NO: 2334558 - protein, 21 aa, Cryptosporidium parvum
FHTLILKICFGYFTVEIESLV

SEQ ID NO: 2334559 - protein, 19 aa, Cryptosporidium parvum
FIACILYFISLVSANGVCI

SEQ ID NO: 2334560 - protein, 31 aa, Cryptosporidium parvum
FIFICIFLVFCKLPYISRCEQLESEEISTGE

SEQ ID NO: 2334561 - protein, 19 aa, Cryptosporidium parvum
FIGGNEWDNVQGLKFLSFA

SEQ ID NO: 2334562 - protein, 27 aa, Cryptosporidium parvum
FIIALIISCLFCDIYAAEAPEENSPNN

SEQ ID NO: 2334563 - protein, 21 aa, Cryptosporidium parvum
FIIDLNEEFIRTALTSLITYY

SEQ ID NO: 2334564 - protein, 27 aa, Cryptosporidium parvum
FIIFLLSALCLAFVPNFAVLGAENETG

SEQ ID NO: 2334565 - protein, 17 aa, Cryptosporidium parvum
FIIPFVLSQSTLLNLGA

SEQ ID NO: 2334566 - protein, 25 aa, Cryptosporidium parvum
FIISVGDNFYRWGVSSVDDPIWENM

SEQ ID NO: 2334567 - protein, 18 aa, Cryptosporidium parvum
FIIYQFFFNSFFSNRVCL

SEQ ID NO: 2334568 - protein, 17 aa, Cryptosporidium parvum
FIKPVSMSHILKGCDHI

SEQ ID NO: 2334569 - protein, 22 aa, Cryptosporidium parvum
FILGFFLIFLGVHSESSLLPEG

SEQ ID NO: 2334570 - protein, 19 aa, Cryptosporidium parvum
FILLFNLLNLHSKHCIFSL

SEQ ID NO: 2334571 - protein, 25 aa, Cryptosporidium parvum
FILNNCIKIKFPYINKFLDEEISKN

SEQ ID NO: 2334572 - protein, 20 aa, Cryptosporidium parvum
FILSAIKSYPNIKCKNLPKE

SEQ ID NO: 2334573 - protein, 22 aa, Cryptosporidium parvum
FILSQFSEIFLKSSRKDITRRF

SEQ ID NO: 2334574 - protein, 24 aa, Cryptosporidium parvum
FIMIPEFDIDYFLNLDKLVISGNR

SEQ ID NO: 2334575 - protein, 17 aa, Cryptosporidium parvum
FIPIEILNWRARKPLFN

SEQ ID NO: 2334576 - protein, 19 aa, Cryptosporidium parvum
FIPKERIVIDIKRDSSELC

SEQ ID NO: 2334577 - protein, 26 aa, Cryptosporidium parvum
FIPPKGFENLPGFYGLYSSIGKSKAV

SEQ ID NO: 2334578 - protein, 20 aa, Cryptosporidium parvum
FIRYYCIKEKIQIRNLRASL

SEQ ID NO: 2334579 - protein, 17 aa, Cryptosporidium parvum
FISFLFLIFQYPSSISF

SEQ ID NO: 2334580 - protein, 19 aa, Cryptosporidium parvum
FITVVDWRQDLKYITPYTN

SEQ ID NO: 2334581 - protein, 17 aa, Cryptosporidium parvum
FIYSVSFFIKQYFIQIN

SEQ ID NO: 2334582 - protein, 25 aa, Cryptosporidium parvum
FKATSFPFKISVDYSEVVPGTNSHG

SEQ ID NO: 2334583 - protein, 21 aa, Cryptosporidium parvum
FKEEIPSGLLYYKILENEYLF

SEQ ID NO: 2334584 - protein, 31 aa, Cryptosporidium parvum; identical to SEQ ID NO: 2206624

SEQ ID NO: 2334585 - protein, 19 aa, Cryptosporidium parvum
FKFYSPIVFVRSIIRTKLS

SEQ ID NO: 2334586 - protein, 24 aa, Cryptosporidium parvum
FKHIVSVALAICYDTLRWQQATCV

SEQ ID NO: 2334587 - protein, 19 aa, Cryptosporidium parvum
FKIHGKLNFLLPLKHDRLF

SEQ ID NO: 2334588 - protein, 20 aa, Cryptosporidium parvum
FKISNLAGMSNWKYSILATV

SEQ ID NO: 2334589 - protein, 21 aa, Cryptosporidium parvum
FKITSRISIFNVLREIKPSLK

SEQ ID NO: 2334590 - protein, 21 aa, Cryptosporidium parvum
FKKKIEPVGEAFFYRYEVKYS

SEQ ID NO: 2334591 - protein, 20 aa, Cryptosporidium parvum
FKLMSLYILKKIYKVAYENP

SEQ ID NO: 2334592 - protein, 29 aa, Cryptosporidium parvum
FKMKIRRLKCLQFILLLLSFVSFKIFMFG

SEQ ID NO: 2334593 - protein, 22 aa, Cryptosporidium parvum
FKMPEFNWNLFSEKLVFTSKNF

SEQ ID NO: 2334594 - protein, 25 aa, Cryptosporidium parvum
FKNRLVLKGLILDEVCSGPYPGNQI

SEQ ID NO: 2334595 - protein, 19 aa, Cryptosporidium parvum
FKRGYRIGANSKKVDEFSD

SEQ ID NO: 2334596 - protein, 18 aa, Cryptosporidium parvum
FKRHECPKADGDSIKREP

SEQ ID NO: 2334597 - protein, 21 aa, Cryptosporidium parvum
FKSGYLFLTNFWLDMRSNFDN

SEQ ID NO: 2334598 - protein, 19 aa, Cryptosporidium parvum
FKSSYSMQALCETSFMSYY

SEQ ID NO: 2334599 - protein, 17 aa, Cryptosporidium parvum
FKTFSRLTINYLKSIIF

SEQ ID NO: 2334600 - protein, 17 aa, Cryptosporidium parvum
FKTSPTGYHVFKSNQSL

SEQ ID NO: 2334601 - protein, 27 aa, Cryptosporidium parvum
FKVSIFYFVLGLILDFGKVSCIPTGIS

SEQ ID NO: 2334602 - protein, 22 aa, Cryptosporidium parvum
FKWFFIATLVFIFGLLILSCRA

SEQ ID NO: 2334603 - protein, 17 aa, Cryptosporidium parvum
FKYIYPLGHAPSKVTFT

SEQ ID NO: 2334604 - protein, 18 aa, Cryptosporidium parvum
FLALDLFATYYLEYASSG

SEQ ID NO: 2334605 - protein, 17 aa, Cryptosporidium parvum
FLDKVIGGDARFTNIKG

SEQ ID NO: 2334606 - protein, 19 aa, Cryptosporidium parvum
FLETARLHNEVCKLLTGTD

SEQ ID NO: 2334607 - protein, 26 aa, Cryptosporidium parvum
FLFNDFIARINLEFQRSNRLNSKEFV

SEQ ID NO: 2334608 - protein, 17 aa, Cryptosporidium parvum
FLGFSCLSKVVLGGDEA

SEQ ID NO: 2334609 - protein, 23 aa, Cryptosporidium parvum
FLGNPRFTGGLQERIFSSFPAIF

SEQ ID NO: 2334610 - protein, 17 aa, Cryptosporidium parvum
FLILCVFTSGTPIPTPN

SEQ ID NO: 2334611 - protein, 18 aa, Cryptosporidium parvum
FLIVFLGSFTFCEQLGHN

SEQ ID NO: 2334612 - protein, 18 aa, Cryptosporidium parvum
FLKIYRYILNKIKNITKI

SEQ ID NO: 2334613 - protein, 19 aa, Cryptosporidium parvum
FLLFIKLGVFSLTINTSPK

SEQ ID NO: 2334614 - protein, 17 aa, Cryptosporidium parvum
FLLFLELQNAWSSLNLS

SEQ ID NO: 2334615 - protein, 19 aa, Cryptosporidium parvum
FLLKWIIFSYIVINNINGI

SEQ ID NO: 2334616 - protein, 18 aa, Cryptosporidium parvum
FLLLFFTKYLKITIGAEA

SEQ ID NO: 2334617 - protein, 27 aa, Cryptosporidium parvum
FLSKSNMPIPNFVPKAVPSFIAKQIGK

SEQ ID NO: 2334618 - protein, 25 aa, Cryptosporidium parvum
FLSKYRLLLKRSFDLYKKMSKSKFL

SEQ ID NO: 2334619 - protein, 17 aa, Cryptosporidium parvum
FLSQFQVIMGIVKIIRI

SEQ ID NO: 2334620 - protein, 17 aa, Cryptosporidium parvum
FLTPFIGLVLLLNFAHG

SEQ ID NO: 2334621 - protein, 17 aa, Cryptosporidium parvum
FLTSGYLIFSPVVFGIG

SEQ ID NO: 2334622 - protein, 17 aa, Cryptosporidium parvum
FLTYTLECINIGKTGGW

SEQ ID NO: 2334623 - protein, 17 aa, Cryptosporidium parvum
FLVGQIVQHLWWNYYGV

SEQ ID NO: 2334624 - protein, 17 aa, Cryptosporidium parvum
FLYPNGILYLGYDTCTF

SEQ ID NO: 2334625 - protein, 18 aa, Cryptosporidium parvum
FMPPDIANWLTSYKNYKF

SEQ ID NO: 2334626 - protein, 27 aa, Cryptosporidium parvum
FMSHCRSSGISFLLSRPVTKLLEQSIV

SEQ ID NO: 2334627 - protein, 25 aa, Cryptosporidium parvum
FNEPRKTCVIETFAPGFPGCAEGSV

SEQ ID NO: 2334628 - protein, 22 aa, Cryptosporidium parvum
FNFGKELLLDFEKLRISYNLPI

SEQ ID NO: 2334629 - protein, 21 aa, Cryptosporidium parvum
FNGRTNIVFLMKGLDLKLLKP

SEQ ID NO: 2334630 - protein, 17 aa, Cryptosporidium parvum
FNHFKYDPELDVLRKSF

SEQ ID NO: 2334631 - protein, 18 aa, Cryptosporidium parvum
FNHGEMLYKLSPNKYTPW

SEQ ID NO: 2334632 - protein, 19 aa, Cryptosporidium parvum
FNILKCPPEKVLSARSIYT

SEQ ID NO: 2334633 - protein, 25 aa, Cryptosporidium parvum
FNKAKEFLLLLSRNARLIENNLGSQ

SEQ ID NO: 2334634 - protein, 19 aa, Cryptosporidium parvum
FNKFRTYKKYSFGTANLAS

SEQ ID NO: 2334635 - protein, 19 aa, Cryptosporidium parvum
FNKICPLGFNLDTDGNCTK

SEQ ID NO: 2334636 - protein, 19 aa, Cryptosporidium parvum
FNKIIKCLGKYSINIYTRS

SEQ ID NO: 2334637 - protein, 20 aa, Cryptosporidium parvum
FNLLNLHSKHCIFSLTNKTA

SEQ ID NO: 2334638 - protein, 21 aa, Cryptosporidium parvum
FNLNEKFWYGYFFTNKDKAVL

SEQ ID NO: 2334639 - protein, 21 aa, Cryptosporidium parvum
FNPPCSNGKVSGIFRYTDNDN

SEQ ID NO: 2334640 - protein, 18 aa, Cryptosporidium parvum
FNPPRGSFNYLLPTNTPG

SEQ ID NO: 2334641 - protein, 27 aa, Cryptosporidium parvum
FNQGNCGSCYAVSSVYILAKRAELKLN

SEQ ID NO: 2334642 - protein, 20 aa, Cryptosporidium parvum
FNRRSILKLLPDIFKSNPID

SEQ ID NO: 2334643 - protein, 18 aa, Cryptosporidium parvum
FNSGISFMAILGPLRTFL

SEQ ID NO: 2334644 - protein, 27 aa, Cryptosporidium parvum
FNSHKCFLMLGFEVEFLENPILNNSGV

SEQ ID NO: 2334645 - protein, 17 aa, Cryptosporidium parvum
FNSINVFEYTAPSSNSD

SEQ ID NO: 2334646 - protein, 17 aa, Cryptosporidium parvum
FNSLIKIPTRNNFEFNK

SEQ ID NO: 2334647 - protein, 19 aa, Cryptosporidium parvum
FNSSSFKSIILGVNEFSNF

SEQ ID NO: 2334648 - protein, 18 aa, Cryptosporidium parvum
FNTELYFNSHKCFLMLGF

SEQ ID NO: 2334649 - protein, 18 aa, Cryptosporidium parvum
FNVAHTFGNATCNVDSTN

SEQ ID NO: 2334650 - protein, 28 aa, Cryptosporidium parvum
FNYKARISLRLEAQYSLAHSLIAAILTL

SEQ ID NO: 2334651 - protein, 21 aa, Cryptosporidium parvum
FPAPGYYRFQLKVRTPVETRK

SEQ ID NO: 2334652 - protein, 20 aa, Cryptosporidium parvum
FPAQMLKEDFPITIENLKEL

SEQ ID NO: 2334653 - protein, 23 aa, Cryptosporidium parvum
FPINSRYGSKIFLYLLTRLQGFT

SEQ ID NO: 2334654 - protein, 23 aa, Cryptosporidium parvum
FPISEIPSFIEFCEIVHSIFTDN

SEQ ID NO: 2334655 - protein, 21 aa, Cryptosporidium parvum
FPKPGSEIFSFYTYLSDSIDF

SEQ ID NO: 2334656 - protein, 20 aa, Cryptosporidium parvum
FPNPIKGFRNMFCKRLEKKY

SEQ ID NO: 2334657 - protein, 22 aa, Cryptosporidium parvum
FPPELVCPPGYTMEAGVAQGTR

SEQ ID NO: 2334658 - protein, 21 aa, Cryptosporidium parvum
FPRFEHSTELTILLDQQSVSN

SEQ ID NO: 2334659 - protein, 20 aa, Cryptosporidium parvum
FPSQHWLRTELPDILEQRAP

SEQ ID NO: 2334660 - protein, 17 aa, Cryptosporidium parvum
FPSSEISGSNFIINSKK

SEQ ID NO: 2334661 - protein, 23 aa, Cryptosporidium parvum
FPVSHKYPWSPFFNRGLNQWCVN

SEQ ID NO: 2334662 - protein, 17 aa, Cryptosporidium parvum
FQEIIDIVGIIDSKVSE

SEQ ID NO: 2334663 - protein, 19 aa, Cryptosporidium parvum
FQKVWIYRVSELLSACAQH

SEQ ID NO: 2334664 - protein, 19 aa, Cryptosporidium parvum
FQPGRAMGTPWPEKGPYEF

SEQ ID NO: 2334665 - protein, 22 aa, Cryptosporidium parvum
FQPKELIEGLSECSLHMFDICN

SEQ ID NO: 2334666 - protein, 25 aa, Cryptosporidium parvum
FQSCLKSVPDRWIPVGLNTTEFTFK

SEQ ID NO: 2334667 - protein, 24 aa, Cryptosporidium parvum
FQSFISWERIEIFKVSPTHSKNFG

SEQ ID NO: 2334668 - protein, 33 aa, Cryptosporidium parvum; identical to SEQ ID NO: 2206685

SEQ ID NO: 2334669 - protein, 25 aa, Cryptosporidium parvum
FREKYRYILNYLGYYYKIYQDFKEK

SEQ ID NO: 2334670 - protein, 20 aa, Cryptosporidium parvum
FRFIASVLLKRQEIFRLEDS

SEQ ID NO: 2334671 - protein, 28 aa, Cryptosporidium parvum
FRFILEEQNFCLKKYISHFPESLTQELK

SEQ ID NO: 2334672 - protein, 27 aa, Cryptosporidium parvum
FRILISGYPRSKWRGADFSTLAYRNSI

SEQ ID NO: 2334673 - protein, 17 aa, Cryptosporidium parvum
FRKYGIDYFKFMNEALK

SEQ ID NO: 2334674 - protein, 26 aa, Cryptosporidium parvum
FRLYMKSTKILPRSSVSTMDRRNACD

SEQ ID NO: 2334675 - protein, 18 aa, Cryptosporidium parvum
FRMVRDVAPRLGYLKPSS

SEQ ID NO: 2334676 - protein, 24 aa, Cryptosporidium parvum
FRNMFCKRLEKKYREYVADILQLR

SEQ ID NO: 2334677 - protein, 17 aa, Cryptosporidium parvum
FRYLYEQGYGRTKKRVI

SEQ ID NO: 2334678 - protein, 18 aa, Cryptosporidium parvum
FSCLIIKWNFSLSQDSLH

SEQ ID NO: 2334679 - protein, 26 aa, Cryptosporidium parvum
FSDFDFYWRKDFLCDTASKIIKFGIE

SEQ ID NO: 2334680 - protein, 25 aa, Cryptosporidium parvum
FSDPEPKCLPGFEFDNKSETCVNRS

SEQ ID NO: 2334681 - protein, 19 aa, Cryptosporidium parvum
FSELGRSRVHSVTESSIEA

SEQ ID NO: 2334682 - protein, 19 aa, Cryptosporidium parvum
FSETLFALQGFKIIEKQVS

SEQ ID NO: 2334683 - protein, 26 aa, Cryptosporidium parvum
FSGDEFKGLCGRVMHGSMLISSIGFE

SEQ ID NO: 2334684 - protein, 24 aa, Cryptosporidium parvum
FSGGNVVHFYGRFASPPTGGIINF

SEQ ID NO: 2334685 - protein, 21 aa, Cryptosporidium parvum
FSGLCPYPNPDEIVWLFNAFP

SEQ ID NO: 2334686 - protein, 17 aa, Cryptosporidium parvum
FSGSGPSLESWLSLQKS

SEQ ID NO: 2334687 - protein, 18 aa, Cryptosporidium parvum
FSKLYSFNPLKIKKYSQE

SEQ ID NO: 2334688 - protein, 18 aa, Cryptosporidium parvum
FSLAKCKASISLFSDIAI

SEQ ID NO: 2334689 - protein, 18 aa, Cryptosporidium parvum
FSLFSSALTAMFSKISFV

SEQ ID NO: 2334690 - protein, 18 aa, Cryptosporidium parvum
FSLGSHRRITEACRKIDP

SEQ ID NO: 2334691 - protein, 20 aa, Cryptosporidium parvum
FSMLVLESVIKILKNQRSKI

SEQ ID NO: 2334692 - protein, 21 aa, Cryptosporidium parvum
FSNIFKWDIGNSYQYAEPYLQ

SEQ ID NO: 2334693 - protein, 25 aa, Cryptosporidium parvum
FSNLRFLRKLIANFIGFQKFNVEIE

SEQ ID NO: 2334694 - protein, 28 aa, Cryptosporidium parvum
FSQFKYYMKMCLISFPAILGSKSKDFQE

SEQ ID NO: 2334695 - protein, 18 aa, Cryptosporidium parvum
FSRFTGFVSRTYRRLTSR

SEQ ID NO: 2334696 - protein, 19 aa, Cryptosporidium parvum
FSSLCYNVYRINNVANGIV

SEQ ID NO: 2334697 - protein, 20 aa, Cryptosporidium parvum
FSSLFCSYPYNQAGIEEAIL

SEQ ID NO: 2334698 - protein, 21 aa, Cryptosporidium parvum
FSSNGRYVLMNAKNVLEALPP

SEQ ID NO: 2334699 - protein, 23 aa, Cryptosporidium parvum
FSVFLSLFLAFPVRSSDEKKYDG

SEQ ID NO: 2334700 - protein, 17 aa, Cryptosporidium parvum
FSYDITMYSHFKILKSS

SEQ ID NO: 2334701 - protein, 18 aa, Cryptosporidium parvum
FSYPGAILEFERNRQWGV

SEQ ID NO: 2334702 - protein, 33 aa, Cryptosporidium parvum; identical to SEQ ID NO: 2206712

SEQ ID NO: 2334703 - protein, 26 aa, Cryptosporidium parvum
FTKYRPKIRELINFGQETLRVAEKYN

SEQ ID NO: 2334704 - protein, 24 aa, Cryptosporidium parvum
FTLDALRTGILVVRHEKNSEIFKQ

SEQ ID NO: 2334705 - protein, 25 aa, Cryptosporidium parvum
FTMPEKSCPPGFVFSGKQCVQSDTA

SEQ ID NO: 2334706 - protein, 23 aa, Cryptosporidium parvum
FTPSTLRAIFKLSIQADQEAVSV

SEQ ID NO: 2334707 - protein, 19 aa, Cryptosporidium parvum
FTSNFFLQEEFELEKSSSI

SEQ ID NO: 2334708 - protein, 26 aa, Cryptosporidium parvum
FTYPKNILFRGYETCTLYGDCKTVSK

SEQ ID NO: 2334709 - protein, 17 aa, Cryptosporidium parvum
FVCECPKGYTLDKNQQD

SEQ ID NO: 2334710 - protein, 18 aa, Cryptosporidium parvum
FVDAESKKNCKILASATP

SEQ ID NO: 2334711 - protein, 17 aa, Cryptosporidium parvum
FVDFKYYPICGTNGKTY

SEQ ID NO: 2334712 - protein, 24 aa, Cryptosporidium parvum
FVGHSLGGIIIRAALPHLHMFSSQ

SEQ ID NO: 2334713 - protein, 19 aa, Cryptosporidium parvum
FVIYPNLLFEQEICDLSII

SEQ ID NO: 2334714 - protein, 23 aa, Cryptosporidium parvum
FVLEAFKSVYLLFNAIKLSDDPN

SEQ ID NO: 2334715 - protein, 17 aa, Cryptosporidium parvum
FVLLLMHTLVSCEKFEE

SEQ ID NO: 2334716 - protein, 25 aa, Cryptosporidium parvum
FVNCHDPRYGLTIIKPPLYNYLFEL

SEQ ID NO: 2334717 - protein, 17 aa, Cryptosporidium parvum
FVRHTIFQGSYDMEEFQ

SEQ ID NO: 2334718 - protein, 17 aa, Cryptosporidium parvum
FVRPCNQLNCQVNCMNP

SEQ ID NO: 2334719 - protein, 17 aa, Cryptosporidium parvum
FVYRMIYYCTGRIILPK

SEQ ID NO: 2334720 - protein, 18 aa, Cryptosporidium parvum
FWLNYTALNSDSWKEIDF

SEQ ID NO: 2334721 - protein, 17 aa, Cryptosporidium parvum
FWYGYFFTNKDKAVLSI

SEQ ID NO: 2334722 - protein, 21 aa, Cryptosporidium parvum
FYEFKDFFSPIFRRNSRWSIV

SEQ ID NO: 2334723 - protein, 25 aa, Cryptosporidium parvum
FYIRLRSGQWFALKQQVEYDSSEMG

SEQ ID NO: 2334724 - protein, 18 aa, Cryptosporidium parvum
FYQMEFVEIFQLILHNTD

SEQ ID NO: 2334725 - protein, 25 aa, Cryptosporidium parvum
FYTDDCAACVTIIERLEKLNEEIGN

SEQ ID NO: 2334726 - protein, 17 aa, Cryptosporidium parvum
FYTIEMKELNGIVSEVF

SEQ ID NO: 2334727 - protein, 29 aa, Cryptosporidium parvum
FYYGLLAEMDFNFQFNWNDICLISESTIP

SEQ ID NO: 2334728 - protein, 24 aa, Cryptosporidium parvum
GAKEGRGRMKRRMKRRKMRRRMGR

SEQ ID NO: 2334729 - protein, 33 aa, Cryptosporidium parvum; identical to SEQ ID NO: 2206741

SEQ ID NO: 2334730 - protein, 18 aa, Cryptosporidium parvum
GANRGAWQTGVLRGLLGQ

SEQ ID NO: 2334731 - protein, 24 aa, Cryptosporidium parvum
GAPKKPPLPANWRLPLNNENHNRA

SEQ ID NO: 2334732 - protein, 18 aa, Cryptosporidium parvum
GARLMRFRIDRKTAGHPR

SEQ ID NO: 2334733 - protein, 27 aa, Cryptosporidium parvum
GARTPVKSFKCWEGYKQNWDCSDLKSL

SEQ ID NO: 2334734 - protein, 19 aa, Cryptosporidium parvum
GAVLLKAEKYYELFYNSEQ

SEQ ID NO: 2334735 - protein, 23 aa, Cryptosporidium parvum
GAYIKTRTTLKCFKNHPQESGAE

SEQ ID NO: 2334736 - protein, 21 aa, Cryptosporidium parvum
GCAPVEFPYCGTNGVTYINNC

SEQ ID NO: 2334737 - protein, 17 aa, Cryptosporidium parvum
GCSCTTAKCTGGECTPA

SEQ ID NO: 2334738 - protein, 17 aa, Cryptosporidium parvum
GCSIPCLSKIKNTFFSH

SEQ ID NO: 2334739 - protein, 23 aa, Cryptosporidium parvum
GDALMPVSSWISISVNRISGFIY

SEQ ID NO: 2334740 - protein, 22 aa, Cryptosporidium parvum
GDCGDCFAVTAATIITSRLWIK

SEQ ID NO: 2334741 - protein, 24 aa, Cryptosporidium parvum
GDLCNRRKTNISWDIEFKVTETYV

SEQ ID NO: 2334742 - protein, 22 aa, Cryptosporidium parvum
GDLGLPHLFDLRFKHDVLSSYE

SEQ ID NO: 2334743 - protein, 23 aa, Cryptosporidium parvum
GDRCALFTNKICPNGNCERLISK

SEQ ID NO: 2334744 - protein, 24 aa, Cryptosporidium parvum
GDRNCTRLLLHFVNKHTGSTLYKN

SEQ ID NO: 2334745 - protein, 20 aa, Cryptosporidium parvum
GDSFSDCLYMLHDVQNERPP

SEQ ID NO: 2334746 - protein, 23 aa, Cryptosporidium parvum
GDVFKYPHDIFVGVDNKDYDLSK

SEQ ID NO: 2334747 - protein, 23 aa, Cryptosporidium parvum
GEAIFPRLLDFRVSDACKVVSAM

SEQ ID NO: 2334748 - protein, 25 aa, Cryptosporidium parvum
GEEEKNIFGIYIFKNRMALQDFENF

SEQ ID NO: 2334749 - protein, 18 aa, Cryptosporidium parvum
GEEFKFRNCPGTLKNLLF

SEQ ID NO: 2334750 - protein, 23 aa, Cryptosporidium parvum
GEIGCSFHSIGWISGSRDLAVKY

SEQ ID NO: 2334751 - protein, 24 aa, Cryptosporidium parvum
GEILGRFRYRLSLLDHTLNFLQRI

SEQ ID NO: 2334752 - protein, 18 aa, Cryptosporidium parvum
GEKCKIAALLSNILDTNA

SEQ ID NO: 2334753 - protein, 24 aa, Cryptosporidium parvum
GELKELIDNIAMLRGMDFDLFGET

SEQ ID NO: 2334754 - protein, 18 aa, Cryptosporidium parvum
GELNRLFNKIKFEKNSKH

SEQ ID NO: 2334755 - protein, 19 aa, Cryptosporidium parvum
GEQLIRCDSSPMNLCGSDL

SEQ ID NO: 2334756 - protein, 21 aa, Cryptosporidium parvum
GESVLRPLLSDAIPNEYGTLD

SEQ ID NO: 2334757 - protein, 20 aa, Cryptosporidium parvum
GETPVSFAIVDHQPFQQDSS

SEQ ID NO: 2334758 - protein, 25 aa, Cryptosporidium parvum
GEYGHSYLLGSLFMRSYYTVYAKNI

SEQ ID NO: 2334759 - protein, 18 aa, Cryptosporidium parvum
GFASFGIIASSSQIIGQN

SEQ ID NO: 2334760 - protein, 24 aa, Cryptosporidium parvum
GFDKRGFRPITFHMMHDTSRMEFF

SEQ ID NO: 2334761 - protein, 18 aa, Cryptosporidium parvum
GFGGETPVSFAIVDHQPF

SEQ ID NO: 2334762 - protein, 18 aa, Cryptosporidium parvum
GFHYFLGLKDMYEQLKYI

SEQ ID NO: 2334763 - protein, 20 aa, Cryptosporidium parvum
GFKIRSRNSGFFKYSAESCN

SEQ ID NO: 2334764 - protein, 20 aa, Cryptosporidium parvum
GFKYGKKLPKELIKDLDKDL

SEQ ID NO: 2334765 - protein, 31 aa, Cryptosporidium parvum; identical to SEQ ID NO: 2206767

SEQ ID NO: 2334766 - protein, 19 aa, Cryptosporidium parvum
GFNPESFCKISDQFIIPAI

SEQ ID NO: 2334767 - protein, 22 aa, Cryptosporidium parvum
GFPGCAEGSVYYDLQTCIMAYQ

SEQ ID NO: 2334768 - protein, 18 aa, Cryptosporidium parvum
GFSARLLSNIILISNTLS

SEQ ID NO: 2334769 - protein, 22 aa, Cryptosporidium parvum
GFSLYMIFIFLLGNVASIHINR

SEQ ID NO: 2334770 - protein, 24 aa, Cryptosporidium parvum
GFSPRAFPTILFVKAGTRTPIPYD

SEQ ID NO: 2334771 - protein, 25 aa, Cryptosporidium parvum
GFVRDCRLFLSESFSNLLDLELLEL

SEQ ID NO: 2334772 - protein, 17 aa, Cryptosporidium parvum
GFYQFNAPFGYKNAVYK

SEQ ID NO: 2334773 - protein, 26 aa, Cryptosporidium parvum
GFYSSTLRRMLFRAADVGKIKEISLT

SEQ ID NO: 2334774 - protein, 23 aa, Cryptosporidium parvum
GGDGGFDFGGFGGFGGFGDFGGF

SEQ ID NO: 2334775 - protein, 31 aa, Cryptosporidium parvum
GGDRGKKKPVLRMMKSFPFKGSEKSSHCHHH

SEQ ID NO: 2334776 - protein, 23 aa, Cryptosporidium parvum
GGFSNRVALAVLQGGFYQFNAPF

SEQ ID NO: 2334777 - protein, 17 aa, Cryptosporidium parvum
GGGDCLYNSIISSLNLS

SEQ ID NO: 2334778 - protein, 20 aa, Cryptosporidium parvum
GGIRVPGVRALLDQYFGSFG

SEQ ID NO: 2334779 - protein, 24 aa, Cryptosporidium parvum
GGPIPCIEFRFLSIPEMDYDAKSY

SEQ ID NO: 2334780 - protein, 28 aa, Cryptosporidium parvum
GGSCSPARVRGARCVKHEILPNHHCAKE

SEQ ID NO: 2334781 - protein, 24 aa, Cryptosporidium parvum
GGSETALQWWVDYGDGGKKPKPVL

SEQ ID NO: 2334782 - protein, 18 aa, Cryptosporidium parvum
GGTICFYGGDILKIGDDM

SEQ ID NO: 2334783 - protein, 19 aa, Cryptosporidium parvum
GGTSLSGKVPEHFQYIFRR

SEQ ID NO: 2334784 - protein, 24 aa, Cryptosporidium parvum
GGVSLKSTYLSSVETLMENAKNLT

SEQ ID NO: 2334785 - protein, 20 aa, Cryptosporidium parvum
GHGNMVQWVGGPVNFDNMVD

SEQ ID NO: 2334786 - protein, 21 aa, Cryptosporidium parvum
GHGSESWLGGTLQNQENSLEE

SEQ ID NO: 2334787 - protein, 17 aa, Cryptosporidium parvum
GIDYEKLSKVSLYNLPP

SEQ ID NO: 2334788 - protein, 22 aa, Cryptosporidium parvum
GIFKTKVAPFLTEYHLSIKHEY

SEQ ID NO: 2334789 - protein, 21 aa, Cryptosporidium parvum
GIGAPFCQNSTFSLKYDYNHS

SEQ ID NO: 2334790 - protein, 19 aa, Cryptosporidium parvum
GIIEKRIGIGNSIILEMNL

SEQ ID NO: 2334791 - protein, 18 aa, Cryptosporidium parvum
GIILFLILHVLIKFKHVI

SEQ ID NO: 2334792 - protein, 24 aa, Cryptosporidium parvum
GIKKACIKFDYFRTSSCGNLVSNY

SEQ ID NO: 2334793 - protein, 19 aa, Cryptosporidium parvum
GILSRFGYTYLPKFKLGED

SEQ ID NO: 2334794 - protein, 27 aa, Cryptosporidium parvum
GINGTFPPFVKWPYRGGSGETLYLLNE

SEQ ID NO: 2334795 - protein, 27 aa, Cryptosporidium parvum
GIPRIKHKFEIATLFIQYFLQDVLNIL

SEQ ID NO: 2334796 - protein, 23 aa, Cryptosporidium parvum
GIQGNFPVMIVFSNRREVPNNVI

SEQ ID NO: 2334797 - protein, 18 aa, Cryptosporidium parvum
GISAGDGRELWKMGPNGQ

SEQ ID NO: 2334798 - protein, 25 aa, Cryptosporidium parvum
GISECELYLFSTCNGTSAKIMPEDA

SEQ ID NO: 2334799 - protein, 27 aa, Cryptosporidium parvum
GISGINWKGVKIMALKFLRGNGVGFLS

SEQ ID NO: 2334800 - protein, 17 aa, Cryptosporidium parvum
GITPSEVINPFIPTCVN

SEQ ID NO: 2334801 - protein, 27 aa, Cryptosporidium parvum
GIVKIRLKNLKMAFSKYCMPEEKRILF

SEQ ID NO: 2334802 - protein, 20 aa, Cryptosporidium parvum
GKALIRGSCISVNTTRLDSP

SEQ ID NO: 2334803 - protein, 30 aa, Cryptosporidium parvum
GKATMKDKIVKFFFEKRLKNYQEQCRKLAT

SEQ ID NO: 2334804 - protein, 23 aa, Cryptosporidium parvum
GKCVAGDCSHRCYCDECVAPRCQ

SEQ ID NO: 2334805 - protein, 23 aa, Cryptosporidium parvum
GKDGRLWSVEKYLSEPFIDRVLK

SEQ ID NO: 2334806 - protein, 26 aa, Cryptosporidium parvum
GKEFPRIGTSWITFKAPDTIGPQSSS

SEQ ID NO: 2334807 - protein, 22 aa, Cryptosporidium parvum
GKEIRIHASLLYLANYRTKKVV

SEQ ID NO: 2334808 - protein, 25 aa, Cryptosporidium parvum
GKHEIPMDVRIRFDDFSGFDLLLGV

SEQ ID NO: 2334809 - protein, 20 aa, Cryptosporidium parvum
GKHKNLCFIYLKNGEISLEE

SEQ ID NO: 2334810 - protein, 18 aa, Cryptosporidium parvum
GKKSSLRVRCLHSNKAKK

SEQ ID NO: 2334811 - protein, 20 aa, Cryptosporidium parvum
GKLSLLPSLALKINKNSKLS

SEQ ID NO: 2334812 - protein, 20 aa, Cryptosporidium parvum
GKRLYNCKTKNWEKYTTTPL

SEQ ID NO: 2334813 - protein, 19 aa, Cryptosporidium parvum
GKRNGIRIAPWKMIPDSMW

SEQ ID NO: 2334814 - protein, 18 aa, Cryptosporidium parvum
GKSEYSLLELVSQMTESE

SEQ ID NO: 2334815 - protein, 17 aa, Cryptosporidium parvum
GKTNFVLIGRDFSSFAL

SEQ ID NO: 2334816 - protein, 19 aa, Cryptosporidium parvum
GKVPEHFQYIFRRSYLLVY

SEQ ID NO: 2334817 - protein, 23 aa, Cryptosporidium parvum
GKVSPRIASVINTLVGQFEKLNL

SEQ ID NO: 2334818 - protein, 17 aa, Cryptosporidium parvum
GLAPVGGFSKIQELQAF

SEQ ID NO: 2334819 - protein, 45 aa, Cryptosporidium parvum
GLDDLRTHKILKYSTCIGELKHGEFCSLTCPVGYRMKDLTKMKSE

SEQ ID NO: 2334820 - protein, 20 aa, Cryptosporidium parvum
GLEFVVRGFSEFRTYKGVFS

SEQ ID NO: 2334821 - protein, 18 aa, Cryptosporidium parvum
GLGFLILAICLNVEVKSQ

SEQ ID NO: 2334822 - protein, 23 aa, Cryptosporidium parvum
GLGNNLPDLFGYSTFDIITSIET

SEQ ID NO: 2334823 - protein, 24 aa, Cryptosporidium parvum
GLILLGRGLSYPSLKPNVNPTGLI

SEQ ID NO: 2334824 - protein, 23 aa, Cryptosporidium parvum
GLKALMGCILLISGLLSIVDESF

SEQ ID NO: 2334825 - protein, 25 aa, Cryptosporidium parvum
GLNDVFMLIYLVGRLKGYYDDWKIV

SEQ ID NO: 2334826 - protein, 18 aa, Cryptosporidium parvum
GLNIYKLLISNRSIISTS

SEQ ID NO: 2334827 - protein, 23 aa, Cryptosporidium parvum
GLPSPRIAKKYIMTFVQSDPEDN

SEQ ID NO: 2334828 - protein, 24 aa, Cryptosporidium parvum
GLQPRCIFNTVASRVLERILRKYF

SEQ ID NO: 2334829 - protein, 19 aa, Cryptosporidium parvum
GLRMLESIRLFGVFHDSFR

SEQ ID NO: 2334830 - protein, 17 aa, Cryptosporidium parvum
GLSAWLYLDSREKPESY

SEQ ID NO: 2334831 - protein, 19 aa, Cryptosporidium parvum
GLSHTLSGLSLDDMKDTSE

SEQ ID NO: 2334832 - protein, 19 aa, Cryptosporidium parvum
GLSSGEWGNEFAINNILSS

SEQ ID NO: 2334833 - protein, 28 aa, Cryptosporidium parvum
GLTPIEFCGLSEKMILKGDVLNYFNIIC

SEQ ID NO: 2334834 - protein, 28 aa, Cryptosporidium parvum
GLVKEYSYFLSVYYRLRCENGNEYHDGT

SEQ ID NO: 2334835 - protein, 17 aa, Cryptosporidium parvum
GLVSIGFLERKANYDDY

SEQ ID NO: 2334836 - protein, 19 aa, Cryptosporidium parvum
GLVSTASFLPERAMKKLIS

SEQ ID NO: 2334837 - protein, 18 aa, Cryptosporidium parvum
GLVVKGEQLIRCDSSPMN

SEQ ID NO: 2334838 - protein, 21 aa, Cryptosporidium parvum
GLYDFCIDNSLSLSYQIYSTY

SEQ ID NO: 2334839 - protein, 20 aa, Cryptosporidium parvum
GLYRRIRVELRKKEEIKFIK

SEQ ID NO: 2334840 - protein, 17 aa, Cryptosporidium parvum
GMFPRFEHSTELTILLD

SEQ ID NO: 2334841 - protein, 18 aa, Cryptosporidium parvum
GMIPEELNGHYLDFLRRM

SEQ ID NO: 2334842 - protein, 24 aa, Cryptosporidium parvum
GMMHFFKKEMESLIRESSKPNSLI

SEQ ID NO: 2334843 - protein, 24 aa, Cryptosporidium parvum
GNDLTWETCYSIYSSVSMMLNSLQ

SEQ ID NO: 2334844 - protein, 17 aa, Cryptosporidium parvum
GNIKFYVRRVLITDHIE

SEQ ID NO: 2334845 - protein, 28 aa, Cryptosporidium parvum
GNILTRFPSSWKKYKWEKYLKSVLDHID

SEQ ID NO: 2334846 - protein, 18 aa, Cryptosporidium parvum
GNMDLFFSDVVALKKIIN

SEQ ID NO: 2334847 - protein, 25 aa, Cryptosporidium parvum
GNNVFSRLVGLRIRCGSKWRKTKLG

SEQ ID NO: 2334848 - protein, 25 aa, Cryptosporidium parvum
GNSECISCSYSLLPKSVQIGSTVLI

SEQ ID NO: 2334849 - protein, 17 aa, Cryptosporidium parvum
GNTGPKVPIIITSPQPI

SEQ ID NO: 2334850 - protein, 28 aa, Cryptosporidium parvum
GNTLGWYARPFNWWPMDPSITLHNAVKG

SEQ ID NO: 2334851 - protein, 21 aa, Cryptosporidium parvum
GPAPFRLAILAMLVSDFVTDN

SEQ ID NO: 2334852 - protein, 20 aa, Cryptosporidium parvum
GPDCKTVFVDFKYYPICGTN

SEQ ID NO: 2334853 - protein, 18 aa, Cryptosporidium parvum
GPIPNLFNIEGEFIEGIQ

SEQ ID NO: 2334854 - protein, 21 aa, Cryptosporidium parvum
GPISVCLHCFMGTISDCSSIS

SEQ ID NO: 2334855 - protein, 24 aa, Cryptosporidium parvum
GPNAGEITQGFSLAVKLGATKKDF

SEQ ID NO: 2334856 - protein, 24 aa, Cryptosporidium parvum
GPNFELTELLSAFNINNGLEDVLS

SEQ ID NO: 2334857 - protein, 27 aa, Cryptosporidium parvum
GPRVENRNYLTLPFTRDGHCEKGTIYN

SEQ ID NO: 2334858 - protein, 18 aa, Cryptosporidium parvum
GQCDPNCDTIECFYDKGD

SEQ ID NO: 2334859 - protein, 34 aa, Cryptosporidium parvum; identical to SEQ ID NO: 2206827

SEQ ID NO: 2334860 - protein, 17 aa, Cryptosporidium parvum
GQFGVGFYASYLVSDRV

SEQ ID NO: 2334861 - protein, 28 aa, Cryptosporidium parvum
GQGRRSKVIPGRLIIKYKEKVLSKAVKE

SEQ ID NO: 2334862 - protein, 18 aa, Cryptosporidium parvum
GQIPLCIGRETVPKQETC

SEQ ID NO: 2334863 - protein, 23 aa, Cryptosporidium parvum
GQLKDILPGYAFLDTNYIGGCFF

SEQ ID NO: 2334864 - protein, 21 aa, Cryptosporidium parvum
GREPYKFGLLSTMGSGKLYDM

SEQ ID NO: 2334865 - protein, 24 aa, Cryptosporidium parvum
GREVKRCEVRALSLKLKSEIYEGK

SEQ ID NO: 2334866 - protein, 20 aa, Cryptosporidium parvum
GRILKLKSNIQQGVVLNIKT

SEQ ID NO: 2334867 - protein, 27 aa, Cryptosporidium parvum
GRLFLPILVIFSFVWLSESVRLENYEI

SEQ ID NO: 2334868 - protein, 19 aa, Cryptosporidium parvum
GRLNPYFKSEEPPSEEDND

SEQ ID NO: 2334869 - protein, 17 aa, Cryptosporidium parvum
GRPSYRHFVNGVRNESN

SEQ ID NO: 2334870 - protein, 23 aa, Cryptosporidium parvum
GRSDAFCKMLRRNYNIVRKQVKN

SEQ ID NO: 2334871 - protein, 18 aa, Cryptosporidium parvum
GRVKCIPKNLIINKLIED

SEQ ID NO: 2334872 - protein, 23 aa, Cryptosporidium parvum
GRYSNVFFAWKIDLSPETKNKIG

SEQ ID NO: 2334873 - protein, 26 aa, Cryptosporidium parvum
GSDLVIYKSECDFLASKARLSDLTIL

SEQ ID NO: 2334874 - protein, 24 aa, Cryptosporidium parvum
GSFLCEIKTQIGLPPLKIYGKGSN

SEQ ID NO: 2334875 - protein, 27 aa, Cryptosporidium parvum
GSFVGRGKIPAGINLGSSINFVLVPSS

SEQ ID NO: 2334876 - protein, 17 aa, Cryptosporidium parvum
GSGKHFSEKICGPCKNI

SEQ ID NO: 2334877 - protein, 23 aa, Cryptosporidium parvum
GSIFQRNTLKGMGFFNKFIIMNN

SEQ ID NO: 2334878 - protein, 19 aa, Cryptosporidium parvum
GSIKDNCKIYRDENDDFEH

SEQ ID NO: 2334879 - protein, 26 aa, Cryptosporidium parvum
GSISRISKIPGFVRHTIFQGSYDMEE

SEQ ID NO: 2334880 - protein, 26 aa, Cryptosporidium parvum
GSKFEINRLITICAFINLSFEIFIDD

SEQ ID NO: 2334881 - protein, 23 aa, Cryptosporidium parvum
GSKLEFPTLINLFKVNNLTDDIY

SEQ ID NO: 2334882 - protein, 22 aa, Cryptosporidium parvum
GSLIPSEFWWKKIKGKSKEKNI

SEQ ID NO: 2334883 - protein, 35 aa, Cryptosporidium parvum
GSLTISSPCDGHLSFRLPLNHSFERSDIILSGKCL

SEQ ID NO: 2334884 - protein, 24 aa, Cryptosporidium parvum
GSPKMCYKATCVKKDCNHIAIHMV

SEQ ID NO: 2334885 - protein, 17 aa, Cryptosporidium parvum
GSQQPGINWEHFTEVLK

SEQ ID NO: 2334886 - protein, 24 aa, Cryptosporidium parvum
GSSAPEECKNEWVINRKNKKLEKP

SEQ ID NO: 2334887 - protein, 24 aa, Cryptosporidium parvum
GSSKIPLELGLKMFENSYIDVYKR

SEQ ID NO: 2334888 - protein, 21 aa, Cryptosporidium parvum
GSSRIPSLVLLEGYFSQIHSF

SEQ ID NO: 2334889 - protein, 19 aa, Cryptosporidium parvum
GTAGLARFCKKQGSDKIEQ

SEQ ID NO: 2334890 - protein, 17 aa, Cryptosporidium parvum
GTCSLGSVVDSDFNVRG

SEQ ID NO: 2334891 - protein, 22 aa, Cryptosporidium parvum
GTDFMIPSVVCFGTNENLSQQL

SEQ ID NO: 2334892 - protein, 26 aa, Cryptosporidium parvum
GTEIWSREFCEIVQGFKIDEISCNCK

SEQ ID NO: 2334893 - protein, 17 aa, Cryptosporidium parvum
GTFQEIIDIVGIIDSKV

SEQ ID NO: 2334894 - protein, 19 aa, Cryptosporidium parvum
GTIIEWEASGSILNERLNK

SEQ ID NO: 2334895 - protein, 25 aa, Cryptosporidium parvum
GTKRKRKSIGLVFRKSSYTDSFCSL

SEQ ID NO: 2334896 - protein, 21 aa, Cryptosporidium parvum
GTKSRALCTCAKKTLKELKDN

SEQ ID NO: 2334897 - protein, 17 aa, Cryptosporidium parvum
GTNRFARDLSFMDEAHV

SEQ ID NO: 2334898 - protein, 19 aa, Cryptosporidium parvum
GTPILARRAGFFSRNMIRP

SEQ ID NO: 2334899 - protein, 19 aa, Cryptosporidium parvum
GTPSFETSIHFGINLYVLT

SEQ ID NO: 2334900 - protein, 17 aa, Cryptosporidium parvum
GTTAIWDLKMKKSAISF

SEQ ID NO: 2334901 - protein, 26 aa, Cryptosporidium parvum
GVCNYPRKGMEWDIYTKTVNTKLNSG

SEQ ID NO: 2334902 - protein, 24 aa, Cryptosporidium parvum
GVDALKKVGGWLHKHRNSLPYWPS

SEQ ID NO: 2334903 - protein, 17 aa, Cryptosporidium parvum
GVDSCSIESGIASLRAY

SEQ ID NO: 2334904 - protein, 19 aa, Cryptosporidium parvum
GVEIWRRTLLSGKDEELCG

SEQ ID NO: 2334905 - protein, 19 aa, Cryptosporidium parvum
GVFVRVFVLLTDFMDTLMI

SEQ ID NO: 2334906 - protein, 22 aa, Cryptosporidium parvum
GVLFLILSWVGLVVPKLEIYIS

SEQ ID NO: 2334907 - protein, 31 aa, Cryptosporidium parvum
GVPLDFSEELFRIEILVSEALYNTGLSISNA

SEQ ID NO: 2334908 - protein, 17 aa, Cryptosporidium parvum
GVRLQIYLRNGFEGQVP

SEQ ID NO: 2334909 - protein, 20 aa, Cryptosporidium parvum
GVSGCSMANVYANNGKKVLL

SEQ ID NO: 2334910 - protein, 18 aa, Cryptosporidium parvum
GVVGWEFHPTLMEFEFPS

SEQ ID NO: 2334911 - protein, 19 aa, Cryptosporidium parvum
GWDLKKGKKSLALENELII

SEQ ID NO: 2334912 - protein, 17 aa, Cryptosporidium parvum
GWTLFILISTGIPIRDP

SEQ ID NO: 2334913 - protein, 25 aa, Cryptosporidium parvum
GWYITAFCRAVYFAEKDVCISKGVK

SEQ ID NO: 2334914 - protein, 20 aa, Cryptosporidium parvum
GYAKIRRGKNIGGIENQAVF

SEQ ID NO: 2334915 - protein, 18 aa, Cryptosporidium parvum
GYEDIPFPDGLRGSYYDN

SEQ ID NO: 2334916 - protein, 19 aa, Cryptosporidium parvum
GYELSGFRILISGYPRSKW

SEQ ID NO: 2334917 - protein, 32 aa, Cryptosporidium parvum
GYIERELTIGIGWSRLGLFIINDDHNSYIDIK

SEQ ID NO: 2334918 - protein, 20 aa, Cryptosporidium parvum
GYLSKLPTFQKFVSRHRKLA

SEQ ID NO: 2334919 - protein, 29 aa, Cryptosporidium parvum
GYNKCELFNSWAYKLLHRQSIIAYLQGNI

SEQ ID NO: 2334920 - protein, 19 aa, Cryptosporidium parvum
GYTAWFCGTNEDFAKYASN

SEQ ID NO: 2334921 - protein, 17 aa, Cryptosporidium parvum
GYVGGCYGCCDEDRMKE

SEQ ID NO: 2334922 - protein, 23 aa, Cryptosporidium parvum
HDDIRFLFWKMRDYSLQNPEMNL

SEQ ID NO: 2334923 - protein, 23 aa, Cryptosporidium parvum
HDPSNLHGLGFYLMNIMLSASNS

SEQ ID NO: 2334924 - protein, 17 aa, Cryptosporidium parvum
HDRLFLNKLLKSFYKSI

SEQ ID NO: 2334925 - protein, 21 aa, Cryptosporidium parvum
HEAAERIKVQMVNSGETEESA

SEQ ID NO: 2334926 - protein, 29 aa, Cryptosporidium parvum
HEYFSEALIKFCSYLKSFSPKRIHLDPAM

SEQ ID NO: 2334927 - protein, 17 aa, Cryptosporidium parvum
HFFGLVTMQKSLLFLTF

SEQ ID NO: 2334928 - protein, 17 aa, Cryptosporidium parvum
HFIRKLYSISYLIRRDL

SEQ ID NO: 2334929 - protein, 26 aa, Cryptosporidium parvum
HFKRPRKKVRFNLELNQEYPSEVIQR

SEQ ID NO: 2334930 - protein, 26 aa, Cryptosporidium parvum
HFNWKMGVPEGGYPVGHWTQVVRAAA

SEQ ID NO: 2334931 - protein, 30 aa, Cryptosporidium parvum; identical to SEQ ID NO: 2206879

SEQ ID NO: 2334932 - protein, 21 aa, Cryptosporidium parvum
HGDKVPFPPLHGSIGGRSGNV

SEQ ID NO: 2334933 - protein, 19 aa, Cryptosporidium parvum
HGLPKFLINKARYIQAYFI

SEQ ID NO: 2334934 - protein, 17 aa, Cryptosporidium parvum
HHRFIKASMGVKICANG

SEQ ID NO: 2334935 - protein, 17 aa, Cryptosporidium parvum
HIFKRLNVLTDKSIKEA

SEQ ID NO: 2334936 - protein, 21 aa, Cryptosporidium parvum
HIGCMFKLEGWVSGNSETIIS

SEQ ID NO: 2334937 - protein, 17 aa, Cryptosporidium parvum
HIIGVFIKAMRKIQKIN

SEQ ID NO: 2334938 - protein, 24 aa, Cryptosporidium parvum
HIKLELLPDMAFLIGDQRKRRGIP

SEQ ID NO: 2334939 - protein, 24 aa, Cryptosporidium parvum
HILILSVFCVLLFNIDLYNYCPHF

SEQ ID NO: 2334940 - protein, 23 aa, Cryptosporidium parvum
HIQLRWRVLDLAKHILNEKENKL

SEQ ID NO: 2334941 - protein, 22 aa, Cryptosporidium parvum
HIVEWLKRHILIEISNVDGNIP

SEQ ID NO: 2334942 - protein, 19 aa, Cryptosporidium parvum
HKDKIFFVIFEYNDDINNN

SEQ ID NO: 2334943 - protein, 38 aa, Cryptosporidium parvum
HKEKEKVASCKYLTFLLSELLKLFQFFGNSIKNLIKDF

SEQ ID NO: 2334944 - protein, 23 aa, Cryptosporidium parvum
HKHRNSLPYWPSINISPPKNRIT

SEQ ID NO: 2334945 - protein, 24 aa, Cryptosporidium parvum
HKTLRFLQEKIKSFSVDGDNVAKE

SEQ ID NO: 2334946 - protein, 23 aa, Cryptosporidium parvum
HKTSSSFEWGKLVETLRNHIRML

SEQ ID NO: 2334947 - protein, 17 aa, Cryptosporidium parvum
HKVKRIWTGVNGLCSTP

SEQ ID NO: 2334948 - protein, 22 aa, Cryptosporidium parvum
HKVVIPKAPKFQGEIEEVSERE

SEQ ID NO: 2334949 - protein, 26 aa, Cryptosporidium parvum
HLEIAPSLEGRDFFEAKLLERELIKI

SEQ ID NO: 2334950 - protein, 27 aa, Cryptosporidium parvum
HLETFVKMFGCKIYRSVPNVLEIVPQN

SEQ ID NO: 2334951 - protein, 22 aa, Cryptosporidium parvum
HLGNNYWLGFDFNHNDDKILSI

SEQ ID NO: 2334952 - protein, 24 aa, Cryptosporidium parvum
HLKPIRYIYPRGYAPSTSNFTQIL

SEQ ID NO: 2334953 - protein, 27 aa, Cryptosporidium parvum
HLTDPKLRIGLFKGYISLEEMQSRTII

SEQ ID NO: 2334954 - protein, 25 aa, Cryptosporidium parvum
HNTAAKRRALLFVQKYVKSIKLLHF

SEQ ID NO: 2334955 - protein, 22 aa, Cryptosporidium parvum
HNVVCSGPYPKDSIIDYGDTLK

SEQ ID NO: 2334956 - protein, 24 aa, Cryptosporidium parvum
HRLPNLKEKLVFISRSISILIYQN

SEQ ID NO: 2334957 - protein, 17 aa, Cryptosporidium parvum
HRLSELLVLPFGLWDSR

SEQ ID NO: 2334958 - protein, 19 aa, Cryptosporidium parvum
HSEICRLCGCDSTKNVNVE

SEQ ID NO: 2334959 - protein, 22 aa, Cryptosporidium parvum
HSGEIYLNIESWKGSNKGTKFT

SEQ ID NO: 2334960 - protein, 17 aa, Cryptosporidium parvum
HSIDFIPKIYLPYDSIV

SEQ ID NO: 2334961 - protein, 18 aa, Cryptosporidium parvum
HSIIGLTLICDGKPLNPV

SEQ ID NO: 2334962 - protein, 20 aa, Cryptosporidium parvum
HSINELILEFPIDYQEVLWD

SEQ ID NO: 2334963 - protein, 28 aa, Cryptosporidium parvum
HSNATDIGYLFGHLLDFSHKACVNIISY

SEQ ID NO: 2334964 - protein, 21 aa, Cryptosporidium parvum
HSYLRGYAMFNYRAMRIGYCV

SEQ ID NO: 2334965 - protein, 24 aa, Cryptosporidium parvum
HTCKNGYFSFDFNPPCSNGKVSGI

SEQ ID NO: 2334966 - protein, 17 aa, Cryptosporidium parvum
HTDCPKIVSNMLHSLSE

SEQ ID NO: 2334967 - protein, 19 aa, Cryptosporidium parvum
HTFLKDFICYSYLGGWIIY

SEQ ID NO: 2334968 - protein, 19 aa, Cryptosporidium parvum
HTLSPPLIRFSELGRSRVH

SEQ ID NO: 2334969 - protein, 22 aa, Cryptosporidium parvum
HVNNLFLRCEIVAITDKILKKQ

SEQ ID NO: 2334970 - protein, 24 aa, Cryptosporidium parvum
HYEKYWLPENMNLYIDSALDYRLF

SEQ ID NO: 2334971 - protein, 21 aa, Cryptosporidium parvum
HYYNICGGYSVYCNRWLFTNR

SEQ ID NO: 2334972 - protein, 20 aa, Cryptosporidium parvum
IACNACIYRPVVSNLNTHFY

SEQ ID NO: 2334973 - protein, 17 aa, Cryptosporidium parvum
IAEALLHEVDLRFFNRE

SEQ ID NO: 2334974 - protein, 23 aa, Cryptosporidium parvum
IAERHIIFLQAFIHHFSALSNIQ

SEQ ID NO: 2334975 - protein, 26 aa, Cryptosporidium parvum
IALKAECGYFEGFKNLIVDILDFLVE

SEQ ID NO: 2334976 - protein, 17 aa, Cryptosporidium parvum
IASKFGKDSKFRVFVSA

SEQ ID NO: 2334977 - protein, 23 aa, Cryptosporidium parvum
IATPSKSSIKWEKLEPQSLLFLS

SEQ ID NO: 2334978 - protein, 24 aa, Cryptosporidium parvum
ICFGIRSDKGIGYNVCTKNRNMRN

SEQ ID NO: 2334979 - protein, 19 aa, Cryptosporidium parvum
ICIRMDFWGSESCDKLPMT

SEQ ID NO: 2334980 - protein, 17 aa, Cryptosporidium parvum
ICKAFELMGDNPPREKC

SEQ ID NO: 2334981 - protein, 18 aa, Cryptosporidium parvum
ICQCYCSVSQYIFENGKM

SEQ ID NO: 2334982 - protein, 29 aa, Cryptosporidium parvum
ICSEYIWECIKRKLLFLGNGYDISNSNDL

SEQ ID NO: 2334983 - protein, 21 aa, Cryptosporidium parvum
ICSMTTFWSKICIKNNSNNYD

SEQ ID NO: 2334984 - protein, 21 aa, Cryptosporidium parvum
ICSSSLRWEKCPVKGSIKSKF

SEQ ID NO: 2334985 - protein, 19 aa, Cryptosporidium parvum
ICSTLSPGLNLEFETEIKS

SEQ ID NO: 2334986 - protein, 20 aa, Cryptosporidium parvum
IDAICPPEFLDNGKDCVKYS

SEQ ID NO: 2334987 - protein, 18 aa, Cryptosporidium parvum
IDFIPKIYLPYDSIVNAF

SEQ ID NO: 2334988 - protein, 17 aa, Cryptosporidium parvum
IDGFAHFDFLYKKLYDI

SEQ ID NO: 2334989 - protein, 23 aa, Cryptosporidium parvum
IDIHGRLGVFSNYGHRSVDMAAP

SEQ ID NO: 2334990 - protein, 19 aa, Cryptosporidium parvum
IDISIIYLFKNRLVLKGLI

SEQ ID NO: 2334991 - protein, 17 aa, Cryptosporidium parvum
IDISSRYSALLDSILSF

SEQ ID NO: 2334992 - protein, 25 aa, Cryptosporidium parvum
IDKEFYLHYLAVDFSLNYSLKTIYE

SEQ ID NO: 2334993 - protein, 17 aa, Cryptosporidium parvum
IDKEVKSKFNVKFSINL

SEQ ID NO: 2334994 - protein, 17 aa, Cryptosporidium parvum
IDLKCSFNDGVYYNTAI

SEQ ID NO: 2334995 - protein, 19 aa, Cryptosporidium parvum
IDLKLSSCLTYIINNQEST

SEQ ID NO: 2334996 - protein, 23 aa, Cryptosporidium parvum
IDLLRSSSCNLCLHEDDLNSSVI

SEQ ID NO: 2334997 - protein, 17 aa, Cryptosporidium parvum
IDLRGYRIISIHLESLL

SEQ ID NO: 2334998 - protein, 18 aa, Cryptosporidium parvum
IDLSFVWVPSALKSRNTH

SEQ ID NO: 2334999 - protein, 18 aa, Cryptosporidium parvum
IDNSLSLSYQIYSTYSLF

SEQ ID NO: 2335000 - protein, 22 aa, Cryptosporidium parvum
IDPIKRLPFRRDHTLPDTYRSS

SEQ ID NO: 2335001 - protein, 17 aa, Cryptosporidium parvum
IDQPREWNTPQYSSEKF

SEQ ID NO: 2335002 - protein, 19 aa, Cryptosporidium parvum
IDSICQKYSYYLNEYSEII

SEQ ID NO: 2335003 - protein, 22 aa, Cryptosporidium parvum
IDSICRLSVKWFENYPKFVKVL

SEQ ID NO: 2335004 - protein, 18 aa, Cryptosporidium parvum
IDSYRTIYRLLLDNMQLF

SEQ ID NO: 2335005 - protein, 18 aa, Cryptosporidium parvum
IDYNKLIDKFGCKLITKD

SEQ ID NO: 2335006 - protein, 17 aa, Cryptosporidium parvum
IEAWAEKFWNSGHAETH

SEQ ID NO: 2335007 - protein, 21 aa, Cryptosporidium parvum
IECPKGYKLDEEALLLLPPEH

SEQ ID NO: 2335008 - protein, 18 aa, Cryptosporidium parvum
IEDIPIKTLNAWKKTKFN

SEQ ID NO: 2335009 - protein, 19 aa, Cryptosporidium parvum
IEDYCKFAFRCISNGSNTL

SEQ ID NO: 2335010 - protein, 17 aa, Cryptosporidium parvum
IEFKCSYNKSGISQVTE

SEQ ID NO: 2335011 - protein, 20 aa, Cryptosporidium parvum
IEFSANITLSYEFSKQSSGL

SEQ ID NO: 2335012 - protein, 19 aa, Cryptosporidium parvum
IEGEDGIKIRVNEIEVERS

SEQ ID NO: 2335013 - protein, 21 aa, Cryptosporidium parvum
IEISTGLDFSGLKEFTINYLK

SEQ ID NO: 2335014 - protein, 18 aa, Cryptosporidium parvum
IEKLRGTYRSTLSKQFST

SEQ ID NO: 2335015 - protein, 17 aa, Cryptosporidium parvum
IELEGVLGLGFTQMSSS

SEQ ID NO: 2335016 - protein, 17 aa, Cryptosporidium parvum
IELILNYITAFFSKHII

SEQ ID NO: 2335017 - protein, 20 aa, Cryptosporidium parvum
IELPSSGGISDILSVDNLET

SEQ ID NO: 2335018 - protein, 18 aa, Cryptosporidium parvum
IENELSFTNYLYEIYMRA

SEQ ID NO: 2335019 - protein, 17 aa, Cryptosporidium parvum
IERLNLHLRIRNANIEK

SEQ ID NO: 2335020 - protein, 26 aa, Cryptosporidium parvum
IESAVYAELILKLIALFTADEVDTKY

SEQ ID NO: 2335021 - protein, 17 aa, Cryptosporidium parvum
IESKLKISQLRKEIKYL

SEQ ID NO: 2335022 - protein, 19 aa, Cryptosporidium parvum
IEVRYARLSDFIYLLKMIL

SEQ ID NO: 2335023 - protein, 25 aa, Cryptosporidium parvum
IEWFAVRDGILWVGSFGKEFVSNGI

SEQ ID NO: 2335024 - protein, 24 aa, Cryptosporidium parvum
IFCNFALIFCRRIPCEFEGNRDVR

SEQ ID NO: 2335025 - protein, 29 aa, Cryptosporidium parvum
IFGDLQIKFLVHFFRNRVVLLDPSHGLSC

SEQ ID NO: 2335026 - protein, 18 aa, Cryptosporidium parvum
IFGPRPWNLDFLSLDVIR

SEQ ID NO: 2335027 - protein, 19 aa, Cryptosporidium parvum
IFIQLSWVFGTESQNAKHR

SEQ ID NO: 2335028 - protein, 18 aa, Cryptosporidium parvum
IFIYTWLILFKKVDGSFL

SEQ ID NO: 2335029 - protein, 20 aa, Cryptosporidium parvum
IFKQFGRGFPTGGYESTSNS

SEQ ID NO: 2335030 - protein, 19 aa, Cryptosporidium parvum
IFLNESFILMYDWKNHQEY

SEQ ID NO: 2335031 - protein, 19 aa, Cryptosporidium parvum
IFLNSEFSKCINIDSNNNS

SEQ ID NO: 2335032 - protein, 18 aa, Cryptosporidium parvum
IFLSIIILFISCSTQLEL

SEQ ID NO: 2335033 - protein, 19 aa, Cryptosporidium parvum
IFLTIIRVLIFNAHVVACK

SEQ ID NO: 2335034 - protein, 18 aa, Cryptosporidium parvum
IFMGSGFGSQFSDSTTED

SEQ ID NO: 2335035 - protein, 17 aa, Cryptosporidium parvum
IFNGRPSYRHFVNGVRN

SEQ ID NO: 2335036 - protein, 18 aa, Cryptosporidium parvum
IFNMKQYIDFAARTNNSP

SEQ ID NO: 2335037 - protein, 25 aa, Cryptosporidium parvum
IFSRWRRQFMCIVMAISDIPKDVSL

SEQ ID NO: 2335038 - protein, 18 aa, Cryptosporidium parvum
IFTRDRFGSRDTLKTIPQ

SEQ ID NO: 2335039 - protein, 28 aa, Cryptosporidium parvum
IFVNDYLARLGIKFSILEEYCNNPSVIE

SEQ ID NO: 2335040 - protein, 18 aa, Cryptosporidium parvum
IGCSNGYSFISFGGSKLS

SEQ ID NO: 2335041 - protein, 17 aa, Cryptosporidium parvum
IGDEITLELVEEKIKKV

SEQ ID NO: 2335042 - protein, 26 aa, Cryptosporidium parvum
IGETKLKSLFGIEGEDGIKIRVNEIE

SEQ ID NO: 2335043 - protein, 25 aa, Cryptosporidium parvum
IGEVGCTYHALGWISGDVNVVAIDC

SEQ ID NO: 2335044 - protein, 22 aa, Cryptosporidium parvum
IGFNLASLFIGPGVGNFLSIDS

SEQ ID NO: 2335045 - protein, 25 aa, Cryptosporidium parvum
IGKEVIKIVKFFDNFSFGKEISSTI

SEQ ID NO: 2335046 - protein, 17 aa, Cryptosporidium parvum
IGLLEGFSKYFYSLSYE

SEQ ID NO: 2335047 - protein, 23 aa, Cryptosporidium parvum
IGLLRSRKCPFIIALNKIDRLYG

SEQ ID NO: 2335048 - protein, 20 aa, Cryptosporidium parvum
IGSSCPKCTFSDPINENNDD

SEQ ID NO: 2335049 - protein, 17 aa, Cryptosporidium parvum
IGTSLGGFVAMRIAQRF

SEQ ID NO: 2335050 - protein, 19 aa, Cryptosporidium parvum
IHFLLFFGISANNNRLSIK

SEQ ID NO: 2335051 - protein, 24 aa, Cryptosporidium parvum
IHIGSKLIWKIGFDSYYSIYLNVY

SEQ ID NO: 2335052 - protein, 17 aa, Cryptosporidium parvum
IHTVKVCPDGNCEQLIR

SEQ ID NO: 2335053 - protein, 23 aa, Cryptosporidium parvum
IIDAIECKHFYLSMVNKELPLQI

SEQ ID NO: 2335054 - protein, 23 aa, Cryptosporidium parvum
IIDFKYLLLFFGSRMELAAEVLL

SEQ ID NO: 2335055 - protein, 22 aa, Cryptosporidium parvum
IIEALDLLPGIVRAEIRIFFEL

SEQ ID NO: 2335056 - protein, 19 aa, Cryptosporidium parvum
IIELRRLVDEAAYFASKSE

SEQ ID NO: 2335057 - protein, 25 aa, Cryptosporidium parvum
IIFSILICKVRLEVVIENEDPKADM

SEQ ID NO: 2335058 - protein, 17 aa, Cryptosporidium parvum
IIFYNNINKNFLLGKIF

SEQ ID NO: 2335059 - protein, 17 aa, Cryptosporidium parvum
IIHGLGYVYSNVVMSKG

SEQ ID NO: 2335060 - protein, 18 aa, Cryptosporidium parvum
IIKAVVGFDSFIFDIAKN

SEQ ID NO: 2335061 - protein, 18 aa, Cryptosporidium parvum
IIKSACTEDIFLKIRNNI

SEQ ID NO: 2335062 - protein, 17 aa, Cryptosporidium parvum
IIKSELVTNSWLNLSKI

SEQ ID NO: 2335063 - protein, 19 aa, Cryptosporidium parvum
IILEFLLYRYKVLTEQYLE

SEQ ID NO: 2335064 - protein, 17 aa, Cryptosporidium parvum
IILLHSFDFVRSEAPNE

SEQ ID NO: 2335065 - protein, 17 aa, Cryptosporidium parvum
IIMVRFLCSDYITSFSI

SEQ ID NO: 2335066 - protein, 24 aa, Cryptosporidium parvum
IINNYKLGKNRNFSNSTVTNNIND

SEQ ID NO: 2335067 - protein, 18 aa, Cryptosporidium parvum
IIPLIDLALCIKGALQLN

SEQ ID NO: 2335068 - protein, 23 aa, Cryptosporidium parvum
IIRDLKLTWRLHYSSLKLRLIFR

SEQ ID NO: 2335069 - protein, 21 aa, Cryptosporidium parvum
IIRKLHDAISFGNSESKIKFG

SEQ ID NO: 2335070 - protein, 20 aa, Cryptosporidium parvum
IISFCLKFSSEIDCDNVSSS

SEQ ID NO: 2335071 - protein, 22 aa, Cryptosporidium parvum
IISILAVIAVFYSFTSTESDLA

SEQ ID NO: 2335072 - protein, 18 aa, Cryptosporidium parvum
IITTGVVGWEFHPTLMEF

SEQ ID NO: 2335073 - protein, 19 aa, Cryptosporidium parvum
IKAPKFILFSGHDLTVIPL

SEQ ID NO: 2335074 - protein, 17 aa, Cryptosporidium parvum
IKAVFGLHVQEWEDVAD

SEQ ID NO: 2335075 - protein, 22 aa, Cryptosporidium parvum
IKDAPYKISLMKYTYSALSSQS

SEQ ID NO: 2335076 - protein, 23 aa, Cryptosporidium parvum
IKDELKMGNIIWISTKVHNGNIG

SEQ ID NO: 2335077 - protein, 21 aa, Cryptosporidium parvum
IKDFIRNLFFVYYCKNPLVMN

SEQ ID NO: 2335078 - protein, 18 aa, Cryptosporidium parvum
IKDSCRNLALSGSIPKNI

SEQ ID NO: 2335079 - protein, 20 aa, Cryptosporidium parvum
IKDVDAINVFIKRENSKLST

SEQ ID NO: 2335080 - protein, 19 aa, Cryptosporidium parvum
IKDVGNLKNSVKIKNNPGE

SEQ ID NO: 2335081 - protein, 20 aa, Cryptosporidium parvum
IKEAREISEINLLEQVKNFY

SEQ ID NO: 2335082 - protein, 19 aa, Cryptosporidium parvum
IKELHVIYETLTIKLQSLS

SEQ ID NO: 2335083 - protein, 21 aa, Cryptosporidium parvum
IKEQIVRDVAALNAIVKLEAE

SEQ ID NO: 2335084 - protein, 19 aa, Cryptosporidium parvum
IKEYFPGPVERRHFVPACM

SEQ ID NO: 2335085 - protein, 23 aa, Cryptosporidium parvum
IKFFKSSALLKWLKNSRTDDFNY

SEQ ID NO: 2335086 - protein, 23 aa, Cryptosporidium parvum
IKFPDKLFYVIRYFNFIMILTEY

SEQ ID NO: 2335087 - protein, 23 aa, Cryptosporidium parvum
IKGIALQCGNSWLEEANLGLVGP

SEQ ID NO: 2335088 - protein, 20 aa, Cryptosporidium parvum
IKIEYKRLIVMAKDSSDKIA

SEQ ID NO: 2335089 - protein, 22 aa, Cryptosporidium parvum
IKIKFDELMGAYDGKIIVFTDN

SEQ ID NO: 2335090 - protein, 24 aa, Cryptosporidium parvum
IKILKLPSPQYFTASIKKGLLLNK

SEQ ID NO: 2335091 - protein, 19 aa, Cryptosporidium parvum
IKISLDLISFCLTYYQFEE

SEQ ID NO: 2335092 - protein, 19 aa, Cryptosporidium parvum
IKISSVMPNFSCPTDYKLR

SEQ ID NO: 2335093 - protein, 20 aa, Cryptosporidium parvum
IKIVDQYLCRKKGVENDLEY

SEQ ID NO: 2335094 - protein, 20 aa, Cryptosporidium parvum
IKKQLSFKCINKLRTLLDYT

SEQ ID NO: 2335095 - protein, 19 aa, Cryptosporidium parvum
IKKTIPIKLEKHILLQQQK

SEQ ID NO: 2335096 - protein, 18 aa, Cryptosporidium parvum
IKLFSKFVIKKNGKKGKN

SEQ ID NO: 2335097 - protein, 17 aa, Cryptosporidium parvum
IKLISFIFNDRYFFLEK

SEQ ID NO: 2335098 - protein, 17 aa, Cryptosporidium parvum
IKLKSGFYRPLAGTGGR

SEQ ID NO: 2335099 - protein, 21 aa, Cryptosporidium parvum
IKLNNELDVFLISRPGKHTYG

SEQ ID NO: 2335100 - protein, 24 aa, Cryptosporidium parvum
IKLTEKRLNPIFIGEKGNMLILPN

SEQ ID NO: 2335101 - protein, 24 aa, Cryptosporidium parvum
IKNDPSTVCSYAFSNEFVNSDFDT

SEQ ID NO: 2335102 - protein, 19 aa, Cryptosporidium parvum
IKNELKNASLTRTFYSKPS

SEQ ID NO: 2335103 - protein, 22 aa, Cryptosporidium parvum
IKPESCTLSFIKELIQKIEEIE

SEQ ID NO: 2335104 - protein, 24 aa, Cryptosporidium parvum
IKQILKYKFDYYFDVSPRQISKQI

SEQ ID NO: 2335105 - protein, 17 aa, Cryptosporidium parvum
IKQVRIFSNTMRSAVED

SEQ ID NO: 2335106 - protein, 17 aa, Cryptosporidium parvum
IKRERAWCVGIKEQTSY

SEQ ID NO: 2335107 - protein, 20 aa, Cryptosporidium parvum
IKSDIEFYEFVKKRLNILES

SEQ ID NO: 2335108 - protein, 17 aa, Cryptosporidium parvum
IKSKEFLDIKSMNNQNL

SEQ ID NO: 2335109 - protein, 21 aa, Cryptosporidium parvum
IKSKIDSIWFSLKYLSKDDVL

SEQ ID NO: 2335110 - protein, 25 aa, Cryptosporidium parvum
IKSREWIMIVNFYRPGCGPCKQLVQ

SEQ ID NO: 2335111 - protein, 26 aa, Cryptosporidium parvum
IKSYFRGVFKIGRIVWNREREILYSL

SEQ ID NO: 2335112 - protein, 18 aa, Cryptosporidium parvum
IKTLNAWKKTKFNEREEN

SEQ ID NO: 2335113 - protein, 17 aa, Cryptosporidium parvum
IKTSVLEKMYNIAKFGP

SEQ ID NO: 2335114 - protein, 18 aa, Cryptosporidium parvum
IKVPKFILFSGHDTTVIP

SEQ ID NO: 2335115 - protein, 24 aa, Cryptosporidium parvum
IKVSELLIEVPFFKSKLFSQNMYK

SEQ ID NO: 2335116 - protein, 26 aa, Cryptosporidium parvum
IKYAEKYLIMSIGFAFKRKITRNRST

SEQ ID NO: 2335117 - protein, 22 aa, Cryptosporidium parvum
ILADKSPNFWTRHLRGGNRKII

SEQ ID NO: 2335118 - protein, 22 aa, Cryptosporidium parvum
ILAFCSEVYYGVSTQDFKVRAE

SEQ ID NO: 2335119 - protein, 19 aa, Cryptosporidium parvum
ILDYLKWMSSESHVIVVLE

SEQ ID NO: 2335120 - protein, 22 aa, Cryptosporidium parvum
ILEGACTYFASYLNMASFSVFQ

SEQ ID NO: 2335121 - protein, 20 aa, Cryptosporidium parvum
ILEILGYFDIRILKDSSLIS

SEQ ID NO: 2335122 - protein, 18 aa, Cryptosporidium parvum
ILEKEFYIHESVFLFARE

SEQ ID NO: 2335123 - protein, 26 aa, Cryptosporidium parvum
ILEYPCPRSTPGLNWMISSKLVDTGL

SEQ ID NO: 2335124 - protein, 25 aa, Cryptosporidium parvum
ILGCKWCIVHQNILKNVLIYFELPQ

SEQ ID NO: 2335125 - protein, 17 aa, Cryptosporidium parvum
ILGSPLRLRSRVLKDEF

SEQ ID NO: 2335126 - protein, 26 aa, Cryptosporidium parvum
ILGVQARLLPLFSFVSRYSTINESYK

SEQ ID NO: 2335127 - protein, 30 aa, Cryptosporidium parvum
ILISYRALEFLQRFRFKRDYDISIIRTPKN

SEQ ID NO: 2335128 - protein, 24 aa, Cryptosporidium parvum
ILKTVKIKLYFLAKRVNVAYSTLY

SEQ ID NO: 2335129 - protein, 17 aa, Cryptosporidium parvum
ILLCEYSFSLGNIQNQF

SEQ ID NO: 2335130 - protein, 23 aa, Cryptosporidium parvum
ILLSALAIFEFCLGTDLTADLDS

SEQ ID NO: 2335131 - protein, 21 aa, Cryptosporidium parvum
ILLTYCNPDFVFPFRSAKKDI

SEQ ID NO: 2335132 - protein, 18 aa, Cryptosporidium parvum
ILNAISPFDTLFLVSDEQ

SEQ ID NO: 2335133 - protein, 18 aa, Cryptosporidium parvum
ILNHNIKLISFLHAEGGK

SEQ ID NO: 2335134 - protein, 18 aa, Cryptosporidium parvum
ILRGYFLFHDYFECKDLT

SEQ ID NO: 2335135 - protein, 25 aa, Cryptosporidium parvum
ILRKCPPNKIGLGPFKGVRSYETSE

SEQ ID NO: 2335136 - protein, 20 aa, Cryptosporidium parvum
ILRLRERALRDIKKGRRPNG

SEQ ID NO: 2335137 - protein, 23 aa, Cryptosporidium parvum
ILSELLKLMIIKKVHFGYNVIAK

SEQ ID NO: 2335138 - protein, 23 aa, Cryptosporidium parvum
ILSEYSYFLNIFYKLKCEHKHEY

SEQ ID NO: 2335139 - protein, 31 aa, Cryptosporidium parvum
ILSLHSSIIKFCFKFGIFYILKSQLNKKQEI

SEQ ID NO: 2335140 - protein, 17 aa, Cryptosporidium parvum
ILTEYLIRQGLKDIDAF

SEQ ID NO: 2335141 - protein, 23 aa, Cryptosporidium parvum
ILTKSLKFYFGFDSNQESNRQRN

SEQ ID NO: 2335142 - protein, 24 aa, Cryptosporidium parvum
IMGPSLRDVIKFFKSSALLKWLKN

SEQ ID NO: 2335143 - protein, 17 aa, Cryptosporidium parvum
INDLLILEAGFRRLVRL

SEQ ID NO: 2335144 - protein, 23 aa, Cryptosporidium parvum
INEIIKCRGGKNWITAQEHMIKM

SEQ ID NO: 2335145 - protein, 23 aa, Cryptosporidium parvum
INESKLNLGLITFYGFPKSKDSS

SEQ ID NO: 2335146 - protein, 17 aa, Cryptosporidium parvum
INEWWAVGVNFIGRNSS

SEQ ID NO: 2335147 - protein, 33 aa, Cryptosporidium parvum
INFAMSCIFEVDLLFKHLNLRNGSSYNSSDAIK

SEQ ID NO: 2335148 - protein, 17 aa, Cryptosporidium parvum
INFCKKVGLNILGVVEN

SEQ ID NO: 2335149 - protein, 28 aa, Cryptosporidium parvum
INFLPAKTLFGWREVLFDQAMESIGKYD

SEQ ID NO: 2335150 - protein, 20 aa, Cryptosporidium parvum
INFPFGARLMRFRIDRKTAG

SEQ ID NO: 2335151 - protein, 17 aa, Cryptosporidium parvum
INGDHLTWSLGIDHSYL

SEQ ID NO: 2335152 - protein, 19 aa, Cryptosporidium parvum
INGTSLLTDSKFNKLVNGR

SEQ ID NO: 2335153 - protein, 19 aa, Cryptosporidium parvum
INHPHFPPGIQAAPLNGSL

SEQ ID NO: 2335154 - protein, 23 aa, Cryptosporidium parvum
INIEEVKKFISFQKLKVERLEDM

SEQ ID NO: 2335155 - protein, 17 aa, Cryptosporidium parvum
INIELPSSGGISDILSV

SEQ ID NO: 2335156 - protein, 22 aa, Cryptosporidium parvum
INIRYHINRAFDILHFNIRGLS

SEQ ID NO: 2335157 - protein, 17 aa, Cryptosporidium parvum
INKEFYVSAYLYCESIR

SEQ ID NO: 2335158 - protein, 22 aa, Cryptosporidium parvum
INKLLKCILVLLTQIVEKKLFK

SEQ ID NO: 2335159 - protein, 25 aa, Cryptosporidium parvum
INKRSNIFLKIFISFKKIFFGCFNH

SEQ ID NO: 2335160 - protein, 17 aa, Cryptosporidium parvum
INLGDLISMKFIIEKEC

SEQ ID NO: 2335161 - protein, 18 aa, Cryptosporidium parvum
INLLPKVRKGGYQRFYRM

SEQ ID NO: 2335162 - protein, 25 aa, Cryptosporidium parvum
INLSEIEWLNERDIEDNKKIDETNL

SEQ ID NO: 2335163 - protein, 18 aa, Cryptosporidium parvum
INMGLKALMGCILLISGL

SEQ ID NO: 2335164 - protein, 20 aa, Cryptosporidium parvum
INPELLFKLIQTAILKNTNC

SEQ ID NO: 2335165 - protein, 25 aa, Cryptosporidium parvum
INPIKARELLLLFFINLGRTSAEEK

SEQ ID NO: 2335166 - protein, 18 aa, Cryptosporidium parvum
INPVYTIMSLGRYAGISI

SEQ ID NO: 2335167 - protein, 25 aa, Cryptosporidium parvum
INQAYCIRVEPRVTSLLNTPINENI

SEQ ID NO: 2335168 - protein, 21 aa, Cryptosporidium parvum
INYLKSIIFSISYIKTDSVNS

SEQ ID NO: 2335169 - protein, 19 aa, Cryptosporidium parvum
IPEIPGPPSRRGSGPISDR

SEQ ID NO: 2335170 - protein, 20 aa, Cryptosporidium parvum
IPGLSRYLLYTLLFGSLKKK

SEQ ID NO: 2335171 - protein, 25 aa, Cryptosporidium parvum
IPIFPTDIPQVFTIKSVPKAWDHIN

SEQ ID NO: 2335172 - protein, 17 aa, Cryptosporidium parvum
IPIKKKLFENFRKEVTV

SEQ ID NO: 2335173 - protein, 18 aa, Cryptosporidium parvum
IPILERIYYLNSTVALPM

SEQ ID NO: 2335174 - protein, 17 aa, Cryptosporidium parvum
IPINFKISNLAGMSNWK

SEQ ID NO: 2335175 - protein, 31 aa, Cryptosporidium parvum; identical to SEQ ID NO: 2207038

SEQ ID NO: 2335176 - protein, 19 aa, Cryptosporidium parvum
IPIPVRPGSNQGQSTPSFP

SEQ ID NO: 2335177 - protein, 25 aa, Cryptosporidium parvum
IPITAVRMWFVRKIEGNNVFSRLVG

SEQ ID NO: 2335178 - protein, 26 aa, Cryptosporidium parvum
IPKEFKYSNGVLKKFIQYCRRGIRSL

SEQ ID NO: 2335179 - protein, 25 aa, Cryptosporidium parvum
IPKNRPDGLPSISFIGIENEVMPLH

SEQ ID NO: 2335180 - protein, 21 aa, Cryptosporidium parvum
IPKSRGSITLDEMGLPEINSS

SEQ ID NO: 2335181 - protein, 23 aa, Cryptosporidium parvum
IPKYRGCYVKGILQPSRAIGDFR

SEQ ID NO: 2335182 - protein, 21 aa, Cryptosporidium parvum
IPLGFSPLRVLPPSNFPKTGY

SEQ ID NO: 2335183 - protein, 20 aa, Cryptosporidium parvum
IPLVLCLAFLSNFLGIHDQI

SEQ ID NO: 2335184 - protein, 24 aa, Cryptosporidium parvum
IPNGEIPYGITFEGLHRKPTSTVL

SEQ ID NO: 2335185 - protein, 21 aa, Cryptosporidium parvum
IPNKLGISIPRLLKKMYKKYY

SEQ ID NO: 2335186 - protein, 26 aa, Cryptosporidium parvum
IPSKDEAWWNVSYNVRKEPRRMDYSE

SEQ ID NO: 2335187 - protein, 20 aa, Cryptosporidium parvum
IPSLELPGGSKLNVEPLINL

SEQ ID NO: 2335188 - protein, 18 aa, Cryptosporidium parvum
IPSLTYYSPLLFFSKDQN

SEQ ID NO: 2335189 - protein, 27 aa, Cryptosporidium parvum
IPSWYHKPCGVNFTFSGKLVSFSSKST

SEQ ID NO: 2335190 - protein, 18 aa, Cryptosporidium parvum
IPTDVSIQIERKLGGPLK

SEQ ID NO: 2335191 - protein, 23 aa, Cryptosporidium parvum
IPTRNNFEFNKITKLVHDNIPLN

SEQ ID NO: 2335192 - protein, 29 aa, Cryptosporidium parvum
IPVDDSGACFKRIILWHYEKVELIKNDRS

SEQ ID NO: 2335193 - protein, 21 aa, Cryptosporidium parvum
IPYFRRPAIPKSRINYSNVRR

SEQ ID NO: 2335194 - protein, 21 aa, Cryptosporidium parvum
IPYWIIRNSWGANWGKKGYAK

SEQ ID NO: 2335195 - protein, 21 aa, Cryptosporidium parvum
IQFDFKKCLDDLFQIKIEKIQ

SEQ ID NO: 2335196 - protein, 18 aa, Cryptosporidium parvum
IQFTHTWVQNSTFAEVKS

SEQ ID NO: 2335197 - protein, 26 aa, Cryptosporidium parvum
IQGNCLGGIIGIAAALGMKSNIGAVA

SEQ ID NO: 2335198 - protein, 25 aa, Cryptosporidium parvum
IQILVFSCLLCFFAAVESSVNKIDT

SEQ ID NO: 2335199 - protein, 17 aa, Cryptosporidium parvum
IQKRNILLYGITMNNNH

SEQ ID NO: 2335200 - protein, 18 aa, Cryptosporidium parvum
IQRPRGWMIKKTYGKKAL

SEQ ID NO: 2335201 - protein, 19 aa, Cryptosporidium parvum
IQSICPSEYVLSPNMKKCI

SEQ ID NO: 2335202 - protein, 17 aa, Cryptosporidium parvum
IQSYAALRYKFADKAVI

SEQ ID NO: 2335203 - protein, 17 aa, Cryptosporidium parvum
IQVLIQLVLICFFILLG

SEQ ID NO: 2335204 - protein, 17 aa, Cryptosporidium parvum
IQYCRRGIRSLAYERYI

SEQ ID NO: 2335205 - protein, 17 aa, Cryptosporidium parvum
IREIFLLEKDHAIHRPY

SEQ ID NO: 2335206 - protein, 17 aa, Cryptosporidium parvum
IRFELINKQFLYPNEIL

SEQ ID NO: 2335207 - protein, 23 aa, Cryptosporidium parvum
IRGDEFNAFLILEKTQESDYSKN

SEQ ID NO: 2335208 - protein, 17 aa, Cryptosporidium parvum
IRLFGVFHDSFRNLLKK

SEQ ID NO: 2335209 - protein, 17 aa, Cryptosporidium parvum
IRLVDAIQNLRSKKYNK

SEQ ID NO: 2335210 - protein, 20 aa, Cryptosporidium parvum
IRPNTEYDLFCFSEEVSRII

SEQ ID NO: 2335211 - protein, 19 aa, Cryptosporidium parvum
IRSQFKWDGPNSKITFESK

SEQ ID NO: 2335212 - protein, 22 aa, Cryptosporidium parvum
IRSTRIATILLFIKEILLSFSE

SEQ ID NO: 2335213 - protein, 26 aa, Cryptosporidium parvum
IRTLLHIPSFLGMCGNDIDVTKTTGE

SEQ ID NO: 2335214 - protein, 19 aa, Cryptosporidium parvum
IRVELRKKEEIKFIKEVSK

SEQ ID NO: 2335215 - protein, 19 aa, Cryptosporidium parvum
ISCLILVALLQYATGDQKA

SEQ ID NO: 2335216 - protein, 25 aa, Cryptosporidium parvum
ISECDLYLFSTCNATSAKIMPEDTI

SEQ ID NO: 2335217 - protein, 25 aa, Cryptosporidium parvum
ISECDLYLFSTCNATSAKIMPEDTT

SEQ ID NO: 2335218 - protein, 25 aa, Cryptosporidium parvum
ISECDLYLFSTCNATSAKIMPEDVT

SEQ ID NO: 2335219 - protein, 25 aa, Cryptosporidium parvum
ISECDLYLFSTCNATSTKFMPDGTI

SEQ ID NO: 2335220 - protein, 24 aa, Cryptosporidium parvum
ISECDLYLFSTCNGTSAKIMPEDA

SEQ ID NO: 2335221 - protein, 18 aa, Cryptosporidium parvum
ISEIGGPFVFVDTKEKYS

SEQ ID NO: 2335222 - protein, 24 aa, Cryptosporidium parvum
ISIKELRDALNYKIGTWTPTQNEW

SEQ ID NO: 2335223 - protein, 19 aa, Cryptosporidium parvum
ISKAFRYLYEQGYGRTKKR

SEQ ID NO: 2335224 - protein, 38 aa, Cryptosporidium parvum
ISKEDIETWMNLPLKLKLPVINYYFLLVATMGQSSEKE

SEQ ID NO: 2335225 - protein, 23 aa, Cryptosporidium parvum
ISKFKSGEFEKELKKVNKIEREY

SEQ ID NO: 2335226 - protein, 17 aa, Cryptosporidium parvum
ISKNLAKNGYRALRFDF

SEQ ID NO: 2335227 - protein, 25 aa, Cryptosporidium parvum
ISLCKYELSNLLTLIKKLNLKARQL

SEQ ID NO: 2335228 - protein, 25 aa, Cryptosporidium parvum
ISLKPKDTFFKQGWTLFVMLNNGIP

SEQ ID NO: 2335229 - protein, 17 aa, Cryptosporidium parvum
ISMNIYSSFVLDFQESD

SEQ ID NO: 2335230 - protein, 23 aa, Cryptosporidium parvum
ISNDGYYWMGYNFMKDNDPVFTL

SEQ ID NO: 2335231 - protein, 25 aa, Cryptosporidium parvum
ISNKEFKTIPGVILILRTSDDIPPN

SEQ ID NO: 2335232 - protein, 19 aa, Cryptosporidium parvum
ISNPLPFDLAKIVRHPHLG

SEQ ID NO: 2335233 - protein, 21 aa, Cryptosporidium parvum
ISPKKAYLIWKETLIAMNFAI

SEQ ID NO: 2335234 - protein, 18 aa, Cryptosporidium parvum
ISQLIPAWIEALTMMTEG

SEQ ID NO: 2335235 - protein, 18 aa, Cryptosporidium parvum
ISQLRSNFGSTFGALLDS

SEQ ID NO: 2335236 - protein, 17 aa, Cryptosporidium parvum
ISQSLKFIQEFSPDYVY

SEQ ID NO: 2335237 - protein, 19 aa, Cryptosporidium parvum
ISQVFLRYLGVPFIKENDF

SEQ ID NO: 2335238 - protein, 20 aa, Cryptosporidium parvum
ISRESILGVRWLEEIHSHIY

SEQ ID NO: 2335239 - protein, 22 aa, Cryptosporidium parvum
ISRTEMSVGMYINDSVDENERF

SEQ ID NO: 2335240 - protein, 28 aa, Cryptosporidium parvum
ISSSKSKLLRRVLEMKLKRVNHKISKIT

SEQ ID NO: 2335241 - protein, 20 aa, Cryptosporidium parvum
ISSVSFVYRMIYYCTGRIIL

SEQ ID NO: 2335242 - protein, 27 aa, Cryptosporidium parvum
ISTCLKEGCAYFIGRSASMTPVLVIRA

SEQ ID NO: 2335243 - protein, 17 aa, Cryptosporidium parvum
ISTKIEDYCKFAFRCIS

SEQ ID NO: 2335244 - protein, 30 aa, Cryptosporidium parvum
ISTQVIRDKFSWNRVHRIGRYDSMPIVFPS

SEQ ID NO: 2335245 - protein, 24 aa, Cryptosporidium parvum
ISVNRISGFIYFTLNDQIFASFPD

SEQ ID NO: 2335246 - protein, 21 aa, Cryptosporidium parvum
ISVPPRVLISTNFSEEQEKNE

SEQ ID NO: 2335247 - protein, 28 aa, Cryptosporidium parvum
ISVSDKIKWSIGFGKNYLLYLNVYDLNN

SEQ ID NO: 2335248 - protein, 19 aa, Cryptosporidium parvum
ITCVGRLSLSQSEFRIFKS

SEQ ID NO: 2335249 - protein, 27 aa, Cryptosporidium parvum
ITDQLIKWRLELIPSILNIFQSPLSKL

SEQ ID NO: 2335250 - protein, 21 aa, Cryptosporidium parvum
ITGFGPHRHGDFIVSSTGEAL

SEQ ID NO: 2335251 - protein, 18 aa, Cryptosporidium parvum
ITHLESVKSWSLENDAKH

SEQ ID NO: 2335252 - protein, 17 aa, Cryptosporidium parvum
ITKSWWLNISKLSDPTI

SEQ ID NO: 2335253 - protein, 20 aa, Cryptosporidium parvum
ITKYAKERILAITLESNEGF

SEQ ID NO: 2335254 - protein, 22 aa, Cryptosporidium parvum
ITNEWMGNSLIEYLTNKRITKN

SEQ ID NO: 2335255 - protein, 20 aa, Cryptosporidium parvum
ITNLEHWPKIMLTPELSQVI

SEQ ID NO: 2335256 - protein, 23 aa, Cryptosporidium parvum
ITNTLCYSVSGFSNMTSVSIPAG

SEQ ID NO: 2335257 - protein, 23 aa, Cryptosporidium parvum
ITNTRIFSMKSFGRTVVPSYSQK

SEQ ID NO: 2335258 - protein, 17 aa, Cryptosporidium parvum
ITPLRMIIEGVGGRSED

SEQ ID NO: 2335259 - protein, 19 aa, Cryptosporidium parvum
ITREFWKTYGRNYYTRFDY

SEQ ID NO: 2335260 - protein, 17 aa, Cryptosporidium parvum
ITRNCYRLIRYFQKSGI

SEQ ID NO: 2335261 - protein, 18 aa, Cryptosporidium parvum
ITSGPWGQSAYMQKIQKA

SEQ ID NO: 2335262 - protein, 20 aa, Cryptosporidium parvum
ITSTESFNLPNITNLTNGSL

SEQ ID NO: 2335263 - protein, 20 aa, Cryptosporidium parvum
ITWQLIMGVVRRIKPTGQAK

SEQ ID NO: 2335264 - protein, 25 aa, Cryptosporidium parvum
IVDFALKYNLDFIALSFVQNGADVQ

SEQ ID NO: 2335265 - protein, 22 aa, Cryptosporidium parvum
IVDGRLFLNMNMTFVNQSNNTF

SEQ ID NO: 2335266 - protein, 23 aa, Cryptosporidium parvum
IVDRLLFAIPFFFKSDVFTNPFV

SEQ ID NO: 2335267 - protein, 17 aa, Cryptosporidium parvum
IVKIIRIKMEEINSRLN

SEQ ID NO: 2335268 - protein, 19 aa, Cryptosporidium parvum
IVKPKVTSIFYGKNKPSVC

SEQ ID NO: 2335269 - protein, 26 aa, Cryptosporidium parvum
IVLFSYKSLFSLRVCQKDGSWSDIKV

SEQ ID NO: 2335270 - protein, 18 aa, Cryptosporidium parvum
IVLLPLFFISYFQQTLND

SEQ ID NO: 2335271 - protein, 18 aa, Cryptosporidium parvum
IVLLSIILLHSFDFVRSE

SEQ ID NO: 2335272 - protein, 17 aa, Cryptosporidium parvum
IVNEFLKSESISKISEL

SEQ ID NO: 2335273 - protein, 21 aa, Cryptosporidium parvum
IVPDVNFKPSFIFVPPTPNNR

SEQ ID NO: 2335274 - protein, 24 aa, Cryptosporidium parvum
IVPPKPAARRIFQASGAQGITQPT

SEQ ID NO: 2335275 - protein, 28 aa, Cryptosporidium parvum
IVPTHKIYLAINFFFPFENKKMASIRST

SEQ ID NO: 2335276 - protein, 26 aa, Cryptosporidium parvum
IVRAEIRIFFELNTKYGYYRINTLEK

SEQ ID NO: 2335277 - protein, 17 aa, Cryptosporidium parvum
IVRGFCTEAGMMHFFKK

SEQ ID NO: 2335278 - protein, 22 aa, Cryptosporidium parvum
IVSALYKLCHFPLFDTQRTNLI

SEQ ID NO: 2335279 - protein, 24 aa, Cryptosporidium parvum
IVSKFELQKGFVLPANQLFIGYET

SEQ ID NO: 2335280 - protein, 20 aa, Cryptosporidium parvum
IVVESSSFIRPGGNEMNQLN

SEQ ID NO: 2335281 - protein, 17 aa, Cryptosporidium parvum
IVVKACQAQCSHRFDTD

SEQ ID NO: 2335282 - protein, 24 aa, Cryptosporidium parvum
IWDEHWPPYASTFIIEIYNNPILS

SEQ ID NO: 2335283 - protein, 24 aa, Cryptosporidium parvum
IWDLKMKKSAISFRDPAQRSRPST

SEQ ID NO: 2335284 - protein, 18 aa, Cryptosporidium parvum
IWFSLKYLSKDDVLVKKN

SEQ ID NO: 2335285 - protein, 20 aa, Cryptosporidium parvum
IWKNYFESIYSTAFELQNIP

SEQ ID NO: 2335286 - protein, 24 aa, Cryptosporidium parvum
IWLFYLFFGPCLGLRANTTHKLAI

SEQ ID NO: 2335287 - protein, 18 aa, Cryptosporidium parvum
IWSFPARLISPVKQPLIY

SEQ ID NO: 2335288 - protein, 19 aa, Cryptosporidium parvum
IYGNYLPSLNFYHFNNFCE

SEQ ID NO: 2335289 - protein, 17 aa, Cryptosporidium parvum
IYIELTINGIKNIEYIL

SEQ ID NO: 2335290 - protein, 23 aa, Cryptosporidium parvum
IYKISPRESLVAFQQWKAIILQM

SEQ ID NO: 2335291 - protein, 27 aa, Cryptosporidium parvum
IYLETGCVLMGGLIAFGSSPFMINLPA

SEQ ID NO: 2335292 - protein, 17 aa, Cryptosporidium parvum
IYMKNLVKRKWDIDWEH

SEQ ID NO: 2335293 - protein, 20 aa, Cryptosporidium parvum
IYSAEAPYNFNFQENQESSF

SEQ ID NO: 2335294 - protein, 18 aa, Cryptosporidium parvum
KAFGKLCSKTMNRYIQIF

SEQ ID NO: 2335295 - protein, 19 aa, Cryptosporidium parvum
KAFGMPSIPDYQYWNYEPE

SEQ ID NO: 2335296 - protein, 17 aa, Cryptosporidium parvum
KAGYPVKKRFFMVDRKG

SEQ ID NO: 2335297 - protein, 20 aa, Cryptosporidium parvum
KAIDLLTPFIKGGKIGLFGG

SEQ ID NO: 2335298 - protein, 22 aa, Cryptosporidium parvum
KAILLLGCIGMSNALTVFHLTN

SEQ ID NO: 2335299 - protein, 17 aa, Cryptosporidium parvum
KAIWLRPREEITKEEYN

SEQ ID NO: 2335300 - protein, 20 aa, Cryptosporidium parvum
KAKSCKKFFMSPAPRSPRCS

SEQ ID NO: 2335301 - protein, 19 aa, Cryptosporidium parvum
KALHSWSPIVDGVIIKDSC

SEQ ID NO: 2335302 - protein, 20 aa, Cryptosporidium parvum
KALPASHGIQLFVAPSEMST

SEQ ID NO: 2335303 - protein, 24 aa, Cryptosporidium parvum
KAMDKHRWVALPLVSPQSYIPNLG

SEQ ID NO: 2335304 - protein, 20 aa, Cryptosporidium parvum
KANGPRSIVIPMSFPQLYIK

SEQ ID NO: 2335305 - protein, 21 aa, Cryptosporidium parvum
KAQAITLFFFLIAFISLNEFF

SEQ ID NO: 2335306 - protein, 19 aa, Cryptosporidium parvum
KAQFSEFIDYEGLCEKKIR

SEQ ID NO: 2335307 - protein, 19 aa, Cryptosporidium parvum
KASDGSGLFELMPNNQLRL

SEQ ID NO: 2335308 - protein, 18 aa, Cryptosporidium parvum
KASNYILEDSFLYPINIM

SEQ ID NO: 2335309 - protein, 24 aa, Cryptosporidium parvum
KAVLSAAWEAFDYWITVQDSDLPS

SEQ ID NO: 2335310 - protein, 22 aa, Cryptosporidium parvum
KAVQQNHEWYLLAMGQFTQLKF

SEQ ID NO: 2335311 - protein, 17 aa, Cryptosporidium parvum
KCDEPFVFNEPRKTCVI

SEQ ID NO: 2335312 - protein, 31 aa, Cryptosporidium parvum
KCENKKILKRKCLRLLGDKCKTCETTEWSRW

SEQ ID NO: 2335313 - protein, 22 aa, Cryptosporidium parvum
KCESDPKCPEGFTLNNSTISCE

SEQ ID NO: 2335314 - protein, 23 aa, Cryptosporidium parvum
KCFYGLNCLYGLDSMDELINEEE

SEQ ID NO: 2335315 - protein, 27 aa, Cryptosporidium parvum
KCGNSIVLFDFHRKRYVTLNEMKKNLI

SEQ ID NO: 2335316 - protein, 17 aa, Cryptosporidium parvum
KCIKISSVMPNFSCPTD

SEQ ID NO: 2335317 - protein, 19 aa, Cryptosporidium parvum
KCLDDLFQIKIEKIQKTLK

SEQ ID NO: 2335318 - protein, 19 aa, Cryptosporidium parvum
KCLDITRLNALLPGERYNL

SEQ ID NO: 2335319 - protein, 19 aa, Cryptosporidium parvum
KCLLSSEFSTLVSDIISKL

SEQ ID NO: 2335320 - protein, 24 aa, Cryptosporidium parvum
KCNCNKELLGNNVCDIECNNIECN

SEQ ID NO: 2335321 - protein, 22 aa, Cryptosporidium parvum
KCNLEILDMISARGTPLRVEES

SEQ ID NO: 2335322 - protein, 24 aa, Cryptosporidium parvum
KCSNLKNAFALLILIFEGNDEDTF

SEQ ID NO: 2335323 - protein, 17 aa, Cryptosporidium parvum
KDEIVKMSKEKKNNGEK

SEQ ID NO: 2335324 - protein, 26 aa, Cryptosporidium parvum
KDFIQSEAFCLLSMSPFTSQVENILG

SEQ ID NO: 2335325 - protein, 22 aa, Cryptosporidium parvum
KDFYNYRMILRAEATGVGCSIA

SEQ ID NO: 2335326 - protein, 17 aa, Cryptosporidium parvum
KDGVCNRLLQVDSLSQC

SEQ ID NO: 2335327 - protein, 18 aa, Cryptosporidium parvum
KDGVSPLFEKPELDGRYN

SEQ ID NO: 2335328 - protein, 17 aa, Cryptosporidium parvum
KDGYTFEQAVDWTTNRL

SEQ ID NO: 2335329 - protein, 25 aa, Cryptosporidium parvum
KDIFPYKDSIAFATFMGPFFITKRC

SEQ ID NO: 2335330 - protein, 24 aa, Cryptosporidium parvum
KDLKNSWLRHLCRTGGEQQFSSNY

SEQ ID NO: 2335331 - protein, 17 aa, Cryptosporidium parvum
KDLMIGLVLPGLEQEVE

SEQ ID NO: 2335332 - protein, 17 aa, Cryptosporidium parvum
KDLQVIDLLSFKEGTNF

SEQ ID NO: 2335333 - protein, 24 aa, Cryptosporidium parvum
KECLSIKKLQKWVSLKNEYNNKIL

SEQ ID NO: 2335334 - protein, 25 aa, Cryptosporidium parvum
KEEIKIPYLYVVLCDQSLAKVPMGG

SEQ ID NO: 2335335 - protein, 25 aa, Cryptosporidium parvum
KEEKEALLRLGIDPKVIKRMNSLLK

SEQ ID NO: 2335336 - protein, 24 aa, Cryptosporidium parvum
KEEKVELCRLVRVVTKIEQNFEAV

SEQ ID NO: 2335337 - protein, 22 aa, Cryptosporidium parvum
KEERKRVGAGLDREEVRRNLER

SEQ ID NO: 2335338 - protein, 22 aa, Cryptosporidium parvum
KEFYIHESVFLFAREELQRIEL

SEQ ID NO: 2335339 - protein, 20 aa, Cryptosporidium parvum
KEIFQAPKFSLRNTPKGVVC

SEQ ID NO: 2335340 - protein, 17 aa, Cryptosporidium parvum
KEIKQAYRRLVLSHHPD

SEQ ID NO: 2335341 - protein, 21 aa, Cryptosporidium parvum
KEILSLIKYNFISWVNYNDNI

SEQ ID NO: 2335342 - protein, 24 aa, Cryptosporidium parvum
KEIVPRSSFYGRVAKDCPILETKC

SEQ ID NO: 2335343 - protein, 20 aa, Cryptosporidium parvum
KEKFNGILTDLFSKNLNRGQ

SEQ ID NO: 2335344 - protein, 24 aa, Cryptosporidium parvum
KEKKNRLRMLGLYRKEREEMEKRK

SEQ ID NO: 2335345 - protein, 17 aa, Cryptosporidium parvum
KEKKSSCFSKKKKQNYV

SEQ ID NO: 2335346 - protein, 21 aa, Cryptosporidium parvum
KENNKGWVLRAMNPHPNPSPP

SEQ ID NO: 2335347 - protein, 19 aa, Cryptosporidium parvum
KEQVEAFCYMVFEKLYGKK

SEQ ID NO: 2335348 - protein, 21 aa, Cryptosporidium parvum
KERMLELLKLESFLIREISRH

SEQ ID NO: 2335349 - protein, 27 aa, Cryptosporidium parvum
KERWVKAPPLRRPEGINVESDLVPEIV

SEQ ID NO: 2335350 - protein, 20 aa, Cryptosporidium parvum
KESKQMCLLLKPANHKSCIK

SEQ ID NO: 2335351 - protein, 25 aa, Cryptosporidium parvum
KESRFSFSVIWDCILSVMNDFKDDI

SEQ ID NO: 2335352 - protein, 26 aa, Cryptosporidium parvum
KETFSKIQFNFCYNMPHLKTTESNSG

SEQ ID NO: 2335353 - protein, 22 aa, Cryptosporidium parvum
KEVVCTISINLAHGINLLEPVE

SEQ ID NO: 2335354 - protein, 23 aa, Cryptosporidium parvum
KEYQRFTFKTGKLDIIGDEPKHI

SEQ ID NO: 2335355 - protein, 23 aa, Cryptosporidium parvum
KFERYCVFAEKLLNDNGENDFIK

SEQ ID NO: 2335356 - protein, 19 aa, Cryptosporidium parvum
KFGKDSKFRVFVSAFDVEF

SEQ ID NO: 2335357 - protein, 22 aa, Cryptosporidium parvum
KFKKICRLASSLSLIVPFDIKL

SEQ ID NO: 2335358 - protein, 23 aa, Cryptosporidium parvum
KFLELSEFLFGIIEKRIGIGNSI

SEQ ID NO: 2335359 - protein, 26 aa, Cryptosporidium parvum
KFMPDGTIFKQGWTLFVMINTGVPDY

SEQ ID NO: 2335360 - protein, 21 aa, Cryptosporidium parvum
KFNDFCLVGIILFNTKSYSRT

SEQ ID NO: 2335361 - protein, 23 aa, Cryptosporidium parvum
KFPCRYLNTVGFCRNLKDCRFSH

SEQ ID NO: 2335362 - protein, 17 aa, Cryptosporidium parvum
KFPSLRSDEKINVESKA

SEQ ID NO: 2335363 - protein, 22 aa, Cryptosporidium parvum
KFRQEFLLAINSFRSIVGKFAT

SEQ ID NO: 2335364 - protein, 17 aa, Cryptosporidium parvum
KFVKNVTKYSCYRMKNT

SEQ ID NO: 2335365 - protein, 27 aa, Cryptosporidium parvum
KFVTRRRLRQLVKSGLSKGFLEGVPPF

SEQ ID NO: 2335366 - protein, 18 aa, Cryptosporidium parvum
KGECKKGKCVAGDCSHRC

SEQ ID NO: 2335367 - protein, 19 aa, Cryptosporidium parvum
KGERFLGIICDARDYKPIN

SEQ ID NO: 2335368 - protein, 23 aa, Cryptosporidium parvum
KGGFECKCGIGFQYDENENACKD

SEQ ID NO: 2335369 - protein, 36 aa, Cryptosporidium parvum
KGGSEKEWIMSFAPKLRPGRMQRRRDLFSEEEIEEA

SEQ ID NO: 2335370 - protein, 20 aa, Cryptosporidium parvum
KGGSKHSTWSRIMGNVGPNL

SEQ ID NO: 2335371 - protein, 17 aa, Cryptosporidium parvum
KGKLTILDSRPILYALN

SEQ ID NO: 2335372 - protein, 23 aa, Cryptosporidium parvum
KGKYRLQKRIPLTLESARDIHSK

SEQ ID NO: 2335373 - protein, 26 aa, Cryptosporidium parvum
KGLNKKIFVVEIIKKLNLNVMFYNYK

SEQ ID NO: 2335374 - protein, 17 aa, Cryptosporidium parvum
KGLSFILLAGNALSQTT

SEQ ID NO: 2335375 - protein, 21 aa, Cryptosporidium parvum
KGLYLCLLNILKMLKKEFQLN

SEQ ID NO: 2335376 - protein, 25 aa, Cryptosporidium parvum
KGSYGEVWRGLAFTEYLSEPFGNCG

SEQ ID NO: 2335377 - protein, 17 aa, Cryptosporidium parvum
KHCKQIVTMLLNNAETY

SEQ ID NO: 2335378 - protein, 28 aa, Cryptosporidium parvum
KHCSYIQVFRYLKSNIFEKLKLYQNSLN

SEQ ID NO: 2335379 - protein, 19 aa, Cryptosporidium parvum
KHINIRGWDLKKGKKSLAL

SEQ ID NO: 2335380 - protein, 28 aa, Cryptosporidium parvum
KHYSKFKTVCFPMFCGLSSKNIILNVGD

SEQ ID NO: 2335381 - protein, 22 aa, Cryptosporidium parvum
KIADLNGGYVYDSKIKGISRTR

SEQ ID NO: 2335382 - protein, 19 aa, Cryptosporidium parvum
KIDPRLVNHKKLFKILNFH

SEQ ID NO: 2335383 - protein, 17 aa, Cryptosporidium parvum
KIDVEGLNSLPPNEYNP

SEQ ID NO: 2335384 - protein, 23 aa, Cryptosporidium parvum
KIEIKVRNAGLIIDDNNSNSNNK

SEQ ID NO: 2335385 - protein, 24 aa, Cryptosporidium parvum
KIEITRIVPELGRFNIVVKSDTPG

SEQ ID NO: 2335386 - protein, 29 aa, Cryptosporidium parvum
KIERYSECGMSFYIEWDVEGILISIDTFG

SEQ ID NO: 2335387 - protein, 31 aa, Cryptosporidium parvum
KIFNDLYLPFLQGIHVCRSYPNTNCTKKNPC

SEQ ID NO: 2335388 - protein, 24 aa, Cryptosporidium parvum
KIIKQAFVRYMFKGFSSRYRERIF

SEQ ID NO: 2335389 - protein, 25 aa, Cryptosporidium parvum
KIIPMVNVILEFFDIYFLNPEKVFS

SEQ ID NO: 2335390 - protein, 21 aa, Cryptosporidium parvum
KIKKADSWQECASLCMDYVAF

SEQ ID NO: 2335391 - protein, 21 aa, Cryptosporidium parvum
KIKLLEKLFPRRNFTNDELDV

SEQ ID NO: 2335392 - protein, 21 aa, Cryptosporidium parvum
KIKPFDMLIPFVNESGQIKFV

SEQ ID NO: 2335393 - protein, 17 aa, Cryptosporidium parvum
KILAGYLMLTITLYHSR

SEQ ID NO: 2335394 - protein, 20 aa, Cryptosporidium parvum
KILNTKIEFSKGISKSLFLE

SEQ ID NO: 2335395 - protein, 18 aa, Cryptosporidium parvum
KILPRINPVYTIMSLGRY

SEQ ID NO: 2335396 - protein, 20 aa, Cryptosporidium parvum
KINYSFAFGFSKDSIGDYLR

SEQ ID NO: 2335397 - protein, 24 aa, Cryptosporidium parvum
KIPKPTLHYGRPNWLVVGQQGPSW

SEQ ID NO: 2335398 - protein, 22 aa, Cryptosporidium parvum
KISDLRPLRLGTFGHLSRSETP

SEQ ID NO: 2335399 - protein, 18 aa, Cryptosporidium parvum
KISTQYLPNGRELVQKCI

SEQ ID NO: 2335400 - protein, 18 aa, Cryptosporidium parvum
KISTWFKNNYLKHFYKNK

SEQ ID NO: 2335401 - protein, 17 aa, Cryptosporidium parvum
KIVKLLKFHTSKSGDST

SEQ ID NO: 2335402 - protein, 24 aa, Cryptosporidium parvum
KIWEHYKNSFIYKGSLPKHDLFHN

SEQ ID NO: 2335403 - protein, 22 aa, Cryptosporidium parvum
KIYRDVCSEVSYTLQELNPFEN

SEQ ID NO: 2335404 - protein, 19 aa, Cryptosporidium parvum
KIYRQRATGVFGIGLKSSL

SEQ ID NO: 2335405 - protein, 20 aa, Cryptosporidium parvum
KKDFSKCLLPVIKLVEDSIN

SEQ ID NO: 2335406 - protein, 19 aa, Cryptosporidium parvum
KKEALRLTFDSSITNEWMG

SEQ ID NO: 2335407 - protein, 22 aa, Cryptosporidium parvum
KKEFPIPLYYAVKEFKQAKNLT

SEQ ID NO: 2335408 - protein, 18 aa, Cryptosporidium parvum
KKERGISPTEEYEISSEE

SEQ ID NO: 2335409 - protein, 19 aa, Cryptosporidium parvum
KKERIEFISQLSYTDFLIW

SEQ ID NO: 2335410 - protein, 19 aa, Cryptosporidium parvum
KKFSENKFVVGVNYNNLLL

SEQ ID NO: 2335411 - protein, 19 aa, Cryptosporidium parvum
KKFYSDSMLKFMNKKREAL

SEQ ID NO: 2335412 - protein, 19 aa, Cryptosporidium parvum
KKGLAGIIPIVYPTVAIMP

SEQ ID NO: 2335413 - protein, 19 aa, Cryptosporidium parvum
KKGLIPKLLEEIRSGVKLK

SEQ ID NO: 2335414 - protein, 18 aa, Cryptosporidium parvum
KKGNKFTRFFKRLFKKPS

SEQ ID NO: 2335415 - protein, 19 aa, Cryptosporidium parvum
KKGQTLWYGFMVTYPEGKM

SEQ ID NO: 2335416 - protein, 17 aa, Cryptosporidium parvum
KKHIVQFYYDYFLMDSP

SEQ ID NO: 2335417 - protein, 19 aa, Cryptosporidium parvum
KKILQKLLHASRQLTEKLK

SEQ ID NO: 2335418 - protein, 19 aa, Cryptosporidium parvum
KKINFNLLESCNEYMQQSR

SEQ ID NO: 2335419 - protein, 26 aa, Cryptosporidium parvum
KKISCSQIKSIFGFKDSCNVGKFAFP

SEQ ID NO: 2335420 - protein, 17 aa, Cryptosporidium parvum
KKISSLLKEKSEEEKFE

SEQ ID NO: 2335421 - protein, 32 aa, Cryptosporidium parvum
KKKKKGIPLMEWFRYSSVLKLAAEFGSGLLSL

SEQ ID NO: 2335422 - protein, 20 aa, Cryptosporidium parvum
KKKVGYGVSDLDYLRRSNDD

SEQ ID NO: 2335423 - protein, 27 aa, Cryptosporidium parvum
KKKYPEAYHPLALEIFSTISKEDIETW

SEQ ID NO: 2335424 - protein, 28 aa, Cryptosporidium parvum
KKNSFDPWIVCLRRYENAIPFHGSSKQR

SEQ ID NO: 2335425 - protein, 20 aa, Cryptosporidium parvum
KKPITSFCTMKGWKKFYSDS

SEQ ID NO: 2335426 - protein, 18 aa, Cryptosporidium parvum
KKRKARANKNLNRRNSSD

SEQ ID NO: 2335427 - protein, 19 aa, Cryptosporidium parvum
KKRSARVVRKLALLEKLKL

SEQ ID NO: 2335428 - protein, 18 aa, Cryptosporidium parvum
KKRSDEFIAKNKDRKGVI

SEQ ID NO: 2335429 - protein, 20 aa, Cryptosporidium parvum
KKSFWKSREGEVGYETRCIE

SEQ ID NO: 2335430 - protein, 25 aa, Cryptosporidium parvum
KKSKISWLMERCFIYTKKKDINNGI

SEQ ID NO: 2335431 - protein, 30 aa, Cryptosporidium parvum; identical to SEQ ID NO: 2207207

SEQ ID NO: 2335432 - protein, 20 aa, Cryptosporidium parvum
KKSLLKKRSDEFIAKNKDRK

SEQ ID NO: 2335433 - protein, 20 aa, Cryptosporidium parvum
KKSQGLTRFSGFEMLSQLED

SEQ ID NO: 2335434 - protein, 17 aa, Cryptosporidium parvum
KKSTTIYWVYPIPPESY

SEQ ID NO: 2335435 - protein, 28 aa, Cryptosporidium parvum
KKTFLSRFKDFLLRRTINSYLFIGDEIG

SEQ ID NO: 2335436 - protein, 24 aa, Cryptosporidium parvum
KKTKKRKGPLISITKINNLINKNH

SEQ ID NO: 2335437 - protein, 17 aa, Cryptosporidium parvum
KKVEYEITDGLNNDQSL

SEQ ID NO: 2335438 - protein, 18 aa, Cryptosporidium parvum
KKVTAQCILGRMRSESDG

SEQ ID NO: 2335439 - protein, 17 aa, Cryptosporidium parvum
KKVVLKKPVKFHTLKTF

SEQ ID NO: 2335440 - protein, 17 aa, Cryptosporidium parvum
KKYLGKNSEMGFSSQNS

SEQ ID NO: 2335441 - protein, 25 aa, Cryptosporidium parvum
KLAAFSLEGRDAYLYSRGADVLKTD

SEQ ID NO: 2335442 - protein, 33 aa, Cryptosporidium parvum
KLDALVKEWNRHLNWVRDIPKLCNDQLSTMNKL

SEQ ID NO: 2335443 - protein, 20 aa, Cryptosporidium parvum
KLDEDAVILGAERKESNKGI

SEQ ID NO: 2335444 - protein, 22 aa, Cryptosporidium parvum
KLDGKIGFKSVIKNILRSRKYL

SEQ ID NO: 2335445 - protein, 23 aa, Cryptosporidium parvum
KLDKCKYRKSILKGEQVEKEVMY

SEQ ID NO: 2335446 - protein, 19 aa, Cryptosporidium parvum
KLEEIRKIKDNGIKESTAD

SEQ ID NO: 2335447 - protein, 20 aa, Cryptosporidium parvum
KLEKLFPININLLSPNKSNF

SEQ ID NO: 2335448 - protein, 20 aa, Cryptosporidium parvum
KLELIPRYKVSSTDEIVYNI

SEQ ID NO: 2335449 - protein, 23 aa, Cryptosporidium parvum
KLEVAYNLGFSKLASVGACTTVS

SEQ ID NO: 2335450 - protein, 20 aa, Cryptosporidium parvum
KLFGKILLKYGEVHGVAIGN

SEQ ID NO: 2335451 - protein, 17 aa, Cryptosporidium parvum
KLFKLINRKASKRASKM

SEQ ID NO: 2335452 - protein, 20 aa, Cryptosporidium parvum
KLFTRIAFGSIWSDKKYRGQ

SEQ ID NO: 2335453 - protein, 23 aa, Cryptosporidium parvum
KLFYELLKIIKIESIKQNDQKIK

SEQ ID NO: 2335454 - protein, 20 aa, Cryptosporidium parvum
KLGIHPSEIIFLDYSQSIKW

SEQ ID NO: 2335455 - protein, 26 aa, Cryptosporidium parvum
KLGRKEFLCGFEGYGKNDSLNLSEET

SEQ ID NO: 2335456 - protein, 23 aa, Cryptosporidium parvum
KLISEIAFEMFVLIRKEGIPNID

SEQ ID NO: 2335457 - protein, 23 aa, Cryptosporidium parvum
KLISSNWENTGWIVMEYYDGISL

SEQ ID NO: 2335458 - protein, 26 aa, Cryptosporidium parvum
KLKDLVLRYSQFINFPIYIYNPEGVN

SEQ ID NO: 2335459 - protein, 19 aa, Cryptosporidium parvum
KLKENFELFKPSKSLFTRF

SEQ ID NO: 2335460 - protein, 19 aa, Cryptosporidium parvum
KLLILYFFFPLRYPQNETR

SEQ ID NO: 2335461 - protein, 24 aa, Cryptosporidium parvum
KLLKMDGLLCLLFAVFIFTHYLNF

SEQ ID NO: 2335462 - protein, 19 aa, Cryptosporidium parvum
KLLRLCNQTLFSLLKQDLL

SEQ ID NO: 2335463 - protein, 23 aa, Cryptosporidium parvum
KLLSLDPSNKFALSITHGPYIDE

SEQ ID NO: 2335464 - protein, 17 aa, Cryptosporidium parvum
KLLTLIILLIILAQLNY

SEQ ID NO: 2335465 - protein, 20 aa, Cryptosporidium parvum
KLMIACPYAISNHCMQNNCG

SEQ ID NO: 2335466 - protein, 28 aa, Cryptosporidium parvum
KLNDGFFDIFAFYFFKDYAAIQYLLDGT

SEQ ID NO: 2335467 - protein, 21 aa, Cryptosporidium parvum
KLNIDIPCRGIHASIDNNNIP

SEQ ID NO: 2335468 - protein, 22 aa, Cryptosporidium parvum
KLNTICSMPYMGKRSQITTVYP

SEQ ID NO: 2335469 - protein, 21 aa, Cryptosporidium parvum
KLPVLEVAFTKQEWLATSSGS

SEQ ID NO: 2335470 - protein, 21 aa, Cryptosporidium parvum
KLREREAYKLGFVSGEASSDP

SEQ ID NO: 2335471 - protein, 17 aa, Cryptosporidium parvum
KLSEMRILGAHPNSSEY

SEQ ID NO: 2335472 - protein, 17 aa, Cryptosporidium parvum
KLSIGIDSMSMLYLNVF

SEQ ID NO: 2335473 - protein, 23 aa, Cryptosporidium parvum
KLSSKPMFFFSMYISSKRKGSLY

SEQ ID NO: 2335474 - protein, 22 aa, Cryptosporidium parvum
KLTRIRMIGKYSGFGGETPVSF

SEQ ID NO: 2335475 - protein, 25 aa, Cryptosporidium parvum
KLTRKSLFYCIKIIILSYYKSSIQQ

SEQ ID NO: 2335476 - protein, 20 aa, Cryptosporidium parvum
KLVLPAIPYFRRPAIPKSRI

SEQ ID NO: 2335477 - protein, 22 aa, Cryptosporidium parvum
KMIDAICPDGFLPNGDDCIQFS

SEQ ID NO: 2335478 - protein, 28 aa, Cryptosporidium parvum
KMKASRIKICFKARICSRMMKKEEGTDN

SEQ ID NO: 2335479 - protein, 21 aa, Cryptosporidium parvum
KMKEYRKLKGKKKKLLDEEIE

SEQ ID NO: 2335480 - protein, 17 aa, Cryptosporidium parvum
KMPGIPCGLLGSMDATK

SEQ ID NO: 2335481 - protein, 17 aa, Cryptosporidium parvum
KMQEYGWNDKYFLIDGF

SEQ ID NO: 2335482 - protein, 25 aa, Cryptosporidium parvum
KMRPFSGLFPVLVGEVIDNSINYCI

SEQ ID NO: 2335483 - protein, 23 aa, Cryptosporidium parvum
KMRRRMGRARGKYDSGSSGSSSS

SEQ ID NO: 2335484 - protein, 22 aa, Cryptosporidium parvum
KMSEVGIFPSIDPLESRSKVLD

SEQ ID NO: 2335485 - protein, 24 aa, Cryptosporidium parvum
KNAKFLSCGFKFRFNNTTLPMLVN

SEQ ID NO: 2335486 - protein, 25 aa, Cryptosporidium parvum
KNDHLYWRRGELLNHELNSLILDAL

SEQ ID NO: 2335487 - protein, 20 aa, Cryptosporidium parvum
KNEIRIYNPLLFKNYPQLIL

SEQ ID NO: 2335488 - protein, 22 aa, Cryptosporidium parvum
KNFWWLSKIRFSSGHYITKVHE

SEQ ID NO: 2335489 - protein, 20 aa, Cryptosporidium parvum
KNIELPIRMDIAEFTKLLPH

SEQ ID NO: 2335490 - protein, 23 aa, Cryptosporidium parvum
KNIPVNKIRLGIMKEGNPYPVNI

SEQ ID NO: 2335491 - protein, 25 aa, Cryptosporidium parvum
KNKESFCRYVSLVLEDDFFEKSILF

SEQ ID NO: 2335492 - protein, 22 aa, Cryptosporidium parvum
KNKEYYTICPISYDNRFGRFKY

SEQ ID NO: 2335493 - protein, 25 aa, Cryptosporidium parvum
KNKPKRAMTAFMYFASSRRAEITAA

SEQ ID NO: 2335494 - protein, 24 aa, Cryptosporidium parvum
KNLAKNGYRALRFDFYGHGLSQYK

SEQ ID NO: 2335495 - protein, 18 aa, Cryptosporidium parvum
KNLFLINVFERYISLSDP

SEQ ID NO: 2335496 - protein, 21 aa, Cryptosporidium parvum
KNPAAKFTIIYSHSNATDIGY

SEQ ID NO: 2335497 - protein, 24 aa, Cryptosporidium parvum
KNPDIASIKLMWKTSNIQEQVIPS

SEQ ID NO: 2335498 - protein, 17 aa, Cryptosporidium parvum
KNQFEIIGLIYKYINKL

SEQ ID NO: 2335499 - protein, 18 aa, Cryptosporidium parvum
KNRLEWSLTEIACSTYGM

SEQ ID NO: 2335500 - protein, 18 aa, Cryptosporidium parvum
KNVQEWKIIREVSILKLL

SEQ ID NO: 2335501 - protein, 17 aa, Cryptosporidium parvum
KPDMTGASEALRNLKSV

SEQ ID NO: 2335502 - protein, 22 aa, Cryptosporidium parvum
KPEDKYGVSYPFFPPGIKPAPI

SEQ ID NO: 2335503 - protein, 22 aa, Cryptosporidium parvum
KPFSLKCPHGYNLENGQCIQEI

SEQ ID NO: 2335504 - protein, 20 aa, Cryptosporidium parvum
KPGLNIFKQFGRGFPTGGYE

SEQ ID NO: 2335505 - protein, 26 aa, Cryptosporidium parvum
KPIRSEILRILAILEEIEFNSKEVIK

SEQ ID NO: 2335506 - protein, 17 aa, Cryptosporidium parvum
KPLESLNGIWKRDESYP

SEQ ID NO: 2335507 - protein, 19 aa, Cryptosporidium parvum
KPLKRRAPPPPAHPSYSVK

SEQ ID NO: 2335508 - protein, 20 aa, Cryptosporidium parvum
KPLTHIFSSFVLNFSFEKRS

SEQ ID NO: 2335509 - protein, 20 aa, Cryptosporidium parvum
KPLTKKGLHELLKKHRTGYN

SEQ ID NO: 2335510 - protein, 25 aa, Cryptosporidium parvum
KPMEFYRYAVLLSMSLIKDKNVDIK

SEQ ID NO: 2335511 - protein, 20 aa, Cryptosporidium parvum
KPNFPFTIIDVAPFVNANAN

SEQ ID NO: 2335512 - protein, 21 aa, Cryptosporidium parvum
KPREVPGRCNSLTMQGWNYGT

SEQ ID NO: 2335513 - protein, 20 aa, Cryptosporidium parvum
KPRQLTCSDTASFIFQLPVG

SEQ ID NO: 2335514 - protein, 18 aa, Cryptosporidium parvum
KPWLLQRIPELTGLSYND

SEQ ID NO: 2335515 - protein, 20 aa, Cryptosporidium parvum
KPYLSCPENTVLVATNTCKM

SEQ ID NO: 2335516 - protein, 25 aa, Cryptosporidium parvum
KQGEALKVKSFFFGLGGGDKKEEKN

SEQ ID NO: 2335517 - protein, 25 aa, Cryptosporidium parvum
KQGIPCIIYKLISLDFEYSGQDEMK

SEQ ID NO: 2335518 - protein, 19 aa, Cryptosporidium parvum
KQGWTLFVMLNNGIPTSVS

SEQ ID NO: 2335519 - protein, 23 aa, Cryptosporidium parvum
KQLKNCLKYKHILVPLEKKLIYM

SEQ ID NO: 2335520 - protein, 22 aa, Cryptosporidium parvum
KQLLVKAGIVKIRLKNLKMAFS

SEQ ID NO: 2335521 - protein, 21 aa, Cryptosporidium parvum
KQNAFYSYWGQGGIVADQAQP

SEQ ID NO: 2335522 - protein, 24 aa, Cryptosporidium parvum
KQNLLVQCKILYQAFYSYKNSVRS

SEQ ID NO: 2335523 - protein, 18 aa, Cryptosporidium parvum
KQYIFTNFIRVCVHNYFW

SEQ ID NO: 2335524 - protein, 20 aa, Cryptosporidium parvum
KRDINMNYIRFVKLPEYDQT

SEQ ID NO: 2335525 - protein, 19 aa, Cryptosporidium parvum
KRDMYSLKTAWQCKTKKTT

SEQ ID NO: 2335526 - protein, 18 aa, Cryptosporidium parvum
KRFNECILVKEKYPVLNG

SEQ ID NO: 2335527 - protein, 24 aa, Cryptosporidium parvum
KRFPEPIQALGVRLFGRFQGINTN

SEQ ID NO: 2335528 - protein, 20 aa, Cryptosporidium parvum
KRHIEGKTVRYCEFTGLSTN

SEQ ID NO: 2335529 - protein, 24 aa, Cryptosporidium parvum
KRHLKALEIKKSWEDGGVKGAVID

SEQ ID NO: 2335530 - protein, 25 aa, Cryptosporidium parvum
KRIFKLKKIICRILQVQQENNQTGF

SEQ ID NO: 2335531 - protein, 20 aa, Cryptosporidium parvum
KRITNSIVLPDGYTIYTPLY

SEQ ID NO: 2335532 - protein, 17 aa, Cryptosporidium parvum
KRKCIKISSVMPNFSCP

SEQ ID NO: 2335533 - protein, 18 aa, Cryptosporidium parvum
KRLGELLEIDYKSIGVIA

SEQ ID NO: 2335534 - protein, 19 aa, Cryptosporidium parvum
KRLIGRRFKDDSVQKDKTL

SEQ ID NO: 2335535 - protein, 20 aa, Cryptosporidium parvum
KRLRDELGIIRDLKLTWRLH

SEQ ID NO: 2335536 - protein, 20 aa, Cryptosporidium parvum
KRLRQSEIFHMKNSFRKVLR

SEQ ID NO: 2335537 - protein, 17 aa, Cryptosporidium parvum
KRPPLKKEYAYGAVMNH

SEQ ID NO: 2335538 - protein, 17 aa, Cryptosporidium parvum
KRPYLPQGIVPSPISTT

SEQ ID NO: 2335539 - protein, 19 aa, Cryptosporidium parvum
KRQRIGVQILDELDKLEKL

SEQ ID NO: 2335540 - protein, 19 aa, Cryptosporidium parvum
KRRLPWSTFFSIKQNGLPT

SEQ ID NO: 2335541 - protein, 20 aa, Cryptosporidium parvum
KRRNRGKINSRRVIPTGRNL

SEQ ID NO: 2335542 - protein, 19 aa, Cryptosporidium parvum
KRSLIPVVDFISDRTIDVY

SEQ ID NO: 2335543 - protein, 20 aa, Cryptosporidium parvum
KRWPRIYKIELTKIPIRARK

SEQ ID NO: 2335544 - protein, 23 aa, Cryptosporidium parvum
KSAQYIWLIARMKFNVFILEAES

SEQ ID NO: 2335545 - protein, 18 aa, Cryptosporidium parvum
KSCEYAFSMVKHLIASGF

SEQ ID NO: 2335546 - protein, 20 aa, Cryptosporidium parvum
KSDIFSIVIIPDCEDNELID

SEQ ID NO: 2335547 - protein, 20 aa, Cryptosporidium parvum
KSEKGCVLYLYTQDSPNPTE

SEQ ID NO: 2335548 - protein, 22 aa, Cryptosporidium parvum
KSEKLCTCVKHLQEISPEVMKS

SEQ ID NO: 2335549 - protein, 20 aa, Cryptosporidium parvum
KSELGGVPFGVEIKIKGFLG

SEQ ID NO: 2335550 - protein, 20 aa, Cryptosporidium parvum
KSEMSRLLFDVRDYIMDVIL

SEQ ID NO: 2335551 - protein, 20 aa, Cryptosporidium parvum
KSEPIIACANGFVEDAQGCV

SEQ ID NO: 2335552 - protein, 24 aa, Cryptosporidium parvum
KSFNIPGIPIFGGPRVENRNYLTL

SEQ ID NO: 2335553 - protein, 25 aa, Cryptosporidium parvum
KSFYNLSLFFLKWFKTGPERGDCRF

SEQ ID NO: 2335554 - protein, 30 aa, Cryptosporidium parvum
KSGNGKGGFLSRLFGFFGRNNSGKKDKASK

SEQ ID NO: 2335555 - protein, 25 aa, Cryptosporidium parvum
KSHNIRPYFDFSQFNICLVPQVEEF

SEQ ID NO: 2335556 - protein, 21 aa, Cryptosporidium parvum
KSHSPRRVVILAFSTRSFTEK

SEQ ID NO: 2335557 - protein, 24 aa, Cryptosporidium parvum
KSIKFKDVVDFASYIIKMGSIESL

SEQ ID NO: 2335558 - protein, 21 aa, Cryptosporidium parvum
KSIKHIPGFHFHNPEISYRNG

SEQ ID NO: 2335559 - protein, 18 aa, Cryptosporidium parvum
KSIPKLRGLAQISPEQAD

SEQ ID NO: 2335560 - protein, 21 aa, Cryptosporidium parvum
KSKFPNGANFIPLVLDANTGQ

SEQ ID NO: 2335561 - protein, 18 aa, Cryptosporidium parvum
KSKFYSVCTLKYNEDFNY

SEQ ID NO: 2335562 - protein, 24 aa, Cryptosporidium parvum
KSKKKPLTRRGLEYLLKKRKARAN

SEQ ID NO: 2335563 - protein, 22 aa, Cryptosporidium parvum
KSKRKPLTRRDLEDLLKKHKTR

SEQ ID NO: 2335564 - protein, 26 aa, Cryptosporidium parvum
KSKRKPLTRRGLRDLIEKHKTGTNQN

SEQ ID NO: 2335565 - protein, 17 aa, Cryptosporidium parvum
KSLLTKRICSIEWKNRF

SEQ ID NO: 2335566 - protein, 17 aa, Cryptosporidium parvum
KSLRNMAYTVFTAPNGD

SEQ ID NO: 2335567 - protein, 30 aa, Cryptosporidium parvum; identical to SEQ ID NO: 2207308

SEQ ID NO: 2335568 - protein, 18 aa, Cryptosporidium parvum
KSNLSSLGSRPGIKGSYK

SEQ ID NO: 2335569 - protein, 18 aa, Cryptosporidium parvum
KSPEEFVADCKRVITMLQ

SEQ ID NO: 2335570 - protein, 24 aa, Cryptosporidium parvum
KSPRWYLPNFWYYTIEEFESPVNS

SEQ ID NO: 2335571 - protein, 22 aa, Cryptosporidium parvum
KSRSKGLFGRIFSKKKKNKPDE

SEQ ID NO: 2335572 - protein, 25 aa, Cryptosporidium parvum
KSSDFCIISELLLQRGSLKEIKESC

SEQ ID NO: 2335573 - protein, 19 aa, Cryptosporidium parvum
KSSIYFCEYLWVIAYIIEE

SEQ ID NO: 2335574 - protein, 19 aa, Cryptosporidium parvum
KSSSEFNIGFLMEKYMTTY

SEQ ID NO: 2335575 - protein, 20 aa, Cryptosporidium parvum
KSVSEYRAKFSEDFSDELPH

SEQ ID NO: 2335576 - protein, 20 aa, Cryptosporidium parvum
KSYLEMTFESISQLRSNFGS

SEQ ID NO: 2335577 - protein, 20 aa, Cryptosporidium parvum
KTFCISAAEYCYPIKGRLNV

SEQ ID NO: 2335578 - protein, 20 aa, Cryptosporidium parvum
KTFILPFVMFPDEKSFENFK

SEQ ID NO: 2335579 - protein, 25 aa, Cryptosporidium parvum
KTFYSIDIVGLFSYLPNEFELSRIS

SEQ ID NO: 2335580 - protein, 18 aa, Cryptosporidium parvum
KTGAISGIGFHWKKPPKP

SEQ ID NO: 2335581 - protein, 17 aa, Cryptosporidium parvum
KTIYCQMAYFGFSSLIP

SEQ ID NO: 2335582 - protein, 18 aa, Cryptosporidium parvum
KTLTCSKLLTNENIYQTL

SEQ ID NO: 2335583 - protein, 17 aa, Cryptosporidium parvum
KTMFLWNETIFFENLSI

SEQ ID NO: 2335584 - protein, 23 aa, Cryptosporidium parvum
KTMRISWECFTKVNNVIWIPNKK

SEQ ID NO: 2335585 - protein, 29 aa, Cryptosporidium parvum
KTNARLVTLSYLFMKSFKYAIPSEYRECI

SEQ ID NO: 2335586 - protein, 17 aa, Cryptosporidium parvum
KTNRFSFNLNSLKNKFR

SEQ ID NO: 2335587 - protein, 31 aa, Cryptosporidium parvum; identical to SEQ ID NO: 2207325

SEQ ID NO: 2335588 - protein, 20 aa, Cryptosporidium parvum
KTTNIWVFFHLFQEADEIRF

SEQ ID NO: 2335589 - protein, 19 aa, Cryptosporidium parvum
KVALGDWIKKIDFSSNGRY

SEQ ID NO: 2335590 - protein, 21 aa, Cryptosporidium parvum
KVASIRPGRGIEIVLNSHSQR

SEQ ID NO: 2335591 - protein, 25 aa, Cryptosporidium parvum
KVFIHKGGKCIYNYNSRIDEYKAPP

SEQ ID NO: 2335592 - protein, 20 aa, Cryptosporidium parvum
KVIILWKNRGIFYPTLGDQV

SEQ ID NO: 2335593 - protein, 30 aa, Cryptosporidium parvum
KVKNLKNQICEFSKIFEFYLISISKNIGLK

SEQ ID NO: 2335594 - protein, 18 aa, Cryptosporidium parvum
KVLMAWKHLGINTSVSKG

SEQ ID NO: 2335595 - protein, 20 aa, Cryptosporidium parvum
KVNNDYYVWGGMRGEANIEA

SEQ ID NO: 2335596 - protein, 18 aa, Cryptosporidium parvum
KVNTTLCVFCQKQYLINN

SEQ ID NO: 2335597 - protein, 19 aa, Cryptosporidium parvum
KVNVSILWIYIDKASPESF

SEQ ID NO: 2335598 - protein, 19 aa, Cryptosporidium parvum
KVRKALKISPHFVQRKKSN

SEQ ID NO: 2335599 - protein, 22 aa, Cryptosporidium parvum
KYCIKSGKGKIILSAGALNTPM

SEQ ID NO: 2335600 - protein, 25 aa, Cryptosporidium parvum
KYCMPEEKRILFLMKQTIVGKYKNT

SEQ ID NO: 2335601 - protein, 25 aa, Cryptosporidium parvum
KYENNTRNALDYGDLNDPGFTIRIV

SEQ ID NO: 2335602 - protein, 26 aa, Cryptosporidium parvum
KYERRPYEDIGLLDFRILDPLTAPAK

SEQ ID NO: 2335603 - protein, 23 aa, Cryptosporidium parvum
KYFNYKLMPKYVIINNIETNQIN

SEQ ID NO: 2335604 - protein, 25 aa, Cryptosporidium parvum
KYKHRYRMIISLFKEFVDHSNKFGF

SEQ ID NO: 2335605 - protein, 19 aa, Cryptosporidium parvum
KYLKALQLLNVYRERSHEI

SEQ ID NO: 2335606 - protein, 17 aa, Cryptosporidium parvum
KYLKFLINGEEHFYPFI

SEQ ID NO: 2335607 - protein, 20 aa, Cryptosporidium parvum
KYLNAKEIIRNSGILNTDNR

SEQ ID NO: 2335608 - protein, 23 aa, Cryptosporidium parvum
KYLRMNRVLEIDSAWLKNTYPEI

SEQ ID NO: 2335609 - protein, 23 aa, Cryptosporidium parvum
KYLSEPFIDRVLKLNGQLSPFLR

SEQ ID NO: 2335610 - protein, 30 aa, Cryptosporidium parvum; identical to SEQ ID NO: 2207343

SEQ ID NO: 2335611 - protein, 69 aa, Cryptosporidium parvum
KYMTLQDIRYEICKFGMIHKSGCKIVPFSTLLSLPRHSFEIWKSFGLVLQFEFLIAMTYSIEHEMNFDN

SEQ ID NO: 2335612 - protein, 19 aa, Cryptosporidium parvum
KYNLSRFSMLVLESVIKIL

SEQ ID NO: 2335613 - protein, 24 aa, Cryptosporidium parvum
KYPGGYKNRWDMISEYLKNTKTKE

SEQ ID NO: 2335614 - protein, 17 aa, Cryptosporidium parvum
KYPGSKWYFSEIPSDQN

SEQ ID NO: 2335615 - protein, 29 aa, Cryptosporidium parvum
KYPNIEVPLDWQSRVFIKYYPEESSIKVH

SEQ ID NO: 2335616 - protein, 20 aa, Cryptosporidium parvum
KYRIRVEMFHSSHLRYKNPD

SEQ ID NO: 2335617 - protein, 19 aa, Cryptosporidium parvum
KYSEKYMYGDKMKYFNVLA

SEQ ID NO: 2335618 - protein, 20 aa, Cryptosporidium parvum
KYSPLLPRWARDQTKDPFIV

SEQ ID NO: 2335619 - protein, 20 aa, Cryptosporidium parvum
KYTYGLTFFDIFYPPDSHHI

SEQ ID NO: 2335620 - protein, 19 aa, Cryptosporidium parvum
KYYPICGTNGKTYENVSHF

SEQ ID NO: 2335621 - protein, 20 aa, Cryptosporidium parvum
LAALQRIISFCLKFSSEIDC

SEQ ID NO: 2335622 - protein, 21 aa, Cryptosporidium parvum
LACGSETKFSISTSECEGLCS

SEQ ID NO: 2335623 - protein, 18 aa, Cryptosporidium parvum
LAERVFILQSEISELSVD

SEQ ID NO: 2335624 - protein, 19 aa, Cryptosporidium parvum
LAHGKWLIKAPYPVFYPST

SEQ ID NO: 2335625 - protein, 21 aa, Cryptosporidium parvum
LAICYLMLKVALTTFVFGSKE

SEQ ID NO: 2335626 - protein, 17 aa, Cryptosporidium parvum
LALALILYWRERQYDIS

SEQ ID NO: 2335627 - protein, 17 aa, Cryptosporidium parvum
LALDPRNIFDVDLLGVK

SEQ ID NO: 2335628 - protein, 19 aa, Cryptosporidium parvum
LALKTRIILQLLPSKYSRD

SEQ ID NO: 2335629 - protein, 19 aa, Cryptosporidium parvum
LALSICQKGLGLGVRVGVG

SEQ ID NO: 2335630 - protein, 17 aa, Cryptosporidium parvum
LASLEIWDEHWPPYAST

SEQ ID NO: 2335631 - protein, 28 aa, Cryptosporidium parvum
LASLRKCFEYQYVCLLARHLEDDEILEL

SEQ ID NO: 2335632 - protein, 20 aa, Cryptosporidium parvum
LASRGYRVFITPPITMIPTP

SEQ ID NO: 2335633 - protein, 19 aa, Cryptosporidium parvum
LASRLKTLLSVEQIIYLVR

SEQ ID NO: 2335634 - protein, 18 aa, Cryptosporidium parvum
LASTSAVMSCTLGKATCL

SEQ ID NO: 2335635 - protein, 20 aa, Cryptosporidium parvum
LATLLSELLFYDWKRPDVGR

SEQ ID NO: 2335636 - protein, 19 aa, Cryptosporidium parvum
LAVSELGAGFKAGSLCFTD

SEQ ID NO: 2335637 - protein, 25 aa, Cryptosporidium parvum
LAYLELCGFEQVMINSEFRDQGKKS

SEQ ID NO: 2335638 - protein, 26 aa, Cryptosporidium parvum
LCARNFRNSIEIWGNMASCQSSQIIG

SEQ ID NO: 2335639 - protein, 21 aa, Cryptosporidium parvum
LCCISPFPSDTVRFLKGLLEH

SEQ ID NO: 2335640 - protein, 29 aa, Cryptosporidium parvum
LCESPFEYMCKYISLRLKRSSLEEDGEGI

SEQ ID NO: 2335641 - protein, 21 aa, Cryptosporidium parvum
LCKDPEIMKLWYSGPLISTDT

SEQ ID NO: 2335642 - protein, 17 aa, Cryptosporidium parvum
LCLYDLKTNNFISSSLP

SEQ ID NO: 2335643 - protein, 20 aa, Cryptosporidium parvum
LCQIDLKSIYAYLGSQNQQS

SEQ ID NO: 2335644 - protein, 19 aa, Cryptosporidium parvum
LCSSMSIGAHSTREEAIEL

SEQ ID NO: 2335645 - protein, 25 aa, Cryptosporidium parvum
LCTYFIKGRCKNGSSCQFKHSAIPI

SEQ ID NO: 2335646 - protein, 17 aa, Cryptosporidium parvum
LCYCILGINRVFGANDL

SEQ ID NO: 2335647 - protein, 17 aa, Cryptosporidium parvum
LDATILLIKSRSEEAVI

SEQ ID NO: 2335648 - protein, 17 aa, Cryptosporidium parvum
LDDARTTIEGMVKTIPY

SEQ ID NO: 2335649 - protein, 17 aa, Cryptosporidium parvum
LDFCKIGIWYSKEISNL

SEQ ID NO: 2335650 - protein, 26 aa, Cryptosporidium parvum
LDFENGKYWFGFRFEDENNNKLLSLY

SEQ ID NO: 2335651 - protein, 21 aa, Cryptosporidium parvum
LDHFNSFCVNSLLNYYRNSPS

SEQ ID NO: 2335652 - protein, 19 aa, Cryptosporidium parvum
LDLISFCLTYYQFEEEVTQ

SEQ ID NO: 2335653 - protein, 18 aa, Cryptosporidium parvum
LDLLPKKRTHPITWQLIM

SEQ ID NO: 2335654 - protein, 19 aa, Cryptosporidium parvum
LDLSCTRIEEETKPKSKSK

SEQ ID NO: 2335655 - protein, 17 aa, Cryptosporidium parvum
LDMLGLGDKQIWSGSNY

SEQ ID NO: 2335656 - protein, 24 aa, Cryptosporidium parvum
LDNFLNKWIEVFGENCSDDYLKKL

SEQ ID NO: 2335657 - protein, 25 aa, Cryptosporidium parvum
LDPDLRLVKIPGVKCSGDFQFTNPI

SEQ ID NO: 2335658 - protein, 23 aa, Cryptosporidium parvum
LDPRKFYLGCIGILKVLEAKRVI

SEQ ID NO: 2335659 - protein, 21 aa, Cryptosporidium parvum
LDPSHGLSCSGPYISNQAVTE

SEQ ID NO: 2335660 - protein, 26 aa, Cryptosporidium parvum
LDSMMSLGFYSCFRIICTKKKSGISK

SEQ ID NO: 2335661 - protein, 17 aa, Cryptosporidium parvum
LDTSFSLLEIFKKKSKR

SEQ ID NO: 2335662 - protein, 25 aa, Cryptosporidium parvum
LDVISRFSSCLAKPIITKLGRTVSE

SEQ ID NO: 2335663 - protein, 17 aa, Cryptosporidium parvum
LDVLIVFYAPWCGHCRK

SEQ ID NO: 2335664 - protein, 30 aa, Cryptosporidium parvum
LDVSLFYDKRLRSWIFGDLENIGYNTEESI

SEQ ID NO: 2335665 - protein, 21 aa, Cryptosporidium parvum
LEAMLRLLIIYKNDFTNDLIF

SEQ ID NO: 2335666 - protein, 21 aa, Cryptosporidium parvum
LEDSFLYPINIMYLGYETCSL

SEQ ID NO: 2335667 - protein, 17 aa, Cryptosporidium parvum
LEECLLKILEKVVELEL

SEQ ID NO: 2335668 - protein, 19 aa, Cryptosporidium parvum
LEELVSLSHILPHYCFGNN

SEQ ID NO: 2335669 - protein, 19 aa, Cryptosporidium parvum
LEFWRKSRTSEKMPFKSIT

SEQ ID NO: 2335670 - protein, 19 aa, Cryptosporidium parvum
LEIQFRRKAYGHFQEKEYQ

SEQ ID NO: 2335671 - protein, 18 aa, Cryptosporidium parvum
LEIRNEVHSLLKVEEFKS

SEQ ID NO: 2335672 - protein, 18 aa, Cryptosporidium parvum
LEISDFKNQMYIRSSDTQ

SEQ ID NO: 2335673 - protein, 19 aa, Cryptosporidium parvum
LEIYISRYQFDNFKNMINK

SEQ ID NO: 2335674 - protein, 25 aa, Cryptosporidium parvum
LEKDELIKWIKFVSERSSLKEVEAE

SEQ ID NO: 2335675 - protein, 31 aa, Cryptosporidium parvum; identical to SEQ ID NO: 2207382

SEQ ID NO: 2335676 - protein, 32 aa, Cryptosporidium parvum; identical to SEQ ID NO: 2207383

SEQ ID NO: 2335677 - protein, 20 aa, Cryptosporidium parvum
LELDSYLFSYGVKLPLEKDS

SEQ ID NO: 2335678 - protein, 17 aa, Cryptosporidium parvum
LELIYCMHRGVTHFTTG

SEQ ID NO: 2335679 - protein, 22 aa, Cryptosporidium parvum
LELKLIFPIPYQKNLWRYKLTE

SEQ ID NO: 2335680 - protein, 19 aa, Cryptosporidium parvum
LELNKPCRGKDGNLDSPFE

SEQ ID NO: 2335681 - protein, 17 aa, Cryptosporidium parvum
LEMESLLSISMELLGLI

SEQ ID NO: 2335682 - protein, 19 aa, Cryptosporidium parvum
LEMRNCIGNLNSDYSQLTG

SEQ ID NO: 2335683 - protein, 19 aa, Cryptosporidium parvum
LEMSPDLSLAKFLIIPLRI

SEQ ID NO: 2335684 - protein, 17 aa, Cryptosporidium parvum
LENLKFIIGEPWEGFEI

SEQ ID NO: 2335685 - protein, 17 aa, Cryptosporidium parvum
LENPNCWYNQRGKKVIL

SEQ ID NO: 2335686 - protein, 21 aa, Cryptosporidium parvum
LEPILKEIDIRNEIIRFYQNE

SEQ ID NO: 2335687 - protein, 24 aa, Cryptosporidium parvum
LEPVTPAFSRYILKLRDVLGPKEA

SEQ ID NO: 2335688 - protein, 25 aa, Cryptosporidium parvum
LEQILKCLMLLRLDKYSRKIFKDNS

SEQ ID NO: 2335689 - protein, 20 aa, Cryptosporidium parvum
LEQQSICRLVQLVRPSQLPN

SEQ ID NO: 2335690 - protein, 18 aa, Cryptosporidium parvum
LERARQWAEIAAWRFQSD

SEQ ID NO: 2335691 - protein, 23 aa, Cryptosporidium parvum
LERILRKYFSSIVRKLVLEMSQS

SEQ ID NO: 2335692 - protein, 18 aa, Cryptosporidium parvum
LESAVAKTKHRGSFRLPK

SEQ ID NO: 2335693 - protein, 19 aa, Cryptosporidium parvum
LESEVKVSVSMLKEHFSSV

SEQ ID NO: 2335694 - protein, 18 aa, Cryptosporidium parvum
LESIFFSIHENYRYVEQL

SEQ ID NO: 2335695 - protein, 17 aa, Cryptosporidium parvum
LESIPRFQLEDLQLDPE

SEQ ID NO: 2335696 - protein, 26 aa, Cryptosporidium parvum
LEVDKVCGRKAFKIYSKNNDGKKTII

SEQ ID NO: 2335697 - protein, 19 aa, Cryptosporidium parvum
LEYLLLKNGLMFRVSLTER

SEQ ID NO: 2335698 - protein, 19 aa, Cryptosporidium parvum
LEYLNPFNMVVTFSSSSFN

SEQ ID NO: 2335699 - protein, 23 aa, Cryptosporidium parvum
LFCLGCISVIPGIKNQLVNSMSF

SEQ ID NO: 2335700 - protein, 20 aa, Cryptosporidium parvum
LFCLLILCFNSVLIFCNSSL

SEQ ID NO: 2335701 - protein, 19 aa, Cryptosporidium parvum
LFCRDIAGRFFYPRLFTNS

SEQ ID NO: 2335702 - protein, 31 aa, Cryptosporidium parvum
LFERYEIDHLLKFLNRNSMEFLASARKSMVE

SEQ ID NO: 2335703 - protein, 18 aa, Cryptosporidium parvum
LFFFAIYIMIGISNASDM

SEQ ID NO: 2335704 - protein, 18 aa, Cryptosporidium parvum
LFFIRKKYVPSFNPESSC

SEQ ID NO: 2335705 - protein, 20 aa, Cryptosporidium parvum
LFFLCVLFINKFDFLIGSDT

SEQ ID NO: 2335706 - protein, 19 aa, Cryptosporidium parvum
LFFSFIILLCEYSFSLGNI

SEQ ID NO: 2335707 - protein, 18 aa, Cryptosporidium parvum
LFFSGLFLLNYVFCINTT

SEQ ID NO: 2335708 - protein, 18 aa, Cryptosporidium parvum
LFIDDRMAEEVTYLLNIA

SEQ ID NO: 2335709 - protein, 24 aa, Cryptosporidium parvum
LFKEIIKSGFLQPSIPMISDTAKN

SEQ ID NO: 2335710 - protein, 34 aa, Cryptosporidium parvum
LFLCDLHNFQDYSCLRISILSLKSEVCENSDTGS

SEQ ID NO: 2335711 - protein, 18 aa, Cryptosporidium parvum
LFLGEKTISFLFVNNDVP

SEQ ID NO: 2335712 - protein, 22 aa, Cryptosporidium parvum
LFLLSLWLFLCDLHNFQDYSCL

SEQ ID NO: 2335713 - protein, 22 aa, Cryptosporidium parvum
LFLYKIEVFESVEIEGIQLIGK

SEQ ID NO: 2335714 - protein, 17 aa, Cryptosporidium parvum
LFQFISRINQIKELEEN

SEQ ID NO: 2335715 - protein, 19 aa, Cryptosporidium parvum
LFSKFKHIVFCSSHQDMYA

SEQ ID NO: 2335716 - protein, 20 aa, Cryptosporidium parvum
LFSKKVCHYLHLSHADSDPS

SEQ ID NO: 2335717 - protein, 17 aa, Cryptosporidium parvum
LFSNIIILCLYLGILKC

SEQ ID NO: 2335718 - protein, 19 aa, Cryptosporidium parvum
LFSSLCTGIGLKSPSTSSG

SEQ ID NO: 2335719 - protein, 18 aa, Cryptosporidium parvum
LFTLFLINIINIHDINQY

SEQ ID NO: 2335720 - protein, 25 aa, Cryptosporidium parvum
LFTNRPWKSRIIIQSNFEELLVITK

SEQ ID NO: 2335721 - protein, 29 aa, Cryptosporidium parvum
LFYQTMCFLKRLFVLAGALFVLICLSQKA

SEQ ID NO: 2335722 - protein, 20 aa, Cryptosporidium parvum
LGAGFKAGSLCFTDTMDSYP

SEQ ID NO: 2335723 - protein, 19 aa, Cryptosporidium parvum
LGCPNGWAFNGIKCTGVLT

SEQ ID NO: 2335724 - protein, 28 aa, Cryptosporidium parvum
LGDLISMKFIIEKECNCINKINHLGNNY

SEQ ID NO: 2335725 - protein, 24 aa, Cryptosporidium parvum
LGDRCARFAPKVCPSGGCEKIEST

SEQ ID NO: 2335726 - protein, 20 aa, Cryptosporidium parvum
LGDSNLGMWWTMGNESEFLI

SEQ ID NO: 2335727 - protein, 24 aa, Cryptosporidium parvum
LGDYSIRSSERFNNLFSSLIVNIG

SEQ ID NO: 2335728 - protein, 18 aa, Cryptosporidium parvum
LGELFIVPLTSAIADNYY

SEQ ID NO: 2335729 - protein, 17 aa, Cryptosporidium parvum
LGGTCVNVGCVPKKLMH

SEQ ID NO: 2335730 - protein, 18 aa, Cryptosporidium parvum
LGHMAISIITFFEEHSFI

SEQ ID NO: 2335731 - protein, 23 aa, Cryptosporidium parvum
LGILAIFIKLAITYANQHANEPE

SEQ ID NO: 2335732 - protein, 22 aa, Cryptosporidium parvum
LGITSNRFGFFLVNKDLNALIH

SEQ ID NO: 2335733 - protein, 21 aa, Cryptosporidium parvum
LGKIFCASKLILDVENNKFRI

SEQ ID NO: 2335734 - protein, 17 aa, Cryptosporidium parvum
LGLKEIYPTPVYTPDEV

SEQ ID NO: 2335735 - protein, 17 aa, Cryptosporidium parvum
LGLLFGLVSVHSLSLRA

SEQ ID NO: 2335736 - protein, 49 aa, Cryptosporidium parvum
LGNDSTVKSSSFFNPMDLSHPFFQMKEQFFRPFRPVTTTTTTTTTTTTT

SEQ ID NO: 2335737 - protein, 25 aa, Cryptosporidium parvum
LGSVCSGPLPGAKEVNFGDKIKLSI

SEQ ID NO: 2335738 - protein, 20 aa, Cryptosporidium parvum
LGTGCFPKDVLVAPFKMDQV

SEQ ID NO: 2335739 - protein, 19 aa, Cryptosporidium parvum
LGYYYKIYQDFKEKKKIIL

SEQ ID NO: 2335740 - protein, 26 aa, Cryptosporidium parvum
LHALICIWLLFRIILEPVNGKNDSKF

SEQ ID NO: 2335741 - protein, 19 aa, Cryptosporidium parvum
LHIYPRITGNLSEQRKFEI

SEQ ID NO: 2335742 - protein, 17 aa, Cryptosporidium parvum
LHLKAFPLFSTQLNISK

SEQ ID NO: 2335743 - protein, 25 aa, Cryptosporidium parvum
LHLPRSQRKYSFKFSDINEVDKTLK

SEQ ID NO: 2335744 - protein, 19 aa, Cryptosporidium parvum
LHNEVCKLLTGTDLILVKS

SEQ ID NO: 2335745 - protein, 17 aa, Cryptosporidium parvum
LHSPRAQLLFSKQTEEI

SEQ ID NO: 2335746 - protein, 20 aa, Cryptosporidium parvum
LHVGHLVPFLFTKYLQDTFK

SEQ ID NO: 2335747 - protein, 27 aa, Cryptosporidium parvum
LHYSSLKLRLIFRFILKSMEVSNARKV

SEQ ID NO: 2335748 - protein, 20 aa, Cryptosporidium parvum
LIAFFLFFGVSLIEGKNDGG

SEQ ID NO: 2335749 - protein, 20 aa, Cryptosporidium parvum
LICILIYLNIQVTLGGDAQT

SEQ ID NO: 2335750 - protein, 17 aa, Cryptosporidium parvum
LICPESFVPLSNGNCQK

SEQ ID NO: 2335751 - protein, 25 aa, Cryptosporidium parvum
LIDLALCIKGALQLNNTVTSKSKRT

SEQ ID NO: 2335752 - protein, 19 aa, Cryptosporidium parvum
LIESYYLRLNERLYNPQEV

SEQ ID NO: 2335753 - protein, 21 aa, Cryptosporidium parvum
LIGDEIVCLVLQFTNPKVECP

SEQ ID NO: 2335754 - protein, 20 aa, Cryptosporidium parvum
LIIRAMVLSMTYLVNKFIPV

SEQ ID NO: 2335755 - protein, 24 aa, Cryptosporidium parvum
LIKEMCIYSDKILGLSLARNKDTE

SEQ ID NO: 2335756 - protein, 18 aa, Cryptosporidium parvum
LILEFPIDYQEVLWDSSP

SEQ ID NO: 2335757 - protein, 21 aa, Cryptosporidium parvum
LINLCIFLLVYLQSYQSSLQE

SEQ ID NO: 2335758 - protein, 18 aa, Cryptosporidium parvum
LIQISWLKNSLVLSQLMP

SEQ ID NO: 2335759 - protein, 25 aa, Cryptosporidium parvum
LIRLEDFPCIIFSQNCFPTSNNKFS

SEQ ID NO: 2335760 - protein, 18 aa, Cryptosporidium parvum
LISCFTILILFLQFNTVY

SEQ ID NO: 2335761 - protein, 17 aa, Cryptosporidium parvum
LISCPENYLLLENECVF

SEQ ID NO: 2335762 - protein, 18 aa, Cryptosporidium parvum
LISKRPYLPQGIVPSPIS

SEQ ID NO: 2335763 - protein, 23 aa, Cryptosporidium parvum
LISNPNFQSLRNLTSSTLDNNNI

SEQ ID NO: 2335764 - protein, 18 aa, Cryptosporidium parvum
LITLAFKFAQEVGVRTQD

SEQ ID NO: 2335765 - protein, 25 aa, Cryptosporidium parvum
LITYKQLLLVVAFLFHLFLVLNAIP

SEQ ID NO: 2335766 - protein, 18 aa, Cryptosporidium parvum
LIVPFLVLFTAVEGAPDY

SEQ ID NO: 2335767 - protein, 23 aa, Cryptosporidium parvum
LIVSRARKVQKFLTQPFFMSEAF

SEQ ID NO: 2335768 - protein, 19 aa, Cryptosporidium parvum
LKANVIFTDPYFRYRTDFV

SEQ ID NO: 2335769 - protein, 22 aa, Cryptosporidium parvum
LKDPRAVCLFENFGSFLDLCFP

SEQ ID NO: 2335770 - protein, 21 aa, Cryptosporidium parvum
LKDSFVERLFRACRPNTDLLS

SEQ ID NO: 2335771 - protein, 19 aa, Cryptosporidium parvum
LKEKIKIESSIPINNIYSQ

SEQ ID NO: 2335772 - protein, 22 aa, Cryptosporidium parvum
LKEQVAFPVLELEKNMINKEKL

SEQ ID NO: 2335773 - protein, 19 aa, Cryptosporidium parvum
LKERVSFLYYIYRSYVQQI

SEQ ID NO: 2335774 - protein, 27 aa, Cryptosporidium parvum
LKEVGVAIGEPIWKIYNTSTIGRAQRR

SEQ ID NO: 2335775 - protein, 22 aa, Cryptosporidium parvum
LKFIIGEPWEGFEIAKVQLNSS

SEQ ID NO: 2335776 - protein, 27 aa, Cryptosporidium parvum
LKFIQEFSPDYVYFIGMSCSVEHDETN

SEQ ID NO: 2335777 - protein, 26 aa, Cryptosporidium parvum
LKFQLNKLMSILTMHMIKTKEITITS

SEQ ID NO: 2335778 - protein, 26 aa, Cryptosporidium parvum
LKGCDHIRSSLNISKPIMENNEIFTK

SEQ ID NO: 2335779 - protein, 17 aa, Cryptosporidium parvum
LKGDVLNYFNIICVDEL

SEQ ID NO: 2335780 - protein, 26 aa, Cryptosporidium parvum
LKIKNVFGPNIFKLFKKKEEQKPARK

SEQ ID NO: 2335781 - protein, 17 aa, Cryptosporidium parvum
LKILLSIYQGVASRKSY

SEQ ID NO: 2335782 - protein, 18 aa, Cryptosporidium parvum
LKIPNKRSSRRERSKHSK

SEQ ID NO: 2335783 - protein, 19 aa, Cryptosporidium parvum
LKIPNMHVWWEMKEKHENL

SEQ ID NO: 2335784 - protein, 17 aa, Cryptosporidium parvum
LKIWNLTFLGRRVAFEV

SEQ ID NO: 2335785 - protein, 20 aa, Cryptosporidium parvum
LKKNKECEHCIIKGDQSVKT

SEQ ID NO: 2335786 - protein, 17 aa, Cryptosporidium parvum
LKKSSLNKKGWFSNIDI

SEQ ID NO: 2335787 - protein, 20 aa, Cryptosporidium parvum
LKLEIVTMIIFYSEDDLQVQ

SEQ ID NO: 2335788 - protein, 18 aa, Cryptosporidium parvum
LKLHPKLLIDPLKYDECV

SEQ ID NO: 2335789 - protein, 18 aa, Cryptosporidium parvum
LKLPSSSLILYGQSIGSA

SEQ ID NO: 2335790 - protein, 25 aa, Cryptosporidium parvum
LKLRRGCWYGMRIFDGDGKMTDRTE

SEQ ID NO: 2335791 - protein, 17 aa, Cryptosporidium parvum
LKNDVLYIFYGDKNGIE

SEQ ID NO: 2335792 - protein, 22 aa, Cryptosporidium parvum
LKNQLLRYIPRDNVSVIGVPNQ

SEQ ID NO: 2335793 - protein, 19 aa, Cryptosporidium parvum
LKPEASCCITNTLCYSVSG

SEQ ID NO: 2335794 - protein, 18 aa, Cryptosporidium parvum
LKQISFPGEVAKLYIDKF

SEQ ID NO: 2335795 - protein, 20 aa, Cryptosporidium parvum
LKQWCSGMMTNWYRQLQKMG

SEQ ID NO: 2335796 - protein, 21 aa, Cryptosporidium parvum
LKRNLELFNQTLIYYRVNQTY

SEQ ID NO: 2335797 - protein, 20 aa, Cryptosporidium parvum
LKRTILLVIISIILKSRNTY

SEQ ID NO: 2335798 - protein, 18 aa, Cryptosporidium parvum
LKSGFKLDTINIPPFSLS

SEQ ID NO: 2335799 - protein, 26 aa, Cryptosporidium parvum
LKSIEFEMSEGLGISKDSFFNPELLS

SEQ ID NO: 2335800 - protein, 23 aa, Cryptosporidium parvum
LKSKEIYKICKFTSKPVLNVVMH

SEQ ID NO: 2335801 - protein, 21 aa, Cryptosporidium parvum
LKSLFFFLELSLIITNSSTYI

SEQ ID NO: 2335802 - protein, 20 aa, Cryptosporidium parvum
LKSMVSILINYVSEFISLVE

SEQ ID NO: 2335803 - protein, 22 aa, Cryptosporidium parvum
LKTALILLLKFIGSSGISNYQG

SEQ ID NO: 2335804 - protein, 18 aa, Cryptosporidium parvum
LKTPFKVKVTKDINNIQD

SEQ ID NO: 2335805 - protein, 19 aa, Cryptosporidium parvum
LKTPILLTYCNPDFVFPFR

SEQ ID NO: 2335806 - protein, 22 aa, Cryptosporidium parvum
LKVCMKFNMLDIMLYPRLNNKT

SEQ ID NO: 2335807 - protein, 20 aa, Cryptosporidium parvum
LKYYHSIDCNTPLPNNSALP

SEQ ID NO: 2335808 - protein, 20 aa, Cryptosporidium parvum
LLATIIFCNFALIFCRRIPC

SEQ ID NO: 2335809 - protein, 24 aa, Cryptosporidium parvum
LLAVKFGGIYLDYVQKQYLKKHEC

SEQ ID NO: 2335810 - protein, 27 aa, Cryptosporidium parvum
LLDFEKLRISYNLPIMNINGNIGISTI

SEQ ID NO: 2335811 - protein, 17 aa, Cryptosporidium parvum
LLDSFALLVDSSFSESC

SEQ ID NO: 2335812 - protein, 24 aa, Cryptosporidium parvum
LLECTDALNSWSYFAKMTVKKLLD

SEQ ID NO: 2335813 - protein, 19 aa, Cryptosporidium parvum
LLEEMLIQATTAFSILHSS

SEQ ID NO: 2335814 - protein, 25 aa, Cryptosporidium parvum
LLEGGSCSLQDLFNAGWKFDKKLKI

SEQ ID NO: 2335815 - protein, 25 aa, Cryptosporidium parvum
LLERLFKCILSRKIKKYSKSSGYEV

SEQ ID NO: 2335816 - protein, 18 aa, Cryptosporidium parvum
LLESGYESACMFASNLLK

SEQ ID NO: 2335817 - protein, 25 aa, Cryptosporidium parvum
LLETKRLGVFQIHMNDHPYEISQEV

SEQ ID NO: 2335818 - protein, 24 aa, Cryptosporidium parvum
LLEYLKIKIIKVVHLLNEYNVNEI

SEQ ID NO: 2335819 - protein, 19 aa, Cryptosporidium parvum
LLFCVKFAREVILTTGNEN

SEQ ID NO: 2335820 - protein, 21 aa, Cryptosporidium parvum
LLFCYIYLVAAINGTKRKRKS

SEQ ID NO: 2335821 - protein, 19 aa, Cryptosporidium parvum
LLFIAISLLFISKVKSSRI

SEQ ID NO: 2335822 - protein, 18 aa, Cryptosporidium parvum
LLFILRQVLEVAIKNPRL

SEQ ID NO: 2335823 - protein, 18 aa, Cryptosporidium parvum
LLFKQLRNTLLFSNHLDP

SEQ ID NO: 2335824 - protein, 17 aa, Cryptosporidium parvum
LLFLILSLFNIFIQFKE

SEQ ID NO: 2335825 - protein, 17 aa, Cryptosporidium parvum
LLFTFLESVIFCQEIDK

SEQ ID NO: 2335826 - protein, 17 aa, Cryptosporidium parvum
LLHLQLLIVSVRSNGDD

SEQ ID NO: 2335827 - protein, 19 aa, Cryptosporidium parvum
LLIDPLKYDECVNLFTEAN

SEQ ID NO: 2335828 - protein, 17 aa, Cryptosporidium parvum
LLKKKMQEYGWNDKYFL

SEQ ID NO: 2335829 - protein, 29 aa, Cryptosporidium parvum
LLKKMYKKYYCGINMFIVLSSKRSLTDQE

SEQ ID NO: 2335830 - protein, 20 aa, Cryptosporidium parvum
LLKLIQSVLFDYESSLTPSR

SEQ ID NO: 2335831 - protein, 24 aa, Cryptosporidium parvum
LLLFSLNALRIFEKISARAFVLPK

SEQ ID NO: 2335832 - protein, 20 aa, Cryptosporidium parvum
LLLIFLIQISWLKNSLVLSQ

SEQ ID NO: 2335833 - protein, 18 aa, Cryptosporidium parvum
LLLLFIFFSYCMCGDMIS

SEQ ID NO: 2335834 - protein, 22 aa, Cryptosporidium parvum
LLNLWFTYSFVSGNDLDSKKND

SEQ ID NO: 2335835 - protein, 17 aa, Cryptosporidium parvum
LLNNFFLTYYSRPSKMI

SEQ ID NO: 2335836 - protein, 24 aa, Cryptosporidium parvum
LLNSFPCPFSKVLMKTKDSQSEIE

SEQ ID NO: 2335837 - protein, 24 aa, Cryptosporidium parvum
LLNYLKNRVNAILEESIRIYDSKF

SEQ ID NO: 2335838 - protein, 25 aa, Cryptosporidium parvum
LLPPEHFRKAPPRCVSKQTVFTHYY

SEQ ID NO: 2335839 - protein, 20 aa, Cryptosporidium parvum
LLPYLLVFFQKRVICNIFNT

SEQ ID NO: 2335840 - protein, 19 aa, Cryptosporidium parvum
LLQPGSWSVFQGVKQDSIY

SEQ ID NO: 2335841 - protein, 23 aa, Cryptosporidium parvum
LLRMFKEKLVIRLNDIDEINQQI

SEQ ID NO: 2335842 - protein, 21 aa, Cryptosporidium parvum
LLSFKEGTNFVYFEKSKFDSF

SEQ ID NO: 2335843 - protein, 21 aa, Cryptosporidium parvum
LLSIFFLNWFLIIKRIKGIDL

SEQ ID NO: 2335844 - protein, 20 aa, Cryptosporidium parvum
LLSIPGCVKKLAKFSHEAKA

SEQ ID NO: 2335845 - protein, 19 aa, Cryptosporidium parvum
LLTKRICSIEWKNRFFFGF

SEQ ID NO: 2335846 - protein, 23 aa, Cryptosporidium parvum
LLTTCIKFLLSIYLGESLKVLPT

SEQ ID NO: 2335847 - protein, 23 aa, Cryptosporidium parvum
LMCESCQLITFALKEYISKKLSI

SEQ ID NO: 2335848 - protein, 26 aa, Cryptosporidium parvum
LMEAAKSYSALRFAYGNTKAAQSNNS

SEQ ID NO: 2335849 - protein, 27 aa, Cryptosporidium parvum
LMITKRLHYRLKDILIVLILIIEDIIR

SEQ ID NO: 2335850 - protein, 18 aa, Cryptosporidium parvum
LMLGVAIGTAIGYKLYPN

SEQ ID NO: 2335851 - protein, 29 aa, Cryptosporidium parvum
LMRCCALKYLIVFKSHFNNASSLDILQQS

SEQ ID NO: 2335852 - protein, 24 aa, Cryptosporidium parvum
LMVHKGHRLIPLIIPSDSEFCDSP

SEQ ID NO: 2335853 - protein, 26 aa, Cryptosporidium parvum
LMYMEKFRFLYIISEPSLDGKEIDIV

SEQ ID NO: 2335854 - protein, 19 aa, Cryptosporidium parvum
LMYVREVLDKLYFYPHFRG

SEQ ID NO: 2335855 - protein, 19 aa, Cryptosporidium parvum
LNELLKLTDYYILNLEKFK

SEQ ID NO: 2335856 - protein, 19 aa, Cryptosporidium parvum
LNESCLFSPTPMKISKKDS

SEQ ID NO: 2335857 - protein, 18 aa, Cryptosporidium parvum
LNFFPYCATNGVTYINEC

SEQ ID NO: 2335858 - protein, 18 aa, Cryptosporidium parvum
LNFHFNNFILRYLKSGEL

SEQ ID NO: 2335859 - protein, 17 aa, Cryptosporidium parvum
LNFKCIIPNSAYSSLEF

SEQ ID NO: 2335860 - protein, 19 aa, Cryptosporidium parvum
LNFLLPLKHDRLFLNKLLK

SEQ ID NO: 2335861 - protein, 22 aa, Cryptosporidium parvum
LNFNGTITFIWIMLGLCSSLSN

SEQ ID NO: 2335862 - protein, 24 aa, Cryptosporidium parvum
LNGNWYVKLGEMWYIDNSSSLDFI

SEQ ID NO: 2335863 - protein, 19 aa, Cryptosporidium parvum
LNHFELMAMIKLREELEKH

SEQ ID NO: 2335864 - protein, 17 aa, Cryptosporidium parvum
LNIEVLPNSIWRVFLAS

SEQ ID NO: 2335865 - protein, 26 aa, Cryptosporidium parvum
LNIKGEKGMKIYSWIEETLVEIQTLD

SEQ ID NO: 2335866 - protein, 17 aa, Cryptosporidium parvum
LNIKTEFSLISNDNSTQ

SEQ ID NO: 2335867 - protein, 18 aa, Cryptosporidium parvum
LNKDCTKYEEFLSQNKKF

SEQ ID NO: 2335868 - protein, 19 aa, Cryptosporidium parvum
LNKFCQLLFKQLRNTLLFS

SEQ ID NO: 2335869 - protein, 22 aa, Cryptosporidium parvum
LNLDYAITWAINEDNWGYLNDY

SEQ ID NO: 2335870 - protein, 17 aa, Cryptosporidium parvum
LNLIFLGGALVLDGVFC

SEQ ID NO: 2335871 - protein, 20 aa, Cryptosporidium parvum
LNLIPYKVLNPIMNVTSLSE

SEQ ID NO: 2335872 - protein, 17 aa, Cryptosporidium parvum
LNLNVVGSFQYYDYNRE

SEQ ID NO: 2335873 - protein, 20 aa, Cryptosporidium parvum
LNLYNNWLLRNSEITYENFI

SEQ ID NO: 2335874 - protein, 21 aa, Cryptosporidium parvum
LNMKGLFCLGWNSIKIKKADS

SEQ ID NO: 2335875 - protein, 20 aa, Cryptosporidium parvum
LNNYGIYFAIEFKDDAVCYL

SEQ ID NO: 2335876 - protein, 17 aa, Cryptosporidium parvum
LNPLNGFIALGTNSTSD

SEQ ID NO: 2335877 - protein, 18 aa, Cryptosporidium parvum
LNQWCVNMINSLVDQRLL

SEQ ID NO: 2335878 - protein, 25 aa, Cryptosporidium parvum
LNRSWPFELLDCISMTICSGDDNKL

SEQ ID NO: 2335879 - protein, 24 aa, Cryptosporidium parvum
LNSTKFIYNSRVKAVEALYKKILA

SEQ ID NO: 2335880 - protein, 17 aa, Cryptosporidium parvum
LNTNGFGNMPFSYINTV

SEQ ID NO: 2335881 - protein, 17 aa, Cryptosporidium parvum
LNVGYGLNSQIPLSTQS

SEQ ID NO: 2335882 - protein, 19 aa, Cryptosporidium parvum
LNVISEFRRFMGSTDPKKS

SEQ ID NO: 2335883 - protein, 21 aa, Cryptosporidium parvum
LPDIHKVAAMTFQLPNLRDES

SEQ ID NO: 2335884 - protein, 21 aa, Cryptosporidium parvum
LPELHLLASSLFFEVSKHDKY

SEQ ID NO: 2335885 - protein, 19 aa, Cryptosporidium parvum
LPEVILDIFMGSGFGSQFS

SEQ ID NO: 2335886 - protein, 18 aa, Cryptosporidium parvum
LPIRLHVPIIPIDNSVKI

SEQ ID NO: 2335887 - protein, 25 aa, Cryptosporidium parvum
LPKECDIMKRKKCNCYRTDHSGKIS

SEQ ID NO: 2335888 - protein, 20 aa, Cryptosporidium parvum
LPKLCSNGFLKDIIKINDIK

SEQ ID NO: 2335889 - protein, 18 aa, Cryptosporidium parvum
LPLEKDSNLIWSISESLV

SEQ ID NO: 2335890 - protein, 17 aa, Cryptosporidium parvum
LPLLTGCDLIQMKNFQK

SEQ ID NO: 2335891 - protein, 20 aa, Cryptosporidium parvum
LPLRQSLIFFYYAGIKEVIK

SEQ ID NO: 2335892 - protein, 26 aa, Cryptosporidium parvum
LPNIYSVKILQEFPHYHIPENHIFSE

SEQ ID NO: 2335893 - protein, 24 aa, Cryptosporidium parvum
LPNSIWRVFLASGILTSITTTNMS

SEQ ID NO: 2335894 - protein, 21 aa, Cryptosporidium parvum
LPPEYSCMMFLLVEQAKNIIR

SEQ ID NO: 2335895 - protein, 18 aa, Cryptosporidium parvum
LPPKRFISKYSKNDSTIS

SEQ ID NO: 2335896 - protein, 18 aa, Cryptosporidium parvum
LPPSNFPKTGYRGCGSNF

SEQ ID NO: 2335897 - protein, 22 aa, Cryptosporidium parvum
LPQKNLDTFIGRAAHIQVIENQ

SEQ ID NO: 2335898 - protein, 18 aa, Cryptosporidium parvum
LPQQMLLIDNAYFPNGLS

SEQ ID NO: 2335899 - protein, 18 aa, Cryptosporidium parvum
LPRLPGIRYIVLLRPEDG

SEQ ID NO: 2335900 - protein, 20 aa, Cryptosporidium parvum
LPSGTLLPGGFSNRVALAVL

SEQ ID NO: 2335901 - protein, 18 aa, Cryptosporidium parvum
LPSSPLYIKGKKFGIKNL

SEQ ID NO: 2335902 - protein, 18 aa, Cryptosporidium parvum
LPTFQKFVSRHRKLAFTL

SEQ ID NO: 2335903 - protein, 21 aa, Cryptosporidium parvum
LPVEYKDIFYLKQCSNSNEDL

SEQ ID NO: 2335904 - protein, 20 aa, Cryptosporidium parvum
LQAVILVCLLYLCIHVEGNG

SEQ ID NO: 2335905 - protein, 26 aa, Cryptosporidium parvum
LQEFFYGIEFSWRGYSSIFPDSLNEI

SEQ ID NO: 2335906 - protein, 19 aa, Cryptosporidium parvum
LQGFTQIKECLSIKKLQKW

SEQ ID NO: 2335907 - protein, 20 aa, Cryptosporidium parvum
LQILFGWFSFSNGFASVTVS

SEQ ID NO: 2335908 - protein, 19 aa, Cryptosporidium parvum
LQIPGLLFIDTPGHESFNN

SEQ ID NO: 2335909 - protein, 17 aa, Cryptosporidium parvum
LQISFANVFFNSISRRR

SEQ ID NO: 2335910 - protein, 17 aa, Cryptosporidium parvum
LQTRKFLLDAIARASRQ

SEQ ID NO: 2335911 - protein, 25 aa, Cryptosporidium parvum
LQVKSGKEISEWQRIRYKTEQWKML

SEQ ID NO: 2335912 - protein, 21 aa, Cryptosporidium parvum
LQYLKECKIGVKFGSNEEELK

SEQ ID NO: 2335913 - protein, 19 aa, Cryptosporidium parvum
LQYLLGVILLIGIVHALIF

SEQ ID NO: 2335914 - protein, 18 aa, Cryptosporidium parvum
LRADLKLFENLQILLSEK

SEQ ID NO: 2335915 - protein, 17 aa, Cryptosporidium parvum
LRCRESLRVVSNGMKVS

SEQ ID NO: 2335916 - protein, 19 aa, Cryptosporidium parvum
LRDEYSISEFLSGNQSNED

SEQ ID NO: 2335917 - protein, 23 aa, Cryptosporidium parvum
LRDHPSLSIFGFFRGLSTDNVRI

SEQ ID NO: 2335918 - protein, 19 aa, Cryptosporidium parvum
LRDLCTVASKMSMESFLRT

SEQ ID NO: 2335919 - protein, 18 aa, Cryptosporidium parvum
LRESCWNITSQSTLEEFK

SEQ ID NO: 2335920 - protein, 19 aa, Cryptosporidium parvum
LRGILLPLVDMFQVSIGCA

SEQ ID NO: 2335921 - protein, 19 aa, Cryptosporidium parvum
LRGSLDCFLNFYTSFSQPF

SEQ ID NO: 2335922 - protein, 26 aa, Cryptosporidium parvum
LRIPHFSVGVIPTALFLKLNTGEYMS

SEQ ID NO: 2335923 - protein, 19 aa, Cryptosporidium parvum
LRISYWDLSRLSLLFYWNL

SEQ ID NO: 2335924 - protein, 22 aa, Cryptosporidium parvum
LRKKLLLACSGIHMHLFEIKPK

SEQ ID NO: 2335925 - protein, 20 aa, Cryptosporidium parvum
LRKLIIIVGISGILRNERTS

SEQ ID NO: 2335926 - protein, 20 aa, Cryptosporidium parvum
LRLDPSPTYFESYYQFRKAL

SEQ ID NO: 2335927 - protein, 17 aa, Cryptosporidium parvum
LRLKEGITYILDTKEDF

SEQ ID NO: 2335928 - protein, 22 aa, Cryptosporidium parvum
LRLPATSKEWFVYIRAQTVTFS

SEQ ID NO: 2335929 - protein, 19 aa, Cryptosporidium parvum
LRLPENFVASKGVETVFID

SEQ ID NO: 2335930 - protein, 21 aa, Cryptosporidium parvum
LRLTFDSSITNEWMGNSLIEY

SEQ ID NO: 2335931 - protein, 17 aa, Cryptosporidium parvum
LRLTGVSVKAFIIYVKY

SEQ ID NO: 2335932 - protein, 24 aa, Cryptosporidium parvum
LRLWEYRKEIVLNQIMSFPVNPSL

SEQ ID NO: 2335933 - protein, 19 aa, Cryptosporidium parvum
LRNFLHVVKQLHLNTLRKD

SEQ ID NO: 2335934 - protein, 24 aa, Cryptosporidium parvum
LRNVDPDNPLECILLVEGPKSKRN

SEQ ID NO: 2335935 - protein, 17 aa, Cryptosporidium parvum
LRRLYPQSSDLDMKSLV

SEQ ID NO: 2335936 - protein, 20 aa, Cryptosporidium parvum
LRRNFAYHLATSFVYWHYYI

SEQ ID NO: 2335937 - protein, 24 aa, Cryptosporidium parvum
LRSESNRLVFAYQLIDGSLIPSSA

SEQ ID NO: 2335938 - protein, 26 aa, Cryptosporidium parvum
LRSSESFNNSFLFNFEKMVFKSFYNL

SEQ ID NO: 2335939 - protein, 24 aa, Cryptosporidium parvum
LRSSRPEMPIWYFGTEEQRDREKR

SEQ ID NO: 2335940 - protein, 18 aa, Cryptosporidium parvum
LRTECWLLESELLSLSEE

SEQ ID NO: 2335941 - protein, 21 aa, Cryptosporidium parvum
LRTIAGKHCVNAQLFLKYRSS

SEQ ID NO: 2335942 - protein, 19 aa, Cryptosporidium parvum
LRTSTGASLVECKALGESL

SEQ ID NO: 2335943 - protein, 18 aa, Cryptosporidium parvum
LRYSFRVESSFSGKRGQL

SEQ ID NO: 2335944 - protein, 18 aa, Cryptosporidium parvum
LSAAMLVCQKRDYIPKQI

SEQ ID NO: 2335945 - protein, 28 aa, Cryptosporidium parvum
LSCEESWIGDGWCDKECFSDDCGNDGGD

SEQ ID NO: 2335946 - protein, 24 aa, Cryptosporidium parvum
LSCILNIRLLFFIFTVANAANNSD

SEQ ID NO: 2335947 - protein, 18 aa, Cryptosporidium parvum
LSCKAPFSLVGGDCLYNA

SEQ ID NO: 2335948 - protein, 25 aa, Cryptosporidium parvum
LSDCTLPIWKNILKFATHYIGGLFG

SEQ ID NO: 2335949 - protein, 25 aa, Cryptosporidium parvum
LSDEGYPLFKWMESVMNLKNPGDRE

SEQ ID NO: 2335950 - protein, 19 aa, Cryptosporidium parvum
LSDFIYLLKMILKKSKIHN

SEQ ID NO: 2335951 - protein, 18 aa, Cryptosporidium parvum
LSECKMLLPYGVDQKEII

SEQ ID NO: 2335952 - protein, 21 aa, Cryptosporidium parvum
LSEEGLNCDIYWKNDDFRGNV

SEQ ID NO: 2335953 - protein, 27 aa, Cryptosporidium parvum
LSEGCPCSRNIFSLECSCSVYPKNPGC

SEQ ID NO: 2335954 - protein, 24 aa, Cryptosporidium parvum
LSEPRTVSGIVINWASSPGEVRID

SEQ ID NO: 2335955 - protein, 28 aa, Cryptosporidium parvum
LSEYTFKIEVMINFSFEAILFAIENFFF

SEQ ID NO: 2335956 - protein, 17 aa, Cryptosporidium parvum
LSGFSGKISTWFKNNYL

SEQ ID NO: 2335957 - protein, 17 aa, Cryptosporidium parvum
LSGKVPEHFQYIFRRSY

SEQ ID NO: 2335958 - protein, 27 aa, Cryptosporidium parvum
LSGKWKNPINFILRCRESLRVVSNGMK

SEQ ID NO: 2335959 - protein, 19 aa, Cryptosporidium parvum
LSGNICSVSSQFVEFLLEL

SEQ ID NO: 2335960 - protein, 17 aa, Cryptosporidium parvum
LSIFILLIKSLDNICFA

SEQ ID NO: 2335961 - protein, 22 aa, Cryptosporidium parvum
LSILLKLSFYIQYIVYFPNTGK

SEQ ID NO: 2335962 - protein, 17 aa, Cryptosporidium parvum
LSKIRNAYSYIQNPMNS

SEQ ID NO: 2335963 - protein, 18 aa, Cryptosporidium parvum
LSKRYGILEYRFDEICKA

SEQ ID NO: 2335964 - protein, 22 aa, Cryptosporidium parvum
LSKYRKSGVTSVFFYNGDDKVA

SEQ ID NO: 2335965 - protein, 20 aa, Cryptosporidium parvum
LSLAKFLIIPLRIGKENLNE

SEQ ID NO: 2335966 - protein, 20 aa, Cryptosporidium parvum
LSLDVIRMVSMYRYGDIRYL

SEQ ID NO: 2335967 - protein, 19 aa, Cryptosporidium parvum
LSLVWLSIYDKIQIRHRNE

SEQ ID NO: 2335968 - protein, 19 aa, Cryptosporidium parvum
LSNEVVLNFSLVKNLNISN

SEQ ID NO: 2335969 - protein, 18 aa, Cryptosporidium parvum
LSNGVLFGRILSSETNLN

SEQ ID NO: 2335970 - protein, 20 aa, Cryptosporidium parvum
LSNLELFGFDNLVSSGDYSQ

SEQ ID NO: 2335971 - protein, 24 aa, Cryptosporidium parvum
LSNLPDIFYGNGIQILLQPFSDLS

SEQ ID NO: 2335972 - protein, 17 aa, Cryptosporidium parvum
LSNYYLLEFNQEEERIR

SEQ ID NO: 2335973 - protein, 24 aa, Cryptosporidium parvum
LSPKMTIPLIYRVFLPSDILPGKN

SEQ ID NO: 2335974 - protein, 25 aa, Cryptosporidium parvum
LSPPLRYTIFIALLKLVSELTFEQS

SEQ ID NO: 2335975 - protein, 34 aa, Cryptosporidium parvum
LSQSLPCFKFTRREFLPLFSAFFQKKAIRNLEYY

SEQ ID NO: 2335976 - protein, 24 aa, Cryptosporidium parvum
LSREMLPFKYLIPVGESPYSKMRV

SEQ ID NO: 2335977 - protein, 18 aa, Cryptosporidium parvum
LSRGRKKPVLRSMRTLSL

SEQ ID NO: 2335978 - protein, 17 aa, Cryptosporidium parvum
LSRLKLFNRNHMKKKMG

SEQ ID NO: 2335979 - protein, 17 aa, Cryptosporidium parvum
LSSCLTYIINNQESTKE

SEQ ID NO: 2335980 - protein, 24 aa, Cryptosporidium parvum
LSSELKANMGVHFDVNLDPNSDSA

SEQ ID NO: 2335981 - protein, 21 aa, Cryptosporidium parvum
LSSFLLWLVSTSFLINLARSS

SEQ ID NO: 2335982 - protein, 25 aa, Cryptosporidium parvum
LSSLGSRPGIKGSYKQEGREEKKTF

SEQ ID NO: 2335983 - protein, 18 aa, Cryptosporidium parvum
LSSPRPRRRNPWRYGNKG

SEQ ID NO: 2335984 - protein, 21 aa, Cryptosporidium parvum
LSSYHASSRFIKLRDSFDNDG

SEQ ID NO: 2335985 - protein, 17 aa, Cryptosporidium parvum
LSTLEWNIIQSRWELLK

SEQ ID NO: 2335986 - protein, 19 aa, Cryptosporidium parvum
LSTYPITFKTSIGIISQPI

SEQ ID NO: 2335987 - protein, 20 aa, Cryptosporidium parvum
LSYDVWSVGIVMLQMIWGNL

SEQ ID NO: 2335988 - protein, 17 aa, Cryptosporidium parvum
LTDSKFNKLVNGRFNTT

SEQ ID NO: 2335989 - protein, 23 aa, Cryptosporidium parvum
LTEIACSTYGMVLSPMYDALGPD

SEQ ID NO: 2335990 - protein, 26 aa, Cryptosporidium parvum
LTELYRYLMVHNYLHIIGSIYRHTKN

SEQ ID NO: 2335991 - protein, 17 aa, Cryptosporidium parvum
LTEVSGELNRLFNKIKF

SEQ ID NO: 2335992 - protein, 18 aa, Cryptosporidium parvum
LTGVSVKAFIIYVKYKAD

SEQ ID NO: 2335993 - protein, 19 aa, Cryptosporidium parvum
LTKKKARSLLPERTNTSNM

SEQ ID NO: 2335994 - protein, 23 aa, Cryptosporidium parvum
LTNKRITKNFGFLSSELARTLTI

SEQ ID NO: 2335995 - protein, 17 aa, Cryptosporidium parvum
LTPCSYMYPIVISLKNI

SEQ ID NO: 2335996 - protein, 24 aa, Cryptosporidium parvum
LTRAFCTLSSIPKCHFDTNDSDHK

SEQ ID NO: 2335997 - protein, 26 aa, Cryptosporidium parvum
LTSGIWKPKERFAGFQPPIINSAQGA

SEQ ID NO: 2335998 - protein, 19 aa, Cryptosporidium parvum
LTYEPIRKMYSIGIENNSK

SEQ ID NO: 2335999 - protein, 27 aa, Cryptosporidium parvum
LVANVTCPDLLIHLTHLAQKGMVESMN

SEQ ID NO: 2336000 - protein, 17 aa, Cryptosporidium parvum
LVCPPGFSSSKPIQPIS

SEQ ID NO: 2336001 - protein, 17 aa, Cryptosporidium parvum
LVDETLQILGLSRMVVG

SEQ ID NO: 2336002 - protein, 17 aa, Cryptosporidium parvum
LVDFCPIAEALLHEVDL

SEQ ID NO: 2336003 - protein, 17 aa, Cryptosporidium parvum
LVFIFGLLILSCRAEEI

SEQ ID NO: 2336004 - protein, 17 aa, Cryptosporidium parvum
LVHEAAERIKVQMVNSG

SEQ ID NO: 2336005 - protein, 27 aa, Cryptosporidium parvum
LVKIRSLICLSFFKLMRFKEVSEEIYK

SEQ ID NO: 2336006 - protein, 30 aa, Cryptosporidium parvum; identical to SEQ ID NO: 2207631

SEQ ID NO: 2336007 - protein, 24 aa, Cryptosporidium parvum
LVLTLSLLAGFVFGTNENPNFLRL

SEQ ID NO: 2336008 - protein, 25 aa, Cryptosporidium parvum
LVNHKKLFKILNFHVDKVIFSSLDK

SEQ ID NO: 2336009 - protein, 25 aa, Cryptosporidium parvum
LVNLLTLMLLQGHFGQIGCKSSDKG

SEQ ID NO: 2336010 - protein, 18 aa, Cryptosporidium parvum
LVQLGFNVAHTFGNATCN

SEQ ID NO: 2336011 - protein, 24 aa, Cryptosporidium parvum
LVRKSREALQVSIFTYFMAQKKLS

SEQ ID NO: 2336012 - protein, 22 aa, Cryptosporidium parvum
LVRTWYRVFRKLGSTKNRMKKS

SEQ ID NO: 2336013 - protein, 18 aa, Cryptosporidium parvum
LVSLSIQCGDEFFKPVGN

SEQ ID NO: 2336014 - protein, 18 aa, Cryptosporidium parvum
LVSVHSLSLRAGSQELII

SEQ ID NO: 2336015 - protein, 25 aa, Cryptosporidium parvum
LVTCKPGYFLKGLHVFSNTSEDIIQ

SEQ ID NO: 2336016 - protein, 19 aa, Cryptosporidium parvum
LVTMLPIVRYMKLLNSYGE

SEQ ID NO: 2336017 - protein, 21 aa, Cryptosporidium parvum
LVTRNGLRIGHNYRDEIYIRS

SEQ ID NO: 2336018 - protein, 17 aa, Cryptosporidium parvum
LVVPPKFTGSVDKYPSK

SEQ ID NO: 2336019 - protein, 18 aa, Cryptosporidium parvum
LWDSYNFIQKGVIYGRAG

SEQ ID NO: 2336020 - protein, 18 aa, Cryptosporidium parvum
LWEKGLKSPFKFDSNSEF

SEQ ID NO: 2336021 - protein, 19 aa, Cryptosporidium parvum
LWIYYEHHRLPNLKEKLVF

SEQ ID NO: 2336022 - protein, 17 aa, Cryptosporidium parvum
LWNRIHSLAAKGLHPLI

SEQ ID NO: 2336023 - protein, 24 aa, Cryptosporidium parvum
LYDIMKHYIVRGTLKVIATLSNEN

SEQ ID NO: 2336024 - protein, 17 aa, Cryptosporidium parvum
LYDKLFIHLIDAKIWHG

SEQ ID NO: 2336025 - protein, 19 aa, Cryptosporidium parvum
LYFNGLRPRPATLAQKQNE

SEQ ID NO: 2336026 - protein, 18 aa, Cryptosporidium parvum
LYGKSDIFSIVIIPDCED

SEQ ID NO: 2336027 - protein, 20 aa, Cryptosporidium parvum
LYIDKKLNVIPVRNNLINVV

SEQ ID NO: 2336028 - protein, 36 aa, Cryptosporidium parvum; identical to SEQ ID NO: 2207650

SEQ ID NO: 2336029 - protein, 19 aa, Cryptosporidium parvum
LYLFSTCNGTSAKIMPEDA

SEQ ID NO: 2336030 - protein, 19 aa, Cryptosporidium parvum
LYLLCSIFVGSSHSEEVPA

SEQ ID NO: 2336031 - protein, 18 aa, Cryptosporidium parvum
LYNIFSRIGRLEYYHSPK

SEQ ID NO: 2336032 - protein, 17 aa, Cryptosporidium parvum
LYNMYKLQWEIYERLGD

SEQ ID NO: 2336033 - protein, 20 aa, Cryptosporidium parvum
LYNSALRKGWFLPQNIPVAN

SEQ ID NO: 2336034 - protein, 19 aa, Cryptosporidium parvum
LYTGFRFIASVLLKRQEIF

SEQ ID NO: 2336035 - protein, 23 aa, Cryptosporidium parvum
LYVKPKAGLMLSSYQLPDGSQKL

SEQ ID NO: 2336036 - protein, 17 aa, Cryptosporidium parvum
LYVLPFIQGGVQTHFSD

SEQ ID NO: 2336037 - protein, 21 aa, Cryptosporidium parvum
MALKFLRGNGVGFLSDSVKAI

SEQ ID NO: 2336038 - protein, 21 aa, Cryptosporidium parvum
MASFARGYSRYVLETVSLAVS

SEQ ID NO: 2336039 - protein, 18 aa, Cryptosporidium parvum
MCVVEKLLPAEVECPKDF

SEQ ID NO: 2336040 - protein, 23 aa, Cryptosporidium parvum
MDDKGGSMFDVFASKAEGAEGGD

SEQ ID NO: 2336041 - protein, 24 aa, Cryptosporidium parvum
MDFALPLNCLAKLVVVKSQGEKVV

SEQ ID NO: 2336042 - protein, 31 aa, Cryptosporidium parvum; identical to SEQ ID NO: 2207662

SEQ ID NO: 2336043 - protein, 26 aa, Cryptosporidium parvum
MDKLRRINLCFIPEGQENTWYAPMVF

SEQ ID NO: 2336044 - protein, 25 aa, Cryptosporidium parvum
MDLEIGEIFVNFDFSLLSNGDFIDS

SEQ ID NO: 2336045 - protein, 18 aa, Cryptosporidium parvum
MEEILGGILFESKKLVSW

SEQ ID NO: 2336046 - protein, 18 aa, Cryptosporidium parvum
MEVADFVLGCPNGWAFNG

SEQ ID NO: 2336047 - protein, 17 aa, Cryptosporidium parvum
MFRNFVIPTPRYYKAPE

SEQ ID NO: 2336048 - protein, 21 aa, Cryptosporidium parvum
MGAKHTSSCIVDFQPVNATHM

SEQ ID NO: 2336049 - protein, 24 aa, Cryptosporidium parvum
MGNNKGLISWLFLSTVTFTVLVLS

SEQ ID NO: 2336050 - protein, 19 aa, Cryptosporidium parvum
MHEYAQWIFVNNGFLAKSS

SEQ ID NO: 2336051 - protein, 25 aa, Cryptosporidium parvum
MHFGMAPFFSGMLMSYSLQDVVGSA

SEQ ID NO: 2336052 - protein, 24 aa, Cryptosporidium parvum
MIAKCARLIINAHLSNNSVDYLSY

SEQ ID NO: 2336053 - protein, 18 aa, Cryptosporidium parvum
MIILPIFVDNNLKTSKSD

SEQ ID NO: 2336054 - protein, 18 aa, Cryptosporidium parvum
MINIFKAQFSEFIDYEGL

SEQ ID NO: 2336055 - protein, 25 aa, Cryptosporidium parvum
MIPSIWYLELIHCMHFGMAPFFSGM

SEQ ID NO: 2336056 - protein, 23 aa, Cryptosporidium parvum
MKAARPTVFIAVPRLFTRIYKGK

SEQ ID NO: 2336057 - protein, 18 aa, Cryptosporidium parvum
MKDKLGVKPEDETIKRVD

SEQ ID NO: 2336058 - protein, 20 aa, Cryptosporidium parvum
MKIYLSNSIFGYYSLIIDIN

SEQ ID NO: 2336059 - protein, 18 aa, Cryptosporidium parvum
MKKLLKLMNELRQKRNEL

SEQ ID NO: 2336060 - protein, 20 aa, Cryptosporidium parvum
MKLFYSSAVPMSWDEQQSQF

SEQ ID NO: 2336061 - protein, 22 aa, Cryptosporidium parvum
MKPASVDCPIGFSRQGSQCVKI

SEQ ID NO: 2336062 - protein, 17 aa, Cryptosporidium parvum
MKSLFGVETTKKADGVL

SEQ ID NO: 2336063 - protein, 18 aa, Cryptosporidium parvum
MKTICSMSLIGGIHSLDY

SEQ ID NO: 2336064 - protein, 27 aa, Cryptosporidium parvum
MKYLNCFMITFFFIKIDAINVGENHEK

SEQ ID NO: 2336065 - protein, 22 aa, Cryptosporidium parvum
MKYSVEMFVIAGMFVSGEEGAE

SEQ ID NO: 2336066 - protein, 20 aa, Cryptosporidium parvum
MKYYRESINFQRDSKGDNSI

SEQ ID NO: 2336067 - protein, 18 aa, Cryptosporidium parvum
MLFPDLKLQIELLDREKE

SEQ ID NO: 2336068 - protein, 21 aa, Cryptosporidium parvum
MLNSRSSIVLDKLRQKFPNCA

SEQ ID NO: 2336069 - protein, 19 aa, Cryptosporidium parvum
MLPLPLGPPIPGTEPGIEG

SEQ ID NO: 2336070 - protein, 26 aa, Cryptosporidium parvum
MLVSGLMTYCKLNFRGFPIEKNGRSI

SEQ ID NO: 2336071 - protein, 17 aa, Cryptosporidium parvum
MLYLLTLVKTFFGKIRS

SEQ ID NO: 2336072 - protein, 28 aa, Cryptosporidium parvum
MMKSPNWKGNFVPWRFVESCTNILRTLS

SEQ ID NO: 2336073 - protein, 25 aa, Cryptosporidium parvum
MNFAILPKWRDSWQDEIRKPSPLDE

SEQ ID NO: 2336074 - protein, 19 aa, Cryptosporidium parvum
MNFMLKKSIIKLCSIVVNS

SEQ ID NO: 2336075 - protein, 25 aa, Cryptosporidium parvum
MNFTIGIGLSRLGLYLMNSKLQSLI

SEQ ID NO: 2336076 - protein, 23 aa, Cryptosporidium parvum
MNHGNCICMGYCFHFEEQNVIYI

SEQ ID NO: 2336077 - protein, 34 aa, Cryptosporidium parvum; identical to SEQ ID NO: 2207683

SEQ ID NO: 2336078 - protein, 23 aa, Cryptosporidium parvum
MNNNFKLSFTFDVKFEGSELKVI

SEQ ID NO: 2336079 - protein, 17 aa, Cryptosporidium parvum
MPCEGIFTAVPRYHGKK

SEQ ID NO: 2336080 - protein, 18 aa, Cryptosporidium parvum
MPCNFRLVADLDMNSKPG

SEQ ID NO: 2336081 - protein, 22 aa, Cryptosporidium parvum
MPEIDPKFPRNFVIYTEDVPKK

SEQ ID NO: 2336082 - protein, 19 aa, Cryptosporidium parvum
MPERVCLNGGELMSDFNCM

SEQ ID NO: 2336083 - protein, 19 aa, Cryptosporidium parvum
MPIPFFTASLPLIGQLAAN

SEQ ID NO: 2336084 - protein, 22 aa, Cryptosporidium parvum
MPNKMCPAGFELIDDDQCSQTV

SEQ ID NO: 2336085 - protein, 18 aa, Cryptosporidium parvum
MPNMKIKLLEKLFPRRNF

SEQ ID NO: 2336086 - protein, 32 aa, Cryptosporidium parvum; identical to SEQ ID NO: 2207686

SEQ ID NO: 2336087 - protein, 23 aa, Cryptosporidium parvum
MPRTQRGPSDWGYTTTAINGRTK

SEQ ID NO: 2336088 - protein, 17 aa, Cryptosporidium parvum
MQKRPPLKKEYAYGAVM

SEQ ID NO: 2336089 - protein, 25 aa, Cryptosporidium parvum
MQVNSYLLKIGRMLNRDFVAVSDVS

SEQ ID NO: 2336090 - protein, 17 aa, Cryptosporidium parvum
MRELMKIGTQFTSEIAQ

SEQ ID NO: 2336091 - protein, 19 aa, Cryptosporidium parvum
MRIKTEFSIYLSFGSNIDP

SEQ ID NO: 2336092 - protein, 19 aa, Cryptosporidium parvum
MRIRSFDWANPQHVYGRLG

SEQ ID NO: 2336093 - protein, 17 aa, Cryptosporidium parvum
MRLRTIAGKHCVNAQLF

SEQ ID NO: 2336094 - protein, 35 aa, Cryptosporidium parvum
MRMFMFKEFSMDYLARKGLPLNINEEAMYSPENFD

SEQ ID NO: 2336095 - protein, 19 aa, Cryptosporidium parvum
MRNALCLDPDLRLVKIPGV

SEQ ID NO: 2336096 - protein, 25 aa, Cryptosporidium parvum
MRNNCAGCIWDLYVNKVSKDLYIDG

SEQ ID NO: 2336097 - protein, 21 aa, Cryptosporidium parvum
MRRIRRRLCCCCCSTSCDSDS

SEQ ID NO: 2336098 - protein, 30 aa, Cryptosporidium parvum; identical to SEQ ID NO: 2207691

SEQ ID NO: 2336099 - protein, 22 aa, Cryptosporidium parvum
MSSLKPVYVFIHGGLYLFGSSN

SEQ ID NO: 2336100 - protein, 23 aa, Cryptosporidium parvum
MSTGFKMWWNEVVNSVGAESTNQ

SEQ ID NO: 2336101 - protein, 24 aa, Cryptosporidium parvum
MTNNLRSVVSFCRDAALSKDARDK

SEQ ID NO: 2336102 - protein, 22 aa, Cryptosporidium parvum
MTPIKNIICDSVSLQKSLQKFQ

SEQ ID NO: 2336103 - protein, 17 aa, Cryptosporidium parvum
MVFKSFYNLSLFFLKWF

SEQ ID NO: 2336104 - protein, 18 aa, Cryptosporidium parvum
MVGYGGKYTFRFSAVGSG

SEQ ID NO: 2336105 - protein, 17 aa, Cryptosporidium parvum
MVLSMTYLVNKFIPVEE

SEQ ID NO: 2336106 - protein, 24 aa, Cryptosporidium parvum
MYLGMAPKFLGMVFSYSLKDIIGA

SEQ ID NO: 2336107 - protein, 17 aa, Cryptosporidium parvum
MYLYPSFDKKLKPKKKL

SEQ ID NO: 2336108 - protein, 32 aa, Cryptosporidium parvum
MYRYGDIRYLLSREFLYLFGKFGELDDYNIYT

SEQ ID NO: 2336109 - protein, 24 aa, Cryptosporidium parvum
NAAPELMSSLGFNKPNFPFTIIDV

SEQ ID NO: 2336110 - protein, 20 aa, Cryptosporidium parvum
NADLFRKTIEPVKKVLEDAG

SEQ ID NO: 2336111 - protein, 18 aa, Cryptosporidium parvum
NAGWKFDKKLKIWVRGNN

SEQ ID NO: 2336112 - protein, 17 aa, Cryptosporidium parvum
NAIFEEWMDLISNTDLS

SEQ ID NO: 2336113 - protein, 25 aa, Cryptosporidium parvum
NAIGLLRYGFLYALINEINNQFQKK

SEQ ID NO: 2336114 - protein, 19 aa, Cryptosporidium parvum
NAIQMLHLEIAPSLEGRDF

SEQ ID NO: 2336115 - protein, 24 aa, Cryptosporidium parvum
NALPRCQCLPGYIGDGRTKGTGCQ

SEQ ID NO: 2336116 - protein, 25 aa, Cryptosporidium parvum
NARSFAYKYGHYFKRRIKKMEIFLN

SEQ ID NO: 2336117 - protein, 37 aa, Cryptosporidium parvum
NASEGILTGIGGIDLPGMPLSTEYTNSTNLDSSKVLL

SEQ ID NO: 2336118 - protein, 18 aa, Cryptosporidium parvum
NASFPASRTQFQMDPNHG

SEQ ID NO: 2336119 - protein, 17 aa, Cryptosporidium parvum
NASLPASRTQFQMDSRH

SEQ ID NO: 2336120 - protein, 28 aa, Cryptosporidium parvum
NCGCRMCDCSCLFCLQHPFDSPKKSIYD

SEQ ID NO: 2336121 - protein, 23 aa, Cryptosporidium parvum
NCKTPCTREYRPICGNDGVTYGN

SEQ ID NO: 2336122 - protein, 24 aa, Cryptosporidium parvum
NCSSNFDFYFPLRPYTMVGNLIDD

SEQ ID NO: 2336123 - protein, 17 aa, Cryptosporidium parvum
NCTGRHALSEGCPCSRN

SEQ ID NO: 2336124 - protein, 22 aa, Cryptosporidium parvum
NDELKMRILLKIHEEKTKLMYV

SEQ ID NO: 2336125 - protein, 24 aa, Cryptosporidium parvum
NDFKKRLKSLAAVYHYNITNDWQG

SEQ ID NO: 2336126 - protein, 19 aa, Cryptosporidium parvum
NDHLKRLASTSAVMSCTLG

SEQ ID NO: 2336127 - protein, 29 aa, Cryptosporidium parvum
NDLLTLRKLRIIPGIIFRVKLSGSPIEPS

SEQ ID NO: 2336128 - protein, 17 aa, Cryptosporidium parvum
NDLSLLNSFPCPFSKVL

SEQ ID NO: 2336129 - protein, 17 aa, Cryptosporidium parvum
NDPEFQLGNLLWIQLKM

SEQ ID NO: 2336130 - protein, 20 aa, Cryptosporidium parvum
NDRGLGFVVDFISQAAYPVT

SEQ ID NO: 2336131 - protein, 18 aa, Cryptosporidium parvum
NDRNINMMYISKDPIEGV

SEQ ID NO: 2336132 - protein, 19 aa, Cryptosporidium parvum
NEALKKYKTFFVPSTDGRI

SEQ ID NO: 2336133 - protein, 23 aa, Cryptosporidium parvum
NECDLHLKWAPFVTSSECLAYIG

SEQ ID NO: 2336134 - protein, 26 aa, Cryptosporidium parvum
NEDFNYFKFIYPRGYSPSRSIFTQKI

SEQ ID NO: 2336135 - protein, 23 aa, Cryptosporidium parvum
NEFELPGLVNIYFVSNDHQNILS

SEQ ID NO: 2336136 - protein, 26 aa, Cryptosporidium parvum
NEFFPDLVYGDSFPFYPPGVHPAPIV

SEQ ID NO: 2336137 - protein, 25 aa, Cryptosporidium parvum
NEFMYKKHLNNILSLSTYVYTSKLL

SEQ ID NO: 2336138 - protein, 22 aa, Cryptosporidium parvum
NEFWIPICLPAISTVSYVYCYI

SEQ ID NO: 2336139 - protein, 31 aa, Cryptosporidium parvum
NEGDIPLEYMLKLPKGIYRWEEIEPQEREKL

SEQ ID NO: 2336140 - protein, 20 aa, Cryptosporidium parvum
NEHFSRLVLDATKQNENQEQ

SEQ ID NO: 2336141 - protein, 20 aa, Cryptosporidium parvum
NEIDVGFQITTPGPKYVQNL

SEQ ID NO: 2336142 - protein, 17 aa, Cryptosporidium parvum
NEIEFPPSWHFFENHNS

SEQ ID NO: 2336143 - protein, 23 aa, Cryptosporidium parvum
NEKEFTEDFMFDHSRDVRAVKIQ

SEQ ID NO: 2336144 - protein, 20 aa, Cryptosporidium parvum
NEKLAWSLVENMFSEDSVER

SEQ ID NO: 2336145 - protein, 21 aa, Cryptosporidium parvum
NEKLIIIYIIMKYINHNLNSN

SEQ ID NO: 2336146 - protein, 17 aa, Cryptosporidium parvum
NEKRWKTIGGVFDSENS

SEQ ID NO: 2336147 - protein, 20 aa, Cryptosporidium parvum
NELLTFPFLNKYNITLNCNK

SEQ ID NO: 2336148 - protein, 31 aa, Cryptosporidium parvum; identical to SEQ ID NO: 2207724

SEQ ID NO: 2336149 - protein, 24 aa, Cryptosporidium parvum
NEPSLWKSLPLILPKLPTYPEQIR

SEQ ID NO: 2336150 - protein, 22 aa, Cryptosporidium parvum
NEQGKCKPGIMMIDVPGEYGHS

SEQ ID NO: 2336151 - protein, 18 aa, Cryptosporidium parvum
NERSLGFNLCSSMSIGAH

SEQ ID NO: 2336152 - protein, 23 aa, Cryptosporidium parvum
NETRDSLDFACKIMDNIRKYTRL

SEQ ID NO: 2336153 - protein, 24 aa, Cryptosporidium parvum
NEVMTRTVLPGMQYDECYNSTMIT

SEQ ID NO: 2336154 - protein, 25 aa, Cryptosporidium parvum
NEVSGELWIPFAISQIIYRKSKVLM

SEQ ID NO: 2336155 - protein, 28 aa, Cryptosporidium parvum
NFHIKCPNGYRIIGIDAIVGDQITAVSL

SEQ ID NO: 2336156 - protein, 24 aa, Cryptosporidium parvum
NFHSLPDLCSGSLDATNSNQGTVD

SEQ ID NO: 2336157 - protein, 19 aa, Cryptosporidium parvum
NFRKIHPFRIMGSQHSSFI

SEQ ID NO: 2336158 - protein, 24 aa, Cryptosporidium parvum
NFTELKGSFLWWSSYFDSAINENI

SEQ ID NO: 2336159 - protein, 27 aa, Cryptosporidium parvum
NFVSIFVPRLIDFTLKGKQGLVTLIYN

SEQ ID NO: 2336160 - protein, 20 aa, Cryptosporidium parvum
NGDEAMAFGAAFVAANQSAT

SEQ ID NO: 2336161 - protein, 17 aa, Cryptosporidium parvum
NGIAKKSLLKHFEVYDK

SEQ ID NO: 2336162 - protein, 17 aa, Cryptosporidium parvum
NGILYLGYDTCTFNGEC

SEQ ID NO: 2336163 - protein, 17 aa, Cryptosporidium parvum
NGKKLDVISRFSSCLAK

SEQ ID NO: 2336164 - protein, 17 aa, Cryptosporidium parvum
NGKWHWYTWCKRPDFNL

SEQ ID NO: 2336165 - protein, 20 aa, Cryptosporidium parvum
NGLIKQFLSDVVWGELDFLI

SEQ ID NO: 2336166 - protein, 24 aa, Cryptosporidium parvum
NGQVVMWRRLRGYNLSQLNIVADT

SEQ ID NO: 2336167 - protein, 24 aa, Cryptosporidium parvum
NGQYPKLDGVAFLTRVVSALSESA

SEQ ID NO: 2336168 - protein, 28 aa, Cryptosporidium parvum
NGRVIRKLASGLECDKCELCTEDKKCFY

SEQ ID NO: 2336169 - protein, 21 aa, Cryptosporidium parvum
NGVPVYRPYAPFRYFAAETFN

SEQ ID NO: 2336170 - protein, 22 aa, Cryptosporidium parvum
NHEVTGCTFCEIKKARISLIEW

SEQ ID NO: 2336171 - protein, 26 aa, Cryptosporidium parvum
NHISNFLLEEGFTYPKNILFRGYETC

SEQ ID NO: 2336172 - protein, 18 aa, Cryptosporidium parvum
NHKSCIKLSSGDLTLAYK

SEQ ID NO: 2336173 - protein, 28 aa, Cryptosporidium parvum
NHKSRIWRGGRWTGVCIGLLNLGGGILK

SEQ ID NO: 2336174 - protein, 33 aa, Cryptosporidium parvum
NHLNKPCTRNTCIIELKKYFLMEKIKTYNLIIE

SEQ ID NO: 2336175 - protein, 24 aa, Cryptosporidium parvum
NHSKLLWKATIPINEFITEDSNEI

SEQ ID NO: 2336176 - protein, 26 aa, Cryptosporidium parvum
NICSLRYSMDVIKRLESIFFSIHENY

SEQ ID NO: 2336177 - protein, 18 aa, Cryptosporidium parvum
NIDISFNLNVEKLRFIKI

SEQ ID NO: 2336178 - protein, 20 aa, Cryptosporidium parvum
NIECPAYMNLTFASTGSPIC

SEQ ID NO: 2336179 - protein, 19 aa, Cryptosporidium parvum
NIERARQLFIEHLGRMDAG

SEQ ID NO: 2336180 - protein, 21 aa, Cryptosporidium parvum
NIFYPGEYRAFGLAYIAFGDV

SEQ ID NO: 2336181 - protein, 28 aa, Cryptosporidium parvum
NIGCSMLSDSVWREDLCTSNISPSKQES

SEQ ID NO: 2336182 - protein, 24 aa, Cryptosporidium parvum
NIIILCLYLGILKCVNSHISNEIQ

SEQ ID NO: 2336183 - protein, 20 aa, Cryptosporidium parvum
NILACTKLFKNRGIKHDDIR

SEQ ID NO: 2336184 - protein, 17 aa, Cryptosporidium parvum
NILIFFAGKTLSEPLPF

SEQ ID NO: 2336185 - protein, 24 aa, Cryptosporidium parvum
NIPDQDFLNALALSGKMKYEKKQQ

SEQ ID NO: 2336186 - protein, 34 aa, Cryptosporidium parvum
NIQSKARLANIFKRKKLTASEKLERLMSLKKDIE

SEQ ID NO: 2336187 - protein, 23 aa, Cryptosporidium parvum
NISKLAITEGFIFSPKSLNLIEC

SEQ ID NO: 2336188 - protein, 18 aa, Cryptosporidium parvum
NISNLIFPFLKIYKKSFL

SEQ ID NO: 2336189 - protein, 18 aa, Cryptosporidium parvum
NIVDFEFQIPCTFYSPII

SEQ ID NO: 2336190 - protein, 21 aa, Cryptosporidium parvum
NIYAKSFLKQISFPGEVAKLY

SEQ ID NO: 2336191 - protein, 33 aa, Cryptosporidium parvum; identical to SEQ ID NO: 2207755

SEQ ID NO: 2336192 - protein, 19 aa, Cryptosporidium parvum
NKAELKPEASCCITNTLCY

SEQ ID NO: 2336193 - protein, 21 aa, Cryptosporidium parvum
NKAYGIEDFEIIAARIDPTNL

SEQ ID NO: 2336194 - protein, 30 aa, Cryptosporidium parvum
NKEFKPVIKVDFLSPSFCDWRVDESKNITS

SEQ ID NO: 2336195 - protein, 17 aa, Cryptosporidium parvum
NKEIILNFEKKWPNITN

SEQ ID NO: 2336196 - protein, 23 aa, Cryptosporidium parvum
NKETMIRRCVNFFSNEKNIEDYN

SEQ ID NO: 2336197 - protein, 22 aa, Cryptosporidium parvum
NKFKSNALLLSFLTSNIPQYLR

SEQ ID NO: 2336198 - protein, 28 aa, Cryptosporidium parvum
NKIDGSIALCFLAFIIFFVVKVGGTNNE

SEQ ID NO: 2336199 - protein, 26 aa, Cryptosporidium parvum
NKKLRECFKLELELISLNYIYFQEGD

SEQ ID NO: 2336200 - protein, 24 aa, Cryptosporidium parvum
NKRFDFTRFRSVVNLLDRLTFENF

SEQ ID NO: 2336201 - protein, 23 aa, Cryptosporidium parvum
NKRGGFQCTCPKGFQLGMDGKVC

SEQ ID NO: 2336202 - protein, 23 aa, Cryptosporidium parvum
NKRKMCLEFSKELLDLDGTDFLK

SEQ ID NO: 2336203 - protein, 26 aa, Cryptosporidium parvum
NKRVYEKFVPGRGFDKILQKKLINTY

SEQ ID NO: 2336204 - protein, 26 aa, Cryptosporidium parvum
NKRYAGQFLLIIFLFVFYKLAFSSEI

SEQ ID NO: 2336205 - protein, 24 aa, Cryptosporidium parvum
NKYESVSFIAFFKELFSLIYEQII

SEQ ID NO: 2336206 - protein, 19 aa, Cryptosporidium parvum
NLADICSILKGYQDLESRV

SEQ ID NO: 2336207 - protein, 18 aa, Cryptosporidium parvum
NLCCKTLASYKWMVKNWP

SEQ ID NO: 2336208 - protein, 21 aa, Cryptosporidium parvum
NLCKRIPSILEKFFDKSMTKK

SEQ ID NO: 2336209 - protein, 19 aa, Cryptosporidium parvum
NLCLFAFPGKDNFSGEKYP

SEQ ID NO: 2336210 - protein, 22 aa, Cryptosporidium parvum
NLDSVYCFYNFNKSSKMIKLQG

SEQ ID NO: 2336211 - protein, 24 aa, Cryptosporidium parvum
NLEDYSSYGFVTWIKPVESNSTKV

SEQ ID NO: 2336212 - protein, 23 aa, Cryptosporidium parvum
NLETQNSMGWLCSKQTQDESLTN

SEQ ID NO: 2336213 - protein, 17 aa, Cryptosporidium parvum
NLFKIYIELTINGIKNI

SEQ ID NO: 2336214 - protein, 19 aa, Cryptosporidium parvum
NLFVHRGFYFVDAESKKNC

SEQ ID NO: 2336215 - protein, 24 aa, Cryptosporidium parvum
NLGCKKPNCIKRLSKNDEPKYSSD

SEQ ID NO: 2336216 - protein, 25 aa, Cryptosporidium parvum
NLIEEREIWNLYGGDALMPVSSWIS

SEQ ID NO: 2336217 - protein, 22 aa, Cryptosporidium parvum
NLINRIALIPVTIQPIKTIPIN

SEQ ID NO: 2336218 - protein, 20 aa, Cryptosporidium parvum
NLKSPRLGRRRPRGRGNQGG

SEQ ID NO: 2336219 - protein, 23 aa, Cryptosporidium parvum
NLLEPSIKRCLTRIRFNKDNLST

SEQ ID NO: 2336220 - protein, 18 aa, Cryptosporidium parvum
NLLLKNDVLYIFYGDKNG

SEQ ID NO: 2336221 - protein, 23 aa, Cryptosporidium parvum
NLLNRKDFKMVFDSMHGVAGPYA

SEQ ID NO: 2336222 - protein, 20 aa, Cryptosporidium parvum
NLLNSLCRLYYIYKSCLRDE

SEQ ID NO: 2336223 - protein, 19 aa, Cryptosporidium parvum
NLLSPGFIFMVLLRDDIEH

SEQ ID NO: 2336224 - protein, 21 aa, Cryptosporidium parvum
NLPGCKVHLPIIGDKDRHDIV

SEQ ID NO: 2336225 - protein, 18 aa, Cryptosporidium parvum
NLPHAISTIASRIKEFPN

SEQ ID NO: 2336226 - protein, 22 aa, Cryptosporidium parvum
NLREKKECKKLYKSINNNRFYI

SEQ ID NO: 2336227 - protein, 24 aa, Cryptosporidium parvum
NLSEAIFKLYLMNSRELDIRSLKA

SEQ ID NO: 2336228 - protein, 19 aa, Cryptosporidium parvum
NLSKIIVYFIQSYAALRYK

SEQ ID NO: 2336229 - protein, 18 aa, Cryptosporidium parvum
NLSRQVCYSYYKKRAATV

SEQ ID NO: 2336230 - protein, 26 aa, Cryptosporidium parvum
NLTIGLGWSRLGFFLLNKDSESLINI

SEQ ID NO: 2336231 - protein, 23 aa, Cryptosporidium parvum
NLWRYKLTEYISFFLDDESEEGL

SEQ ID NO: 2336232 - protein, 20 aa, Cryptosporidium parvum
NLYRILPRKLWNRIHSLAAK

SEQ ID NO: 2336233 - protein, 19 aa, Cryptosporidium parvum
NMCLLRSAIFEGINELLHE

SEQ ID NO: 2336234 - protein, 21 aa, Cryptosporidium parvum
NMGNSEWRSASNLSAEQQIVY

SEQ ID NO: 2336235 - protein, 27 aa, Cryptosporidium parvum
NMPWPIGLCQCSLYCVAIDVSRQEEED

SEQ ID NO: 2336236 - protein, 23 aa, Cryptosporidium parvum
NNDLMYKWRLLSNDISVYEISVF

SEQ ID NO: 2336237 - protein, 21 aa, Cryptosporidium parvum
NNEEKYWIGINLKSSSSESLM

SEQ ID NO: 2336238 - protein, 24 aa, Cryptosporidium parvum
NNENSRWTWNRIEKPIFRTNTARP

SEQ ID NO: 2336239 - protein, 22 aa, Cryptosporidium parvum
NNGFYRPDLNNETGLYEPEKKY

SEQ ID NO: 2336240 - protein, 23 aa, Cryptosporidium parvum
NNGKSSWKSIISTSTTTISTRED

SEQ ID NO: 2336241 - protein, 24 aa, Cryptosporidium parvum
NNGPKFKICLNKPDSFIVLASGAI

SEQ ID NO: 2336242 - protein, 23 aa, Cryptosporidium parvum
NNKFKIKLPPVIKYHDICNHVAK

SEQ ID NO: 2336243 - protein, 23 aa, Cryptosporidium parvum
NNKSCVYWSYGIWDQTIGERSTF

SEQ ID NO: 2336244 - protein, 21 aa, Cryptosporidium parvum
NNLIPLQFKLMIACPYAISNH

SEQ ID NO: 2336245 - protein, 23 aa, Cryptosporidium parvum
NNLKSAPIFTYRKDHITNYKTRG

SEQ ID NO: 2336246 - protein, 23 aa, Cryptosporidium parvum
NNNMKCPFNIIIPAPDFYSYNIV

SEQ ID NO: 2336247 - protein, 25 aa, Cryptosporidium parvum
NNNRIPLPIMVRYGLTEDGKLAAFS

SEQ ID NO: 2336248 - protein, 25 aa, Cryptosporidium parvum
NNNYLRWAGSAIKYAEKYLIMSIGF

SEQ ID NO: 2336249 - protein, 28 aa, Cryptosporidium parvum
NNQIKVYLEQRFNPIVKAIKSNKYLKKK

SEQ ID NO: 2336250 - protein, 19 aa, Cryptosporidium parvum
NNQLRLARGGNLCLTSPGD

SEQ ID NO: 2336251 - protein, 27 aa, Cryptosporidium parvum
NNQPLIYKFCLNSWVGDGYCDEDCNNE

SEQ ID NO: 2336252 - protein, 22 aa, Cryptosporidium parvum
NNSEFLFQCVIRDISLDDHIFK

SEQ ID NO: 2336253 - protein, 23 aa, Cryptosporidium parvum
NNSGRGRYGISIDSSGSSSDSDS

SEQ ID NO: 2336254 - protein, 20 aa, Cryptosporidium parvum
NNYLFYYPMDPFWNYANNSS

SEQ ID NO: 2336255 - protein, 18 aa, Cryptosporidium parvum
NPCEFKRARCRDPSLRRA

SEQ ID NO: 2336256 - protein, 18 aa, Cryptosporidium parvum
NPCSKSQPGISWVIESEI

SEQ ID NO: 2336257 - protein, 28 aa, Cryptosporidium parvum
NPDLKLLWRYISPHLIEIDIGGSRPKLQ

SEQ ID NO: 2336258 - protein, 19 aa, Cryptosporidium parvum
NPEVEVVSLSPSVTPVEYI

SEQ ID NO: 2336259 - protein, 19 aa, Cryptosporidium parvum
NPGGILSLELQDISDDPGY

SEQ ID NO: 2336260 - protein, 17 aa, Cryptosporidium parvum
NPGKALVLFLLIFDENG

SEQ ID NO: 2336261 - protein, 23 aa, Cryptosporidium parvum
NPKLRLTYFNGLPYPYHMNNEDL

SEQ ID NO: 2336262 - protein, 23 aa, Cryptosporidium parvum
NPKSFEGLDAWREEFLIQATPKD

SEQ ID NO: 2336263 - protein, 29 aa, Cryptosporidium parvum
NPLSFPYVRSEPMLHLFFYNSLNKNLSST

SEQ ID NO: 2336264 - protein, 20 aa, Cryptosporidium parvum
NQCPIFFELKAPYTTLESIR

SEQ ID NO: 2336265 - protein, 23 aa, Cryptosporidium parvum
NQDIKRLVGYQHKMINSSSLYIV

SEQ ID NO: 2336266 - protein, 21 aa, Cryptosporidium parvum
NQFFPRVKFITKIVEKNKENK

SEQ ID NO: 2336267 - protein, 21 aa, Cryptosporidium parvum
NQGISTYRIFNLRNENKQLLV

SEQ ID NO: 2336268 - protein, 19 aa, Cryptosporidium parvum
NQIKWRFEKDHERYLSESQ

SEQ ID NO: 2336269 - protein, 24 aa, Cryptosporidium parvum
NQLPVPKWEGLAIAGWNNMKNDEK

SEQ ID NO: 2336270 - protein, 23 aa, Cryptosporidium parvum
NQPRAVFSYKLVKQTIIEMLGTN

SEQ ID NO: 2336271 - protein, 23 aa, Cryptosporidium parvum
NQRNEIKNSANIDLHSEIYNPIQ

SEQ ID NO: 2336272 - protein, 23 aa, Cryptosporidium parvum
NQYPLRFNNIFIIQQNDIWTTLK

SEQ ID NO: 2336273 - protein, 20 aa, Cryptosporidium parvum
NRFGRFKYIYPLGHAPSKVT

SEQ ID NO: 2336274 - protein, 19 aa, Cryptosporidium parvum
NRKIIKIPYLANITDFSTI

SEQ ID NO: 2336275 - protein, 23 aa, Cryptosporidium parvum
NRKLKHPSFNPIRRYIFNDDDID

SEQ ID NO: 2336276 - protein, 19 aa, Cryptosporidium parvum
NRKRVLLKVIILGDSGVGK

SEQ ID NO: 2336277 - protein, 23 aa, Cryptosporidium parvum
NRLKECYGEEICHVSLPDILIRE

SEQ ID NO: 2336278 - protein, 27 aa, Cryptosporidium parvum
NRLMLSLKCNLPIQVMQDLVAKYFNGI

SEQ ID NO: 2336279 - protein, 26 aa, Cryptosporidium parvum
NRNAKGLPFFPDFKKIDILQEKFSDK

SEQ ID NO: 2336280 - protein, 25 aa, Cryptosporidium parvum
NRSYRNKLKPGFILLINDSTVNSGA

SEQ ID NO: 2336281 - protein, 20 aa, Cryptosporidium parvum
NRYIQIFGMIGIGNHGISCN

SEQ ID NO: 2336282 - protein, 23 aa, Cryptosporidium parvum
NSAMILYIFWRLFEFSYMNFDKT

SEQ ID NO: 2336283 - protein, 20 aa, Cryptosporidium parvum
NSEILKKCQVMARRQAKILA

SEQ ID NO: 2336284 - protein, 17 aa, Cryptosporidium parvum
NSGLRLNDFYSSKFENE

SEQ ID NO: 2336285 - protein, 17 aa, Cryptosporidium parvum
NSILFPYLMIQEFVNPL

SEQ ID NO: 2336286 - protein, 23 aa, Cryptosporidium parvum
NSKKEIFSSFMVDSKPLSINETL

SEQ ID NO: 2336287 - protein, 22 aa, Cryptosporidium parvum
NSKSGFYRPIFNSTSGLYNNDQ

SEQ ID NO: 2336288 - protein, 22 aa, Cryptosporidium parvum
NSKSLPWYDAFKNLEKIQKVKC

SEQ ID NO: 2336289 - protein, 33 aa, Cryptosporidium parvum
NSKTKCVCPPGYTLCSSIDYYFGNHISTFDKSR

SEQ ID NO: 2336290 - protein, 20 aa, Cryptosporidium parvum
NSNSGLILFHLIINDNGLFL

SEQ ID NO: 2336291 - protein, 21 aa, Cryptosporidium parvum
NSRDLMCILEVGLQPDVIPTG

SEQ ID NO: 2336292 - protein, 25 aa, Cryptosporidium parvum
NSVKIKNNPGEFIINNYKLGKNRNF

SEQ ID NO: 2336293 - protein, 18 aa, Cryptosporidium parvum
NSWGANWGKKGYAKIRRG

SEQ ID NO: 2336294 - protein, 22 aa, Cryptosporidium parvum
NSYKFAQKVCSMIFEQPIHNIL

SEQ ID NO: 2336295 - protein, 25 aa, Cryptosporidium parvum
NTFHFGGGGPFGFGGGGGGRRQGSN

SEQ ID NO: 2336296 - protein, 17 aa, Cryptosporidium parvum
NTFKNKKILALIISINS

SEQ ID NO: 2336297 - protein, 25 aa, Cryptosporidium parvum
NTIGGYKCGCYKGFRLNLTGPEENR

SEQ ID NO: 2336298 - protein, 27 aa, Cryptosporidium parvum
NTINSCLSWKTFGYFNLISCYSVLVNS

SEQ ID NO: 2336299 - protein, 18 aa, Cryptosporidium parvum
NTLDLLWNNFLIFENSAF

SEQ ID NO: 2336300 - protein, 19 aa, Cryptosporidium parvum
NTLGFLFYKKFVVLINLIT

SEQ ID NO: 2336301 - protein, 23 aa, Cryptosporidium parvum
NTLLYEGYEKCSLYNNCLSNKLE

SEQ ID NO: 2336302 - protein, 23 aa, Cryptosporidium parvum
NTPTGKTWLVFKGSHAKVVAGYL

SEQ ID NO: 2336303 - protein, 27 aa, Cryptosporidium parvum
NTRLLLKAECQWSPWRRETGCSSTCDS

SEQ ID NO: 2336304 - protein, 25 aa, Cryptosporidium parvum
NTRWKCLKITVVKDYRYWVFSCNGE

SEQ ID NO: 2336305 - protein, 18 aa, Cryptosporidium parvum
NTTDIFKGIGNTINNITK

SEQ ID NO: 2336306 - protein, 19 aa, Cryptosporidium parvum
NTTKIACNACIYRPVVSNL

SEQ ID NO: 2336307 - protein, 34 aa, Cryptosporidium parvum
NTVCTIGKIENGWRFKYIFPIGHSPSVSSFVQIK

SEQ ID NO: 2336308 - protein, 19 aa, Cryptosporidium parvum
NVCTPKGYPISVAGLQCNG

SEQ ID NO: 2336309 - protein, 20 aa, Cryptosporidium parvum
NVEWLCFKPKTSITQIQAAT

SEQ ID NO: 2336310 - protein, 24 aa, Cryptosporidium parvum
NVFKKLSAAFFRFILLKFASSNEE

SEQ ID NO: 2336311 - protein, 22 aa, Cryptosporidium parvum
NVPTMVCPTGYTLDSNRQCVAR

SEQ ID NO: 2336312 - protein, 21 aa, Cryptosporidium parvum
NVRTSWVIALERAFNETGTFH

SEQ ID NO: 2336313 - protein, 26 aa, Cryptosporidium parvum
NVVPEPRYIPTVKIYDSQIEDLSFPE

SEQ ID NO: 2336314 - protein, 24 aa, Cryptosporidium parvum
NYEEGSNLISCFDPPFDGLEIPGR

SEQ ID NO: 2336315 - protein, 35 aa, Cryptosporidium parvum
NYRIYGLPSGRPFMPFKFTFGRDVYEMRNNCAGCI

SEQ ID NO: 2336316 - protein, 17 aa, Cryptosporidium parvum
NYVGAIFTLNKAKITYQ

SEQ ID NO: 2336317 - protein, 24 aa, Cryptosporidium parvum
PADPKHGFVPLYILDNSTETAALP

SEQ ID NO: 2336318 - protein, 20 aa, Cryptosporidium parvum
PAGSIPRGHKCIVITNVPII

SEQ ID NO: 2336319 - protein, 23 aa, Cryptosporidium parvum
PAKECPPNFILQGLQCIQTSSAP

SEQ ID NO: 2336320 - protein, 23 aa, Cryptosporidium parvum
PAQRSRPSTLAWVPNQPTQIVVG

SEQ ID NO: 2336321 - protein, 17 aa, Cryptosporidium parvum
PARKIIISRPILQTLTE

SEQ ID NO: 2336322 - protein, 24 aa, Cryptosporidium parvum
PASEFNRFIFLNTMIERYLTISGL

SEQ ID NO: 2336323 - protein, 21 aa, Cryptosporidium parvum
PATECSECPDSMFPEKSEDGE

SEQ ID NO: 2336324 - protein, 19 aa, Cryptosporidium parvum
PATFELVWGKYFQLIYETA

SEQ ID NO: 2336325 - protein, 24 aa, Cryptosporidium parvum
PCCGSEINNSFSLWQLSNTVIYPL

SEQ ID NO: 2336326 - protein, 26 aa, Cryptosporidium parvum
PCHITCPREYAPVCATDAETYENLCL

SEQ ID NO: 2336327 - protein, 20 aa, Cryptosporidium parvum
PCNTNPCSDCMVYLEDSQLN

SEQ ID NO: 2336328 - protein, 20 aa, Cryptosporidium parvum
PCQFMHPITIQFIGSYPKSG

SEQ ID NO: 2336329 - protein, 19 aa, Cryptosporidium parvum
PDASQREFDCNWQMQNGLE

SEQ ID NO: 2336330 - protein, 20 aa, Cryptosporidium parvum
PDKFFPFPVQKQGVTLLNYK

SEQ ID NO: 2336331 - protein, 19 aa, Cryptosporidium parvum
PDKVLSLDFSYSGCVNESM

SEQ ID NO: 2336332 - protein, 18 aa, Cryptosporidium parvum
PDLFRYKVTIPITNNKSI

SEQ ID NO: 2336333 - protein, 20 aa, Cryptosporidium parvum
PDLRISGKLYSPGEGSLVDQ

SEQ ID NO: 2336334 - protein, 21 aa, Cryptosporidium parvum
PDSEMYSIWKLFNSKIQPTEV

SEQ ID NO: 2336335 - protein, 18 aa, Cryptosporidium parvum
PDVLCLLSTCNEDYTDGP

SEQ ID NO: 2336336 - protein, 26 aa, Cryptosporidium parvum
PEDITFKEFWTLFVISSTGIPNKGSE

SEQ ID NO: 2336337 - protein, 22 aa, Cryptosporidium parvum
PEECKLPCISIIKFPSVDEGKM

SEQ ID NO: 2336338 - protein, 18 aa, Cryptosporidium parvum
PEEKPDFTYARKVFELVV

SEQ ID NO: 2336339 - protein, 21 aa, Cryptosporidium parvum
PEEYSHIAGTLFSAMYQYFPI

SEQ ID NO: 2336340 - protein, 20 aa, Cryptosporidium parvum
PEFISGTPLEPLPSSFDYRL

SEQ ID NO: 2336341 - protein, 21 aa, Cryptosporidium parvum
PEFQLGNLLWIQLKMEVSNPL

SEQ ID NO: 2336342 - protein, 17 aa, Cryptosporidium parvum
PEGLVSIGFLERKANYD

SEQ ID NO: 2336343 - protein, 21 aa, Cryptosporidium parvum
PEIRLLQLYTILNKYAVQKGF

SEQ ID NO: 2336344 - protein, 19 aa, Cryptosporidium parvum
PEIWTMWKAIITQKDRDLN

SEQ ID NO: 2336345 - protein, 21 aa, Cryptosporidium parvum
PEKECPTGFVLIGKQCTQTTQ

SEQ ID NO: 2336346 - protein, 20 aa, Cryptosporidium parvum
PEKTEPLGLHKADMCMETIK

SEQ ID NO: 2336347 - protein, 25 aa, Cryptosporidium parvum
PENIDLRLNVVYPVGHFLGIIEANK

SEQ ID NO: 2336348 - protein, 21 aa, Cryptosporidium parvum
PEPRCREGFVFSVEDAACIKV

SEQ ID NO: 2336349 - protein, 24 aa, Cryptosporidium parvum
PETTISGFILFKGLENSFKPRIYL

SEQ ID NO: 2336350 - protein, 21 aa, Cryptosporidium parvum
PEVPKRTVSLIPGRDPYKRGF

SEQ ID NO: 2336351 - protein, 22 aa, Cryptosporidium parvum
PEYCSKIPMIPMIPTTVQQIFI

SEQ ID NO: 2336352 - protein, 17 aa, Cryptosporidium parvum
PEYIKLHYILENSIQAF

SEQ ID NO: 2336353 - protein, 22 aa, Cryptosporidium parvum
PEYLLRSTYCFSKALFESNYKD

SEQ ID NO: 2336354 - protein, 26 aa, Cryptosporidium parvum
PEYLVSAFLLYLLICSFRELAFSSFS

SEQ ID NO: 2336355 - protein, 18 aa, Cryptosporidium parvum
PEYSEIKEYFPGPVERRH

SEQ ID NO: 2336356 - protein, 25 aa, Cryptosporidium parvum
PFDLFSMGFGNLFGMGPGRGDGERY

SEQ ID NO: 2336357 - protein, 24 aa, Cryptosporidium parvum
PFFLKAIIAFGFILQLSFCQLASL

SEQ ID NO: 2336358 - protein, 18 aa, Cryptosporidium parvum
PFGAWKTSVGNTIGESIT

SEQ ID NO: 2336359 - protein, 26 aa, Cryptosporidium parvum
PFLKSLCYSCWDLMRVYDRYFAEKYD

SEQ ID NO: 2336360 - protein, 18 aa, Cryptosporidium parvum
PFLSLAYIFSREMIKDKA

SEQ ID NO: 2336361 - protein, 20 aa, Cryptosporidium parvum
PGELGCPVGYTDGDKGLCKS

SEQ ID NO: 2336362 - protein, 18 aa, Cryptosporidium parvum
PGIFPIKYLRNLGYHVDG

SEQ ID NO: 2336363 - protein, 17 aa, Cryptosporidium parvum
PGIKVDSALCLSHSPQD

SEQ ID NO: 2336364 - protein, 23 aa, Cryptosporidium parvum
PGPPSRRGSGPISDRVIPTSTDE

SEQ ID NO: 2336365 - protein, 18 aa, Cryptosporidium parvum
PGSWCVGLNATYNQVDSD

SEQ ID NO: 2336366 - protein, 20 aa, Cryptosporidium parvum
PGYLDRFMDRYGFTEDEYIA

SEQ ID NO: 2336367 - protein, 18 aa, Cryptosporidium parvum
PHGFALAGEECISMKEFA

SEQ ID NO: 2336368 - protein, 18 aa, Cryptosporidium parvum
PHGNCVKEEDSLYLELYR

SEQ ID NO: 2336369 - protein, 19 aa, Cryptosporidium parvum
PHLDGRHVVFGKLVDDESK

SEQ ID NO: 2336370 - protein, 27 aa, Cryptosporidium parvum
PHLHMFSSQFYLYWSLSTPHLGCISNN

SEQ ID NO: 2336371 - protein, 19 aa, Cryptosporidium parvum
PHPEGMVGYGGKYTFRFSA

SEQ ID NO: 2336372 - protein, 22 aa, Cryptosporidium parvum
PHSLEGFISGHLMLRYNKGGMS

SEQ ID NO: 2336373 - protein, 23 aa, Cryptosporidium parvum
PIFLLFVIFCDFTERSFLSKISL

SEQ ID NO: 2336374 - protein, 27 aa, Cryptosporidium parvum
PIGSIKWVYRYAWADFAFGVRLKQVNL

SEQ ID NO: 2336375 - protein, 23 aa, Cryptosporidium parvum
PIGVPRNRLGLRNTEGSSEKKNI

SEQ ID NO: 2336376 - protein, 19 aa, Cryptosporidium parvum
PIKSPSSLVFIGRERPDLY

SEQ ID NO: 2336377 - protein, 24 aa, Cryptosporidium parvum
PINTDRFKWYVAIGNDLSFTARYY

SEQ ID NO: 2336378 - protein, 19 aa, Cryptosporidium parvum
PIRSLLIKACDDALFHEKD

SEQ ID NO: 2336379 - protein, 18 aa, Cryptosporidium parvum
PIYLIRRITLRTKNNHLS

SEQ ID NO: 2336380 - protein, 20 aa, Cryptosporidium parvum
PKANVKFDWVNIGINQETIL

SEQ ID NO: 2336381 - protein, 22 aa, Cryptosporidium parvum
PKDFTLEIITGMCIKREIEELI

SEQ ID NO: 2336382 - protein, 18 aa, Cryptosporidium parvum
PKKFNVIQQLCWDLGGHM

SEQ ID NO: 2336383 - protein, 18 aa, Cryptosporidium parvum
PKKFPGLATLLSELLFYD

SEQ ID NO: 2336384 - protein, 25 aa, Cryptosporidium parvum
PKKPKLPKKWEIFTDDEKQEWLDRH

SEQ ID NO: 2336385 - protein, 20 aa, Cryptosporidium parvum
PKKRSFFHIHYYDITNTAKF

SEQ ID NO: 2336386 - protein, 24 aa, Cryptosporidium parvum
PKLLEEIRSGVKLKPTGSSASSEI

SEQ ID NO: 2336387 - protein, 22 aa, Cryptosporidium parvum
PKLRSEPIPVYYDNDTVFKLVG

SEQ ID NO: 2336388 - protein, 25 aa, Cryptosporidium parvum
PKNVLKEKIELFKLTGTVISIPLPL

SEQ ID NO: 2336389 - protein, 36 aa, Cryptosporidium parvum
PKPKSPSYKDRLLSFFGSNGGSMFGLGKSSTTTTTT

SEQ ID NO: 2336390 - protein, 25 aa, Cryptosporidium parvum
PKQILYKGYESCSFFEDCPMNATCK

SEQ ID NO: 2336391 - protein, 26 aa, Cryptosporidium parvum
PKSQLPCSWLSNILFSKKVCHYLHLS

SEQ ID NO: 2336392 - protein, 18 aa, Cryptosporidium parvum
PKTPSSITYLTFQSKRSD

SEQ ID NO: 2336393 - protein, 24 aa, Cryptosporidium parvum
PKYSSDFIPRIYLLSRSIPKENFY

SEQ ID NO: 2336394 - protein, 19 aa, Cryptosporidium parvum
PLCKSYRIEIAKSPIISIV

SEQ ID NO: 2336395 - protein, 21 aa, Cryptosporidium parvum
PLEGIVKGYCLFRSVSDEAKE

SEQ ID NO: 2336396 - protein, 22 aa, Cryptosporidium parvum
PLFEDEWRAIIDFMSDPSSPIQ

SEQ ID NO: 2336397 - protein, 18 aa, Cryptosporidium parvum
PLFFDMENCFKQDDEDLV

SEQ ID NO: 2336398 - protein, 18 aa, Cryptosporidium parvum
PLFTEASNLKWRHVSNSN

SEQ ID NO: 2336399 - protein, 19 aa, Cryptosporidium parvum
PLGSIRISFGYLSTFKDVL

SEQ ID NO: 2336400 - protein, 19 aa, Cryptosporidium parvum
PLKMSEFRSLSFIGSPVLM

SEQ ID NO: 2336401 - protein, 18 aa, Cryptosporidium parvum
PLLRVFKSFYSMEKNSSS

SEQ ID NO: 2336402 - protein, 32 aa, Cryptosporidium parvum
PLNTMLERRWFIVPMSLGLPIGELKELIDNIA

SEQ ID NO: 2336403 - protein, 25 aa, Cryptosporidium parvum
PLRSRKTGYTFKEFCDDKIKKCSDS

SEQ ID NO: 2336404 - protein, 18 aa, Cryptosporidium parvum
PLVLKYKFFSEIISSYNY

SEQ ID NO: 2336405 - protein, 18 aa, Cryptosporidium parvum
PLVVCPAGSIPQDNSHCL

SEQ ID NO: 2336406 - protein, 24 aa, Cryptosporidium parvum
PLWKYKPAEYISFFFTDYSNKSLY

SEQ ID NO: 2336407 - protein, 19 aa, Cryptosporidium parvum
PMCPPGIMTKYDFPKLYRL

SEQ ID NO: 2336408 - protein, 21 aa, Cryptosporidium parvum
PNAISGFYWILPRCAPEPIRV

SEQ ID NO: 2336409 - protein, 23 aa, Cryptosporidium parvum
PNDKIKGLIRYFKFNKGSYGEVW

SEQ ID NO: 2336410 - protein, 23 aa, Cryptosporidium parvum
PNDPKFSEQWGMYNRVANTDSKV

SEQ ID NO: 2336411 - protein, 24 aa, Cryptosporidium parvum
PNEKIRYFCWYTAKSAYPNDSSFE

SEQ ID NO: 2336412 - protein, 17 aa, Cryptosporidium parvum
PNFIISVGDNFYRWGVS

SEQ ID NO: 2336413 - protein, 17 aa, Cryptosporidium parvum
PNHRYIPLFEVMENNET

SEQ ID NO: 2336414 - protein, 26 aa, Cryptosporidium parvum
PNIPYFNHFCSLSFIKNLKLIRKNAN

SEQ ID NO: 2336415 - protein, 25 aa, Cryptosporidium parvum
PNQQFSIRWDGFLLAPESGRYYFSI

SEQ ID NO: 2336416 - protein, 18 aa, Cryptosporidium parvum
PNSFPFVVLGNKLDLDQK

SEQ ID NO: 2336417 - protein, 17 aa, Cryptosporidium parvum
PPEKIFVAQKCMISKCN

SEQ ID NO: 2336418 - protein, 24 aa, Cryptosporidium parvum
PPGYYRPQAGVAIRSHGHKASGAS

SEQ ID NO: 2336419 - protein, 19 aa, Cryptosporidium parvum
PPIIKGYKYSKCGNSIVLF

SEQ ID NO: 2336420 - protein, 23 aa, Cryptosporidium parvum
PPIPGMPVPWPLPTATQQLNSTT

SEQ ID NO: 2336421 - protein, 18 aa, Cryptosporidium parvum
PPIYKHGRVKCIPKNLII

SEQ ID NO: 2336422 - protein, 18 aa, Cryptosporidium parvum
PPKCLIVANGDFSGSSPL

SEQ ID NO: 2336423 - protein, 24 aa, Cryptosporidium parvum
PPKNRITFYGCDWTICEREVENQI

SEQ ID NO: 2336424 - protein, 21 aa, Cryptosporidium parvum
PPKVIKFLFIIHASRSNQEEI

SEQ ID NO: 2336425 - protein, 23 aa, Cryptosporidium parvum
PPLKKEYAYGAVMNHNISDLKNQ

SEQ ID NO: 2336426 - protein, 20 aa, Cryptosporidium parvum
PPPVVCKKCNLTPKQEIVIT

SEQ ID NO: 2336427 - protein, 18 aa, Cryptosporidium parvum
PPREIWSGANNEQEFVLL

SEQ ID NO: 2336428 - protein, 20 aa, Cryptosporidium parvum
PPSPKFILGMFSRILDIPST

SEQ ID NO: 2336429 - protein, 19 aa, Cryptosporidium parvum
PQCGPLCSTYKGGYFTFWM

SEQ ID NO: 2336430 - protein, 20 aa, Cryptosporidium parvum
PQCGPYCSTYPKGFFTFWLT

SEQ ID NO: 2336431 - protein, 19 aa, Cryptosporidium parvum
PQCGPYCSTYPNGFFTFWL

SEQ ID NO: 2336432 - protein, 20 aa, Cryptosporidium parvum
PQGFTKLLFAESLYDINEQQ

SEQ ID NO: 2336433 - protein, 17 aa, Cryptosporidium parvum
PQIILYPNIDLFIGNIN

SEQ ID NO: 2336434 - protein, 18 aa, Cryptosporidium parvum
PQILRLNSMTQPWDHFRD

SEQ ID NO: 2336435 - protein, 25 aa, Cryptosporidium parvum
PQRLDSMLANIWWNGPVKKSHKIGI

SEQ ID NO: 2336436 - protein, 29 aa, Cryptosporidium parvum
PQRQPCGRCGFGAKCCYQNLCVGRDIGSS

SEQ ID NO: 2336437 - protein, 26 aa, Cryptosporidium parvum
PQVPIKYILEEGFFYPNNILFIGYET

SEQ ID NO: 2336438 - protein, 19 aa, Cryptosporidium parvum
PQYLQRRLSSIDERVALEE

SEQ ID NO: 2336439 - protein, 21 aa, Cryptosporidium parvum
PRHEYKYAPILKHSVGVDGSE

SEQ ID NO: 2336440 - protein, 21 aa, Cryptosporidium parvum
PRHPFPLPSSPLYIKGKKFGI

SEQ ID NO: 2336441 - protein, 20 aa, Cryptosporidium parvum
PRITCIKGYSIVKESTGTFC

SEQ ID NO: 2336442 - protein, 19 aa, Cryptosporidium parvum
PRIYLRFKSLRDPSSTGFE

SEQ ID NO: 2336443 - protein, 18 aa, Cryptosporidium parvum
PRKEPKSKRKPLTKKELE

SEQ ID NO: 2336444 - protein, 19 aa, Cryptosporidium parvum
PRLFPIFVSDLCIARKMMK

SEQ ID NO: 2336445 - protein, 22 aa, Cryptosporidium parvum
PRPDKEPCIRIIKRIKQRISEV

SEQ ID NO: 2336446 - protein, 22 aa, Cryptosporidium parvum
PRRFLRRLCCCCSSSCSSDDSC

SEQ ID NO: 2336447 - protein, 20 aa, Cryptosporidium parvum
PRVKHFRRSLVLLPSEPYQR

SEQ ID NO: 2336448 - protein, 25 aa, Cryptosporidium parvum
PRVMNEIRYTVLLCGGGLVTMLPIV

SEQ ID NO: 2336449 - protein, 18 aa, Cryptosporidium parvum
PRVTIPRPLGHSASSSSR

SEQ ID NO: 2336450 - protein, 17 aa, Cryptosporidium parvum
PSDMYHRYIPLYMASNN

SEQ ID NO: 2336451 - protein, 26 aa, Cryptosporidium parvum
PSFCSLSIDLCNSVDFSLYAAFSSFN

SEQ ID NO: 2336452 - protein, 17 aa, Cryptosporidium parvum
PSKGLGSGAPRPGKSPK

SEQ ID NO: 2336453 - protein, 19 aa, Cryptosporidium parvum
PSKNHFASIAKDILRYPEV

SEQ ID NO: 2336454 - protein, 17 aa, Cryptosporidium parvum
PSLQLWDLRNVSYPFKE

SEQ ID NO: 2336455 - protein, 17 aa, Cryptosporidium parvum
PSNALNMGNSEWRSASN

SEQ ID NO: 2336456 - protein, 21 aa, Cryptosporidium parvum
PSNCESLLFSFFRRVSYSTRS

SEQ ID NO: 2336457 - protein, 20 aa, Cryptosporidium parvum
PSRLEFISNIGRRFQGKSLN

SEQ ID NO: 2336458 - protein, 18 aa, Cryptosporidium parvum
PSSKHLTCKLEEVDPGSW

SEQ ID NO: 2336459 - protein, 27 aa, Cryptosporidium parvum
PSSSFNRIFSWVGFMILADKSPNFWTR

SEQ ID NO: 2336460 - protein, 26 aa, Cryptosporidium parvum
PSSSIPFHLVCHVFESMKASLQKNET

SEQ ID NO: 2336461 - protein, 25 aa, Cryptosporidium parvum
PSTWYLELIHCMYLGMAPKFLGMVF

SEQ ID NO: 2336462 - protein, 18 aa, Cryptosporidium parvum
PSYFERSKVLSLLSKDMS

SEQ ID NO: 2336463 - protein, 17 aa, Cryptosporidium parvum
PTDAWKFGMVRRNGNCE

SEQ ID NO: 2336464 - protein, 18 aa, Cryptosporidium parvum
PTDSPVLLRFETLKKLDK

SEQ ID NO: 2336465 - protein, 30 aa, Cryptosporidium parvum; identical to SEQ ID NO: 2207973

SEQ ID NO: 2336466 - protein, 17 aa, Cryptosporidium parvum
PTFPFTSNFFLQEEFEL

SEQ ID NO: 2336467 - protein, 17 aa, Cryptosporidium parvum
PTGNMNRRSRTCSSTEI

SEQ ID NO: 2336468 - protein, 17 aa, Cryptosporidium parvum
PTIISSLLRPSAPPTAP

SEQ ID NO: 2336469 - protein, 17 aa, Cryptosporidium parvum
PTLRLGISSKFMTKYSM

SEQ ID NO: 2336470 - protein, 21 aa, Cryptosporidium parvum
PTLRRRAAFPATHTDHRPFKP

SEQ ID NO: 2336471 - protein, 18 aa, Cryptosporidium parvum
PTLYTRRYIGYSLSMICL

SEQ ID NO: 2336472 - protein, 18 aa, Cryptosporidium parvum
PTRPCTRYSYSGSGTCSI

SEQ ID NO: 2336473 - protein, 26 aa, Cryptosporidium parvum
PTSSFFKNKPLLLTSTEGVVLSTTYL

SEQ ID NO: 2336474 - protein, 25 aa, Cryptosporidium parvum
PTSSLCSADIPLLLEVITKTEIKLE

SEQ ID NO: 2336475 - protein, 17 aa, Cryptosporidium parvum
PTTTIKMTLKFPNTAPV

SEQ ID NO: 2336476 - protein, 19 aa, Cryptosporidium parvum
PVAVCPSGFTLTDGQMCSG

SEQ ID NO: 2336477 - protein, 28 aa, Cryptosporidium parvum
PVENDAPFGRTLIRNLFRIYKRNFPSDK

SEQ ID NO: 2336478 - protein, 19 aa, Cryptosporidium parvum
PVHVLYKKFQLFPDFTNKS

SEQ ID NO: 2336479 - protein, 18 aa, Cryptosporidium parvum
PVKGCPYGFNLNELEQIC

SEQ ID NO: 2336480 - protein, 19 aa, Cryptosporidium parvum
PVYEIPNSVTSEICQEVGT

SEQ ID NO: 2336481 - protein, 23 aa, Cryptosporidium parvum
PWKMIPDSMWKHSPFQSFERVVY

SEQ ID NO: 2336482 - protein, 24 aa, Cryptosporidium parvum
PYAPLPGPYFRYLGNESESNERKM

SEQ ID NO: 2336483 - protein, 17 aa, Cryptosporidium parvum
PYESLIGIRAWFPNPES

SEQ ID NO: 2336484 - protein, 22 aa, Cryptosporidium parvum
PYLEIPEVFLFPEDARLKENCI

SEQ ID NO: 2336485 - protein, 17 aa, Cryptosporidium parvum
PYLPQGIVPSPISTTTT

SEQ ID NO: 2336486 - protein, 19 aa, Cryptosporidium parvum
PYLRLKEEFQQRIDNAYSN

SEQ ID NO: 2336487 - protein, 19 aa, Cryptosporidium parvum
PYMGKRSQITTVYPLGYAP

SEQ ID NO: 2336488 - protein, 34 aa, Cryptosporidium parvum; identical to SEQ ID NO: 2126735

SEQ ID NO: 2336489 - protein, 23 aa, Cryptosporidium parvum
QAIKEYEILLLLLKDLISYFSKL

SEQ ID NO: 2336490 - protein, 18 aa, Cryptosporidium parvum
QAKNRLGKEYQKFKSSQE

SEQ ID NO: 2336491 - protein, 19 aa, Cryptosporidium parvum
QALFYWSIEAEKFLNDYKR

SEQ ID NO: 2336492 - protein, 25 aa, Cryptosporidium parvum
QALKETRIQLYLGNFQDSPKIMPKK

SEQ ID NO: 2336493 - protein, 17 aa, Cryptosporidium parvum
QALVTWKGFLSHEKKIL

SEQ ID NO: 2336494 - protein, 22 aa, Cryptosporidium parvum
QAPYLLKRVHSLIKENNEVVLS

SEQ ID NO: 2336495 - protein, 18 aa, Cryptosporidium parvum
QAYSIFCQLMCLIKLLNL

SEQ ID NO: 2336496 - protein, 23 aa, Cryptosporidium parvum
QCGEGLKGLLDRQLIPGDPDALE

SEQ ID NO: 2336497 - protein, 17 aa, Cryptosporidium parvum
QCGPFCSTYTNGFFTFW

SEQ ID NO: 2336498 - protein, 17 aa, Cryptosporidium parvum
QCIGQWIKFLIKDQTVS

SEQ ID NO: 2336499 - protein, 18 aa, Cryptosporidium parvum
QCIYRVPMDITPWRKSIP

SEQ ID NO: 2336500 - protein, 18 aa, Cryptosporidium parvum
QCPDGFRLLGDMCQQSTA

SEQ ID NO: 2336501 - protein, 20 aa, Cryptosporidium parvum
QDCNKEFGCRVERENLRTIA

SEQ ID NO: 2336502 - protein, 19 aa, Cryptosporidium parvum
QDDKINWSLNIGHSGEIYL

SEQ ID NO: 2336503 - protein, 17 aa, Cryptosporidium parvum
QDIPIRLVDAIQNLRSK

SEQ ID NO: 2336504 - protein, 24 aa, Cryptosporidium parvum
QDVYKKFGGIFWARNIPRVSITNM

SEQ ID NO: 2336505 - protein, 21 aa, Cryptosporidium parvum
QEELKLLSLDFILEKKSKNLI

SEQ ID NO: 2336506 - protein, 23 aa, Cryptosporidium parvum
QEFAQKISLEFGINAILISDSSL

SEQ ID NO: 2336507 - protein, 17 aa, Cryptosporidium parvum
QEGRPVYHDGYRYRLNG

SEQ ID NO: 2336508 - protein, 19 aa, Cryptosporidium parvum
QEILGGKGIVEFSKLNRNL

SEQ ID NO: 2336509 - protein, 27 aa, Cryptosporidium parvum
QEIVGLYCKEFLSFGFIDETVKKEGDS

SEQ ID NO: 2336510 - protein, 24 aa, Cryptosporidium parvum
QELNKFKYPWLHIPNLKNFKENIK

SEQ ID NO: 2336511 - protein, 17 aa, Cryptosporidium parvum
QEMKDKLGVKPEDETIK

SEQ ID NO: 2336512 - protein, 24 aa, Cryptosporidium parvum
QENTWYAPMVFYKRYKHLSQVYKK

SEQ ID NO: 2336513 - protein, 24 aa, Cryptosporidium parvum
QESFPAQLRPYFAWVPTSHRNPKR

SEQ ID NO: 2336514 - protein, 18 aa, Cryptosporidium parvum
QESYIKLKLLSNTNNNVS

SEQ ID NO: 2336515 - protein, 21 aa, Cryptosporidium parvum
QEYFCIKRSNCIVAISGVGLT

SEQ ID NO: 2336516 - protein, 21 aa, Cryptosporidium parvum
QFDLSLRLADIVYSLTNCAGD

SEQ ID NO: 2336517 - protein, 20 aa, Cryptosporidium parvum
QFFKKCLDAEESGLMTPLDS

SEQ ID NO: 2336518 - protein, 18 aa, Cryptosporidium parvum
QFIFLNWFYLVYHGSNDL

SEQ ID NO: 2336519 - protein, 17 aa, Cryptosporidium parvum
QFIIPAIISYFEKKNIE

SEQ ID NO: 2336520 - protein, 19 aa, Cryptosporidium parvum
QFLMLFLFICTFREFSGLS

SEQ ID NO: 2336521 - protein, 19 aa, Cryptosporidium parvum
QFNRLCLITGYSNSEDRLK

SEQ ID NO: 2336522 - protein, 18 aa, Cryptosporidium parvum
QFPLGSFSDNWKSQFVGT

SEQ ID NO: 2336523 - protein, 20 aa, Cryptosporidium parvum
QGIWRKRLGNIQNKRLRELE

SEQ ID NO: 2336524 - protein, 18 aa, Cryptosporidium parvum
QGLQFGHGNMVQWVGGPV

SEQ ID NO: 2336525 - protein, 20 aa, Cryptosporidium parvum
QGLTYLMGFIFLNMASEVDN

SEQ ID NO: 2336526 - protein, 26 aa, Cryptosporidium parvum
QGSCIKGDRLLYGWYTIRDIYNKGEW

SEQ ID NO: 2336527 - protein, 33 aa, Cryptosporidium parvum
QGTCLKIELILPKPICPEGLRPSITVMDGQIPL

SEQ ID NO: 2336528 - protein, 17 aa, Cryptosporidium parvum
QHFQRSMMGLALSFGSG

SEQ ID NO: 2336529 - protein, 28 aa, Cryptosporidium parvum
QHLWWNYYGVVVGWDWELNAPKQWADNI

SEQ ID NO: 2336530 - protein, 22 aa, Cryptosporidium parvum
QIFKIEMLVLTAINNLRALSFM

SEQ ID NO: 2336531 - protein, 17 aa, Cryptosporidium parvum
QIGEMLLYISIRDFPVY

SEQ ID NO: 2336532 - protein, 29 aa, Cryptosporidium parvum
QIHLMKRVPIEFIPSERMVRIYASSYDTE

SEQ ID NO: 2336533 - protein, 18 aa, Cryptosporidium parvum
QIHRLRFALYKCSTSYTD

SEQ ID NO: 2336534 - protein, 17 aa, Cryptosporidium parvum
QIICSLGLIAEIEEKLI

SEQ ID NO: 2336535 - protein, 18 aa, Cryptosporidium parvum
QIKCRKCKKKHEVCKKHS

SEQ ID NO: 2336536 - protein, 22 aa, Cryptosporidium parvum
QIQCLCNALSSYALKGTVTPLN

SEQ ID NO: 2336537 - protein, 18 aa, Cryptosporidium parvum
QIRKFKGLFRDFKDDEEL

SEQ ID NO: 2336538 - protein, 26 aa, Cryptosporidium parvum
QISGIKSALGIMGFKLSEGSGIPLAV

SEQ ID NO: 2336539 - protein, 21 aa, Cryptosporidium parvum
QISIADCQIYMTIFVDSASLR

SEQ ID NO: 2336540 - protein, 18 aa, Cryptosporidium parvum
QISSFPTIMVYKTASKLP

SEQ ID NO: 2336541 - protein, 20 aa, Cryptosporidium parvum
QITDRMAVSIAKEIHTLFPQ

SEQ ID NO: 2336542 - protein, 20 aa, Cryptosporidium parvum
QIVNPEWRFFTNVLELLLFQ

SEQ ID NO: 2336543 - protein, 35 aa, Cryptosporidium parvum
QKDDACSHLKHFVLNRMVLFVAYVLEFWRKSRTSE

SEQ ID NO: 2336544 - protein, 18 aa, Cryptosporidium parvum
QKEKSMNFMLKKSIIKLC

SEQ ID NO: 2336545 - protein, 17 aa, Cryptosporidium parvum
QKICEIVNVMIREPASF

SEQ ID NO: 2336546 - protein, 28 aa, Cryptosporidium parvum
QKKRALSLFRVLKYLYKGHTTGWYITAF

SEQ ID NO: 2336547 - protein, 22 aa, Cryptosporidium parvum
QKLADFSLEMSIKVIFNPTSLF

SEQ ID NO: 2336548 - protein, 24 aa, Cryptosporidium parvum
QKLLLLSFLFKYSMNLSLADSNSD

SEQ ID NO: 2336549 - protein, 34 aa, Cryptosporidium parvum
QKMCHEVDLIKPLWTMPLLLRIFLNNINLDKNNP

SEQ ID NO: 2336550 - protein, 25 aa, Cryptosporidium parvum
QKNETFSSFFAYECSSAFEQQASHD

SEQ ID NO: 2336551 - protein, 23 aa, Cryptosporidium parvum
QKVNLPRSWYFLGEKIDEIYVSV

SEQ ID NO: 2336552 - protein, 18 aa, Cryptosporidium parvum
QKYSYYLNEYSEIIPNRD

SEQ ID NO: 2336553 - protein, 27 aa, Cryptosporidium parvum
QLETFVKLRIKWFNIFVNDYLARLGIK

SEQ ID NO: 2336554 - protein, 18 aa, Cryptosporidium parvum
QLKHSSTAKFGLPHQAKN

SEQ ID NO: 2336555 - protein, 23 aa, Cryptosporidium parvum
QLKLRSWLMCPEIENIDLIVMPE

SEQ ID NO: 2336556 - protein, 20 aa, Cryptosporidium parvum
QLLNKFEIHFQVLKKGYLEI

SEQ ID NO: 2336557 - protein, 35 aa, Cryptosporidium parvum
QLLSQKPRMRWPLSGARYHPYISNILGFQKVWIYR

SEQ ID NO: 2336558 - protein, 20 aa, Cryptosporidium parvum
QLSNTVIYPLRISSTTTTTT

SEQ ID NO: 2336559 - protein, 19 aa, Cryptosporidium parvum
QLVLICFFILLGQIKGDKT

SEQ ID NO: 2336560 - protein, 26 aa, Cryptosporidium parvum
QLYIKLIPAILLWIFFLSGKVLSSNT

SEQ ID NO: 2336561 - protein, 17 aa, Cryptosporidium parvum
QLYQDWRKDENKVVPSW

SEQ ID NO: 2336562 - protein, 28 aa, Cryptosporidium parvum
QMFYRDNVFFNFLLVKHFSFGENDKILK

SEQ ID NO: 2336563 - protein, 25 aa, Cryptosporidium parvum
QNDIWSDRFVNGFSSIELENNNSGV

SEQ ID NO: 2336564 - protein, 18 aa, Cryptosporidium parvum
QNILSIYFFQSYLALRDL

SEQ ID NO: 2336565 - protein, 24 aa, Cryptosporidium parvum
QNKNRLRLLWSLNSVRCKIEDCYN

SEQ ID NO: 2336566 - protein, 17 aa, Cryptosporidium parvum
QNLLSTKILFLILESMY

SEQ ID NO: 2336567 - protein, 19 aa, Cryptosporidium parvum
QNPGFCVPMSIYTPCSRCK

SEQ ID NO: 2336568 - protein, 18 aa, Cryptosporidium parvum
QNRDVFCTRMGYSSMTVR

SEQ ID NO: 2336569 - protein, 19 aa, Cryptosporidium parvum
QPELYCLLFTNSMKPNIFS

SEQ ID NO: 2336570 - protein, 19 aa, Cryptosporidium parvum
QPFSGRVGTFSSFSGAAPA

SEQ ID NO: 2336571 - protein, 19 aa, Cryptosporidium parvum
QPKHVWSVTGYYGGFGEEM

SEQ ID NO: 2336572 - protein, 19 aa, Cryptosporidium parvum
QPSSEIAYGFAINNGNEES

SEQ ID NO: 2336573 - protein, 18 aa, Cryptosporidium parvum
QQATCVLESEGYYSLHEK

SEQ ID NO: 2336574 - protein, 21 aa, Cryptosporidium parvum
QQISPLFQFRAKLYFEGNTWK

SEQ ID NO: 2336575 - protein, 23 aa, Cryptosporidium parvum
QQPGINWEHFTEVLKVDSEGNPY

SEQ ID NO: 2336576 - protein, 21 aa, Cryptosporidium parvum
QRFVLSFKKRLGELLEIDYKS

SEQ ID NO: 2336577 - protein, 24 aa, Cryptosporidium parvum
QRGIRELAYRLIVRDKPTNTEPEG

SEQ ID NO: 2336578 - protein, 17 aa, Cryptosporidium parvum
QRKEVWDFVKANQIPLF

SEQ ID NO: 2336579 - protein, 24 aa, Cryptosporidium parvum
QRKKIECKFIKNLIFILIIFSEKN

SEQ ID NO: 2336580 - protein, 25 aa, Cryptosporidium parvum
QRLSDSALCLVKLPTTIWALTPLNW

SEQ ID NO: 2336581 - protein, 23 aa, Cryptosporidium parvum
QRLTGLRFSWPDGTTVVTSGRGS

SEQ ID NO: 2336582 - protein, 23 aa, Cryptosporidium parvum
QSFNIPPPPSFPAPPPPSIPSGT

SEQ ID NO: 2336583 - protein, 24 aa, Cryptosporidium parvum
QSGFYRLRSRLYFLNDGVAYSAIP

SEQ ID NO: 2336584 - protein, 26 aa, Cryptosporidium parvum
QSLLFLSVLMGPKWEKELKRYTQLSV

SEQ ID NO: 2336585 - protein, 17 aa, Cryptosporidium parvum
QSLPQYILIKGILSEYS

SEQ ID NO: 2336586 - protein, 18 aa, Cryptosporidium parvum
QSTFYKYYLESIGKSPTA

SEQ ID NO: 2336587 - protein, 23 aa, Cryptosporidium parvum
QTKGGVLRKREFENFDLSNDAIE

SEQ ID NO: 2336588 - protein, 20 aa, Cryptosporidium parvum
QVDKRLSIFEAYKDIASTLN

SEQ ID NO: 2336589 - protein, 17 aa, Cryptosporidium parvum
QVIELKPLLNCPPDTVL

SEQ ID NO: 2336590 - protein, 19 aa, Cryptosporidium parvum
QVKSMACKFHPELEQTVEE

SEQ ID NO: 2336591 - protein, 17 aa, Cryptosporidium parvum
QVLKTSRQVVFKSPVQF

SEQ ID NO: 2336592 - protein, 26 aa, Cryptosporidium parvum
QVLTEICPKKVPGMYWTFENIIHETN

SEQ ID NO: 2336593 - protein, 28 aa, Cryptosporidium parvum
QVMMPVAAFIRPRLVVDEALLQAFGEIA

SEQ ID NO: 2336594 - protein, 18 aa, Cryptosporidium parvum
QVMRQDGKIKDRVLNEEN

SEQ ID NO: 2336595 - protein, 34 aa, Cryptosporidium parvum
QVRGLKLLKNVLCKYPKINLRYYISPTIEEYKQF

SEQ ID NO: 2336596 - protein, 22 aa, Cryptosporidium parvum
QVRTSSVFGRSIIDYNDKLKAR

SEQ ID NO: 2336597 - protein, 28 aa, Cryptosporidium parvum
QVSIGCAAPCPYQRYFIQTDRVLKRIAK

SEQ ID NO: 2336598 - protein, 19 aa, Cryptosporidium parvum
QVTELCIFASKLAESNTED

SEQ ID NO: 2336599 - protein, 25 aa, Cryptosporidium parvum
QVYLNIKFTYRWNAPGALKIENETV

SEQ ID NO: 2336600 - protein, 25 aa, Cryptosporidium parvum
QWPLYTEIWRSCAYVYKRKATGGEK

SEQ ID NO: 2336601 - protein, 39 aa, Cryptosporidium parvum
QYKKFKCPRLIASFLRDRILGYSCPYLSNINEFFNFVEN

SEQ ID NO: 2336602 - protein, 22 aa, Cryptosporidium parvum
QYLTEIDVSFDFKKTGIQGFDL

SEQ ID NO: 2336603 - protein, 25 aa, Cryptosporidium parvum
RAGLTKFTSAFGIHILGDYRVPDDK

SEQ ID NO: 2336604 - protein, 19 aa, Cryptosporidium parvum
RAGSGWTQQHICEGIYLLN

SEQ ID NO: 2336605 - protein, 18 aa, Cryptosporidium parvum
RAKEMGIFKGEKSQSNGE

SEQ ID NO: 2336606 - protein, 18 aa, Cryptosporidium parvum
RALINILNIYSKVLKEEL

SEQ ID NO: 2336607 - protein, 19 aa, Cryptosporidium parvum
RALMPYKLEKWYNSLNQQI

SEQ ID NO: 2336608 - protein, 18 aa, Cryptosporidium parvum
RAPPPPTCSQSFVRVRTR

SEQ ID NO: 2336609 - protein, 35 aa, Cryptosporidium parvum; identical to SEQ ID NO: 2208070

SEQ ID NO: 2336610 - protein, 19 aa, Cryptosporidium parvum
RAWDFKKPIIVCPAMNSFM

SEQ ID NO: 2336611 - protein, 18 aa, Cryptosporidium parvum
RCGSKWRKTKLGSSMGDR

SEQ ID NO: 2336612 - protein, 17 aa, Cryptosporidium parvum
RCIDLMHYFALARGVRS

SEQ ID NO: 2336613 - protein, 17 aa, Cryptosporidium parvum
RCISGCATAFLAGGLSA

SEQ ID NO: 2336614 - protein, 29 aa, Cryptosporidium parvum
RDDCFSHIWRVWESGIYRNLYIDGTNFEK

SEQ ID NO: 2336615 - protein, 23 aa, Cryptosporidium parvum
RDFPVYWNDLLVIIVKFLPDEQT

SEQ ID NO: 2336616 - protein, 19 aa, Cryptosporidium parvum
RDGRRFNHYSLDNINLNDE

SEQ ID NO: 2336617 - protein, 25 aa, Cryptosporidium parvum
RDLKAGDPFFNFNFQYMQDRFGHCS

SEQ ID NO: 2336618 - protein, 17 aa, Cryptosporidium parvum
RDLSNYYLLEFNQEEER

SEQ ID NO: 2336619 - protein, 21 aa, Cryptosporidium parvum
RDPFYTCPMGFNFEVPTIDGI

SEQ ID NO: 2336620 - protein, 25 aa, Cryptosporidium parvum
RDPTDIFKLHGIKTFKPAYSRVDKQ

SEQ ID NO: 2336621 - protein, 20 aa, Cryptosporidium parvum
RDVESSIYLAKRKIHKLKKC

SEQ ID NO: 2336622 - protein, 25 aa, Cryptosporidium parvum
REASVFLFICLSVRSFSKIGGVAHL

SEQ ID NO: 2336623 - protein, 17 aa, Cryptosporidium parvum
REFDCNWQMQNGLENND

SEQ ID NO: 2336624 - protein, 17 aa, Cryptosporidium parvum
REGYDLYNEMLANGVNK

SEQ ID NO: 2336625 - protein, 19 aa, Cryptosporidium parvum
REIVSLFYRAGDVSRHSLF

SEQ ID NO: 2336626 - protein, 25 aa, Cryptosporidium parvum
REKTQLRPELKVVKRTKPLISKFPI

SEQ ID NO: 2336627 - protein, 17 aa, Cryptosporidium parvum
REMPIPFFTASLPLIGQ

SEQ ID NO: 2336628 - protein, 24 aa, Cryptosporidium parvum
RENMKLFLKGMIQYTTFSQLERFS

SEQ ID NO: 2336629 - protein, 19 aa, Cryptosporidium parvum
REPEIPTDVSIQIERKLGG

SEQ ID NO: 2336630 - protein, 26 aa, Cryptosporidium parvum
RESQLWIKDYVLRNAAYRHYQFEKSH

SEQ ID NO: 2336631 - protein, 21 aa, Cryptosporidium parvum
REYNTRAGGYPALQQTRIERK

SEQ ID NO: 2336632 - protein, 25 aa, Cryptosporidium parvum
RFDLEMMSLLDSLRYPELSKLIYSD

SEQ ID NO: 2336633 - protein, 23 aa, Cryptosporidium parvum
RFESQDIMNVFALSPNGKLVSFV

SEQ ID NO: 2336634 - protein, 22 aa, Cryptosporidium parvum
RFFEINGVPPLTYLSPANETLL

SEQ ID NO: 2336635 - protein, 23 aa, Cryptosporidium parvum
RFFTNVLELLLFQPGRAMGTPWP

SEQ ID NO: 2336636 - protein, 18 aa, Cryptosporidium parvum
RFKQENKFKEKKKKKLPN

SEQ ID NO: 2336637 - protein, 25 aa, Cryptosporidium parvum
RFPNLKPTRVCFSQWKAILDQNKED

SEQ ID NO: 2336638 - protein, 19 aa, Cryptosporidium parvum
RFQSLGVAFYRGADCCALV

SEQ ID NO: 2336639 - protein, 28 aa, Cryptosporidium parvum
RFRGELYSDGSIGWLCSRRINGRWTGWI

SEQ ID NO: 2336640 - protein, 21 aa, Cryptosporidium parvum
RFTKSKIWRFFNYFRLKRKKK

SEQ ID NO: 2336641 - protein, 18 aa, Cryptosporidium parvum
RFVESCTNILRTLSVNGL

SEQ ID NO: 2336642 - protein, 21 aa, Cryptosporidium parvum
RGFCTEAGMMHFFKKEMESLI

SEQ ID NO: 2336643 - protein, 24 aa, Cryptosporidium parvum
RGFPEMAVILAFDIKVDAEAEVEA

SEQ ID NO: 2336644 - protein, 18 aa, Cryptosporidium parvum
RGFSEFRTYKGVFSELIF

SEQ ID NO: 2336645 - protein, 24 aa, Cryptosporidium parvum
RGHVSRFNWSFVYEKIRNSLGAQY

SEQ ID NO: 2336646 - protein, 25 aa, Cryptosporidium parvum
RGIGRIYGYCMLKGEPLNFHFNNFI

SEQ ID NO: 2336647 - protein, 28 aa, Cryptosporidium parvum
RGKKKPELRLMKSLSFEGSEKSSHCHHH

SEQ ID NO: 2336648 - protein, 20 aa, Cryptosporidium parvum
RGLLHVSALFKYSKKYKNSS

SEQ ID NO: 2336649 - protein, 17 aa, Cryptosporidium parvum
RGLLVWGTVSPEYQGVV

SEQ ID NO: 2336650 - protein, 25 aa, Cryptosporidium parvum
RGNLIRLVFELSQLPYIGHAFGGYN

SEQ ID NO: 2336651 - protein, 33 aa, Cryptosporidium parvum
RGPTQRLPVSQIWRATPLENRPEDSLLLTRGTE

SEQ ID NO: 2336652 - protein, 20 aa, Cryptosporidium parvum
RICEKIPLFSTSPMTNNENN

SEQ ID NO: 2336653 - protein, 33 aa, Cryptosporidium parvum
RICSIEWKNRFFFGFALREHYGPIPLNALSSSL

SEQ ID NO: 2336654 - protein, 22 aa, Cryptosporidium parvum
RIDSRYNFFGLRKGETIINERE

SEQ ID NO: 2336655 - protein, 18 aa, Cryptosporidium parvum
RIEYRKILLTNSGNGPDC

SEQ ID NO: 2336656 - protein, 19 aa, Cryptosporidium parvum
RILLLLSTVSYAYSEKKRQ

SEQ ID NO: 2336657 - protein, 18 aa, Cryptosporidium parvum
RILLLSFIIGAFGAPQVK

SEQ ID NO: 2336658 - protein, 18 aa, Cryptosporidium parvum
RINRKKIMDKLRQKTLPR

SEQ ID NO: 2336659 - protein, 17 aa, Cryptosporidium parvum
RIPSISMTTMYASKASP

SEQ ID NO: 2336660 - protein, 18 aa, Cryptosporidium parvum
RISEVNGLLIRKRELQEK

SEQ ID NO: 2336661 - protein, 25 aa, Cryptosporidium parvum
RISIPESIPSVGSDNVFFDSDDPSN

SEQ ID NO: 2336662 - protein, 17 aa, Cryptosporidium parvum
RISKIGRFYQINQNHQK

SEQ ID NO: 2336663 - protein, 20 aa, Cryptosporidium parvum
RIVKDVGGPCPADVTRTGGI

SEQ ID NO: 2336664 - protein, 19 aa, Cryptosporidium parvum
RIVMEMIPLIYSKADMVCP

SEQ ID NO: 2336665 - protein, 25 aa, Cryptosporidium parvum
RKAKYDLPTFLNFVGDFSGTFSLPL

SEQ ID NO: 2336666 - protein, 21 aa, Cryptosporidium parvum
RKDTGIIFVHPFLRKFKPIGS

SEQ ID NO: 2336667 - protein, 17 aa, Cryptosporidium parvum
RKGEMRAPIIGIPSKKP

SEQ ID NO: 2336668 - protein, 18 aa, Cryptosporidium parvum
RKHLKNMLNHIYSSIMHS

SEQ ID NO: 2336669 - protein, 17 aa, Cryptosporidium parvum
RKIEVRSPVSGILSKVN

SEQ ID NO: 2336670 - protein, 17 aa, Cryptosporidium parvum
RKIHPRHPFPLPSSPLY

SEQ ID NO: 2336671 - protein, 19 aa, Cryptosporidium parvum
RKIIISRPILQTLTEETDD

SEQ ID NO: 2336672 - protein, 22 aa, Cryptosporidium parvum
RKIKHKKKKCKMYMEFSSRDIS

SEQ ID NO: 2336673 - protein, 19 aa, Cryptosporidium parvum
RKIVNTFLRTNCSPPEVLH

SEQ ID NO: 2336674 - protein, 19 aa, Cryptosporidium parvum
RKKDCEKLSGGKQCETNYC

SEQ ID NO: 2336675 - protein, 19 aa, Cryptosporidium parvum
RKKICFEIEENGEIEKKMK

SEQ ID NO: 2336676 - protein, 18 aa, Cryptosporidium parvum
RKKIKIAENIPKVKLQHK

SEQ ID NO: 2336677 - protein, 17 aa, Cryptosporidium parvum
RKKPVLRSMRTLSLEGF

SEQ ID NO: 2336678 - protein, 22 aa, Cryptosporidium parvum
RKLCSGPILLLIILSLSNSTEV

SEQ ID NO: 2336679 - protein, 21 aa, Cryptosporidium parvum
RKLLGGEKCKYFHRFNEGSVI

SEQ ID NO: 2336680 - protein, 25 aa, Cryptosporidium parvum
RKNKCSSILIPICGSDGVTYRNPCE

SEQ ID NO: 2336681 - protein, 24 aa, Cryptosporidium parvum
RKQIPAILARKICASTSRWMSCNS

SEQ ID NO: 2336682 - protein, 25 aa, Cryptosporidium parvum
RKRNGIKFEENWVFGQILCSASNIS

SEQ ID NO: 2336683 - protein, 20 aa, Cryptosporidium parvum
RKSAFYILYSMSYKSQPIVP

SEQ ID NO: 2336684 - protein, 20 aa, Cryptosporidium parvum
RKSLYSFKSSYSMQALCETS

SEQ ID NO: 2336685 - protein, 17 aa, Cryptosporidium parvum
RKSPSLKSLDSAQKQDS

SEQ ID NO: 2336686 - protein, 19 aa, Cryptosporidium parvum
RKSRCRDPTLSIVGFPGLP

SEQ ID NO: 2336687 - protein, 17 aa, Cryptosporidium parvum
RKSSYKLALSSLKRIEE

SEQ ID NO: 2336688 - protein, 18 aa, Cryptosporidium parvum
RKTIEPVKKVLEDAGIKK

SEQ ID NO: 2336689 - protein, 21 aa, Cryptosporidium parvum
RKVIWNSILGLDGFDTVSVSG

SEQ ID NO: 2336690 - protein, 19 aa, Cryptosporidium parvum
RKYISNMLIENAVRKVSRP

SEQ ID NO: 2336691 - protein, 24 aa, Cryptosporidium parvum
RKYPNVKLRFIIRPKTLRFFPKSS

SEQ ID NO: 2336692 - protein, 17 aa, Cryptosporidium parvum
RLAVPKKLRDLLSSDSS

SEQ ID NO: 2336693 - protein, 20 aa, Cryptosporidium parvum
RLENWKSHFEEISSLDSHVE

SEQ ID NO: 2336694 - protein, 18 aa, Cryptosporidium parvum
RLEQPIIIRKALSKEICH

SEQ ID NO: 2336695 - protein, 19 aa, Cryptosporidium parvum
RLLLDNMQLFRSFEIKFSK

SEQ ID NO: 2336696 - protein, 19 aa, Cryptosporidium parvum
RLLLEGAPFLNLLPNTEND

SEQ ID NO: 2336697 - protein, 17 aa, Cryptosporidium parvum
RLLRLKEGITYILDTKE

SEQ ID NO: 2336698 - protein, 17 aa, Cryptosporidium parvum
RLREYFPGTLLQLRDAI

SEQ ID NO: 2336699 - protein, 18 aa, Cryptosporidium parvum
RLSSLFSMLKRKRHNPNL

SEQ ID NO: 2336700 - protein, 22 aa, Cryptosporidium parvum
RLTSQSCTLVFIIPTNTQGGNS

SEQ ID NO: 2336701 - protein, 28 aa, Cryptosporidium parvum
RLTTKAPPKFLISSIKASSNSTLEISKL

SEQ ID NO: 2336702 - protein, 18 aa, Cryptosporidium parvum
RLVLLIVIPVIAGKDYYK

SEQ ID NO: 2336703 - protein, 17 aa, Cryptosporidium parvum
RLYYKSDFTRFMLNLII

SEQ ID NO: 2336704 - protein, 21 aa, Cryptosporidium parvum
RMEISKKLILREVSDDDDSVI

SEQ ID NO: 2336705 - protein, 25 aa, Cryptosporidium parvum
RMELAAEVLLAFDILKEAIRLATYL

SEQ ID NO: 2336706 - protein, 17 aa, Cryptosporidium parvum
RMKNKVMRRHNEDKRKK

SEQ ID NO: 2336707 - protein, 24 aa, Cryptosporidium parvum
RNASIGVIWIYEPGLLLAEELVSP

SEQ ID NO: 2336708 - protein, 25 aa, Cryptosporidium parvum
RNEIRPYGYRGSPMILTQFIENIDL

SEQ ID NO: 2336709 - protein, 18 aa, Cryptosporidium parvum
RNEMISLLWNRAANMGDT

SEQ ID NO: 2336710 - protein, 20 aa, Cryptosporidium parvum
RNKEKLLFLNGIDESFNQIR

SEQ ID NO: 2336711 - protein, 26 aa, Cryptosporidium parvum
RNLEVPEIISVIDFLKMIYSNYNSEL

SEQ ID NO: 2336712 - protein, 17 aa, Cryptosporidium parvum
RNNCCSVIYDLFLSKVF

SEQ ID NO: 2336713 - protein, 20 aa, Cryptosporidium parvum
RNNIKDILTLNVTFSELEPC

SEQ ID NO: 2336714 - protein, 17 aa, Cryptosporidium parvum
RNPFRYLCDNSPARKLL

SEQ ID NO: 2336715 - protein, 21 aa, Cryptosporidium parvum
RNRVVLLDPSHGLSCSGPYIS

SEQ ID NO: 2336716 - protein, 18 aa, Cryptosporidium parvum
RNTFDLILNDGIHKSKNS

SEQ ID NO: 2336717 - protein, 18 aa, Cryptosporidium parvum
RNWGEGIATLNGHIYQLT

SEQ ID NO: 2336718 - protein, 24 aa, Cryptosporidium parvum
RPFSHKYPGLGISQSIIYDVFNHG

SEQ ID NO: 2336719 - protein, 17 aa, Cryptosporidium parvum
RPGCGPCKQLVQAYGNI

SEQ ID NO: 2336720 - protein, 19 aa, Cryptosporidium parvum
RPIPIGGGALYLCSIDYYA

SEQ ID NO: 2336721 - protein, 18 aa, Cryptosporidium parvum
RPKQCFIQVKRLLLGENN

SEQ ID NO: 2336722 - protein, 18 aa, Cryptosporidium parvum
RPLPHPLPSSGSYSNGEP

SEQ ID NO: 2336723 - protein, 19 aa, Cryptosporidium parvum
RPPKCIFKTEIQFKVIDLP

SEQ ID NO: 2336724 - protein, 24 aa, Cryptosporidium parvum
RPSIRKLMRCFGCCRGKCKKKPSK

SEQ ID NO: 2336725 - protein, 27 aa, Cryptosporidium parvum
RPVECDGWNPTGPFGRRLEQIIINDEG

SEQ ID NO: 2336726 - protein, 24 aa, Cryptosporidium parvum
RPVPLPRTRHLGGNPPKGLGKAPV

SEQ ID NO: 2336727 - protein, 22 aa, Cryptosporidium parvum
RPYAPFRYFAAETFNEMRNNCC

SEQ ID NO: 2336728 - protein, 19 aa, Cryptosporidium parvum
RPYVSFKGNEIMYVHESSN

SEQ ID NO: 2336729 - protein, 24 aa, Cryptosporidium parvum
RQAKSECFTTMFQLNAEFQETISK

SEQ ID NO: 2336730 - protein, 19 aa, Cryptosporidium parvum
RQFRGEILFVKSGTNLAHE

SEQ ID NO: 2336731 - protein, 26 aa, Cryptosporidium parvum
RQIYHFLFSGGFLFPGNTLYEGYTTC

SEQ ID NO: 2336732 - protein, 29 aa, Cryptosporidium parvum
RQKFRQICKEAGYSTGRWDVYNDRAYSQY

SEQ ID NO: 2336733 - protein, 20 aa, Cryptosporidium parvum
RQPLKLSGVNPVFYEISTLR

SEQ ID NO: 2336734 - protein, 21 aa, Cryptosporidium parvum
RRDLLPKLGIKYLVEKEDYYF

SEQ ID NO: 2336735 - protein, 22 aa, Cryptosporidium parvum
RRIRGVKFLFGQDIKVINAYND

SEQ ID NO: 2336736 - protein, 19 aa, Cryptosporidium parvum
RRKWREEIERGTFWDDDKL

SEQ ID NO: 2336737 - protein, 20 aa, Cryptosporidium parvum
RRLLYLLDLFHRGGTSFYPE

SEQ ID NO: 2336738 - protein, 19 aa, Cryptosporidium parvum
RRLTSRLTSRFTRNNSRRR

SEQ ID NO: 2336739 - protein, 17 aa, Cryptosporidium parvum
RRPCGRCRRGSTCCENN

SEQ ID NO: 2336740 - protein, 18 aa, Cryptosporidium parvum
RRPSTFIQRQHIWTNSVR

SEQ ID NO: 2336741 - protein, 21 aa, Cryptosporidium parvum
RRRFFCQAFNREIMRDADHGE

SEQ ID NO: 2336742 - protein, 29 aa, Cryptosporidium parvum
RRRIRWEREGLGENCGYFFGKNKDGGKDG

SEQ ID NO: 2336743 - protein, 17 aa, Cryptosporidium parvum
RRRSRGVLDREPEIPTD

SEQ ID NO: 2336744 - protein, 18 aa, Cryptosporidium parvum
RRSRYAIEGWLSHKNKSP

SEQ ID NO: 2336745 - protein, 22 aa, Cryptosporidium parvum
RRVSRCCILIQDFVDIALMIIS

SEQ ID NO: 2336746 - protein, 26 aa, Cryptosporidium parvum
RSAGGCGFRKLFCLGSGDYGEGRLHP

SEQ ID NO: 2336747 - protein, 30 aa, Cryptosporidium parvum
RSEIAENHLLNWRFDIMPMHKVIIPKRNSI

SEQ ID NO: 2336748 - protein, 17 aa, Cryptosporidium parvum
RSFWEFNENSQLQVKGT

SEQ ID NO: 2336749 - protein, 21 aa, Cryptosporidium parvum
RSIVIPMSFPQLYIKGYSRAQ

SEQ ID NO: 2336750 - protein, 31 aa, Cryptosporidium parvum
RSKFRKRLRRIPIFFRNLFRRNKNKTKANGK

SEQ ID NO: 2336751 - protein, 17 aa, Cryptosporidium parvum
RSKRGRSGVAVKSLDES

SEQ ID NO: 2336752 - protein, 18 aa, Cryptosporidium parvum
RSPVSGILSKVNIHQTGY

SEQ ID NO: 2336753 - protein, 19 aa, Cryptosporidium parvum
RSRKYLKLRKYYKRMKKFQ

SEQ ID NO: 2336754 - protein, 25 aa, Cryptosporidium parvum
RSSCCSGSSSCCCSCCCSGSCCCSN

SEQ ID NO: 2336755 - protein, 20 aa, Cryptosporidium parvum
RSSFSSIFLCSKHEIKEIPH

SEQ ID NO: 2336756 - protein, 17 aa, Cryptosporidium parvum
RSSLGNGGKTAKCIQNR

SEQ ID NO: 2336757 - protein, 17 aa, Cryptosporidium parvum
RSSQSDCLVPWDSTITW

SEQ ID NO: 2336758 - protein, 18 aa, Cryptosporidium parvum
RSTTIPITSNFESSKKDA

SEQ ID NO: 2336759 - protein, 19 aa, Cryptosporidium parvum
RTEWADLLFQISNNNRKIT

SEQ ID NO: 2336760 - protein, 21 aa, Cryptosporidium parvum
RTKLGTCIVGGVRSHFAAQKI

SEQ ID NO: 2336761 - protein, 18 aa, Cryptosporidium parvum
RTRFPVNTRHGFIPLYII

SEQ ID NO: 2336762 - protein, 29 aa, Cryptosporidium parvum
RTSFLNLFTTFFLCFHFARLAEHNFQNEK

SEQ ID NO: 2336763 - protein, 17 aa, Cryptosporidium parvum
RTSFPADPKHGFVPLYI

SEQ ID NO: 2336764 - protein, 19 aa, Cryptosporidium parvum
RTVHSRSSLSPGNQILLTQ

SEQ ID NO: 2336765 - protein, 22 aa, Cryptosporidium parvum
RVDLYYGMKGIRLQLGNGEQSR

SEQ ID NO: 2336766 - protein, 17 aa, Cryptosporidium parvum
RVFRCGFYCASKLGYVK

SEQ ID NO: 2336767 - protein, 24 aa, Cryptosporidium parvum
RVFSAHPYKSIVIHEVEESVIEEQ

SEQ ID NO: 2336768 - protein, 20 aa, Cryptosporidium parvum
RVIFDRRSRYAIEGWLSHKN

SEQ ID NO: 2336769 - protein, 18 aa, Cryptosporidium parvum
RVPAALECPPEYILNNGE

SEQ ID NO: 2336770 - protein, 25 aa, Cryptosporidium parvum
RVSTIIKALAWIAIVCLVKNASSEG

SEQ ID NO: 2336771 - protein, 19 aa, Cryptosporidium parvum
RVYLSHLFPEEDSLPLKHF

SEQ ID NO: 2336772 - protein, 19 aa, Cryptosporidium parvum
RVYYYPIGFNLASLFIGPG

SEQ ID NO: 2336773 - protein, 24 aa, Cryptosporidium parvum
RWGEKGFCRIIRGVNELSIEHAAV

SEQ ID NO: 2336774 - protein, 17 aa, Cryptosporidium parvum
RWIPVGLNTTEFTFKAG

SEQ ID NO: 2336775 - protein, 21 aa, Cryptosporidium parvum
RWSKQKELKKRKVLDRLRSRI

SEQ ID NO: 2336776 - protein, 18 aa, Cryptosporidium parvum
RYDLSLWSTIGFPAILTP

SEQ ID NO: 2336777 - protein, 26 aa, Cryptosporidium parvum
RYGKYSNKYLYGIREIELMTNNLRSV

SEQ ID NO: 2336778 - protein, 19 aa, Cryptosporidium parvum
RYHGKKSYWVSVNSRGERV

SEQ ID NO: 2336779 - protein, 19 aa, Cryptosporidium parvum
RYLYECAMYLTSMIEHEKL

SEQ ID NO: 2336780 - protein, 18 aa, Cryptosporidium parvum
RYQLELSTGIFINNDVIR

SEQ ID NO: 2336781 - protein, 20 aa, Cryptosporidium parvum
RYWGVCFEGYEEYFGNLIPL

SEQ ID NO: 2336782 - protein, 19 aa, Cryptosporidium parvum
RYYAFKLADSYGHRLDLLP

SEQ ID NO: 2336783 - protein, 26 aa, Cryptosporidium parvum
SAELACGRYSFMFHCEVVEISKEMFE

SEQ ID NO: 2336784 - protein, 18 aa, Cryptosporidium parvum
SAKISWCPISTKNKLSLL

SEQ ID NO: 2336785 - protein, 19 aa, Cryptosporidium parvum
SALICYLCARNFRNSIEIW

SEQ ID NO: 2336786 - protein, 18 aa, Cryptosporidium parvum
SALVIGVSILNRYQDIHT

SEQ ID NO: 2336787 - protein, 24 aa, Cryptosporidium parvum
SANMKFNLIKPICYNGSQNNNCNN

SEQ ID NO: 2336788 - protein, 18 aa, Cryptosporidium parvum
SAVPFGWTNIPLGVSPIR

SEQ ID NO: 2336789 - protein, 18 aa, Cryptosporidium parvum
SCESRFSDMKVFKSSPLL

SEQ ID NO: 2336790 - protein, 24 aa, Cryptosporidium parvum
SCIMAESLIQFGIKNEYFNRLCIN

SEQ ID NO: 2336791 - protein, 26 aa, Cryptosporidium parvum
SCIPDLRPILSFLLADFGVYIPLSSI

SEQ ID NO: 2336792 - protein, 23 aa, Cryptosporidium parvum
SCKRRCTISRNIGRCRGIENRLA

SEQ ID NO: 2336793 - protein, 21 aa, Cryptosporidium parvum
SCLTKYSMVYIDWIYSVLSNY

SEQ ID NO: 2336794 - protein, 28 aa, Cryptosporidium parvum
SCNHSSTNMCISEFDLSISSKYWDPVYF

SEQ ID NO: 2336795 - protein, 24 aa, Cryptosporidium parvum
SCPKNCQKFGHLCKCIDEIPIQSI

SEQ ID NO: 2336796 - protein, 17 aa, Cryptosporidium parvum
SCQDSKKSLAILILMFQ

SEQ ID NO: 2336797 - protein, 21 aa, Cryptosporidium parvum
SCSAQAFGDLCNRRKTNISWD

SEQ ID NO: 2336798 - protein, 22 aa, Cryptosporidium parvum
SCSSSIWKSGYSVLKPKTDDRS

SEQ ID NO: 2336799 - protein, 35 aa, Cryptosporidium parvum
SCVSITYADSVAFCPLSYSHSKLWGSHRGGGGCHV

SEQ ID NO: 2336800 - protein, 17 aa, Cryptosporidium parvum
SDDEIRDAVSFAAIPSV

SEQ ID NO: 2336801 - protein, 21 aa, Cryptosporidium parvum
SDDLRGVPIIKKHSNSPSQIL

SEQ ID NO: 2336802 - protein, 28 aa, Cryptosporidium parvum
SDDTRPIFFSSVLRLEILNKWRKSKSKS

SEQ ID NO: 2336803 - protein, 17 aa, Cryptosporidium parvum
SDEEYWTPFGIDPALLK

SEQ ID NO: 2336804 - protein, 24 aa, Cryptosporidium parvum
SDGLTSSWRLWSLTEKKWNNLDLS

SEQ ID NO: 2336805 - protein, 21 aa, Cryptosporidium parvum
SDGRLTSRIPSLGTSGPDFSN

SEQ ID NO: 2336806 - protein, 28 aa, Cryptosporidium parvum
SDIESPRTLPIIFTMNLRTRKPYINQKE

SEQ ID NO: 2336807 - protein, 26 aa, Cryptosporidium parvum
SDIILSGKCLNGIIFTAMALDSGAIK

SEQ ID NO: 2336808 - protein, 17 aa, Cryptosporidium parvum
SDILKKLEKAYGNGEKR

SEQ ID NO: 2336809 - protein, 17 aa, Cryptosporidium parvum
SDILREVRTSISSCSGV

SEQ ID NO: 2336810 - protein, 27 aa, Cryptosporidium parvum
SDKVCPDCSLKVLPRIILGKYLVLEFK

SEQ ID NO: 2336811 - protein, 20 aa, Cryptosporidium parvum
SDMGISIGVINICSSNKIKI

SEQ ID NO: 2336812 - protein, 24 aa, Cryptosporidium parvum
SDPAKLHALLPIMNIKFGGQPNLI

SEQ ID NO: 2336813 - protein, 26 aa, Cryptosporidium parvum
SDPIKMCPYITSIVFYKVNPFKIEDI

SEQ ID NO: 2336814 - protein, 19 aa, Cryptosporidium parvum
SDQGVICMLPYTLETNFTK

SEQ ID NO: 2336815 - protein, 23 aa, Cryptosporidium parvum
SDRSSSNILFPWIYNSDFSIFES

SEQ ID NO: 2336816 - protein, 19 aa, Cryptosporidium parvum
SDVGSGLYDFCIDNSLSLS

SEQ ID NO: 2336817 - protein, 17 aa, Cryptosporidium parvum
SDVNIVFGSHRDEFQNA

SEQ ID NO: 2336818 - protein, 21 aa, Cryptosporidium parvum
SDVNLGYYFPIYDNSKNEFFP

SEQ ID NO: 2336819 - protein, 25 aa, Cryptosporidium parvum
SDYLQRFPTLTGFNRAGLSGNERII

SEQ ID NO: 2336820 - protein, 19 aa, Cryptosporidium parvum
SEFILDGLLNVYLINDGDS

SEQ ID NO: 2336821 - protein, 25 aa, Cryptosporidium parvum
SEFRTYKGVFSELIFHDKTASNAKI

SEQ ID NO: 2336822 - protein, 20 aa, Cryptosporidium parvum
SEFSERFGIDTLFEKSFEDL

SEQ ID NO: 2336823 - protein, 24 aa, Cryptosporidium parvum
SEFSFKDVNGISVIGIVRPFEQGE

SEQ ID NO: 2336824 - protein, 22 aa, Cryptosporidium parvum
SEFYRYNYVLYRIRGPDCKKPC

SEQ ID NO: 2336825 - protein, 26 aa, Cryptosporidium parvum
SEHVNVCAIVKAVGRQPDGGLILLGR

SEQ ID NO: 2336826 - protein, 19 aa, Cryptosporidium parvum
SEIIFLDYSQSIKWNIETS

SEQ ID NO: 2336827 - protein, 22 aa, Cryptosporidium parvum
SEIKVLGVRALNAYTIEPWMTN

SEQ ID NO: 2336828 - protein, 18 aa, Cryptosporidium parvum
SEILSGLYGSSLEPIIIS

SEQ ID NO: 2336829 - protein, 22 aa, Cryptosporidium parvum
SEIVKYILPYSSYDEYLDENEI

SEQ ID NO: 2336830 - protein, 17 aa, Cryptosporidium parvum
SEKAFLPEGSYKGKWIN

SEQ ID NO: 2336831 - protein, 22 aa, Cryptosporidium parvum
SEKELKERKSLIVKLHEEKNNI

SEQ ID NO: 2336832 - protein, 17 aa, Cryptosporidium parvum
SEKKCKQVEEMIDDQSF

SEQ ID NO: 2336833 - protein, 22 aa, Cryptosporidium parvum
SEKSWQRKLLKAAQPPYLEFHN

SEQ ID NO: 2336834 - protein, 18 aa, Cryptosporidium parvum
SEKYGESYPFFPPGVQPA

SEQ ID NO: 2336835 - protein, 17 aa, Cryptosporidium parvum
SELKRFSLGSHRRITEA

SEQ ID NO: 2336836 - protein, 20 aa, Cryptosporidium parvum
SELLFYDWKRPDVGRETPYD

SEQ ID NO: 2336837 - protein, 28 aa, Cryptosporidium parvum
SENGRPISRFNISGIPEFISKAQEGGAL

SEQ ID NO: 2336838 - protein, 26 aa, Cryptosporidium parvum
SENKSEAWNSELGGNQITPSNIDESY

SEQ ID NO: 2336839 - protein, 18 aa, Cryptosporidium parvum
SENLKAVNLIFVDRKNVI

SEQ ID NO: 2336840 - protein, 18 aa, Cryptosporidium parvum
SEPLSWMTFGDWGEPTAI

SEQ ID NO: 2336841 - protein, 25 aa, Cryptosporidium parvum
SEQNLLAALCWSLPFKFIKCDIDFE

SEQ ID NO: 2336842 - protein, 25 aa, Cryptosporidium parvum
SESDAEYGYMYGLKSNTLFEPVSTL

SEQ ID NO: 2336843 - protein, 18 aa, Cryptosporidium parvum
SESERRSLSPASRSVSRI

SEQ ID NO: 2336844 - protein, 22 aa, Cryptosporidium parvum
SESNDAFGIGGGDYRRDSDEDS

SEQ ID NO: 2336845 - protein, 20 aa, Cryptosporidium parvum
SETTECWAMVYTTSLYISSN

SEQ ID NO: 2336846 - protein, 19 aa, Cryptosporidium parvum
SEVAKLVNVFEKFDDEDQF

SEQ ID NO: 2336847 - protein, 21 aa, Cryptosporidium parvum
SEVEYDLIWLLVPMEPGKGEE

SEQ ID NO: 2336848 - protein, 27 aa, Cryptosporidium parvum
SEVINPFIPTCVNALMTMSMFSPASKL

SEQ ID NO: 2336849 - protein, 33 aa, Cryptosporidium parvum
SEVLLKVVCIYILNMLRFIAVINPELSSSFFKL

SEQ ID NO: 2336850 - protein, 30 aa, Cryptosporidium parvum
SEVMKLGLHLGDFIYPRLFPIFVSDLCIAR

SEQ ID NO: 2336851 - protein, 17 aa, Cryptosporidium parvum
SEVSYTLQELNPFENSS

SEQ ID NO: 2336852 - protein, 20 aa, Cryptosporidium parvum
SEYKQHCMISPHGKNPRNPN

SEQ ID NO: 2336853 - protein, 25 aa, Cryptosporidium parvum
SEYRIAEDYYRYALNSMKMAKDDWE

SEQ ID NO: 2336854 - protein, 25 aa, Cryptosporidium parvum
SFDIKGCSPEEVLIAGNLIRDSSFE

SEQ ID NO: 2336855 - protein, 20 aa, Cryptosporidium parvum
SFEANEGFAQLIFSILDLGT

SEQ ID NO: 2336856 - protein, 18 aa, Cryptosporidium parvum
SFEARKVIRGGVGAPNGT

SEQ ID NO: 2336857 - protein, 20 aa, Cryptosporidium parvum
SFEKRSELVLIDKANKIKKF

SEQ ID NO: 2336858 - protein, 22 aa, Cryptosporidium parvum
SFGDKMKWSLGLDSDNLVYLNY

SEQ ID NO: 2336859 - protein, 18 aa, Cryptosporidium parvum
SFHPFPMLKDQIVELETN

SEQ ID NO: 2336860 - protein, 27 aa, Cryptosporidium parvum
SFIEYIILLFMKFCSPQGLTYYTNRIE

SEQ ID NO: 2336861 - protein, 18 aa, Cryptosporidium parvum
SFKPRIYLRFKSLRDPSS

SEQ ID NO: 2336862 - protein, 19 aa, Cryptosporidium parvum
SFLSSILLLNGIESLKFNE

SEQ ID NO: 2336863 - protein, 24 aa, Cryptosporidium parvum
SFLYKSNVVVLGFPTNKNGKLTRI

SEQ ID NO: 2336864 - protein, 32 aa, Cryptosporidium parvum
SFPTKSFSIGIGWSRLGLFILNEYGDGLIQLK

SEQ ID NO: 2336865 - protein, 19 aa, Cryptosporidium parvum
SFQLRKLYLLSDFAYLVKS

SEQ ID NO: 2336866 - protein, 27 aa, Cryptosporidium parvum
SFSSEIPRLGQYLVFYGHSESTSAASI

SEQ ID NO: 2336867 - protein, 22 aa, Cryptosporidium parvum
SFSVKILLFFLTSGYLIFSPVV

SEQ ID NO: 2336868 - protein, 22 aa, Cryptosporidium parvum
SFVYNCRNALMTLGVEKFPGTK

SEQ ID NO: 2336869 - protein, 25 aa, Cryptosporidium parvum
SGAKSSKLFVRRALSEPPLRNKPSS

SEQ ID NO: 2336870 - protein, 17 aa, Cryptosporidium parvum
SGAPRPGKSPKKDKFGN

SEQ ID NO: 2336871 - protein, 21 aa, Cryptosporidium parvum
SGEIFKLGIGVLEESPDKIYF

SEQ ID NO: 2336872 - protein, 20 aa, Cryptosporidium parvum
SGEYIRLTPPVFKIETKESI

SEQ ID NO: 2336873 - protein, 21 aa, Cryptosporidium parvum
SGFFNIEYVYPLGYAPSMSKF

SEQ ID NO: 2336874 - protein, 18 aa, Cryptosporidium parvum
SGIIFKDYFKTFSRLTIN

SEQ ID NO: 2336875 - protein, 31 aa, Cryptosporidium parvum
SGIVKNIKENIPFKHILLPFTTTTTTVTTTT

SEQ ID NO: 2336876 - protein, 23 aa, Cryptosporidium parvum
SGIYFLVFSVLLTFSFNSINVFE

SEQ ID NO: 2336877 - protein, 22 aa, Cryptosporidium parvum
SGKILARLDTRWDKVGNNETLR

SEQ ID NO: 2336878 - protein, 20 aa, Cryptosporidium parvum
SGLFLLNYVFCINTTKIACN

SEQ ID NO: 2336879 - protein, 18 aa, Cryptosporidium parvum
SGMFKIMLQSSGIDEKDV

SEQ ID NO: 2336880 - protein, 17 aa, Cryptosporidium parvum
SGMTCRAARFVPMKRDM

SEQ ID NO: 2336881 - protein, 23 aa, Cryptosporidium parvum
SGPEWKCPFGSEIFTGDDILETA

SEQ ID NO: 2336882 - protein, 30 aa, Cryptosporidium parvum
SGRFESLSLGWSRLGLFLMNSDFNSLIKIP

SEQ ID NO: 2336883 - protein, 28 aa, Cryptosporidium parvum
SGRKSGVSMRLRYSRMITKIGSRRAKTR

SEQ ID NO: 2336884 - protein, 23 aa, Cryptosporidium parvum
SGSCSSTKCVGCTTEVPRLEGCV

SEQ ID NO: 2336885 - protein, 17 aa, Cryptosporidium parvum
SGSDCPQSTRFLTYDLL

SEQ ID NO: 2336886 - protein, 26 aa, Cryptosporidium parvum
SGSPRTRFWRRFKRYVINMFSSNKGM

SEQ ID NO: 2336887 - protein, 20 aa, Cryptosporidium parvum
SGTCSIDGILPVLKSSNSQS

SEQ ID NO: 2336888 - protein, 17 aa, Cryptosporidium parvum
SGVNPVFYEISTLRNGE

SEQ ID NO: 2336889 - protein, 20 aa, Cryptosporidium parvum
SGVVKILHGYGIHLDSTPND

SEQ ID NO: 2336890 - protein, 17 aa, Cryptosporidium parvum
SHEYPPFDIMKSITGKN

SEQ ID NO: 2336891 - protein, 26 aa, Cryptosporidium parvum
SHKIGIKILLKFPRRYNKGIETQVWG

SEQ ID NO: 2336892 - protein, 22 aa, Cryptosporidium parvum
SHPLLMPPPIYKHGRVKCIPKN

SEQ ID NO: 2336893 - protein, 23 aa, Cryptosporidium parvum
SIETRIAIIKSYKESCLDIKSSN

SEQ ID NO: 2336894 - protein, 17 aa, Cryptosporidium parvum
SIGGGFIRLNITEADSW

SEQ ID NO: 2336895 - protein, 19 aa, Cryptosporidium parvum
SIGIGKSKYGYFILNEILG

SEQ ID NO: 2336896 - protein, 19 aa, Cryptosporidium parvum
SIGPQLMRVDEELSKLQKS

SEQ ID NO: 2336897 - protein, 25 aa, Cryptosporidium parvum
SIIECAEALITFFKLKAETYYDSTE

SEQ ID NO: 2336898 - protein, 23 aa, Cryptosporidium parvum
SIKLKKEGILNIGLKPAPKMETL

SEQ ID NO: 2336899 - protein, 21 aa, Cryptosporidium parvum
SILFDELFISINIEDSGNEYF

SEQ ID NO: 2336900 - protein, 27 aa, Cryptosporidium parvum
SILSEQNVNCFLVFRALPENLKQATSI

SEQ ID NO: 2336901 - protein, 23 aa, Cryptosporidium parvum
SIPCKEAIYLGDIPKLMTKFNYT

SEQ ID NO: 2336902 - protein, 19 aa, Cryptosporidium parvum
SIQACFKLGLAKRQEDVVI

SEQ ID NO: 2336903 - protein, 20 aa, Cryptosporidium parvum
SIQCGDEFFKPVGNPNLIEA

SEQ ID NO: 2336904 - protein, 24 aa, Cryptosporidium parvum
SIRVRKGVSFNEALARLCLDATNK

SEQ ID NO: 2336905 - protein, 23 aa, Cryptosporidium parvum
SISSKLVLGRSWLPSTKNIIDIC

SEQ ID NO: 2336906 - protein, 22 aa, Cryptosporidium parvum
SITLEICESVNLMHSCSNSNSN

SEQ ID NO: 2336907 - protein, 18 aa, Cryptosporidium parvum
SIYFFQSYLALRDLENQN

SEQ ID NO: 2336908 - protein, 17 aa, Cryptosporidium parvum
SKAIKWGQRKGDWHYLE

SEQ ID NO: 2336909 - protein, 23 aa, Cryptosporidium parvum
SKAILPGGAFLPLGGVLTGDILY

SEQ ID NO: 2336910 - protein, 24 aa, Cryptosporidium parvum
SKARKRLLSAKIHSAPSAFSPAGM

SEQ ID NO: 2336911 - protein, 21 aa, Cryptosporidium parvum
SKDILMQHGWGIGTGSGSGSG

SEQ ID NO: 2336912 - protein, 20 aa, Cryptosporidium parvum
SKDYCRAVPLDGFADFAECA

SEQ ID NO: 2336913 - protein, 19 aa, Cryptosporidium parvum
SKEDKCYVLLLSGGANRGA

SEQ ID NO: 2336914 - protein, 20 aa, Cryptosporidium parvum
SKELEPYLTLSGFIDQDTMK

SEQ ID NO: 2336915 - protein, 17 aa, Cryptosporidium parvum
SKELVRGAGSLLVNLQG

SEQ ID NO: 2336916 - protein, 20 aa, Cryptosporidium parvum
SKEQFLFSFFGIKRFDYSKI

SEQ ID NO: 2336917 - protein, 20 aa, Cryptosporidium parvum
SKFNFPEFGSGGNIQAHHVN

SEQ ID NO: 2336918 - protein, 25 aa, Cryptosporidium parvum
SKGRYIMSFQCSRLGDKNRANKNED

SEQ ID NO: 2336919 - protein, 17 aa, Cryptosporidium parvum
SKIHCSSFRSFSENDQL

SEQ ID NO: 2336920 - protein, 19 aa, Cryptosporidium parvum
SKIIKAFKKIPVISPTISF

SEQ ID NO: 2336921 - protein, 17 aa, Cryptosporidium parvum
SKIKNIYAKSFLKQISF

SEQ ID NO: 2336922 - protein, 17 aa, Cryptosporidium parvum
SKIRVYLSHLFPEEDSL

SEQ ID NO: 2336923 - protein, 19 aa, Cryptosporidium parvum
SKKNGVIISSDWQAQFKQI

SEQ ID NO: 2336924 - protein, 21 aa, Cryptosporidium parvum
SKLDILSLCFVIQSVPNCPSQ

SEQ ID NO: 2336925 - protein, 19 aa, Cryptosporidium parvum
SKLKAAIRSVHQWESCRVK

SEQ ID NO: 2336926 - protein, 22 aa, Cryptosporidium parvum
SKLLKRTLVEYLAYRIISGNSS

SEQ ID NO: 2336927 - protein, 25 aa, Cryptosporidium parvum
SKLSTLIKMIHKLISYAYPGILIER

SEQ ID NO: 2336928 - protein, 24 aa, Cryptosporidium parvum
SKLWKYKLGSYVKYFLTQRFHDGF

SEQ ID NO: 2336929 - protein, 26 aa, Cryptosporidium parvum
SKLYSPKLARAISRLEKKKISTHAIQ

SEQ ID NO: 2336930 - protein, 26 aa, Cryptosporidium parvum
SKMNIWPRVCFKEVFPNQSVFSNLFY

SEQ ID NO: 2336931 - protein, 19 aa, Cryptosporidium parvum
SKMVKRLRDELGIIRDLKL

SEQ ID NO: 2336932 - protein, 20 aa, Cryptosporidium parvum
SKNLVPLLAKREILIRKSEK

SEQ ID NO: 2336933 - protein, 23 aa, Cryptosporidium parvum
SKNVKGKYLGGGINEIAFGYDSE

SEQ ID NO: 2336934 - protein, 19 aa, Cryptosporidium parvum
SKPDIKRCNQISGVSPSNT

SEQ ID NO: 2336935 - protein, 23 aa, Cryptosporidium parvum
SKPPTLKCLDGFSLDNNSNCKQV

SEQ ID NO: 2336936 - protein, 20 aa, Cryptosporidium parvum
SKQEGILFLSFSSIDNEELV

SEQ ID NO: 2336937 - protein, 25 aa, Cryptosporidium parvum
SKSQCVFFLSASYTGMFPRFEHSTE

SEQ ID NO: 2336938 - protein, 18 aa, Cryptosporidium parvum
SKSRNRLRRFLDSLNKVE

SEQ ID NO: 2336939 - protein, 25 aa, Cryptosporidium parvum
SKSSCACCSCSKSGNTKEPKPEKES

SEQ ID NO: 2336940 - protein, 22 aa, Cryptosporidium parvum
SKTELFTKVGLFIEGFTLESVA

SEQ ID NO: 2336941 - protein, 20 aa, Cryptosporidium parvum
SKTFRLPKYMQLANFNTSED

SEQ ID NO: 2336942 - protein, 18 aa, Cryptosporidium parvum
SKTNIFTIEAYRQFTSPK

SEQ ID NO: 2336943 - protein, 21 aa, Cryptosporidium parvum
SKTRGMVCFGWGKRYKMIVNC

SEQ ID NO: 2336944 - protein, 24 aa, Cryptosporidium parvum
SKYNEWLPILFIQRYTKPSTLINC

SEQ ID NO: 2336945 - protein, 19 aa, Cryptosporidium parvum
SLDEFGLDFDKMIENNQEK

SEQ ID NO: 2336946 - protein, 24 aa, Cryptosporidium parvum
SLDNEIDENWSLEKGYEKEQEMKI

SEQ ID NO: 2336947 - protein, 18 aa, Cryptosporidium parvum
SLEKGYEKEQEMKISSFN

SEQ ID NO: 2336948 - protein, 18 aa, Cryptosporidium parvum
SLFDEIWTIHNLNGNKVV

SEQ ID NO: 2336949 - protein, 18 aa, Cryptosporidium parvum
SLFKEIFQAPKFSLRNTP

SEQ ID NO: 2336950 - protein, 22 aa, Cryptosporidium parvum
SLGGRDLLWLIWSFPARLISPV

SEQ ID NO: 2336951 - protein, 18 aa, Cryptosporidium parvum
SLIVLILAIVISSNYCFG

SEQ ID NO: 2336952 - protein, 22 aa, Cryptosporidium parvum
SLKCGLCARIDFSSTDKSPDHG

SEQ ID NO: 2336953 - protein, 22 aa, Cryptosporidium parvum
SLLFLFLLQFSFGSSLKSNPLG

SEQ ID NO: 2336954 - protein, 27 aa, Cryptosporidium parvum
SLLLIRMRLLHIFWLFTQIVLAFSAKK

SEQ ID NO: 2336955 - protein, 25 aa, Cryptosporidium parvum
SLMSYRTSSPYAFSPLEEERANKLY

SEQ ID NO: 2336956 - protein, 21 aa, Cryptosporidium parvum
SLNGFRFTLDALRTGILVVRH

SEQ ID NO: 2336957 - protein, 20 aa, Cryptosporidium parvum
SLNGIWKRDESYPKQGETSS

SEQ ID NO: 2336958 - protein, 21 aa, Cryptosporidium parvum
SLQGLISFVFSAMLEDIESEE

SEQ ID NO: 2336959 - protein, 17 aa, Cryptosporidium parvum
SLSECKIIAERHIIFLQ

SEQ ID NO: 2336960 - protein, 19 aa, Cryptosporidium parvum
SLSECYLQCILQDYKTMSI

SEQ ID NO: 2336961 - protein, 22 aa, Cryptosporidium parvum
SLSKELFVKINSFLSQNDKNGD

SEQ ID NO: 2336962 - protein, 17 aa, Cryptosporidium parvum
SLSPDVLFPGWDNNDQI

SEQ ID NO: 2336963 - protein, 19 aa, Cryptosporidium parvum
SLTGFGCLYTSTTEPTLGC

SEQ ID NO: 2336964 - protein, 25 aa, Cryptosporidium parvum
SLYYNCISALKALEAKLIITPPSSD

SEQ ID NO: 2336965 - protein, 18 aa, Cryptosporidium parvum
SMEAGGISGNFGGGNTNQ

SEQ ID NO: 2336966 - protein, 21 aa, Cryptosporidium parvum
SMFPGRSDWTFLAVKDPENGK

SEQ ID NO: 2336967 - protein, 17 aa, Cryptosporidium parvum
SMKYVFEQYFAKFDYIQ

SEQ ID NO: 2336968 - protein, 20 aa, Cryptosporidium parvum
SMPRSCYRSSAGDGKIPPCY

SEQ ID NO: 2336969 - protein, 17 aa, Cryptosporidium parvum
SNFFLFKLPNSINQLNF

SEQ ID NO: 2336970 - protein, 18 aa, Cryptosporidium parvum
SNICKIKIPKSERQMIET

SEQ ID NO: 2336971 - protein, 18 aa, Cryptosporidium parvum
SNIDESYVTNSKNASEGI

SEQ ID NO: 2336972 - protein, 17 aa, Cryptosporidium parvum
SNIDLSAGFADNEAQDN

SEQ ID NO: 2336973 - protein, 26 aa, Cryptosporidium parvum
SNIIISELCYLKFPGFSQNSKLTIEN

SEQ ID NO: 2336974 - protein, 18 aa, Cryptosporidium parvum
SNIQQGVVLNIKTEFSLI

SEQ ID NO: 2336975 - protein, 17 aa, Cryptosporidium parvum
SNIQVVFRKYGIDYFKF

SEQ ID NO: 2336976 - protein, 21 aa, Cryptosporidium parvum
SNKGTKFTICMIGGGSNGKNK

SEQ ID NO: 2336977 - protein, 23 aa, Cryptosporidium parvum
SNKLDRFISIIIEKAIQKSMKNS

SEQ ID NO: 2336978 - protein, 19 aa, Cryptosporidium parvum
SNLCTLHLLLKKYSQNRSG

SEQ ID NO: 2336979 - protein, 24 aa, Cryptosporidium parvum
SNLDRWNETLAIISIYTQPNGIRL

SEQ ID NO: 2336980 - protein, 23 aa, Cryptosporidium parvum
SNLFSLIPCKVFAWDSNGGTCTL

SEQ ID NO: 2336981 - protein, 17 aa, Cryptosporidium parvum
SNLKFSEYHFSKQAKEW

SEQ ID NO: 2336982 - protein, 21 aa, Cryptosporidium parvum
SNLKYIWNGFEFKDKNDQPVL

SEQ ID NO: 2336983 - protein, 23 aa, Cryptosporidium parvum
SNLRNEMIFDIKATKTLDELRDT

SEQ ID NO: 2336984 - protein, 34 aa, Cryptosporidium parvum
SNRKMVKYFVDWLQISVNLIFKVILALSKSFLAY

SEQ ID NO: 2336985 - protein, 24 aa, Cryptosporidium parvum
SNRSRLSEVLAMHLRMRNRIVSLA

SEQ ID NO: 2336986 - protein, 21 aa, Cryptosporidium parvum
SPEYTPSVVLGKRLSYQCTYK

SEQ ID NO: 2336987 - protein, 24 aa, Cryptosporidium parvum
SPFEKGQMVWLNRTVSISNPNLDF

SEQ ID NO: 2336988 - protein, 17 aa, Cryptosporidium parvum
SPFLRAKILERIKLTLQ

SEQ ID NO: 2336989 - protein, 22 aa, Cryptosporidium parvum
SPIRIGENMQHIGIFSYSGIIS

SEQ ID NO: 2336990 - protein, 18 aa, Cryptosporidium parvum
SPLFPERTMIDGSLNDAP

SEQ ID NO: 2336991 - protein, 22 aa, Cryptosporidium parvum
SPLKGVCDDIILGVNKIREEID

SEQ ID NO: 2336992 - protein, 26 aa, Cryptosporidium parvum
SPPVLSWVCPTDYPGFRGGKNDFIDA

SEQ ID NO: 2336993 - protein, 20 aa, Cryptosporidium parvum
SPRLLCPEDYILQYSRCIKQ

SEQ ID NO: 2336994 - protein, 20 aa, Cryptosporidium parvum
SPRRISVIDLNMGPQEMVNA

SEQ ID NO: 2336995 - protein, 23 aa, Cryptosporidium parvum
SPTYCVLRAFIFVNDIVEKNNIE

SEQ ID NO: 2336996 - protein, 18 aa, Cryptosporidium parvum
SPYCSYGNEPICPYQKVI

SEQ ID NO: 2336997 - protein, 25 aa, Cryptosporidium parvum
SPYNLECPNGFILDRERSSCISQVF

SEQ ID NO: 2336998 - protein, 23 aa, Cryptosporidium parvum
SQAHPCGKCSSGSTCCSENLCVG

SEQ ID NO: 2336999 - protein, 17 aa, Cryptosporidium parvum
SQFLKSRYVRVNFINSL

SEQ ID NO: 2337000 - protein, 25 aa, Cryptosporidium parvum
SQFMGISVLKLQANAPWPNRNKSCN

SEQ ID NO: 2337001 - protein, 20 aa, Cryptosporidium parvum
SQGKEASTIFAMIKSPVEEV

SEQ ID NO: 2337002 - protein, 22 aa, Cryptosporidium parvum
SQKEWNHIYALQNYIIERKGEM

SEQ ID NO: 2337003 - protein, 28 aa, Cryptosporidium parvum
SQKVVFPCILKIIPQYIFNARDPIICGV

SEQ ID NO: 2337004 - protein, 25 aa, Cryptosporidium parvum
SQNNNFCKLYDDFILSAYPKEYYVS

SEQ ID NO: 2337005 - protein, 23 aa, Cryptosporidium parvum
SQSDCLVPWDSTITWKNASNSAS

SEQ ID NO: 2337006 - protein, 19 aa, Cryptosporidium parvum
SQSGFSIEFGCNYKNLKDT

SEQ ID NO: 2337007 - protein, 17 aa, Cryptosporidium parvum
SQSLTGICNRKDPGSYY

SEQ ID NO: 2337008 - protein, 18 aa, Cryptosporidium parvum
SQTRISFLSKSNMPIPNF

SEQ ID NO: 2337009 - protein, 31 aa, Cryptosporidium parvum
SQVLEGLCLKKLPGITWKMETILAQTNVNNG

SEQ ID NO: 2337010 - protein, 24 aa, Cryptosporidium parvum
SRAIGDFRLKSMDFNYNWEKDLST

SEQ ID NO: 2337011 - protein, 24 aa, Cryptosporidium parvum
SRARMVTYNNLFVHRGFYFVDAES

SEQ ID NO: 2337012 - protein, 29 aa, Cryptosporidium parvum
SRATFKITCFRILRKLYREGSVSLRSSVL

SEQ ID NO: 2337013 - protein, 25 aa, Cryptosporidium parvum
SREGLKNLPPIFLANIEVSPRPDKE

SEQ ID NO: 2337014 - protein, 18 aa, Cryptosporidium parvum
SRFEWAFLESNLGKLEVI

SEQ ID NO: 2337015 - protein, 30 aa, Cryptosporidium parvum
SRFHISLRRKWALFCWFFSILIREISSDLP

SEQ ID NO: 2337016 - protein, 22 aa, Cryptosporidium parvum
SRFSDMKVFKSSPLLTSILVKC

SEQ ID NO: 2337017 - protein, 24 aa, Cryptosporidium parvum
SRGKWKRFRSFRIHCDFHQGNILV

SEQ ID NO: 2337018 - protein, 26 aa, Cryptosporidium parvum
SRILFSRLRPFISFQSTFIPLKMSEF

SEQ ID NO: 2337019 - protein, 24 aa, Cryptosporidium parvum
SRKFKLRNPLGLDYSKRWNSIIDL

SEQ ID NO: 2337020 - protein, 22 aa, Cryptosporidium parvum
SRKTLLQFCRDVCYKYFTDEAR

SEQ ID NO: 2337021 - protein, 20 aa, Cryptosporidium parvum
SRLGLCLRTKITENWDSLKS

SEQ ID NO: 2337022 - protein, 19 aa, Cryptosporidium parvum
SRLLFKITSRISIFNVLRE

SEQ ID NO: 2337023 - protein, 21 aa, Cryptosporidium parvum
SRLPISISKGFIKSQTHNKMD

SEQ ID NO: 2337024 - protein, 25 aa, Cryptosporidium parvum
SRNRRFKFRFGEVPIDSSIETSSSS

SEQ ID NO: 2337025 - protein, 18 aa, Cryptosporidium parvum
SRPARSVGRVAIKSRARC

SEQ ID NO: 2337026 - protein, 24 aa, Cryptosporidium parvum
SRPEIFCPEGYLLKDVKRDSSIQG

SEQ ID NO: 2337027 - protein, 20 aa, Cryptosporidium parvum
SRPPPPVPQRPIGPLRPVAS

SEQ ID NO: 2337028 - protein, 20 aa, Cryptosporidium parvum
SRSLNIGDTIVWSIGVDDNK

SEQ ID NO: 2337029 - protein, 19 aa, Cryptosporidium parvum
SRSPYAEWCLPKFVENNPF

SEQ ID NO: 2337030 - protein, 17 aa, Cryptosporidium parvum
SRSSLSPGNQILLTQPS

SEQ ID NO: 2337031 - protein, 22 aa, Cryptosporidium parvum
SRVEKVCVAIGIDGKVEGCSSL

SEQ ID NO: 2337032 - protein, 25 aa, Cryptosporidium parvum
SRVPELEGFKFTSIEKSDVRPFEET

SEQ ID NO: 2337033 - protein, 22 aa, Cryptosporidium parvum
SRWELLKMKHFYIEKKEKILME

SEQ ID NO: 2337034 - protein, 37 aa, Cryptosporidium parvum
SRYTEEILIYEGFELTIGIAWSKFGVFILNEKMNSLI

SEQ ID NO: 2337035 - protein, 18 aa, Cryptosporidium parvum
SSASFLVMFLMEFAEKYL

SEQ ID NO: 2337036 - protein, 29 aa, Cryptosporidium parvum
SSDAIKVCRQVWRESYTEMVRFYKTFTPS

SEQ ID NO: 2337037 - protein, 18 aa, Cryptosporidium parvum
SSDFFPKPGSEIFSFYTY

SEQ ID NO: 2337038 - protein, 24 aa, Cryptosporidium parvum
SSDRCLLMLGWHFRSHLRQIFQSY

SEQ ID NO: 2337039 - protein, 34 aa, Cryptosporidium parvum
SSEVYGESGWGWFSRKFMSFMRIIRRSFMRAKPG

SEQ ID NO: 2337040 - protein, 18 aa, Cryptosporidium parvum
SSFDYRLVGIDKDNNSFF

SEQ ID NO: 2337041 - protein, 26 aa, Cryptosporidium parvum
SSFELPELVHAYKLNDGFFDIFAFYF

SEQ ID NO: 2337042 - protein, 20 aa, Cryptosporidium parvum
SSFTSGLEFVVRGFSEFRTY

SEQ ID NO: 2337043 - protein, 18 aa, Cryptosporidium parvum
SSGLKVKFMDNFTYNDPV

SEQ ID NO: 2337044 - protein, 19 aa, Cryptosporidium parvum
SSGLSSFWTPPAGFGGFFP

SEQ ID NO: 2337045 - protein, 21 aa, Cryptosporidium parvum
SSGRRFACQMKSFLKNRRCIS

SEQ ID NO: 2337046 - protein, 33 aa, Cryptosporidium parvum
SSGWKKLLNCLSICLGLSLIGRCLSKNYEFTNK

SEQ ID NO: 2337047 - protein, 23 aa, Cryptosporidium parvum
SSIEEMMILLAFERILTQKTASS

SEQ ID NO: 2337048 - protein, 21 aa, Cryptosporidium parvum
SSIEPRFAINISNRSENICLT

SEQ ID NO: 2337049 - protein, 21 aa, Cryptosporidium parvum
SSIRPISKFFLYENTNDKVNV

SEQ ID NO: 2337050 - protein, 26 aa, Cryptosporidium parvum
SSISKKCSPGLCSEGCIPQVTPEESE

SEQ ID NO: 2337051 - protein, 25 aa, Cryptosporidium parvum
SSKGDLRAACLVASAIAPGRPFAPL

SEQ ID NO: 2337052 - protein, 22 aa, Cryptosporidium parvum
SSKLFPIDLIPLLSGATTISFY

SEQ ID NO: 2337053 - protein, 19 aa, Cryptosporidium parvum
SSKSRGAFKQNIKQKKALE

SEQ ID NO: 2337054 - protein, 24 aa, Cryptosporidium parvum
SSLNSRCTSIAWGSFNPEENALGL

SEQ ID NO: 2337055 - protein, 22 aa, Cryptosporidium parvum
SSLPSNERWELISSCIPGKDSS

SEQ ID NO: 2337056 - protein, 25 aa, Cryptosporidium parvum
SSMYRKCLRALWDMFQYDDEINLKI

SEQ ID NO: 2337057 - protein, 18 aa, Cryptosporidium parvum
SSNLEIWASVGKVFSDGT

SEQ ID NO: 2337058 - protein, 17 aa, Cryptosporidium parvum
SSNTALGKTRFGDPITD

SEQ ID NO: 2337059 - protein, 23 aa, Cryptosporidium parvum
SSNTRFQINLPFYDKMDLEKYNI

SEQ ID NO: 2337060 - protein, 22 aa, Cryptosporidium parvum
SSQAKICYKKWKTVKQSLKSLE

SEQ ID NO: 2337061 - protein, 31 aa, Cryptosporidium parvum
SSQEIAKPNFFLPIDLNNPFFQMKEKFLNPI

SEQ ID NO: 2337062 - protein, 26 aa, Cryptosporidium parvum
SSSFYKSCKDLNCKGQCLKPLEESDP

SEQ ID NO: 2337063 - protein, 24 aa, Cryptosporidium parvum
SSSLLPRRRTIILNIEADHIFNSV

SEQ ID NO: 2337064 - protein, 18 aa, Cryptosporidium parvum
SSSNLEWSIALDSKKFLY

SEQ ID NO: 2337065 - protein, 23 aa, Cryptosporidium parvum
SSTKPLPVIPSFLLSTSKNEENS

SEQ ID NO: 2337066 - protein, 24 aa, Cryptosporidium parvum
SSTWGLNAGEAWFNSSVAKGGDAN

SEQ ID NO: 2337067 - protein, 39 aa, Cryptosporidium parvum
SSYYELSFVKVKCGGGFCKRLRRALCCCSGGEEEEQPEM

SEQ ID NO: 2337068 - protein, 24 aa, Cryptosporidium parvum
STAILGELSFKYSLDGIRSGIIDS

SEQ ID NO: 2337069 - protein, 17 aa, Cryptosporidium parvum
STEHKFLMGNKVSFNDL

SEQ ID NO: 2337070 - protein, 17 aa, Cryptosporidium parvum
STGKTWERPSGAQGNNN

SEQ ID NO: 2337071 - protein, 24 aa, Cryptosporidium parvum
STLAYRNSISLGFLFSKTEDILSR

SEQ ID NO: 2337072 - protein, 23 aa, Cryptosporidium parvum
STSAASICLSHKVFSTSSSNVDS

SEQ ID NO: 2337073 - protein, 17 aa, Cryptosporidium parvum
STSDFGLLEPQFLPGTI

SEQ ID NO: 2337074 - protein, 18 aa, Cryptosporidium parvum
STSFFACSIDYYLINIPT

SEQ ID NO: 2337075 - protein, 23 aa, Cryptosporidium parvum
STTKHPWKLVIEVNSDYNKLQSL

SEQ ID NO: 2337076 - protein, 25 aa, Cryptosporidium parvum
STYSIEYSIQWELRIKDMQDTYLYL

SEQ ID NO: 2337077 - protein, 24 aa, Cryptosporidium parvum
SVERRLYIASLLGFDFNNASTTAN

SEQ ID NO: 2337078 - protein, 28 aa, Cryptosporidium parvum
SVGRVAIKSRARCSGIIVLCKTGPLETG

SEQ ID NO: 2337079 - protein, 34 aa, Cryptosporidium parvum; identical to SEQ ID NO: 2182331

SEQ ID NO: 2337080 - protein, 18 aa, Cryptosporidium parvum
SVKIPPFVLSKFYGSPTY

SEQ ID NO: 2337081 - protein, 21 aa, Cryptosporidium parvum
SVLFYDFSYDITMYSHFKILK

SEQ ID NO: 2337082 - protein, 20 aa, Cryptosporidium parvum
SVLLTFSFNSINVFEYTAPS

SEQ ID NO: 2337083 - protein, 17 aa, Cryptosporidium parvum
SVLSEKVLDIFYNLITF

SEQ ID NO: 2337084 - protein, 21 aa, Cryptosporidium parvum
SVNGLLKYRVSIWGIPLSSYK

SEQ ID NO: 2337085 - protein, 20 aa, Cryptosporidium parvum
SVPSNFQWGFYLGDGTINLV

SEQ ID NO: 2337086 - protein, 25 aa, Cryptosporidium parvum
SVTKLKDIFIEWKYPAIDFNIDLSE

SEQ ID NO: 2337087 - protein, 23 aa, Cryptosporidium parvum
SVTLFCREVINFVTNPGKTTLSF

SEQ ID NO: 2337088 - protein, 21 aa, Cryptosporidium parvum
SVVAYGECIKRLNGINSALDV

SEQ ID NO: 2337089 - protein, 25 aa, Cryptosporidium parvum
SVVKGCPNAGFVVVCQFDSAVNLNK

SEQ ID NO: 2337090 - protein, 17 aa, Cryptosporidium parvum
SVVPMIILPIFVDNNLK

SEQ ID NO: 2337091 - protein, 20 aa, Cryptosporidium parvum
SWDTPGLVNGVGNWRILYEP

SEQ ID NO: 2337092 - protein, 21 aa, Cryptosporidium parvum
SWSDFQFWPSLALDVTDRPKM

SEQ ID NO: 2337093 - protein, 19 aa, Cryptosporidium parvum
SWSDWSGCSSPCKSSTNDL

SEQ ID NO: 2337094 - protein, 18 aa, Cryptosporidium parvum
SWVLPSGTLLPGGFSNRV

SEQ ID NO: 2337095 - protein, 24 aa, Cryptosporidium parvum
SYELYGFRVAMMIRSERIGAIAPL

SEQ ID NO: 2337096 - protein, 17 aa, Cryptosporidium parvum
SYGFKRQASGGIPPDPY

SEQ ID NO: 2337097 - protein, 21 aa, Cryptosporidium parvum
SYIKELIKKFCENVYSVKVSK

SEQ ID NO: 2337098 - protein, 20 aa, Cryptosporidium parvum
SYKGKWINRINMDSLPVEYK

SEQ ID NO: 2337099 - protein, 17 aa, Cryptosporidium parvum
SYLNFLMRVACGDDDGY

SEQ ID NO: 2337100 - protein, 25 aa, Cryptosporidium parvum
SYNILKICKDHRRLKQEQQKLIITW

SEQ ID NO: 2337101 - protein, 25 aa, Cryptosporidium parvum
SYTDSFCSLLGCKDGKGYASSGDGE

SEQ ID NO: 2337102 - protein, 18 aa, Cryptosporidium parvum
SYVYCYIQCWPLVDEFSN

SEQ ID NO: 2337103 - protein, 21 aa, Cryptosporidium parvum
TAESLALNSPSLGITASNEVS

SEQ ID NO: 2337104 - protein, 19 aa, Cryptosporidium parvum
TALGKTRFGDPITDKNNQS

SEQ ID NO: 2337105 - protein, 17 aa, Cryptosporidium parvum
TCIIFLTIIRVLIFNAH

SEQ ID NO: 2337106 - protein, 21 aa, Cryptosporidium parvum
TCTDLGFFFASFTNRFSIFPP

SEQ ID NO: 2337107 - protein, 28 aa, Cryptosporidium parvum
TDGGRKPNCPLGRRGGVRGRDNGPKKDP

SEQ ID NO: 2337108 - protein, 22 aa, Cryptosporidium parvum
TDPYFRYRTDFVLKVRAYNYHE

SEQ ID NO: 2337109 - protein, 20 aa, Cryptosporidium parvum
TDQKCKIEVCDLCCNSAFDG

SEQ ID NO: 2337110 - protein, 22 aa, Cryptosporidium parvum
TDSISIKCCSTIISPKLITNVN

SEQ ID NO: 2337111 - protein, 18 aa, Cryptosporidium parvum
TDTIHGFVPLIPDSEYNV

SEQ ID NO: 2337112 - protein, 24 aa, Cryptosporidium parvum
TEACCLAFGCPDFVVNGDFLSPPA

SEQ ID NO: 2337113 - protein, 21 aa, Cryptosporidium parvum
TEDSCFNRTLPINCDNSNSTL

SEQ ID NO: 2337114 - protein, 25 aa, Cryptosporidium parvum
TEEEIKKALDLCGSEISRLNSEVSS

SEQ ID NO: 2337115 - protein, 18 aa, Cryptosporidium parvum
TEFESFKLGRVEPQKLKI

SEQ ID NO: 2337116 - protein, 17 aa, Cryptosporidium parvum
TEILPLLTGCDLIQMKN

SEQ ID NO: 2337117 - protein, 20 aa, Cryptosporidium parvum
TEKFILKHDSLLLLVPKVLP

SEQ ID NO: 2337118 - protein, 25 aa, Cryptosporidium parvum
TELPFRKGSRFKIYLSCQDAPHSQK

SEQ ID NO: 2337119 - protein, 19 aa, Cryptosporidium parvum
TELSKRFYLTNANISDLVN

SEQ ID NO: 2337120 - protein, 17 aa, Cryptosporidium parvum
TEMKSLFGVETTKKADG

SEQ ID NO: 2337121 - protein, 17 aa, Cryptosporidium parvum
TENCVGALSSLLELHLP

SEQ ID NO: 2337122 - protein, 20 aa, Cryptosporidium parvum
TESILISLLERLFKCILSRK

SEQ ID NO: 2337123 - protein, 18 aa, Cryptosporidium parvum
TEVKCLGLEQDSRLCEFI

SEQ ID NO: 2337124 - protein, 26 aa, Cryptosporidium parvum
TEWTLKLPRWRSSPLGLPPDHPVNAQ

SEQ ID NO: 2337125 - protein, 21 aa, Cryptosporidium parvum
TFAKQDLKSGFKLDTINIPPF

SEQ ID NO: 2337126 - protein, 25 aa, Cryptosporidium parvum
TFEWSKEGFVGKYLRTMKLAIRVND

SEQ ID NO: 2337127 - protein, 24 aa, Cryptosporidium parvum
TFKEFKNGFPKGGFQSSVSNSSLN

SEQ ID NO: 2337128 - protein, 22 aa, Cryptosporidium parvum
TFLGRRVAFEVAMVDAMAHYTV

SEQ ID NO: 2337129 - protein, 18 aa, Cryptosporidium parvum
TFSLPLTYKIFLPDDVLP

SEQ ID NO: 2337130 - protein, 20 aa, Cryptosporidium parvum
TGCVYELGKKSSLRVRCLHS

SEQ ID NO: 2337131 - protein, 27 aa, Cryptosporidium parvum
TGLTYRTYCSLDFSSFIFNMKQYIDFA

SEQ ID NO: 2337132 - protein, 25 aa, Cryptosporidium parvum
TGQSIKRGGIIVGISDSIKEEQDLM

SEQ ID NO: 2337133 - protein, 17 aa, Cryptosporidium parvum
TGVAPRVSATGLTKPTS

SEQ ID NO: 2337134 - protein, 24 aa, Cryptosporidium parvum
TGVKVLFHGGGKYPAKYLLPGMKV

SEQ ID NO: 2337135 - protein, 17 aa, Cryptosporidium parvum
TGYILSNIPLVIYKALG

SEQ ID NO: 2337136 - protein, 20 aa, Cryptosporidium parvum
THILCANAIHLGSPNYRTVY

SEQ ID NO: 2337137 - protein, 17 aa, Cryptosporidium parvum
THTLRLILANKIIQSNP

SEQ ID NO: 2337138 - protein, 26 aa, Cryptosporidium parvum
THYYCPPKFPENVFRPFEYNITKLYS

SEQ ID NO: 2337139 - protein, 23 aa, Cryptosporidium parvum
TIHHPIDIFKIFFADENELETGI

SEQ ID NO: 2337140 - protein, 22 aa, Cryptosporidium parvum
TIITSRLWIKYSNEPDILRKIY

SEQ ID NO: 2337141 - protein, 17 aa, Cryptosporidium parvum
TIIYSVVREVFFGIILY

SEQ ID NO: 2337142 - protein, 23 aa, Cryptosporidium parvum
TIKRVDDQFIVIVKKLKQKSNEI

SEQ ID NO: 2337143 - protein, 30 aa, Cryptosporidium parvum
TISEPSLYELCTRFITTLSITKSVKSFNDN

SEQ ID NO: 2337144 - protein, 21 aa, Cryptosporidium parvum
TISILLFKGVWYIYEGKGYYS

SEQ ID NO: 2337145 - protein, 21 aa, Cryptosporidium parvum
TISVIPWKVIDNTILNLVPEI

SEQ ID NO: 2337146 - protein, 26 aa, Cryptosporidium parvum
TITAKKCLRKSLSQLQSFYVRFFDLK

SEQ ID NO: 2337147 - protein, 25 aa, Cryptosporidium parvum
TITAKRRKGVFSKCVEFHGQKENCE

SEQ ID NO: 2337148 - protein, 20 aa, Cryptosporidium parvum
TIVSELDFGNGEEVKDLDKS

SEQ ID NO: 2337149 - protein, 22 aa, Cryptosporidium parvum
TKAVDFMDEFHLLEISLSRSGL

SEQ ID NO: 2337150 - protein, 22 aa, Cryptosporidium parvum
TKCFLLILFFNLATFFLVHVVV

SEQ ID NO: 2337151 - protein, 17 aa, Cryptosporidium parvum
TKDDLLIILSLATRTYK

SEQ ID NO: 2337152 - protein, 18 aa, Cryptosporidium parvum
TKEQTCFGNSFSGLCPYP

SEQ ID NO: 2337153 - protein, 21 aa, Cryptosporidium parvum
TKIKLLGLAVSRFSDMKKKFE

SEQ ID NO: 2337154 - protein, 17 aa, Cryptosporidium parvum
TKILFLILESMYPNRKL

SEQ ID NO: 2337155 - protein, 27 aa, Cryptosporidium parvum
TKKEEECFRFFPTYFSELGETELTGKQ

SEQ ID NO: 2337156 - protein, 24 aa, Cryptosporidium parvum
TKKNPCKKCKELISKFKSGEFEKE

SEQ ID NO: 2337157 - protein, 24 aa, Cryptosporidium parvum
TKKYPEIYGFYKFIHLHFGETSAF

SEQ ID NO: 2337158 - protein, 23 aa, Cryptosporidium parvum
TKLDCSSLAWARENSRIPNDLDK

SEQ ID NO: 2337159 - protein, 17 aa, Cryptosporidium parvum
TKLLYLAIYEYLVVYST

SEQ ID NO: 2337160 - protein, 21 aa, Cryptosporidium parvum
TKLMLLQPFIIFSCIEVVKQQ

SEQ ID NO: 2337161 - protein, 24 aa, Cryptosporidium parvum
TKLVERLKILLLYLKQEIIGKSSS

SEQ ID NO: 2337162 - protein, 24 aa, Cryptosporidium parvum
TKMSKASVLPGVWHEHLGNISIQK

SEQ ID NO: 2337163 - protein, 32 aa, Cryptosporidium parvum
TKNMDWKQIEVGYCNRPKFYMYQHDRRDGRRF

SEQ ID NO: 2337164 - protein, 24 aa, Cryptosporidium parvum
TKPEATFPFCFENVEFPLDPTRSS

SEQ ID NO: 2337165 - protein, 22 aa, Cryptosporidium parvum
TKSLCIKFNLINSKKENIDDIS

SEQ ID NO: 2337166 - protein, 19 aa, Cryptosporidium parvum
TKYGNWRISDSLTKPFHFG

SEQ ID NO: 2337167 - protein, 18 aa, Cryptosporidium parvum
TLASYKWMVKNWPKKKWY

SEQ ID NO: 2337168 - protein, 17 aa, Cryptosporidium parvum
TLAYKLAFELGKIHNGD

SEQ ID NO: 2337169 - protein, 19 aa, Cryptosporidium parvum
TLDFLKFSLEDISAFHKPE

SEQ ID NO: 2337170 - protein, 21 aa, Cryptosporidium parvum
TLECINIGKTGGWVLKQPSSE

SEQ ID NO: 2337171 - protein, 17 aa, Cryptosporidium parvum
TLEFSLYNSGVFKGFYD

SEQ ID NO: 2337172 - protein, 23 aa, Cryptosporidium parvum
TLFKAEIDLSSFAHIINYFHRTL

SEQ ID NO: 2337173 - protein, 19 aa, Cryptosporidium parvum
TLIAMNFAILPKWRDSWQD

SEQ ID NO: 2337174 - protein, 17 aa, Cryptosporidium parvum
TLILRSVTVLTTLRNSV

SEQ ID NO: 2337175 - protein, 18 aa, Cryptosporidium parvum
TLINCYKHPISPISTNSE

SEQ ID NO: 2337176 - protein, 18 aa, Cryptosporidium parvum
TLLAVPFVVDRESSFEID

SEQ ID NO: 2337177 - protein, 23 aa, Cryptosporidium parvum
TLLRIKPILLYWQDEGIVNQYPL

SEQ ID NO: 2337178 - protein, 17 aa, Cryptosporidium parvum
TLSELVIEIRREIESYQ

SEQ ID NO: 2337179 - protein, 24 aa, Cryptosporidium parvum
TLSKRLGSVFPVFADNQALVTWKG

SEQ ID NO: 2337180 - protein, 36 aa, Cryptosporidium parvum
TLVSGIFERCFASEFLIRGIMSFIFYLSKLNKIFGD

SEQ ID NO: 2337181 - protein, 18 aa, Cryptosporidium parvum
TNAVRIRGGEQNKLESET

SEQ ID NO: 2337182 - protein, 17 aa, Cryptosporidium parvum
TNDLIFLNGCIQSMILN

SEQ ID NO: 2337183 - protein, 17 aa, Cryptosporidium parvum
TNFFLTNDFVFPKQILY

SEQ ID NO: 2337184 - protein, 18 aa, Cryptosporidium parvum
TNFIRVCVHNYFWRVPCG

SEQ ID NO: 2337185 - protein, 18 aa, Cryptosporidium parvum
TNFNQWNLLILLLHLQLL

SEQ ID NO: 2337186 - protein, 23 aa, Cryptosporidium parvum
TNFWLKQHFTQDVIKDGMIPEQL

SEQ ID NO: 2337187 - protein, 24 aa, Cryptosporidium parvum
TNLIHFCLAGNFLVVNNAANGSEH

SEQ ID NO: 2337188 - protein, 18 aa, Cryptosporidium parvum
TNLKRYLIKLFPTEITQE

SEQ ID NO: 2337189 - protein, 25 aa, Cryptosporidium parvum
TNNPESLLLLSRLTTKAPPKFLISS

SEQ ID NO: 2337190 - protein, 22 aa, Cryptosporidium parvum
TNPKKILAIFLYDADTFNEVRK

SEQ ID NO: 2337191 - protein, 17 aa, Cryptosporidium parvum
TNSPSYPVYMRSLSEEK

SEQ ID NO: 2337192 - protein, 21 aa, Cryptosporidium parvum
TPEKRCQLIIDKLENDVKKSI

SEQ ID NO: 2337193 - protein, 20 aa, Cryptosporidium parvum
TPKYTVIFMHGFVVDSSTLY

SEQ ID NO: 2337194 - protein, 24 aa, Cryptosporidium parvum
TPLLKDLWPGDIMDCIMTTICTRN

SEQ ID NO: 2337195 - protein, 22 aa, Cryptosporidium parvum
TPNLLCSISIQGRFISDFYFFE

SEQ ID NO: 2337196 - protein, 22 aa, Cryptosporidium parvum
TPPKPSISWKAFKLKLYEEFRI

SEQ ID NO: 2337197 - protein, 21 aa, Cryptosporidium parvum
TPPSGVAMYSYFLLAESPPFV

SEQ ID NO: 2337198 - protein, 24 aa, Cryptosporidium parvum
TPSLNIPSPPSFPAPQPPTYPKPS

SEQ ID NO: 2337199 - protein, 17 aa, Cryptosporidium parvum
TQFGRGFPENGYPITEK

SEQ ID NO: 2337200 - protein, 23 aa, Cryptosporidium parvum
TQKLKSRFKDMIQSAGESIKNFI

SEQ ID NO: 2337201 - protein, 19 aa, Cryptosporidium parvum
TQWDFILSAIKSYPNIKCK

SEQ ID NO: 2337202 - protein, 18 aa, Cryptosporidium parvum
TQYKWRTSFLNLFTTFFL

SEQ ID NO: 2337203 - protein, 19 aa, Cryptosporidium parvum
TRCTKCKKTNVSESSMAYC

SEQ ID NO: 2337204 - protein, 18 aa, Cryptosporidium parvum
TRENENWNPGPTVDKTSQ

SEQ ID NO: 2337205 - protein, 28 aa, Cryptosporidium parvum
TRFFKRLFKKPSCIKCVKSKKQSKKQKS

SEQ ID NO: 2337206 - protein, 19 aa, Cryptosporidium parvum
TRGDGLYGFELLFEKTGDY

SEQ ID NO: 2337207 - protein, 20 aa, Cryptosporidium parvum
TRIRDGSCGNHEVTGCTFCE

SEQ ID NO: 2337208 - protein, 19 aa, Cryptosporidium parvum
TRKFLLDAIARASRQPSVV

SEQ ID NO: 2337209 - protein, 18 aa, Cryptosporidium parvum
TRLIFSVQNYQGYPFVLL

SEQ ID NO: 2337210 - protein, 17 aa, Cryptosporidium parvum
TRLPKCIPKGEENPREK

SEQ ID NO: 2337211 - protein, 24 aa, Cryptosporidium parvum
TRLSRRFTNDWINFLNLLKTIEID

SEQ ID NO: 2337212 - protein, 20 aa, Cryptosporidium parvum
TRLSSMYHEGVIKGEYELFI

SEQ ID NO: 2337213 - protein, 36 aa, Cryptosporidium parvum; identical to SEQ ID NO: 2208460

SEQ ID NO: 2337214 - protein, 20 aa, Cryptosporidium parvum
TRSGICSLLPQNLREKAIQL

SEQ ID NO: 2337215 - protein, 21 aa, Cryptosporidium parvum
TRTADKWDQGCFVECEGDMSR

SEQ ID NO: 2337216 - protein, 26 aa, Cryptosporidium parvum
TRTTSRPGGVFTRPVGYVSPLPYAPL

SEQ ID NO: 2337217 - protein, 25 aa, Cryptosporidium parvum
TRTTVAGLMYFYSLLVSEFASKAPN

SEQ ID NO: 2337218 - protein, 25 aa, Cryptosporidium parvum
TSASSFYAQCLKIFSTSYGPESIYG

SEQ ID NO: 2337219 - protein, 29 aa, Cryptosporidium parvum
TSCFLIFTIILCCNICFTFEKQEYAFIQN

SEQ ID NO: 2337220 - protein, 25 aa, Cryptosporidium parvum
TSDNLCKLMPLSYCNSQDVSFVIED

SEQ ID NO: 2337221 - protein, 23 aa, Cryptosporidium parvum
TSGREWCYVEPQVASQGSKNWNY

SEQ ID NO: 2337222 - protein, 18 aa, Cryptosporidium parvum
TSIDKMRPIKEDDDSNFD

SEQ ID NO: 2337223 - protein, 17 aa, Cryptosporidium parvum
TSIPAILDLTVFEKLQK

SEQ ID NO: 2337224 - protein, 19 aa, Cryptosporidium parvum
TSISRGWWILSRKLIIKTH

SEQ ID NO: 2337225 - protein, 29 aa, Cryptosporidium parvum
TSLGGFVAMRIAQRFPKHISKLVLDAPPG

SEQ ID NO: 2337226 - protein, 18 aa, Cryptosporidium parvum
TSLNGMAISGFRFNEIKK

SEQ ID NO: 2337227 - protein, 28 aa, Cryptosporidium parvum
TSLPLPVEFWRTIFVQQLHSFNLYSKDL

SEQ ID NO: 2337228 - protein, 36 aa, Cryptosporidium parvum; identical to SEQ ID NO: 2208471

SEQ ID NO: 2337229 - protein, 21 aa, Cryptosporidium parvum
TSPQFFCTKGYTFNELDSTCI

SEQ ID NO: 2337230 - protein, 22 aa, Cryptosporidium parvum
TSPSPRLNVPFVQYSGRDLKAG

SEQ ID NO: 2337231 - protein, 23 aa, Cryptosporidium parvum
TSRLRFLQFTSAYGLEDISDQQF

SEQ ID NO: 2337232 - protein, 20 aa, Cryptosporidium parvum
TSSNFCWEYSGNVMYLPITS

SEQ ID NO: 2337233 - protein, 24 aa, Cryptosporidium parvum
TSSSSCRQIAWGLVIGEGQNISIL

SEQ ID NO: 2337234 - protein, 25 aa, Cryptosporidium parvum
TSTEMLKLVLLNGTEYALVNNETAY

SEQ ID NO: 2337235 - protein, 30 aa, Cryptosporidium parvum
TTIKQLKRLIAWRRSYIPSSIHLEIIGIDR

SEQ ID NO: 2337236 - protein, 20 aa, Cryptosporidium parvum
TTLPNGLRKDLFPYVIEHNK

SEQ ID NO: 2337237 - protein, 24 aa, Cryptosporidium parvum
TTYSCVGIYKNGRVEIIPNEQGNR

SEQ ID NO: 2337238 - protein, 20 aa, Cryptosporidium parvum
TVACFVFFFYSKEINAAELP

SEQ ID NO: 2337239 - protein, 23 aa, Cryptosporidium parvum
TVKVLGVRANTRFVVDRLLGKFC

SEQ ID NO: 2337240 - protein, 28 aa, Cryptosporidium parvum
TVLIAFEFCSVASNGLVGRDHVGTGVQF

SEQ ID NO: 2337241 - protein, 18 aa, Cryptosporidium parvum
TVLLLIGLLVNNEKNSIF

SEQ ID NO: 2337242 - protein, 27 aa, Cryptosporidium parvum
TVLLQSFCYLGFLELWSSFRTAPTILV

SEQ ID NO: 2337243 - protein, 24 aa, Cryptosporidium parvum
TVLNEFKNRFALINSSLNAQLGGL

SEQ ID NO: 2337244 - protein, 17 aa, Cryptosporidium parvum
TVLRSIRKISFKVNENS

SEQ ID NO: 2337245 - protein, 25 aa, Cryptosporidium parvum
TVVPFPPFIPVAGGYVPEPQNNGTT

SEQ ID NO: 2337246 - protein, 19 aa, Cryptosporidium parvum
TVYSISWLISTIIETYWTR

SEQ ID NO: 2337247 - protein, 24 aa, Cryptosporidium parvum
TWIDFSVVMDIKFRMKRRGMFLET

SEQ ID NO: 2337248 - protein, 24 aa, Cryptosporidium parvum
TWKEGVYVTIRFKFPKIVKKRFTY

SEQ ID NO: 2337249 - protein, 19 aa, Cryptosporidium parvum
TWLSLFAHYAKLQMDSIDF

SEQ ID NO: 2337250 - protein, 22 aa, Cryptosporidium parvum
TWTSRVMFGYSLDLSVVKRYSI

SEQ ID NO: 2337251 - protein, 27 aa, Cryptosporidium parvum
TYGILSLESAYGWKMVNQTIRVPVTVP

SEQ ID NO: 2337252 - protein, 27 aa, Cryptosporidium parvum
TYQLKNLRIDWEFPPFTYSIAAKVDGE

SEQ ID NO: 2337253 - protein, 20 aa, Cryptosporidium parvum
TYRHICSVVKNIRRGEIKSL

SEQ ID NO: 2337254 - protein, 17 aa, Cryptosporidium parvum
TYSLLFTFLESVIFCQE

SEQ ID NO: 2337255 - protein, 19 aa, Cryptosporidium parvum
TYSNMLFTYFGIRGAVKES

SEQ ID NO: 2337256 - protein, 24 aa, Cryptosporidium parvum
VADMKSLILEMAFNYNSLYSPLGM

SEQ ID NO: 2337257 - protein, 21 aa, Cryptosporidium parvum
VAFQIVFEYIFTIFNEKLSLS

SEQ ID NO: 2337258 - protein, 25 aa, Cryptosporidium parvum
VAGDGRFFLPEAIQIISEIAAAHKV

SEQ ID NO: 2337259 - protein, 20 aa, Cryptosporidium parvum
VAGPYARKLFIDEFGLPESS

SEQ ID NO: 2337260 - protein, 18 aa, Cryptosporidium parvum
VAIMPIQLYQDWRKDENK

SEQ ID NO: 2337261 - protein, 24 aa, Cryptosporidium parvum
VANGIPRWIGEKLYPDSFEYPCVS

SEQ ID NO: 2337262 - protein, 25 aa, Cryptosporidium parvum
VARKGDQWDGSLCQTFHRYNEFNTR

SEQ ID NO: 2337263 - protein, 25 aa, Cryptosporidium parvum
VCKFNNCMWNIWIGQLSGEFVNERC

SEQ ID NO: 2337264 - protein, 18 aa, Cryptosporidium parvum
VCNMKSFNGFTKFGDMID

SEQ ID NO: 2337265 - protein, 17 aa, Cryptosporidium parvum
VCSREVFAPYSLSCTAD

SEQ ID NO: 2337266 - protein, 17 aa, Cryptosporidium parvum
VCVILYLIHDTIEANSI

SEQ ID NO: 2337267 - protein, 21 aa, Cryptosporidium parvum
VDCGGPCKPCNMFNSCRIGLD

SEQ ID NO: 2337268 - protein, 22 aa, Cryptosporidium parvum
VDCYRLRLENWILEQELVLISE

SEQ ID NO: 2337269 - protein, 33 aa, Cryptosporidium parvum
VDIIVKLLFSYSALLLKFSYFFNENVLHEQIKR

SEQ ID NO: 2337270 - protein, 18 aa, Cryptosporidium parvum
VDLFNMTFSYGRYDSDLT

SEQ ID NO: 2337271 - protein, 25 aa, Cryptosporidium parvum
VDLMARFHGQWSLFYKMFRQKFRQI

SEQ ID NO: 2337272 - protein, 17 aa, Cryptosporidium parvum
VDNIPFISIESNEKNSG

SEQ ID NO: 2337273 - protein, 17 aa, Cryptosporidium parvum
VDYGCLDGKCTGSYQDL

SEQ ID NO: 2337274 - protein, 19 aa, Cryptosporidium parvum
VEACLGGQHFQRSMMGLAL

SEQ ID NO: 2337275 - protein, 18 aa, Cryptosporidium parvum
VECDRVWQEVILGITEGT

SEQ ID NO: 2337276 - protein, 18 aa, Cryptosporidium parvum
VECPPGLSLGEDGICVHS

SEQ ID NO: 2337277 - protein, 25 aa, Cryptosporidium parvum
VEDSGCCSCCSCSSKRTKTKKGENS

SEQ ID NO: 2337278 - protein, 42 aa, Cryptosporidium parvum
VEGYFYKWEAILKMLKKRLESLIRRFEALGCEGPEAKKDRKL

SEQ ID NO: 2337279 - protein, 19 aa, Cryptosporidium parvum
VEHNHGFIPLYQRVSYFNL

SEQ ID NO: 2337280 - protein, 19 aa, Cryptosporidium parvum
VEICRRFLVSPLIGIARDV

SEQ ID NO: 2337281 - protein, 18 aa, Cryptosporidium parvum
VEPLEILKEPEVEVKQSY

SEQ ID NO: 2337282 - protein, 19 aa, Cryptosporidium parvum
VERKLLLNFADFGNSNHNY

SEQ ID NO: 2337283 - protein, 21 aa, Cryptosporidium parvum
VESLSLLFIVLLVHLNGVKSQ

SEQ ID NO: 2337284 - protein, 20 aa, Cryptosporidium parvum
VFCTRMGYSSMTVRGNQIAF

SEQ ID NO: 2337285 - protein, 18 aa, Cryptosporidium parvum
VFLFAREELQRIELPMQQ

SEQ ID NO: 2337286 - protein, 30 aa, Cryptosporidium parvum
VFLLLIIIVIFSFNMDDLLLEAAYNSNKSN

SEQ ID NO: 2337287 - protein, 19 aa, Cryptosporidium parvum
VFLMDKFDWNSSFTVEGQS

SEQ ID NO: 2337288 - protein, 19 aa, Cryptosporidium parvum
VFLSTMWGNRGIFRITCAR

SEQ ID NO: 2337289 - protein, 19 aa, Cryptosporidium parvum
VFQKFRLRLDVSDNISKYE

SEQ ID NO: 2337290 - protein, 18 aa, Cryptosporidium parvum
VFRNEVSGEFSVAGSPQC

SEQ ID NO: 2337291 - protein, 18 aa, Cryptosporidium parvum
VFSKRDFLSLKSMLLSNL

SEQ ID NO: 2337292 - protein, 24 aa, Cryptosporidium parvum
VGASASGIFRQFGDKITQQANPCH

SEQ ID NO: 2337293 - protein, 22 aa, Cryptosporidium parvum
VGDSYKFGMSYEFKSEDDSELI

SEQ ID NO: 2337294 - protein, 30 aa, Cryptosporidium parvum
VGETITIGLGWSRLGLFLINENKDSFIEVK

SEQ ID NO: 2337295 - protein, 26 aa, Cryptosporidium parvum
VGRWYRRMLRGIWLPFYTAAMFMLQN

SEQ ID NO: 2337296 - protein, 17 aa, Cryptosporidium parvum
VGSKVQPITSFHILAKI

SEQ ID NO: 2337297 - protein, 23 aa, Cryptosporidium parvum
VGSPQCGPYCSTYPKGYFAFWLT

SEQ ID NO: 2337298 - protein, 23 aa, Cryptosporidium parvum
VGVEVSKTFSIWQLTNIKEIPAD

SEQ ID NO: 2337299 - protein, 18 aa, Cryptosporidium parvum
VICMLPYTLETNFTKVIT

SEQ ID NO: 2337300 - protein, 24 aa, Cryptosporidium parvum
VICSFLVIFLCLGPEHVEFHLVNG

SEQ ID NO: 2337301 - protein, 22 aa, Cryptosporidium parvum
VIDGHGGWQVAEYVQNNFIRIF

SEQ ID NO: 2337302 - protein, 22 aa, Cryptosporidium parvum
VIECSCQGLAPYALIGTINSTE

SEQ ID NO: 2337303 - protein, 19 aa, Cryptosporidium parvum
VIGCLFLNCDDNIVVERLL

SEQ ID NO: 2337304 - protein, 26 aa, Cryptosporidium parvum
VIIVYFFFHYVLKLFISVVTARDLWI

SEQ ID NO: 2337305 - protein, 18 aa, Cryptosporidium parvum
VILPKANVKFDWVNIGIN

SEQ ID NO: 2337306 - protein, 27 aa, Cryptosporidium parvum
VILPMLFELAMSYDYYFPMETVPLEHI

SEQ ID NO: 2337307 - protein, 18 aa, Cryptosporidium parvum
VIPFNHGEMLYKLSPNKY

SEQ ID NO: 2337308 - protein, 19 aa, Cryptosporidium parvum
VIQQLCWDLGGHMGAANTQ

SEQ ID NO: 2337309 - protein, 18 aa, Cryptosporidium parvum
VISAVIDGHGGWQVAEYV

SEQ ID NO: 2337310 - protein, 20 aa, Cryptosporidium parvum
VISKKMVRKVLEMIKQIQTE

SEQ ID NO: 2337311 - protein, 19 aa, Cryptosporidium parvum
VISRFGGAVLLKAEKYYEL

SEQ ID NO: 2337312 - protein, 17 aa, Cryptosporidium parvum
VISRLPISISKGFIKSQ

SEQ ID NO: 2337313 - protein, 23 aa, Cryptosporidium parvum
VISSCPKPIFNAEYILYTSSGRT

SEQ ID NO: 2337314 - protein, 19 aa, Cryptosporidium parvum
VISTRLGYISDLSAAMLVC

SEQ ID NO: 2337315 - protein, 18 aa, Cryptosporidium parvum
VIVCGRSSLGNGGKTAKC

SEQ ID NO: 2337316 - protein, 22 aa, Cryptosporidium parvum
VKADALGVPMFSGFNHSILDET

SEQ ID NO: 2337317 - protein, 17 aa, Cryptosporidium parvum
VKADYEYRKSIVSEFQA

SEQ ID NO: 2337318 - protein, 18 aa, Cryptosporidium parvum
VKDIIIWVTIPTDENKEV

SEQ ID NO: 2337319 - protein, 19 aa, Cryptosporidium parvum
VKDLGQFLLLSIDKMEVTK

SEQ ID NO: 2337320 - protein, 22 aa, Cryptosporidium parvum
VKEYECPEGYTAQLEEDFFQKD

SEQ ID NO: 2337321 - protein, 24 aa, Cryptosporidium parvum
VKGLCPSPSNTRIWTIEVEISKTN

SEQ ID NO: 2337322 - protein, 23 aa, Cryptosporidium parvum
VKGRLRLQFLKKRGFSAREGSLE

SEQ ID NO: 2337323 - protein, 30 aa, Cryptosporidium parvum
VKHLIASGFYQWSDKIMPLAMIKGRNTDDS

SEQ ID NO: 2337324 - protein, 25 aa, Cryptosporidium parvum
VKKLPRSVPTMPIPNPTASSTTVDL

SEQ ID NO: 2337325 - protein, 22 aa, Cryptosporidium parvum
VKKNIESFCHFASVAFFQGEIS

SEQ ID NO: 2337326 - protein, 18 aa, Cryptosporidium parvum
VKNWPKKKWYMKLDDDTF

SEQ ID NO: 2337327 - protein, 35 aa, Cryptosporidium parvum
VKQVFERFQFCLSHRRFQSTLSFEFLRDIVRFLPF

SEQ ID NO: 2337328 - protein, 18 aa, Cryptosporidium parvum
VKRCYKVDVQYDFASVDT

SEQ ID NO: 2337329 - protein, 17 aa, Cryptosporidium parvum
VKVSVSMLKEHFSSVTS

SEQ ID NO: 2337330 - protein, 17 aa, Cryptosporidium parvum
VLAKKGLLERVEEKVND

SEQ ID NO: 2337331 - protein, 25 aa, Cryptosporidium parvum
VLDELLKLRLAIISSHNLNDREYTI

SEQ ID NO: 2337332 - protein, 26 aa, Cryptosporidium parvum
VLDKLYFYPHFRGVKPSSSLKLKELE

SEQ ID NO: 2337333 - protein, 21 aa, Cryptosporidium parvum
VLEDNAFRWGGNYICQELVQE

SEQ ID NO: 2337334 - protein, 22 aa, Cryptosporidium parvum
VLEIPLLVAAPFMLTSDSNGSA

SEQ ID NO: 2337335 - protein, 20 aa, Cryptosporidium parvum
VLFAFLFRAINIFAQNNDAK

SEQ ID NO: 2337336 - protein, 20 aa, Cryptosporidium parvum
VLLECLILFGERYSPESIFE

SEQ ID NO: 2337337 - protein, 18 aa, Cryptosporidium parvum
VLLRIPFPSSEISGSNFI

SEQ ID NO: 2337338 - protein, 19 aa, Cryptosporidium parvum
VLLSLDLYNIIAKRNTNPK

SEQ ID NO: 2337339 - protein, 17 aa, Cryptosporidium parvum
VLPEFISGTPLEPLPSS

SEQ ID NO: 2337340 - protein, 23 aa, Cryptosporidium parvum
VLQGRGSTVLSDFMTSNGVGLDL

SEQ ID NO: 2337341 - protein, 18 aa, Cryptosporidium parvum
VLSFCSAVYISIYSEKGV

SEQ ID NO: 2337342 - protein, 25 aa, Cryptosporidium parvum
VLSKLVALKNYWKRLHKNRMKQPNN

SEQ ID NO: 2337343 - protein, 18 aa, Cryptosporidium parvum
VLVGEVIDNSINYCIYKY

SEQ ID NO: 2337344 - protein, 20 aa, Cryptosporidium parvum
VLVIRASTIISIKSFKQSSA

SEQ ID NO: 2337345 - protein, 24 aa, Cryptosporidium parvum
VLVSYELFSAILLGKEGNNGANKD

SEQ ID NO: 2337346 - protein, 27 aa, Cryptosporidium parvum
VMFLMEFAEKYLFFPGKVETIDIIVDC

SEQ ID NO: 2337347 - protein, 21 aa, Cryptosporidium parvum
VMNIPEWRRISSYYIGKAPEW

SEQ ID NO: 2337348 - protein, 27 aa, Cryptosporidium parvum
VNAQLFLKYRSSILILVLVFLAILDGS

SEQ ID NO: 2337349 - protein, 20 aa, Cryptosporidium parvum
VNCPEGFEWLSETLNCQSQE

SEQ ID NO: 2337350 - protein, 25 aa, Cryptosporidium parvum
VNFRPGEEWFGRRGLGGSHAEETFC

SEQ ID NO: 2337351 - protein, 23 aa, Cryptosporidium parvum
VNKQRFFPAAAIPRFDNFDTTLI

SEQ ID NO: 2337352 - protein, 17 aa, Cryptosporidium parvum
VNLYRRLLYLLDLFHRG

SEQ ID NO: 2337353 - protein, 17 aa, Cryptosporidium parvum
VNQTIRVPVTVPVNSTK

SEQ ID NO: 2337354 - protein, 19 aa, Cryptosporidium parvum
VNRDLKGLAILLSNEKQED

SEQ ID NO: 2337355 - protein, 19 aa, Cryptosporidium parvum
VNSTQFIFLNWFYLVYHGS

SEQ ID NO: 2337356 - protein, 21 aa, Cryptosporidium parvum
VNTRHGFIPLYIISNYHETAS

SEQ ID NO: 2337357 - protein, 23 aa, Cryptosporidium parvum
VNVGDLIKWSIGIDSLMNLYLNI

SEQ ID NO: 2337358 - protein, 19 aa, Cryptosporidium parvum
VPFLTGIKLIDEIISPKKR

SEQ ID NO: 2337359 - protein, 18 aa, Cryptosporidium parvum
VPFYGMTGISPGYENPAM

SEQ ID NO: 2337360 - protein, 21 aa, Cryptosporidium parvum
VPKFTDLRNKGVFSGEYPEDI

SEQ ID NO: 2337361 - protein, 21 aa, Cryptosporidium parvum
VPMFYSKIFAITKSWWLNISK

SEQ ID NO: 2337362 - protein, 19 aa, Cryptosporidium parvum
VPSGIKFDYIIVGAGANGL

SEQ ID NO: 2337363 - protein, 18 aa, Cryptosporidium parvum
VPTLFFWGAEDRLCPLSS

SEQ ID NO: 2337364 - protein, 18 aa, Cryptosporidium parvum
VQEFYKFSTDLPIKAINY

SEQ ID NO: 2337365 - protein, 18 aa, Cryptosporidium parvum
VQESLCLGTYRFFDHSNF

SEQ ID NO: 2337366 - protein, 26 aa, Cryptosporidium parvum
VQFRNYCFAFVWTLWKSGNEPDLRIS

SEQ ID NO: 2337367 - protein, 30 aa, Cryptosporidium parvum; identical to SEQ ID NO: 2208571

SEQ ID NO: 2337368 - protein, 17 aa, Cryptosporidium parvum
VQNLYSLYLSLIEEPLT

SEQ ID NO: 2337369 - protein, 27 aa, Cryptosporidium parvum
VQNSRKCFRMYFDGSPVVMCAKSDEER

SEQ ID NO: 2337370 - protein, 23 aa, Cryptosporidium parvum
VRCKIEDCYNCKIRNKFHDKLGK

SEQ ID NO: 2337371 - protein, 22 aa, Cryptosporidium parvum
VRFSIEGFWSLITLIPKMVLSN

SEQ ID NO: 2337372 - protein, 17 aa, Cryptosporidium parvum
VRGPGCKTPCTREYNPV

SEQ ID NO: 2337373 - protein, 17 aa, Cryptosporidium parvum
VRGPGCRTPCTREFDPV

SEQ ID NO: 2337374 - protein, 17 aa, Cryptosporidium parvum
VRKNIESNLLLSFETKM

SEQ ID NO: 2337375 - protein, 18 aa, Cryptosporidium parvum
VRPYTWKTLKGIYEQKKL

SEQ ID NO: 2337376 - protein, 19 aa, Cryptosporidium parvum
VRQFGFKIDIEYIKEFINN

SEQ ID NO: 2337377 - protein, 26 aa, Cryptosporidium parvum
VRRSNWFVKHVCSFISQKLNEINKSN

SEQ ID NO: 2337378 - protein, 23 aa, Cryptosporidium parvum
VSAHQKGVMSIEFSPIDPNLLLS

SEQ ID NO: 2337379 - protein, 20 aa, Cryptosporidium parvum
VSAPPHLFKVILAVNPKKEK

SEQ ID NO: 2337380 - protein, 23 aa, Cryptosporidium parvum
VSDISWLEGYLMETDRLKGDWAT

SEQ ID NO: 2337381 - protein, 22 aa, Cryptosporidium parvum
VSDKKMYDEWLKTMTVSEEIIL

SEQ ID NO: 2337382 - protein, 20 aa, Cryptosporidium parvum
VSEKYECVKALYKDHFGELA

SEQ ID NO: 2337383 - protein, 22 aa, Cryptosporidium parvum
VSEYRTGTIALWNSGLDLKSIS

SEQ ID NO: 2337384 - protein, 17 aa, Cryptosporidium parvum
VSGEFSVAGSPQCGPYC

SEQ ID NO: 2337385 - protein, 35 aa, Cryptosporidium parvum
VSIAKFCKGLFERFILRHIEWLKIIIKSIESDNIK

SEQ ID NO: 2337386 - protein, 22 aa, Cryptosporidium parvum
VSIAPFFLEVDLFYSENLEQIL

SEQ ID NO: 2337387 - protein, 17 aa, Cryptosporidium parvum
VSIGLLVSGWTYILSEI

SEQ ID NO: 2337388 - protein, 18 aa, Cryptosporidium parvum
VSILNRYQDIHTHLYISG

SEQ ID NO: 2337389 - protein, 25 aa, Cryptosporidium parvum
VSISYGEKFIWSFGVNENSRMIYFN

SEQ ID NO: 2337390 - protein, 17 aa, Cryptosporidium parvum
VSLEPTLEFSLYNSGVF

SEQ ID NO: 2337391 - protein, 20 aa, Cryptosporidium parvum
VSLFPRKIGRRDILTYSNNL

SEQ ID NO: 2337392 - protein, 18 aa, Cryptosporidium parvum
VSMLRRLVADQFVGINTT

SEQ ID NO: 2337393 - protein, 28 aa, Cryptosporidium parvum
VSNLPLNPPEIWLGSKSPEEFVADCKRV

SEQ ID NO: 2337394 - protein, 28 aa, Cryptosporidium parvum
VSPCDGSIVWLSERWLQYGKSSGLNASQ

SEQ ID NO: 2337395 - protein, 19 aa, Cryptosporidium parvum
VSPTMAWQFKLWYNRGNCS

SEQ ID NO: 2337396 - protein, 18 aa, Cryptosporidium parvum
VSPWGWDIVSQFVEACQE

SEQ ID NO: 2337397 - protein, 21 aa, Cryptosporidium parvum
VTCPPRFVLNLQTQVCERKIE

SEQ ID NO: 2337398 - protein, 42 aa, Cryptosporidium parvum
VTGKNYTVCYIKNLNQFGGGFKYLSPLGYRPNYSRFIQEISP

SEQ ID NO: 2337399 - protein, 19 aa, Cryptosporidium parvum
VTKYSCYRMKNTLVLFYLI

SEQ ID NO: 2337400 - protein, 26 aa, Cryptosporidium parvum
VVDRLLGKFCRLVISMMNIDSVSQPG

SEQ ID NO: 2337401 - protein, 18 aa, Cryptosporidium parvum
VVFPIEKKLACGEYGMGG

SEQ ID NO: 2337402 - protein, 17 aa, Cryptosporidium parvum
VVGAFSIIVIKKPYGEM

SEQ ID NO: 2337403 - protein, 19 aa, Cryptosporidium parvum
VVGKCLFSLSSTKFNSNIK

SEQ ID NO: 2337404 - protein, 18 aa, Cryptosporidium parvum
VVKACTDIAQALMESETT

SEQ ID NO: 2337405 - protein, 17 aa, Cryptosporidium parvum
VVLNIKTEFSLISNDNS

SEQ ID NO: 2337406 - protein, 19 aa, Cryptosporidium parvum
VVRHGRDTIALSIGYGPLS

SEQ ID NO: 2337407 - protein, 18 aa, Cryptosporidium parvum
VWIMKKWSSSQCISQLAL

SEQ ID NO: 2337408 - protein, 17 aa, Cryptosporidium parvum
VWNREREILYSLSKEFW

SEQ ID NO: 2337409 - protein, 32 aa, Cryptosporidium parvum
VYPGMEMIFGIGWSRLGIFVVNSRNEALIQIN

SEQ ID NO: 2337410 - protein, 23 aa, Cryptosporidium parvum
VYSEKSSICKAALQVGVISTNTG

SEQ ID NO: 2337411 - protein, 24 aa, Cryptosporidium parvum
VYSGEYYKSLGLNFDPQRLQESFE

SEQ ID NO: 2337412 - protein, 17 aa, Cryptosporidium parvum
VYSSFIFFNNINYQAPS

SEQ ID NO: 2337413 - protein, 22 aa, Cryptosporidium parvum
WARNIPRVSITNMINLISHTGS

SEQ ID NO: 2337414 - protein, 19 aa, Cryptosporidium parvum
WDHHISKIISFIKENIQSI

SEQ ID NO: 2337415 - protein, 17 aa, Cryptosporidium parvum
WDIGNSYQYAEPYLQLV

SEQ ID NO: 2337416 - protein, 24 aa, Cryptosporidium parvum
WDLSRLSLLFYWNLLASNMETCLP

SEQ ID NO: 2337417 - protein, 20 aa, Cryptosporidium parvum
WDNVQGLKFLSFAYFENTGY

SEQ ID NO: 2337418 - protein, 18 aa, Cryptosporidium parvum
WDSLKSVLLPTSYFDFSV

SEQ ID NO: 2337419 - protein, 18 aa, Cryptosporidium parvum
WDVRLIDLSFVWVPSALK

SEQ ID NO: 2337420 - protein, 27 aa, Cryptosporidium parvum
WDVYDYVICLCFYYLIKRERIRIDWFT

SEQ ID NO: 2337421 - protein, 19 aa, Cryptosporidium parvum
WEKELKRYTQLSVKYFPYS

SEQ ID NO: 2337422 - protein, 17 aa, Cryptosporidium parvum
WGKKGYAKIRRGKNIGG

SEQ ID NO: 2337423 - protein, 21 aa, Cryptosporidium parvum
WGKLLSYCIKCRALTEYMLIQ

SEQ ID NO: 2337424 - protein, 23 aa, Cryptosporidium parvum
WGQRKGDWHYLELLLREVDKETF

SEQ ID NO: 2337425 - protein, 27 aa, Cryptosporidium parvum
WHWYTWCKRPDFNLIHREVLGDEVVHV

SEQ ID NO: 2337426 - protein, 18 aa, Cryptosporidium parvum
WIDYLTILIDDWLDSDAN

SEQ ID NO: 2337427 - protein, 17 aa, Cryptosporidium parvum
WIPSCPNNTLSISVSKY

SEQ ID NO: 2337428 - protein, 20 aa, Cryptosporidium parvum
WIYRVSELLSACAQHTYQSS

SEQ ID NO: 2337429 - protein, 31 aa, Cryptosporidium parvum; identical to SEQ ID NO: 2208621

SEQ ID NO: 2337430 - protein, 21 aa, Cryptosporidium parvum
WKIIREVSILKLLNGYSDNHV

SEQ ID NO: 2337431 - protein, 20 aa, Cryptosporidium parvum
WKNDDFRGNVSIVPTSAVTG

SEQ ID NO: 2337432 - protein, 19 aa, Cryptosporidium parvum
WLALFILVAVVSFEVKYVG

SEQ ID NO: 2337433 - protein, 22 aa, Cryptosporidium parvum
WMSMKVLRMLVSGLMTYCKLNF

SEQ ID NO: 2337434 - protein, 17 aa, Cryptosporidium parvum
WNDICLISESTIPEEYD

SEQ ID NO: 2337435 - protein, 19 aa, Cryptosporidium parvum
WNIETSQIFYSDIKQSCIP

SEQ ID NO: 2337436 - protein, 17 aa, Cryptosporidium parvum
WNLDFLSLDVIRMVSMY

SEQ ID NO: 2337437 - protein, 24 aa, Cryptosporidium parvum
WPNETEKWAKISFLESGSITETNF

SEQ ID NO: 2337438 - protein, 18 aa, Cryptosporidium parvum
WRFEKDHERYLSESQKSL

SEQ ID NO: 2337439 - protein, 20 aa, Cryptosporidium parvum
WRRSFGYNGFIVYPRIKTSV

SEQ ID NO: 2337440 - protein, 21 aa, Cryptosporidium parvum
WRYNYNWKHESCNLIRTLKKK

SEQ ID NO: 2337441 - protein, 30 aa, Cryptosporidium parvum; identical to SEQ ID NO: 2208632

SEQ ID NO: 2337442 - protein, 20 aa, Cryptosporidium parvum
WSLPFKFIKCDIDFEENVLE

SEQ ID NO: 2337443 - protein, 20 aa, Cryptosporidium parvum
WSPNIPGIFATASHNDKVSI

SEQ ID NO: 2337444 - protein, 22 aa, Cryptosporidium parvum
WSQEDYMVISFIIFLSKRLDLA

SEQ ID NO: 2337445 - protein, 29 aa, Cryptosporidium parvum
WSSWSACTNECGWGIQTRGRRINANLIDK

SEQ ID NO: 2337446 - protein, 21 aa, Cryptosporidium parvum
WTDKYTYRYWVLESDQGVICM

SEQ ID NO: 2337447 - protein, 21 aa, Cryptosporidium parvum
WTKSYRYTAFFKYINEHEDIN

SEQ ID NO: 2337448 - protein, 19 aa, Cryptosporidium parvum
WTQQHICEGIYLLNTYRGE

SEQ ID NO: 2337449 - protein, 24 aa, Cryptosporidium parvum
WVNEKELYGRPGVDDDMNGYVDDI

SEQ ID NO: 2337450 - protein, 23 aa, Cryptosporidium parvum
WWEKELDIVTAIILTIFKYQYRH

SEQ ID NO: 2337451 - protein, 20 aa, Cryptosporidium parvum
YAALRYKFADKAVIENSFDE

SEQ ID NO: 2337452 - protein, 18 aa, Cryptosporidium parvum
YAANWGMKCMNGQFQHSP

SEQ ID NO: 2337453 - protein, 22 aa, Cryptosporidium parvum
YAEGSIRLFGLHGSENEVLLEE

SEQ ID NO: 2337454 - protein, 27 aa, Cryptosporidium parvum
YAPAINEWLFLTVAYNFNEKRVVMYIN

SEQ ID NO: 2337455 - protein, 22 aa, Cryptosporidium parvum
YAQKIIVGILMARREKGYGPAA

SEQ ID NO: 2337456 - protein, 19 aa, Cryptosporidium parvum
YAYPSRKNCFCRDENSEKC

SEQ ID NO: 2337457 - protein, 22 aa, Cryptosporidium parvum
YCCDYGSLAYEWENLENEHLYK

SEQ ID NO: 2337458 - protein, 17 aa, Cryptosporidium parvum
YCHTTLLGWWDSYPESV

SEQ ID NO: 2337459 - protein, 21 aa, Cryptosporidium parvum
YCKDDEIISYIGVNNQVVDHS

SEQ ID NO: 2337460 - protein, 19 aa, Cryptosporidium parvum
YCPIYGLNMKGLFCLGWNS

SEQ ID NO: 2337461 - protein, 25 aa, Cryptosporidium parvum
YCSTYPKGFFTFWLTYNNDSKKYLI

SEQ ID NO: 2337462 - protein, 26 aa, Cryptosporidium parvum
YCSTYPKGYFAFWLTLDSINKKYIVS

SEQ ID NO: 2337463 - protein, 25 aa, Cryptosporidium parvum
YCSTYPKGYFAFWLTYDEDNDLYEI

SEQ ID NO: 2337464 - protein, 26 aa, Cryptosporidium parvum
YCSTYPKGYFAFWLTYDPEIHVYTVS

SEQ ID NO: 2337465 - protein, 26 aa, Cryptosporidium parvum
YCSTYPKGYFAFWLTYDSITNKYIIS

SEQ ID NO: 2337466 - protein, 26 aa, Cryptosporidium parvum
YCSTYPKGYFAFWLTYDSKYNYFIIS

SEQ ID NO: 2337467 - protein, 25 aa, Cryptosporidium parvum
YCSTYPKGYFAFWLTYDSVTSKYII

SEQ ID NO: 2337468 - protein, 27 aa, Cryptosporidium parvum
YCSTYPKGYFAFWLTYEPIRKMYSIGI

SEQ ID NO: 2337469 - protein, 30 aa, Cryptosporidium parvum
YCTGRIILPKEAWEIWGLVYSYGGGGHIPK

SEQ ID NO: 2337470 - protein, 23 aa, Cryptosporidium parvum
YDASKFRKSLGVFERSYAAVTDI

SEQ ID NO: 2337471 - protein, 22 aa, Cryptosporidium parvum
YDELCIAVSQMSKMFSDKSRKP

SEQ ID NO: 2337472 - protein, 24 aa, Cryptosporidium parvum
YDGKRTVEAFKEFISEHSSFPQEK

SEQ ID NO: 2337473 - protein, 31 aa, Cryptosporidium parvum
YDHMDLEILIGWSRLGLFLMDNNHNGLIHIQ

SEQ ID NO: 2337474 - protein, 23 aa, Cryptosporidium parvum
YDIIPRRFLRSFYLSNLSHFTQG

SEQ ID NO: 2337475 - protein, 17 aa, Cryptosporidium parvum
YDITMYSHFKILKSSDF

SEQ ID NO: 2337476 - protein, 22 aa, Cryptosporidium parvum
YDKSRLQEELSIEFETKSDSIL

SEQ ID NO: 2337477 - protein, 20 aa, Cryptosporidium parvum
YDLACPAGYALVGDKCATTR

SEQ ID NO: 2337478 - protein, 18 aa, Cryptosporidium parvum
YDPELDVLRKSFSGIDTE

SEQ ID NO: 2337479 - protein, 17 aa, Cryptosporidium parvum
YDPKRDMCIKFEEKKPV

SEQ ID NO: 2337480 - protein, 17 aa, Cryptosporidium parvum
YDSEMLEFASRSCPNTS

SEQ ID NO: 2337481 - protein, 18 aa, Cryptosporidium parvum
YDTLRWQQATCVLESEGY

SEQ ID NO: 2337482 - protein, 20 aa, Cryptosporidium parvum
YDVFISKCGYEYRLYGIENK

SEQ ID NO: 2337483 - protein, 19 aa, Cryptosporidium parvum
YDYNHSWMFEKGPRPYCEY

SEQ ID NO: 2337484 - protein, 17 aa, Cryptosporidium parvum
YEDGNCYSTILNEVSGE

SEQ ID NO: 2337485 - protein, 20 aa, Cryptosporidium parvum
YEGSFGLAFRMQNFERYYLL

SEQ ID NO: 2337486 - protein, 20 aa, Cryptosporidium parvum
YEIKGDPSLITIASLYSQAQ

SEQ ID NO: 2337487 - protein, 25 aa, Cryptosporidium parvum
YENTFKIIFFWGMKDDVVPFPPALE

SEQ ID NO: 2337488 - protein, 25 aa, Cryptosporidium parvum
YEPEKKYNSSFPFFPVGIIPAPISG

SEQ ID NO: 2337489 - protein, 17 aa, Cryptosporidium parvum
YESGYSFEIPLTEAEDI

SEQ ID NO: 2337490 - protein, 18 aa, Cryptosporidium parvum
YESLLKRNLELFNQTLIY

SEQ ID NO: 2337491 - protein, 29 aa, Cryptosporidium parvum
YEWSNKFIYPREMLFLGYSICSAYNDCTD

SEQ ID NO: 2337492 - protein, 19 aa, Cryptosporidium parvum
YFDIRILKDSSLISLFLNE

SEQ ID NO: 2337493 - protein, 21 aa, Cryptosporidium parvum
YFFNNRMVLLDSKNKVACSGP

SEQ ID NO: 2337494 - protein, 24 aa, Cryptosporidium parvum
YFGEMITISFIRPVLCINANDCLK

SEQ ID NO: 2337495 - protein, 17 aa, Cryptosporidium parvum
YFGFLVYVIGSSVNAND

SEQ ID NO: 2337496 - protein, 23 aa, Cryptosporidium parvum
YFKSNYVFELSFVYDESREYNIV

SEQ ID NO: 2337497 - protein, 26 aa, Cryptosporidium parvum
YFKTDCTRSLFDFLVAQRFIKPTLNI

SEQ ID NO: 2337498 - protein, 22 aa, Cryptosporidium parvum
YFLVDPNYFWSLDATTQVETKA

SEQ ID NO: 2337499 - protein, 19 aa, Cryptosporidium parvum
YFNAWRRSFGYNGFIVYPR

SEQ ID NO: 2337500 - protein, 19 aa, Cryptosporidium parvum
YFNESFITVVDWRQDLKYI

SEQ ID NO: 2337501 - protein, 19 aa, Cryptosporidium parvum
YFQEYKHLFDVISASNNGE

SEQ ID NO: 2337502 - protein, 23 aa, Cryptosporidium parvum
YFQKSGIPFIFRAASKIQGSKNY

SEQ ID NO: 2337503 - protein, 19 aa, Cryptosporidium parvum
YFSNCGIFSTYWQKYLNFF

SEQ ID NO: 2337504 - protein, 17 aa, Cryptosporidium parvum
YGDLKICSNIKNARSFA

SEQ ID NO: 2337505 - protein, 21 aa, Cryptosporidium parvum
YGENSYPFFPPGVQPAPIDGD

SEQ ID NO: 2337506 - protein, 19 aa, Cryptosporidium parvum
YGFAEIREIFLLEKDHAIH

SEQ ID NO: 2337507 - protein, 17 aa, Cryptosporidium parvum
YGIKQVRIFSNTMRSAV

SEQ ID NO: 2337508 - protein, 20 aa, Cryptosporidium parvum
YGKKALRLPENFVASKGVET

SEQ ID NO: 2337509 - protein, 18 aa, Cryptosporidium parvum
YGKNYAFYPPGIKPAPII

SEQ ID NO: 2337510 - protein, 24 aa, Cryptosporidium parvum
YGQSWDFDQCLDIFTANETILIYG

SEQ ID NO: 2337511 - protein, 21 aa, Cryptosporidium parvum
YGRHYRYNWANLLGQKFFIPS

SEQ ID NO: 2337512 - protein, 17 aa, Cryptosporidium parvum
YHGEVIKGIRGGAGYLM

SEQ ID NO: 2337513 - protein, 19 aa, Cryptosporidium parvum
YHPELKYFNSYLYFPSSIV

SEQ ID NO: 2337514 - protein, 20 aa, Cryptosporidium parvum
YHQWKVGPIILTKKETENIG

SEQ ID NO: 2337515 - protein, 19 aa, Cryptosporidium parvum
YIAELYPDILRIEKKISCS

SEQ ID NO: 2337516 - protein, 18 aa, Cryptosporidium parvum
YIEHCLFLLQLYAKKKSI

SEQ ID NO: 2337517 - protein, 26 aa, Cryptosporidium parvum
YIFFIYQFVAAEAFTFRNRKEDERRE

SEQ ID NO: 2337518 - protein, 18 aa, Cryptosporidium parvum
YIITCPNGDLALKDSGSD

SEQ ID NO: 2337519 - protein, 19 aa, Cryptosporidium parvum
YIKEYKGRTNAMVVKTSGE

SEQ ID NO: 2337520 - protein, 17 aa, Cryptosporidium parvum
YILIKGILSEYSYFLNI

SEQ ID NO: 2337521 - protein, 24 aa, Cryptosporidium parvum
YILKEIYSAIIYIKENISFEQILQ

SEQ ID NO: 2337522 - protein, 17 aa, Cryptosporidium parvum
YILNLYNNWLLRNSEIT

SEQ ID NO: 2337523 - protein, 25 aa, Cryptosporidium parvum
YINTKKFEIDFCIRLLENFQNQQEN

SEQ ID NO: 2337524 - protein, 29 aa, Cryptosporidium parvum
YISRCQISHSLLFTRAANNLGIQDDECVE

SEQ ID NO: 2337525 - protein, 18 aa, Cryptosporidium parvum
YKESCLDIKSSNQHLFSG

SEQ ID NO: 2337526 - protein, 18 aa, Cryptosporidium parvum
YKFFSEIISSYNYSVTPN

SEQ ID NO: 2337527 - protein, 17 aa, Cryptosporidium parvum
YKFKYLTKMDFRELHLI

SEQ ID NO: 2337528 - protein, 23 aa, Cryptosporidium parvum
YKFRIHPKDALKHPFFTIHPSKH

SEQ ID NO: 2337529 - protein, 27 aa, Cryptosporidium parvum
YKGAGFPVLCGESIRLLHSVTEKFVQS

SEQ ID NO: 2337530 - protein, 17 aa, Cryptosporidium parvum
YKKFQLFPDFTNKSTPW

SEQ ID NO: 2337531 - protein, 25 aa, Cryptosporidium parvum
YKKKDLRKNPSIFHRPKFSESTDEY

SEQ ID NO: 2337532 - protein, 25 aa, Cryptosporidium parvum
YKLIRIAIPASYMISKYNKFPKEYQ

SEQ ID NO: 2337533 - protein, 19 aa, Cryptosporidium parvum
YKNAGSWFRITVLEDNPYE

SEQ ID NO: 2337534 - protein, 34 aa, Cryptosporidium parvum; identical to SEQ ID NO: 2208685

SEQ ID NO: 2337535 - protein, 22 aa, Cryptosporidium parvum
YKSDFTRFMLNLIINKSDPKLT

SEQ ID NO: 2337536 - protein, 19 aa, Cryptosporidium parvum
YKVILAYLELCGFEQVMIN

SEQ ID NO: 2337537 - protein, 19 aa, Cryptosporidium parvum
YKYFIEFSDKVCPDCSLKV

SEQ ID NO: 2337538 - protein, 18 aa, Cryptosporidium parvum
YKYSKCGNSIVLFDFHRK

SEQ ID NO: 2337539 - protein, 19 aa, Cryptosporidium parvum
YKYYLESIGKSPTAQSSQY

SEQ ID NO: 2337540 - protein, 28 aa, Cryptosporidium parvum
YLAKRKIHKLKKCLKKIAKIEEEEEEEA

SEQ ID NO: 2337541 - protein, 25 aa, Cryptosporidium parvum
YLEEGLDRFSHFFIDPLFYENVIEK

SEQ ID NO: 2337542 - protein, 24 aa, Cryptosporidium parvum
YLERKKPELVLSIGLSEAIDNNNL

SEQ ID NO: 2337543 - protein, 27 aa, Cryptosporidium parvum
YLILARISFGFGEELRLSNSNNFGKND

SEQ ID NO: 2337544 - protein, 28 aa, Cryptosporidium parvum
YLILFRDLKHIFGFGNPKIFSLNTCPVP

SEQ ID NO: 2337545 - protein, 17 aa, Cryptosporidium parvum
YLKENNKGWVLRAMNPH

SEQ ID NO: 2337546 - protein, 21 aa, Cryptosporidium parvum
YLKHDIEVLFLTEGVDEPCIS

SEQ ID NO: 2337547 - protein, 23 aa, Cryptosporidium parvum
YLKKKLSKQIPDVIILMNTDQYP

SEQ ID NO: 2337548 - protein, 22 aa, Cryptosporidium parvum
YLKNLRSAFESCKRRCTISRNI

SEQ ID NO: 2337549 - protein, 19 aa, Cryptosporidium parvum
YLMIQEFVNPLGIENNNGI

SEQ ID NO: 2337550 - protein, 23 aa, Cryptosporidium parvum
YLPESVVGYFSFNHIIPNVPTFD

SEQ ID NO: 2337551 - protein, 17 aa, Cryptosporidium parvum
YLSEKFVASEYFKTDCT

SEQ ID NO: 2337552 - protein, 24 aa, Cryptosporidium parvum
YLSIIFLWICFFSRNEIFVRSNNY

SEQ ID NO: 2337553 - protein, 19 aa, Cryptosporidium parvum
YLYEQGYGRTKKRVILGWS

SEQ ID NO: 2337554 - protein, 24 aa, Cryptosporidium parvum
YMDGWGSVCSDGFNSVSERVACTQ

SEQ ID NO: 2337555 - protein, 19 aa, Cryptosporidium parvum
YMKFIRPTTENVLIKAEAT

SEQ ID NO: 2337556 - protein, 27 aa, Cryptosporidium parvum
YNGMDFKIGIGWSKLGLFILNEYSSSL

SEQ ID NO: 2337557 - protein, 19 aa, Cryptosporidium parvum
YNILIDLGKSFREAAISVF

SEQ ID NO: 2337558 - protein, 17 aa, Cryptosporidium parvum
YNKEASISYSKDVELSP

SEQ ID NO: 2337559 - protein, 17 aa, Cryptosporidium parvum
YNLIEGACECPNGVSYC

SEQ ID NO: 2337560 - protein, 17 aa, Cryptosporidium parvum
YNLIKLFIDDRMAEEVT

SEQ ID NO: 2337561 - protein, 18 aa, Cryptosporidium parvum
YNLKKCKKSVRNMLDGKA

SEQ ID NO: 2337562 - protein, 18 aa, Cryptosporidium parvum
YNPLKLGELFIVPLTSAI

SEQ ID NO: 2337563 - protein, 27 aa, Cryptosporidium parvum
YNQAIQWLRLGKHIPKAVLFTNKDSSS

SEQ ID NO: 2337564 - protein, 24 aa, Cryptosporidium parvum
YNYNKEFLTLIGYSLALEYFFEAI

SEQ ID NO: 2337565 - protein, 21 aa, Cryptosporidium parvum
YPIKGRLNVVKDYFTKVSEKA

SEQ ID NO: 2337566 - protein, 19 aa, Cryptosporidium parvum
YPNPDEIVWLFNAFPEIPT

SEQ ID NO: 2337567 - protein, 18 aa, Cryptosporidium parvum
YPPSRFAYLHGETVEVAP

SEQ ID NO: 2337568 - protein, 18 aa, Cryptosporidium parvum
YPSLLGRVTVVANRKYGD

SEQ ID NO: 2337569 - protein, 24 aa, Cryptosporidium parvum
YQECLKKLTGSIMVTKGLEIESRI

SEQ ID NO: 2337570 - protein, 21 aa, Cryptosporidium parvum
YQFNAPFGYKNAVYKSSIDNQ

SEQ ID NO: 2337571 - protein, 18 aa, Cryptosporidium parvum
YQIELIILVGFVVKTFKS

SEQ ID NO: 2337572 - protein, 20 aa, Cryptosporidium parvum
YRFDEICKAFELMGDNPPRE

SEQ ID NO: 2337573 - protein, 25 aa, Cryptosporidium parvum
YRLLPPGPIKYLFHFKQSKTAAIEA

SEQ ID NO: 2337574 - protein, 21 aa, Cryptosporidium parvum
YRLNSIPQFTLYILSSHFDSF

SEQ ID NO: 2337575 - protein, 18 aa, Cryptosporidium parvum
YRMIYYCTGRIILPKEAW

SEQ ID NO: 2337576 - protein, 20 aa, Cryptosporidium parvum
YRNFWKRPNYVNKYRNIDSL

SEQ ID NO: 2337577 - protein, 25 aa, Cryptosporidium parvum
YRQDYGQECTFEWMNDLVTMYYNAF

SEQ ID NO: 2337578 - protein, 20 aa, Cryptosporidium parvum
YRQSPAIWYSSLKKVMYLDF

SEQ ID NO: 2337579 - protein, 18 aa, Cryptosporidium parvum
YRWKTLSILIILFVISVD

SEQ ID NO: 2337580 - protein, 18 aa, Cryptosporidium parvum
YRYEGVSLGNLLFDIDDN

SEQ ID NO: 2337581 - protein, 17 aa, Cryptosporidium parvum
YSCVICLNNICDEDLVR

SEQ ID NO: 2337582 - protein, 20 aa, Cryptosporidium parvum
YSDKGLDAWSPNENDNLLDM

SEQ ID NO: 2337583 - protein, 24 aa, Cryptosporidium parvum
YSDSELKLELNLNVGASLTGSVGT

SEQ ID NO: 2337584 - protein, 20 aa, Cryptosporidium parvum
YSELLSYRLLINIINPKIQL

SEQ ID NO: 2337585 - protein, 23 aa, Cryptosporidium parvum
YSEMCSGCMDLLPIWNSISSKIA

SEQ ID NO: 2337586 - protein, 25 aa, Cryptosporidium parvum
YSFFPQCPNGIIGGIIHYESESNYV

SEQ ID NO: 2337587 - protein, 18 aa, Cryptosporidium parvum
YSGPYVRTSATAGKVSPR

SEQ ID NO: 2337588 - protein, 17 aa, Cryptosporidium parvum
YSKFPINSRYGSKIFLY

SEQ ID NO: 2337589 - protein, 17 aa, Cryptosporidium parvum
YSQLSLLLIILSPFSKI

SEQ ID NO: 2337590 - protein, 26 aa, Cryptosporidium parvum
YSQSCTLSLFQGCFSSEFVLSLPDSS

SEQ ID NO: 2337591 - protein, 19 aa, Cryptosporidium parvum
YSSPIIPKILYIESQPLEY

SEQ ID NO: 2337592 - protein, 23 aa, Cryptosporidium parvum
YSSQCLLRRLPVIQDNTSRQLVM

SEQ ID NO: 2337593 - protein, 25 aa, Cryptosporidium parvum
YSTDFKGKVKLVFEEALTIIEDYVR

SEQ ID NO: 2337594 - protein, 18 aa, Cryptosporidium parvum
YSVCTLKYNEDFNYFKFI

SEQ ID NO: 2337595 - protein, 21 aa, Cryptosporidium parvum
YSVVREVFFGIILYCLPNVSR

SEQ ID NO: 2337596 - protein, 18 aa, Cryptosporidium parvum
YTDFLIWLIAQPPKVIKF

SEQ ID NO: 2337597 - protein, 17 aa, Cryptosporidium parvum
YTEMVRFYKTFTPSTLR

SEQ ID NO: 2337598 - protein, 21 aa, Cryptosporidium parvum
YTNGFFTFWVTYSKIKSSYTI

SEQ ID NO: 2337599 - protein, 26 aa, Cryptosporidium parvum
YTNSTNLDSSKVLLGNDSTVKSSSFF

SEQ ID NO: 2337600 - protein, 26 aa, Cryptosporidium parvum
YTPCSRCKARVRTIFRTSYKVRCPGQ

SEQ ID NO: 2337601 - protein, 18 aa, Cryptosporidium parvum
YTTPIAMLLPLFRPTSMD

SEQ ID NO: 2337602 - protein, 26 aa, Cryptosporidium parvum
YVAFFFIKCKKWSYDVEKKKCLIKSG

SEQ ID NO: 2337603 - protein, 17 aa, Cryptosporidium parvum
YVYGIKQVRIFSNTMRS

SEQ ID NO: 2337604 - protein, 18 aa, Cryptosporidium parvum
YVYPLGYAPSMSKFNQYK

SEQ ID NO: 2337605 - protein, 19 aa, Cryptosporidium parvum
YWDLCSFVQEFYKFSTDLP

SEQ ID NO: 2337606 - protein, 24 aa, Cryptosporidium parvum
YWEYLPRNKFSILINADNSKAREE

SEQ ID NO: 2337607 - protein, 34 aa, Cryptosporidium parvum; identical to SEQ ID NO: 2208737

SEQ ID NO: 2337608 - protein, 18 aa, Cryptosporidium parvum
YWQYFGSSSKLFISYQSQ

SEQ ID NO: 2337609 - protein, 20 aa, Cryptosporidium parvum
YWTGIKWICTRNDSSNTILG

SEQ ID NO: 2337610 - protein, 18 aa, Cryptosporidium parvum
YWTPFGIDPALLKKDIDS

SEQ ID NO: 2337611 - protein, 22 aa, Cryptosporidium parvum
YYQLKDGRRGNAIDPIKRLPFR

SEQ ID NO: 2337612 - protein, 17 aa, Cryptosporidium parvum
YYVSFLPEGGERCQELL

SEQ ID NO: 2337613 - protein, 17 aa, Cryptosporidium parvum
YYYSDKGLDAWSPNEND

SEQ ID NO: 2337614 - protein, 17 aa, Cryptosporidium parvum
PNHGFIPLFMVENSTET

SEQ ID NO: 2337615 - protein, 18 aa, Cryptosporidium parvum
STYPKGYFAFWLTYDSAT

SEQ ID NO: 2337616 - protein, 18 aa, Cryptosporidium parvum
ACCSCSKSGNTKEPKPEK

SEQ ID NO: 2337617 - protein, 17 aa, Cryptosporidium parvum
ACFKRIILWHYEKVELI

SEQ ID NO: 2337618 - protein, 19 aa, Cryptosporidium parvum
ACGRYSFMFHCEVVEISKE

SEQ ID NO: 2337619 - protein, 17 aa, Cryptosporidium parvum
AEDYYRYALNSMKMAKD

SEQ ID NO: 2337620 - protein, 21 aa, Cryptosporidium parvum
AGMKIPFYLRQELIQLSNITP

SEQ ID NO: 2337621 - protein, 18 aa, Cryptosporidium parvum
AILPKWRDSWQDEIRKPS

SEQ ID NO: 2337622 - protein, 19 aa, Cryptosporidium parvum
AKLAWLCIFLVLLFLTINQ

SEQ ID NO: 2337623 - protein, 26 aa, Cryptosporidium parvum
AKQELNGIMRGCMWCTQEVMCNTLSS

SEQ ID NO: 2337624 - protein, 17 aa, Cryptosporidium parvum
ALIETRGPFIIINEEGE

SEQ ID NO: 2337625 - protein, 18 aa, Cryptosporidium parvum
ALLRLGIDPKVIKRMNSL

SEQ ID NO: 2337626 - protein, 17 aa, Cryptosporidium parvum
ALLVFFVATNAVRIRGG

SEQ ID NO: 2337627 - protein, 18 aa, Cryptosporidium parvum
ALSLFRVLKYLYKGHTTG

SEQ ID NO: 2337628 - protein, 19 aa, Cryptosporidium parvum
APEPIRVWCDIKFGASYYI

SEQ ID NO: 2337629 - protein, 18 aa, Cryptosporidium parvum
APGSRLTGLLVHTSTKIP

SEQ ID NO: 2337630 - protein, 19 aa, Cryptosporidium parvum
AQLFLKYRSSILILVLVFL

SEQ ID NO: 2337631 - protein, 17 aa, Cryptosporidium parvum
ARISLRLEAQYSLAHSL

SEQ ID NO: 2337632 - protein, 17 aa, Cryptosporidium parvum
ARLLPLFSFVSRYSTIN

SEQ ID NO: 2337633 - protein, 18 aa, Cryptosporidium parvum
ASEFLIRGIMSFIFYLSK

SEQ ID NO: 2337634 - protein, 17 aa, Cryptosporidium parvum
ATFPFCFENVEFPLDPT

SEQ ID NO: 2337635 - protein, 25 aa, Cryptosporidium parvum
CDGHLSFRLPLNHSFERSDIILSGK

SEQ ID NO: 2337636 - protein, 18 aa, Cryptosporidium parvum
CDHIRSSLNISKPIMENN

SEQ ID NO: 2337637 - protein, 18 aa, Cryptosporidium parvum
CDSRWCKMRENPSEKFED

SEQ ID NO: 2337638 - protein, 17 aa, Cryptosporidium parvum
CFLMLGFEVEFLENPIL

SEQ ID NO: 2337639 - protein, 17 aa, Cryptosporidium parvum
CGFRKLFCLGSGDYGEG

SEQ ID NO: 2337640 - protein, 23 aa, Cryptosporidium parvum
CHITCPREYAPVCATDAETYENL

SEQ ID NO: 2337641 - protein, 23 aa, Cryptosporidium parvum
CIPDLRPILSFLLADFGVYIPLS

SEQ ID NO: 2337642 - protein, 18 aa, Cryptosporidium parvum
CNYPRKGMEWDIYTKTVN

SEQ ID NO: 2337643 - protein, 19 aa, Cryptosporidium parvum
CPNAGFVVVCQFDSAVNLN

SEQ ID NO: 2337644 - protein, 19 aa, Cryptosporidium parvum
CPNGYRIIGIDAIVGDQIT

SEQ ID NO: 2337645 - protein, 25 aa, Cryptosporidium parvum
CSIEWKNRFFFGFALREHYGPIPLN

SEQ ID NO: 2337646 - protein, 17 aa, Cryptosporidium parvum
CSLTCPVGYRMKDLTKM

SEQ ID NO: 2337647 - protein, 21 aa, Cryptosporidium parvum
DEGYPLFKWMESVMNLKNPGD

SEQ ID NO: 2337648 - protein, 19 aa, Cryptosporidium parvum
DFEKLRISYNLPIMNINGN

SEQ ID NO: 2337649 - protein, 20 aa, Cryptosporidium parvum
DGFFDIFAFYFFKDYAAIQY

SEQ ID NO: 2337650 - protein, 19 aa, Cryptosporidium parvum
DIRYEICKFGMIHKSGCKI

SEQ ID NO: 2337651 - protein, 23 aa, Cryptosporidium parvum
DITFKEFWTLFVISSTGIPNKGS

SEQ ID NO: 2337652 - protein, 18 aa, Cryptosporidium parvum
DKIVKFFFEKRLKNYQEQ

SEQ ID NO: 2337653 - protein, 18 aa, Cryptosporidium parvum
DLALCIKGALQLNNTVTS

SEQ ID NO: 2337654 - protein, 24 aa, Cryptosporidium parvum
DQLIKWRLELIPSILNIFQSPLSK

SEQ ID NO: 2337655 - protein, 18 aa, Cryptosporidium parvum
DRFVNGFSSIELENNNSG

SEQ ID NO: 2337656 - protein, 44 aa, Cryptosporidium parvum
DSTVKSSSFFNPMDLSHPFFQMKEQFFRPFRPVTTTTTTTTTTT

SEQ ID NO: 2337657 - protein, 18 aa, Cryptosporidium parvum
DYSCLRISILSLKSEVCE

SEQ ID NO: 2337658 - protein, 17 aa, Cryptosporidium parvum
ECISCSYSLLPKSVQIG

SEQ ID NO: 2337659 - protein, 19 aa, Cryptosporidium parvum
EEKNIFGIYIFKNRMALQD

SEQ ID NO: 2337660 - protein, 21 aa, Cryptosporidium parvum
EGLCLKKLPGITWKMETILAQ

SEQ ID NO: 2337661 - protein, 27 aa, Cryptosporidium parvum
EGYFYKWEAILKMLKKRLESLIRRFEA

SEQ ID NO: 2337662 - protein, 17 aa, Cryptosporidium parvum
EIGCSFHSIGWISGSRD

SEQ ID NO: 2337663 - protein, 20 aa, Cryptosporidium parvum
EIHHPPKLLFFFGSINKFEA

SEQ ID NO: 2337664 - protein, 20 aa, Cryptosporidium parvum
EKYLIMSIGFAFKRKITRNR

SEQ ID NO: 2337665 - protein, 19 aa, Cryptosporidium parvum
ELIKWIKFVSERSSLKEVE

SEQ ID NO: 2337666 - protein, 21 aa, Cryptosporidium parvum
ENGKYWFGFRFEDENNNKLLS

SEQ ID NO: 2337667 - protein, 21 aa, Cryptosporidium parvum
ENHLLNWRFDIMPMHKVIIPK

SEQ ID NO: 2337668 - protein, 19 aa, Cryptosporidium parvum
ENNKRPKIRLGLLEDINDL

SEQ ID NO: 2337669 - protein, 18 aa, Cryptosporidium parvum
ENNTRNALDYGDLNDPGF

SEQ ID NO: 2337670 - protein, 23 aa, Cryptosporidium parvum
ENTFKIIFFWGMKDDVVPFPPAL

SEQ ID NO: 2337671 - protein, 20 aa, Cryptosporidium parvum
EPRTVSGIVINWASSPGEVR

SEQ ID NO: 2337672 - protein, 19 aa, Cryptosporidium parvum
EQILKCLMLLRLDKYSRKI

SEQ ID NO: 2337673 - protein, 21 aa, Cryptosporidium parvum
ERIFEMFKTYSLRLLPNSLRA

SEQ ID NO: 2337674 - protein, 20 aa, Cryptosporidium parvum
ESKLRIGLFGVEVPKTANNF

SEQ ID NO: 2337675 - protein, 19 aa, Cryptosporidium parvum
ESWIGDGWCDKECFSDDCG

SEQ ID NO: 2337676 - protein, 18 aa, Cryptosporidium parvum
ETALQWWVDYGDGGKKPK

SEQ ID NO: 2337677 - protein, 18 aa, Cryptosporidium parvum
ETKRLGVFQIHMNDHPYE

SEQ ID NO: 2337678 - protein, 19 aa, Cryptosporidium parvum
EVGCTYHALGWISGDVNVV

SEQ ID NO: 2337679 - protein, 24 aa, Cryptosporidium parvum
EVSKAFDFILKFNLKLFPKGSPNN

SEQ ID NO: 2337680 - protein, 17 aa, Cryptosporidium parvum
EVVSTPGERLVSMFRKS

SEQ ID NO: 2337681 - protein, 23 aa, Cryptosporidium parvum
EVYGESGWGWFSRKFMSFMRIIR

SEQ ID NO: 2337682 - protein, 22 aa, Cryptosporidium parvum
EYLECRFDFVVPRKACVNDCFQ

SEQ ID NO: 2337683 - protein, 19 aa, Cryptosporidium parvum
EYLPRNKFSILINADNSKA

SEQ ID NO: 2337684 - protein, 20 aa, Cryptosporidium parvum
FGIGWSRLGIFVVNSRNEAL

SEQ ID NO: 2337685 - protein, 18 aa, Cryptosporidium parvum
FIEACIRPYVSFKGNEIM

SEQ ID NO: 2337686 - protein, 17 aa, Cryptosporidium parvum
FIFICIFLVFCKLPYIS

SEQ ID NO: 2337687 - protein, 19 aa, Cryptosporidium parvum
FIHKGGKCIYNYNSRIDEY

SEQ ID NO: 2337688 - protein, 18 aa, Cryptosporidium parvum
FIIEKECNCINKINHLGN

SEQ ID NO: 2337689 - protein, 18 aa, Cryptosporidium parvum
FIQSEAFCLLSMSPFTSQ

SEQ ID NO: 2337690 - protein, 17 aa, Cryptosporidium parvum
FISCGGPYPGGKTLSSS

SEQ ID NO: 2337691 - protein, 17 aa, Cryptosporidium parvum
FKEGWTLFVILSTGVPD

SEQ ID NO: 2337692 - protein, 19 aa, Cryptosporidium parvum
FKFLEFKGIPILNKNSKDI

SEQ ID NO: 2337693 - protein, 20 aa, Cryptosporidium parvum
FKGLCGRVMHGSMLISSIGF

SEQ ID NO: 2337694 - protein, 17 aa, Cryptosporidium parvum
FKKPCKGHNAIIKDSQF

SEQ ID NO: 2337695 - protein, 19 aa, Cryptosporidium parvum
FKRLFKKPSCIKCVKSKKQ

SEQ ID NO: 2337696 - protein, 18 aa, Cryptosporidium parvum
FKTYSLRLLPNSLRAFPI

SEQ ID NO: 2337697 - protein, 17 aa, Cryptosporidium parvum
FLFSGGFLFPGNTLYEG

SEQ ID NO: 2337698 - protein, 17 aa, Cryptosporidium parvum
FLLKWIIFSYIVINNIN

SEQ ID NO: 2337699 - protein, 17 aa, Cryptosporidium parvum
FLLLFFTKYLKITIGAE

SEQ ID NO: 2337700 - protein, 17 aa, Cryptosporidium parvum
FLLLLSRNARLIENNLG

SEQ ID NO: 2337701 - protein, 24 aa, Cryptosporidium parvum
FLYPNIFLFKGYETCGLYEECSTS

SEQ ID NO: 2337702 - protein, 23 aa, Cryptosporidium parvum
FNDFIARINLEFQRSNRLNSKEF

SEQ ID NO: 2337703 - protein, 19 aa, Cryptosporidium parvum
FNNCMWNIWIGQLSGEFVN

SEQ ID NO: 2337704 - protein, 18 aa, Cryptosporidium parvum
FPCILKIIPQYIFNARDP

SEQ ID NO: 2337705 - protein, 20 aa, Cryptosporidium parvum
FPTDIPQVFTIKSVPKAWDH

SEQ ID NO: 2337706 - protein, 19 aa, Cryptosporidium parvum
FQIFETWNRLVSILPFVLH

SEQ ID NO: 2337707 - protein, 17 aa, Cryptosporidium parvum
FQSTLSFEFLRDIVRFL

SEQ ID NO: 2337708 - protein, 20 aa, Cryptosporidium parvum
FRNYCFAFVWTLWKSGNEPD

SEQ ID NO: 2337709 - protein, 21 aa, Cryptosporidium parvum
FSIGIGWSRLGLFILNEYGDG

SEQ ID NO: 2337710 - protein, 21 aa, Cryptosporidium parvum
FSNRVCLFETFKLIKENRNSQ

SEQ ID NO: 2337711 - protein, 18 aa, Cryptosporidium parvum
FSSFFAYECSSAFEQQAS

SEQ ID NO: 2337712 - protein, 17 aa, Cryptosporidium parvum
FVGRGKIPAGINLGSSI

SEQ ID NO: 2337713 - protein, 19 aa, Cryptosporidium parvum
FYVPWCVYCRGIMPEFEKA

SEQ ID NO: 2337714 - protein, 19 aa, Cryptosporidium parvum
GCAAPCPYQRYFIQTDRVL

SEQ ID NO: 2337715 - protein, 18 aa, Cryptosporidium parvum
GCCSCCSCSSKRTKTKKG

SEQ ID NO: 2337716 - protein, 17 aa, Cryptosporidium parvum
GCPCSRNIFSLECSCSV

SEQ ID NO: 2337717 - protein, 17 aa, Cryptosporidium parvum
GEIPYGITFEGLHRKPT

SEQ ID NO: 2337718 - protein, 20 aa, Cryptosporidium parvum
GELWIPFAISQIIYRKSKVL

SEQ ID NO: 2337719 - protein, 20 aa, Cryptosporidium parvum
GFSLYMIFIFLLGNVASIHI

SEQ ID NO: 2337720 - protein, 18 aa, Cryptosporidium parvum
GGIPICLILQYPLECLRR

SEQ ID NO: 2337721 - protein, 23 aa, Cryptosporidium parvum
GGISLKFYIRMCTNLINHFPRLH

SEQ ID NO: 2337722 - protein, 17 aa, Cryptosporidium parvum
GGRKPNCPLGRRGGVRG

SEQ ID NO: 2337723 - protein, 18 aa, Cryptosporidium parvum
GINWKGVKIMALKFLRGN

SEQ ID NO: 2337724 - protein, 19 aa, Cryptosporidium parvum
GKDSSQCLARYKLIRERLL

SEQ ID NO: 2337725 - protein, 21 aa, Cryptosporidium parvum
GKGGFLSRLFGFFGRNNSGKK

SEQ ID NO: 2337726 - protein, 19 aa, Cryptosporidium parvum
GKTRFSIPMLKLGELLEQN

SEQ ID NO: 2337727 - protein, 17 aa, Cryptosporidium parvum
GNCRTWMIGNGICDNSC

SEQ ID NO: 2337728 - protein, 26 aa, Cryptosporidium parvum
GRLFLPILVIFSFVWLSESVRLENYE

SEQ ID NO: 2337729 - protein, 22 aa, Cryptosporidium parvum
GRPFMPFKFTFGRDVYEMRNNC

SEQ ID NO: 2337730 - protein, 20 aa, Cryptosporidium parvum
GSCIFCFSIFLTLYSRIQCQ

SEQ ID NO: 2337731 - protein, 21 aa, Cryptosporidium parvum
GSIALCFLAFIIFFVVKVGGT

SEQ ID NO: 2337732 - protein, 18 aa, Cryptosporidium parvum
GVQARLLPLFSFVSRYST

SEQ ID NO: 2337733 - protein, 18 aa, Cryptosporidium parvum
GYFAFWLTLDSINKKYIV

SEQ ID NO: 2337734 - protein, 17 aa, Cryptosporidium parvum
GYFAFWLTYDEDNDLYE

SEQ ID NO: 2337735 - protein, 17 aa, Cryptosporidium parvum
HKILKYSTCIGELKHGE

SEQ ID NO: 2337736 - protein, 22 aa, Cryptosporidium parvum
HVNVCAIVKAVGRQPDGGLILL

SEQ ID NO: 2337737 - protein, 22 aa, Cryptosporidium parvum
IALIISCLFCDIYAAEAPEENS

SEQ ID NO: 2337738 - protein, 18 aa, Cryptosporidium parvum
ICKEAGYSTGRWDVYNDR

SEQ ID NO: 2337739 - protein, 19 aa, Cryptosporidium parvum
IDLPGMPLSTEYTNSTNLD

SEQ ID NO: 2337740 - protein, 17 aa, Cryptosporidium parvum
IDLRLNVVYPVGHFLGI

SEQ ID NO: 2337741 - protein, 17 aa, Cryptosporidium parvum
IETRGPFIIINEEGEEN

SEQ ID NO: 2337742 - protein, 19 aa, Cryptosporidium parvum
IEVPLDWQSRVFIKYYPEE

SEQ ID NO: 2337743 - protein, 18 aa, Cryptosporidium parvum
IFERCFASEFLIRGIMSF

SEQ ID NO: 2337744 - protein, 24 aa, Cryptosporidium parvum
IFLVFCKLPYISRCEQLESEEIST

SEQ ID NO: 2337745 - protein, 18 aa, Cryptosporidium parvum
IFYFVLGLILDFGKVSCI

SEQ ID NO: 2337746 - protein, 17 aa, Cryptosporidium parvum
IGIKILLKFPRRYNKGI

SEQ ID NO: 2337747 - protein, 18 aa, Cryptosporidium parvum
IGLGWSRLGFFLLNKDSE

SEQ ID NO: 2337748 - protein, 20 aa, Cryptosporidium parvum
IGLLRYGFLYALINEINNQF

SEQ ID NO: 2337749 - protein, 23 aa, Cryptosporidium parvum
IHKSGCKIVPFSTLLSLPRHSFE

SEQ ID NO: 2337750 - protein, 17 aa, Cryptosporidium parvum
IIFKLKLGKIIKNENKK

SEQ ID NO: 2337751 - protein, 22 aa, Cryptosporidium parvum
IIFSILICKVRLEVVIENEDPK

SEQ ID NO: 2337752 - protein, 19 aa, Cryptosporidium parvum
IILCCNICFTFEKQEYAFI

SEQ ID NO: 2337753 - protein, 24 aa, Cryptosporidium parvum
IILPKEAWEIWGLVYSYGGGGHIP

SEQ ID NO: 2337754 - protein, 21 aa, Cryptosporidium parvum
IISELCYLKFPGFSQNSKLTI

SEQ ID NO: 2337755 - protein, 17 aa, Cryptosporidium parvum
IISELLLQRGSLKEIKE

SEQ ID NO: 2337756 - protein, 18 aa, Cryptosporidium parvum
IKFTYRWNAPGALKIENE

SEQ ID NO: 2337757 - protein, 17 aa, Cryptosporidium parvum
IKHKFEIATLFIQYFLQ

SEQ ID NO: 2337758 - protein, 18 aa, Cryptosporidium parvum
IKILLKFPRRYNKGIETQ

SEQ ID NO: 2337759 - protein, 19 aa, Cryptosporidium parvum
IKKALDLCGSEISRLNSEV

SEQ ID NO: 2337760 - protein, 17 aa, Cryptosporidium parvum
IKSRARCSGIIVLCKTG

SEQ ID NO: 2337761 - protein, 18 aa, Cryptosporidium parvum
ILFSRLRPFISFQSTFIP

SEQ ID NO: 2337762 - protein, 19 aa, Cryptosporidium parvum
ILIGWSRLGLFLMDNNHNG

SEQ ID NO: 2337763 - protein, 17 aa, Cryptosporidium parvum
ILLPRIFSHGCGTAAKL

SEQ ID NO: 2337764 - protein, 26 aa, Cryptosporidium parvum
IMSFAPKLRPGRMQRRRDLFSEEEIE

SEQ ID NO: 2337765 - protein, 22 aa, Cryptosporidium parvum
INLKLWEEWLLKLDRFQLEQLD

SEQ ID NO: 2337766 - protein, 19 aa, Cryptosporidium parvum
IPNKFRIVNIWNEENPSLR

SEQ ID NO: 2337767 - protein, 17 aa, Cryptosporidium parvum
IPYGITFEGLHRKPTST

SEQ ID NO: 2337768 - protein, 18 aa, Cryptosporidium parvum
IQCNFDWVAFQSLEELKK

SEQ ID NO: 2337769 - protein, 19 aa, Cryptosporidium parvum
IRFVLPDGFTFLKSNDNEL

SEQ ID NO: 2337770 - protein, 17 aa, Cryptosporidium parvum
IRSSERFNNLFSSLIVN

SEQ ID NO: 2337771 - protein, 22 aa, Cryptosporidium parvum
IRYLLSREFLYLFGKFGELDDY

SEQ ID NO: 2337772 - protein, 18 aa, Cryptosporidium parvum
ISKIPGFVRHTIFQGSYD

SEQ ID NO: 2337773 - protein, 22 aa, Cryptosporidium parvum
ISKKCSPGLCSEGCIPQVTPEE

SEQ ID NO: 2337774 - protein, 18 aa, Cryptosporidium parvum
IWLLFRIILEPVNGKNDS

SEQ ID NO: 2337775 - protein, 19 aa, Cryptosporidium parvum
IWPLLQFIYKKCVELRFTV

SEQ ID NO: 2337776 - protein, 17 aa, Cryptosporidium parvum
KAILLLGCIGMSNALTV

SEQ ID NO: 2337777 - protein, 19 aa, Cryptosporidium parvum
KAPPLRRPEGINVESDLVP

SEQ ID NO: 2337778 - protein, 19 aa, Cryptosporidium parvum
KAQAITLFFFLIAFISLNE

SEQ ID NO: 2337779 - protein, 20 aa, Cryptosporidium parvum
KDLVLRYSQFINFPIYIYNP

SEQ ID NO: 2337780 - protein, 18 aa, Cryptosporidium parvum
KEDIETWMNLPLKLKLPV

SEQ ID NO: 2337781 - protein, 17 aa, Cryptosporidium parvum
KEISEWQRIRYKTEQWK

SEQ ID NO: 2337782 - protein, 17 aa, Cryptosporidium parvum
KGLPLNINEEAMYSPEN

SEQ ID NO: 2337783 - protein, 17 aa, Cryptosporidium parvum
KGMEWDIYTKTVNTKLN

SEQ ID NO: 2337784 - protein, 19 aa, Cryptosporidium parvum
KGYFAFWLTYEPIRKMYSI

SEQ ID NO: 2337785 - protein, 24 aa, Cryptosporidium parvum
KIENGWRFKYIFPIGHSPSVSSFV

SEQ ID NO: 2337786 - protein, 19 aa, Cryptosporidium parvum
KIPSLWYLELIYCMHRGVT

SEQ ID NO: 2337787 - protein, 17 aa, Cryptosporidium parvum
KISWLMERCFIYTKKKD

SEQ ID NO: 2337788 - protein, 19 aa, Cryptosporidium parvum
KITCFRILRKLYREGSVSL

SEQ ID NO: 2337789 - protein, 18 aa, Cryptosporidium parvum
KIYLAINFFFPFENKKMA

SEQ ID NO: 2337790 - protein, 19 aa, Cryptosporidium parvum
KKDYLEFIDALTFDQFYKY

SEQ ID NO: 2337791 - protein, 24 aa, Cryptosporidium parvum
KKEEECFRFFPTYFSELGETELTG

SEQ ID NO: 2337792 - protein, 26 aa, Cryptosporidium parvum
KKFKCPRLIASFLRDRILGYSCPYLS

SEQ ID NO: 2337793 - protein, 17 aa, Cryptosporidium parvum
KKKSWRKKTRKFKLEFL

SEQ ID NO: 2337794 - protein, 19 aa, Cryptosporidium parvum
KKLEVIFSIISFLFLRSFE

SEQ ID NO: 2337795 - protein, 17 aa, Cryptosporidium parvum
KKLLNCLSICLGLSLIG

SEQ ID NO: 2337796 - protein, 24 aa, Cryptosporidium parvum
KKPELRLMKSLSFEGSEKSSHCHH

SEQ ID NO: 2337797 - protein, 24 aa, Cryptosporidium parvum
KKYPEAYHPLALEIFSTISKEDIE

SEQ ID NO: 2337798 - protein, 17 aa, Cryptosporidium parvum
KLKLPVINYYFLLVATM

SEQ ID NO: 2337799 - protein, 20 aa, Cryptosporidium parvum
KLQFLEMFSRGGLESRAKPE

SEQ ID NO: 2337800 - protein, 23 aa, Cryptosporidium parvum
KNIKENIPFKHILLPFTTTTTTV

SEQ ID NO: 2337801 - protein, 17 aa, Cryptosporidium parvum
KNTFIFKNRYEEMKNTQ

SEQ ID NO: 2337802 - protein, 25 aa, Cryptosporidium parvum
KNYARWAVSFLKGWISSRNPFRYLC

SEQ ID NO: 2337803 - protein, 17 aa, Cryptosporidium parvum
KPLMKISCAEYFGISVF

SEQ ID NO: 2337804 - protein, 17 aa, Cryptosporidium parvum
KRFRSFRIHCDFHQGNI

SEQ ID NO: 2337805 - protein, 17 aa, Cryptosporidium parvum
KRGFRPITFHMMHDTSR

SEQ ID NO: 2337806 - protein, 21 aa, Cryptosporidium parvum
KRKRKSIGLVFRKSSYTDSFC

SEQ ID NO: 2337807 - protein, 18 aa, Cryptosporidium parvum
KRLIAWRRSYIPSSIHLE

SEQ ID NO: 2337808 - protein, 18 aa, Cryptosporidium parvum
KSLFGIEGEDGIKIRVNE

SEQ ID NO: 2337809 - protein, 20 aa, Cryptosporidium parvum
KSLLFIPSHPPFDMFDTYMG

SEQ ID NO: 2337810 - protein, 22 aa, Cryptosporidium parvum
KSPSYKDRLLSFFGSNGGSMFG

SEQ ID NO: 2337811 - protein, 19 aa, Cryptosporidium parvum
KTFGGQCLVQITSLQSTNA

SEQ ID NO: 2337812 - protein, 18 aa, Cryptosporidium parvum
KVDHAMVITGWGWETYGN

SEQ ID NO: 2337813 - protein, 18 aa, Cryptosporidium parvum
KYRGCYVKGILQPSRAIG

SEQ ID NO: 2337814 - protein, 21 aa, Cryptosporidium parvum
KYRKCKYWSWRATDFSCSLKS

SEQ ID NO: 2337815 - protein, 18 aa, Cryptosporidium parvum
LCKYELSNLLTLIKKLNL

SEQ ID NO: 2337816 - protein, 18 aa, Cryptosporidium parvum
LCRRLCCCRGNGNDLSTQ

SEQ ID NO: 2337817 - protein, 20 aa, Cryptosporidium parvum
LETGCVLMGGLIAFGSSPFM

SEQ ID NO: 2337818 - protein, 24 aa, Cryptosporidium parvum
LEYPCPRSTPGLNWMISSKLVDTG

SEQ ID NO: 2337819 - protein, 21 aa, Cryptosporidium parvum
LFCLGCISVIPGIKNQLVNSM

SEQ ID NO: 2337820 - protein, 18 aa, Cryptosporidium parvum
LFERFILRHIEWLKIIIK

SEQ ID NO: 2337821 - protein, 17 aa, Cryptosporidium parvum
LFFFAIYIMIGISNASD

SEQ ID NO: 2337822 - protein, 17 aa, Cryptosporidium parvum
LFRDLKHIFGFGNPKIF

SEQ ID NO: 2337823 - protein, 17 aa, Cryptosporidium parvum
LFSYSALLLKFSYFFNE

SEQ ID NO: 2337824 - protein, 19 aa, Cryptosporidium parvum
LFYILHCCDIPEFFEDRIG

SEQ ID NO: 2337825 - protein, 23 aa, Cryptosporidium parvum
LHMFSSQFYLYWSLSTPHLGCIS

SEQ ID NO: 2337826 - protein, 25 aa, Cryptosporidium parvum
LHSSIIKFCFKFGIFYILKSQLNKK

SEQ ID NO: 2337827 - protein, 17 aa, Cryptosporidium parvum
LIAFFLFFGVSLIEGKN

SEQ ID NO: 2337828 - protein, 19 aa, Cryptosporidium parvum
LIFTIILCCNICFTFEKQE

SEQ ID NO: 2337829 - protein, 18 aa, Cryptosporidium parvum
LIHFCLAGNFLVVNNAAN

SEQ ID NO: 2337830 - protein, 27 aa, Cryptosporidium parvum
LIKSSRLSNGFVCMGILNGTEIWSREF

SEQ ID NO: 2337831 - protein, 20 aa, Cryptosporidium parvum
LIQAYRMLLIYSVLLDDAGI

SEQ ID NO: 2337832 - protein, 18 aa, Cryptosporidium parvum
LKGSFLWWSSYFDSAINE

SEQ ID NO: 2337833 - protein, 19 aa, Cryptosporidium parvum
LKLLWRYISPHLIEIDIGG

SEQ ID NO: 2337834 - protein, 18 aa, Cryptosporidium parvum
LKLREFEKILSLKHSAAR

SEQ ID NO: 2337835 - protein, 17 aa, Cryptosporidium parvum
LKLSAQCNDCWAKTAHC

SEQ ID NO: 2337836 - protein, 25 aa, Cryptosporidium parvum
LKLYEEFRIGLNLQQRIKLNSELDL

SEQ ID NO: 2337837 - protein, 19 aa, Cryptosporidium parvum
LKSLFFFLELSLIITNSST

SEQ ID NO: 2337838 - protein, 19 aa, Cryptosporidium parvum
LKSYLALRLPDKFAQPSNS

SEQ ID NO: 2337839 - protein, 19 aa, Cryptosporidium parvum
LKYRSSILILVLVFLAILD

SEQ ID NO: 2337840 - protein, 17 aa, Cryptosporidium parvum
LLEEIRSGVKLKPTGSS

SEQ ID NO: 2337841 - protein, 19 aa, Cryptosporidium parvum
LLFCYIYLVAAINGTKRKR

SEQ ID NO: 2337842 - protein, 17 aa, Cryptosporidium parvum
LLFIAISLLFISKVKSS

SEQ ID NO: 2337843 - protein, 19 aa, Cryptosporidium parvum
LLFSWPRTRLRKSLLDSNR

SEQ ID NO: 2337844 - protein, 23 aa, Cryptosporidium parvum
LLIRMRLLHIFWLFTQIVLAFSA

SEQ ID NO: 2337845 - protein, 18 aa, Cryptosporidium parvum
LLLIFLIQISWLKNSLVL

SEQ ID NO: 2337846 - protein, 18 aa, Cryptosporidium parvum
LLNLWFTYSFVSGNDLDS

SEQ ID NO: 2337847 - protein, 17 aa, Cryptosporidium parvum
LLPLFSFVSRYSTINES

SEQ ID NO: 2337848 - protein, 17 aa, Cryptosporidium parvum
LLVKAGIVKIRLKNLKM

SEQ ID NO: 2337849 - protein, 17 aa, Cryptosporidium parvum
LNALRIFEKISARAFVL

SEQ ID NO: 2337850 - protein, 17 aa, Cryptosporidium parvum
LNIKFTYRWNAPGALKI

SEQ ID NO: 2337851 - protein, 18 aa, Cryptosporidium parvum
LPFWIFKVSDEFSIILIE

SEQ ID NO: 2337852 - protein, 32 aa, Cryptosporidium parvum; identical to SEQ ID NO: 2208911

SEQ ID NO: 2337853 - protein, 18 aa, Cryptosporidium parvum
LPSGRPFMPFKFTFGRDV

SEQ ID NO: 2337854 - protein, 21 aa, Cryptosporidium parvum
LPVEFWRTIFVQQLHSFNLYS

SEQ ID NO: 2337855 - protein, 18 aa, Cryptosporidium parvum
LRECFKLELELISLNYIY

SEQ ID NO: 2337856 - protein, 17 aa, Cryptosporidium parvum
LRLLWSLNSVRCKIEDC

SEQ ID NO: 2337857 - protein, 22 aa, Cryptosporidium parvum
LRTSFREGCRFVHFLKNKGSLP

SEQ ID NO: 2337858 - protein, 17 aa, Cryptosporidium parvum
LSEVLAMHLRMRNRIVS

SEQ ID NO: 2337859 - protein, 19 aa, Cryptosporidium parvum
LSIGTACTGGFGYFDKTND

SEQ ID NO: 2337860 - protein, 23 aa, Cryptosporidium parvum
LTLRKLRIIPGIIFRVKLSGSPI

SEQ ID NO: 2337861 - protein, 17 aa, Cryptosporidium parvum
LTLSLLAGFVFGTNENP

SEQ ID NO: 2337862 - protein, 23 aa, Cryptosporidium parvum
LTYRTYCSLDFSSFIFNMKQYID

SEQ ID NO: 2337863 - protein, 18 aa, Cryptosporidium parvum
LVCSSGFVLLGDRCALFT

SEQ ID NO: 2337864 - protein, 20 aa, Cryptosporidium parvum
LVFSCLLCFFAAVESSVNKI

SEQ ID NO: 2337865 - protein, 22 aa, Cryptosporidium parvum
LVSYELFSAILLGKEGNNGANK

SEQ ID NO: 2337866 - protein, 17 aa, Cryptosporidium parvum
LVYRYRLSHLISTAYHL

SEQ ID NO: 2337867 - protein, 17 aa, Cryptosporidium parvum
LWFTYSFVSGNDLDSKK

SEQ ID NO: 2337868 - protein, 24 aa, Cryptosporidium parvum
LYLPFLQGIHVCRSYPNTNCTKKN

SEQ ID NO: 2337869 - protein, 18 aa, Cryptosporidium parvum
MDVRIRFDDFSGFDLLLG

SEQ ID NO: 2337870 - protein, 18 aa, Cryptosporidium parvum
MEFYRYAVLLSMSLIKDK

SEQ ID NO: 2337871 - protein, 18 aa, Cryptosporidium parvum
MEKFRFLYIISEPSLDGK

SEQ ID NO: 2337872 - protein, 18 aa, Cryptosporidium parvum
MIKELIKLLIMLNNVSEK

SEQ ID NO: 2337873 - protein, 21 aa, Cryptosporidium parvum
MLKKRLESLIRRFEALGCEGP

SEQ ID NO: 2337874 - protein, 18 aa, Cryptosporidium parvum
MLSDSVWREDLCTSNISP

SEQ ID NO: 2337875 - protein, 17 aa, Cryptosporidium parvum
MPLSTEYTNSTNLDSSK

SEQ ID NO: 2337876 - protein, 18 aa, Cryptosporidium parvum
MSCIFEVDLLFKHLNLRN

SEQ ID NO: 2337877 - protein, 24 aa, Cryptosporidium parvum
NDIFKCPNCDLEIFPSENEIEFNS

SEQ ID NO: 2337878 - protein, 19 aa, Cryptosporidium parvum
NDPSTVCSYAFSNEFVNSD

SEQ ID NO: 2337879 - protein, 24 aa, Cryptosporidium parvum
NDYLARLGIKFSILEEYCNNPSVI

SEQ ID NO: 2337880 - protein, 20 aa, Cryptosporidium parvum
NFAFRYLVSRVFGPKAGEAM

SEQ ID NO: 2337881 - protein, 24 aa, Cryptosporidium parvum
NGMDFKIGIGWSKLGLFILNEYSS

SEQ ID NO: 2337882 - protein, 24 aa, Cryptosporidium parvum
NINLLKMNICYPPNIPYSQVKPEK

SEQ ID NO: 2337883 - protein, 17 aa, Cryptosporidium parvum
NKPCTRNTCIIELKKYF

SEQ ID NO: 2337884 - protein, 23 aa, Cryptosporidium parvum
NLKNQICEFSKIFEFYLISISKN

SEQ ID NO: 2337885 - protein, 18 aa, Cryptosporidium parvum
NLLFWKGKDMELIRDHIV

SEQ ID NO: 2337886 - protein, 17 aa, Cryptosporidium parvum
NLPRSWYFLGEKIDEIY

SEQ ID NO: 2337887 - protein, 18 aa, Cryptosporidium parvum
NLRFLRKLIANFIGFQKF

SEQ ID NO: 2337888 - protein, 24 aa, Cryptosporidium parvum
NNQLRCENGIFSPKVYCIAMREIE

SEQ ID NO: 2337889 - protein, 17 aa, Cryptosporidium parvum
NPESLLLLSRLTTKAPP

SEQ ID NO: 2337890 - protein, 18 aa, Cryptosporidium parvum
NSCLSWKTFGYFNLISCY

SEQ ID NO: 2337891 - protein, 17 aa, Cryptosporidium parvum
NVPLRWDIVSGISSGGF

SEQ ID NO: 2337892 - protein, 18 aa, Cryptosporidium parvum
NYLTLPFTRDGHCEKGTI

SEQ ID NO: 2337893 - protein, 20 aa, Cryptosporidium parvum
PCGRCGFGAKCCYQNLCVGR

SEQ ID NO: 2337894 - protein, 19 aa, Cryptosporidium parvum
PCIEFRFLSIPEMDYDAKS

SEQ ID NO: 2337895 - protein, 19 aa, Cryptosporidium parvum
PCTRNTCIIELKKYFLMEK

SEQ ID NO: 2337896 - protein, 19 aa, Cryptosporidium parvum
PEKSCPPGFVFSGKQCVQS

SEQ ID NO: 2337897 - protein, 18 aa, Cryptosporidium parvum
PFFLKAIIAFGFILQLSF

SEQ ID NO: 2337898 - protein, 20 aa, Cryptosporidium parvum
PGIHLHFGYWDGFRGRGNLI

SEQ ID NO: 2337899 - protein, 17 aa, Cryptosporidium parvum
PIFLLFVIFCDFTERSF

SEQ ID NO: 2337900 - protein, 22 aa, Cryptosporidium parvum
PIKARELLLLFFINLGRTSAEE

SEQ ID NO: 2337901 - protein, 18 aa, Cryptosporidium parvum
PISRFNISGIPEFISKAQ

SEQ ID NO: 2337902 - protein, 17 aa, Cryptosporidium parvum
PKAGLMLSSYQLPDGSQ

SEQ ID NO: 2337903 - protein, 17 aa, Cryptosporidium parvum
PKGYFAFWLTYDEDNDL

SEQ ID NO: 2337904 - protein, 22 aa, Cryptosporidium parvum
PLEYMLKLPKGIYRWEEIEPQE

SEQ ID NO: 2337905 - protein, 17 aa, Cryptosporidium parvum
PLIKLPNFNLPIFGIPP

SEQ ID NO: 2337906 - protein, 23 aa, Cryptosporidium parvum
PLKHFKSVLKYLLDIAVNDEPSK

SEQ ID NO: 2337907 - protein, 17 aa, Cryptosporidium parvum
PPFVKWPYRGGSGETLY

SEQ ID NO: 2337908 - protein, 19 aa, Cryptosporidium parvum
PQAPLIYRCRFSGPDLLKN

SEQ ID NO: 2337909 - protein, 20 aa, Cryptosporidium parvum
PRCQCLPGYIGDGRTKGTGC

SEQ ID NO: 2337910 - protein, 17 aa, Cryptosporidium parvum
PRKGMEWDIYTKTVNTK

SEQ ID NO: 2337911 - protein, 25 aa, Cryptosporidium parvum
PRVFYKPKFGWRFFPPNVPDFSRLL

SEQ ID NO: 2337912 - protein, 17 aa, Cryptosporidium parvum
PRYIPTVKIYDSQIEDL

SEQ ID NO: 2337913 - protein, 19 aa, Cryptosporidium parvum
PSLWKSLPLILPKLPTYPE

SEQ ID NO: 2337914 - protein, 18 aa, Cryptosporidium parvum
PSTLRAIFKLSIQADQEA

SEQ ID NO: 2337915 - protein, 19 aa, Cryptosporidium parvum
PTKSFSIGIGWSRLGLFIL

SEQ ID NO: 2337916 - protein, 20 aa, Cryptosporidium parvum
PTQRLPVSQIWRATPLENRP

SEQ ID NO: 2337917 - protein, 18 aa, Cryptosporidium parvum
PVEEIINATFIYPGTQQP

SEQ ID NO: 2337918 - protein, 19 aa, Cryptosporidium parvum
PVSQIWRATPLENRPEDSL

SEQ ID NO: 2337919 - protein, 21 aa, Cryptosporidium parvum
PYFNHFCSLSFIKNLKLIRKN

SEQ ID NO: 2337920 - protein, 17 aa, Cryptosporidium parvum
QDYGQECTFEWMNDLVT

SEQ ID NO: 2337921 - protein, 17 aa, Cryptosporidium parvum
QECTFEWMNDLVTMYYN

SEQ ID NO: 2337922 - protein, 17 aa, Cryptosporidium parvum
QFSIRWDGFLLAPESGR

SEQ ID NO: 2337923 - protein, 18 aa, Cryptosporidium parvum
QILYKGYESCSFFEDCPM

SEQ ID NO: 2337924 - protein, 23 aa, Cryptosporidium parvum
QKPRMRWPLSGARYHPYISNILG

SEQ ID NO: 2337925 - protein, 22 aa, Cryptosporidium parvum
QLKNLRIDWEFPPFTYSIAAKV

SEQ ID NO: 2337926 - protein, 18 aa, Cryptosporidium parvum
QLLLVVAFLFHLFLVLNA

SEQ ID NO: 2337927 - protein, 17 aa, Cryptosporidium parvum
QPLKLSGVNPVFYEIST

SEQ ID NO: 2337928 - protein, 25 aa, Cryptosporidium parvum
QRIALEWIHKYIVNFGGDPNRIILA

SEQ ID NO: 2337929 - protein, 24 aa, Cryptosporidium parvum
QSKARLANIFKRKKLTASEKLERL

SEQ ID NO: 2337930 - protein, 22 aa, Cryptosporidium parvum
QTMCFLKRLFVLAGALFVLICL

SEQ ID NO: 2337931 - protein, 18 aa, Cryptosporidium parvum
RDAVSFAAIPSVTLFCRE

SEQ ID NO: 2337932 - protein, 20 aa, Cryptosporidium parvum
RDLKHIFGFGNPKIFSLNTC

SEQ ID NO: 2337933 - protein, 18 aa, Cryptosporidium parvum
RILLLLSTVSYAYSEKKR

SEQ ID NO: 2337934 - protein, 17 aa, Cryptosporidium parvum
RITFYGCDWTICEREVE

SEQ ID NO: 2337935 - protein, 18 aa, Cryptosporidium parvum
RIWRGGRWTGVCIGLLNL

SEQ ID NO: 2337936 - protein, 19 aa, Cryptosporidium parvum
RKKVRFNLELNQEYPSEVI

SEQ ID NO: 2337937 - protein, 17 aa, Cryptosporidium parvum
RKLCSGPILLLIILSLS

SEQ ID NO: 2337938 - protein, 21 aa, Cryptosporidium parvum
RKPNCPLGRRGGVRGRDNGPK

SEQ ID NO: 2337939 - protein, 22 aa, Cryptosporidium parvum
RLEWPRELILLILSQDFSLSDS

SEQ ID NO: 2337940 - protein, 17 aa, Cryptosporidium parvum
RLGVFQIHMNDHPYEIS

SEQ ID NO: 2337941 - protein, 24 aa, Cryptosporidium parvum
RLLLKAECQWSPWRRETGCSSTCD

SEQ ID NO: 2337942 - protein, 20 aa, Cryptosporidium parvum
RLRRIPIFFRNLFRRNKNKT

SEQ ID NO: 2337943 - protein, 19 aa, Cryptosporidium parvum
RPYGYRGSPMILTQFIENI

SEQ ID NO: 2337944 - protein, 17 aa, Cryptosporidium parvum
RRINLCFIPEGQENTWY

SEQ ID NO: 2337945 - protein, 19 aa, Cryptosporidium parvum
RSKVIPGRLIIKYKEKVLS

SEQ ID NO: 2337946 - protein, 18 aa, Cryptosporidium parvum
RSLICLSFFKLMRFKEVS

SEQ ID NO: 2337947 - protein, 23 aa, Cryptosporidium parvum
RSNWFVKHVCSFISQKLNEINKS

SEQ ID NO: 2337948 - protein, 19 aa, Cryptosporidium parvum
RSSGISFLLSRPVTKLLEQ

SEQ ID NO: 2337949 - protein, 18 aa, Cryptosporidium parvum
RTGLTMTISDIWATAKDI

SEQ ID NO: 2337950 - protein, 17 aa, Cryptosporidium parvum
RVHCDGCSSSLCHLEGA

SEQ ID NO: 2337951 - protein, 18 aa, Cryptosporidium parvum
RWEFVIEWRNVFLKSEQY

SEQ ID NO: 2337952 - protein, 17 aa, Cryptosporidium parvum
RYPEVVSTPGERLVSMF

SEQ ID NO: 2337953 - protein, 24 aa, Cryptosporidium parvum
RYSECGMSFYIEWDVEGILISIDT

SEQ ID NO: 2337954 - protein, 23 aa, Cryptosporidium parvum
SDKIKWSIGFGKNYLLYLNVYDL

SEQ ID NO: 2337955 - protein, 23 aa, Cryptosporidium parvum
SDPEPKCLPGFEFDNKSETCVNR

SEQ ID NO: 2337956 - protein, 20 aa, Cryptosporidium parvum
SEILRILAILEEIEFNSKEV

SEQ ID NO: 2337957 - protein, 22 aa, Cryptosporidium parvum
SEQNVNCFLVFRALPENLKQAT

SEQ ID NO: 2337958 - protein, 24 aa, Cryptosporidium parvum
SFLKLRNGISFGPNLCRRLCCCRG

SEQ ID NO: 2337959 - protein, 18 aa, Cryptosporidium parvum
SFSVKILLFFLTSGYLIF

SEQ ID NO: 2337960 - protein, 18 aa, Cryptosporidium parvum
SIEFEMSEGLGISKDSFF

SEQ ID NO: 2337961 - protein, 18 aa, Cryptosporidium parvum
SKFFPFFISKYIRSLQKS

SEQ ID NO: 2337962 - protein, 18 aa, Cryptosporidium parvum
SKLLRRVLEMKLKRVNHK

SEQ ID NO: 2337963 - protein, 20 aa, Cryptosporidium parvum
SLKLRLIFRFILKSMEVSNA

SEQ ID NO: 2337964 - protein, 18 aa, Cryptosporidium parvum
SLLLLSRLTTKAPPKFLI

SEQ ID NO: 2337965 - protein, 17 aa, Cryptosporidium parvum
SLLYGFSIIGLRSAGGC

SEQ ID NO: 2337966 - protein, 28 aa, Cryptosporidium parvum
SLPCFKFTRREFLPLFSAFFQKKAIRNL

SEQ ID NO: 2337967 - protein, 21 aa, Cryptosporidium parvum
SLRPPVPFQLVQGIEECELEI

SEQ ID NO: 2337968 - protein, 22 aa, Cryptosporidium parvum
SLSLGWSRLGLFLMNSDFNSLI

SEQ ID NO: 2337969 - protein, 17 aa, Cryptosporidium parvum
SMIRFGYLGGYLAVDFL

SEQ ID NO: 2337970 - protein, 21 aa, Cryptosporidium parvum
SMYRKCLRALWDMFQYDDEIN

SEQ ID NO: 2337971 - protein, 18 aa, Cryptosporidium parvum
SNDAFGIGGGDYRRDSDE

SEQ ID NO: 2337972 - protein, 18 aa, Cryptosporidium parvum
SNKFIYPREMLFLGYSIC

SEQ ID NO: 2337973 - protein, 17 aa, Cryptosporidium parvum
SNNFDFYNGYGFDFLFM

SEQ ID NO: 2337974 - protein, 20 aa, Cryptosporidium parvum
SPRTLPIIFTMNLRTRKPYI

SEQ ID NO: 2337975 - protein, 17 aa, Cryptosporidium parvum
SQLPCSWLSNILFSKKV

SEQ ID NO: 2337976 - protein, 20 aa, Cryptosporidium parvum
SQYDLLAILFVVKTRQGEAP

SEQ ID NO: 2337977 - protein, 17 aa, Cryptosporidium parvum
SRFKDFLLRRTINSYLF

SEQ ID NO: 2337978 - protein, 17 aa, Cryptosporidium parvum
SRFNWSFVYEKIRNSLG

SEQ ID NO: 2337979 - protein, 20 aa, Cryptosporidium parvum
SRPGGVFTRPVGYVSPLPYA

SEQ ID NO: 2337980 - protein, 17 aa, Cryptosporidium parvum
SRWTWNRIEKPIFRTNT

SEQ ID NO: 2337981 - protein, 23 aa, Cryptosporidium parvum
SSEIPRLGQYLVFYGHSESTSAA

SEQ ID NO: 2337982 - protein, 18 aa, Cryptosporidium parvum
SSFFKNKPLLLTSTEGVV

SEQ ID NO: 2337983 - protein, 23 aa, Cryptosporidium parvum
SSFNRIFSWVGFMILADKSPNFW

SEQ ID NO: 2337984 - protein, 25 aa, Cryptosporidium parvum
SSRRHCKRILSSIGIVSEEDLSQTL

SEQ ID NO: 2337985 - protein, 24 aa, Cryptosporidium parvum
SSSIPFHLVCHVFESMKASLQKNE

SEQ ID NO: 2337986 - protein, 17 aa, Cryptosporidium parvum
STLRRMLFRAADVGKIK

SEQ ID NO: 2337987 - protein, 18 aa, Cryptosporidium parvum
STYPKGYFAFWLTLDSIN

SEQ ID NO: 2337988 - protein, 18 aa, Cryptosporidium parvum
STYPKGYFAFWLTYDEDN

SEQ ID NO: 2337989 - protein, 18 aa, Cryptosporidium parvum
STYPKGYFAFWLTYDPEI

SEQ ID NO: 2337990 - protein, 18 aa, Cryptosporidium parvum
STYPKGYFAFWLTYDSIT

SEQ ID NO: 2337991 - protein, 18 aa, Cryptosporidium parvum
STYPKGYFAFWLTYDSKY

SEQ ID NO: 2337992 - protein, 18 aa, Cryptosporidium parvum
STYPKGYFAFWLTYDSVT

SEQ ID NO: 2337993 - protein, 18 aa, Cryptosporidium parvum
STYPKGYFAFWLTYEPIR

SEQ ID NO: 2337994 - protein, 17 aa, Cryptosporidium parvum
SYGEVWRGLAFTEYLSE

SEQ ID NO: 2337995 - protein, 21 aa, Cryptosporidium parvum
TCLKEGCAYFIGRSASMTPVL

SEQ ID NO: 2337996 - protein, 18 aa, Cryptosporidium parvum
TDDCAACVTIIERLEKLN

SEQ ID NO: 2337997 - protein, 24 aa, Cryptosporidium parvum
TDPKLRIGLFKGYISLEEMQSRTI

SEQ ID NO: 2337998 - protein, 18 aa, Cryptosporidium parvum
TDSRFCVILIMEKNDFRM

SEQ ID NO: 2337999 - protein, 20 aa, Cryptosporidium parvum
TEMLKLVLLNGTEYALVNNE

SEQ ID NO: 2338000 - protein, 19 aa, Cryptosporidium parvum
TFSKIQFNFCYNMPHLKTT

SEQ ID NO: 2338001 - protein, 18 aa, Cryptosporidium parvum
TFVKLRIKWFNIFVNDYL

SEQ ID NO: 2338002 - protein, 22 aa, Cryptosporidium parvum
TIGIGWSRLGLFIINDDHNSYI

SEQ ID NO: 2338003 - protein, 22 aa, Cryptosporidium parvum
TIGLGWSRLGLFLINENKDSFI

SEQ ID NO: 2338004 - protein, 19 aa, Cryptosporidium parvum
TKAPPKFLISSIKASSNST

SEQ ID NO: 2338005 - protein, 29 aa, Cryptosporidium parvum
TLFFFLLLQFSKYALCEVNTITYSENKSE

SEQ ID NO: 2338006 - protein, 23 aa, Cryptosporidium parvum
TTEVPRLEGCVARPAHCTGGSCS

SEQ ID NO: 2338007 - protein, 17 aa, Cryptosporidium parvum
TTSRPGGVFTRPVGYVS

SEQ ID NO: 2338008 - protein, 18 aa, Cryptosporidium parvum
VAEKYNKKKSWRKKTRKF

SEQ ID NO: 2338009 - protein, 17 aa, Cryptosporidium parvum
VAKCMNRDLQLVANVTC

SEQ ID NO: 2338010 - protein, 23 aa, Cryptosporidium parvum
VCIYILNMLRFIAVINPELSSSF

SEQ ID NO: 2338011 - protein, 17 aa, Cryptosporidium parvum
VCVQRGFFAEALLLAVK

SEQ ID NO: 2338012 - protein, 18 aa, Cryptosporidium parvum
VDDSGACFKRIILWHYEK

SEQ ID NO: 2338013 - protein, 19 aa, Cryptosporidium parvum
VDKVCGRKAFKIYSKNNDG

SEQ ID NO: 2338014 - protein, 24 aa, Cryptosporidium parvum
VFLLLIIIVIFSFNMDDLLLEAAY

SEQ ID NO: 2338015 - protein, 23 aa, Cryptosporidium parvum
VGWCAPECRPTWLGDGQCDIDCF

SEQ ID NO: 2338016 - protein, 19 aa, Cryptosporidium parvum
VICSFLVIFLCLGPEHVEF

SEQ ID NO: 2338017 - protein, 17 aa, Cryptosporidium parvum
VKILLFFLTSGYLIFSP

SEQ ID NO: 2338018 - protein, 18 aa, Cryptosporidium parvum
VKILQEFPHYHIPENHIF

SEQ ID NO: 2338019 - protein, 29 aa, Cryptosporidium parvum
VKVKCGGGFCKRLRRALCCCSGGEEEEQP

SEQ ID NO: 2338020 - protein, 19 aa, Cryptosporidium parvum
VLIAFEFCSVASNGLVGRD

SEQ ID NO: 2338021 - protein, 22 aa, Cryptosporidium parvum
VLNEFKNRFALINSSLNAQLGG

SEQ ID NO: 2338022 - protein, 19 aa, Cryptosporidium parvum
VNVILEFFDIYFLNPEKVF

SEQ ID NO: 2338023 - protein, 18 aa, Cryptosporidium parvum
VQQNHEWYLLAMGQFTQL

SEQ ID NO: 2338024 - protein, 17 aa, Cryptosporidium parvum
VTFKEGWTLFVILSTGV

SEQ ID NO: 2338025 - protein, 19 aa, Cryptosporidium parvum
VVPEPRYIPTVKIYDSQIE

SEQ ID NO: 2338026 - protein, 17 aa, Cryptosporidium parvum
VYEKFVPGRGFDKILQK

SEQ ID NO: 2338027 - protein, 19 aa, Cryptosporidium parvum
VYLEQRFNPIVKAIKSNKY

SEQ ID NO: 2338028 - protein, 20 aa, Cryptosporidium parvum
WSREFCEIVQGFKIDEISCN

SEQ ID NO: 2338029 - protein, 20 aa, Cryptosporidium parvum
WSVGCLFSQMLFRLGTLKTN

SEQ ID NO: 2338030 - protein, 19 aa, Cryptosporidium parvum
WVYRYAWADFAFGVRLKQV

SEQ ID NO: 2338031 - protein, 24 aa, Cryptosporidium parvum
WWNYYGVVVGWDWELNAPKQWADN

SEQ ID NO: 2338032 - protein, 20 aa, Cryptosporidium parvum
WYHKPCGVNFTFSGKLVSFS

SEQ ID NO: 2338033 - protein, 20 aa, Cryptosporidium parvum
WYTWCKRPDFNLIHREVLGD

SEQ ID NO: 2338034 - protein, 27 aa, Cryptosporidium parvum
YEEGKLAGGLAWALGVGKYVCNSKSAF

SEQ ID NO: 2338035 - protein, 18 aa, Cryptosporidium parvum
YELCTRFITTLSITKSVK

SEQ ID NO: 2338036 - protein, 17 aa, Cryptosporidium parvum
YELSNLLTLIKKLNLKA

SEQ ID NO: 2338037 - protein, 19 aa, Cryptosporidium parvum
YEMCLFDCTLLNKKDACEE

SEQ ID NO: 2338038 - protein, 23 aa, Cryptosporidium parvum
YIWECIKRKLLFLGNGYDISNSN

SEQ ID NO: 2338039 - protein, 21 aa, Cryptosporidium parvum
YKKYYCGINMFIVLSSKRSLT

SEQ ID NO: 2338040 - protein, 27 aa, Cryptosporidium parvum
YKLDYKLKFLRRMLRKDKKMIIQIHAL

SEQ ID NO: 2338041 - protein, 22 aa, Cryptosporidium parvum
YLQRFPTLTGFNRAGLSGNERI

SEQ ID NO: 2338042 - protein, 17 aa, Cryptosporidium parvum
YLTFLLSELLKLFQFFG

SEQ ID NO: 2338043 - protein, 20 aa, Cryptosporidium parvum
YNLECPNGFILDRERSSCIS

SEQ ID NO: 2338044 - protein, 23 aa, Cryptosporidium parvum
YPLECLRRSAAVFYFTSEPKSRG

SEQ ID NO: 2338045 - protein, 18 aa, Cryptosporidium parvum
YPREMLFLGYSICSAYND

SEQ ID NO: 2338046 - protein, 17 aa, Cryptosporidium parvum
YRLPIGYIPIARRYQRV

SEQ ID NO: 2338047 - protein, 20 aa, Cryptosporidium parvum
YRTSSPYAFSPLEEERANKL

SEQ ID NO: 2338048 - protein, 17 aa, Cryptosporidium parvum
YRYAVLLSMSLIKDKNV

SEQ ID NO: 2338049 - protein, 21 aa, Cryptosporidium parvum
YSALLLKFSYFFNENVLHEQI

SEQ ID NO: 2338050 - protein, 17 aa, Cryptosporidium parvum
YSALRFAYGNTKAAQSN

SEQ ID NO: 2338051 - protein, 18 aa, Cryptosporidium parvum
YTEEILIYEGFELTIGIA

SEQ ID NO: 2338052 - protein, 19 aa, Cryptosporidium parvum
YTFKIEVMINFSFEAILFA

SEQ ID NO: 2338053 - protein, 19 aa, Cryptosporidium parvum
YVICLCFYYLIKRERIRID

SEQ ID NO: 2338054 - protein, 19 aa, Cryptosporidium parvum
YVRSEPMLHLFFYNSLNKN

SEQ ID NO: 2338055 - protein, 19 aa, Cryptosporidium parvum
YYMKMCLISFPAILGSKSK

SEQ ID NO: 2338056 - protein, 25 aa, Cryptosporidium parvum
YYNEYSFPDYMYIKDVGNLKNSVKI

SEQ ID NO: 2338057 - protein, 23 aa, Cryptosporidium parvum
FNEGWTLFVILSTGVPEYGDNSN

SEQ ID NO: 2338058 - protein, 24 aa, Cryptosporidium parvum
LLFIYFMFLFENVTDDFLVKKEIS

SEQ ID NO: 2338059 - protein, 29 aa, Cryptosporidium parvum
RTPSPNIPPPPSFPAPPPPSIPSGTPSHT

SEQ ID NO: 2338060 - protein, 29 aa, Cryptosporidium parvum
YCSTYPKGYFAFWLTYDSATSKYIISVEN

SEQ ID NO: 2338061 - protein, 27 aa, Cryptosporidium parvum
AAIMRDIDWIFVIGHFPCYSSGEHGDN

SEQ ID NO: 2338062 - protein, 26 aa, Cryptosporidium parvum
AAKRRALLFVQKYVKSIKLLHFKVDS

SEQ ID NO: 2338063 - protein, 31 aa, Cryptosporidium parvum; identical to SEQ ID NO: 2209042

SEQ ID NO: 2338064 - protein, 21 aa, Cryptosporidium parvum
AANAFPMIKGISSLAPKKPKP

SEQ ID NO: 2338065 - protein, 29 aa, Cryptosporidium parvum
AAPRVFYKPKFGWRFFPPNVPDFSRLLVL

SEQ ID NO: 2338066 - protein, 19 aa, Cryptosporidium parvum
AARPTVFIAVPRLFTRIYK

SEQ ID NO: 2338067 - protein, 25 aa, Cryptosporidium parvum
AASEYLEYLLLKNGLMFRVSLTERY

SEQ ID NO: 2338068 - protein, 25 aa, Cryptosporidium parvum
AASRHQLLFILRQVLEVAIKNPRLK

SEQ ID NO: 2338069 - protein, 22 aa, Cryptosporidium parvum
ADEILRRNFAYHLATSFVYWHY

SEQ ID NO: 2338070 - protein, 20 aa, Cryptosporidium parvum
ADFELQIPGLLFIDTPGHES

SEQ ID NO: 2338071 - protein, 20 aa, Cryptosporidium parvum
ADFVLGCPNGWAFNGIKCTG

SEQ ID NO: 2338072 - protein, 21 aa, Cryptosporidium parvum
ADGVLPKYLLFDDMDKFDFDP

SEQ ID NO: 2338073 - protein, 28 aa, Cryptosporidium parvum
ADSFFGAIEWIWMYKLSNIDNINKYATW

SEQ ID NO: 2338074 - protein, 21 aa, Cryptosporidium parvum
ADYKLPDAVIPLTKFNGNPLK

SEQ ID NO: 2338075 - protein, 26 aa, Cryptosporidium parvum
ADYYFGNRQWSYIYDFSLNSKYINGV

SEQ ID NO: 2338076 - protein, 26 aa, Cryptosporidium parvum
AEEDKIEMLPLPLGPPIPGTEPGIEG

SEQ ID NO: 2338077 - protein, 28 aa, Cryptosporidium parvum
AEGEIEFKSLLFIPSHPPFDMFDTYMGK

SEQ ID NO: 2338078 - protein, 25 aa, Cryptosporidium parvum
AERLEWPRELILLILSQDFSLSDSN

SEQ ID NO: 2338079 - protein, 18 aa, Cryptosporidium parvum
AFIIYVKYKADIGLHIYR

SEQ ID NO: 2338080 - protein, 20 aa, Cryptosporidium parvum
AFSPAGMKIPFYLRQELIQL

SEQ ID NO: 2338081 - protein, 20 aa, Cryptosporidium parvum
AFVFVILQVSNYHSTTQHFS

SEQ ID NO: 2338082 - protein, 21 aa, Cryptosporidium parvum
AGLRTSFREGCRFVHFLKNKG

SEQ ID NO: 2338083 - protein, 21 aa, Cryptosporidium parvum
AGNLPYTILVSIPKAALPVSR

SEQ ID NO: 2338084 - protein, 26 aa, Cryptosporidium parvum
AGSKVLEIPLLVAAPFMLTSDSNGSA

SEQ ID NO: 2338085 - protein, 22 aa, Cryptosporidium parvum
AGYGYPFPGFQQYAPAPRFTNS

SEQ ID NO: 2338086 - protein, 20 aa, Cryptosporidium parvum
AIISFAYVGIFKVYGEEQKV

SEQ ID NO: 2338087 - protein, 27 aa, Cryptosporidium parvum
AIKEYEILLLLLKDLISYFSKLLELCE

SEQ ID NO: 2338088 - protein, 23 aa, Cryptosporidium parvum
AIKSNKYLKKKLSKQIPDVIILM

SEQ ID NO: 2338089 - protein, 21 aa, Cryptosporidium parvum
AILIICFCINYSFGASNQSKS

SEQ ID NO: 2338090 - protein, 18 aa, Cryptosporidium parvum
AINLLPKVRKGGYQRFYR

SEQ ID NO: 2338091 - protein, 27 aa, Cryptosporidium parvum
AIPITKKKLCWYFISGKCSKSDCQYSH

SEQ ID NO: 2338092 - protein, 25 aa, Cryptosporidium parvum
AIQFQSILKILLFNQNLTTCSLINE

SEQ ID NO: 2338093 - protein, 28 aa, Cryptosporidium parvum
AIRRPKTHHLFPNPIKGFRNMFCKRLEK

SEQ ID NO: 2338094 - protein, 17 aa, Cryptosporidium parvum
AIRRTLSRRAGFTLSNL

SEQ ID NO: 2338095 - protein, 26 aa, Cryptosporidium parvum
AISDYALVGFPILRKFDPTDGSYDPF

SEQ ID NO: 2338096 - protein, 21 aa, Cryptosporidium parvum
AISGFYYVRPFCSTKPLRVYC

SEQ ID NO: 2338097 - protein, 17 aa, Cryptosporidium parvum
AISGIGFHWKKPPKPGQ

SEQ ID NO: 2338098 - protein, 17 aa, Cryptosporidium parvum
AISIITFFEEHSFILSQ

SEQ ID NO: 2338099 - protein, 24 aa, Cryptosporidium parvum
AIYHEGHCLIVTAPLKQCPPGYEI

SEQ ID NO: 2338100 - protein, 27 aa, Cryptosporidium parvum
AKECARVLYPTLLRLGYTVSQSRVEKV

SEQ ID NO: 2338101 - protein, 32 aa, Cryptosporidium parvum
AKFCKGLFERFILRHIEWLKIIIKSIESDNIK

SEQ ID NO: 2338102 - protein, 22 aa, Cryptosporidium parvum
AKGLPFFPDFKKIDILQEKFSD

SEQ ID NO: 2338103 - protein, 25 aa, Cryptosporidium parvum
AKGMKIEWFAVRDGILWVGSFGKEF

SEQ ID NO: 2338104 - protein, 24 aa, Cryptosporidium parvum
AKHYCKQILLTSLQLFLGINLWNN

SEQ ID NO: 2338105 - protein, 23 aa, Cryptosporidium parvum
AKIQTFCLIYLKNMGLNELVTLN

SEQ ID NO: 2338106 - protein, 20 aa, Cryptosporidium parvum
AKKLGIKLPFHSFSPEAYLR

SEQ ID NO: 2338107 - protein, 30 aa, Cryptosporidium parvum
AKLAWLCIFLVLLFLTINQTLGSSPKKAVD

SEQ ID NO: 2338108 - protein, 22 aa, Cryptosporidium parvum
AKLHALLPIMNIKFGGQPNLIK

SEQ ID NO: 2338109 - protein, 23 aa, Cryptosporidium parvum
ALEDDWIKFTPEKRCQLIIDKLE

SEQ ID NO: 2338110 - protein, 24 aa, Cryptosporidium parvum
ALEKGPIYLIRRITLRTKNNHLSF

SEQ ID NO: 2338111 - protein, 25 aa, Cryptosporidium parvum
ALERGFLDMLGLGDKQIWSGSNYGG

SEQ ID NO: 2338112 - protein, 26 aa, Cryptosporidium parvum
ALISVIKRLRLIYNSYITELESNIDP

SEQ ID NO: 2338113 - protein, 20 aa, Cryptosporidium parvum
ALLDSILSFENWIKRFSKEY

SEQ ID NO: 2338114 - protein, 21 aa, Cryptosporidium parvum
ALLVFFVATNAVRIRGGEQNK

SEQ ID NO: 2338115 - protein, 23 aa, Cryptosporidium parvum
ALNSKSFIVRRWGKNVQSKLRKL

SEQ ID NO: 2338116 - protein, 22 aa, Cryptosporidium parvum
ALQIYKLFNKLKSQAPSLGSKF

SEQ ID NO: 2338117 - protein, 17 aa, Cryptosporidium parvum
ALQVSIFTYFMAQKKLS

SEQ ID NO: 2338118 - protein, 17 aa, Cryptosporidium parvum
ALSFLTIPKSRGSITLD

SEQ ID NO: 2338119 - protein, 18 aa, Cryptosporidium parvum
ALSILKYAVRRKKPDNKC

SEQ ID NO: 2338120 - protein, 30 aa, Cryptosporidium parvum
ALSTILNVLPRLPGIRYIVLLRPEDGGDVE

SEQ ID NO: 2338121 - protein, 26 aa, Cryptosporidium parvum
ANEGFAQLIFSILDLGTFVIASFNNY

SEQ ID NO: 2338122 - protein, 23 aa, Cryptosporidium parvum
ANKDKFKFISRKTLLQFCRDVCY

SEQ ID NO: 2338123 - protein, 33 aa, Cryptosporidium parvum
ANNQLRCENGIFSPKVYCIAMREIERQKSSISK

SEQ ID NO: 2338124 - protein, 24 aa, Cryptosporidium parvum
ANSALVYAILFVTSTLQYTVMENC

SEQ ID NO: 2338125 - protein, 25 aa, Cryptosporidium parvum
ANVTCPDLLIHLTHLAQKGMVESMN

SEQ ID NO: 2338126 - protein, 24 aa, Cryptosporidium parvum
APELMSSLGFNKPNFPFTIIDVAP

SEQ ID NO: 2338127 - protein, 26 aa, Cryptosporidium parvum
APEPIRVWCDIKFGASYYIWNDGGNP

SEQ ID NO: 2338128 - protein, 27 aa, Cryptosporidium parvum
APESILEILGYFDIRILKDSSLISLFL

SEQ ID NO: 2338129 - protein, 27 aa, Cryptosporidium parvum
APFGRTLIRNLFRIYKRNFPSDKRIKK

SEQ ID NO: 2338130 - protein, 28 aa, Cryptosporidium parvum
APIREMPIPFFTASLPLIGQLAANAFPM

SEQ ID NO: 2338131 - protein, 29 aa, Cryptosporidium parvum
APLNKTGWFLDYDLNPLNGFIALGTNSTS

SEQ ID NO: 2338132 - protein, 20 aa, Cryptosporidium parvum
APMIGFCPDGSEVPPSGLCT

SEQ ID NO: 2338133 - protein, 24 aa, Cryptosporidium parvum
APSATFFLRIMLPEPKKLENNKSV

SEQ ID NO: 2338134 - protein, 19 aa, Cryptosporidium parvum
APSFFWKNYLEDVLDDSLI

SEQ ID NO: 2338135 - protein, 27 aa, Cryptosporidium parvum
AQIKNRRFFDFTLTTEVYPPVSGIFGI

SEQ ID NO: 2338136 - protein, 19 aa, Cryptosporidium parvum
ARIIQFKYFFEINTKIFII

SEQ ID NO: 2338137 - protein, 21 aa, Cryptosporidium parvum
ASFIMPEKHIYFGGTKYFFKS

SEQ ID NO: 2338138 - protein, 22 aa, Cryptosporidium parvum
ASLEETPFGRYPHYPHYPPYPD

SEQ ID NO: 2338139 - protein, 32 aa, Cryptosporidium parvum
ASNYILEDSFLYPINIMYLGYETCSLFSDCSQ

SEQ ID NO: 2338140 - protein, 17 aa, Cryptosporidium parvum
ASRFRRHVPTDAPLWGK

SEQ ID NO: 2338141 - protein, 25 aa, Cryptosporidium parvum
ASRGYRVFITPPITMIPTPEHPGLG

SEQ ID NO: 2338142 - protein, 24 aa, Cryptosporidium parvum
ASVFLFICLSVRSFSKIGGVAHLE

SEQ ID NO: 2338143 - protein, 25 aa, Cryptosporidium parvum
ATMKDKIVKFFFEKRLKNYQEQCRK

SEQ ID NO: 2338144 - protein, 20 aa, Cryptosporidium parvum
ATYELFYFNNTQSYKYENNT

SEQ ID NO: 2338145 - protein, 22 aa, Cryptosporidium parvum
AVGTYFKVFYPEVTTPRKDYSP

SEQ ID NO: 2338146 - protein, 20 aa, Cryptosporidium parvum
AVPLLLDARHDGPVKVTSVA

SEQ ID NO: 2338147 - protein, 27 aa, Cryptosporidium parvum
AVSTSVIGLLEGFSKYFYSLSYERKQN

SEQ ID NO: 2338148 - protein, 19 aa, Cryptosporidium parvum
AYFASALKRPTAYSSPAII

SEQ ID NO: 2338149 - protein, 17 aa, Cryptosporidium parvum
AYHPLALEIFSTISKED

SEQ ID NO: 2338150 - protein, 19 aa, Cryptosporidium parvum
AYRNSISLGFLFSKTEDIL

SEQ ID NO: 2338151 - protein, 21 aa, Cryptosporidium parvum
CDEYSNVLLRIPFPSSEISGS

SEQ ID NO: 2338152 - protein, 24 aa, Cryptosporidium parvum
CDHTMHFLKSMDYFFLSSSELFEL

SEQ ID NO: 2338153 - protein, 25 aa, Cryptosporidium parvum
CEIKKARISLIEWAFNDIQSDLTRL

SEQ ID NO: 2338154 - protein, 23 aa, Cryptosporidium parvum
CEKCGSRIYRVGCLCSSIGNHRE

SEQ ID NO: 2338155 - protein, 24 aa, Cryptosporidium parvum
CELLPGYEDIPFPDGLRGSYYDNP

SEQ ID NO: 2338156 - protein, 17 aa, Cryptosporidium parvum
CFEYQYVCLLARHLEDD

SEQ ID NO: 2338157 - protein, 24 aa, Cryptosporidium parvum
CFSHIWRVWESGIYRNLYIDGTNF

SEQ ID NO: 2338158 - protein, 20 aa, Cryptosporidium parvum
CFSSLMHWYHFSKKRRKLKG

SEQ ID NO: 2338159 - protein, 23 aa, Cryptosporidium parvum
CFSTLDFLKFSLEDISAFHKPEH

SEQ ID NO: 2338160 - protein, 23 aa, Cryptosporidium parvum
CGEIVELDLLANSLLFGSHQFAS

SEQ ID NO: 2338161 - protein, 28 aa, Cryptosporidium parvum
CGGLNDVFMLIYLVGRLKGYYDDWKIVT

SEQ ID NO: 2338162 - protein, 22 aa, Cryptosporidium parvum
CGNSIVLFDFHRKRYVTLNEMK

SEQ ID NO: 2338163 - protein, 27 aa, Cryptosporidium parvum
CHILPLLLFIILAILFNSNVPSHGKSI

SEQ ID NO: 2338164 - protein, 23 aa, Cryptosporidium parvum
CHMEDMIWLFQTFPNKLNDNVDR

SEQ ID NO: 2338165 - protein, 17 aa, Cryptosporidium parvum
CIENFQFKLVFTNSQIQ

SEQ ID NO: 2338166 - protein, 17 aa, Cryptosporidium parvum
CISCSYSLLPKSVQIGS

SEQ ID NO: 2338167 - protein, 21 aa, Cryptosporidium parvum
CKARVRTIFRTSYKVRCPGQE

SEQ ID NO: 2338168 - protein, 24 aa, Cryptosporidium parvum
CKKGKLFLESFSLLPKISGENKET

SEQ ID NO: 2338169 - protein, 18 aa, Cryptosporidium parvum
CKTPFVTFDLKLICGSDG

SEQ ID NO: 2338170 - protein, 26 aa, Cryptosporidium parvum
CLDPKIQLQKMPGIPCGLLGSMDATK

SEQ ID NO: 2338171 - protein, 20 aa, Cryptosporidium parvum
CLICLLNYTTFNQLGRVDEH

SEQ ID NO: 2338172 - protein, 33 aa, Cryptosporidium parvum
CLKYKHILVPLEKKLIYMMKSVSNVLVLYEQSF

SEQ ID NO: 2338173 - protein, 18 aa, Cryptosporidium parvum
CLLILAVSFVSIYSAEAP

SEQ ID NO: 2338174 - protein, 22 aa, Cryptosporidium parvum
CLLLFIIIISINNEISLSCSSS

SEQ ID NO: 2338175 - protein, 17 aa, Cryptosporidium parvum
CLTYSKKSIQNVCEDGF

SEQ ID NO: 2338176 - protein, 19 aa, Cryptosporidium parvum
CMHFGMAPFFSGMLMSYSL

SEQ ID NO: 2338177 - protein, 18 aa, Cryptosporidium parvum
CMIAKYYLAYKKHLRNEM

SEQ ID NO: 2338178 - protein, 18 aa, Cryptosporidium parvum
CMPEEKRILFLMKQTIVG

SEQ ID NO: 2338179 - protein, 26 aa, Cryptosporidium parvum
CNQTLLSLLYYRHLQLDLILENGRRF

SEQ ID NO: 2338180 - protein, 30 aa, Cryptosporidium parvum
CPLNTMLERRWFIVPMSLGLPIGELKELID

SEQ ID NO: 2338181 - protein, 20 aa, Cryptosporidium parvum
CPVKCFVGEWSNWSKCPNDD

SEQ ID NO: 2338182 - protein, 18 aa, Cryptosporidium parvum
CQLKPVIHHITSLDLINT

SEQ ID NO: 2338183 - protein, 25 aa, Cryptosporidium parvum
CRNPELYLAKPMGFPCREEDRNKDL

SEQ ID NO: 2338184 - protein, 24 aa, Cryptosporidium parvum
CRSNLFSLIPCKVFAWDSNGGTCT

SEQ ID NO: 2338185 - protein, 25 aa, Cryptosporidium parvum
CSGIFKMPSLPAVDLRPLNLALMNP

SEQ ID NO: 2338186 - protein, 22 aa, Cryptosporidium parvum
CSIDYYLINIPTPVSFNIDIEL

SEQ ID NO: 2338187 - protein, 25 aa, Cryptosporidium parvum
CSLQDLFNAGWKFDKKLKIWVRGNN

SEQ ID NO: 2338188 - protein, 23 aa, Cryptosporidium parvum
CSQNYYNSLLAVGPIYDAVREMT

SEQ ID NO: 2338189 - protein, 23 aa, Cryptosporidium parvum
CSRRINGRWTGWIPVSESRVPPQ

SEQ ID NO: 2338190 - protein, 26 aa, Cryptosporidium parvum
CSTYKGGYFTFWMSYDSLNEEISISI

SEQ ID NO: 2338191 - protein, 27 aa, Cryptosporidium parvum
CTQPTIISSLLRPSAPPTAPVCSSYKS

SEQ ID NO: 2338192 - protein, 20 aa, Cryptosporidium parvum
CTRLVPGALQYVCPVGTREG

SEQ ID NO: 2338193 - protein, 31 aa, Cryptosporidium parvum; identical to SEQ ID NO: 2209146

SEQ ID NO: 2338194 - protein, 17 aa, Cryptosporidium parvum
CVAFTMPEKSCPPGFVF

SEQ ID NO: 2338195 - protein, 21 aa, Cryptosporidium parvum
CVFIIIFFGSLFSNILHIKGA

SEQ ID NO: 2338196 - protein, 22 aa, Cryptosporidium parvum
CVVAFMRILSLPFGLEKEKAEE

SEQ ID NO: 2338197 - protein, 29 aa, Cryptosporidium parvum
CYKSSIYFCEYLWVIAYIIEEKKSFKTQM

SEQ ID NO: 2338198 - protein, 23 aa, Cryptosporidium parvum
DADLTESLLILITNRFEANFTSE

SEQ ID NO: 2338199 - protein, 26 aa, Cryptosporidium parvum
DADNVIFATSLLLLTNIYSDNLGMSS

SEQ ID NO: 2338200 - protein, 32 aa, Cryptosporidium parvum; identical to SEQ ID NO: 2209155

SEQ ID NO: 2338201 - protein, 27 aa, Cryptosporidium parvum
DANYNNRRFITINRLLIPLVVNSSLPS

SEQ ID NO: 2338202 - protein, 26 aa, Cryptosporidium parvum
DAQEKLFVFTFEDTLPYNLSNQATSQ

SEQ ID NO: 2338203 - protein, 23 aa, Cryptosporidium parvum
DASLLKILPRINPVYTIMSLGRY

SEQ ID NO: 2338204 - protein, 20 aa, Cryptosporidium parvum
DAYLLLFKMMDHDKQKMLLL

SEQ ID NO: 2338205 - protein, 21 aa, Cryptosporidium parvum
DCKTPFVTADYRPICGSDGKT

SEQ ID NO: 2338206 - protein, 25 aa, Cryptosporidium parvum
DCPQSTRFLTYDLLMLQNVGEEPTD

SEQ ID NO: 2338207 - protein, 20 aa, Cryptosporidium parvum
DDLGLFRSGPRRRKRRDVYD

SEQ ID NO: 2338208 - protein, 24 aa, Cryptosporidium parvum
DDTRPIFFSSVLRLEILNKWRKSK

SEQ ID NO: 2338209 - protein, 18 aa, Cryptosporidium parvum
DEFHLLEISLSRSGLSSA

SEQ ID NO: 2338210 - protein, 24 aa, Cryptosporidium parvum
DEILLSCNMFYRAYYEIAIQKYIN

SEQ ID NO: 2338211 - protein, 17 aa, Cryptosporidium parvum
DEIVCLVLQFTNPKVEC

SEQ ID NO: 2338212 - protein, 22 aa, Cryptosporidium parvum
DEKIHIVYDIWTIFNQIEREIF

SEQ ID NO: 2338213 - protein, 23 aa, Cryptosporidium parvum
DEMKDLELIPKGSKYNLTIKVDA

SEQ ID NO: 2338214 - protein, 33 aa, Cryptosporidium parvum
DEQAKFANLILKRIIIFWNPSLNFGVDISSKGA

SEQ ID NO: 2338215 - protein, 29 aa, Cryptosporidium parvum
DESNQTLMLLFPLKNYLQPYMKSGPIFFI

SEQ ID NO: 2338216 - protein, 25 aa, Cryptosporidium parvum
DETLFPYELATRRLLQYLKECKIGV

SEQ ID NO: 2338217 - protein, 25 aa, Cryptosporidium parvum
DETNKFLENLFPSKLSSIKNETEQN

SEQ ID NO: 2338218 - protein, 25 aa, Cryptosporidium parvum
DEVTVVPFPPFIPVAGGYVPEPQNN

SEQ ID NO: 2338219 - protein, 19 aa, Cryptosporidium parvum
DFANFFIKNFSISGSVLGN

SEQ ID NO: 2338220 - protein, 25 aa, Cryptosporidium parvum
DFASKYSFIKLKSGFYRPLAGTGGR

SEQ ID NO: 2338221 - protein, 24 aa, Cryptosporidium parvum
DFDFYWRKDFLCDTASKIIKFGIE

SEQ ID NO: 2338222 - protein, 22 aa, Cryptosporidium parvum
DFELLMLERSFLRRVISQFEST

SEQ ID NO: 2338223 - protein, 18 aa, Cryptosporidium parvum
DFFNCFYSVNKYLHGMVT

SEQ ID NO: 2338224 - protein, 19 aa, Cryptosporidium parvum
DFFRNKFLQGLAEEAKKEE

SEQ ID NO: 2338225 - protein, 23 aa, Cryptosporidium parvum
DFNRRSILKLLPDIFKSNPIDSR

SEQ ID NO: 2338226 - protein, 23 aa, Cryptosporidium parvum
DFTRFMLNLIINKSDPKLTSPIF

SEQ ID NO: 2338227 - protein, 26 aa, Cryptosporidium parvum
DFYKYPNRLVFLKTALEDPMECYIIQ

SEQ ID NO: 2338228 - protein, 19 aa, Cryptosporidium parvum
DGCKLYLYFDDNVGYTVIT

SEQ ID NO: 2338229 - protein, 24 aa, Cryptosporidium parvum
DGESNYYFFKKAISSSTLVGSSFN

SEQ ID NO: 2338230 - protein, 27 aa, Cryptosporidium parvum
DGIKMRMFMFKEFSMDYLARKGLPLNI

SEQ ID NO: 2338231 - protein, 27 aa, Cryptosporidium parvum
DGNYHIQSYISFILSKYNFDDSELVKD

SEQ ID NO: 2338232 - protein, 28 aa, Cryptosporidium parvum
DGSIALCFLAFIIFFVVKVGGTNNENLS

SEQ ID NO: 2338233 - protein, 28 aa, Cryptosporidium parvum
DGTCYIVEYAPFSLTCNDPYTLFDNKEC

SEQ ID NO: 2338234 - protein, 23 aa, Cryptosporidium parvum
DHLFDYFFYGFGVEIVEFATQSN

SEQ ID NO: 2338235 - protein, 23 aa, Cryptosporidium parvum
DHTLNFLQRIWEQNIYHCDLCHP

SEQ ID NO: 2338236 - protein, 20 aa, Cryptosporidium parvum
DIATIYFFNNRMVLLDSKNK

SEQ ID NO: 2338237 - protein, 17 aa, Cryptosporidium parvum
DICMIAKYYLAYKKHLR

SEQ ID NO: 2338238 - protein, 25 aa, Cryptosporidium parvum
DICRFVGKVEPWIYTKRSGFTNHCI

SEQ ID NO: 2338239 - protein, 19 aa, Cryptosporidium parvum
DIFFLSKSPGKTLVIGASY

SEQ ID NO: 2338240 - protein, 26 aa, Cryptosporidium parvum
DIGAPQQVGIFLKSNTRWKCLKITVV

SEQ ID NO: 2338241 - protein, 26 aa, Cryptosporidium parvum
DIICKPYESLIGIRAWFPNPESKGRK

SEQ ID NO: 2338242 - protein, 26 aa, Cryptosporidium parvum
DIIDPVDLMLIYRDANKMPLLAVRNE

SEQ ID NO: 2338243 - protein, 21 aa, Cryptosporidium parvum
DIISLYLQYKRITRILLNIYN

SEQ ID NO: 2338244 - protein, 25 aa, Cryptosporidium parvum
DILVSTTFMLIAHASPSPIPGKSPK

SEQ ID NO: 2338245 - protein, 18 aa, Cryptosporidium parvum
DIMNVFALSPNGKLVSFV

SEQ ID NO: 2338246 - protein, 25 aa, Cryptosporidium parvum
DINLALPFMEIKWNPGSSLSNGVIS

SEQ ID NO: 2338247 - protein, 18 aa, Cryptosporidium parvum
DIPYLLKLVNVLSDSYGF

SEQ ID NO: 2338248 - protein, 18 aa, Cryptosporidium parvum
DIRILKDSSLISLFLNEI

SEQ ID NO: 2338249 - protein, 26 aa, Cryptosporidium parvum
DITTNLKRYLIKLFPTEITQEHYKKD

SEQ ID NO: 2338250 - protein, 18 aa, Cryptosporidium parvum
DIVMDQYYFMYYHQGRRG

SEQ ID NO: 2338251 - protein, 17 aa, Cryptosporidium parvum
DKDGLCCLMPNYCSKEA

SEQ ID NO: 2338252 - protein, 22 aa, Cryptosporidium parvum
DKDIKLEFWFNLGGNKKKQKCY

SEQ ID NO: 2338253 - protein, 24 aa, Cryptosporidium parvum
DKFRQEFLLAINSFRSIVGKFATN

SEQ ID NO: 2338254 - protein, 21 aa, Cryptosporidium parvum
DKFSDLKGWNKAMDKHRWVAL

SEQ ID NO: 2338255 - protein, 29 aa, Cryptosporidium parvum
DKHRLSELLVLPFGLWDSRHIYSIQIITA

SEQ ID NO: 2338256 - protein, 24 aa, Cryptosporidium parvum
DKIKGLIRYFKFNKGSYGEVWRGL

SEQ ID NO: 2338257 - protein, 18 aa, Cryptosporidium parvum
DKLSKPCAILLLGGIDQN

SEQ ID NO: 2338258 - protein, 19 aa, Cryptosporidium parvum
DKLVSAPPHLFKVILAVNP

SEQ ID NO: 2338259 - protein, 27 aa, Cryptosporidium parvum
DKTDILRGYFLFHDYFECKDLTEAQIF

SEQ ID NO: 2338260 - protein, 35 aa, Cryptosporidium parvum
DKTIIFSVNLYRRLLYLLDLFHRGGTSFYPEELED

SEQ ID NO: 2338261 - protein, 26 aa, Cryptosporidium parvum
DKYGESYPFFPPGIKPAPIDGDENNT

SEQ ID NO: 2338262 - protein, 26 aa, Cryptosporidium parvum
DKYGESYPFFPPGIKPAPIDGDESNT

SEQ ID NO: 2338263 - protein, 20 aa, Cryptosporidium parvum
DLAINLLEPSIKRCLTRIRF

SEQ ID NO: 2338264 - protein, 27 aa, Cryptosporidium parvum
DLKDEIFAYRTDLIPPPAAGRGPVLPY

SEQ ID NO: 2338265 - protein, 18 aa, Cryptosporidium parvum
DLKLTWRLHYSSLKLRLI

SEQ ID NO: 2338266 - protein, 25 aa, Cryptosporidium parvum
DLLSKLIMECSLLFTPQFSALDVEE

SEQ ID NO: 2338267 - protein, 23 aa, Cryptosporidium parvum
DLLTQQALFYWSIEAEKFLNDYK

SEQ ID NO: 2338268 - protein, 25 aa, Cryptosporidium parvum
DLNRMQWRFFLTSYSPELDNVRIIK

SEQ ID NO: 2338269 - protein, 24 aa, Cryptosporidium parvum
DLNTRSIYLDRIVWSWSSRKIEDN

SEQ ID NO: 2338270 - protein, 31 aa, Cryptosporidium parvum
DLNVLLEVIPAKSIEIMLMIPPNSAGEDLSE

SEQ ID NO: 2338271 - protein, 18 aa, Cryptosporidium parvum
DLNWLYCQDLPKYLNKLD

SEQ ID NO: 2338272 - protein, 29 aa, Cryptosporidium parvum
DLQIKFLVHFFRNRVVLLDPSHGLSCSGP

SEQ ID NO: 2338273 - protein, 24 aa, Cryptosporidium parvum
DLRESQLWIKDYVLRNAAYRHYQF

SEQ ID NO: 2338274 - protein, 17 aa, Cryptosporidium parvum
DLRLNVVYPVGHFLGII

SEQ ID NO: 2338275 - protein, 18 aa, Cryptosporidium parvum
DLRVFSAHPYKSIVIHEV

SEQ ID NO: 2338276 - protein, 17 aa, Cryptosporidium parvum
DLSKDDWKLVIQLKKTF

SEQ ID NO: 2338277 - protein, 17 aa, Cryptosporidium parvum
DLVIPDLLGVYLINNGH

SEQ ID NO: 2338278 - protein, 18 aa, Cryptosporidium parvum
DLVNLMEKMIFNIMMRFT

SEQ ID NO: 2338279 - protein, 25 aa, Cryptosporidium parvum
DLVRLIQNVVLFRPFTKEEALKILE

SEQ ID NO: 2338280 - protein, 19 aa, Cryptosporidium parvum
DMCMETIKKPFKYHCLSGG

SEQ ID NO: 2338281 - protein, 24 aa, Cryptosporidium parvum
DMKVFKSSPLLTSILVKCPTSCNP

SEQ ID NO: 2338282 - protein, 20 aa, Cryptosporidium parvum
DNCLYPAKLKPKKSSLDSFS

SEQ ID NO: 2338283 - protein, 22 aa, Cryptosporidium parvum
DNLLKLIQSVLFDYESSLTPSR

SEQ ID NO: 2338284 - protein, 23 aa, Cryptosporidium parvum
DNLWSFNSIMMLLHSSRNNQGEN

SEQ ID NO: 2338285 - protein, 25 aa, Cryptosporidium parvum
DNNSFFPAFGIFNKGDALALNNFTN

SEQ ID NO: 2338286 - protein, 23 aa, Cryptosporidium parvum
DNSLRKWVPNKPELVLKCDKASY

SEQ ID NO: 2338287 - protein, 26 aa, Cryptosporidium parvum
DNSNLLINIVWTLASAFNSLWVGGVE

SEQ ID NO: 2338288 - protein, 23 aa, Cryptosporidium parvum
DNVLPEFISGTPLEPLPSSFDYR

SEQ ID NO: 2338289 - protein, 23 aa, Cryptosporidium parvum
DPDTNIIFRVRIVYRPISIAEDP

SEQ ID NO: 2338290 - protein, 23 aa, Cryptosporidium parvum
DPITGELLFDAEALSRNITSTIT

SEQ ID NO: 2338291 - protein, 20 aa, Cryptosporidium parvum
DPKHGFVPLYILDNSTETAA

SEQ ID NO: 2338292 - protein, 23 aa, Cryptosporidium parvum
DPLIAQKLFLGEKTISFLFVNND

SEQ ID NO: 2338293 - protein, 25 aa, Cryptosporidium parvum
DPLTKIVYGPFFYEINNVSLPLNIT

SEQ ID NO: 2338294 - protein, 40 aa, Cryptosporidium parvum
DPNSQLETFVKLRIKWFNIFVNDYLARLGIKFSILEEYCN

SEQ ID NO: 2338295 - protein, 18 aa, Cryptosporidium parvum
DPNWKYIQVAYLLNLNYN

SEQ ID NO: 2338296 - protein, 27 aa, Cryptosporidium parvum
DQAFTFWTKSYRYTAFFKYINEHEDIN

SEQ ID NO: 2338297 - protein, 24 aa, Cryptosporidium parvum
DQARSLFDVLLECLILFGERYSPE

SEQ ID NO: 2338298 - protein, 24 aa, Cryptosporidium parvum
DQILKFEVTAYFCYLKNLRSAFES

SEQ ID NO: 2338299 - protein, 28 aa, Cryptosporidium parvum
DQIMEVYSRQRLLLKNYLIYSKRSETSA

SEQ ID NO: 2338300 - protein, 23 aa, Cryptosporidium parvum
DQVYLNIKFTYRWNAPGALKIEN

SEQ ID NO: 2338301 - protein, 24 aa, Cryptosporidium parvum
DRANFNNLLFAPSDLNLAGVEEAW

SEQ ID NO: 2338302 - protein, 18 aa, Cryptosporidium parvum
DRLYGWIEQNWSSSRSTL

SEQ ID NO: 2338303 - protein, 19 aa, Cryptosporidium parvum
DRMLNKGAIPGIVSEESGK

SEQ ID NO: 2338304 - protein, 26 aa, Cryptosporidium parvum
DRSSSNILFPWIYNSDFSIFESEFSF

SEQ ID NO: 2338305 - protein, 31 aa, Cryptosporidium parvum; identical to SEQ ID NO: 2209223

SEQ ID NO: 2338306 - protein, 30 aa, Cryptosporidium parvum; identical to SEQ ID NO: 2209224

SEQ ID NO: 2338307 - protein, 25 aa, Cryptosporidium parvum
DSDSKLIWLNFTLSKDLQGDPNTFE

SEQ ID NO: 2338308 - protein, 26 aa, Cryptosporidium parvum
DSFSNGFYKLLRKMKMITKAAIDPDM

SEQ ID NO: 2338309 - protein, 26 aa, Cryptosporidium parvum
DSGLKIWNLTFLGRRVAFEVAMVDAM

SEQ ID NO: 2338310 - protein, 51 aa, Cryptosporidium parvum; identical to SEQ ID NO: 2209230

SEQ ID NO: 2338311 - protein, 17 aa, Cryptosporidium parvum
DSILYKCSEGYLLSESS

SEQ ID NO: 2338312 - protein, 24 aa, Cryptosporidium parvum
DSLPPTWHVYGIRPIQASIIRTRF

SEQ ID NO: 2338313 - protein, 28 aa, Cryptosporidium parvum
DSNDEFLLEYRLKILSNTTIRELIESLI

SEQ ID NO: 2338314 - protein, 23 aa, Cryptosporidium parvum
DSNKRIFKLKKIICRILQVQQEN

SEQ ID NO: 2338315 - protein, 17 aa, Cryptosporidium parvum
DSNTYLPIMFRGLLHVS

SEQ ID NO: 2338316 - protein, 24 aa, Cryptosporidium parvum
DSTCNYEMLIISPVICSHPLLMPP

SEQ ID NO: 2338317 - protein, 23 aa, Cryptosporidium parvum
DSVYRLSLMRLCLLDISEGKLGY

SEQ ID NO: 2338318 - protein, 31 aa, Cryptosporidium parvum
DTEKKVLLFFTKTILNMLFEVSLLSIPGCVK

SEQ ID NO: 2338319 - protein, 17 aa, Cryptosporidium parvum
DTFKVPLVIQLTDDEKF

SEQ ID NO: 2338320 - protein, 22 aa, Cryptosporidium parvum
DTGGEFVVALYPGLKQYTGAAG

SEQ ID NO: 2338321 - protein, 30 aa, Cryptosporidium parvum; identical to SEQ ID NO: 2209236

SEQ ID NO: 2338322 - protein, 18 aa, Cryptosporidium parvum
DTLWSTVVFISPDAYVTA

SEQ ID NO: 2338323 - protein, 18 aa, Cryptosporidium parvum
DTRFVIYPNLLFEQEICD

SEQ ID NO: 2338324 - protein, 31 aa, Cryptosporidium parvum
DTSEDWLKLMKKIFDFQKIQNLLNRKDFKMV

SEQ ID NO: 2338325 - protein, 22 aa, Cryptosporidium parvum
DVFAIARFYMAVDTIPIYEFGG

SEQ ID NO: 2338326 - protein, 28 aa, Cryptosporidium parvum
DVIIKNLKGLYLCLLNILKMLKKEFQLN

SEQ ID NO: 2338327 - protein, 18 aa, Cryptosporidium parvum
DVILVSGILREGDTIIVC

SEQ ID NO: 2338328 - protein, 28 aa, Cryptosporidium parvum
DVLSPIIAILTWIYLTRAFCTLSSIPKC

SEQ ID NO: 2338329 - protein, 20 aa, Cryptosporidium parvum
DVLVIYFFNNRVALQDLINS

SEQ ID NO: 2338330 - protein, 20 aa, Cryptosporidium parvum
DVNVLRMYMASGLLNSVQLD

SEQ ID NO: 2338331 - protein, 21 aa, Cryptosporidium parvum
DVRIRFDDFSGFDLLLGVYPS

SEQ ID NO: 2338332 - protein, 27 aa, Cryptosporidium parvum
DVSYTWQKRFRRFGYWVCFRDCGGGGD

SEQ ID NO: 2338333 - protein, 26 aa, Cryptosporidium parvum
DVYKKFGGIFWARNIPRVSITNMINL

SEQ ID NO: 2338334 - protein, 17 aa, Cryptosporidium parvum
DYFAIGETKLKSLFGIE

SEQ ID NO: 2338335 - protein, 18 aa, Cryptosporidium parvum
DYFLNLDKLVISGNRFII

SEQ ID NO: 2338336 - protein, 17 aa, Cryptosporidium parvum
DYMFNYFDTYLPDPNNE

SEQ ID NO: 2338337 - protein, 20 aa, Cryptosporidium parvum
DYNSLFPLSPYNSVSNEYLI

SEQ ID NO: 2338338 - protein, 26 aa, Cryptosporidium parvum
DYTTPIAMLLPLFRPTSMDTRSEDLE

SEQ ID NO: 2338339 - protein, 25 aa, Cryptosporidium parvum
DYVIKIICLKVITAKPYLSCPENTV

SEQ ID NO: 2338340 - protein, 18 aa, Cryptosporidium parvum
EAEFLRTTFCISAAVFCY

SEQ ID NO: 2338341 - protein, 30 aa, Cryptosporidium parvum
EAELVQESLPYYIRLLYNGQVITNRLKECY

SEQ ID NO: 2338342 - protein, 19 aa, Cryptosporidium parvum
EAFFYRYEVKYSNKINFLK

SEQ ID NO: 2338343 - protein, 29 aa, Cryptosporidium parvum
EAVIWSHLMRKWIFLPRRVSFDEYDEEKD

SEQ ID NO: 2338344 - protein, 23 aa, Cryptosporidium parvum
EAYLRGYLHLSFRISRLGLCLRT

SEQ ID NO: 2338345 - protein, 24 aa, Cryptosporidium parvum
ECAEALITFFKLKAETYYDSTERY

SEQ ID NO: 2338346 - protein, 19 aa, Cryptosporidium parvum
ECAGTTWMPLPCALDPHKP

SEQ ID NO: 2338347 - protein, 27 aa, Cryptosporidium parvum
ECANSPGFKFLLLETIDLLVAVNGWDF

SEQ ID NO: 2338348 - protein, 20 aa, Cryptosporidium parvum
ECDLHLKWAPFVTSSECLAY

SEQ ID NO: 2338349 - protein, 22 aa, Cryptosporidium parvum
EDARLKENCITSLIVVFEKNLQ

SEQ ID NO: 2338350 - protein, 26 aa, Cryptosporidium parvum
EDDRFSFKTFPNFVPPDIPKIAGQRL

SEQ ID NO: 2338351 - protein, 18 aa, Cryptosporidium parvum
EDEDIVIELFLKDELDLQ

SEQ ID NO: 2338352 - protein, 29 aa, Cryptosporidium parvum
EDHRSPHQLPLYYIVLQSLGILSDMVSST

SEQ ID NO: 2338353 - protein, 27 aa, Cryptosporidium parvum
EDILKNFMSNLPYIAYSKFLELSEFLF

SEQ ID NO: 2338354 - protein, 21 aa, Cryptosporidium parvum
EDIPFVAVIPVGSKPGLNIFK

SEQ ID NO: 2338355 - protein, 22 aa, Cryptosporidium parvum
EDLIYLPQISILSQELLISSKK

SEQ ID NO: 2338356 - protein, 23 aa, Cryptosporidium parvum
EDLLRLHLKAFPLFSTQLNISKR

SEQ ID NO: 2338357 - protein, 23 aa, Cryptosporidium parvum
EDSEPIYLPIPTQKKLNKDIINN

SEQ ID NO: 2338358 - protein, 27 aa, Cryptosporidium parvum
EDSVERRLYIASLLGFDFNNASTTANQ

SEQ ID NO: 2338359 - protein, 26 aa, Cryptosporidium parvum
EDTFSVLLLFLLICSARIVEGNSFKE

SEQ ID NO: 2338360 - protein, 17 aa, Cryptosporidium parvum
EEDLLLGISFDELLIDP

SEQ ID NO: 2338361 - protein, 18 aa, Cryptosporidium parvum
EEDSLYLELYRDGSKKIN

SEQ ID NO: 2338362 - protein, 24 aa, Cryptosporidium parvum
EEEKNIFGIYIFKNRMALQDFENF

SEQ ID NO: 2338363 - protein, 20 aa, Cryptosporidium parvum
EEELLQGLPSQPVLGQLEIA

SEQ ID NO: 2338364 - protein, 25 aa, Cryptosporidium parvum
EEIPQQCPIGFVFVESVRKCIKKES

SEQ ID NO: 2338365 - protein, 25 aa, Cryptosporidium parvum
EEIPTLYTRRYIGYSLSMICLEFGE

SEQ ID NO: 2338366 - protein, 24 aa, Cryptosporidium parvum
EELVSPCFGIISYYPNMQITVMKG

SEQ ID NO: 2338367 - protein, 25 aa, Cryptosporidium parvum
EEQKPARKIIISRPILQTLTEETDD

SEQ ID NO: 2338368 - protein, 25 aa, Cryptosporidium parvum
EESAINLLLRLVLKGCPNILDDVLT

SEQ ID NO: 2338369 - protein, 45 aa, Cryptosporidium parvum; identical to SEQ ID NO: 2209273

SEQ ID NO: 2338370 - protein, 24 aa, Cryptosporidium parvum
EESQTLEFCRNEMISLLWNRAANM

SEQ ID NO: 2338371 - protein, 34 aa, Cryptosporidium parvum
EFCMSLYLFRFKGLKQIMLAIRGLLSLILTGETS

SEQ ID NO: 2338372 - protein, 21 aa, Cryptosporidium parvum
EFHHTKIVGLFKIVNEFLKSE

SEQ ID NO: 2338373 - protein, 21 aa, Cryptosporidium parvum
EFKDFFSPIFRRNSRWSIVKP

SEQ ID NO: 2338374 - protein, 26 aa, Cryptosporidium parvum
EFKTIPGVILILRTSDDIPPNTMINP

SEQ ID NO: 2338375 - protein, 17 aa, Cryptosporidium parvum
EFLELSNEFLQHTKAIR

SEQ ID NO: 2338376 - protein, 30 aa, Cryptosporidium parvum; identical to SEQ ID NO: 2209278

SEQ ID NO: 2338377 - protein, 28 aa, Cryptosporidium parvum
EFLIRGIMSFIFYLSKLNKIFGDPSIET

SEQ ID NO: 2338378 - protein, 18 aa, Cryptosporidium parvum
EFLSLIKNKKLFKLINRK

SEQ ID NO: 2338379 - protein, 25 aa, Cryptosporidium parvum
EFQLGNLLWIQLKMEVSNPLIEENG

SEQ ID NO: 2338380 - protein, 22 aa, Cryptosporidium parvum
EFSERFGIDTLFEKSFEDLNEP

SEQ ID NO: 2338381 - protein, 23 aa, Cryptosporidium parvum
EFTCPGMLHSPRAQLLFSKQTEE

SEQ ID NO: 2338382 - protein, 25 aa, Cryptosporidium parvum
EGDIPLEYMLKLPKGIYRWEEIEPQ

SEQ ID NO: 2338383 - protein, 22 aa, Cryptosporidium parvum
EGFISGHLMLRYNKGGMSSSSS

SEQ ID NO: 2338384 - protein, 23 aa, Cryptosporidium parvum
EGLDAWREEFLIQATPKDPNSFP

SEQ ID NO: 2338385 - protein, 22 aa, Cryptosporidium parvum
EGLYNWIRELVIRYLADERTDN

SEQ ID NO: 2338386 - protein, 25 aa, Cryptosporidium parvum
EGNLIFKDEFILSDNEIKSLNSLED

SEQ ID NO: 2338387 - protein, 20 aa, Cryptosporidium parvum
EGSFGLAFRMQNFERYYLLE

SEQ ID NO: 2338388 - protein, 27 aa, Cryptosporidium parvum
EGYEEYFGNLIPLGPFDRVRGPGCKTP

SEQ ID NO: 2338389 - protein, 21 aa, Cryptosporidium parvum
EHLLMNWMFADMNINKSLIPV

SEQ ID NO: 2338390 - protein, 27 aa, Cryptosporidium parvum
EHNHGFIPLYQRVSYFNLTASFPASRT

SEQ ID NO: 2338391 - protein, 22 aa, Cryptosporidium parvum
EHNYAFIAFFQEGEQKLEVLHK

SEQ ID NO: 2338392 - protein, 17 aa, Cryptosporidium parvum
EIAERLEWPRELILLIL

SEQ ID NO: 2338393 - protein, 25 aa, Cryptosporidium parvum
EIDEIFKLDSILKDLNLILKSNNTD

SEQ ID NO: 2338394 - protein, 18 aa, Cryptosporidium parvum
EIEKLRGTYRSTLSKQFS

SEQ ID NO: 2338395 - protein, 24 aa, Cryptosporidium parvum
EIEWSLFNIGVYRNWDIIAMIETK

SEQ ID NO: 2338396 - protein, 19 aa, Cryptosporidium parvum
EIIKVALGDWIKKIDFSSN

SEQ ID NO: 2338397 - protein, 19 aa, Cryptosporidium parvum
EIKIKGFLGSIFLAIRSLS

SEQ ID NO: 2338398 - protein, 20 aa, Cryptosporidium parvum
EILFGETSVFFQNLVIVCGR

SEQ ID NO: 2338399 - protein, 18 aa, Cryptosporidium parvum
EILTTYPTPVYQTGTIYQ

SEQ ID NO: 2338400 - protein, 19 aa, Cryptosporidium parvum
EILVLQKITSLLTQNKNRL

SEQ ID NO: 2338401 - protein, 18 aa, Cryptosporidium parvum
EIMSKVGFPIAAMGSTPA

SEQ ID NO: 2338402 - protein, 27 aa, Cryptosporidium parvum
EINDERLQWLFLVESASIPNPLVYSTD

SEQ ID NO: 2338403 - protein, 23 aa, Cryptosporidium parvum
EINRLITICAFINLSFEIFIDDS

SEQ ID NO: 2338404 - protein, 20 aa, Cryptosporidium parvum
EIPYGITFEGLHRKPTSTVL

SEQ ID NO: 2338405 - protein, 17 aa, Cryptosporidium parvum
EIRRDLFKLFPPTDSNS

SEQ ID NO: 2338406 - protein, 31 aa, Cryptosporidium parvum
EISILKNVIFLYNYLIFLFGSRFSKPEEVLI

SEQ ID NO: 2338407 - protein, 19 aa, Cryptosporidium parvum
EITLLKINGLFYIMDSNGL

SEQ ID NO: 2338408 - protein, 35 aa, Cryptosporidium parvum
EITRNCYRLIRYFQKSGIPFIFRAASKIQGSKNYN

SEQ ID NO: 2338409 - protein, 20 aa, Cryptosporidium parvum
EITYENFILIKKFMIESLSI

SEQ ID NO: 2338410 - protein, 27 aa, Cryptosporidium parvum
EIVNILKEMYLQLIKTLTLLHKEKEKV

SEQ ID NO: 2338411 - protein, 24 aa, Cryptosporidium parvum
EKAIEFCYNLEPFALLECHALTWI

SEQ ID NO: 2338412 - protein, 24 aa, Cryptosporidium parvum
EKEANRELLIEFLKFMHTNRMNIR

SEQ ID NO: 2338413 - protein, 25 aa, Cryptosporidium parvum
EKEDRHKIFTKAIISTIISKNEIKI

SEQ ID NO: 2338414 - protein, 35 aa, Cryptosporidium parvum; identical to SEQ ID NO: 2209305

SEQ ID NO: 2338415 - protein, 27 aa, Cryptosporidium parvum
EKINLKLWEEWLLKLDRFQLEQLDNFL

SEQ ID NO: 2338416 - protein, 17 aa, Cryptosporidium parvum
EKKWPNITNLEFDYSKC

SEQ ID NO: 2338417 - protein, 34 aa, Cryptosporidium parvum
EKLRPHLRKCVSLFILSILVFNEPINSENGPQLR

SEQ ID NO: 2338418 - protein, 23 aa, Cryptosporidium parvum
EKPALIEGIQFPPAEYDIVEVQP

SEQ ID NO: 2338419 - protein, 23 aa, Cryptosporidium parvum
EKPNWLFMPMKIGNAEGLVLPDG

SEQ ID NO: 2338420 - protein, 26 aa, Cryptosporidium parvum
EKQILKYQYPLITEFDPLIAQKLFLG

SEQ ID NO: 2338421 - protein, 23 aa, Cryptosporidium parvum
EKRLNPIFIGEKGNMLILPNRRH

SEQ ID NO: 2338422 - protein, 30 aa, Cryptosporidium parvum
EKRNKYVILSRLSEKLFPLYKDANLYGTLI

SEQ ID NO: 2338423 - protein, 30 aa, Cryptosporidium parvum
EKRSLNRCLLLIILLIILEILCANGEGRIS

SEQ ID NO: 2338424 - protein, 22 aa, Cryptosporidium parvum
EKYYMELLQFILNNCIKIKFPY

SEQ ID NO: 2338425 - protein, 25 aa, Cryptosporidium parvum
ELAPNKYWHGFSFYNKQNEKVLSIL

SEQ ID NO: 2338426 - protein, 19 aa, Cryptosporidium parvum
ELAQYRQQFRRTVDGRLCS

SEQ ID NO: 2338427 - protein, 24 aa, Cryptosporidium parvum
ELAWTTELVILWKMARQKDITTCK

SEQ ID NO: 2338428 - protein, 25 aa, Cryptosporidium parvum
ELDYYLVTCKPGYFLKGLHVFSNTS

SEQ ID NO: 2338429 - protein, 32 aa, Cryptosporidium parvum
ELEREIALLMEKFLVLLDYGVDNFLGHMAISI

SEQ ID NO: 2338430 - protein, 20 aa, Cryptosporidium parvum
ELFCRDIAGRFFYPRLFTNS

SEQ ID NO: 2338431 - protein, 37 aa, Cryptosporidium parvum
ELFNQTLIYYRVNQTYFLMILSLEKLILLSHEVLLES

SEQ ID NO: 2338432 - protein, 17 aa, Cryptosporidium parvum
ELFTATIPHVLPIAKKS

SEQ ID NO: 2338433 - protein, 20 aa, Cryptosporidium parvum
ELFTGCVYELGKKSSLRVRC

SEQ ID NO: 2338434 - protein, 25 aa, Cryptosporidium parvum
ELFVTDKNLYFLPLSEKRSDLSKQI

SEQ ID NO: 2338435 - protein, 18 aa, Cryptosporidium parvum
ELISNYIIGIYKKNPILV

SEQ ID NO: 2338436 - protein, 23 aa, Cryptosporidium parvum
ELKSFCRTLLERRLRDGEIQIFP

SEQ ID NO: 2338437 - protein, 22 aa, Cryptosporidium parvum
ELLDTLKHFGIKDLYSMFVRFQ

SEQ ID NO: 2338438 - protein, 28 aa, Cryptosporidium parvum
ELLELIKTIYCQMAYFGFSSLIPNHTDE

SEQ ID NO: 2338439 - protein, 19 aa, Cryptosporidium parvum
ELLKTPQRDLPISKPTPLY

SEQ ID NO: 2338440 - protein, 17 aa, Cryptosporidium parvum
ELLLEDILKNFMSNLPY

SEQ ID NO: 2338441 - protein, 17 aa, Cryptosporidium parvum
ELLLSYLDTFISSGSSI

SEQ ID NO: 2338442 - protein, 31 aa, Cryptosporidium parvum; identical to SEQ ID NO: 2334384

SEQ ID NO: 2338443 - protein, 43 aa, Cryptosporidium parvum; identical to SEQ ID NO: 2209327

SEQ ID NO: 2338444 - protein, 29 aa, Cryptosporidium parvum
ELPQQMLLIDNAYFPNGLSSNGPILFSNG

SEQ ID NO: 2338445 - protein, 19 aa, Cryptosporidium parvum
ELQGYLGCGFSSLLDYQTK

SEQ ID NO: 2338446 - protein, 18 aa, Cryptosporidium parvum
ELRLRKLQFLEMFSRGGL

SEQ ID NO: 2338447 - protein, 26 aa, Cryptosporidium parvum
ELSDFTYNPKKLLRLCNQTLFSLLKQ

SEQ ID NO: 2338448 - protein, 23 aa, Cryptosporidium parvum
ELSNLLLPEILEKAFKFLTGCDL

SEQ ID NO: 2338449 - protein, 19 aa, Cryptosporidium parvum
ELYAGLEVPYFSAKQKKYG

SEQ ID NO: 2338450 - protein, 29 aa, Cryptosporidium parvum
ELYDKLFIHLIDAKIWHGPASAVPGIVRL

SEQ ID NO: 2338451 - protein, 20 aa, Cryptosporidium parvum
EMESLLSISMELLGLISANM

SEQ ID NO: 2338452 - protein, 20 aa, Cryptosporidium parvum
EMLFIEKLDAIPYIKVIVVL

SEQ ID NO: 2338453 - protein, 27 aa, Cryptosporidium parvum
EMLTGFAGLKFLRQSHIPFLMAKEELN

SEQ ID NO: 2338454 - protein, 20 aa, Cryptosporidium parvum
EMSYIGSIFHRVIPGFMAQG

SEQ ID NO: 2338455 - protein, 26 aa, Cryptosporidium parvum
ENGNVLRLMLNFSKIGFWIWDNNLLS

SEQ ID NO: 2338456 - protein, 25 aa, Cryptosporidium parvum
ENGWRFKYIFPIGHSPSVSSFVQIK

SEQ ID NO: 2338457 - protein, 29 aa, Cryptosporidium parvum
ENIPGLSRYLLYTLLFGSLKKKFTRQFAL

SEQ ID NO: 2338458 - protein, 23 aa, Cryptosporidium parvum
ENLSDEFILVSLKIYNSEGNELF

SEQ ID NO: 2338459 - protein, 18 aa, Cryptosporidium parvum
ENLWKAIYNQMHIDLLLG

SEQ ID NO: 2338460 - protein, 24 aa, Cryptosporidium parvum
ENNNKLLSLYFNESFITVVDWRQD

SEQ ID NO: 2338461 - protein, 48 aa, Cryptosporidium parvum; identical to SEQ ID NO: 2209343

SEQ ID NO: 2338462 - protein, 22 aa, Cryptosporidium parvum
ENRSIQINPLTSITLNGIIWHS

SEQ ID NO: 2338463 - protein, 28 aa, Cryptosporidium parvum
ENSDNFMIFLDVINYILVSTLSASKVTS

SEQ ID NO: 2338464 - protein, 17 aa, Cryptosporidium parvum
ENSRWTWNRIEKPIFRT

SEQ ID NO: 2338465 - protein, 30 aa, Cryptosporidium parvum
EPEKKYNSSFPFFPVGIIPAPISGNYHNTP

SEQ ID NO: 2338466 - protein, 21 aa, Cryptosporidium parvum
EPFVQILRRISISRVITDVGK

SEQ ID NO: 2338467 - protein, 31 aa, Cryptosporidium parvum
EQGTQSFNIPPPPSFPAPPPPSIPSGTSSPA

SEQ ID NO: 2338468 - protein, 26 aa, Cryptosporidium parvum
EQKKDNFYIRLRSGQWFALKQQVEYD

SEQ ID NO: 2338469 - protein, 30 aa, Cryptosporidium parvum; identical to SEQ ID NO: 2209352

SEQ ID NO: 2338470 - protein, 29 aa, Cryptosporidium parvum
EQSRLKHVGPKYRFVHAPVGYEKSKSTYL

SEQ ID NO: 2338471 - protein, 18 aa, Cryptosporidium parvum
ERALYILRTAVSVLEHRE

SEQ ID NO: 2338472 - protein, 32 aa, Cryptosporidium parvum
ERCQELLNRLKQNAFYSYWGQGGIVADQAQPI

SEQ ID NO: 2338473 - protein, 18 aa, Cryptosporidium parvum
ERFELFTGCVYELGKKSS

SEQ ID NO: 2338474 - protein, 38 aa, Cryptosporidium parvum
ERNCLVDIIVKLLFSYSALLLKFSYFFNENVLHEQIKR

SEQ ID NO: 2338475 - protein, 35 aa, Cryptosporidium parvum
ERQNYRIYGLPSGRPFMPFKFTFGRDVYEMRNNCA

SEQ ID NO: 2338476 - protein, 17 aa, Cryptosporidium parvum
ERSKYNNYPWLVMSEDL

SEQ ID NO: 2338477 - protein, 29 aa, Cryptosporidium parvum
ERTVRSRLRLFKKMRDRLVSTRDSLALIL

SEQ ID NO: 2338478 - protein, 27 aa, Cryptosporidium parvum
ERYFKKYITAPLLFAKAIRFYYTSKVM

SEQ ID NO: 2338479 - protein, 25 aa, Cryptosporidium parvum
ESAVYAELILKLIALFTADEVDTKY

SEQ ID NO: 2338480 - protein, 25 aa, Cryptosporidium parvum
ESDKYYLLIKIVPPNTFWIKDEYKN

SEQ ID NO: 2338481 - protein, 25 aa, Cryptosporidium parvum
ESFIEYIILLFMKFCSPQGLTYYTN

SEQ ID NO: 2338482 - protein, 27 aa, Cryptosporidium parvum
ESFPAQLRPYFAWVPTSHRNPKRERGI

SEQ ID NO: 2338483 - protein, 25 aa, Cryptosporidium parvum
ESIDFTVRRWIGRPFSQMVTLTNSI

SEQ ID NO: 2338484 - protein, 24 aa, Cryptosporidium parvum
ESKKLVSWFGSKYIKNLPSTDFSL

SEQ ID NO: 2338485 - protein, 26 aa, Cryptosporidium parvum
ESNPKNPFLVVWDPSKLSASLQAPTD

SEQ ID NO: 2338486 - protein, 26 aa, Cryptosporidium parvum
ESNRYPFIYHGFIECSFGDECQPTKE

SEQ ID NO: 2338487 - protein, 27 aa, Cryptosporidium parvum
ESPRTLPIIFTMNLRTRKPYINQKEAF

SEQ ID NO: 2338488 - protein, 29 aa, Cryptosporidium parvum
ESQEKFVLDFFDLLLSPLNFTNEIMDLEI

SEQ ID NO: 2338489 - protein, 43 aa, Cryptosporidium parvum
ESQGELSVPIAIPNIYEEGKLAGGLAWALGVGKYVCNSKSAFS

SEQ ID NO: 2338490 - protein, 20 aa, Cryptosporidium parvum
ESQINLNEWKKEALRLTFDS

SEQ ID NO: 2338491 - protein, 34 aa, Cryptosporidium parvum
ESSFQLRKLYLLSDFAYLVKSLYLCLQKFEIKEI

SEQ ID NO: 2338492 - protein, 27 aa, Cryptosporidium parvum
ESSKDLFKNLWEKGLKSPFKFDSNSEF

SEQ ID NO: 2338493 - protein, 26 aa, Cryptosporidium parvum
ESTIKQLFIMIPEFDIDYFLNLDKLV

SEQ ID NO: 2338494 - protein, 26 aa, Cryptosporidium parvum
ETCIDYPVLYHAIHSSVPKPVAVPEA

SEQ ID NO: 2338495 - protein, 18 aa, Cryptosporidium parvum
ETCSNKHLQPLFKFDLEN

SEQ ID NO: 2338496 - protein, 17 aa, Cryptosporidium parvum
ETFPSLIRLYNPGFNPE

SEQ ID NO: 2338497 - protein, 23 aa, Cryptosporidium parvum
ETHNKYYKSLKLSSTPYFQNTTS

SEQ ID NO: 2338498 - protein, 23 aa, Cryptosporidium parvum
EVEYDLIWLLVPMEPGKGEESIK

SEQ ID NO: 2338499 - protein, 28 aa, Cryptosporidium parvum
EVIDSYRTIYRLLLDNMQLFRSFEIKFS

SEQ ID NO: 2338500 - protein, 29 aa, Cryptosporidium parvum
EVLLKVVCIYILNMLRFIAVINPELSSSF

SEQ ID NO: 2338501 - protein, 18 aa, Cryptosporidium parvum
EVLRLMEKIEVLSANVRE

SEQ ID NO: 2338502 - protein, 26 aa, Cryptosporidium parvum
EVNLIYTSYLLFLISCSHKDFYQMEF

SEQ ID NO: 2338503 - protein, 27 aa, Cryptosporidium parvum
EVSGELWIPFAISQIIYRKSKVLMNPL

SEQ ID NO: 2338504 - protein, 32 aa, Cryptosporidium parvum
EVYREFLFNKFGNSLFFIPKTIYLKEKNNEKI

SEQ ID NO: 2338505 - protein, 23 aa, Cryptosporidium parvum
EWEHIQLRWRVLDLAKHILNEKE

SEQ ID NO: 2338506 - protein, 20 aa, Cryptosporidium parvum
EWMRSIYMVFENKLEIIPNI

SEQ ID NO: 2338507 - protein, 23 aa, Cryptosporidium parvum
EYFNRLCINLISYDIWNFSGNFD

SEQ ID NO: 2338508 - protein, 21 aa, Cryptosporidium parvum
EYLPIIFDEFHFCNTSCLILS

SEQ ID NO: 2338509 - protein, 25 aa, Cryptosporidium parvum
EYLVSAFLLYLLICSFRELAFSSFS

SEQ ID NO: 2338510 - protein, 24 aa, Cryptosporidium parvum
EYSSPIIPKILYIESQPLEYRYRK

SEQ ID NO: 2338511 - protein, 27 aa, Cryptosporidium parvum
EYTFKIEVMINFSFEAILFAIENFFFF

SEQ ID NO: 2338512 - protein, 19 aa, Cryptosporidium parvum
EYYNQFFPRVKFITKIVEK

SEQ ID NO: 2338513 - protein, 21 aa, Cryptosporidium parvum
FAAIPSVTLFCREVINFVTNP

SEQ ID NO: 2338514 - protein, 20 aa, Cryptosporidium parvum
FAEKYLFFPGKVETIDIIVD

SEQ ID NO: 2338515 - protein, 25 aa, Cryptosporidium parvum
FAIEICMIPSIWYLELIHCMHFGMA

SEQ ID NO: 2338516 - protein, 22 aa, Cryptosporidium parvum
FAILLLFGVFLTVSEASEGPIE

SEQ ID NO: 2338517 - protein, 19 aa, Cryptosporidium parvum
FAILLLFSILENKFGIAHD

SEQ ID NO: 2338518 - protein, 28 aa, Cryptosporidium parvum
FASFKLMSLYILKKIYKVAYENPKLNLD

SEQ ID NO: 2338519 - protein, 17 aa, Cryptosporidium parvum
FASIAKDILRYPEVVST

SEQ ID NO: 2338520 - protein, 22 aa, Cryptosporidium parvum
FAYLFQLLWRYIISEGTQINAA

SEQ ID NO: 2338521 - protein, 17 aa, Cryptosporidium parvum
FCEIVQGFKIDEISCNC

SEQ ID NO: 2338522 - protein, 30 aa, Cryptosporidium parvum
FCIEILIQMMLIIYTFILRCNAVFNPEESI

SEQ ID NO: 2338523 - protein, 17 aa, Cryptosporidium parvum
FDFSQFNICLVPQVEEF

SEQ ID NO: 2338524 - protein, 21 aa, Cryptosporidium parvum
FDLATILFSVVAYGECIKRLN

SEQ ID NO: 2338525 - protein, 33 aa, Cryptosporidium parvum
FDPELTFIFTNLEYIAELYPDILRIEKKISCSQ

SEQ ID NO: 2338526 - protein, 25 aa, Cryptosporidium parvum
FDRKSEFFKFFKPRSTPMSNLRVFF

SEQ ID NO: 2338527 - protein, 21 aa, Cryptosporidium parvum
FDSFTLLSILNSSIKRFKTDI

SEQ ID NO: 2338528 - protein, 28 aa, Cryptosporidium parvum
FDVLKSSLFIVFFFEKSSLDTILNEIFQ

SEQ ID NO: 2338529 - protein, 18 aa, Cryptosporidium parvum
FDVRSALICYLCARNFRN

SEQ ID NO: 2338530 - protein, 26 aa, Cryptosporidium parvum
FDYIQERRLYYKSDFTRFMLNLIINK

SEQ ID NO: 2338531 - protein, 27 aa, Cryptosporidium parvum
FEAILFAIENFFFFKNGIAKKSLLKHF

SEQ ID NO: 2338532 - protein, 25 aa, Cryptosporidium parvum
FEDHELFKFLEFKGIPILNKNSKDI

SEQ ID NO: 2338533 - protein, 18 aa, Cryptosporidium parvum
FEDLSFKYRNDPINFFWI

SEQ ID NO: 2338534 - protein, 17 aa, Cryptosporidium parvum
FEELGPLARKILMAAGY

SEQ ID NO: 2338535 - protein, 34 aa, Cryptosporidium parvum; identical to SEQ ID NO: 2209395

SEQ ID NO: 2338536 - protein, 22 aa, Cryptosporidium parvum
FEKFMIKELIKLLIMLNNVSEK

SEQ ID NO: 2338537 - protein, 18 aa, Cryptosporidium parvum
FETAPMIGFCPDGSEVPP

SEQ ID NO: 2338538 - protein, 23 aa, Cryptosporidium parvum
FETFIKEIIPPPQLIDPKYDIRS

SEQ ID NO: 2338539 - protein, 26 aa, Cryptosporidium parvum
FFADVEPRLSVLYKLLVKISSTHNQV

SEQ ID NO: 2338540 - protein, 24 aa, Cryptosporidium parvum
FFDGTLIHWSLQYIFSQIYNRNIG

SEQ ID NO: 2338541 - protein, 35 aa, Cryptosporidium parvum
FFIIYQFFFNSFFSNRVCLFETFKLIKENRNSQFM

SEQ ID NO: 2338542 - protein, 19 aa, Cryptosporidium parvum
FFNIEYVYPLGYAPSMSKF

SEQ ID NO: 2338543 - protein, 17 aa, Cryptosporidium parvum
FFQVFKILSKEAASIYG

SEQ ID NO: 2338544 - protein, 32 aa, Cryptosporidium parvum
FFSVPIVIVSALYKLCHFPLFDTQRTNLIVPP

SEQ ID NO: 2338545 - protein, 22 aa, Cryptosporidium parvum
FGLIFLFMGCGYIGSIRVNLLG

SEQ ID NO: 2338546 - protein, 24 aa, Cryptosporidium parvum
FGNNSNLNLIPYKVLNPIMNVTSL

SEQ ID NO: 2338547 - protein, 17 aa, Cryptosporidium parvum
FGNYINFASMKYVFEQY

SEQ ID NO: 2338548 - protein, 33 aa, Cryptosporidium parvum
FGPVTFPNGAILPLGALLPNGTLLQAGTKLGQM

SEQ ID NO: 2338549 - protein, 23 aa, Cryptosporidium parvum
FGQRRRLFGSVRPLSNIGQCAAL

SEQ ID NO: 2338550 - protein, 33 aa, Cryptosporidium parvum
FGSLLKECKLLTLIILLIILAQLNYATSNISKL

SEQ ID NO: 2338551 - protein, 27 aa, Cryptosporidium parvum
FHANLESFFINKYLLIDYKKLEHMYNS

SEQ ID NO: 2338552 - protein, 17 aa, Cryptosporidium parvum
FHIKCPNGYRIIGIDAI

SEQ ID NO: 2338553 - protein, 22 aa, Cryptosporidium parvum
FIACILYFISLVSANGVCILKK

SEQ ID NO: 2338554 - protein, 23 aa, Cryptosporidium parvum
FIAYLFLFFYCLNVARCDNKINN

SEQ ID NO: 2338555 - protein, 25 aa, Cryptosporidium parvum
FIDGNNLVLVLFYDSSTTSKNIIHG

SEQ ID NO: 2338556 - protein, 17 aa, Cryptosporidium parvum
FIDKFVPLIKRHSNKKI

SEQ ID NO: 2338557 - protein, 31 aa, Cryptosporidium parvum
FIEEMDDLTIMLYLLAKEFPSKNHFASIAKD

SEQ ID NO: 2338558 - protein, 23 aa, Cryptosporidium parvum
FIESYFQSFPPENFEGATLLVAG

SEQ ID NO: 2338559 - protein, 28 aa, Cryptosporidium parvum
FIFICIFLVFCKLPYISRCEQLESEEIS

SEQ ID NO: 2338560 - protein, 19 aa, Cryptosporidium parvum
FIIALIISCLFCDIYAAEA

SEQ ID NO: 2338561 - protein, 19 aa, Cryptosporidium parvum
FIIELILNQFVVFGKFRDE

SEQ ID NO: 2338562 - protein, 27 aa, Cryptosporidium parvum
FIIFLLSALCLAFVPNFAVLGAENETG

SEQ ID NO: 2338563 - protein, 19 aa, Cryptosporidium parvum
FIIVGLLIGLISCEERENI

SEQ ID NO: 2338564 - protein, 25 aa, Cryptosporidium parvum
FILGFFLIFLGVHSESSLLPEGTVS

SEQ ID NO: 2338565 - protein, 21 aa, Cryptosporidium parvum
FILGLLFSVLSSLSLTNVTAH

SEQ ID NO: 2338566 - protein, 17 aa, Cryptosporidium parvum
FILIGSVFTSIIKCSKK

SEQ ID NO: 2338567 - protein, 18 aa, Cryptosporidium parvum
FILNNCIKIKFPYINKFL

SEQ ID NO: 2338568 - protein, 18 aa, Cryptosporidium parvum
FIMHCDFPDCSLCNDFQS

SEQ ID NO: 2338569 - protein, 18 aa, Cryptosporidium parvum
FIQDLLNEKYDFQNILKK

SEQ ID NO: 2338570 - protein, 20 aa, Cryptosporidium parvum
FIRVCVHNYFWRVPCGEIVE

SEQ ID NO: 2338571 - protein, 18 aa, Cryptosporidium parvum
FISFILEYTQTILGSSSN

SEQ ID NO: 2338572 - protein, 18 aa, Cryptosporidium parvum
FISFLFLIFQYPSSISFH

SEQ ID NO: 2338573 - protein, 18 aa, Cryptosporidium parvum
FISIFSILFTLFSGDDLN

SEQ ID NO: 2338574 - protein, 17 aa, Cryptosporidium parvum
FISTFIPILSKKSSKTS

SEQ ID NO: 2338575 - protein, 25 aa, Cryptosporidium parvum
FKAKKDLMKFTPQKGIELGKKIARN

SEQ ID NO: 2338576 - protein, 19 aa, Cryptosporidium parvum
FKEFWTLFVISSTGIPNKG

SEQ ID NO: 2338577 - protein, 25 aa, Cryptosporidium parvum
FKKDEYIFFLETLIPQISTIDESFN

SEQ ID NO: 2338578 - protein, 17 aa, Cryptosporidium parvum
FKLFLQKFEEKLMHVLG

SEQ ID NO: 2338579 - protein, 20 aa, Cryptosporidium parvum
FKMIQSLRKVIWNSILGLDG

SEQ ID NO: 2338580 - protein, 31 aa, Cryptosporidium parvum
FKNWSFLAILNILLFITKFQSGATSATDELF

SEQ ID NO: 2338581 - protein, 20 aa, Cryptosporidium parvum
FKQDWTLFVMVSTGIPEYED

SEQ ID NO: 2338582 - protein, 19 aa, Cryptosporidium parvum
FKVPLVIQLTDDEKFIFKS

SEQ ID NO: 2338583 - protein, 26 aa, Cryptosporidium parvum
FKVSIFYFVLGLILDFGKVSCIPTGI

SEQ ID NO: 2338584 - protein, 29 aa, Cryptosporidium parvum
FKWFFIATLVFIFGLLILSCRAEEIEGED

SEQ ID NO: 2338585 - protein, 17 aa, Cryptosporidium parvum
FLALFSTSVESVKAKAS

SEQ ID NO: 2338586 - protein, 21 aa, Cryptosporidium parvum
FLDQRIALEWIHKYIVNFGGD

SEQ ID NO: 2338587 - protein, 19 aa, Cryptosporidium parvum
FLFIIYSSSRDVETKPGIS

SEQ ID NO: 2338588 - protein, 20 aa, Cryptosporidium parvum
FLIILLLSISEVYSEQNDEY

SEQ ID NO: 2338589 - protein, 17 aa, Cryptosporidium parvum
FLIIYFRERERTKTRER

SEQ ID NO: 2338590 - protein, 20 aa, Cryptosporidium parvum
FLILCVFTSGTPIPTPNEIV

SEQ ID NO: 2338591 - protein, 19 aa, Cryptosporidium parvum
FLILFILIKIEYKRLIVMA

SEQ ID NO: 2338592 - protein, 19 aa, Cryptosporidium parvum
FLIVFLGSFTFCEQLGHNN

SEQ ID NO: 2338593 - protein, 17 aa, Cryptosporidium parvum
FLKFMHTNRMNIRKWIL

SEQ ID NO: 2338594 - protein, 25 aa, Cryptosporidium parvum
FLLFIKLGVFSLTINTSPKPNPFTV

SEQ ID NO: 2338595 - protein, 19 aa, Cryptosporidium parvum
FLLFLELQNAWSSLNLSLN

SEQ ID NO: 2338596 - protein, 24 aa, Cryptosporidium parvum
FLLKWIIFSYIVINNINGIKSINT

SEQ ID NO: 2338597 - protein, 22 aa, Cryptosporidium parvum
FLLLFFTKYLKITIGAEAPINE

SEQ ID NO: 2338598 - protein, 23 aa, Cryptosporidium parvum
FLLLLLLVLSKQGEALKVKSFFF

SEQ ID NO: 2338599 - protein, 19 aa, Cryptosporidium parvum
FLMHFVINYGKIPRVIFDR

SEQ ID NO: 2338600 - protein, 24 aa, Cryptosporidium parvum
FLSRFKDFLLRRTINSYLFIGDEI

SEQ ID NO: 2338601 - protein, 23 aa, Cryptosporidium parvum
FLTPFIGLVLLLNFAHGNPKTSS

SEQ ID NO: 2338602 - protein, 28 aa, Cryptosporidium parvum
FMPDGTIFKQGWTLFVMINTGVPDYDPN

SEQ ID NO: 2338603 - protein, 27 aa, Cryptosporidium parvum
FMTETLDLMIYLARKFNPKLLGEGLAI

SEQ ID NO: 2338604 - protein, 22 aa, Cryptosporidium parvum
FNEDWTLFVILSTGVPEYGDNS

SEQ ID NO: 2338605 - protein, 17 aa, Cryptosporidium parvum
FNEMLFIEKLDAIPYIK

SEQ ID NO: 2338606 - protein, 35 aa, Cryptosporidium parvum
FNFEKMVFKSFYNLSLFFLKWFKTGPERGDCRFYK

SEQ ID NO: 2338607 - protein, 26 aa, Cryptosporidium parvum
FNGRTNIVFLMKGLDLKLLKPGDLPS

SEQ ID NO: 2338608 - protein, 23 aa, Cryptosporidium parvum
FNHGNLLWINGTLGKDINGRLLL

SEQ ID NO: 2338609 - protein, 17 aa, Cryptosporidium parvum
FNKPFPCNSKYKSIQKL

SEQ ID NO: 2338610 - protein, 23 aa, Cryptosporidium parvum
FNQPAGIITRRLGKRGVSHHHHH

SEQ ID NO: 2338611 - protein, 19 aa, Cryptosporidium parvum
FNSDCIYGLRTLSIGARHA

SEQ ID NO: 2338612 - protein, 19 aa, Cryptosporidium parvum
FPEFLGNRSFPITPPVVLS

SEQ ID NO: 2338613 - protein, 18 aa, Cryptosporidium parvum
FPFIINSKGPRAFFKNIA

SEQ ID NO: 2338614 - protein, 25 aa, Cryptosporidium parvum
FPLAFTSFVLCTLEYEIWNLENNVE

SEQ ID NO: 2338615 - protein, 41 aa, Cryptosporidium parvum
FPQFQDFYYFIPHIVPTHKIYLAINFFFPFENKKMASIRST

SEQ ID NO: 2338616 - protein, 29 aa, Cryptosporidium parvum
FPYVRSEPMLHLFFYNSLNKNLSSTDNTS

SEQ ID NO: 2338617 - protein, 31 aa, Cryptosporidium parvum
FQEKMIENGVFVRVFVLLTDFMDTLMIGDIS

SEQ ID NO: 2338618 - protein, 19 aa, Cryptosporidium parvum
FQFHTLILKICFGYFTVEI

SEQ ID NO: 2338619 - protein, 30 aa, Cryptosporidium parvum; identical to SEQ ID NO: 2209459

SEQ ID NO: 2338620 - protein, 18 aa, Cryptosporidium parvum
FQIRTCNHVIWTSEVLLS

SEQ ID NO: 2338621 - protein, 20 aa, Cryptosporidium parvum
FQIVFEYIFTIFNEKLSLSG

SEQ ID NO: 2338622 - protein, 26 aa, Cryptosporidium parvum
FQNEVFSMVWISYPTLVLSIIESILR

SEQ ID NO: 2338623 - protein, 17 aa, Cryptosporidium parvum
FQWGFYLGDGTINLVTD

SEQ ID NO: 2338624 - protein, 20 aa, Cryptosporidium parvum
FSCLIIKWNFSLSQDSLHSV

SEQ ID NO: 2338625 - protein, 24 aa, Cryptosporidium parvum
FSDKNLMIMAKGKRLYNCKTKNWE

SEQ ID NO: 2338626 - protein, 23 aa, Cryptosporidium parvum
FSEALIKFCSYLKSFSPKRIHLD

SEQ ID NO: 2338627 - protein, 27 aa, Cryptosporidium parvum
FSEEIILLLNLANKIEMAILNTLLKRF

SEQ ID NO: 2338628 - protein, 23 aa, Cryptosporidium parvum
FSEFRTYKGVFSELIFHDKTASN

SEQ ID NO: 2338629 - protein, 17 aa, Cryptosporidium parvum
FSGFDLLLGVYPSTTIK

SEQ ID NO: 2338630 - protein, 33 aa, Cryptosporidium parvum; identical to SEQ ID NO: 2189886

SEQ ID NO: 2338631 - protein, 24 aa, Cryptosporidium parvum
FSKVDVPTLFFWGAEDRLCPLSSA

SEQ ID NO: 2338632 - protein, 22 aa, Cryptosporidium parvum
FSLPLTYKIFLPDDVLPSVTVV

SEQ ID NO: 2338633 - protein, 18 aa, Cryptosporidium parvum
FSMLVLESVIKILKNQRS

SEQ ID NO: 2338634 - protein, 21 aa, Cryptosporidium parvum
FSNCGIFSTYWQKYLNFFSTS

SEQ ID NO: 2338635 - protein, 26 aa, Cryptosporidium parvum
FSNKDIIINKYLNTYFSYWSEIHQRF

SEQ ID NO: 2338636 - protein, 23 aa, Cryptosporidium parvum
FSNLFYTYIIVPLIKDDLLKNMS

SEQ ID NO: 2338637 - protein, 26 aa, Cryptosporidium parvum
FSQFKYYMKMCLISFPAILGSKSKDF

SEQ ID NO: 2338638 - protein, 17 aa, Cryptosporidium parvum
FSSIFLCSKHEIKEIPH

SEQ ID NO: 2338639 - protein, 20 aa, Cryptosporidium parvum
FSSSFPHIFGGRTDIHCLVP

SEQ ID NO: 2338640 - protein, 23 aa, Cryptosporidium parvum
FSVFLSLFLAFPVRSSDEKKYDG

SEQ ID NO: 2338641 - protein, 22 aa, Cryptosporidium parvum
FSYSELLSYRLLINIINPKIQL

SEQ ID NO: 2338642 - protein, 19 aa, Cryptosporidium parvum
FTATIPHVLPIAKKSLAFT

SEQ ID NO: 2338643 - protein, 24 aa, Cryptosporidium parvum
FTDSLELFITGIRFICNDGSSSFH

SEQ ID NO: 2338644 - protein, 20 aa, Cryptosporidium parvum
FTERSFLSKISLVRTKIIHK

SEQ ID NO: 2338645 - protein, 29 aa, Cryptosporidium parvum
FTKIDSVVLFYVPWCVYCRGIMPEFEKAA

SEQ ID NO: 2338646 - protein, 17 aa, Cryptosporidium parvum
FTKSLLHFVVMMKVTAT

SEQ ID NO: 2338647 - protein, 21 aa, Cryptosporidium parvum
FTNDWINFLNLLKTIEIDSKT

SEQ ID NO: 2338648 - protein, 26 aa, Cryptosporidium parvum
FTNKSTPWISPFYGKYLAYYIGSEEH

SEQ ID NO: 2338649 - protein, 17 aa, Cryptosporidium parvum
FTRIAFGSIWSDKKYRG

SEQ ID NO: 2338650 - protein, 29 aa, Cryptosporidium parvum
FTRPVGYVSPLPYAPLPGPYFRYLGNESE

SEQ ID NO: 2338651 - protein, 31 aa, Cryptosporidium parvum; identical to SEQ ID NO: 2209481

SEQ ID NO: 2338652 - protein, 24 aa, Cryptosporidium parvum
FTSSLCERIHLFRKHSYGKDLVNT

SEQ ID NO: 2338653 - protein, 19 aa, Cryptosporidium parvum
FTTPYHFLELNPSSIRELI

SEQ ID NO: 2338654 - protein, 25 aa, Cryptosporidium parvum
FTYARKVFELVVIRKLTLLHSRGDL

SEQ ID NO: 2338655 - protein, 17 aa, Cryptosporidium parvum
FVFIAIFALNSYSTLAE

SEQ ID NO: 2338656 - protein, 22 aa, Cryptosporidium parvum
FVGIFLKNSLSPDVLFPGWDNN

SEQ ID NO: 2338657 - protein, 19 aa, Cryptosporidium parvum
FVKIRVFVETLNPVKHQSQ

SEQ ID NO: 2338658 - protein, 23 aa, Cryptosporidium parvum
FVKNFILEVSFLNAASLETGSEG

SEQ ID NO: 2338659 - protein, 17 aa, Cryptosporidium parvum
FVLLLMHTLVSCEKFEE

SEQ ID NO: 2338660 - protein, 19 aa, Cryptosporidium parvum
FVMISEFFGRWLDTSNSLF

SEQ ID NO: 2338661 - protein, 31 aa, Cryptosporidium parvum; identical to SEQ ID NO: 2209490

SEQ ID NO: 2338662 - protein, 18 aa, Cryptosporidium parvum
FVPLYILDNSTETAALPA

SEQ ID NO: 2338663 - protein, 18 aa, Cryptosporidium parvum
FVTGKRWPRIYKIELTKI

SEQ ID NO: 2338664 - protein, 18 aa, Cryptosporidium parvum
FVTISVNGFYAFDPIVIP

SEQ ID NO: 2338665 - protein, 20 aa, Cryptosporidium parvum
FVTNPILPPPPTSTIVKPYK

SEQ ID NO: 2338666 - protein, 17 aa, Cryptosporidium parvum
FVVEIIKKLNLNVMFYN

SEQ ID NO: 2338667 - protein, 20 aa, Cryptosporidium parvum
FYAQCLKIFSTSYGPESIYG

SEQ ID NO: 2338668 - protein, 18 aa, Cryptosporidium parvum
FYDHYIFNQCTCSKKKSG

SEQ ID NO: 2338669 - protein, 22 aa, Cryptosporidium parvum
FYEFVKKRLNILESSKFDFIQD

SEQ ID NO: 2338670 - protein, 26 aa, Cryptosporidium parvum
FYKGEIKFLPLFEFLNVYAETFVMGG

SEQ ID NO: 2338671 - protein, 26 aa, Cryptosporidium parvum
FYLFTLYTSLIYPVSYGSNYYQAISE

SEQ ID NO: 2338672 - protein, 20 aa, Cryptosporidium parvum
FYLIILLKTSNCQIPGGNYD

SEQ ID NO: 2338673 - protein, 20 aa, Cryptosporidium parvum
FYLIVIVGLVVSVESGDLYI

SEQ ID NO: 2338674 - protein, 23 aa, Cryptosporidium parvum
FYSKIFAITKSWWLNISKLSDPT

SEQ ID NO: 2338675 - protein, 21 aa, Cryptosporidium parvum
FYSPIVFVRSIIRTKLSPCKI

SEQ ID NO: 2338676 - protein, 27 aa, Cryptosporidium parvum
GAIIPEIRLLQLYTILNKYAVQKGFSC

SEQ ID NO: 2338677 - protein, 21 aa, Cryptosporidium parvum
GARLYSPTYFKPAAASDEEYW

SEQ ID NO: 2338678 - protein, 25 aa, Cryptosporidium parvum
GASNLFAIILSHFEWEHIQLRWRVL

SEQ ID NO: 2338679 - protein, 17 aa, Cryptosporidium parvum
GCLLLIVTHILCANAIH

SEQ ID NO: 2338680 - protein, 24 aa, Cryptosporidium parvum
GCYIPCQPPFKDSFYSHWCSNDLS

SEQ ID NO: 2338681 - protein, 24 aa, Cryptosporidium parvum
GDHLKPIRYIYPRGYAPSTSNFTQ

SEQ ID NO: 2338682 - protein, 33 aa, Cryptosporidium parvum; identical to SEQ ID NO: 2190034

SEQ ID NO: 2338683 - protein, 22 aa, Cryptosporidium parvum
GDPVLFKLVHESRPLSKIQLEI

SEQ ID NO: 2338684 - protein, 22 aa, Cryptosporidium parvum
GDRLLYGWYTIRDIYNKGEWGV

SEQ ID NO: 2338685 - protein, 20 aa, Cryptosporidium parvum
GEALKVKSFFFGLGGGDKKE

SEQ ID NO: 2338686 - protein, 24 aa, Cryptosporidium parvum
GEELHLIYYGLLTLNCFTHQTQGE

SEQ ID NO: 2338687 - protein, 25 aa, Cryptosporidium parvum
GEEYSYYSFVPKFTDLRNKGVFSGE

SEQ ID NO: 2338688 - protein, 22 aa, Cryptosporidium parvum
GEIFVNFDFSLLSNGDFIDSSV

SEQ ID NO: 2338689 - protein, 22 aa, Cryptosporidium parvum
GEIIPYDVFITNITIPLFEVKN

SEQ ID NO: 2338690 - protein, 24 aa, Cryptosporidium parvum
GENSYPFFPPGVQPAPIDGDENNT

SEQ ID NO: 2338691 - protein, 28 aa, Cryptosporidium parvum
GEPKQDNLPFIPSPPPPPPSIAPEHEPE

SEQ ID NO: 2338692 - protein, 19 aa, Cryptosporidium parvum
GFFTFWVTYSKIKSSYTIT

SEQ ID NO: 2338693 - protein, 40 aa, Cryptosporidium parvum
GFISFSPIYSEAFVPALPSYAPPHGILAPLWTDFTTRGRR

SEQ ID NO: 2338694 - protein, 18 aa, Cryptosporidium parvum
GFIVYPRIKTSVLEKMYN

SEQ ID NO: 2338695 - protein, 24 aa, Cryptosporidium parvum
GFKNLIVDILDFLVELRLLNNIEA

SEQ ID NO: 2338696 - protein, 17 aa, Cryptosporidium parvum
GFLSFLDESRRKLNEKH

SEQ ID NO: 2338697 - protein, 24 aa, Cryptosporidium parvum
GFNKAKEFLLLLSRNARLIENNLG

SEQ ID NO: 2338698 - protein, 25 aa, Cryptosporidium parvum
GFSENYLSFFNLKNSNIVGIVCSTN

SEQ ID NO: 2338699 - protein, 26 aa, Cryptosporidium parvum
GFSLYMIFIFLLGNVASIHINRELQN

SEQ ID NO: 2338700 - protein, 20 aa, Cryptosporidium parvum
GFTRVKYIHPLGYSPSYMIM

SEQ ID NO: 2338701 - protein, 41 aa, Cryptosporidium parvum
GFVRDCRLFLSESFSNLLDLELLELLLELWSDLANSKSSNN

SEQ ID NO: 2338702 - protein, 18 aa, Cryptosporidium parvum
GFWPVSAIRFAGGDLVVQ

SEQ ID NO: 2338703 - protein, 27 aa, Cryptosporidium parvum
GFYDPITRQYPWSSIPWHKVDHAMVIT

SEQ ID NO: 2338704 - protein, 27 aa, Cryptosporidium parvum
GGELVLTIVPSLPKYFGGKGAYSIESS

SEQ ID NO: 2338705 - protein, 25 aa, Cryptosporidium parvum
GGGLVTMLPIVRYMKLLNSYGEYMS

SEQ ID NO: 2338706 - protein, 24 aa, Cryptosporidium parvum
GGISLKFYIRMCTNLINHFPRLHH

SEQ ID NO: 2338707 - protein, 29 aa, Cryptosporidium parvum
GGLSPETIFYFESLILQASSILFIIVANA

SEQ ID NO: 2338708 - protein, 18 aa, Cryptosporidium parvum
GGQNKIISPLLYSLLQLT

SEQ ID NO: 2338709 - protein, 25 aa, Cryptosporidium parvum
GHTTGWYITAFCRAVYFAEKDVCIS

SEQ ID NO: 2338710 - protein, 25 aa, Cryptosporidium parvum
GIAYYDYDFLYSWEPKSYNLTVNVT

SEQ ID NO: 2338711 - protein, 19 aa, Cryptosporidium parvum
GICISILIFSISGVKCRLY

SEQ ID NO: 2338712 - protein, 34 aa, Cryptosporidium parvum
GIIHQGNFQLFRGKLPIVTLSSTSILLPIDSISD

SEQ ID NO: 2338713 - protein, 22 aa, Cryptosporidium parvum
GIILFLILHVLIKFKHVIGEIT

SEQ ID NO: 2338714 - protein, 27 aa, Cryptosporidium parvum
GIKHDDIRFLFWKMRDYSLQNPEMNLI

SEQ ID NO: 2338715 - protein, 18 aa, Cryptosporidium parvum
GINHPHFPPGIQAAPLNG

SEQ ID NO: 2338716 - protein, 26 aa, Cryptosporidium parvum
GINWKGVKIMALKFLRGNGVGFLSDS

SEQ ID NO: 2338717 - protein, 26 aa, Cryptosporidium parvum
GIQNSDFLYLYPQGYAPKPSTFKEFK

SEQ ID NO: 2338718 - protein, 25 aa, Cryptosporidium parvum
GKCLNGIIFTAMALDSGAIKGSVVP

SEQ ID NO: 2338719 - protein, 24 aa, Cryptosporidium parvum
GKDGKTICWTLLNNQQPEIFTEIH

SEQ ID NO: 2338720 - protein, 23 aa, Cryptosporidium parvum
GKECVLTNYYPLEAICQDGTRSK

SEQ ID NO: 2338721 - protein, 25 aa, Cryptosporidium parvum
GKFNPYTMSLLFMIKERQQHDPRIL

SEQ ID NO: 2338722 - protein, 24 aa, Cryptosporidium parvum
GKHKNLCFIYLKNGEISLEEQSML

SEQ ID NO: 2338723 - protein, 31 aa, Cryptosporidium parvum; identical to SEQ ID NO: 2209537

SEQ ID NO: 2338724 - protein, 22 aa, Cryptosporidium parvum
GKLSLLPSLALKINKNSKLSTL

SEQ ID NO: 2338725 - protein, 20 aa, Cryptosporidium parvum
GKNDALYAKSLLLTKLINKE

SEQ ID NO: 2338726 - protein, 22 aa, Cryptosporidium parvum
GKPSVRKVFLDPTGRNPGGILS

SEQ ID NO: 2338727 - protein, 18 aa, Cryptosporidium parvum
GLFDPEYGGRGRVLESYK

SEQ ID NO: 2338728 - protein, 22 aa, Cryptosporidium parvum
GLFHLIEHVLFLGTKKYPAPES

SEQ ID NO: 2338729 - protein, 19 aa, Cryptosporidium parvum
GLGFLILAICLNVEVKSQQ

SEQ ID NO: 2338730 - protein, 17 aa, Cryptosporidium parvum
GLLVQLSLSLERCLASN

SEQ ID NO: 2338731 - protein, 22 aa, Cryptosporidium parvum
GLNMKGLFCLGWNSIKIKKADS

SEQ ID NO: 2338732 - protein, 19 aa, Cryptosporidium parvum
GLSLFINFGIRFFGKLESD

SEQ ID NO: 2338733 - protein, 25 aa, Cryptosporidium parvum
GLTSSWRLWSLTEKKWNNLDLSLEC

SEQ ID NO: 2338734 - protein, 17 aa, Cryptosporidium parvum
GLVLPGGGIFPGGILIP

SEQ ID NO: 2338735 - protein, 19 aa, Cryptosporidium parvum
GLVLPIQVLNEFIPSSVYN

SEQ ID NO: 2338736 - protein, 18 aa, Cryptosporidium parvum
GMKIPFYLRQELIQLSNI

SEQ ID NO: 2338737 - protein, 20 aa, Cryptosporidium parvum
GMMTNWYRQLQKMGLVVPKP

SEQ ID NO: 2338738 - protein, 22 aa, Cryptosporidium parvum
GNEELILSLKLYNDSIIFRNEK

SEQ ID NO: 2338739 - protein, 26 aa, Cryptosporidium parvum
GNEKLIIIYIIMKYINHNLNSNKFQY

SEQ ID NO: 2338740 - protein, 18 aa, Cryptosporidium parvum
GNGKVTLKYPPYSGLEEE

SEQ ID NO: 2338741 - protein, 26 aa, Cryptosporidium parvum
GNNNRIPLPIMVRYGLTEDGKLAAFS

SEQ ID NO: 2338742 - protein, 22 aa, Cryptosporidium parvum
GPDCKTVFVDFKYYPICGTNGK

SEQ ID NO: 2338743 - protein, 24 aa, Cryptosporidium parvum
GPDGRDLFLPENGIRRGINHWLSD

SEQ ID NO: 2338744 - protein, 25 aa, Cryptosporidium parvum
GPKDRYLSFLPLAHIFEREVNHILI

SEQ ID NO: 2338745 - protein, 20 aa, Cryptosporidium parvum
GPKVPIIITSPQPILDIESL

SEQ ID NO: 2338746 - protein, 20 aa, Cryptosporidium parvum
GQMLSLHTLIFENLYTDADV

SEQ ID NO: 2338747 - protein, 17 aa, Cryptosporidium parvum
GQRLKEWVILKYKQIHD

SEQ ID NO: 2338748 - protein, 18 aa, Cryptosporidium parvum
GRKKPVLRSMRTLSLEGF

SEQ ID NO: 2338749 - protein, 31 aa, Cryptosporidium parvum
GRLFLPILVIFSFVWLSESVRLENYEILAED

SEQ ID NO: 2338750 - protein, 26 aa, Cryptosporidium parvum
GRRGYFSRFTGFVSRTYRRLTSRLTS

SEQ ID NO: 2338751 - protein, 24 aa, Cryptosporidium parvum
GRVSLAYFLFPNVISRDILAKVTP

SEQ ID NO: 2338752 - protein, 22 aa, Cryptosporidium parvum
GSEIFSFYTYLSDSIDFIQSEV

SEQ ID NO: 2338753 - protein, 21 aa, Cryptosporidium parvum
GSFTPPPPPPPPPPPPPPPPP

SEQ ID NO: 2338754 - protein, 24 aa, Cryptosporidium parvum
GSKDKNFALVKRLLSKFLSSKEKF

SEQ ID NO: 2338755 - protein, 29 aa, Cryptosporidium parvum
GSKTIKYGLLKYLSLNDYDPKIKSIRSIL

SEQ ID NO: 2338756 - protein, 24 aa, Cryptosporidium parvum
GSQNKNLFLINVFERYISLSDPFS

SEQ ID NO: 2338757 - protein, 23 aa, Cryptosporidium parvum
GSVKFNYLSIPWEDLEDSRGISS

SEQ ID NO: 2338758 - protein, 23 aa, Cryptosporidium parvum
GSVSHGFLCLGLNKLKSFKTESW

SEQ ID NO: 2338759 - protein, 25 aa, Cryptosporidium parvum
GTIPGIFPIKYLRNLGYHVDGGFIA

SEQ ID NO: 2338760 - protein, 24 aa, Cryptosporidium parvum
GTLDKFIKGFYILMAETGVRLQIY

SEQ ID NO: 2338761 - protein, 20 aa, Cryptosporidium parvum
GTLIEIIDLKLSSCLTYIIN

SEQ ID NO: 2338762 - protein, 24 aa, Cryptosporidium parvum
GTYNYGFQFINTFTSKIVLSINLY

SEQ ID NO: 2338763 - protein, 33 aa, Cryptosporidium parvum
GVDVVIFSSKLFPIDLIPLLSGATTISFYGLTL

SEQ ID NO: 2338764 - protein, 20 aa, Cryptosporidium parvum
GVGDSIPPLGPFDRTRGPGC

SEQ ID NO: 2338765 - protein, 26 aa, Cryptosporidium parvum
GVKGEGHYIFFRAPGYMPGASAVLIG

SEQ ID NO: 2338766 - protein, 22 aa, Cryptosporidium parvum
GVLFLILSWVGLVVPKLEIYIS

SEQ ID NO: 2338767 - protein, 23 aa, Cryptosporidium parvum
GVRSHFAAQKIYRVALKYLEMSP

SEQ ID NO: 2338768 - protein, 34 aa, Cryptosporidium parvum
GVYVTIRFKFPKIVKKRFTYYLDSSLRTLSSQTV

SEQ ID NO: 2338769 - protein, 17 aa, Cryptosporidium parvum
GWCAPECRPTWLGDGQC

SEQ ID NO: 2338770 - protein, 19 aa, Cryptosporidium parvum
GWDNTLLIQFDLSSYAKII

SEQ ID NO: 2338771 - protein, 28 aa, Cryptosporidium parvum
GWLHKHRNSLPYWPSINISPPKNRITFY

SEQ ID NO: 2338772 - protein, 18 aa, Cryptosporidium parvum
GWSRLGFFLLNKDSESLI

SEQ ID NO: 2338773 - protein, 28 aa, Cryptosporidium parvum
GYDISKPFPFYFLVIVECDILYNLIKLF

SEQ ID NO: 2338774 - protein, 27 aa, Cryptosporidium parvum
GYFNKDFFIGKSIFNLFLIPKIADLNG

SEQ ID NO: 2338775 - protein, 21 aa, Cryptosporidium parvum
GYFTFWLQKKFSENKFVVGVN

SEQ ID NO: 2338776 - protein, 25 aa, Cryptosporidium parvum
GYILSNIPLVIYKALGNTINKSSNN

SEQ ID NO: 2338777 - protein, 19 aa, Cryptosporidium parvum
GYIPIFQRIANNETASFPA

SEQ ID NO: 2338778 - protein, 26 aa, Cryptosporidium parvum
GYKLDEEALLLLPPEHFRKAPPRCVS

SEQ ID NO: 2338779 - protein, 18 aa, Cryptosporidium parvum
GYRGSPMILTQFIENIDL

SEQ ID NO: 2338780 - protein, 21 aa, Cryptosporidium parvum
GYSFGSILPSCTYVNGGNVCT

SEQ ID NO: 2338781 - protein, 24 aa, Cryptosporidium parvum
GYSVYCNRWLFTNRPWKSRIIIQS

SEQ ID NO: 2338782 - protein, 25 aa, Cryptosporidium parvum
HADHAPYNLICPVGSRLVADKCVTY

SEQ ID NO: 2338783 - protein, 35 aa, Cryptosporidium parvum
HAYKLNDGFFDIFAFYFFKDYAAIQYLLDGTVCRN

SEQ ID NO: 2338784 - protein, 18 aa, Cryptosporidium parvum
HDHYERTLRFLTFQAEQV

SEQ ID NO: 2338785 - protein, 25 aa, Cryptosporidium parvum
HEISKFPCRYLNTVGFCRNLKDCRF

SEQ ID NO: 2338786 - protein, 20 aa, Cryptosporidium parvum
HFFRRNIFLSHRDFEKILDV

SEQ ID NO: 2338787 - protein, 17 aa, Cryptosporidium parvum
HFPPGIQAAPLNGSLIN

SEQ ID NO: 2338788 - protein, 19 aa, Cryptosporidium parvum
HFRRSLVLLPSEPYQRVMT

SEQ ID NO: 2338789 - protein, 25 aa, Cryptosporidium parvum
HGESLNPSIFLLKSGFLYPNEVLVH

SEQ ID NO: 2338790 - protein, 40 aa, Cryptosporidium parvum
HGLDSSTLYWFGYQFLFDSNPIFSLLFNETFVTFTDLISR

SEQ ID NO: 2338791 - protein, 18 aa, Cryptosporidium parvum
HGLGFYLMNIMLSASNSD

SEQ ID NO: 2338792 - protein, 19 aa, Cryptosporidium parvum
HHNAYYPIQTYVQQTYVQP

SEQ ID NO: 2338793 - protein, 24 aa, Cryptosporidium parvum
HIDILSILIALREFLNSKNSEEIS

SEQ ID NO: 2338794 - protein, 40 aa, Cryptosporidium parvum; identical to SEQ ID NO: 2190710

SEQ ID NO: 2338795 - protein, 23 aa, Cryptosporidium parvum
HKKDALEFWKLESKIRNMDNIIL

SEQ ID NO: 2338796 - protein, 19 aa, Cryptosporidium parvum
HKRQPIYDFLGSKTALVYG

SEQ ID NO: 2338797 - protein, 26 aa, Cryptosporidium parvum
HKSCWFKCTKVWEYPLCGSDGITYSS

SEQ ID NO: 2338798 - protein, 33 aa, Cryptosporidium parvum
HLATSFVYWHYYISLPKWVFYENWEGIYSSNAV

SEQ ID NO: 2338799 - protein, 19 aa, Cryptosporidium parvum
HLKHFVLNRMVLFVAYVLE

SEQ ID NO: 2338800 - protein, 20 aa, Cryptosporidium parvum
HLMALQPIIQGYIYDNLRTN

SEQ ID NO: 2338801 - protein, 23 aa, Cryptosporidium parvum
HLTDPKLRIGLFKGYISLEEMQS

SEQ ID NO: 2338802 - protein, 25 aa, Cryptosporidium parvum
HLVYSFCLVLCPITRSIYAEGSIRL

SEQ ID NO: 2338803 - protein, 19 aa, Cryptosporidium parvum
HMHRIFNRIGWVKTKNPIE

SEQ ID NO: 2338804 - protein, 25 aa, Cryptosporidium parvum
HNDDKILSIFLNESFILMYDWKNHQ

SEQ ID NO: 2338805 - protein, 29 aa, Cryptosporidium parvum
HNDGRDKIFPLPYNGDNFAPGLLLKAHGI

SEQ ID NO: 2338806 - protein, 18 aa, Cryptosporidium parvum
HNFNYELGYIKRDYYKLV

SEQ ID NO: 2338807 - protein, 35 aa, Cryptosporidium parvum; identical to SEQ ID NO: 2209592

SEQ ID NO: 2338808 - protein, 20 aa, Cryptosporidium parvum
HNKRSSFSSIFLCSKHEIKE

SEQ ID NO: 2338809 - protein, 25 aa, Cryptosporidium parvum
HNQIWPLLQFIYKKCVELRFTVNNE

SEQ ID NO: 2338810 - protein, 23 aa, Cryptosporidium parvum
HPEGTIVLFSYKSLFSLRVCQKD

SEQ ID NO: 2338811 - protein, 22 aa, Cryptosporidium parvum
HPITWQLIMGVVRRIKPTGQAK

SEQ ID NO: 2338812 - protein, 20 aa, Cryptosporidium parvum
HQIFKCLLRNVPSSSKDPLN

SEQ ID NO: 2338813 - protein, 18 aa, Cryptosporidium parvum
HQMLVNRIWYDGTSFKTL

SEQ ID NO: 2338814 - protein, 18 aa, Cryptosporidium parvum
HRGFYFVDAESKKNCKIL

SEQ ID NO: 2338815 - protein, 17 aa, Cryptosporidium parvum
HSAIPITKKKLCWYFIS

SEQ ID NO: 2338816 - protein, 29 aa, Cryptosporidium parvum
HSGATPPIPGMPVPWPLPTATQQLNSTTS

SEQ ID NO: 2338817 - protein, 17 aa, Cryptosporidium parvum
HSKCFILGFSGYGNRGM

SEQ ID NO: 2338818 - protein, 23 aa, Cryptosporidium parvum
HSLIKLSSPRRFLRRLCCCCSSS

SEQ ID NO: 2338819 - protein, 21 aa, Cryptosporidium parvum
HSLSYLSLFDGLQLGISLFSQ

SEQ ID NO: 2338820 - protein, 27 aa, Cryptosporidium parvum
HSNHPVKHWLYDSLSFKKISNVLGGKI

SEQ ID NO: 2338821 - protein, 22 aa, Cryptosporidium parvum
HSPRRVVILAFSTRSFTEKKLP

SEQ ID NO: 2338822 - protein, 17 aa, Cryptosporidium parvum
HSSHLNTVLLVEPEMLP

SEQ ID NO: 2338823 - protein, 27 aa, Cryptosporidium parvum
HTDHRPFKPLYDPLYKIPTKTTQIRKT

SEQ ID NO: 2338824 - protein, 22 aa, Cryptosporidium parvum
HTIDYFIISTPPSYTLPKSEKL

SEQ ID NO: 2338825 - protein, 23 aa, Cryptosporidium parvum
HTKDILLYDIAASIIFLLNELHA

SEQ ID NO: 2338826 - protein, 37 aa, Cryptosporidium parvum
HVQNINLLKMNICYPPNIPYSQVKPEKKYYLNDEVIE

SEQ ID NO: 2338827 - protein, 17 aa, Cryptosporidium parvum
HYNEMLFPDLKLQIELL

SEQ ID NO: 2338828 - protein, 23 aa, Cryptosporidium parvum
HYNIDRMLFCSPSIGYYLEMTQK

SEQ ID NO: 2338829 - protein, 25 aa, Cryptosporidium parvum
IADCQIYMTIFVDSASLRDNINQSL

SEQ ID NO: 2338830 - protein, 19 aa, Cryptosporidium parvum
IAEKILAGYLMLTITLYHS

SEQ ID NO: 2338831 - protein, 24 aa, Cryptosporidium parvum
IAGTPIPTPPFSPPPPSVPAPAPP

SEQ ID NO: 2338832 - protein, 19 aa, Cryptosporidium parvum
IAIISLINPLNVLYHVEDI

SEQ ID NO: 2338833 - protein, 17 aa, Cryptosporidium parvum
IALLYTNTNYIINNRIS

SEQ ID NO: 2338834 - protein, 24 aa, Cryptosporidium parvum
IANEYADYELACPPGLIVISDKCA

SEQ ID NO: 2338835 - protein, 23 aa, Cryptosporidium parvum
IANRLKSYLALRLPDKFAQPSNS

SEQ ID NO: 2338836 - protein, 20 aa, Cryptosporidium parvum
IAPGRPFAPLIKGSIKSKCQ

SEQ ID NO: 2338837 - protein, 24 aa, Cryptosporidium parvum
IAPTLPNMPPMKRPQAPLIYRCRF

SEQ ID NO: 2338838 - protein, 31 aa, Cryptosporidium parvum
IARNASIGVIWIYEPGLLLAEELVSPCFGII

SEQ ID NO: 2338839 - protein, 23 aa, Cryptosporidium parvum
ICDHTPLFFYLNDTFGHQIEPYK

SEQ ID NO: 2338840 - protein, 20 aa, Cryptosporidium parvum
ICISLIHQLNFNGTITFIWI

SEQ ID NO: 2338841 - protein, 31 aa, Cryptosporidium parvum; identical to SEQ ID NO: 2209611

SEQ ID NO: 2338842 - protein, 25 aa, Cryptosporidium parvum
ICSEYIWECIKRKLLFLGNGYDISN

SEQ ID NO: 2338843 - protein, 18 aa, Cryptosporidium parvum
ICYKKWKTVKQSLKSLEA

SEQ ID NO: 2338844 - protein, 17 aa, Cryptosporidium parvum
ICYLMLKVALTTFVFGS

SEQ ID NO: 2338845 - protein, 28 aa, Cryptosporidium parvum
IDAGRNVYIQIFRDSYVTLYTNKVVGDS

SEQ ID NO: 2338846 - protein, 23 aa, Cryptosporidium parvum
IDGFAHFDFLYKKLYDIINTIHY

SEQ ID NO: 2338847 - protein, 45 aa, Cryptosporidium parvum
IDGVIIVYFFFHYVLKLFISVVTARDLWIILKNWLTHSTDYFISD

SEQ ID NO: 2338848 - protein, 18 aa, Cryptosporidium parvum
IDRKIPGVLTISLVLLLI

SEQ ID NO: 2338849 - protein, 18 aa, Cryptosporidium parvum
IDSLINFFENEDIKAKEE

SEQ ID NO: 2338850 - protein, 20 aa, Cryptosporidium parvum
IDSLSFNDFIIWFSSSNQIN

SEQ ID NO: 2338851 - protein, 22 aa, Cryptosporidium parvum
IDTPSHIIGVFIKAMRKIQKIN

SEQ ID NO: 2338852 - protein, 23 aa, Cryptosporidium parvum
IDVNLLPLGWESVLNKSIELKKK

SEQ ID NO: 2338853 - protein, 28 aa, Cryptosporidium parvum
IEDSNLCTLHLLLKKYSQNRSGSPNSKV

SEQ ID NO: 2338854 - protein, 24 aa, Cryptosporidium parvum
IEDTLAIYFFNNRLALQDLKENIV

SEQ ID NO: 2338855 - protein, 21 aa, Cryptosporidium parvum
IEEMMILLAFERILTQKTASS

SEQ ID NO: 2338856 - protein, 26 aa, Cryptosporidium parvum
IEEYHLFNMVVIPIIPFKGINIDERI

SEQ ID NO: 2338857 - protein, 24 aa, Cryptosporidium parvum
IEFSPIDPNLLLSSGKDGKTICWT

SEQ ID NO: 2338858 - protein, 22 aa, Cryptosporidium parvum
IEGLSHIIPLDKVPIRPQKRQD

SEQ ID NO: 2338859 - protein, 22 aa, Cryptosporidium parvum
IEGWQWDNTSNNWLWGPLRNQD

SEQ ID NO: 2338860 - protein, 20 aa, Cryptosporidium parvum
IEHILLRICSRNIDLLRSSS

SEQ ID NO: 2338861 - protein, 23 aa, Cryptosporidium parvum
IELKKYFLMEKIKTYNLIIELLI

SEQ ID NO: 2338862 - protein, 38 aa, Cryptosporidium parvum
IELLKQAYSIFCQLMCLIKLLNLFNSLNVLFTTRQSQE

SEQ ID NO: 2338863 - protein, 35 aa, Cryptosporidium parvum
IELNWRDELISKVRQFILYLSPKPKIQSSKSSYMT

SEQ ID NO: 2338864 - protein, 30 aa, Cryptosporidium parvum
IESLLEQILKCLMLLRLDKYSRKIFKDNSV

SEQ ID NO: 2338865 - protein, 27 aa, Cryptosporidium parvum
IETQPIKPNWLWFSPDINIRYHINRAF

SEQ ID NO: 2338866 - protein, 25 aa, Cryptosporidium parvum
IEVIESFYEFWRGFQSNRDFSIHEE

SEQ ID NO: 2338867 - protein, 17 aa, Cryptosporidium parvum
IFEKIATFPPILPDLSN

SEQ ID NO: 2338868 - protein, 18 aa, Cryptosporidium parvum
IFEPNKIYKKINSFFPVG

SEQ ID NO: 2338869 - protein, 21 aa, Cryptosporidium parvum
IFESIVLVYRYRLSHLISTAY

SEQ ID NO: 2338870 - protein, 18 aa, Cryptosporidium parvum
IFEWSQLNFLTSGASPPI

SEQ ID NO: 2338871 - protein, 17 aa, Cryptosporidium parvum
IFFVFIGGINENKEILN

SEQ ID NO: 2338872 - protein, 18 aa, Cryptosporidium parvum
IFHRVIPGFMAQGGDFTN

SEQ ID NO: 2338873 - protein, 20 aa, Cryptosporidium parvum
IFIFFVLFDIFATSQHEVSP

SEQ ID NO: 2338874 - protein, 19 aa, Cryptosporidium parvum
IFIQLSWVFGTESQNAKHR

SEQ ID NO: 2338875 - protein, 25 aa, Cryptosporidium parvum
IFIYTWLILFKKVDGSFLTGNNIAA

SEQ ID NO: 2338876 - protein, 19 aa, Cryptosporidium parvum
IFKEILYQIFQGLNSAHSL

SEQ ID NO: 2338877 - protein, 23 aa, Cryptosporidium parvum
IFLILIFLICQTQGISNDLSSLT

SEQ ID NO: 2338878 - protein, 20 aa, Cryptosporidium parvum
IFLLFLISSPFGNSVYVTKE

SEQ ID NO: 2338879 - protein, 20 aa, Cryptosporidium parvum
IFLLLSIIIASEAQIKLWNS

SEQ ID NO: 2338880 - protein, 18 aa, Cryptosporidium parvum
IFLLSVFLANYKKNGIFL

SEQ ID NO: 2338881 - protein, 23 aa, Cryptosporidium parvum
IFLSIIILFISCSTQLELDIMKD

SEQ ID NO: 2338882 - protein, 17 aa, Cryptosporidium parvum
IFNLFLIPKIADLNGGY

SEQ ID NO: 2338883 - protein, 19 aa, Cryptosporidium parvum
IFPRLLDFRVSDACKVVSA

SEQ ID NO: 2338884 - protein, 18 aa, Cryptosporidium parvum
IFQESYIKLKLLSNTNNN

SEQ ID NO: 2338885 - protein, 28 aa, Cryptosporidium parvum
IFSKIINPELLFKLIQTAILKNTNCKPI

SEQ ID NO: 2338886 - protein, 26 aa, Cryptosporidium parvum
IFSLPATFELVWGKYFQLIYETAIDS

SEQ ID NO: 2338887 - protein, 26 aa, Cryptosporidium parvum
IFTGALILLEYLKIKIIKVVHLLNEY

SEQ ID NO: 2338888 - protein, 25 aa, Cryptosporidium parvum
IGAIAPLYRVATPIDLPPITAKDIS

SEQ ID NO: 2338889 - protein, 22 aa, Cryptosporidium parvum
IGKILVFNSPRRSSLLKLIFPL

SEQ ID NO: 2338890 - protein, 24 aa, Cryptosporidium parvum
IGRNALVRTWYRVFRKLGSTKNRM

SEQ ID NO: 2338891 - protein, 25 aa, Cryptosporidium parvum
IGSIKWVYRYAWADFAFGVRLKQVN

SEQ ID NO: 2338892 - protein, 23 aa, Cryptosporidium parvum
IGTSYLLLKIMISSPEYSIIKLT

SEQ ID NO: 2338893 - protein, 19 aa, Cryptosporidium parvum
IGYSNVLLNALIYDKSRLQ

SEQ ID NO: 2338894 - protein, 21 aa, Cryptosporidium parvum
IHDTLFLTQKISKGIFEIICK

SEQ ID NO: 2338895 - protein, 25 aa, Cryptosporidium parvum
IHEFDRYIFMQYLEGVTLSEVLKRL

SEQ ID NO: 2338896 - protein, 21 aa, Cryptosporidium parvum
IHFLLFFGISANNNRLSIKEF

SEQ ID NO: 2338897 - protein, 25 aa, Cryptosporidium parvum
IHKKNLITLYLPFETKLNGNEKLII

SEQ ID NO: 2338898 - protein, 18 aa, Cryptosporidium parvum
IHPLGYSPSFNKYTQINS

SEQ ID NO: 2338899 - protein, 29 aa, Cryptosporidium parvum
IHQLNFNGTITFIWIMLGLCSSLSNQELI

SEQ ID NO: 2338900 - protein, 27 aa, Cryptosporidium parvum
IIAERHIIFLQAFIHHFSALSNIQLQP

SEQ ID NO: 2338901 - protein, 18 aa, Cryptosporidium parvum
IIALTALIQNVRSSNIIL

SEQ ID NO: 2338902 - protein, 24 aa, Cryptosporidium parvum
IIFKDYFKTFSRLTINYLKSIIFS

SEQ ID NO: 2338903 - protein, 20 aa, Cryptosporidium parvum
IIFLQLFMSICGRLNLPDDT

SEQ ID NO: 2338904 - protein, 21 aa, Cryptosporidium parvum
IIFSILICKVRLEVVIENEDP

SEQ ID NO: 2338905 - protein, 17 aa, Cryptosporidium parvum
IIHNFILVCRELPEWQN

SEQ ID NO: 2338906 - protein, 18 aa, Cryptosporidium parvum
IIIGLLSITFVQASTVQS

SEQ ID NO: 2338907 - protein, 21 aa, Cryptosporidium parvum
IIIPLLYLTFNYQSTFSENFS

SEQ ID NO: 2338908 - protein, 21 aa, Cryptosporidium parvum
IILFSFLDLIYSQVNIMTDEY

SEQ ID NO: 2338909 - protein, 28 aa, Cryptosporidium parvum
IILLLLLFINFLFLFENITDNFLFKKDV

SEQ ID NO: 2338910 - protein, 20 aa, Cryptosporidium parvum
IINATFIYPGTQQPDLVPNQ

SEQ ID NO: 2338911 - protein, 24 aa, Cryptosporidium parvum
IINNASFIYIYLSSISLPISKNQA

SEQ ID NO: 2338912 - protein, 24 aa, Cryptosporidium parvum
IINTIHYPGFQFIDDVRVDLYYGM

SEQ ID NO: 2338913 - protein, 17 aa, Cryptosporidium parvum
IIPIVYPTVAIMPIQLY

SEQ ID NO: 2338914 - protein, 19 aa, Cryptosporidium parvum
IIPRRFLRSFYLSNLSHFT

SEQ ID NO: 2338915 - protein, 41 aa, Cryptosporidium parvum; identical to SEQ ID NO: 2209669

SEQ ID NO: 2338916 - protein, 28 aa, Cryptosporidium parvum
IISILAVIAVFYSFTSTESDLASSSYYE

SEQ ID NO: 2338917 - protein, 26 aa, Cryptosporidium parvum
IITNLLLILFLYKIEVFESVEIEGIQ

SEQ ID NO: 2338918 - protein, 17 aa, Cryptosporidium parvum
IITWIDEIFESKSVAFN

SEQ ID NO: 2338919 - protein, 32 aa, Cryptosporidium parvum; identical to SEQ ID NO: 2209674

SEQ ID NO: 2338920 - protein, 17 aa, Cryptosporidium parvum
IIYSQFNRLCLITGYSN

SEQ ID NO: 2338921 - protein, 24 aa, Cryptosporidium parvum
IKAIDLLTPFIKGGKIGLFGGAGV

SEQ ID NO: 2338922 - protein, 19 aa, Cryptosporidium parvum
IKCCSTIISPKLITNVNTT

SEQ ID NO: 2338923 - protein, 27 aa, Cryptosporidium parvum
IKDFIRNLFFVYYCKNPLVMNSSLCSF

SEQ ID NO: 2338924 - protein, 20 aa, Cryptosporidium parvum
IKDIIVENLLRIYPNIELTG

SEQ ID NO: 2338925 - protein, 25 aa, Cryptosporidium parvum
IKESCPYLLLQITNLEHWPKIMLTP

SEQ ID NO: 2338926 - protein, 17 aa, Cryptosporidium parvum
IKGNTKEWILITDNSLR

SEQ ID NO: 2338927 - protein, 19 aa, Cryptosporidium parvum
IKKLNLNVMFYNYKGEELQ

SEQ ID NO: 2338928 - protein, 26 aa, Cryptosporidium parvum
IKMCPYITSIVFYKVNPFKIEDIRIN

SEQ ID NO: 2338929 - protein, 24 aa, Cryptosporidium parvum
IKNKKLFKLINRKASKRASKMMYE

SEQ ID NO: 2338930 - protein, 18 aa, Cryptosporidium parvum
IKNLASIYQLYSKPMKYL

SEQ ID NO: 2338931 - protein, 27 aa, Cryptosporidium parvum
IKRVDDQFIVIVKKLKQKSNEIPTDTK

SEQ ID NO: 2338932 - protein, 18 aa, Cryptosporidium parvum
IKTVLINSIIYKLKKSTS

SEQ ID NO: 2338933 - protein, 20 aa, Cryptosporidium parvum
IKVIFNPTSLFGQIFEWSQL

SEQ ID NO: 2338934 - protein, 21 aa, Cryptosporidium parvum
IKVIILTAFDVLKSSLFIVFF

SEQ ID NO: 2338935 - protein, 24 aa, Cryptosporidium parvum
IKYILEEGFFYPNNILFIGYETCS

SEQ ID NO: 2338936 - protein, 26 aa, Cryptosporidium parvum
IKYLNTIYTILTKSLKFYFGFDSNQE

SEQ ID NO: 2338937 - protein, 23 aa, Cryptosporidium parvum
ILDSRPILYALNKKRSKLGENSV

SEQ ID NO: 2338938 - protein, 18 aa, Cryptosporidium parvum
ILDYLKWMSSESHVIVVL

SEQ ID NO: 2338939 - protein, 22 aa, Cryptosporidium parvum
ILEFFDIYFLNPEKVFSKRDFL

SEQ ID NO: 2338940 - protein, 25 aa, Cryptosporidium parvum
ILELDSYLFSYGVKLPLEKDSNLIW

SEQ ID NO: 2338941 - protein, 18 aa, Cryptosporidium parvum
ILESSKFDFIQDPSPIRK

SEQ ID NO: 2338942 - protein, 21 aa, Cryptosporidium parvum
ILFLILILGVFVKSENFRSAQ

SEQ ID NO: 2338943 - protein, 17 aa, Cryptosporidium parvum
ILGFSGYGNRGMWSAAV

SEQ ID NO: 2338944 - protein, 25 aa, Cryptosporidium parvum
ILGVQARLLPLFSFVSRYSTINESY

SEQ ID NO: 2338945 - protein, 21 aa, Cryptosporidium parvum
ILIALIFTQTNLHVNDLIIFQ

SEQ ID NO: 2338946 - protein, 17 aa, Cryptosporidium parvum
ILILEKKEFKKSASNIL

SEQ ID NO: 2338947 - protein, 23 aa, Cryptosporidium parvum
ILILWILLLTQLISECTSSSLDT

SEQ ID NO: 2338948 - protein, 23 aa, Cryptosporidium parvum
ILKEFTPLSFNLNSPVWGKGYSN

SEQ ID NO: 2338949 - protein, 26 aa, Cryptosporidium parvum
ILLAFFYIVFVKCDLPIHVTTADIIG

SEQ ID NO: 2338950 - protein, 19 aa, Cryptosporidium parvum
ILLFYPISTSLGKESELFW

SEQ ID NO: 2338951 - protein, 17 aa, Cryptosporidium parvum
ILLVVSIFSGFVNCCPE

SEQ ID NO: 2338952 - protein, 29 aa, Cryptosporidium parvum
ILMKYLNCFMITFFFIKIDAINVGENHEK

SEQ ID NO: 2338953 - protein, 17 aa, Cryptosporidium parvum
ILRIDYTNRLLLEGAPF

SEQ ID NO: 2338954 - protein, 27 aa, Cryptosporidium parvum
ILSELLKLMIIKKVHFGYNVIAKKMIS

SEQ ID NO: 2338955 - protein, 18 aa, Cryptosporidium parvum
ILVFIIGLTLLNGIESKG

SEQ ID NO: 2338956 - protein, 28 aa, Cryptosporidium parvum
ILVLNILLFELPIVVESSSFIRPGGNEM

SEQ ID NO: 2338957 - protein, 20 aa, Cryptosporidium parvum
IMEDLHRLFEMNGDSEGNLI

SEQ ID NO: 2338958 - protein, 19 aa, Cryptosporidium parvum
IMEFYDDWYKGPKSKRLCS

SEQ ID NO: 2338959 - protein, 22 aa, Cryptosporidium parvum
IMTKYDFPKLYRLSNSSLVSAI

SEQ ID NO: 2338960 - protein, 19 aa, Cryptosporidium parvum
INDYPTMKFFRNKVAEEYY

SEQ ID NO: 2338961 - protein, 25 aa, Cryptosporidium parvum
INGSCIFCFSIFLTLYSRIQCQYVE

SEQ ID NO: 2338962 - protein, 30 aa, Cryptosporidium parvum
INGTKRKRKSIGLVFRKSSYTDSFCSLLGC

SEQ ID NO: 2338963 - protein, 19 aa, Cryptosporidium parvum
INIFKAQFSEFIDYEGLCE

SEQ ID NO: 2338964 - protein, 18 aa, Cryptosporidium parvum
INIWKEFLSLIKNKKLFK

SEQ ID NO: 2338965 - protein, 17 aa, Cryptosporidium parvum
INLLSIAGLSQYAHARL

SEQ ID NO: 2338966 - protein, 30 aa, Cryptosporidium parvum
INMGLKALMGCILLISGLLSIVDESFDVIT

SEQ ID NO: 2338967 - protein, 22 aa, Cryptosporidium parvum
INNIGFGFVFPFQPTSREEISD

SEQ ID NO: 2338968 - protein, 26 aa, Cryptosporidium parvum
INPIKARELLLLFFINLGRTSAEEKN

SEQ ID NO: 2338969 - protein, 17 aa, Cryptosporidium parvum
INQYKLPPRVTLLFIGL

SEQ ID NO: 2338970 - protein, 26 aa, Cryptosporidium parvum
INSCLSWKTFGYFNLISCYSVLVNSG

SEQ ID NO: 2338971 - protein, 29 aa, Cryptosporidium parvum
INSRYGSKIFLYLLTRLQGFTQIKECLSI

SEQ ID NO: 2338972 - protein, 25 aa, Cryptosporidium parvum
INTDRFKWYVAIGNDLSFTARYYVK

SEQ ID NO: 2338973 - protein, 18 aa, Cryptosporidium parvum
INYPVYSSFIFFNNINYQ

SEQ ID NO: 2338974 - protein, 24 aa, Cryptosporidium parvum
IPEFNTELYFNSHKCFLMLGFEVE

SEQ ID NO: 2338975 - protein, 21 aa, Cryptosporidium parvum
IPERGFSSLKFLPGSFDQIIV

SEQ ID NO: 2338976 - protein, 18 aa, Cryptosporidium parvum
IPFGPQAPHLAMVDIFGV

SEQ ID NO: 2338977 - protein, 31 aa, Cryptosporidium parvum; identical to SEQ ID NO: 2209706

SEQ ID NO: 2338978 - protein, 18 aa, Cryptosporidium parvum
IPIPVRPGSNQGQSTPSF

SEQ ID NO: 2338979 - protein, 20 aa, Cryptosporidium parvum
IPKSTLIPGSQILLGIPGSV

SEQ ID NO: 2338980 - protein, 25 aa, Cryptosporidium parvum
IPKVSLDINFLPAKTLFGWREVLFD

SEQ ID NO: 2338981 - protein, 22 aa, Cryptosporidium parvum
IPLVLCLAFLSNFLGIHDQILS

SEQ ID NO: 2338982 - protein, 17 aa, Cryptosporidium parvum
IPMDVRIRFDDFSGFDL

SEQ ID NO: 2338983 - protein, 17 aa, Cryptosporidium parvum
IPMLYQRQHAQRTREKL

SEQ ID NO: 2338984 - protein, 24 aa, Cryptosporidium parvum
IPNKLGISIPRLLKKMYKKYYCGI

SEQ ID NO: 2338985 - protein, 18 aa, Cryptosporidium parvum
IPPLGPFDRTRGPGCKTP

SEQ ID NO: 2338986 - protein, 24 aa, Cryptosporidium parvum
IPPNTMINPLLLSLKPDESPYMIE

SEQ ID NO: 2338987 - protein, 20 aa, Cryptosporidium parvum
IPRCMMRLLTYLGKLGSELV

SEQ ID NO: 2338988 - protein, 17 aa, Cryptosporidium parvum
IPSEFWWKKIKGKSKEK

SEQ ID NO: 2338989 - protein, 34 aa, Cryptosporidium parvum
IPSGLLYYKILENEYLFINIKIIKQAFVRYMFKG

SEQ ID NO: 2338990 - protein, 32 aa, Cryptosporidium parvum
IPSTPTAKIVPPKPAARRIFQASGAQGITQPT

SEQ ID NO: 2338991 - protein, 20 aa, Cryptosporidium parvum
IPVHVLYKKFQLFPDFTNKS

SEQ ID NO: 2338992 - protein, 31 aa, Cryptosporidium parvum; identical to SEQ ID NO: 2131351

SEQ ID NO: 2338993 - protein, 19 aa, Cryptosporidium parvum
IQDVKYIHPLGYSPSFNKY

SEQ ID NO: 2338994 - protein, 18 aa, Cryptosporidium parvum
IQGYIYDNLRTNKQLGYI

SEQ ID NO: 2338995 - protein, 20 aa, Cryptosporidium parvum
IQIFGPRPWNLDFLSLDVIR

SEQ ID NO: 2338996 - protein, 24 aa, Cryptosporidium parvum
IQILGYPSILLFKSEMKTEPILYN

SEQ ID NO: 2338997 - protein, 21 aa, Cryptosporidium parvum
IQILVFSCLLCFFAAVESSVN

SEQ ID NO: 2338998 - protein, 27 aa, Cryptosporidium parvum
IQLQPELYCLLFTNSMKPNIFSFVSNL

SEQ ID NO: 2338999 - protein, 31 aa, Cryptosporidium parvum
IQNIELLTVIYPFLTPPSYKKVLTPVEVVNT

SEQ ID NO: 2339000 - protein, 21 aa, Cryptosporidium parvum
IQSLIKDLVIPSLDPLFTLNN

SEQ ID NO: 2339001 - protein, 22 aa, Cryptosporidium parvum
IQSLNYYVFSYAQINSAAGSTS

SEQ ID NO: 2339002 - protein, 19 aa, Cryptosporidium parvum
IQVVFRKYGIDYFKFMNEA

SEQ ID NO: 2339003 - protein, 32 aa, Cryptosporidium parvum
IREKDGLWAVLAWLSILAYKNPDPTKSLVSVE

SEQ ID NO: 2339004 - protein, 17 aa, Cryptosporidium parvum
IREVSILKLLNGYSDNH

SEQ ID NO: 2339005 - protein, 18 aa, Cryptosporidium parvum
IRGSNVSAKFVFLISRQG

SEQ ID NO: 2339006 - protein, 29 aa, Cryptosporidium parvum
IRHRNEGALIILFLLSPIYRVINGENFDG

SEQ ID NO: 2339007 - protein, 25 aa, Cryptosporidium parvum
IRKLTLLHSRGDLPSLSLWAKKMKD

SEQ ID NO: 2339008 - protein, 19 aa, Cryptosporidium parvum
IRLFGVFHDSFRNLLKKLE

SEQ ID NO: 2339009 - protein, 17 aa, Cryptosporidium parvum
IRLVFELSQLPYIGHAF

SEQ ID NO: 2339010 - protein, 25 aa, Cryptosporidium parvum
IRNTLVLFIIFFIHNINCKAQEKPE

SEQ ID NO: 2339011 - protein, 18 aa, Cryptosporidium parvum
IRRRFFCQAFNREIMRDA

SEQ ID NO: 2339012 - protein, 22 aa, Cryptosporidium parvum
ISCLILVALLQYATGDQKAEQK

SEQ ID NO: 2339013 - protein, 32 aa, Cryptosporidium parvum
ISDLRISYWDLSRLSLLFYWNLLASNMETCLP

SEQ ID NO: 2339014 - protein, 24 aa, Cryptosporidium parvum
ISDVYKTAFYPPPLEFLQYGVSNM

SEQ ID NO: 2339015 - protein, 23 aa, Cryptosporidium parvum
ISEDSMIRFGYLGGYLAVDFLPS

SEQ ID NO: 2339016 - protein, 18 aa, Cryptosporidium parvum
ISKPFRAHKLKKALGKEG

SEQ ID NO: 2339017 - protein, 24 aa, Cryptosporidium parvum
ISKPTPLYKAVRAKALELWEKIDS

SEQ ID NO: 2339018 - protein, 18 aa, Cryptosporidium parvum
ISKSLFLELTFDDKPANA

SEQ ID NO: 2339019 - protein, 17 aa, Cryptosporidium parvum
ISLGLLAGAFATATSVF

SEQ ID NO: 2339020 - protein, 18 aa, Cryptosporidium parvum
ISLPPYPTPSSPTPMPMP

SEQ ID NO: 2339021 - protein, 27 aa, Cryptosporidium parvum
ISMEPWDVRLIDLSFVWVPSALKSRNT

SEQ ID NO: 2339022 - protein, 26 aa, Cryptosporidium parvum
ISRCQISHSLLFTRAANNLGIQDDEC

SEQ ID NO: 2339023 - protein, 25 aa, Cryptosporidium parvum
ISREDYMLPTFSLLNIQPYNATYCS

SEQ ID NO: 2339024 - protein, 39 aa, Cryptosporidium parvum
ISSTLDSVPLIKLPNFNLPIFGIPPIPPQVLKTTSTSTS

SEQ ID NO: 2339025 - protein, 25 aa, Cryptosporidium parvum
ISSVSFVYRMIYYCTGRIILPKEAW

SEQ ID NO: 2339026 - protein, 19 aa, Cryptosporidium parvum
ISYFSKLLELCEEIFHVSP

SEQ ID NO: 2339027 - protein, 24 aa, Cryptosporidium parvum
ITDHIEDLLPKYLNFIKGVVDSDD

SEQ ID NO: 2339028 - protein, 18 aa, Cryptosporidium parvum
ITFFEEHSFILSQFSEIF

SEQ ID NO: 2339029 - protein, 22 aa, Cryptosporidium parvum
ITHWTLSNIPLNEIRILIAQLE

SEQ ID NO: 2339030 - protein, 19 aa, Cryptosporidium parvum
ITKPFLSLAYIFSREMIKD

SEQ ID NO: 2339031 - protein, 26 aa, Cryptosporidium parvum
ITLILYLVILDYCICAEFVESLESII

SEQ ID NO: 2339032 - protein, 17 aa, Cryptosporidium parvum
ITMIPTPEHPGLGGLLQ

SEQ ID NO: 2339033 - protein, 18 aa, Cryptosporidium parvum
ITSRLWIKYSNEPDILRK

SEQ ID NO: 2339034 - protein, 26 aa, Cryptosporidium parvum
IVEKPFERYFNAWRRSFGYNGFIVYP

SEQ ID NO: 2339035 - protein, 17 aa, Cryptosporidium parvum
IVEYLPIIFDEFHFCNT

SEQ ID NO: 2339036 - protein, 17 aa, Cryptosporidium parvum
IVFFSQISNIKHCAPAP

SEQ ID NO: 2339037 - protein, 18 aa, Cryptosporidium parvum
IVGLFKIVNEFLKSESIS

SEQ ID NO: 2339038 - protein, 23 aa, Cryptosporidium parvum
IVGQFEYNLLNPIFNYVPRTGEI

SEQ ID NO: 2339039 - protein, 24 aa, Cryptosporidium parvum
IVINTFTIFLYKTLKNLGRTSLKT

SEQ ID NO: 2339040 - protein, 18 aa, Cryptosporidium parvum
IVKLLKFHTSKSGDSTVF

SEQ ID NO: 2339041 - protein, 20 aa, Cryptosporidium parvum
IVKYILPYSSYDEYLDENEI

SEQ ID NO: 2339042 - protein, 26 aa, Cryptosporidium parvum
IVLLPLFFISYFQQTLNDELYSICFT

SEQ ID NO: 2339043 - protein, 21 aa, Cryptosporidium parvum
IVLLSIILLHSFDFVRSEAPN

SEQ ID NO: 2339044 - protein, 35 aa, Cryptosporidium parvum; identical to SEQ ID NO: 2209748

SEQ ID NO: 2339045 - protein, 30 aa, Cryptosporidium parvum
IVNSTQFIFLNWFYLVYHGSNDLYFSKKMV

SEQ ID NO: 2339046 - protein, 18 aa, Cryptosporidium parvum
IVSILIPDIQSHLGKMCP

SEQ ID NO: 2339047 - protein, 23 aa, Cryptosporidium parvum
IVTRLKSYLASKLPEKFPQPSNS

SEQ ID NO: 2339048 - protein, 23 aa, Cryptosporidium parvum
IWLFYLFFGPCLGLRANTTHKLA

SEQ ID NO: 2339049 - protein, 20 aa, Cryptosporidium parvum
IWSREFCEIVQGFKIDEISC

SEQ ID NO: 2339050 - protein, 20 aa, Cryptosporidium parvum
IWVFTIICLSQKLNKCSDNI

SEQ ID NO: 2339051 - protein, 20 aa, Cryptosporidium parvum
IYDKIQIRHRNEGALIILFL

SEQ ID NO: 2339052 - protein, 26 aa, Cryptosporidium parvum
IYKKINSFFPVGINPAPIFGDYHNTP

SEQ ID NO: 2339053 - protein, 43 aa, Cryptosporidium parvum
IYNELQLYNNLLLSILLKLSFYIQYIVYFPNTGKLFGGNEDYN

SEQ ID NO: 2339054 - protein, 23 aa, Cryptosporidium parvum
IYNVKVIILWKNRGIFYPTLGDQ

SEQ ID NO: 2339055 - protein, 27 aa, Cryptosporidium parvum
IYPERNFLPIRIALASLAYYAISTNQS

SEQ ID NO: 2339056 - protein, 21 aa, Cryptosporidium parvum
IYSPAILMKSGIGPTEVLRKH

SEQ ID NO: 2339057 - protein, 17 aa, Cryptosporidium parvum
KAIKKIAAMLGGGSFTA

SEQ ID NO: 2339058 - protein, 19 aa, Cryptosporidium parvum
KAIYLTFLSSCKFFNDIIT

SEQ ID NO: 2339059 - protein, 20 aa, Cryptosporidium parvum
KAIYNQMHIDLLLGRQQRVS

SEQ ID NO: 2339060 - protein, 19 aa, Cryptosporidium parvum
KAKTTLLKKVMFGFTQNEW

SEQ ID NO: 2339061 - protein, 20 aa, Cryptosporidium parvum
KALNKLLNVLKIPNKRSSRR

SEQ ID NO: 2339062 - protein, 25 aa, Cryptosporidium parvum
KAMDKHRWVALPLVSPQSYIPNLGG

SEQ ID NO: 2339063 - protein, 18 aa, Cryptosporidium parvum
KAMSYLINLHSCASNFVV

SEQ ID NO: 2339064 - protein, 19 aa, Cryptosporidium parvum
KAPKFILFSGHDLTVIPLL

SEQ ID NO: 2339065 - protein, 30 aa, Cryptosporidium parvum
KAQAITLFFFLIAFISLNEFFSEASSTQQK

SEQ ID NO: 2339066 - protein, 30 aa, Cryptosporidium parvum
KATLSPPLRYTIFIALLKLVSELTFEQSKR

SEQ ID NO: 2339067 - protein, 21 aa, Cryptosporidium parvum
KAWYVFLKASTPSNSGCLIPC

SEQ ID NO: 2339068 - protein, 17 aa, Cryptosporidium parvum
KAYSKRTRPILTSPRGS

SEQ ID NO: 2339069 - protein, 19 aa, Cryptosporidium parvum
KCGGGFCKRLRRALCCCSG

SEQ ID NO: 2339070 - protein, 25 aa, Cryptosporidium parvum
KCSKVFNLILLLDEHKKNLSRSKEL

SEQ ID NO: 2339071 - protein, 32 aa, Cryptosporidium parvum
KCTIQDLVTLLYYQNIFLALKNLFNSAFKEKE

SEQ ID NO: 2339072 - protein, 26 aa, Cryptosporidium parvum
KDACEEYLECRFDFVVPRKACVNDCF

SEQ ID NO: 2339073 - protein, 23 aa, Cryptosporidium parvum
KDDKKVFSILFDELFISINIEDS

SEQ ID NO: 2339074 - protein, 20 aa, Cryptosporidium parvum
KDGFQLVIPPELYLTPNEQG

SEQ ID NO: 2339075 - protein, 26 aa, Cryptosporidium parvum
KDIDLKIIFMQYIKSTLRCIQLYESK

SEQ ID NO: 2339076 - protein, 17 aa, Cryptosporidium parvum
KDLIAATYISSQTKLVH

SEQ ID NO: 2339077 - protein, 18 aa, Cryptosporidium parvum
KDLNFHIKCPNGYRIIGI

SEQ ID NO: 2339078 - protein, 22 aa, Cryptosporidium parvum
KDLTQLYIQLAKLEMEINLVKQ

SEQ ID NO: 2339079 - protein, 18 aa, Cryptosporidium parvum
KDNLIFKQDWTLFVMVST

SEQ ID NO: 2339080 - protein, 17 aa, Cryptosporidium parvum
KDNVVGGGALVLDDCRK

SEQ ID NO: 2339081 - protein, 19 aa, Cryptosporidium parvum
KDRELLTKVILDLRDSKDL

SEQ ID NO: 2339082 - protein, 25 aa, Cryptosporidium parvum
KDSGPFETLPLGPFDRVRGPDCVTP

SEQ ID NO: 2339083 - protein, 17 aa, Cryptosporidium parvum
KDYQNIFYFPIYSTNIS

SEQ ID NO: 2339084 - protein, 24 aa, Cryptosporidium parvum
KEDGKYYREFGLPYLYDDIGNVRS

SEQ ID NO: 2339085 - protein, 19 aa, Cryptosporidium parvum
KEFYIHESVFLFAREELQR

SEQ ID NO: 2339086 - protein, 35 aa, Cryptosporidium parvum
KEGRGRMKRRMKRRKMRRRMGRARGKYDSGSSGSS

SEQ ID NO: 2339087 - protein, 23 aa, Cryptosporidium parvum
KEKSMNFMLKKSIIKLCSIVVNS

SEQ ID NO: 2339088 - protein, 35 aa, Cryptosporidium parvum; identical to SEQ ID NO: 2191931

SEQ ID NO: 2339089 - protein, 37 aa, Cryptosporidium parvum
KEKVASCKYLTFLLSELLKLFQFFGNSIKNLIKDFEE

SEQ ID NO: 2339090 - protein, 33 aa, Cryptosporidium parvum; identical to SEQ ID NO: 2191935

SEQ ID NO: 2339091 - protein, 30 aa, Cryptosporidium parvum
KELNIEVLPNSIWRVFLASGILTSITTTNM

SEQ ID NO: 2339092 - protein, 25 aa, Cryptosporidium parvum
KELSVKKIIFLLRSQEIQDAITEAY

SEQ ID NO: 2339093 - protein, 25 aa, Cryptosporidium parvum
KELTKDLHIMIFVHGLQGSAFDMRN

SEQ ID NO: 2339094 - protein, 26 aa, Cryptosporidium parvum
KELVKLLRDFLSAYATKGTAGLARFC

SEQ ID NO: 2339095 - protein, 23 aa, Cryptosporidium parvum
KEMEKMLPRIYWNDINKVFVGYG

SEQ ID NO: 2339096 - protein, 22 aa, Cryptosporidium parvum
KENLKYTLQKYKTKIKNIAEAL

SEQ ID NO: 2339097 - protein, 24 aa, Cryptosporidium parvum
KEPNTIWPRLLKDQKLKIPNMHVW

SEQ ID NO: 2339098 - protein, 20 aa, Cryptosporidium parvum
KETHTCKNGYFSFDFNPPCS

SEQ ID NO: 2339099 - protein, 17 aa, Cryptosporidium parvum
KEWVILKYKQIHDFLMA

SEQ ID NO: 2339100 - protein, 21 aa, Cryptosporidium parvum
KFAVLILPPFCNIAHWTYNSK

SEQ ID NO: 2339101 - protein, 34 aa, Cryptosporidium parvum; identical to SEQ ID NO: 2191978

SEQ ID NO: 2339102 - protein, 17 aa, Cryptosporidium parvum
KFEIHFQVLKKGYLEIW

SEQ ID NO: 2339103 - protein, 21 aa, Cryptosporidium parvum
KFESSSYFMSLLVPGTHAFAK

SEQ ID NO: 2339104 - protein, 18 aa, Cryptosporidium parvum
KFEVEVAKILYWRIKTDA

SEQ ID NO: 2339105 - protein, 20 aa, Cryptosporidium parvum
KFGIKNLFRKNAARAKLGYY

SEQ ID NO: 2339106 - protein, 18 aa, Cryptosporidium parvum
KFLNTFFHSTLSKVEHVT

SEQ ID NO: 2339107 - protein, 30 aa, Cryptosporidium parvum; identical to SEQ ID NO: 2209791

SEQ ID NO: 2339108 - protein, 20 aa, Cryptosporidium parvum
KFNDFCLVGIILFNTKSYSR

SEQ ID NO: 2339109 - protein, 17 aa, Cryptosporidium parvum
KFNGILTDLFSKNLNRG

SEQ ID NO: 2339110 - protein, 29 aa, Cryptosporidium parvum
KFRKRLRRIPIFFRNLFRRNKNKTKANGK

SEQ ID NO: 2339111 - protein, 17 aa, Cryptosporidium parvum
KFSEDFSDELPHETYDR

SEQ ID NO: 2339112 - protein, 17 aa, Cryptosporidium parvum
KFSKIFENKLSTLFANT

SEQ ID NO: 2339113 - protein, 18 aa, Cryptosporidium parvum
KFSKLYSFNPLKIKKYSQ

SEQ ID NO: 2339114 - protein, 21 aa, Cryptosporidium parvum
KGEFSFIINSLKWNGSNKINQ

SEQ ID NO: 2339115 - protein, 18 aa, Cryptosporidium parvum
KGELFYLYTGRGPSSESL

SEQ ID NO: 2339116 - protein, 21 aa, Cryptosporidium parvum
KGFLGSIFLAIRSLSKKILHL

SEQ ID NO: 2339117 - protein, 17 aa, Cryptosporidium parvum
KGKMRFNYIPKFSEISQ

SEQ ID NO: 2339118 - protein, 19 aa, Cryptosporidium parvum
KGLSFILLAGNALSQTTQQ

SEQ ID NO: 2339119 - protein, 18 aa, Cryptosporidium parvum
KGMGFFNKFIIMNNPKRT

SEQ ID NO: 2339120 - protein, 19 aa, Cryptosporidium parvum
KGNFVPWRFVESCTNILRT

SEQ ID NO: 2339121 - protein, 22 aa, Cryptosporidium parvum
KHCSYIQVFRYLKSNIFEKLKL

SEQ ID NO: 2339122 - protein, 37 aa, Cryptosporidium parvum
KHCVNAQLFLKYRSSILILVLVFLAILDGSFSGEESS

SEQ ID NO: 2339123 - protein, 24 aa, Cryptosporidium parvum
KHIPAYLMYSPALVTLDFLESNFT

SEQ ID NO: 2339124 - protein, 25 aa, Cryptosporidium parvum
KHTEGILVPWPWELSKYRVLDVISY

SEQ ID NO: 2339125 - protein, 20 aa, Cryptosporidium parvum
KHYRYARGVLGKRPIRYKKA

SEQ ID NO: 2339126 - protein, 30 aa, Cryptosporidium parvum; identical to SEQ ID NO: 2192106

SEQ ID NO: 2339127 - protein, 19 aa, Cryptosporidium parvum
KIDPRLVNHKKLFKILNFH

SEQ ID NO: 2339128 - protein, 25 aa, Cryptosporidium parvum
KIDTKTLIFFIPDDLVDQMIFEIER

SEQ ID NO: 2339129 - protein, 23 aa, Cryptosporidium parvum
KIECKFIKNLIFILIIFSEKNYS

SEQ ID NO: 2339130 - protein, 17 aa, Cryptosporidium parvum
KIEITSVFFKLTSNFDL

SEQ ID NO: 2339131 - protein, 19 aa, Cryptosporidium parvum
KIEMAILNTLLKRFSINMS

SEQ ID NO: 2339132 - protein, 18 aa, Cryptosporidium parvum
KIIMFPQTVFFKNEINKV

SEQ ID NO: 2339133 - protein, 21 aa, Cryptosporidium parvum
KIINEKIVISRLPISISKGFI

SEQ ID NO: 2339134 - protein, 23 aa, Cryptosporidium parvum
KIIQSNPILYPFEIEYKNISSCQ

SEQ ID NO: 2339135 - protein, 19 aa, Cryptosporidium parvum
KIKENSFFQVFKILSKEAA

SEQ ID NO: 2339136 - protein, 24 aa, Cryptosporidium parvum
KIKGIFKIVIVEDPDVLLHLREHL

SEQ ID NO: 2339137 - protein, 18 aa, Cryptosporidium parvum
KIKLVSDVLPVPFKKSEQ

SEQ ID NO: 2339138 - protein, 20 aa, Cryptosporidium parvum
KIKNIYAKSFLKQISFPGEV

SEQ ID NO: 2339139 - protein, 23 aa, Cryptosporidium parvum
KIKPFDMLIPFVNESGQIKFVTR

SEQ ID NO: 2339140 - protein, 26 aa, Cryptosporidium parvum
KIKWSIGFGKNYLLYLNVYDLNNNNK

SEQ ID NO: 2339141 - protein, 19 aa, Cryptosporidium parvum
KILGLLEWNKDILSVFIEA

SEQ ID NO: 2339142 - protein, 18 aa, Cryptosporidium parvum
KINLINFAMSCIFEVDLL

SEQ ID NO: 2339143 - protein, 33 aa, Cryptosporidium parvum
KINVSSMYRLLPPGPIKYLFHFKQSKTAAIEAI

SEQ ID NO: 2339144 - protein, 23 aa, Cryptosporidium parvum
KIQRPRGWMIKKTYGKKALRLPE

SEQ ID NO: 2339145 - protein, 19 aa, Cryptosporidium parvum
KIREMLNEIPSYEYTGLNR

SEQ ID NO: 2339146 - protein, 33 aa, Cryptosporidium parvum; identical to SEQ ID NO: 2209815

SEQ ID NO: 2339147 - protein, 17 aa, Cryptosporidium parvum
KITAIIFTKDSGPFETL

SEQ ID NO: 2339148 - protein, 24 aa, Cryptosporidium parvum
KKDYLEFIDALTFDQFYKYWQYFG

SEQ ID NO: 2339149 - protein, 27 aa, Cryptosporidium parvum
KKEKEKLPLQKKKKWYEKRDPITGELL

SEQ ID NO: 2339150 - protein, 22 aa, Cryptosporidium parvum
KKETLVPIYLNAETLDLVNKRH

SEQ ID NO: 2339151 - protein, 20 aa, Cryptosporidium parvum
KKEYSCREIPLSIRAIHEQD

SEQ ID NO: 2339152 - protein, 29 aa, Cryptosporidium parvum
KKGNISNLIFPFLKIYKKSFLNIVNINDL

SEQ ID NO: 2339153 - protein, 37 aa, Cryptosporidium parvum; identical to SEQ ID NO: 2209823

SEQ ID NO: 2339154 - protein, 20 aa, Cryptosporidium parvum
KKIPNLIHALFNSELRKQRK

SEQ ID NO: 2339155 - protein, 18 aa, Cryptosporidium parvum
KKISTKIKLLGLAVSRFS

SEQ ID NO: 2339156 - protein, 17 aa, Cryptosporidium parvum
KKKFSKIFENKLSTLFA

SEQ ID NO: 2339157 - protein, 28 aa, Cryptosporidium parvum
KKKGIPLMEWFRYSSVLKLAAEFGSGLL

SEQ ID NO: 2339158 - protein, 23 aa, Cryptosporidium parvum
KKKLLILGQRQLATMELSVVSSF

SEQ ID NO: 2339159 - protein, 29 aa, Cryptosporidium parvum
KKLEVIFSIISFLFLRSFEDIKYYYNKLS

SEQ ID NO: 2339160 - protein, 26 aa, Cryptosporidium parvum
KKMRDILFLILPLVIVTISCCNYIES

SEQ ID NO: 2339161 - protein, 33 aa, Cryptosporidium parvum
KKNRKLKIKNVFGPNIFKLFKKKEEQKPARKII

SEQ ID NO: 2339162 - protein, 21 aa, Cryptosporidium parvum
KKQLSFKCINKLRTLLDYTNK

SEQ ID NO: 2339163 - protein, 17 aa, Cryptosporidium parvum
KKVMFGFTQNEWNRILV

SEQ ID NO: 2339164 - protein, 27 aa, Cryptosporidium parvum
KKVYSQVLLYMKSLCKTQREKLSNLSA

SEQ ID NO: 2339165 - protein, 26 aa, Cryptosporidium parvum
KKYPEIYGFYKFIHLHFGETSAFTDL

SEQ ID NO: 2339166 - protein, 22 aa, Cryptosporidium parvum
KLDILSLCFVIQSVPNCPSQTR

SEQ ID NO: 2339167 - protein, 17 aa, Cryptosporidium parvum
KLDKLRCPANCPDYGIV

SEQ ID NO: 2339168 - protein, 31 aa, Cryptosporidium parvum
KLDSEWLNIRTFKSYVLLNLPKDRPSEYGDK

SEQ ID NO: 2339169 - protein, 23 aa, Cryptosporidium parvum
KLDYYDMKLDFYNRLISGFEYDL

SEQ ID NO: 2339170 - protein, 17 aa, Cryptosporidium parvum
KLEKLFPININLLSPNK

SEQ ID NO: 2339171 - protein, 26 aa, Cryptosporidium parvum
KLEQLLAEIFSCLLRMAAKRYSGKSI

SEQ ID NO: 2339172 - protein, 20 aa, Cryptosporidium parvum
KLFTLLENPNCWYNQRGKKV

SEQ ID NO: 2339173 - protein, 19 aa, Cryptosporidium parvum
KLKIWVRGNNNRIPLPIMV

SEQ ID NO: 2339174 - protein, 17 aa, Cryptosporidium parvum
KLKLKRSQWLAIQEAIR

SEQ ID NO: 2339175 - protein, 26 aa, Cryptosporidium parvum
KLKQLESKYLKLLSEVSSIGPQLMRV

SEQ ID NO: 2339176 - protein, 17 aa, Cryptosporidium parvum
KLLFLNGIDESFNQIRG

SEQ ID NO: 2339177 - protein, 22 aa, Cryptosporidium parvum
KLLILYFFFPLRYPQNETRSQK

SEQ ID NO: 2339178 - protein, 17 aa, Cryptosporidium parvum
KLLKMDGLLCLLFAVFI

SEQ ID NO: 2339179 - protein, 22 aa, Cryptosporidium parvum
KLLSYVILTKYFIIADIFNLEI

SEQ ID NO: 2339180 - protein, 26 aa, Cryptosporidium parvum
KLNFTFTDIYPSIPTRLIFSVQNYQG

SEQ ID NO: 2339181 - protein, 24 aa, Cryptosporidium parvum
KLNLGLITFYGFPKSKDSSQDINL

SEQ ID NO: 2339182 - protein, 18 aa, Cryptosporidium parvum
KLRERGRFAFVEDACLGL

SEQ ID NO: 2339183 - protein, 24 aa, Cryptosporidium parvum
KLRSSRPEMPIWYFGTEEQRDREK

SEQ ID NO: 2339184 - protein, 17 aa, Cryptosporidium parvum
KLSKKILYFSKPKMDPQ

SEQ ID NO: 2339185 - protein, 18 aa, Cryptosporidium parvum
KLSPIPVHVLYKKFQLFP

SEQ ID NO: 2339186 - protein, 32 aa, Cryptosporidium parvum; identical to SEQ ID NO: 2209840

SEQ ID NO: 2339187 - protein, 20 aa, Cryptosporidium parvum
KLVTLPFINSPIESISHSEK

SEQ ID NO: 2339188 - protein, 19 aa, Cryptosporidium parvum
KLVTNPQIHRLRFALYKCS

SEQ ID NO: 2339189 - protein, 19 aa, Cryptosporidium parvum
KLVWEDYFELLYEKILDPN

SEQ ID NO: 2339190 - protein, 34 aa, Cryptosporidium parvum; identical to SEQ ID NO: 2209843

SEQ ID NO: 2339191 - protein, 23 aa, Cryptosporidium parvum
KLYFETNLLRQFGEWQHYYVEAK

SEQ ID NO: 2339192 - protein, 26 aa, Cryptosporidium parvum
KLYSPKLARAISRLEKKKISTHAIQK

SEQ ID NO: 2339193 - protein, 18 aa, Cryptosporidium parvum
KMIDAICPDGFLPNGDDC

SEQ ID NO: 2339194 - protein, 36 aa, Cryptosporidium parvum
KMNEDRYWHFIRKLYSISYLIRRDLLPKLGIKYLVE

SEQ ID NO: 2339195 - protein, 33 aa, Cryptosporidium parvum; identical to SEQ ID NO: 2209848

SEQ ID NO: 2339196 - protein, 21 aa, Cryptosporidium parvum
KNDVLYIFYGDKNGIERSIFN

SEQ ID NO: 2339197 - protein, 19 aa, Cryptosporidium parvum
KNDWLVVLVTPFCQPCIDT

SEQ ID NO: 2339198 - protein, 28 aa, Cryptosporidium parvum
KNEIRIYNPLLFKNYPQLILSSIHRSLT

SEQ ID NO: 2339199 - protein, 18 aa, Cryptosporidium parvum
KNIIFEKIATFPPILPDL

SEQ ID NO: 2339200 - protein, 29 aa, Cryptosporidium parvum
KNIKENIPFKHILLPFTTTTTTVTTTTTT

SEQ ID NO: 2339201 - protein, 24 aa, Cryptosporidium parvum
KNRKLKHPSFNPIRRYIFNDDDID

SEQ ID NO: 2339202 - protein, 30 aa, Cryptosporidium parvum
KNVFKKLSAAFFRFILLKFASSNEEPFVQI

SEQ ID NO: 2339203 - protein, 25 aa, Cryptosporidium parvum
KPTPPYPLPQLSPSPSPYPSPAISL

SEQ ID NO: 2339204 - protein, 18 aa, Cryptosporidium parvum
KPWLLQRIPELTGLSYND

SEQ ID NO: 2339205 - protein, 21 aa, Cryptosporidium parvum
KQDWTLFVIISTGIPEYDNNS

SEQ ID NO: 2339206 - protein, 17 aa, Cryptosporidium parvum
KQFDQSEFIPFLNELEK

SEQ ID NO: 2339207 - protein, 26 aa, Cryptosporidium parvum
KQIDKEFYLHYLAVDFSLNYSLKTIY

SEQ ID NO: 2339208 - protein, 18 aa, Cryptosporidium parvum
KQIINWDGPVKFTPTQKR

SEQ ID NO: 2339209 - protein, 21 aa, Cryptosporidium parvum
KQILKYKFDYYFDVSPRQISK

SEQ ID NO: 2339210 - protein, 25 aa, Cryptosporidium parvum
KQKKEILSLIKYNFISWVNYNDNIQ

SEQ ID NO: 2339211 - protein, 24 aa, Cryptosporidium parvum
KQMKERWVKAPPLRRPEGINVESD

SEQ ID NO: 2339212 - protein, 23 aa, Cryptosporidium parvum
KQPLIYLSYILNSKQKNSLFWFL

SEQ ID NO: 2339213 - protein, 23 aa, Cryptosporidium parvum
KQTDLIKLSILGKSLQLSNSNSD

SEQ ID NO: 2339214 - protein, 27 aa, Cryptosporidium parvum
KRFEDIQFLFNDFIARINLEFQRSNRL

SEQ ID NO: 2339215 - protein, 25 aa, Cryptosporidium parvum
KRGRFSRFKSAISKPFRAHKLKKAL

SEQ ID NO: 2339216 - protein, 22 aa, Cryptosporidium parvum
KRIQTFFTNPYSFKNFKSRKYE

SEQ ID NO: 2339217 - protein, 18 aa, Cryptosporidium parvum
KRIVMEMIPLIYSKADMV

SEQ ID NO: 2339218 - protein, 24 aa, Cryptosporidium parvum
KRKGKFKVYPPLGTILTVGEDQTN

SEQ ID NO: 2339219 - protein, 25 aa, Cryptosporidium parvum
KRLSKFYEPLLKFVKDEFPGEFLKV

SEQ ID NO: 2339220 - protein, 26 aa, Cryptosporidium parvum
KRNHVYWVPIIYPSNVYKVSLEGLSI

SEQ ID NO: 2339221 - protein, 23 aa, Cryptosporidium parvum
KRNNWFFKLLISQYNAISQVYLE

SEQ ID NO: 2339222 - protein, 47 aa, Cryptosporidium parvum
KRPKIRLGLLEDINDLLILEAGFRRLVRLFRSINISTLLVPNNSTHK

SEQ ID NO: 2339223 - protein, 25 aa, Cryptosporidium parvum
KRSDKPLWYYYDTIGRRWDDSIEDD

SEQ ID NO: 2339224 - protein, 23 aa, Cryptosporidium parvum
KRVYGVLPVNPFAGNIFTPSLSE

SEQ ID NO: 2339225 - protein, 25 aa, Cryptosporidium parvum
KRYTETILDWIYFEKPDSYKEICML

SEQ ID NO: 2339226 - protein, 28 aa, Cryptosporidium parvum
KSGLLGLRQKVISLGPLFSTKVTSYKSP

SEQ ID NO: 2339227 - protein, 29 aa, Cryptosporidium parvum
KSGNGKGGFLSRLFGFFGRNNSGKKDKAS

SEQ ID NO: 2339228 - protein, 27 aa, Cryptosporidium parvum
KSGSIQGIPWPPIKSPSSLVFIGRERP

SEQ ID NO: 2339229 - protein, 24 aa, Cryptosporidium parvum
KSKEHVIVTFFAPWCGHCTALEPE

SEQ ID NO: 2339230 - protein, 26 aa, Cryptosporidium parvum
KSKEQFLFSFFGIKRFDYSKITSETS

SEQ ID NO: 2339231 - protein, 25 aa, Cryptosporidium parvum
KSKIWRFFNYFRLKRKKKKQPRHPG

SEQ ID NO: 2339232 - protein, 18 aa, Cryptosporidium parvum
KSKLLRRVLEMKLKRVNH

SEQ ID NO: 2339233 - protein, 23 aa, Cryptosporidium parvum
KSKYGYFILNEILGSLITLNANG

SEQ ID NO: 2339234 - protein, 22 aa, Cryptosporidium parvum
KSLIKISLDLISFCLTYYQFEE

SEQ ID NO: 2339235 - protein, 21 aa, Cryptosporidium parvum
KSNIWLVYRYEGVSLGNLLFD

SEQ ID NO: 2339236 - protein, 25 aa, Cryptosporidium parvum
KSNYYLGYHFLTTLVTFWTGGSKFR

SEQ ID NO: 2339237 - protein, 23 aa, Cryptosporidium parvum
KSREWIMIVNFYRPGCGPCKQLV

SEQ ID NO: 2339238 - protein, 19 aa, Cryptosporidium parvum
KSRPNILQPYMLISNPKLS

SEQ ID NO: 2339239 - protein, 33 aa, Cryptosporidium parvum
KSSISKHFNKILNLLINSITGGGEWINVGIEKM

SEQ ID NO: 2339240 - protein, 19 aa, Cryptosporidium parvum
KTELFTKVGLFIEGFTLES

SEQ ID NO: 2339241 - protein, 31 aa, Cryptosporidium parvum
KTFLKKLFTKISSFPKVWPLHLRSEELPFIK

SEQ ID NO: 2339242 - protein, 23 aa, Cryptosporidium parvum
KTIRKLEIQFRRKAYGHFQEKEY

SEQ ID NO: 2339243 - protein, 27 aa, Cryptosporidium parvum
KTLENLYRQLFILNQDIKRLVGYQHKM

SEQ ID NO: 2339244 - protein, 24 aa, Cryptosporidium parvum
KTMFLWNETIFFENLSINELYSPS

SEQ ID NO: 2339245 - protein, 29 aa, Cryptosporidium parvum
KTNARLVTLSYLFMKSFKYAIPSEYRECI

SEQ ID NO: 2339246 - protein, 22 aa, Cryptosporidium parvum
KTPDVKALRRLAAAKETSTVYE

SEQ ID NO: 2339247 - protein, 20 aa, Cryptosporidium parvum
KTYSLRLLPNSLRAFPIFET

SEQ ID NO: 2339248 - protein, 30 aa, Cryptosporidium parvum; identical to SEQ ID NO: 2209892

SEQ ID NO: 2339249 - protein, 25 aa, Cryptosporidium parvum
KVILVRKRRPAFNWLRKWRNKRKIK

SEQ ID NO: 2339250 - protein, 18 aa, Cryptosporidium parvum
KVKSGGHQMWISSKSRNT

SEQ ID NO: 2339251 - protein, 23 aa, Cryptosporidium parvum
KVLAVPKLWPECQMLFGTSSGKY

SEQ ID NO: 2339252 - protein, 25 aa, Cryptosporidium parvum
KVNVSILWIYIDKASPESFIFTQYL

SEQ ID NO: 2339253 - protein, 25 aa, Cryptosporidium parvum
KVQKFLTQPFFMSEAFTGKPGVFVN

SEQ ID NO: 2339254 - protein, 28 aa, Cryptosporidium parvum
KVRFSIEGFWSLITLIPKMVLSNLNTKD

SEQ ID NO: 2339255 - protein, 22 aa, Cryptosporidium parvum
KVSELLIEVPFFKSKLFSQNMY

SEQ ID NO: 2339256 - protein, 18 aa, Cryptosporidium parvum
KVSGIFRYTDNDNYYQVI

SEQ ID NO: 2339257 - protein, 18 aa, Cryptosporidium parvum
KVTLKYPPYSGLEEESFQ

SEQ ID NO: 2339258 - protein, 17 aa, Cryptosporidium parvum
KVYTPKKPSLDAFKTRG

SEQ ID NO: 2339259 - protein, 19 aa, Cryptosporidium parvum
KWYSLLDSINIFAISMLSS

SEQ ID NO: 2339260 - protein, 25 aa, Cryptosporidium parvum
KYDFQNILKKERLKRFQKLLKDSLA

SEQ ID NO: 2339261 - protein, 27 aa, Cryptosporidium parvum
KYENTFKIIFFWGMKDDVVPFPPALEF

SEQ ID NO: 2339262 - protein, 22 aa, Cryptosporidium parvum
KYGFFMETLLHLKKKSERDGEI

SEQ ID NO: 2339263 - protein, 17 aa, Cryptosporidium parvum
KYHGEVIKGIRGGAGYL

SEQ ID NO: 2339264 - protein, 19 aa, Cryptosporidium parvum
KYIQELMLLVINTYEKIGK

SEQ ID NO: 2339265 - protein, 27 aa, Cryptosporidium parvum
KYNEDFNYFKFIYPRGYSPSRSIFTQK

SEQ ID NO: 2339266 - protein, 19 aa, Cryptosporidium parvum
KYNNVFLRTLSKRTLENTQ

SEQ ID NO: 2339267 - protein, 18 aa, Cryptosporidium parvum
KYSMVYIDWIYSVLSNYK

SEQ ID NO: 2339268 - protein, 47 aa, Cryptosporidium parvum
KYVKSIKLLHFKVDSAKKIVFLALKTRIILQLLPSKYSRDYSSEELE

SEQ ID NO: 2339269 - protein, 19 aa, Cryptosporidium parvum
KYWLPENMNLYIDSALDYR

SEQ ID NO: 2339270 - protein, 20 aa, Cryptosporidium parvum
LAEPFKSKFLKMFVKEPLED

SEQ ID NO: 2339271 - protein, 17 aa, Cryptosporidium parvum
LAFELITFLLRSATDFE

SEQ ID NO: 2339272 - protein, 17 aa, Cryptosporidium parvum
LAGYLMLTITLYHSRSE

SEQ ID NO: 2339273 - protein, 17 aa, Cryptosporidium parvum
LAICYLMLKVALTTFVF

SEQ ID NO: 2339274 - protein, 21 aa, Cryptosporidium parvum
LAITEGFIFSPKSLNLIECTN

SEQ ID NO: 2339275 - protein, 24 aa, Cryptosporidium parvum
LAKALIMFNFLLETKRLGVFQIHM

SEQ ID NO: 2339276 - protein, 18 aa, Cryptosporidium parvum
LALLAILVGVCANTYVSP

SEQ ID NO: 2339277 - protein, 22 aa, Cryptosporidium parvum
LALYDLCNQIMEAIMFLSDSID

SEQ ID NO: 2339278 - protein, 25 aa, Cryptosporidium parvum
LAMRMMLFLPHQLRNTLNCKSAIIA

SEQ ID NO: 2339279 - protein, 25 aa, Cryptosporidium parvum
LAPGFEILPYFHPDFPKDGNDLTWE

SEQ ID NO: 2339280 - protein, 20 aa, Cryptosporidium parvum
LAPIIGNVRIQFLEKRPLSQ

SEQ ID NO: 2339281 - protein, 60 aa, Cryptosporidium parvum
LAPTALTYLAPPYPIPTSFAYPTPTPYPYLYPYPYHLTPFPYSPVPFPYPAQNSSLTPIS

SEQ ID NO: 2339282 - protein, 21 aa, Cryptosporidium parvum
LAPVQIVCFPTTKIKSIIASI

SEQ ID NO: 2339283 - protein, 18 aa, Cryptosporidium parvum
LARELPIPTPLYSQVPEV

SEQ ID NO: 2339284 - protein, 18 aa, Cryptosporidium parvum
LASIYQLYSKPMKYLSAS

SEQ ID NO: 2339285 - protein, 23 aa, Cryptosporidium parvum
LASSSYYELSFVKVKCGGGFCKR

SEQ ID NO: 2339286 - protein, 17 aa, Cryptosporidium parvum
LATALLQQIHLLPTYMF

SEQ ID NO: 2339287 - protein, 17 aa, Cryptosporidium parvum
LATSNFAFRYLVSRVFG

SEQ ID NO: 2339288 - protein, 22 aa, Cryptosporidium parvum
LAYFACLNAFLFNRQAKSECFT

SEQ ID NO: 2339289 - protein, 38 aa, Cryptosporidium parvum
LAYIGLYNQLVRHYSNMPWPIGLCQCSLYCVAIDVSRQ

SEQ ID NO: 2339290 - protein, 25 aa, Cryptosporidium parvum
LCESPFEYMCKYISLRLKRSSLEED

SEQ ID NO: 2339291 - protein, 19 aa, Cryptosporidium parvum
LCLFIASYSALCKFSKKGI

SEQ ID NO: 2339292 - protein, 23 aa, Cryptosporidium parvum
LCNSVDFSLYAAFSSFNERELGI

SEQ ID NO: 2339293 - protein, 17 aa, Cryptosporidium parvum
LCTEISSIISKLKQLES

SEQ ID NO: 2339294 - protein, 17 aa, Cryptosporidium parvum
LCVGIINPKIPPPGELP

SEQ ID NO: 2339295 - protein, 20 aa, Cryptosporidium parvum
LCVRLKDNVVGGGALVLDDC

SEQ ID NO: 2339296 - protein, 17 aa, Cryptosporidium parvum
LDELYSKYYEFKSSQEG

SEQ ID NO: 2339297 - protein, 17 aa, Cryptosporidium parvum
LDKKEVIDSYRTIYRLL

SEQ ID NO: 2339298 - protein, 18 aa, Cryptosporidium parvum
LDLNIWCLALRQKVPDMK

SEQ ID NO: 2339299 - protein, 25 aa, Cryptosporidium parvum
LDLSSKYLLFFFTSRMTQTSEVLLS

SEQ ID NO: 2339300 - protein, 17 aa, Cryptosporidium parvum
LDQKLFTLLENPNCWYN

SEQ ID NO: 2339301 - protein, 17 aa, Cryptosporidium parvum
LDSMLANIWWNGPVKKS

SEQ ID NO: 2339302 - protein, 29 aa, Cryptosporidium parvum
LDYVEGYFYKWEAILKMLKKRLESLIRRF

SEQ ID NO: 2339303 - protein, 24 aa, Cryptosporidium parvum
LEDPGFIYILKDRLVLQNHLGSVC

SEQ ID NO: 2339304 - protein, 25 aa, Cryptosporidium parvum
LEDYSSYGFVTWIKPVESNSTKVVL

SEQ ID NO: 2339305 - protein, 18 aa, Cryptosporidium parvum
LEEHAKILDLLKKNQEKL

SEQ ID NO: 2339306 - protein, 23 aa, Cryptosporidium parvum
LEERRICEKIPLFSTSPMTNNEN

SEQ ID NO: 2339307 - protein, 18 aa, Cryptosporidium parvum
LEFLQFQIEAITPNLSAL

SEQ ID NO: 2339308 - protein, 25 aa, Cryptosporidium parvum
LEIEPLALNFIVSGRGYKFLKMILK

SEQ ID NO: 2339309 - protein, 32 aa, Cryptosporidium parvum
LEKAFKFLTGCDLNLLYLINTRISTIEYLLIQ

SEQ ID NO: 2339310 - protein, 17 aa, Cryptosporidium parvum
LEKDELIKWIKFVSERS

SEQ ID NO: 2339311 - protein, 17 aa, Cryptosporidium parvum
LEKILEIEPLALNFIVS

SEQ ID NO: 2339312 - protein, 26 aa, Cryptosporidium parvum
LEKQGIPCIIYKLISLDFEYSGQDEM

SEQ ID NO: 2339313 - protein, 24 aa, Cryptosporidium parvum
LELSKLIWGIIKSPSFKKIKFSKD

SEQ ID NO: 2339314 - protein, 26 aa, Cryptosporidium parvum
LENNDLFSRFLFSGSGPSLESWLSLQ

SEQ ID NO: 2339315 - protein, 25 aa, Cryptosporidium parvum
LEQQISPLFQFRAKLYFEGNTWKVD

SEQ ID NO: 2339316 - protein, 27 aa, Cryptosporidium parvum
LESAPTIPVYIPPSAPSIPPSIPPPIR

SEQ ID NO: 2339317 - protein, 19 aa, Cryptosporidium parvum
LESLIRRFEALGCEGPEAK

SEQ ID NO: 2339318 - protein, 17 aa, Cryptosporidium parvum
LEYLISCDLDSSLKSMV

SEQ ID NO: 2339319 - protein, 22 aa, Cryptosporidium parvum
LFAFLKAIYATDHRGSLTISSP

SEQ ID NO: 2339320 - protein, 17 aa, Cryptosporidium parvum
LFAILISSYLTESHGYQ

SEQ ID NO: 2339321 - protein, 17 aa, Cryptosporidium parvum
LFANIYSPVWGCYQFMD

SEQ ID NO: 2339322 - protein, 19 aa, Cryptosporidium parvum
LFATYFLTKTGFRNSESIS

SEQ ID NO: 2339323 - protein, 25 aa, Cryptosporidium parvum
LFCLLILCFNSVLIFCNSSLESIPR

SEQ ID NO: 2339324 - protein, 28 aa, Cryptosporidium parvum
LFEEILLIIEQCLLLVELFAMQTISKNL

SEQ ID NO: 2339325 - protein, 19 aa, Cryptosporidium parvum
LFETLRNLVFKLKSYLVKC

SEQ ID NO: 2339326 - protein, 20 aa, Cryptosporidium parvum
LFFAILLVINQVIDGVKSEL

SEQ ID NO: 2339327 - protein, 21 aa, Cryptosporidium parvum
LFFFAIYIMIGISNASDMTSS

SEQ ID NO: 2339328 - protein, 25 aa, Cryptosporidium parvum
LFFLCVLFINKFDFLIGSDTPHNNQ

SEQ ID NO: 2339329 - protein, 26 aa, Cryptosporidium parvum
LFFSFIILLCEYSFSLGNIQNQFERF

SEQ ID NO: 2339330 - protein, 20 aa, Cryptosporidium parvum
LFIDEFGLPESSLLHLESKP

SEQ ID NO: 2339331 - protein, 18 aa, Cryptosporidium parvum
LFLALALLRNAAGDEFSD

SEQ ID NO: 2339332 - protein, 18 aa, Cryptosporidium parvum
LFLFCSIVLGSDLNETFQ

SEQ ID NO: 2339333 - protein, 18 aa, Cryptosporidium parvum
LFLLSLLCLGVTTVFGDL

SEQ ID NO: 2339334 - protein, 27 aa, Cryptosporidium parvum
LFLLSLWLFLCDLHNFQDYSCLRISIL

SEQ ID NO: 2339335 - protein, 17 aa, Cryptosporidium parvum
LFLSFVSTISLCSRLEW

SEQ ID NO: 2339336 - protein, 20 aa, Cryptosporidium parvum
LFLSIKTNLIHFCLAGNFLV

SEQ ID NO: 2339337 - protein, 18 aa, Cryptosporidium parvum
LFLSLLALAFGNGENSIS

SEQ ID NO: 2339338 - protein, 17 aa, Cryptosporidium parvum
LFPLYKDANLYGTLIEI

SEQ ID NO: 2339339 - protein, 26 aa, Cryptosporidium parvum
LFSGHDLTVIPLLSSLHAWDEHLPPY

SEQ ID NO: 2339340 - protein, 24 aa, Cryptosporidium parvum
LFSNIIILCLYLGILKCVNSHISN

SEQ ID NO: 2339341 - protein, 21 aa, Cryptosporidium parvum
LFTLFLINIINIHDINQYFSI

SEQ ID NO: 2339342 - protein, 20 aa, Cryptosporidium parvum
LFVLFSLSLFSVLSSANIPN

SEQ ID NO: 2339343 - protein, 31 aa, Cryptosporidium parvum
LFYQTMCFLKRLFVLAGALFVLICLSQKAGS

SEQ ID NO: 2339344 - protein, 23 aa, Cryptosporidium parvum
LGAYPSFHIFGATPGLQLTSPSP

SEQ ID NO: 2339345 - protein, 27 aa, Cryptosporidium parvum
LGDGSKFFPFFISKYIRSLQKSNYFGE

SEQ ID NO: 2339346 - protein, 23 aa, Cryptosporidium parvum
LGDLGLPHLFDLRFKHDVLSSYE

SEQ ID NO: 2339347 - protein, 18 aa, Cryptosporidium parvum
LGDWIKKIDFSSNGRYVL

SEQ ID NO: 2339348 - protein, 19 aa, Cryptosporidium parvum
LGFVSYLEIVIDGISTIFI

SEQ ID NO: 2339349 - protein, 21 aa, Cryptosporidium parvum
LGILAIFIKLAITYANQHANE

SEQ ID NO: 2339350 - protein, 20 aa, Cryptosporidium parvum
LGILLLFQKQDQDLEDLDAL

SEQ ID NO: 2339351 - protein, 29 aa, Cryptosporidium parvum
LGLHLGDFIYPRLFPIFVSDLCIARKMMK

SEQ ID NO: 2339352 - protein, 29 aa, Cryptosporidium parvum
LGLLFGLVSVHSLSLRAGSQELIISEDVS

SEQ ID NO: 2339353 - protein, 23 aa, Cryptosporidium parvum
LGLNGLYHQWKVGPIILTKKETE

SEQ ID NO: 2339354 - protein, 26 aa, Cryptosporidium parvum
LGMVNKLFVVKLKIIKILQSAQNRNN

SEQ ID NO: 2339355 - protein, 20 aa, Cryptosporidium parvum
LGQIDTFYQALYDSSRDLKN

SEQ ID NO: 2339356 - protein, 25 aa, Cryptosporidium parvum
LGSLEALLVFLKSSNIPVVALNIGT

SEQ ID NO: 2339357 - protein, 25 aa, Cryptosporidium parvum
LGSYKNTFRCISKLSFDGLKLSAQC

SEQ ID NO: 2339358 - protein, 27 aa, Cryptosporidium parvum
LGYHIDKYSPLLPRWARDQTKDPFIVE

SEQ ID NO: 2339359 - protein, 26 aa, Cryptosporidium parvum
LHALICIWLLFRIILEPVNGKNDSKF

SEQ ID NO: 2339360 - protein, 30 aa, Cryptosporidium parvum
LHGSRRQIYHFLFSGGFLFPGNTLYEGYTT

SEQ ID NO: 2339361 - protein, 21 aa, Cryptosporidium parvum
LHHCQGGHLDLLKTQLLTFKI

SEQ ID NO: 2339362 - protein, 26 aa, Cryptosporidium parvum
LHNFQDYSCLRISILSLKSEVCENSD

SEQ ID NO: 2339363 - protein, 22 aa, Cryptosporidium parvum
LIAFFLFFGVSLIEGKNDGGIL

SEQ ID NO: 2339364 - protein, 22 aa, Cryptosporidium parvum
LICILIYLNIQVTLGGDAQTTL

SEQ ID NO: 2339365 - protein, 21 aa, Cryptosporidium parvum
LIDLMGLAALQRIISFCLKFS

SEQ ID NO: 2339366 - protein, 44 aa, Cryptosporidium parvum; identical to SEQ ID NO: 2209952

SEQ ID NO: 2339367 - protein, 22 aa, Cryptosporidium parvum
LIFAILAGYLISLSACAEKFKY

SEQ ID NO: 2339368 - protein, 20 aa, Cryptosporidium parvum
LIFDSIELIINQIKWRFEKD

SEQ ID NO: 2339369 - protein, 17 aa, Cryptosporidium parvum
LIFLVGIFTTKICSSLT

SEQ ID NO: 2339370 - protein, 23 aa, Cryptosporidium parvum
LIFSLILLYSTFQICYSEEIGRN

SEQ ID NO: 2339371 - protein, 25 aa, Cryptosporidium parvum
LIGPNEVIIFKLKLGKIIKNENKKP

SEQ ID NO: 2339372 - protein, 17 aa, Cryptosporidium parvum
LIIFIGGWGGGKLVRVE

SEQ ID NO: 2339373 - protein, 23 aa, Cryptosporidium parvum
LIIFVFSLSFLSFEHRNERDIVV

SEQ ID NO: 2339374 - protein, 23 aa, Cryptosporidium parvum
LIILLLAILGVASALDGVQLSEI

SEQ ID NO: 2339375 - protein, 18 aa, Cryptosporidium parvum
LIIYYVGGLFGESTDYSP

SEQ ID NO: 2339376 - protein, 19 aa, Cryptosporidium parvum
LIKYYNMKLSKLKAAIRSV

SEQ ID NO: 2339377 - protein, 21 aa, Cryptosporidium parvum
LILFTLAIYSQSIHANEDDVI

SEQ ID NO: 2339378 - protein, 18 aa, Cryptosporidium parvum
LILFVLNSINISQCNISS

SEQ ID NO: 2339379 - protein, 25 aa, Cryptosporidium parvum
LILVNLLTLMLLQGHFGQIGCKSSD

SEQ ID NO: 2339380 - protein, 25 aa, Cryptosporidium parvum
LINLCIFLLVYLQSYQSSLQELLLK

SEQ ID NO: 2339381 - protein, 22 aa, Cryptosporidium parvum
LINSIGIWWCQKALPQLITDKE

SEQ ID NO: 2339382 - protein, 17 aa, Cryptosporidium parvum
LINTKAIYLTFLSSCKF

SEQ ID NO: 2339383 - protein, 17 aa, Cryptosporidium parvum
LIRRKILRKSAISTSFL

SEQ ID NO: 2339384 - protein, 18 aa, Cryptosporidium parvum
LITSLFLSGVINSNLDWI

SEQ ID NO: 2339385 - protein, 21 aa, Cryptosporidium parvum
LIVPFLVLFTAVEGAPDYSGI

SEQ ID NO: 2339386 - protein, 19 aa, Cryptosporidium parvum
LIVTHILCANAIHLGSPNY

SEQ ID NO: 2339387 - protein, 17 aa, Cryptosporidium parvum
LIWKNYFESIYSTAFEL

SEQ ID NO: 2339388 - protein, 25 aa, Cryptosporidium parvum
LIYFELPQIILYPNIDLFIGNINIL

SEQ ID NO: 2339389 - protein, 24 aa, Cryptosporidium parvum
LKERVSFLYYIYRSYVQQISNLKN

SEQ ID NO: 2339390 - protein, 18 aa, Cryptosporidium parvum
LKFTDLVNFLLQRSSSEG

SEQ ID NO: 2339391 - protein, 25 aa, Cryptosporidium parvum
LKGKPIPYIPTLSDKDLKPLFSKSR

SEQ ID NO: 2339392 - protein, 17 aa, Cryptosporidium parvum
LKGLLDRQLIPGDPDAL

SEQ ID NO: 2339393 - protein, 19 aa, Cryptosporidium parvum
LKKEGILNIGLKPAPKMET

SEQ ID NO: 2339394 - protein, 25 aa, Cryptosporidium parvum
LKKNYARWAVSFLKGWISSRNPFRY

SEQ ID NO: 2339395 - protein, 24 aa, Cryptosporidium parvum
LKLLSLDFILEKKSKNLIKNFFET

SEQ ID NO: 2339396 - protein, 35 aa, Cryptosporidium parvum
LKLTDYYILNLEKFKIKLISFIFNDRYFFLEKSIV

SEQ ID NO: 2339397 - protein, 23 aa, Cryptosporidium parvum
LKNASLTRTFYSKPSSALASELN

SEQ ID NO: 2339398 - protein, 30 aa, Cryptosporidium parvum
LKPKDTFFKQGWTLFVMLNNGIPTSVSEKN

SEQ ID NO: 2339399 - protein, 24 aa, Cryptosporidium parvum
LKPTDSPVLLRFETLKKLDKVVSN

SEQ ID NO: 2339400 - protein, 19 aa, Cryptosporidium parvum
LKQGFYSSTLRRMLFRAAD

SEQ ID NO: 2339401 - protein, 20 aa, Cryptosporidium parvum
LKRFQKLLKDSLAARVNEIE

SEQ ID NO: 2339402 - protein, 21 aa, Cryptosporidium parvum
LKRTILLVIISIILKSRNTYG

SEQ ID NO: 2339403 - protein, 23 aa, Cryptosporidium parvum
LKSLFFFLELSLIITNSSTYIPN

SEQ ID NO: 2339404 - protein, 24 aa, Cryptosporidium parvum
LKTALILLLKFIGSSGISNYQGFG

SEQ ID NO: 2339405 - protein, 23 aa, Cryptosporidium parvum
LKTVPVLPKMFIFHSKLNTRKVH

SEQ ID NO: 2339406 - protein, 19 aa, Cryptosporidium parvum
LKVFLVSNSLLYTSSLSLG

SEQ ID NO: 2339407 - protein, 25 aa, Cryptosporidium parvum
LKVLPRIILGKYLVLEFKLQSPTKN

SEQ ID NO: 2339408 - protein, 27 aa, Cryptosporidium parvum
LKVNESKPFILFFKQHPTEASLATTQC

SEQ ID NO: 2339409 - protein, 24 aa, Cryptosporidium parvum
LLACSGIHMHLFEIKPKGVSFTKL

SEQ ID NO: 2339410 - protein, 20 aa, Cryptosporidium parvum
LLAFLSISLIVTAKDGESNY

SEQ ID NO: 2339411 - protein, 26 aa, Cryptosporidium parvum
LLATIIFCNFALIFCRRIPCEFEGNR

SEQ ID NO: 2339412 - protein, 26 aa, Cryptosporidium parvum
LLEKIKILPFWIFKVSDEFSIILIES

SEQ ID NO: 2339413 - protein, 31 aa, Cryptosporidium parvum; identical to SEQ ID NO: 2209986

SEQ ID NO: 2339414 - protein, 18 aa, Cryptosporidium parvum
LLFCVKFAREVILTTGNE

SEQ ID NO: 2339415 - protein, 21 aa, Cryptosporidium parvum
LLFCYIYLVAAINGTKRKRKS

SEQ ID NO: 2339416 - protein, 20 aa, Cryptosporidium parvum
LLFIAISLLFISKVKSSRII

SEQ ID NO: 2339417 - protein, 21 aa, Cryptosporidium parvum
LLFLFKLFDGTFGKSYYDILG

SEQ ID NO: 2339418 - protein, 27 aa, Cryptosporidium parvum
LLFLILSLFNIFIQFKEAYSNDPALVT

SEQ ID NO: 2339419 - protein, 19 aa, Cryptosporidium parvum
LLFMFIRNVKSFENGLLRL

SEQ ID NO: 2339420 - protein, 20 aa, Cryptosporidium parvum
LLGIFVLGLIIICFGVSECY

SEQ ID NO: 2339421 - protein, 18 aa, Cryptosporidium parvum
LLGISFDELLIDPANLEI

SEQ ID NO: 2339422 - protein, 19 aa, Cryptosporidium parvum
LLGKLPRMSALSRSITPIN

SEQ ID NO: 2339423 - protein, 20 aa, Cryptosporidium parvum
LLIKIMRYYNWVPLKSLKLE

SEQ ID NO: 2339424 - protein, 17 aa, Cryptosporidium parvum
LLKNDVLYIFYGDKNGI

SEQ ID NO: 2339425 - protein, 18 aa, Cryptosporidium parvum
LLKQSLFINTKKYPEIYG

SEQ ID NO: 2339426 - protein, 22 aa, Cryptosporidium parvum
LLLAVKFGGIYLDYVQKQYLKK

SEQ ID NO: 2339427 - protein, 18 aa, Cryptosporidium parvum
LLLFSLNALRIFEKISAR

SEQ ID NO: 2339428 - protein, 20 aa, Cryptosporidium parvum
LLLGIFLEFVERHDAIKVKE

SEQ ID NO: 2339429 - protein, 23 aa, Cryptosporidium parvum
LLLIFLIQISWLKNSLVLSQLMP

SEQ ID NO: 2339430 - protein, 24 aa, Cryptosporidium parvum
LLLLFIFFSYCMCGDMISAIIESA

SEQ ID NO: 2339431 - protein, 30 aa, Cryptosporidium parvum
LLLLFKYTYGLTFFDIFYPPDSHHITFYEG

SEQ ID NO: 2339432 - protein, 30 aa, Cryptosporidium parvum
LLLLLLLLFINFLFFFENITDNFLFKKDVS

SEQ ID NO: 2339433 - protein, 29 aa, Cryptosporidium parvum
LLLPHKRNLVKWFHIALNSLTCTDLGFFF

SEQ ID NO: 2339434 - protein, 17 aa, Cryptosporidium parvum
LLNCPPDTVLEQTTMTC

SEQ ID NO: 2339435 - protein, 20 aa, Cryptosporidium parvum
LLNLSFQLFKKLQEMDRILL

SEQ ID NO: 2339436 - protein, 19 aa, Cryptosporidium parvum
LLNLWFTYSFVSGNDLDSK

SEQ ID NO: 2339437 - protein, 17 aa, Cryptosporidium parvum
LLNNFFLTYYSRPSKMI

SEQ ID NO: 2339438 - protein, 22 aa, Cryptosporidium parvum
LLPEYIKLHYILENSIQAFKFI

SEQ ID NO: 2339439 - protein, 24 aa, Cryptosporidium parvum
LLPYLLVFFQKRVICNIFNTSSIS

SEQ ID NO: 2339440 - protein, 17 aa, Cryptosporidium parvum
LLRIPFPSSEISGSNFI

SEQ ID NO: 2339441 - protein, 26 aa, Cryptosporidium parvum
LLRLCNQTLFSLLKQDLLDISESALN

SEQ ID NO: 2339442 - protein, 27 aa, Cryptosporidium parvum
LLRSRKCPFIIALNKIDRLYGWIEQNW

SEQ ID NO: 2339443 - protein, 29 aa, Cryptosporidium parvum
LLSCILNIRLLFFIFTVANAANNSDQCIN

SEQ ID NO: 2339444 - protein, 26 aa, Cryptosporidium parvum
LLSIFFLNWFLIIKRIKGIDLNDDKE

SEQ ID NO: 2339445 - protein, 18 aa, Cryptosporidium parvum
LLSPPNFGFPYNLNSKAG

SEQ ID NO: 2339446 - protein, 19 aa, Cryptosporidium parvum
LLTFFSLSELICSQINEAD

SEQ ID NO: 2339447 - protein, 21 aa, Cryptosporidium parvum
LLTIFYFGLSASQDLSILSDP

SEQ ID NO: 2339448 - protein, 19 aa, Cryptosporidium parvum
LLTSILVKCPTSCNPENGG

SEQ ID NO: 2339449 - protein, 20 aa, Cryptosporidium parvum
LLTTLVLILFLFNYEHNEQE

SEQ ID NO: 2339450 - protein, 23 aa, Cryptosporidium parvum
LLTVLFIGLFNDSVSQFTQNLKI

SEQ ID NO: 2339451 - protein, 22 aa, Cryptosporidium parvum
LMELALLERLDLSSKYLLFFFT

SEQ ID NO: 2339452 - protein, 28 aa, Cryptosporidium parvum
LMNTSLSFSPPPAPPPPPPLPGQSPTNS

SEQ ID NO: 2339453 - protein, 18 aa, Cryptosporidium parvum
LNDRLMIASILSAKLDFL

SEQ ID NO: 2339454 - protein, 18 aa, Cryptosporidium parvum
LNEWKKEALRLTFDSSIT

SEQ ID NO: 2339455 - protein, 34 aa, Cryptosporidium parvum
LNEYLISFSMLLKRRFRKFIFKKYSPSRIRSQFA

SEQ ID NO: 2339456 - protein, 18 aa, Cryptosporidium parvum
LNGFRFTLDALRTGILVV

SEQ ID NO: 2339457 - protein, 18 aa, Cryptosporidium parvum
LNGKTCLLLTACFASTLS

SEQ ID NO: 2339458 - protein, 30 aa, Cryptosporidium parvum
LNGQLSPFLRAKILERIKLTLQAFIKVFEL

SEQ ID NO: 2339459 - protein, 28 aa, Cryptosporidium parvum
LNKTTNIWVFFHLFQEADEIRFVLPDGF

SEQ ID NO: 2339460 - protein, 35 aa, Cryptosporidium parvum; identical to SEQ ID NO: 2210022

SEQ ID NO: 2339461 - protein, 20 aa, Cryptosporidium parvum
LNLIFLGGALVLDGVFCTDD

SEQ ID NO: 2339462 - protein, 22 aa, Cryptosporidium parvum
LNLIGQFGVGFYASYLVSDRVT

SEQ ID NO: 2339463 - protein, 24 aa, Cryptosporidium parvum
LNNAYKLIRIAIPASYMISKYNKF

SEQ ID NO: 2339464 - protein, 23 aa, Cryptosporidium parvum
LNNELDVFLISRPGKHTYGTLHI

SEQ ID NO: 2339465 - protein, 18 aa, Cryptosporidium parvum
LNTVLLVEPEMLPTVAVA

SEQ ID NO: 2339466 - protein, 18 aa, Cryptosporidium parvum
LNVIRIINEPTAAAIAFG

SEQ ID NO: 2339467 - protein, 20 aa, Cryptosporidium parvum
LPEWRSWWEKEGDSKKILKQ

SEQ ID NO: 2339468 - protein, 26 aa, Cryptosporidium parvum
LPEYDQTLYTLWPSPVAELVFTEHCI

SEQ ID NO: 2339469 - protein, 20 aa, Cryptosporidium parvum
LPLLIFFSQFLGLMHDKKKN

SEQ ID NO: 2339470 - protein, 21 aa, Cryptosporidium parvum
LPPEYSCMMFLLVEQAKNIIR

SEQ ID NO: 2339471 - protein, 29 aa, Cryptosporidium parvum
LPPFPVSHKYPWSPFFNRGLNQWCVNMIN

SEQ ID NO: 2339472 - protein, 17 aa, Cryptosporidium parvum
LPPIPVGLHGELASGPV

SEQ ID NO: 2339473 - protein, 17 aa, Cryptosporidium parvum
LPTILTSLYTRLVHGCD

SEQ ID NO: 2339474 - protein, 20 aa, Cryptosporidium parvum
LPYDLRNKHYIKLPPDGWDA

SEQ ID NO: 2339475 - protein, 18 aa, Cryptosporidium parvum
LQCLISGYRIIGHAGIPC

SEQ ID NO: 2339476 - protein, 23 aa, Cryptosporidium parvum
LQILFGWFSFSNGFASVTVSTTL

SEQ ID NO: 2339477 - protein, 20 aa, Cryptosporidium parvum
LQLLKFHPRFSHYDELDDFV

SEQ ID NO: 2339478 - protein, 17 aa, Cryptosporidium parvum
LQPYMKSGPIFFINNYI

SEQ ID NO: 2339479 - protein, 17 aa, Cryptosporidium parvum
LQPYMLISNPKLSTYCN

SEQ ID NO: 2339480 - protein, 19 aa, Cryptosporidium parvum
LQSGFYRLRSRLYFLNDGV

SEQ ID NO: 2339481 - protein, 27 aa, Cryptosporidium parvum
LQSGQFYPFKILPGPYKPFNTNLLDPK

SEQ ID NO: 2339482 - protein, 19 aa, Cryptosporidium parvum
LQTRKFLLDAIARASRQPS

SEQ ID NO: 2339483 - protein, 24 aa, Cryptosporidium parvum
LQYLLGVILLIGIVHALIFDQAKV

SEQ ID NO: 2339484 - protein, 20 aa, Cryptosporidium parvum
LRAMNPHPNPSPPKGKWLTT

SEQ ID NO: 2339485 - protein, 27 aa, Cryptosporidium parvum
LRDHPSLSIFGFFRGLSTDNVRIPSSE

SEQ ID NO: 2339486 - protein, 21 aa, Cryptosporidium parvum
LRGDICVLVDIIRPNLKCEKG

SEQ ID NO: 2339487 - protein, 20 aa, Cryptosporidium parvum
LRGSLDCFLNFYTSFSQPFS

SEQ ID NO: 2339488 - protein, 19 aa, Cryptosporidium parvum
LRKLIIIVGISGILRNERT

SEQ ID NO: 2339489 - protein, 17 aa, Cryptosporidium parvum
LRKLQFLEMFSRGGLES

SEQ ID NO: 2339490 - protein, 18 aa, Cryptosporidium parvum
LRLILANKIIQSNPILYP

SEQ ID NO: 2339491 - protein, 27 aa, Cryptosporidium parvum
LRRKSFATYLSPQSSYYYPGSSNYLYT

SEQ ID NO: 2339492 - protein, 33 aa, Cryptosporidium parvum
LRSESNRLVFAYQLIDGSLIPSSALALNSKSFI

SEQ ID NO: 2339493 - protein, 23 aa, Cryptosporidium parvum
LRSHSYQILISYRALEFLQRFRF

SEQ ID NO: 2339494 - protein, 18 aa, Cryptosporidium parvum
LSELFIKMNNMEWRAKPK

SEQ ID NO: 2339495 - protein, 19 aa, Cryptosporidium parvum
LSEYSYFLNIFYKLKCEHK

SEQ ID NO: 2339496 - protein, 26 aa, Cryptosporidium parvum
LSFGKFRNIDLLQSGFYRLRSRLYFL

SEQ ID NO: 2339497 - protein, 18 aa, Cryptosporidium parvum
LSFLMRTESFIEYIILLF

SEQ ID NO: 2339498 - protein, 20 aa, Cryptosporidium parvum
LSFSPWLTVKALKGIFQSFI

SEQ ID NO: 2339499 - protein, 34 aa, Cryptosporidium parvum
LSGIYSFTPSNCESLLFSFFRRVSYSTRSSIADS

SEQ ID NO: 2339500 - protein, 22 aa, Cryptosporidium parvum
LSIFILLIKSLDNICFASNGEF

SEQ ID NO: 2339501 - protein, 20 aa, Cryptosporidium parvum
LSILVIYLNLTASYCKRNRK

SEQ ID NO: 2339502 - protein, 20 aa, Cryptosporidium parvum
LSIVSLKYGLNKLQSIGMDK

SEQ ID NO: 2339503 - protein, 25 aa, Cryptosporidium parvum
LSKQIPDVIILMNTDQYPELSQIGG

SEQ ID NO: 2339504 - protein, 19 aa, Cryptosporidium parvum
LSLGNFYPSFMSETGGLDP

SEQ ID NO: 2339505 - protein, 21 aa, Cryptosporidium parvum
LSLILVLCFLGPTYQASGETR

SEQ ID NO: 2339506 - protein, 18 aa, Cryptosporidium parvum
LSLLNSFPCPFSKVLMKT

SEQ ID NO: 2339507 - protein, 17 aa, Cryptosporidium parvum
LSMDVFAIARFYMAVDT

SEQ ID NO: 2339508 - protein, 37 aa, Cryptosporidium parvum
LSMNMILVILEKILDFLKIYRYILNKIKNITKIETRN

SEQ ID NO: 2339509 - protein, 17 aa, Cryptosporidium parvum
LSNFLIKKGWISKMDAV

SEQ ID NO: 2339510 - protein, 37 aa, Cryptosporidium parvum
LSQSLPCFKFTRREFLPLFSAFFQKKAIRNLEYYNLN

SEQ ID NO: 2339511 - protein, 27 aa, Cryptosporidium parvum
LSSFLLWLVSTSFLINLARSSLIGIDI

SEQ ID NO: 2339512 - protein, 24 aa, Cryptosporidium parvum
LSSSFFKLLNLVFATLHNYSLEDK

SEQ ID NO: 2339513 - protein, 23 aa, Cryptosporidium parvum
LSVKWFENYPKFVKVLRKVDSRI

SEQ ID NO: 2339514 - protein, 18 aa, Cryptosporidium parvum
LSWVCPTDYPGFRGGKND

SEQ ID NO: 2339515 - protein, 17 aa, Cryptosporidium parvum
LSYTPRFPNLKPTRVCF

SEQ ID NO: 2339516 - protein, 19 aa, Cryptosporidium parvum
LTCLYDLRVFSAHPYKSIV

SEQ ID NO: 2339517 - protein, 31 aa, Cryptosporidium parvum
LTDEEVFFLESLFSGFISLAYFACLNAFLFN

SEQ ID NO: 2339518 - protein, 19 aa, Cryptosporidium parvum
LTGTVISIPLPLFTEASNL

SEQ ID NO: 2339519 - protein, 17 aa, Cryptosporidium parvum
LTHIFSSFVLNFSFEKR

SEQ ID NO: 2339520 - protein, 27 aa, Cryptosporidium parvum
LTILEKLVMDLFRKYGFNAATCQALLV

SEQ ID NO: 2339521 - protein, 30 aa, Cryptosporidium parvum
LTLIGYSLALEYFFEAIYACILRVEGENGL

SEQ ID NO: 2339522 - protein, 26 aa, Cryptosporidium parvum
LTLISCFTILILFLQFNTVYSESAKS

SEQ ID NO: 2339523 - protein, 20 aa, Cryptosporidium parvum
LTLLIYTIGKPHGCEAGLLD

SEQ ID NO: 2339524 - protein, 25 aa, Cryptosporidium parvum
LTLQTVLFFLYFSIVKGGNLTELNK

SEQ ID NO: 2339525 - protein, 25 aa, Cryptosporidium parvum
LTNDFVFPKQILYKGYESCSFFEDC

SEQ ID NO: 2339526 - protein, 25 aa, Cryptosporidium parvum
LTPSSWSDFQFWPSLALDVTDRPKM

SEQ ID NO: 2339527 - protein, 23 aa, Cryptosporidium parvum
LTSYKKISLPKIDLSKIGVQELI

SEQ ID NO: 2339528 - protein, 30 aa, Cryptosporidium parvum
LTWRLHYSSLKLRLIFRFILKSMEVSNARK

SEQ ID NO: 2339529 - protein, 25 aa, Cryptosporidium parvum
LVAGDGRFFLPEAIQIISEIAAAHK

SEQ ID NO: 2339530 - protein, 23 aa, Cryptosporidium parvum
LVALFAVVQFAVSTSVIGLLEGF

SEQ ID NO: 2339531 - protein, 18 aa, Cryptosporidium parvum
LVDGVSQIVKLPNGKESK

SEQ ID NO: 2339532 - protein, 17 aa, Cryptosporidium parvum
LVDIIRPNLKCEKGFQL

SEQ ID NO: 2339533 - protein, 20 aa, Cryptosporidium parvum
LVFAFMMSINLIGSMKSKYY

SEQ ID NO: 2339534 - protein, 27 aa, Cryptosporidium parvum
LVLLLLQLILWITLIQELSIVKAADSR

SEQ ID NO: 2339535 - protein, 19 aa, Cryptosporidium parvum
LVLLPSEPYQRVMTFAIEQ

SEQ ID NO: 2339536 - protein, 17 aa, Cryptosporidium parvum
LVLMIATPSKSSIKWEK

SEQ ID NO: 2339537 - protein, 18 aa, Cryptosporidium parvum
LVSLYLKHDIEVLFLTEG

SEQ ID NO: 2339538 - protein, 30 aa, Cryptosporidium parvum
LVTMQKSLLFLTFLYLLCSIFVGSSHSEEV

SEQ ID NO: 2339539 - protein, 19 aa, Cryptosporidium parvum
LVVIFFFLVKTSKGEENEK

SEQ ID NO: 2339540 - protein, 19 aa, Cryptosporidium parvum
LVVPPGFYFNKTTSQYEPL

SEQ ID NO: 2339541 - protein, 21 aa, Cryptosporidium parvum
LWGLLIFPALFQKCHGNKYRT

SEQ ID NO: 2339542 - protein, 17 aa, Cryptosporidium parvum
LWITCDLNLNYKNFDTI

SEQ ID NO: 2339543 - protein, 24 aa, Cryptosporidium parvum
LYATRLIFPPRLRNNIVTDFVIEI

SEQ ID NO: 2339544 - protein, 27 aa, Cryptosporidium parvum
LYAYPQFPQLLTPCNHMYPMNIIIGNT

SEQ ID NO: 2339545 - protein, 30 aa, Cryptosporidium parvum
LYDNQVITNYLLQDGFLYPNTLLYEGYEKC

SEQ ID NO: 2339546 - protein, 19 aa, Cryptosporidium parvum
LYFGEMITISFIRPVLCIN

SEQ ID NO: 2339547 - protein, 39 aa, Cryptosporidium parvum
LYGLSLSNSLYLFLFDYKTNYWRFLTPDLSISISQILEN

SEQ ID NO: 2339548 - protein, 19 aa, Cryptosporidium parvum
LYISIRDFPVYWNDLLVII

SEQ ID NO: 2339549 - protein, 21 aa, Cryptosporidium parvum
LYISNFYSRMLKILNGKLKEC

SEQ ID NO: 2339550 - protein, 22 aa, Cryptosporidium parvum
LYLFFLLVFTATDAFNPIGNII

SEQ ID NO: 2339551 - protein, 28 aa, Cryptosporidium parvum
LYNYGKNYAFYPPGIKPAPIIGNYHTTP

SEQ ID NO: 2339552 - protein, 27 aa, Cryptosporidium parvum
LYPEFDMDSIFYMPLHNKLPTLSVTFD

SEQ ID NO: 2339553 - protein, 22 aa, Cryptosporidium parvum
LYPSLVSFFYKENMKRLKMYLY

SEQ ID NO: 2339554 - protein, 19 aa, Cryptosporidium parvum
LYTGFRFIASVLLKRQEIF

SEQ ID NO: 2339555 - protein, 19 aa, Cryptosporidium parvum
LYVPFSYFNSQSVAFQIVF

SEQ ID NO: 2339556 - protein, 18 aa, Cryptosporidium parvum
MAKHLYTGFRFIASVLLK

SEQ ID NO: 2339557 - protein, 20 aa, Cryptosporidium parvum
MCESCQLITFALKEYISKKL

SEQ ID NO: 2339558 - protein, 27 aa, Cryptosporidium parvum
MDGLLCLLFAVFIFTHYLNFASCFLDE

SEQ ID NO: 2339559 - protein, 19 aa, Cryptosporidium parvum
MDKLIKKEALAYSKNNLKE

SEQ ID NO: 2339560 - protein, 20 aa, Cryptosporidium parvum
MDQYYFMYYHQGRRGGKGKW

SEQ ID NO: 2339561 - protein, 19 aa, Cryptosporidium parvum
MDSPYLTSLLFLSVHENFK

SEQ ID NO: 2339562 - protein, 22 aa, Cryptosporidium parvum
MELLRQEFIFRRSLMNTINKEQ

SEQ ID NO: 2339563 - protein, 17 aa, Cryptosporidium parvum
MFVELIILFMQMKVLSR

SEQ ID NO: 2339564 - protein, 36 aa, Cryptosporidium parvum
MGNNKGLISWLFLSTVTFTVLVLSISYIGNQLSMMA

SEQ ID NO: 2339565 - protein, 18 aa, Cryptosporidium parvum
MHYHIPLELQLFHKKQFN

SEQ ID NO: 2339566 - protein, 26 aa, Cryptosporidium parvum
MIDDVPDKFFPFPVQKQGVTLLNYKD

SEQ ID NO: 2339567 - protein, 21 aa, Cryptosporidium parvum
MIDSMVSLFPRKIGRRDILTY

SEQ ID NO: 2339568 - protein, 17 aa, Cryptosporidium parvum
MIGLVLPGLEQEVENFT

SEQ ID NO: 2339569 - protein, 18 aa, Cryptosporidium parvum
MIPEELNGHYLDFLRRMV

SEQ ID NO: 2339570 - protein, 32 aa, Cryptosporidium parvum
MITKRLHYRLKDILIVLILIIEDIIRRCENVI

SEQ ID NO: 2339571 - protein, 25 aa, Cryptosporidium parvum
MKAKPSQYIGIRQLVALGSGSPLAM

SEQ ID NO: 2339572 - protein, 22 aa, Cryptosporidium parvum
MKANIIYHLCDMFTKYYSDVQE

SEQ ID NO: 2339573 - protein, 25 aa, Cryptosporidium parvum
MKDNDPVFTLLFNETYLTIKDWKGK

SEQ ID NO: 2339574 - protein, 28 aa, Cryptosporidium parvum
MKFNYDFRIIIKEKWIYITSPQGQTLVS

SEQ ID NO: 2339575 - protein, 21 aa, Cryptosporidium parvum
MLDIMLYPRLNNKTLLSEFKI

SEQ ID NO: 2339576 - protein, 19 aa, Cryptosporidium parvum
MLDRGWDFSKLYRKPIVFS

SEQ ID NO: 2339577 - protein, 18 aa, Cryptosporidium parvum
MLESIRLFGVFHDSFRNL

SEQ ID NO: 2339578 - protein, 19 aa, Cryptosporidium parvum
MLNSLQLDLIFPQISPLCT

SEQ ID NO: 2339579 - protein, 18 aa, Cryptosporidium parvum
MLTDFIPIEILNWRARKP

SEQ ID NO: 2339580 - protein, 24 aa, Cryptosporidium parvum
MNDNKKIMTLLLNETFIGVYDLTK

SEQ ID NO: 2339581 - protein, 23 aa, Cryptosporidium parvum
MNLINRIALIPVTIQPIKTIPIN

SEQ ID NO: 2339582 - protein, 23 aa, Cryptosporidium parvum
MNLYIDSALDYRLFEKLLASEMA

SEQ ID NO: 2339583 - protein, 20 aa, Cryptosporidium parvum
MPEDITFKEFWTLFVISSTG

SEQ ID NO: 2339584 - protein, 19 aa, Cryptosporidium parvum
MPSFFKMKIRRLKCLQFIL

SEQ ID NO: 2339585 - protein, 21 aa, Cryptosporidium parvum
MQDVLFFVDNIYRFTQAGSEV

SEQ ID NO: 2339586 - protein, 26 aa, Cryptosporidium parvum
MQIEKIPLVYYFPFGEDKVSKMFLYD

SEQ ID NO: 2339587 - protein, 17 aa, Cryptosporidium parvum
MQWKIVSILIPDIQSHL

SEQ ID NO: 2339588 - protein, 20 aa, Cryptosporidium parvum
MSCIFEVDLLFKHLNLRNGS

SEQ ID NO: 2339589 - protein, 23 aa, Cryptosporidium parvum
MSNSLANLFIKNGQRYLDICNDG

SEQ ID NO: 2339590 - protein, 24 aa, Cryptosporidium parvum
MSSIGFFNPLLRVFKSFYSMEKNS

SEQ ID NO: 2339591 - protein, 23 aa, Cryptosporidium parvum
MSTRQWLMNLYRIPQIQENNKNS

SEQ ID NO: 2339592 - protein, 18 aa, Cryptosporidium parvum
MVCFGWGKRYKMIVNCPE

SEQ ID NO: 2339593 - protein, 29 aa, Cryptosporidium parvum
MYVREVLDKLYFYPHFRGVKPSSSLKLKE

SEQ ID NO: 2339594 - protein, 25 aa, Cryptosporidium parvum
NAAFEFWNNSFLLHDNPDILSINCN

SEQ ID NO: 2339595 - protein, 26 aa, Cryptosporidium parvum
NAISNGYNFPLYPSQNYLYSNNYSYN

SEQ ID NO: 2339596 - protein, 20 aa, Cryptosporidium parvum
NALTVFHLTNPFDLLQGLSH

SEQ ID NO: 2339597 - protein, 23 aa, Cryptosporidium parvum
NAYDYLIPFIPSEVLDPVMKKFS

SEQ ID NO: 2339598 - protein, 18 aa, Cryptosporidium parvum
NCKTPFVTLDLDPICGSD

SEQ ID NO: 2339599 - protein, 25 aa, Cryptosporidium parvum
NCMKTTNPIMKCPVEYTLVGENMCQ

SEQ ID NO: 2339600 - protein, 26 aa, Cryptosporidium parvum
NCPGTLKNLLFWKGKDMELIRDHIVS

SEQ ID NO: 2339601 - protein, 30 aa, Cryptosporidium parvum
NCSDDYLKKLYLIFTIKILNINNFDANKSL

SEQ ID NO: 2339602 - protein, 26 aa, Cryptosporidium parvum
NCSSNFDFYFPLRPYTMVGNLIDDED

SEQ ID NO: 2339603 - protein, 25 aa, Cryptosporidium parvum
NCVNNYLFYYPMDPFWNYANNSSNP

SEQ ID NO: 2339604 - protein, 23 aa, Cryptosporidium parvum
NDASYPIIPITVSLGPYLFDIAG

SEQ ID NO: 2339605 - protein, 25 aa, Cryptosporidium parvum
NDFTNDLIFLNGCIQSMILNSMLER

SEQ ID NO: 2339606 - protein, 20 aa, Cryptosporidium parvum
NDLSFTARYYVKEGMYIKEG

SEQ ID NO: 2339607 - protein, 20 aa, Cryptosporidium parvum
NDRNINMMYISKDPIEGVPN

SEQ ID NO: 2339608 - protein, 32 aa, Cryptosporidium parvum
NDWQGWFNNSLFLLYMGFSIISTFSTTGRYLY

SEQ ID NO: 2339609 - protein, 17 aa, Cryptosporidium parvum
NEDFFNCFYSVNKYLHG

SEQ ID NO: 2339610 - protein, 22 aa, Cryptosporidium parvum
NEDQYIIYIYSNRIAIQDLNNY

SEQ ID NO: 2339611 - protein, 31 aa, Cryptosporidium parvum; identical to SEQ ID NO: 2210134

SEQ ID NO: 2339612 - protein, 24 aa, Cryptosporidium parvum
NEFWIPICLPAISTVSYVYCYIQC

SEQ ID NO: 2339613 - protein, 28 aa, Cryptosporidium parvum
NEIFTKVIQYLILRIYNIGNHEILSIIH

SEQ ID NO: 2339614 - protein, 74 aa, Cryptosporidium parvum
NEIKIPKYMTLQDIRYEICKFGMIHKSGCKIVPFSTLLSLPRHSFEIWKSFGLVLQFEFLIAMTYSIEHEMNFD

SEQ ID NO: 2339615 - protein, 24 aa, Cryptosporidium parvum
NEKFRKLLIFTSAGKPIYSYGITD

SEQ ID NO: 2339616 - protein, 19 aa, Cryptosporidium parvum
NENLYTNLLLNFISNRPLN

SEQ ID NO: 2339617 - protein, 21 aa, Cryptosporidium parvum
NEQFYSLLPKLTYIDLQNYMR

SEQ ID NO: 2339618 - protein, 25 aa, Cryptosporidium parvum
NEQKTLIRFELINKQFLYPNEILYQ

SEQ ID NO: 2339619 - protein, 22 aa, Cryptosporidium parvum
NERLTEYLPVPKTPSSITYLTF

SEQ ID NO: 2339620 - protein, 25 aa, Cryptosporidium parvum
NERSHILYMLLLRSKIGREGLASKG

SEQ ID NO: 2339621 - protein, 23 aa, Cryptosporidium parvum
NESMLYLLTLVKTFFGKIRSSNF

SEQ ID NO: 2339622 - protein, 24 aa, Cryptosporidium parvum
NETAYPIYPMDEESMFNEIQTIGL

SEQ ID NO: 2339623 - protein, 18 aa, Cryptosporidium parvum
NETKNTLYLLFDTTNKNF

SEQ ID NO: 2339624 - protein, 18 aa, Cryptosporidium parvum
NFEYLLNPLCNKYEHYYS

SEQ ID NO: 2339625 - protein, 19 aa, Cryptosporidium parvum
NFFVVLERLIEIQEPSWDV

SEQ ID NO: 2339626 - protein, 28 aa, Cryptosporidium parvum
NFGQFFNSICWRILSTYPITFKTSIGII

SEQ ID NO: 2339627 - protein, 20 aa, Cryptosporidium parvum
NFHFNNFILRYLKSGELNNE

SEQ ID NO: 2339628 - protein, 20 aa, Cryptosporidium parvum
NFLIIRAMVLSMTYLVNKFI

SEQ ID NO: 2339629 - protein, 21 aa, Cryptosporidium parvum
NFLLVLLFTVSSTSNNFVKNF

SEQ ID NO: 2339630 - protein, 26 aa, Cryptosporidium parvum
NFTELKGSFLWWSSYFDSAINENILK

SEQ ID NO: 2339631 - protein, 27 aa, Cryptosporidium parvum
NFTITPFLFSAIALNKPVFSPDSQIFE

SEQ ID NO: 2339632 - protein, 23 aa, Cryptosporidium parvum
NGEFEVFLMDKFDWNSSFTVEGQ

SEQ ID NO: 2339633 - protein, 26 aa, Cryptosporidium parvum
NGFGNMPFSYINTVKELPVGLKPQDA

SEQ ID NO: 2339634 - protein, 35 aa, Cryptosporidium parvum
NGHIDISIIYLFKNRLVLKGLILDEVCSGPYPGNQ

SEQ ID NO: 2339635 - protein, 19 aa, Cryptosporidium parvum
NGIEDVLVIYFFNNRVALQ

SEQ ID NO: 2339636 - protein, 25 aa, Cryptosporidium parvum
NGILDKIIILHKLAIEIELTKIVYL

SEQ ID NO: 2339637 - protein, 17 aa, Cryptosporidium parvum
NGIMRGCMWCTQEVMCN

SEQ ID NO: 2339638 - protein, 17 aa, Cryptosporidium parvum
NGLFYIMDSNGLAMIEY

SEQ ID NO: 2339639 - protein, 25 aa, Cryptosporidium parvum
NGMDFKIGIGWSKLGLFILNEYSSS

SEQ ID NO: 2339640 - protein, 25 aa, Cryptosporidium parvum
NGPPDRVYYYPIGFNLASLFIGPGV

SEQ ID NO: 2339641 - protein, 30 aa, Cryptosporidium parvum
NGPRSIVIPMSFPQLYIKGYSRAQKLVKKI

SEQ ID NO: 2339642 - protein, 17 aa, Cryptosporidium parvum
NGSSITIILNTKKFKYL

SEQ ID NO: 2339643 - protein, 28 aa, Cryptosporidium parvum
NGTHNTLGFLFYKKFVVLINLITHEQCS

SEQ ID NO: 2339644 - protein, 29 aa, Cryptosporidium parvum
NGTKKNAIGLLRYGFLYALINEINNQFQK

SEQ ID NO: 2339645 - protein, 25 aa, Cryptosporidium parvum
NGVLKKFIQYCRRGIRSLAYERYIS

SEQ ID NO: 2339646 - protein, 26 aa, Cryptosporidium parvum
NHKSRIWRGGRWTGVCIGLLNLGGGI

SEQ ID NO: 2339647 - protein, 22 aa, Cryptosporidium parvum
NHSIDFIPKIYLPYDSIVNAFG

SEQ ID NO: 2339648 - protein, 29 aa, Cryptosporidium parvum
NIDFDTEALLFELIKFYGSYYSSNLMTIS

SEQ ID NO: 2339649 - protein, 19 aa, Cryptosporidium parvum
NIISLYYPDVLCLLSTCNE

SEQ ID NO: 2339650 - protein, 23 aa, Cryptosporidium parvum
NIKSLLFSFFQQDKNIPKDCFLI

SEQ ID NO: 2339651 - protein, 20 aa, Cryptosporidium parvum
NILIFFAGKTLSEPLPFSSD

SEQ ID NO: 2339652 - protein, 29 aa, Cryptosporidium parvum
NILRSRKYLKLRKYYKRMKKFQSYLSHKK

SEQ ID NO: 2339653 - protein, 20 aa, Cryptosporidium parvum
NILSSFIIFGDLQIKFLVHF

SEQ ID NO: 2339654 - protein, 21 aa, Cryptosporidium parvum
NILVIATFLLTLIVEGAEFNE

SEQ ID NO: 2339655 - protein, 24 aa, Cryptosporidium parvum
NINSRLLMLWDVDKTLWDSYNFIQ

SEQ ID NO: 2339656 - protein, 21 aa, Cryptosporidium parvum
NIPSLTYYSPLLFFSKDQNSL

SEQ ID NO: 2339657 - protein, 22 aa, Cryptosporidium parvum
NISLLLKFERIIFTKRSDQAKK

SEQ ID NO: 2339658 - protein, 24 aa, Cryptosporidium parvum
NISTKLFYELLKIIKIESIKQNDQ

SEQ ID NO: 2339659 - protein, 27 aa, Cryptosporidium parvum
NIVDRLLFAIPFFFKSDVFTNPFVNPI

SEQ ID NO: 2339660 - protein, 30 aa, Cryptosporidium parvum
NIVQFRNYCFAFVWTLWKSGNEPDLRISGK

SEQ ID NO: 2339661 - protein, 21 aa, Cryptosporidium parvum
NKEIILNFEKKWPNITNLEFD

SEQ ID NO: 2339662 - protein, 22 aa, Cryptosporidium parvum
NKEKMLFFCKNEVIDYIIKSKV

SEQ ID NO: 2339663 - protein, 37 aa, Cryptosporidium parvum
NKELKSYFTPTKTKLLYLAIYEYLVVYSTLEDNLEKV

SEQ ID NO: 2339664 - protein, 23 aa, Cryptosporidium parvum
NKFIYPREMLFLGYSICSAYNDC

SEQ ID NO: 2339665 - protein, 21 aa, Cryptosporidium parvum
NKFKAIHNQIWPLLQFIYKKC

SEQ ID NO: 2339666 - protein, 20 aa, Cryptosporidium parvum
NKIISPLLYSLLQLTAGVQG

SEQ ID NO: 2339667 - protein, 18 aa, Cryptosporidium parvum
NKIPWDKELLYVCDLGLS

SEQ ID NO: 2339668 - protein, 37 aa, Cryptosporidium parvum
NKKTTTTYYLLTQPTSSFFKNKPLLLTSTEGVVLSTT

SEQ ID NO: 2339669 - protein, 19 aa, Cryptosporidium parvum
NKLNTICSMPYMGKRSQIT

SEQ ID NO: 2339670 - protein, 27 aa, Cryptosporidium parvum
NKNNDIYFIIKLLKYVYIKEKNIHKKK

SEQ ID NO: 2339671 - protein, 27 aa, Cryptosporidium parvum
NKNSNEVPFLTGIKLIDEIISPKKRAS

SEQ ID NO: 2339672 - protein, 26 aa, Cryptosporidium parvum
NKPKRAMTAFMYFASSRRAEITAANP

SEQ ID NO: 2339673 - protein, 25 aa, Cryptosporidium parvum
NKQGLRVIRFKLENFRMIDFSFSLD

SEQ ID NO: 2339674 - protein, 24 aa, Cryptosporidium parvum
NKRSPQNAIILPTPSKFSNRNPEL

SEQ ID NO: 2339675 - protein, 32 aa, Cryptosporidium parvum
NKRYAGQFLLIIFLFVFYKLAFSSEISEISES

SEQ ID NO: 2339676 - protein, 26 aa, Cryptosporidium parvum
NKSQQFLMLFLFICTFREFSGLSFSE

SEQ ID NO: 2339677 - protein, 20 aa, Cryptosporidium parvum
NKTIAFDVKWPIIANISDLI

SEQ ID NO: 2339678 - protein, 23 aa, Cryptosporidium parvum
NKTIKIFNVVPLSYKKSVLDIDY

SEQ ID NO: 2339679 - protein, 23 aa, Cryptosporidium parvum
NKTQYIPRFSSTKPLPVIPSFLL

SEQ ID NO: 2339680 - protein, 22 aa, Cryptosporidium parvum
NKVTGFVFNLKTKLIIGRSSDS

SEQ ID NO: 2339681 - protein, 38 aa, Cryptosporidium parvum
NKWMLITYKQLLLVVAFLFHLFLVLNAIPIIQINKQVS

SEQ ID NO: 2339682 - protein, 23 aa, Cryptosporidium parvum
NKYATWVPAVTGLPKRRPNSSLL

SEQ ID NO: 2339683 - protein, 24 aa, Cryptosporidium parvum
NKYKVIIVSILYQEDLKLNYLQGV

SEQ ID NO: 2339684 - protein, 21 aa, Cryptosporidium parvum
NKYRGLIYTGVPEIEFSKPDI

SEQ ID NO: 2339685 - protein, 21 aa, Cryptosporidium parvum
NKYSFIRLKNDIQVFLVSQRS

SEQ ID NO: 2339686 - protein, 30 aa, Cryptosporidium parvum
NLAKVLEAMLRLLIIYKNDFTNDLIFLNGC

SEQ ID NO: 2339687 - protein, 22 aa, Cryptosporidium parvum
NLDVLIVFYAPWCGHCRKLEPD

SEQ ID NO: 2339688 - protein, 25 aa, Cryptosporidium parvum
NLEFRYWGVCFEGYEEYFGNLIPLG

SEQ ID NO: 2339689 - protein, 25 aa, Cryptosporidium parvum
NLEIEKVQYLLPKHKKRSLIPVVDF

SEQ ID NO: 2339690 - protein, 31 aa, Cryptosporidium parvum; identical to SEQ ID NO: 2210174

SEQ ID NO: 2339691 - protein, 25 aa, Cryptosporidium parvum
NLENLALSMYFFFTVNNLIKEKGGF

SEQ ID NO: 2339692 - protein, 25 aa, Cryptosporidium parvum
NLEVPEIISVIDFLKMIYSNYNSEL

SEQ ID NO: 2339693 - protein, 19 aa, Cryptosporidium parvum
NLGYYFPIYDNSKNEFFPD

SEQ ID NO: 2339694 - protein, 18 aa, Cryptosporidium parvum
NLHVIPPEVLLPEPDYDA

SEQ ID NO: 2339695 - protein, 23 aa, Cryptosporidium parvum
NLKIMDKFLYQLQARIDLFCGRI

SEQ ID NO: 2339696 - protein, 19 aa, Cryptosporidium parvum
NLKLEIVTMIIFYSEDDLQ

SEQ ID NO: 2339697 - protein, 20 aa, Cryptosporidium parvum
NLKNAFALLILIFEGNDEDT

SEQ ID NO: 2339698 - protein, 32 aa, Cryptosporidium parvum
NLKNQICEFSKIFEFYLISISKNIGLKSVSNE

SEQ ID NO: 2339699 - protein, 20 aa, Cryptosporidium parvum
NLLGKFELSGIPPAPRGVPQ

SEQ ID NO: 2339700 - protein, 27 aa, Cryptosporidium parvum
NLLSPGFIFMVLLRDDIEHLPNNWEER

SEQ ID NO: 2339701 - protein, 27 aa, Cryptosporidium parvum
NLMEKMIFNIMMRFTENSYLQSCSDRV

SEQ ID NO: 2339702 - protein, 20 aa, Cryptosporidium parvum
NLNLDYAITWAINEDNWGYL

SEQ ID NO: 2339703 - protein, 19 aa, Cryptosporidium parvum
NLNSRFFKFFSPSGSSNSG

SEQ ID NO: 2339704 - protein, 30 aa, Cryptosporidium parvum; identical to SEQ ID NO: 2210182

SEQ ID NO: 2339705 - protein, 22 aa, Cryptosporidium parvum
NLYFNETFITLIDDLQGRQYIS

SEQ ID NO: 2339706 - protein, 23 aa, Cryptosporidium parvum
NMNKLAYDFTLEGIAKSSAKQCQ

SEQ ID NO: 2339707 - protein, 28 aa, Cryptosporidium parvum
NMNKQKLLLLSFLFKYSMNLSLADSNSD

SEQ ID NO: 2339708 - protein, 22 aa, Cryptosporidium parvum
NMNLKRFKIFSKDFPVKFSSDT

SEQ ID NO: 2339709 - protein, 20 aa, Cryptosporidium parvum
NMPIPNFVPKAVPSFIAKQI

SEQ ID NO: 2339710 - protein, 25 aa, Cryptosporidium parvum
NMQLFRSFEIKFSKVKFLNTFFHST

SEQ ID NO: 2339711 - protein, 26 aa, Cryptosporidium parvum
NMRRDSYRYFVKNPLSFPYVRSEPML

SEQ ID NO: 2339712 - protein, 18 aa, Cryptosporidium parvum
NMSLFKPILSTYDSNRKD

SEQ ID NO: 2339713 - protein, 24 aa, Cryptosporidium parvum
NNCCSVIYDLFLSKVFPHLSTNHY

SEQ ID NO: 2339714 - protein, 25 aa, Cryptosporidium parvum
NNEERKVPLFLSKSPLVVNSGGGGG

SEQ ID NO: 2339715 - protein, 27 aa, Cryptosporidium parvum
NNEKLLMHIFSRHFAFSEPFIKQGKYP

SEQ ID NO: 2339716 - protein, 18 aa, Cryptosporidium parvum
NNEYLRGLIIFISEFQVQ

SEQ ID NO: 2339717 - protein, 29 aa, Cryptosporidium parvum
NNFCKLYDDFILSAYPKEYYVSFLPEGGE

SEQ ID NO: 2339718 - protein, 26 aa, Cryptosporidium parvum
NNFNILSDDILLKNPYKYIDDSESSD

SEQ ID NO: 2339719 - protein, 23 aa, Cryptosporidium parvum
NNGEIIMVRFLCSDYITSFSIGQ

SEQ ID NO: 2339720 - protein, 19 aa, Cryptosporidium parvum
NNIVWAPTAPYPWKHHTAS

SEQ ID NO: 2339721 - protein, 23 aa, Cryptosporidium parvum
NNKFKIKLPPVIKYHDICNHVAK

SEQ ID NO: 2339722 - protein, 17 aa, Cryptosporidium parvum
NNLFVHRGFYFVDAESK

SEQ ID NO: 2339723 - protein, 24 aa, Cryptosporidium parvum
NNLIPLQFKLMIACPYAISNHCMQ

SEQ ID NO: 2339724 - protein, 22 aa, Cryptosporidium parvum
NNLNSIFPLKVGIKDLVIPFKS

SEQ ID NO: 2339725 - protein, 21 aa, Cryptosporidium parvum
NNLRELFEKFTYRYLSRVGIM

SEQ ID NO: 2339726 - protein, 24 aa, Cryptosporidium parvum
NNNCERISYIPPILSCPQNFERSG

SEQ ID NO: 2339727 - protein, 24 aa, Cryptosporidium parvum
NNPGEFIINNYKLGKNRNFSNSTV

SEQ ID NO: 2339728 - protein, 25 aa, Cryptosporidium parvum
NNQIKVYLEQRFNPIVKAIKSNKYL

SEQ ID NO: 2339729 - protein, 23 aa, Cryptosporidium parvum
NNQPLIYKFCLNSWVGDGYCDED

SEQ ID NO: 2339730 - protein, 21 aa, Cryptosporidium parvum
NNRIDSRYNFFGLRKGETIIN

SEQ ID NO: 2339731 - protein, 25 aa, Cryptosporidium parvum
NNTFAFNDVLWYFGINDTSKYTYKF

SEQ ID NO: 2339732 - protein, 27 aa, Cryptosporidium parvum
NNTNSKSLPWYDAFKNLEKIQKVKCPV

SEQ ID NO: 2339733 - protein, 24 aa, Cryptosporidium parvum
NNYDLPELHLLASSLFFEVSKHDK

SEQ ID NO: 2339734 - protein, 22 aa, Cryptosporidium parvum
NPDEIVWLFNAFPEIPTEVNNG

SEQ ID NO: 2339735 - protein, 25 aa, Cryptosporidium parvum
NPEKALEILLKKYVSFKIGINGASV

SEQ ID NO: 2339736 - protein, 27 aa, Cryptosporidium parvum
NPKIIHERLLIIFQLINSQSSTPSCKM

SEQ ID NO: 2339737 - protein, 27 aa, Cryptosporidium parvum
NPNAISGFYWILPRCAPEPIRVWCDIK

SEQ ID NO: 2339738 - protein, 23 aa, Cryptosporidium parvum
NPPFQNQIPNYPGGRYPPYERML

SEQ ID NO: 2339739 - protein, 23 aa, Cryptosporidium parvum
NPSLQLWDLRNVSYPFKEAVSAH

SEQ ID NO: 2339740 - protein, 18 aa, Cryptosporidium parvum
NPTKILPYQFSKTKSSQG

SEQ ID NO: 2339741 - protein, 27 aa, Cryptosporidium parvum
NPTQTYTTRWWKTSPIGQKLAVLLSSE

SEQ ID NO: 2339742 - protein, 20 aa, Cryptosporidium parvum
NPVQTLFDVKRLIGRRFKDD

SEQ ID NO: 2339743 - protein, 26 aa, Cryptosporidium parvum
NPYSQNAYPLIIIPVLIGIPQIDKNG

SEQ ID NO: 2339744 - protein, 25 aa, Cryptosporidium parvum
NQKSRPEIFCPEGYLLKDVKRDSSI

SEQ ID NO: 2339745 - protein, 26 aa, Cryptosporidium parvum
NQQFSIRWDGFLLAPESGRYYFSIEA

SEQ ID NO: 2339746 - protein, 22 aa, Cryptosporidium parvum
NQSFIYFGSLAKSNIRLSIPQE

SEQ ID NO: 2339747 - protein, 24 aa, Cryptosporidium parvum
NQSNYIDIIKKLFNRIIFGDVSKN

SEQ ID NO: 2339748 - protein, 19 aa, Cryptosporidium parvum
NRHKFISFILEYTQTILGS

SEQ ID NO: 2339749 - protein, 19 aa, Cryptosporidium parvum
NRIFSWVGFMILADKSPNF

SEQ ID NO: 2339750 - protein, 24 aa, Cryptosporidium parvum
NRISGFIYFTLNDQIFASFPDYPS

SEQ ID NO: 2339751 - protein, 26 aa, Cryptosporidium parvum
NRMVLFVAYVLEFWRKSRTSEKMPFK

SEQ ID NO: 2339752 - protein, 24 aa, Cryptosporidium parvum
NRNMRNIWMNAITEMVLCEKTGVR

SEQ ID NO: 2339753 - protein, 24 aa, Cryptosporidium parvum
NRNVVFTENFFLKHIPGAIKGEEE

SEQ ID NO: 2339754 - protein, 19 aa, Cryptosporidium parvum
NRRHHLINYIFQKDGASLY

SEQ ID NO: 2339755 - protein, 27 aa, Cryptosporidium parvum
NSCIASIRNIWDSFPLFGGINENNVIG

SEQ ID NO: 2339756 - protein, 22 aa, Cryptosporidium parvum
NSDNLWVPKYGLGGFIPTITPT

SEQ ID NO: 2339757 - protein, 23 aa, Cryptosporidium parvum
NSEFNAFKLIRKRLNHLIYNEHL

SEQ ID NO: 2339758 - protein, 19 aa, Cryptosporidium parvum
NSEFWLNYTALNSDSWKEI

SEQ ID NO: 2339759 - protein, 29 aa, Cryptosporidium parvum
NSEGVQFFRSFIAYLPAISRGLATSNFAF

SEQ ID NO: 2339760 - protein, 20 aa, Cryptosporidium parvum
NSFPAGLGPPLVRVQKVKGE

SEQ ID NO: 2339761 - protein, 24 aa, Cryptosporidium parvum
NSGKIIIYPVIPIPTFEFNGEKSV

SEQ ID NO: 2339762 - protein, 18 aa, Cryptosporidium parvum
NSIRYQTLSILLNYFLSG

SEQ ID NO: 2339763 - protein, 33 aa, Cryptosporidium parvum
NSKLSTLIKMIHKLISYAYPGILIERIRHLETQ

SEQ ID NO: 2339764 - protein, 26 aa, Cryptosporidium parvum
NSKQKNSLFWFLQKNNYITNSNSVYE

SEQ ID NO: 2339765 - protein, 33 aa, Cryptosporidium parvum
NSKYIELNKYKHRYRMIISLFKEFVDHSNKFGF

SEQ ID NO: 2339766 - protein, 31 aa, Cryptosporidium parvum; identical to SEQ ID NO: 2210219

SEQ ID NO: 2339767 - protein, 25 aa, Cryptosporidium parvum
NSRFKPLKIVKFYQILRNFMKNEIK

SEQ ID NO: 2339768 - protein, 25 aa, Cryptosporidium parvum
NSRGERVTLFWKENTWICVNTLSNS

SEQ ID NO: 2339769 - protein, 31 aa, Cryptosporidium parvum
NSRSSIVLDKLRQKFPNCALSCEESWIGDGW

SEQ ID NO: 2339770 - protein, 45 aa, Cryptosporidium parvum
NSSYSFVLQLAKYNPQLYLILFRDLKHIFGFGNPKIFSLNTCPVP

SEQ ID NO: 2339771 - protein, 25 aa, Cryptosporidium parvum
NSVNMNMLKWDYSLQGYAQNWATVC

SEQ ID NO: 2339772 - protein, 22 aa, Cryptosporidium parvum
NSYDIHFALSSYLLGVNYTNFR

SEQ ID NO: 2339773 - protein, 23 aa, Cryptosporidium parvum
NTAQTIFWDSSACIFELDTGRPI

SEQ ID NO: 2339774 - protein, 23 aa, Cryptosporidium parvum
NTDEPIWMRIRSFDWANPQHVYG

SEQ ID NO: 2339775 - protein, 28 aa, Cryptosporidium parvum
NTEHGYIPILERIYYLNSTVALPMSRVS

SEQ ID NO: 2339776 - protein, 22 aa, Cryptosporidium parvum
NTEMKTICSMSLIGGIHSLDYI

SEQ ID NO: 2339777 - protein, 34 aa, Cryptosporidium parvum
NTGALLGFGAYFTKKLYVLPFIQGGVQTHFSDLQ

SEQ ID NO: 2339778 - protein, 28 aa, Cryptosporidium parvum
NTGETIYSYCEFLYLQCLISGYRIIGHA

SEQ ID NO: 2339779 - protein, 20 aa, Cryptosporidium parvum
NTIGGYKCGCYKGFRLNLTG

SEQ ID NO: 2339780 - protein, 22 aa, Cryptosporidium parvum
NTKTQWDFILSAIKSYPNIKCK

SEQ ID NO: 2339781 - protein, 22 aa, Cryptosporidium parvum
NTKYSFLIPFNKVLQIRHKVVL

SEQ ID NO: 2339782 - protein, 19 aa, Cryptosporidium parvum
NTLYLLFDTTNKNFVSIFV

SEQ ID NO: 2339783 - protein, 30 aa, Cryptosporidium parvum
NTNFNQWNLLILLLHLQLLIVSVRSNGDDE

SEQ ID NO: 2339784 - protein, 25 aa, Cryptosporidium parvum
NTNGSQFFITFTPTPHLDGRHVVFG

SEQ ID NO: 2339785 - protein, 19 aa, Cryptosporidium parvum
NTNPKKILAIFLYDADTFN

SEQ ID NO: 2339786 - protein, 22 aa, Cryptosporidium parvum
NTNSLILSITYSDSLVSLTNEQ

SEQ ID NO: 2339787 - protein, 29 aa, Cryptosporidium parvum
NTPQYSSEKFLFVCFELIGSLLSQSKVKI

SEQ ID NO: 2339788 - protein, 17 aa, Cryptosporidium parvum
NTYFSYWSEIHQRFIPN

SEQ ID NO: 2339789 - protein, 29 aa, Cryptosporidium parvum
NTYFTVIFPIPHQSPLWKYKPAEYISFFF

SEQ ID NO: 2339790 - protein, 31 aa, Cryptosporidium parvum
NTYLPIMFRGLLHVSALFKYSKKYKNSSSTL

SEQ ID NO: 2339791 - protein, 27 aa, Cryptosporidium parvum
NVDILDPRKFYLGCIGILKVLEAKRVI

SEQ ID NO: 2339792 - protein, 28 aa, Cryptosporidium parvum
NVEYNKGMLIIPLIDLALCIKGALQLNN

SEQ ID NO: 2339793 - protein, 24 aa, Cryptosporidium parvum
NVFLILFFQAFLVVLASTEFESFK

SEQ ID NO: 2339794 - protein, 24 aa, Cryptosporidium parvum
NVGDLIKWSIGIDSLMNLYLNILD

SEQ ID NO: 2339795 - protein, 32 aa, Cryptosporidium parvum
NVIAKKMISFLSKYRLLLKRSFDLYKKMSKSK

SEQ ID NO: 2339796 - protein, 17 aa, Cryptosporidium parvum
NVLALYDLCNQIMEAIM

SEQ ID NO: 2339797 - protein, 18 aa, Cryptosporidium parvum
NVNLQFLHWGECSKSICN

SEQ ID NO: 2339798 - protein, 25 aa, Cryptosporidium parvum
NVNPTGLITVLFFAVVTYDNVLPEF

SEQ ID NO: 2339799 - protein, 21 aa, Cryptosporidium parvum
NVPAPIGVPRNRLGLRNTEGS

SEQ ID NO: 2339800 - protein, 25 aa, Cryptosporidium parvum
NVQNIIRAFFLSINKIKDLKLDINI

SEQ ID NO: 2339801 - protein, 23 aa, Cryptosporidium parvum
NVRIQFLEKRPLSQNKYRGLIYT

SEQ ID NO: 2339802 - protein, 19 aa, Cryptosporidium parvum
NWLWGPLRNQDGTPLLPLS

SEQ ID NO: 2339803 - protein, 29 aa, Cryptosporidium parvum
NYEFKYVQYFESFSFLKIKASAPTSGFCE

SEQ ID NO: 2339804 - protein, 19 aa, Cryptosporidium parvum
NYELGYIKRDYYKLVKAVR

SEQ ID NO: 2339805 - protein, 22 aa, Cryptosporidium parvum
NYLLLLIAILNIKQTEKLTLIN

SEQ ID NO: 2339806 - protein, 31 aa, Cryptosporidium parvum
NYLVTKLMYMEKFRFLYIISEPSLDGKEIDI

SEQ ID NO: 2339807 - protein, 28 aa, Cryptosporidium parvum
NYRLNKFCQLLFKQLRNTLLFSNHLDPN

SEQ ID NO: 2339808 - protein, 24 aa, Cryptosporidium parvum
NYRMPCEGIFTAVPRYHGKKSYWV

SEQ ID NO: 2339809 - protein, 25 aa, Cryptosporidium parvum
PACNGLMIVLLDHAEFVHSYFTSLV

SEQ ID NO: 2339810 - protein, 22 aa, Cryptosporidium parvum
PAKTLFGWREVLFDQAMESIGK

SEQ ID NO: 2339811 - protein, 25 aa, Cryptosporidium parvum
PARKLLRELFLHRKHKQRLFFTNTM

SEQ ID NO: 2339812 - protein, 24 aa, Cryptosporidium parvum
PATRFENIIFHYISIIFPNSEEKD

SEQ ID NO: 2339813 - protein, 26 aa, Cryptosporidium parvum
PCDGSIVWLSERWLQYGKSSGLNASQ

SEQ ID NO: 2339814 - protein, 24 aa, Cryptosporidium parvum
PCPYQRYFIQTDRVLKRIAKVEAK

SEQ ID NO: 2339815 - protein, 18 aa, Cryptosporidium parvum
PCTSYYHLKYGRKLPPKS

SEQ ID NO: 2339816 - protein, 24 aa, Cryptosporidium parvum
PDDIELRIVTLRNFYLSATRNPVL

SEQ ID NO: 2339817 - protein, 27 aa, Cryptosporidium parvum
PDFNEKLLIKYPWLRDRVGEAIYSDDG

SEQ ID NO: 2339818 - protein, 18 aa, Cryptosporidium parvum
PDQFTDLFREKYRYILNY

SEQ ID NO: 2339819 - protein, 19 aa, Cryptosporidium parvum
PDRTVAIGSFSRIKYKKFY

SEQ ID NO: 2339820 - protein, 20 aa, Cryptosporidium parvum
PEAFIFHIFNIGNLLEHYMD

SEQ ID NO: 2339821 - protein, 45 aa, Cryptosporidium parvum
PEAYITMEFPIPNQSKLWKYKLGSYVKYFLTQRFHDGFLDKMTNL

SEQ ID NO: 2339822 - protein, 30 aa, Cryptosporidium parvum
PECIKTISVPYILKCESPFILDGDKCIEKT

SEQ ID NO: 2339823 - protein, 28 aa, Cryptosporidium parvum
PEDKYGVSYPFFPPGIKPAPIDGDENNT

SEQ ID NO: 2339824 - protein, 24 aa, Cryptosporidium parvum
PEEKRRALYNLVLKQMGRKQMKER

SEQ ID NO: 2339825 - protein, 24 aa, Cryptosporidium parvum
PEEMKSPIPIIPVEEEVKPNNSVD

SEQ ID NO: 2339826 - protein, 24 aa, Cryptosporidium parvum
PEGKYWEYLPRNKFSILINADNSK

SEQ ID NO: 2339827 - protein, 20 aa, Cryptosporidium parvum
PEIKILYSKLKKILLKLLQC

SEQ ID NO: 2339828 - protein, 24 aa, Cryptosporidium parvum
PEKLGFLKPMEFYRYAVLLSMSLI

SEQ ID NO: 2339829 - protein, 20 aa, Cryptosporidium parvum
PELIKLVRKNIESNLLLSFE

SEQ ID NO: 2339830 - protein, 30 aa, Cryptosporidium parvum
PELSPKMTIPLIYRVFLPSDILPGKNVVGS

SEQ ID NO: 2339831 - protein, 25 aa, Cryptosporidium parvum
PENVFRPFEYNITKLYSLISEKMKN

SEQ ID NO: 2339832 - protein, 19 aa, Cryptosporidium parvum
PESFIFTQYLKLIIENRLN

SEQ ID NO: 2339833 - protein, 26 aa, Cryptosporidium parvum
PFFLKAIIAFGFILQLSFCQLASLNY

SEQ ID NO: 2339834 - protein, 24 aa, Cryptosporidium parvum
PFGQRPLPHPLPSSGSYSNGEPKK

SEQ ID NO: 2339835 - protein, 17 aa, Cryptosporidium parvum
PFKTTIGPILFAGKPEG

SEQ ID NO: 2339836 - protein, 27 aa, Cryptosporidium parvum
PFNLNEKFWYGYFFTNKDKAVLSILFN

SEQ ID NO: 2339837 - protein, 17 aa, Cryptosporidium parvum
PFTIIDVAPFVNANANI

SEQ ID NO: 2339838 - protein, 22 aa, Cryptosporidium parvum
PGGVSISYGEKFIWSFGVNENS

SEQ ID NO: 2339839 - protein, 20 aa, Cryptosporidium parvum
PGLAHLLKQSLFINTKKYPE

SEQ ID NO: 2339840 - protein, 24 aa, Cryptosporidium parvum
PGLVNGVGNWRILYEPIGGGGRSG

SEQ ID NO: 2339841 - protein, 26 aa, Cryptosporidium parvum
PGRGILMVHKGHRLIPLIIPSDSEFC

SEQ ID NO: 2339842 - protein, 32 aa, Cryptosporidium parvum
PGYQKPKKLVLPAIPYFRRPAIPKSRINYSNV

SEQ ID NO: 2339843 - protein, 24 aa, Cryptosporidium parvum
PIAYSTFYFPINVGVPKISLSSRI

SEQ ID NO: 2339844 - protein, 18 aa, Cryptosporidium parvum
PIDKLKQIINWDGPVKFT

SEQ ID NO: 2339845 - protein, 19 aa, Cryptosporidium parvum
PIFFELKAPYTTLESIRNG

SEQ ID NO: 2339846 - protein, 23 aa, Cryptosporidium parvum
PIFLLFVIFCDFTERSFLSKISL

SEQ ID NO: 2339847 - protein, 20 aa, Cryptosporidium parvum
PIFRRNSRWSIVKPVPEIGN

SEQ ID NO: 2339848 - protein, 19 aa, Cryptosporidium parvum
PIGFNLASLFIGPGVGNFL

SEQ ID NO: 2339849 - protein, 17 aa, Cryptosporidium parvum
PIGIFIAILLVNSFGPS

SEQ ID NO: 2339850 - protein, 18 aa, Cryptosporidium parvum
PIIKGYKYSKCGNSIVLF

SEQ ID NO: 2339851 - protein, 19 aa, Cryptosporidium parvum
PILSFLLADFGVYIPLSSI

SEQ ID NO: 2339852 - protein, 18 aa, Cryptosporidium parvum
PIPCIEFRFLSIPEMDYD

SEQ ID NO: 2339853 - protein, 18 aa, Cryptosporidium parvum
PIPPKPEYQPPPPPIPTL

SEQ ID NO: 2339854 - protein, 44 aa, Cryptosporidium parvum
PIPTPPSFSPPPPPVPAPPLFPPPSPPMPGYPLPSSPIPTPPSS

SEQ ID NO: 2339855 - protein, 19 aa, Cryptosporidium parvum
PIQAIPPKGYLPIQPQHPS

SEQ ID NO: 2339856 - protein, 21 aa, Cryptosporidium parvum
PISKILPLHGSRRQIYHFLFS

SEQ ID NO: 2339857 - protein, 21 aa, Cryptosporidium parvum
PISPISLYDAIIGKTDYVIKI

SEQ ID NO: 2339858 - protein, 19 aa, Cryptosporidium parvum
PKCLIVANGDFSGSSPLLI

SEQ ID NO: 2339859 - protein, 26 aa, Cryptosporidium parvum
PKDNPDLKLLWRYISPHLIEIDIGGS

SEQ ID NO: 2339860 - protein, 24 aa, Cryptosporidium parvum
PKDPNSFPFVVLGNKLDLDQKSRK

SEQ ID NO: 2339861 - protein, 19 aa, Cryptosporidium parvum
PKKEFPIPLYYAVKEFKQA

SEQ ID NO: 2339862 - protein, 19 aa, Cryptosporidium parvum
PKKRSFFHIHYYDITNTAK

SEQ ID NO: 2339863 - protein, 18 aa, Cryptosporidium parvum
PKNILFRGYETCTLYGDC

SEQ ID NO: 2339864 - protein, 29 aa, Cryptosporidium parvum
PKPEYQPPPPPIPTLSPSPPAPPMPAFPS

SEQ ID NO: 2339865 - protein, 36 aa, Cryptosporidium parvum; identical to SEQ ID NO: 2210274

SEQ ID NO: 2339866 - protein, 20 aa, Cryptosporidium parvum
PLAYTTLKPMKGMLSTESRL

SEQ ID NO: 2339867 - protein, 23 aa, Cryptosporidium parvum
PLDRPKQCFIQVKRLLLGENNFH

SEQ ID NO: 2339868 - protein, 18 aa, Cryptosporidium parvum
PLGSIRISFGYLSTFKDV

SEQ ID NO: 2339869 - protein, 18 aa, Cryptosporidium parvum
PLNFTLKQDFMYPNEILF

SEQ ID NO: 2339870 - protein, 25 aa, Cryptosporidium parvum
PLNPHRTPFYDYYLSSVGQSSYRKD

SEQ ID NO: 2339871 - protein, 24 aa, Cryptosporidium parvum
PLRFNNIFIIQQNDIWTTLKDILG

SEQ ID NO: 2339872 - protein, 21 aa, Cryptosporidium parvum
PLTRRGLEYLLKKRKARANKN

SEQ ID NO: 2339873 - protein, 17 aa, Cryptosporidium parvum
PMNFAIFICSSSLRWEK

SEQ ID NO: 2339874 - protein, 21 aa, Cryptosporidium parvum
PMNTYYYFQHYYTIVTDIYQP

SEQ ID NO: 2339875 - protein, 26 aa, Cryptosporidium parvum
PMTRRPIIHPFTRKIYDLSKRYGILE

SEQ ID NO: 2339876 - protein, 28 aa, Cryptosporidium parvum
PNARYKSRKLNPYLNAGLENLFEIGLNP

SEQ ID NO: 2339877 - protein, 21 aa, Cryptosporidium parvum
PNCDWSISTLKILDKLFGNET

SEQ ID NO: 2339878 - protein, 25 aa, Cryptosporidium parvum
PNEKIRYFCWYTAKSAYPNDSSFEA

SEQ ID NO: 2339879 - protein, 24 aa, Cryptosporidium parvum
PNGANFIPLVLDANTGQYGVELKT

SEQ ID NO: 2339880 - protein, 30 aa, Cryptosporidium parvum
PNGNLIHIGSKLIWKIGFDSYYSIYLNVYD

SEQ ID NO: 2339881 - protein, 25 aa, Cryptosporidium parvum
PNIECPAYMNLTFASTGSPICIGSR

SEQ ID NO: 2339882 - protein, 26 aa, Cryptosporidium parvum
PNLVTSYYYPYFDKSINEFNPLYNYG

SEQ ID NO: 2339883 - protein, 26 aa, Cryptosporidium parvum
PNNSALPYNFRLFHFCQKTCQVCNKE

SEQ ID NO: 2339884 - protein, 18 aa, Cryptosporidium parvum
PNTLLYEGYEKCSLYNNC

SEQ ID NO: 2339885 - protein, 23 aa, Cryptosporidium parvum
PPGIPITAVRMWFVRKIEGNNVF

SEQ ID NO: 2339886 - protein, 20 aa, Cryptosporidium parvum
PPGYTLCSSIDYYFGNHIST

SEQ ID NO: 2339887 - protein, 35 aa, Cryptosporidium parvum
PPPPPPPPPPPPPPPPPPSPPPSPPPSPFYAVVSD

SEQ ID NO: 2339888 - protein, 26 aa, Cryptosporidium parvum
PPPPPPPPPPPPPPPPPSYTSPSNGI

SEQ ID NO: 2339889 - protein, 26 aa, Cryptosporidium parvum
PPPPPPPPPPPPPPPTYPAPTLPSTF

SEQ ID NO: 2339890 - protein, 18 aa, Cryptosporidium parvum
PPQKPMKKPLPIPKDFPK

SEQ ID NO: 2339891 - protein, 25 aa, Cryptosporidium parvum
PPSSSPPPPPPPPPPPPSGCSCGNE

SEQ ID NO: 2339892 - protein, 21 aa, Cryptosporidium parvum
PPVFHHENILWMNFKLPTQNC

SEQ ID NO: 2339893 - protein, 26 aa, Cryptosporidium parvum
PPVFQRYLYSYPKDYGYYFFNRISDS

SEQ ID NO: 2339894 - protein, 20 aa, Cryptosporidium parvum
PPYERMLPPQTQSQSIRPPP

SEQ ID NO: 2339895 - protein, 22 aa, Cryptosporidium parvum
PQAPLIYRCRFSGPDLLKNSNL

SEQ ID NO: 2339896 - protein, 25 aa, Cryptosporidium parvum
PQASYSFLSIFYTIVEALKVQFPKE

SEQ ID NO: 2339897 - protein, 26 aa, Cryptosporidium parvum
PQCGPFCSTYTNGFFTFWVTYSKIKS

SEQ ID NO: 2339898 - protein, 33 aa, Cryptosporidium parvum
PQCGPYCSTYPKGFFTFWLTYNNDSKKYLISVN

SEQ ID NO: 2339899 - protein, 18 aa, Cryptosporidium parvum
PQEKKMWIHKANAFIERS

SEQ ID NO: 2339900 - protein, 30 aa, Cryptosporidium parvum
PQGTCLKIELILPKPICPEGLRPSITVMDG

SEQ ID NO: 2339901 - protein, 17 aa, Cryptosporidium parvum
PQMMRPSSSLPSTGNGM

SEQ ID NO: 2339902 - protein, 19 aa, Cryptosporidium parvum
PQPVVLNPILYTISSIFQS

SEQ ID NO: 2339903 - protein, 19 aa, Cryptosporidium parvum
PQRDLPISKPTPLYKAVRA

SEQ ID NO: 2339904 - protein, 17 aa, Cryptosporidium parvum
PQSFPHIGGYNADLKTL

SEQ ID NO: 2339905 - protein, 25 aa, Cryptosporidium parvum
PQSLLFLSVLMGPKWEKELKRYTQL

SEQ ID NO: 2339906 - protein, 20 aa, Cryptosporidium parvum
PQSYIPNLGGLNLFQRMVLH

SEQ ID NO: 2339907 - protein, 23 aa, Cryptosporidium parvum
PRESLVAFQQWKAIILQMTIDES

SEQ ID NO: 2339908 - protein, 18 aa, Cryptosporidium parvum
PRVLDIICKPYESLIGIR

SEQ ID NO: 2339909 - protein, 20 aa, Cryptosporidium parvum
PSFNHYLFELLGVCIRNSSD

SEQ ID NO: 2339910 - protein, 17 aa, Cryptosporidium parvum
PSGLFRDTNECLALQQY

SEQ ID NO: 2339911 - protein, 19 aa, Cryptosporidium parvum
PSIIPFNRVLERKSIYFDS

SEQ ID NO: 2339912 - protein, 22 aa, Cryptosporidium parvum
PSIRYMYGPAKFDSVEPLKEFM

SEQ ID NO: 2339913 - protein, 21 aa, Cryptosporidium parvum
PSKTYVLWNLLDISNPPKQSA

SEQ ID NO: 2339914 - protein, 19 aa, Cryptosporidium parvum
PSPPPSPPPYTPLSNRIPS

SEQ ID NO: 2339915 - protein, 17 aa, Cryptosporidium parvum
PSSPLYIKGKKFGIKNL

SEQ ID NO: 2339916 - protein, 37 aa, Cryptosporidium parvum
PSSPPSPTLPKLPPLPPLPPLPPTPKAPTIPPPTLPP

SEQ ID NO: 2339917 - protein, 26 aa, Cryptosporidium parvum
PSYKDRLLSFFGSNGGSMFGLGKSST

SEQ ID NO: 2339918 - protein, 22 aa, Cryptosporidium parvum
PTIPNELTLFQGFLKTSKSGQE

SEQ ID NO: 2339919 - protein, 18 aa, Cryptosporidium parvum
PTLEKKESILKCIDFVNQ

SEQ ID NO: 2339920 - protein, 26 aa, Cryptosporidium parvum
PTLIQSLNFIIQLKNKIFLNSEFSKC

SEQ ID NO: 2339921 - protein, 21 aa, Cryptosporidium parvum
PTLPTLPPTPPSPSSPPSPTL

SEQ ID NO: 2339922 - protein, 23 aa, Cryptosporidium parvum
PTMAWQFKLWYNRGNCSRVKGND

SEQ ID NO: 2339923 - protein, 34 aa, Cryptosporidium parvum
PTMDKYVNYILLDNFLYPNGILYLGYDTCTFNGE

SEQ ID NO: 2339924 - protein, 24 aa, Cryptosporidium parvum
PTPMPMPMPMPTPTPIQIPIRPLQ

SEQ ID NO: 2339925 - protein, 28 aa, Cryptosporidium parvum
PTRDKFFGINFPFGARLMRFRIDRKTAG

SEQ ID NO: 2339926 - protein, 18 aa, Cryptosporidium parvum
PVAAFIRPRLVVDEALLQ

SEQ ID NO: 2339927 - protein, 19 aa, Cryptosporidium parvum
PVEEIINATFIYPGTQQPD

SEQ ID NO: 2339928 - protein, 21 aa, Cryptosporidium parvum
PVNHRVATIMLYLSSPPPDGR

SEQ ID NO: 2339929 - protein, 17 aa, Cryptosporidium parvum
PVVDFRVYLGDLGLPHL

SEQ ID NO: 2339930 - protein, 19 aa, Cryptosporidium parvum
PVYVFIHGGLYLFGSSNSE

SEQ ID NO: 2339931 - protein, 27 aa, Cryptosporidium parvum
PYCSTYPKGYFAFWLTYDEDNDLYEIS

SEQ ID NO: 2339932 - protein, 29 aa, Cryptosporidium parvum
PYCSTYPKGYFAFWLTYDPEIHVYTVSVD

SEQ ID NO: 2339933 - protein, 30 aa, Cryptosporidium parvum
PYCSTYPKGYFAFWLTYDSVTSKYIISVEN

SEQ ID NO: 2339934 - protein, 29 aa, Cryptosporidium parvum
PYCSTYPNGFFTFWLSYDYSSNNYIISVS

SEQ ID NO: 2339935 - protein, 19 aa, Cryptosporidium parvum
PYDFQDPLGPLFVPGKHCS

SEQ ID NO: 2339936 - protein, 27 aa, Cryptosporidium parvum
PYEDIGLLDFRILDPLTAPAKPPSFLP

SEQ ID NO: 2339937 - protein, 20 aa, Cryptosporidium parvum
PYFNHFCSLSFIKNLKLIRK

SEQ ID NO: 2339938 - protein, 24 aa, Cryptosporidium parvum
PYLEIPEVFLFPEDARLKENCITS

SEQ ID NO: 2339939 - protein, 19 aa, Cryptosporidium parvum
PYQYQYPYSYTYSYQYPYT

SEQ ID NO: 2339940 - protein, 18 aa, Cryptosporidium parvum
PYTYSYQYPYAGVPGYPY

SEQ ID NO: 2339941 - protein, 17 aa, Cryptosporidium parvum
QADFFVESLYKDVDISQ

SEQ ID NO: 2339942 - protein, 26 aa, Cryptosporidium parvum
QCAALEFAPFILSCPSGYTQSEGKCV

SEQ ID NO: 2339943 - protein, 20 aa, Cryptosporidium parvum
QCSKTEILVLQKITSLLTQN

SEQ ID NO: 2339944 - protein, 26 aa, Cryptosporidium parvum
QDLVIVRRMISLFNTYFENVKLRSDY

SEQ ID NO: 2339945 - protein, 23 aa, Cryptosporidium parvum
QDNLSSWVLPSGTLLPGGFSNRV

SEQ ID NO: 2339946 - protein, 23 aa, Cryptosporidium parvum
QDPYFRMVRDVAPRLGYLKPSSI

SEQ ID NO: 2339947 - protein, 29 aa, Cryptosporidium parvum
QDYLSDCTLPIWKNILKFATHYIGGLFGS

SEQ ID NO: 2339948 - protein, 26 aa, Cryptosporidium parvum
QEDYMVISFIIFLSKRLDLATKTFEI

SEQ ID NO: 2339949 - protein, 26 aa, Cryptosporidium parvum
QEEERIRLLRLKEGITYILDTKEDFK

SEQ ID NO: 2339950 - protein, 26 aa, Cryptosporidium parvum
QELNKFKYPWLHIPNLKNFKENIKSL

SEQ ID NO: 2339951 - protein, 20 aa, Cryptosporidium parvum
QEMDRILLKITGRGDKFAAI

SEQ ID NO: 2339952 - protein, 25 aa, Cryptosporidium parvum
QENTWYAPMVFYKRYKHLSQVYKKC

SEQ ID NO: 2339953 - protein, 18 aa, Cryptosporidium parvum
QFKHSAIPITKKKLCWYF

SEQ ID NO: 2339954 - protein, 19 aa, Cryptosporidium parvum
QFPVISPFESLSLVWLSIY

SEQ ID NO: 2339955 - protein, 25 aa, Cryptosporidium parvum
QFQKKIDFKLKLHPKLLIDPLKYDE

SEQ ID NO: 2339956 - protein, 20 aa, Cryptosporidium parvum
QFSEFIDYEGLCEKKIRRYI

SEQ ID NO: 2339957 - protein, 18 aa, Cryptosporidium parvum
QFYNKYFTLVTPLISRDE

SEQ ID NO: 2339958 - protein, 19 aa, Cryptosporidium parvum
QGRFISDFYFFESNGQGLS

SEQ ID NO: 2339959 - protein, 23 aa, Cryptosporidium parvum
QGRLKTIINVVSIPKPKAILPNG

SEQ ID NO: 2339960 - protein, 22 aa, Cryptosporidium parvum
QGVRIIFTDGSRIIFRISGTGS

SEQ ID NO: 2339961 - protein, 31 aa, Cryptosporidium parvum
QIASLNRFFEINGVPPLTYLSPANETLLPNN

SEQ ID NO: 2339962 - protein, 27 aa, Cryptosporidium parvum
QIDHPMFRNFVIPTPRYYKAPEMSQYN

SEQ ID NO: 2339963 - protein, 19 aa, Cryptosporidium parvum
QIELIILVGFVVKTFKSIW

SEQ ID NO: 2339964 - protein, 25 aa, Cryptosporidium parvum
QIFETWNRLVSILPFVLHKLEQTCK

SEQ ID NO: 2339965 - protein, 19 aa, Cryptosporidium parvum
QIFGKLVTLPFINSPIESI

SEQ ID NO: 2339966 - protein, 17 aa, Cryptosporidium parvum
QIFIIYPTVKAWDHLHN

SEQ ID NO: 2339967 - protein, 23 aa, Cryptosporidium parvum
QIIDKYFNYKLMPKYVIINNIET

SEQ ID NO: 2339968 - protein, 19 aa, Cryptosporidium parvum
QIIGLEYFTDSLELFITGI

SEQ ID NO: 2339969 - protein, 19 aa, Cryptosporidium parvum
QIPIRPLQTPPQSPPPPPP

SEQ ID NO: 2339970 - protein, 33 aa, Cryptosporidium parvum
QIPYNLISLCKYELSNLLTLIKKLNLKARQLGV

SEQ ID NO: 2339971 - protein, 18 aa, Cryptosporidium parvum
QIVLRKLDPVKADALGVP

SEQ ID NO: 2339972 - protein, 33 aa, Cryptosporidium parvum
QIVNPEWRFFTNVLELLLFQPGRAMGTPWPEKG

SEQ ID NO: 2339973 - protein, 30 aa, Cryptosporidium parvum
QKGGSEKEWIMSFAPKLRPGRMQRRRDLFS

SEQ ID NO: 2339974 - protein, 25 aa, Cryptosporidium parvum
QKNLLLSDILRKCPPNKIGLGPFKG

SEQ ID NO: 2339975 - protein, 23 aa, Cryptosporidium parvum
QKPLKRRAPPPPAHPSYSVKTEA

SEQ ID NO: 2339976 - protein, 18 aa, Cryptosporidium parvum
QKYRIRVEMFHSSHLRYK

SEQ ID NO: 2339977 - protein, 26 aa, Cryptosporidium parvum
QLCKDPEIMKLWYSGPLISTDTSLSL

SEQ ID NO: 2339978 - protein, 18 aa, Cryptosporidium parvum
QLDLIFPQISPLCTKITK

SEQ ID NO: 2339979 - protein, 21 aa, Cryptosporidium parvum
QLEFSIPLFEDEWRAIIDFMS

SEQ ID NO: 2339980 - protein, 25 aa, Cryptosporidium parvum
QLISKRPYLPQGIVPSPISTTTTTT

SEQ ID NO: 2339981 - protein, 28 aa, Cryptosporidium parvum
QLKNLRIDWEFPPFTYSIAAKVDGEMKQ

SEQ ID NO: 2339982 - protein, 28 aa, Cryptosporidium parvum
QLKRDINMNYIRFVKLPEYDQTLYTLWP

SEQ ID NO: 2339983 - protein, 47 aa, Cryptosporidium parvum
QLLSQKPRMRWPLSGARYHPYISNILGFQKVWIYRVSELLSACAQHT

SEQ ID NO: 2339984 - protein, 19 aa, Cryptosporidium parvum
QLMTINEIIKCRGGKNWIT

SEQ ID NO: 2339985 - protein, 23 aa, Cryptosporidium parvum
QLRNPYSAPLFSPSDILEARETH

SEQ ID NO: 2339986 - protein, 30 aa, Cryptosporidium parvum
QLSYTDFLIWLIAQPPKVIKFLFIIHASRS

SEQ ID NO: 2339987 - protein, 17 aa, Cryptosporidium parvum
QLTWTSRVMFGYSLDLS

SEQ ID NO: 2339988 - protein, 29 aa, Cryptosporidium parvum
QMDPNHGFVPLFTKLYLYNDTAALPASRT

SEQ ID NO: 2339989 - protein, 31 aa, Cryptosporidium parvum
QMFERLNYWSTIHLYFLSFTMGIPNSSEILS

SEQ ID NO: 2339990 - protein, 28 aa, Cryptosporidium parvum
QMFYRDNVFFNFLLVKHFSFGENDKILK

SEQ ID NO: 2339991 - protein, 22 aa, Cryptosporidium parvum
QMIHLNRYLLLSNELGLSLFIN

SEQ ID NO: 2339992 - protein, 35 aa, Cryptosporidium parvum; identical to SEQ ID NO: 2210359

SEQ ID NO: 2339993 - protein, 21 aa, Cryptosporidium parvum
QNELMQYYHSGSTNKYIINNQ

SEQ ID NO: 2339994 - protein, 26 aa, Cryptosporidium parvum
QNGLSFIFFSKVVFPNLLKATLSPPL

SEQ ID NO: 2339995 - protein, 17 aa, Cryptosporidium parvum
QNIDSILYKCSEGYLLS

SEQ ID NO: 2339996 - protein, 25 aa, Cryptosporidium parvum
QNKLYKVILAYLELCGFEQVMINSE

SEQ ID NO: 2339997 - protein, 24 aa, Cryptosporidium parvum
QNKPFVLFCLGPPGSGKGTQCAKI

SEQ ID NO: 2339998 - protein, 25 aa, Cryptosporidium parvum
QNLLAALCWSLPFKFIKCDIDFEEN

SEQ ID NO: 2339999 - protein, 24 aa, Cryptosporidium parvum
QNLTKVPIYQLVHIPELLSNATHL

SEQ ID NO: 2340000 - protein, 21 aa, Cryptosporidium parvum
QNVNCFLVFRALPENLKQATS

SEQ ID NO: 2340001 - protein, 20 aa, Cryptosporidium parvum
QPLVLKYKFFSEIISSYNYS

SEQ ID NO: 2340002 - protein, 19 aa, Cryptosporidium parvum
QPNLIKWIHSSYLIKRERA

SEQ ID NO: 2340003 - protein, 23 aa, Cryptosporidium parvum
QPRMERILRFLGSNPVDLAGQDK

SEQ ID NO: 2340004 - protein, 26 aa, Cryptosporidium parvum
QQTYIDYLNALPRCQCLPGYIGDGRT

SEQ ID NO: 2340005 - protein, 36 aa, Cryptosporidium parvum
QRFRPQRIIIRDIADTYWHLIGPYKASKIPGYVLPE

SEQ ID NO: 2340006 - protein, 33 aa, Cryptosporidium parvum
QRMEESIKFLKRKLLFSWPRTRLRKSLLDSNRR

SEQ ID NO: 2340007 - protein, 24 aa, Cryptosporidium parvum
QSFCYLGFLELWSSFRTAPTILVV

SEQ ID NO: 2340008 - protein, 23 aa, Cryptosporidium parvum
QSKARLANIFKRKKLTASEKLER

SEQ ID NO: 2340009 - protein, 33 aa, Cryptosporidium parvum
QSNKYESVSFIAFFKELFSLIYEQIIRKNRLHV

SEQ ID NO: 2340010 - protein, 24 aa, Cryptosporidium parvum
QSQDSFSFFKNLFSSSLALSMGFE

SEQ ID NO: 2340011 - protein, 21 aa, Cryptosporidium parvum
QSSLYRMLDLKEGLLSDIVNT

SEQ ID NO: 2340012 - protein, 18 aa, Cryptosporidium parvum
QSSYYYPGSSNYLYTLYG

SEQ ID NO: 2340013 - protein, 19 aa, Cryptosporidium parvum
QSTFIPLKMSEFRSLSFIG

SEQ ID NO: 2340014 - protein, 20 aa, Cryptosporidium parvum
QSYVPIKKVLEKIKIILKVD

SEQ ID NO: 2340015 - protein, 25 aa, Cryptosporidium parvum
QTGFDSFKMPISDFIQFGKIFESWD

SEQ ID NO: 2340016 - protein, 22 aa, Cryptosporidium parvum
QTIQLKPLSTMKSISGLFVEKD

SEQ ID NO: 2340017 - protein, 32 aa, Cryptosporidium parvum; identical to SEQ ID NO: 2210376

SEQ ID NO: 2340018 - protein, 32 aa, Cryptosporidium parvum; identical to SEQ ID NO: 2210378

SEQ ID NO: 2340019 - protein, 18 aa, Cryptosporidium parvum
QVFLRYLGVPFIKENDFN

SEQ ID NO: 2340020 - protein, 19 aa, Cryptosporidium parvum
QVPPMPFCQEPAIYHEGHC

SEQ ID NO: 2340021 - protein, 27 aa, Cryptosporidium parvum
QVRTLKEFIYFLDYINTKKFEIDFCIR

SEQ ID NO: 2340022 - protein, 17 aa, Cryptosporidium parvum
QVSIFTYFMAQKKLSEM

SEQ ID NO: 2340023 - protein, 20 aa, Cryptosporidium parvum
QVWRESYTEMVRFYKTFTPS

SEQ ID NO: 2340024 - protein, 21 aa, Cryptosporidium parvum
QYCEKYLSELFIKMNNMEWRA

SEQ ID NO: 2340025 - protein, 17 aa, Cryptosporidium parvum
QYIPLDNPSMWPASLTM

SEQ ID NO: 2340026 - protein, 30 aa, Cryptosporidium parvum; identical to SEQ ID NO: 2210380

SEQ ID NO: 2340027 - protein, 17 aa, Cryptosporidium parvum
QYKLPPRVTLLFIGLEH

SEQ ID NO: 2340028 - protein, 23 aa, Cryptosporidium parvum
RAEIRIFFELNTKYGYYRINTLE

SEQ ID NO: 2340029 - protein, 21 aa, Cryptosporidium parvum
RAISMCAYFNHWISYKFSTKN

SEQ ID NO: 2340030 - protein, 27 aa, Cryptosporidium parvum
RAKPKNNSLVRLITIPTSSDQSKVNIK

SEQ ID NO: 2340031 - protein, 21 aa, Cryptosporidium parvum
RALHGLPKFLINKARYIQAYF

SEQ ID NO: 2340032 - protein, 33 aa, Cryptosporidium parvum
RALNCYQSLPQYILIKGILSEYSYFLNIFYKLK

SEQ ID NO: 2340033 - protein, 26 aa, Cryptosporidium parvum
RATFKITCFRILRKLYREGSVSLRSS

SEQ ID NO: 2340034 - protein, 19 aa, Cryptosporidium parvum
RCLLMLGWHFRSHLRQIFQ

SEQ ID NO: 2340035 - protein, 17 aa, Cryptosporidium parvum
RCPGQESFPAQLRPYFA

SEQ ID NO: 2340036 - protein, 26 aa, Cryptosporidium parvum
RCVQYLPANKICPPGFNLSGQQCMAP

SEQ ID NO: 2340037 - protein, 25 aa, Cryptosporidium parvum
RDVESSIYLAKRKIHKLKKCLKKIA

SEQ ID NO: 2340038 - protein, 27 aa, Cryptosporidium parvum
REGLKNLPPIFLANIEVSPRPDKEPCI

SEQ ID NO: 2340039 - protein, 25 aa, Cryptosporidium parvum
REIEIDPIVTCPPRFVLNLQTQVCE

SEQ ID NO: 2340040 - protein, 17 aa, Cryptosporidium parvum
REKELNIEVLPNSIWRV

SEQ ID NO: 2340041 - protein, 23 aa, Cryptosporidium parvum
REQNVPALIPPLPKIINDKTAFD

SEQ ID NO: 2340042 - protein, 25 aa, Cryptosporidium parvum
RESDYLQRFPTLTGFNRAGLSGNER

SEQ ID NO: 2340043 - protein, 21 aa, Cryptosporidium parvum
RETVQLFFEKLLKVFAASELI

SEQ ID NO: 2340044 - protein, 24 aa, Cryptosporidium parvum
RFDLEMMSLLDSLRYPELSKLIYS

SEQ ID NO: 2340045 - protein, 24 aa, Cryptosporidium parvum
RFMYEIRDFILDAILFYENKNDGL

SEQ ID NO: 2340046 - protein, 24 aa, Cryptosporidium parvum
RFPGGYEAVISKTFRLPKYMQLAN

SEQ ID NO: 2340047 - protein, 17 aa, Cryptosporidium parvum
RFRRHVPTDAPLWGKSA

SEQ ID NO: 2340048 - protein, 19 aa, Cryptosporidium parvum
RGHKCIVITNVPIIPSCPS

SEQ ID NO: 2340049 - protein, 17 aa, Cryptosporidium parvum
RGKLEQQSICRLVQLVR

SEQ ID NO: 2340050 - protein, 17 aa, Cryptosporidium parvum
RGNQIAFRLYMKSTKIL

SEQ ID NO: 2340051 - protein, 17 aa, Cryptosporidium parvum
RGSDLASIRSFTISKLS

SEQ ID NO: 2340052 - protein, 32 aa, Cryptosporidium parvum
RGSNQLLLLFFSGLFLLNYVFCINTTKIACNA

SEQ ID NO: 2340053 - protein, 18 aa, Cryptosporidium parvum
RGTYRSTLSKQFSTGKTW

SEQ ID NO: 2340054 - protein, 29 aa, Cryptosporidium parvum
RHDIVDFALKYNLDFIALSFVQNGADVQL

SEQ ID NO: 2340055 - protein, 22 aa, Cryptosporidium parvum
RHSLFDLSILVKESLESAYRAL

SEQ ID NO: 2340056 - protein, 18 aa, Cryptosporidium parvum
RIAKKYIMTFVQSDPEDN

SEQ ID NO: 2340057 - protein, 24 aa, Cryptosporidium parvum
RICSIEWKNRFFFGFALREHYGPI

SEQ ID NO: 2340058 - protein, 17 aa, Cryptosporidium parvum
RIFVDLMARFHGQWSLF

SEQ ID NO: 2340059 - protein, 34 aa, Cryptosporidium parvum
RIGMRNPIHTFFGINFTGLLVVGAPIVQLTSGIT

SEQ ID NO: 2340060 - protein, 18 aa, Cryptosporidium parvum
RIIGLIGSPPPREIWSGA

SEQ ID NO: 2340061 - protein, 18 aa, Cryptosporidium parvum
RIIVTPELAYLISDLLPI

SEQ ID NO: 2340062 - protein, 19 aa, Cryptosporidium parvum
RIKLTLQAFIKVFELSYFN

SEQ ID NO: 2340063 - protein, 20 aa, Cryptosporidium parvum
RILLLLSTVSYAYSEKKRQL

SEQ ID NO: 2340064 - protein, 22 aa, Cryptosporidium parvum
RILLLSFIIGAFGAPQVKPNIP

SEQ ID NO: 2340065 - protein, 19 aa, Cryptosporidium parvum
RIPETTISGFILFKGLENS

SEQ ID NO: 2340066 - protein, 23 aa, Cryptosporidium parvum
RISTIEYLLIQMLKFNNNNKSDH

SEQ ID NO: 2340067 - protein, 17 aa, Cryptosporidium parvum
RKCFRMYFDGSPVVMCA

SEQ ID NO: 2340068 - protein, 24 aa, Cryptosporidium parvum
RKDPLRLREYFPGTLLQLRDAIES

SEQ ID NO: 2340069 - protein, 26 aa, Cryptosporidium parvum
RKDTGIIFVHPFLRKFKPIGSIKWVY

SEQ ID NO: 2340070 - protein, 20 aa, Cryptosporidium parvum
RKFKLEFLELSNEFLQHTKA

SEQ ID NO: 2340071 - protein, 27 aa, Cryptosporidium parvum
RKIEQLALALILYWRERQYDISSIDPI

SEQ ID NO: 2340072 - protein, 25 aa, Cryptosporidium parvum
RKLCSGPILLLIILSLSNSTEVDKA

SEQ ID NO: 2340073 - protein, 23 aa, Cryptosporidium parvum
RKLSLHIMVLALILVIQLTQCVK

SEQ ID NO: 2340074 - protein, 23 aa, Cryptosporidium parvum
RKNMNLPGCKVHLPIIGDKDRHD

SEQ ID NO: 2340075 - protein, 28 aa, Cryptosporidium parvum
RKVQNDPKNFWWLSKIRFSSGHYITKVH

SEQ ID NO: 2340076 - protein, 25 aa, Cryptosporidium parvum
RLESNLAFVLQIGTSIWGSNKAFSP

SEQ ID NO: 2340077 - protein, 17 aa, Cryptosporidium parvum
RLIPLIIPSDSEFCDSP

SEQ ID NO: 2340078 - protein, 17 aa, Cryptosporidium parvum
RLKEWVILKYKQIHDFL

SEQ ID NO: 2340079 - protein, 18 aa, Cryptosporidium parvum
RLLSLSYQLLDPGFMKIS

SEQ ID NO: 2340080 - protein, 20 aa, Cryptosporidium parvum
RLMIASILSAKLDFLTIDQI

SEQ ID NO: 2340081 - protein, 17 aa, Cryptosporidium parvum
RLNVVYPVGHFLGIIEA

SEQ ID NO: 2340082 - protein, 18 aa, Cryptosporidium parvum
RLPTTKRKLRKEVLSPLI

SEQ ID NO: 2340083 - protein, 21 aa, Cryptosporidium parvum
RLQAVILVCLLYLCIHVEGNG

SEQ ID NO: 2340084 - protein, 52 aa, Cryptosporidium parvum; identical to SEQ ID NO: 2210429

SEQ ID NO: 2340085 - protein, 23 aa, Cryptosporidium parvum
RLVLLIVIPVIAGKDYYKILGVP

SEQ ID NO: 2340086 - protein, 27 aa, Cryptosporidium parvum
RMENLYNSALRKGWFLPQNIPVANNEL

SEQ ID NO: 2340087 - protein, 30 aa, Cryptosporidium parvum
RMQVKKVKLLLILLSALAIFEFCLGTDLTA

SEQ ID NO: 2340088 - protein, 17 aa, Cryptosporidium parvum
RMVTYNNLFVHRGFYFV

SEQ ID NO: 2340089 - protein, 21 aa, Cryptosporidium parvum
RNAVKTILFPKYLSAQSNQML

SEQ ID NO: 2340090 - protein, 25 aa, Cryptosporidium parvum
RNERLSLLIRSVKFFIESLFERTCS

SEQ ID NO: 2340091 - protein, 22 aa, Cryptosporidium parvum
RNIAKMSGPEWKCPFGSEIFTG

SEQ ID NO: 2340092 - protein, 21 aa, Cryptosporidium parvum
RNIFSLECSCSVYPKNPGCPC

SEQ ID NO: 2340093 - protein, 18 aa, Cryptosporidium parvum
RNKHYIKLPPDGWDANDD

SEQ ID NO: 2340094 - protein, 24 aa, Cryptosporidium parvum
RNMKEIYKVLLESLLTLKKFYEAV

SEQ ID NO: 2340095 - protein, 25 aa, Cryptosporidium parvum
RNNALFINYLVNYFSIPQGAISQLH

SEQ ID NO: 2340096 - protein, 36 aa, Cryptosporidium parvum
RNNSGFQLYIKLIPAILLWIFFLSGKVLSSNTYENL

SEQ ID NO: 2340097 - protein, 30 aa, Cryptosporidium parvum
RNPEKRIIIDPLLLIVYIPKYKTFVDVEHA

SEQ ID NO: 2340098 - protein, 45 aa, Cryptosporidium parvum; identical to SEQ ID NO: 2210436

SEQ ID NO: 2340099 - protein, 27 aa, Cryptosporidium parvum
RNSEVFFLALDLFATYYLEYASSGGIG

SEQ ID NO: 2340100 - protein, 25 aa, Cryptosporidium parvum
RNVYEPYALQCPDGFRLLGDMCQQS

SEQ ID NO: 2340101 - protein, 24 aa, Cryptosporidium parvum
RPDKEPCIRIIKRIKQRISEVNGL

SEQ ID NO: 2340102 - protein, 18 aa, Cryptosporidium parvum
RPIPIGGGALYLCSIDYY

SEQ ID NO: 2340103 - protein, 17 aa, Cryptosporidium parvum
RPKIRELINFGQETLRV

SEQ ID NO: 2340104 - protein, 20 aa, Cryptosporidium parvum
RPTIELFGQSPVFVSSRGLS

SEQ ID NO: 2340105 - protein, 17 aa, Cryptosporidium parvum
RQFALLIKKHKCSYRAS

SEQ ID NO: 2340106 - protein, 17 aa, Cryptosporidium parvum
RQMLIIISLNEFAINLL

SEQ ID NO: 2340107 - protein, 27 aa, Cryptosporidium parvum
RQSPAIWYSSLKKVMYLDFYNAIHEVG

SEQ ID NO: 2340108 - protein, 17 aa, Cryptosporidium parvum
RQVAFERLKLIHEIDLA

SEQ ID NO: 2340109 - protein, 18 aa, Cryptosporidium parvum
RRCISGCATAFLAGGLSA

SEQ ID NO: 2340110 - protein, 17 aa, Cryptosporidium parvum
RRDLFKLFPPTDSNSET

SEQ ID NO: 2340111 - protein, 18 aa, Cryptosporidium parvum
RRHVPTDAPLWGKSATLT

SEQ ID NO: 2340112 - protein, 22 aa, Cryptosporidium parvum
RRKAFGMPSIPDYQYWNYEPEI

SEQ ID NO: 2340113 - protein, 34 aa, Cryptosporidium parvum
RSISILIYQNKIILEFLLYRYKVLTEQYLEFFNS

SEQ ID NO: 2340114 - protein, 30 aa, Cryptosporidium parvum
RSIVNYEDIIPVRLLLLGMSPKQIEKEPKD

SEQ ID NO: 2340115 - protein, 23 aa, Cryptosporidium parvum
RSKDAFIKYIKKLTGPAVQVAES

SEQ ID NO: 2340116 - protein, 17 aa, Cryptosporidium parvum
RSKWRGADFSTLAYRNS

SEQ ID NO: 2340117 - protein, 21 aa, Cryptosporidium parvum
RSLESSFIMHCDFPDCSLCND

SEQ ID NO: 2340118 - protein, 20 aa, Cryptosporidium parvum
RSLFDFLVAQRFIKPTLNIY

SEQ ID NO: 2340119 - protein, 35 aa, Cryptosporidium parvum
RSNFGSTFGALLDSFALLVDSSFSESCLSLIDSLV

SEQ ID NO: 2340120 - protein, 23 aa, Cryptosporidium parvum
RSNIFLKIFISFKKIFFGCFNHI

SEQ ID NO: 2340121 - protein, 23 aa, Cryptosporidium parvum
RSPEMRILRFDGFEVPDFPFSDT

SEQ ID NO: 2340122 - protein, 25 aa, Cryptosporidium parvum
RSSLLKLIFPLNNISKIKLSSKPMF

SEQ ID NO: 2340123 - protein, 28 aa, Cryptosporidium parvum
RSYRNKLKPGFILLINDSTVNSGANAKS

SEQ ID NO: 2340124 - protein, 21 aa, Cryptosporidium parvum
RTERLFINKPLSPDFMDELEN

SEQ ID NO: 2340125 - protein, 27 aa, Cryptosporidium parvum
RTEWTLKLPRWRSSPLGLPPDHPVNAQ

SEQ ID NO: 2340126 - protein, 17 aa, Cryptosporidium parvum
RTKPLISKFPIEEGSHS

SEQ ID NO: 2340127 - protein, 17 aa, Cryptosporidium parvum
RTPLLKDLWPGDIMDCI

SEQ ID NO: 2340128 - protein, 24 aa, Cryptosporidium parvum
RTRCMRIWTLLRNSVPNALKNKIL

SEQ ID NO: 2340129 - protein, 18 aa, Cryptosporidium parvum
RTRKPYINQKEAFTLLED

SEQ ID NO: 2340130 - protein, 26 aa, Cryptosporidium parvum
RTTNYSALQFFTTLESKAMGTLSKPS

SEQ ID NO: 2340131 - protein, 25 aa, Cryptosporidium parvum
RTTVAGLMYFYSLLVSEFASKAPNS

SEQ ID NO: 2340132 - protein, 27 aa, Cryptosporidium parvum
RVAEKYNKKKSWRKKTRKFKLEFLELS

SEQ ID NO: 2340133 - protein, 19 aa, Cryptosporidium parvum
RVALKYLEMSPDLSLAKFL

SEQ ID NO: 2340134 - protein, 26 aa, Cryptosporidium parvum
RVCEQHGILYFIPANEKQYFDSFPMF

SEQ ID NO: 2340135 - protein, 20 aa, Cryptosporidium parvum
RVIPLTHDFGCDNPKGCNSQ

SEQ ID NO: 2340136 - protein, 18 aa, Cryptosporidium parvum
RVMDHFIKIIKSKTGKDV

SEQ ID NO: 2340137 - protein, 20 aa, Cryptosporidium parvum
RVVRKLALLEKLKLKRKPKT

SEQ ID NO: 2340138 - protein, 26 aa, Cryptosporidium parvum
RVYEKFVPGRGFDKILQKKLINTYDS

SEQ ID NO: 2340139 - protein, 20 aa, Cryptosporidium parvum
RWRDRDFPFYNMLMSTVATT

SEQ ID NO: 2340140 - protein, 28 aa, Cryptosporidium parvum
RYGLTIIKPPLYNYLFELANKIQQDKSF

SEQ ID NO: 2340141 - protein, 25 aa, Cryptosporidium parvum
RYRERIFEMFKTYSLRLLPNSLRAF

SEQ ID NO: 2340142 - protein, 17 aa, Cryptosporidium parvum
RYTIGPFASLVHKRDQD

SEQ ID NO: 2340143 - protein, 18 aa, Cryptosporidium parvum
SACTNECGWGIQTRGRRI

SEQ ID NO: 2340144 - protein, 28 aa, Cryptosporidium parvum
SADFVVISFYKMFGYPTGLGALISKTDQ

SEQ ID NO: 2340145 - protein, 30 aa, Cryptosporidium parvum
SAGDQIPFFLNYWTDKYTYRYWVLESDQGV

SEQ ID NO: 2340146 - protein, 26 aa, Cryptosporidium parvum
SAINDIAIELFFIRKKYVPSFNPESS

SEQ ID NO: 2340147 - protein, 24 aa, Cryptosporidium parvum
SAKVKGRLRLQFLKKRGFSAREGS

SEQ ID NO: 2340148 - protein, 30 aa, Cryptosporidium parvum
SAPPPPPHSPPPPPPPPPPSSPPSPPPSPP

SEQ ID NO: 2340149 - protein, 25 aa, Cryptosporidium parvum
SAPSIPPSIPPPIRQSVRHPIPPSI

SEQ ID NO: 2340150 - protein, 24 aa, Cryptosporidium parvum
SAPSPISYFFVLSSLIQYVSYTHK

SEQ ID NO: 2340151 - protein, 21 aa, Cryptosporidium parvum
SASFKYRKCKYWSWRATDFSC

SEQ ID NO: 2340152 - protein, 23 aa, Cryptosporidium parvum
SASKITVFGILNMILRNALENPK

SEQ ID NO: 2340153 - protein, 23 aa, Cryptosporidium parvum
SASSVFLSISAPVSLSVSVSSSS

SEQ ID NO: 2340154 - protein, 23 aa, Cryptosporidium parvum
SCNRALLKGWPIGMEALNGNWDL

SEQ ID NO: 2340155 - protein, 18 aa, Cryptosporidium parvum
SCNSPYLPKSPYNQSRKD

SEQ ID NO: 2340156 - protein, 28 aa, Cryptosporidium parvum
SCPEKLAILMFLFQNTLYDVLPSHLNEN

SEQ ID NO: 2340157 - protein, 20 aa, Cryptosporidium parvum
SCQSMVVPYIKFSKPKSSKS

SEQ ID NO: 2340158 - protein, 24 aa, Cryptosporidium parvum
SDGSGLFELMPNNQLRLARGGNLC

SEQ ID NO: 2340159 - protein, 25 aa, Cryptosporidium parvum
SDGVQKFFFKILRRKVHSNHPVKHW

SEQ ID NO: 2340160 - protein, 19 aa, Cryptosporidium parvum
SDIILSGKCLNGIIFTAMA

SEQ ID NO: 2340161 - protein, 21 aa, Cryptosporidium parvum
SDIRYSFMKLGRKEFLCGFEG

SEQ ID NO: 2340162 - protein, 20 aa, Cryptosporidium parvum
SDLLLLDVTPLTLGIETVGG

SEQ ID NO: 2340163 - protein, 23 aa, Cryptosporidium parvum
SDPKCPEGFTLNNSTISCEYEKS

SEQ ID NO: 2340164 - protein, 19 aa, Cryptosporidium parvum
SDSIIYFITVKPGTEITVN

SEQ ID NO: 2340165 - protein, 17 aa, Cryptosporidium parvum
SECDFLASKARLSDLTI

SEQ ID NO: 2340166 - protein, 25 aa, Cryptosporidium parvum
SEEHMSNLVWIPWSENGPLNQNRSY

SEQ ID NO: 2340167 - protein, 24 aa, Cryptosporidium parvum
SEELFRIEILVSEALYNTGLSISN

SEQ ID NO: 2340168 - protein, 25 aa, Cryptosporidium parvum
SEEPEISLVTFILFKCIADLEYLGN

SEQ ID NO: 2340169 - protein, 17 aa, Cryptosporidium parvum
SEFILDGLLNVYLINDG

SEQ ID NO: 2340170 - protein, 24 aa, Cryptosporidium parvum
SEFLDNIYLLYSLNNKVSSYYCTH

SEQ ID NO: 2340171 - protein, 23 aa, Cryptosporidium parvum
SEFNRFIFLNTMIERYLTISGLG

SEQ ID NO: 2340172 - protein, 26 aa, Cryptosporidium parvum
SEIHVNHMWWVPLLKKIIKEDEEIAA

SEQ ID NO: 2340173 - protein, 32 aa, Cryptosporidium parvum
SEIIPNRDQLKLFAAKLAVFGSAPYSYDSAPF

SEQ ID NO: 2340174 - protein, 22 aa, Cryptosporidium parvum
SELARTLTIKLLDTISLKDEMS

SEQ ID NO: 2340175 - protein, 18 aa, Cryptosporidium parvum
SELNSCIASIRNIWDSFP

SEQ ID NO: 2340176 - protein, 26 aa, Cryptosporidium parvum
SELQNLLSTKILFLILESMYPNRKLE

SEQ ID NO: 2340177 - protein, 24 aa, Cryptosporidium parvum
SENKLRILYKIDQSNWFRLTEVSG

SEQ ID NO: 2340178 - protein, 25 aa, Cryptosporidium parvum
SENLQILEYDFIFSKLKDINGDVND

SEQ ID NO: 2340179 - protein, 23 aa, Cryptosporidium parvum
SEPFIDRVLKLNGQLSPFLRAKI

SEQ ID NO: 2340180 - protein, 34 aa, Cryptosporidium parvum
SERLFSYAIGICKIPSLWYLELIYCMHRGVTHFT

SEQ ID NO: 2340181 - protein, 25 aa, Cryptosporidium parvum
SERVKSWRYLGYIKLSKTKKELEDI

SEQ ID NO: 2340182 - protein, 25 aa, Cryptosporidium parvum
SETALQWWVDYGDGGKKPKPVLTSS

SEQ ID NO: 2340183 - protein, 21 aa, Cryptosporidium parvum
SFDLLLEPILSNPESPLFVPP

SEQ ID NO: 2340184 - protein, 26 aa, Cryptosporidium parvum
SFEANYLLELTFINLAKVLEAMLRLL

SEQ ID NO: 2340185 - protein, 25 aa, Cryptosporidium parvum
SFFGKIKSFFKKKPSSVNLGCKKPN

SEQ ID NO: 2340186 - protein, 26 aa, Cryptosporidium parvum
SFFTVLFNFLLLLSDQVFFNDFLNTS

SEQ ID NO: 2340187 - protein, 30 aa, Cryptosporidium parvum; identical to SEQ ID NO: 2210483

SEQ ID NO: 2340188 - protein, 17 aa, Cryptosporidium parvum
SFLSSILLLNGIESLKF

SEQ ID NO: 2340189 - protein, 20 aa, Cryptosporidium parvum
SFPKVAPYTSRLFGAAIHKS

SEQ ID NO: 2340190 - protein, 24 aa, Cryptosporidium parvum
SFRRVSRCCILIQDFVDIALMIIS

SEQ ID NO: 2340191 - protein, 24 aa, Cryptosporidium parvum
SFSDMVVLPFKYKIDLPPEVLPGS

SEQ ID NO: 2340192 - protein, 27 aa, Cryptosporidium parvum
SFSVKILLFFLTSGYLIFSPVVFGIGL

SEQ ID NO: 2340193 - protein, 20 aa, Cryptosporidium parvum
SFTLNNLVYNILNINLAEKP

SEQ ID NO: 2340194 - protein, 17 aa, Cryptosporidium parvum
SFVGPIIIPIHTSTTTK

SEQ ID NO: 2340195 - protein, 17 aa, Cryptosporidium parvum
SFYISTYSNIYKLPVLE

SEQ ID NO: 2340196 - protein, 23 aa, Cryptosporidium parvum
SGACFKRIILWHYEKVELIKNDR

SEQ ID NO: 2340197 - protein, 32 aa, Cryptosporidium parvum; identical to SEQ ID NO: 2210491

SEQ ID NO: 2340198 - protein, 34 aa, Cryptosporidium parvum
SGFILFKGLENSFKPRIYLRFKSLRDPSSTGFER

SEQ ID NO: 2340199 - protein, 19 aa, Cryptosporidium parvum
SGIFRQFGDKITQQANPCH

SEQ ID NO: 2340200 - protein, 20 aa, Cryptosporidium parvum
SGIKFDYIIVGAGANGLITA

SEQ ID NO: 2340201 - protein, 17 aa, Cryptosporidium parvum
SGISFLLSRPVTKLLEQ

SEQ ID NO: 2340202 - protein, 26 aa, Cryptosporidium parvum
SGISFMAILGPLRTFLDLMNKNWGIG

SEQ ID NO: 2340203 - protein, 24 aa, Cryptosporidium parvum
SGIYFLVFSVLLTFSFNSINVFEY

SEQ ID NO: 2340204 - protein, 26 aa, Cryptosporidium parvum
SGKDRDLLLQLLLTQKMLGNLKEFHS

SEQ ID NO: 2340205 - protein, 34 aa, Cryptosporidium parvum; identical to SEQ ID NO: 2210495

SEQ ID NO: 2340206 - protein, 27 aa, Cryptosporidium parvum
SGKYQSNFFLFKLPNSINQLNFNFIEV

SEQ ID NO: 2340207 - protein, 23 aa, Cryptosporidium parvum
SGLYSMNYWVQQLTTFASTSLTE

SEQ ID NO: 2340208 - protein, 26 aa, Cryptosporidium parvum
SGMRIAQFFILNKTKTFILPFVMFPD

SEQ ID NO: 2340209 - protein, 21 aa, Cryptosporidium parvum
SGNVMYLPITSAFSTGWDNTL

SEQ ID NO: 2340210 - protein, 22 aa, Cryptosporidium parvum
SGPAPFRLAILAMLVSDFVTDN

SEQ ID NO: 2340211 - protein, 26 aa, Cryptosporidium parvum
SGRGYKFLKMILKSNYYLGYHFLTTL

SEQ ID NO: 2340212 - protein, 26 aa, Cryptosporidium parvum
SGVAMYSYFLLAESPPFVGSLSLFAP

SEQ ID NO: 2340213 - protein, 26 aa, Cryptosporidium parvum
SGWKKLLNCLSICLGLSLIGRCLSKN

SEQ ID NO: 2340214 - protein, 20 aa, Cryptosporidium parvum
SHEPILPFQNVIEAPFGIAQ

SEQ ID NO: 2340215 - protein, 23 aa, Cryptosporidium parvum
SHIYQLNKFLLSVWNHFVIEKHP

SEQ ID NO: 2340216 - protein, 35 aa, Cryptosporidium parvum
SIAKEIHTLFPQIKFKKICRLASSLSLIVPFDIKL

SEQ ID NO: 2340217 - protein, 17 aa, Cryptosporidium parvum
SIDIVGLFSYLPNEFEL

SEQ ID NO: 2340218 - protein, 26 aa, Cryptosporidium parvum
SIEADCGARLFLGGRAIIIDRMPQPS

SEQ ID NO: 2340219 - protein, 18 aa, Cryptosporidium parvum
SIEKLKLKRSQWLAIQEA

SEQ ID NO: 2340220 - protein, 22 aa, Cryptosporidium parvum
SIFFVFLNHFLGFSADVQIAGN

SEQ ID NO: 2340221 - protein, 20 aa, Cryptosporidium parvum
SIFLPLLKHSFGYQANQPNV

SEQ ID NO: 2340222 - protein, 17 aa, Cryptosporidium parvum
SIFTYFMAQKKLSEMRI

SEQ ID NO: 2340223 - protein, 23 aa, Cryptosporidium parvum
SIGKPFLPVGIHSAPYFGTSENT

SEQ ID NO: 2340224 - protein, 18 aa, Cryptosporidium parvum
SIHSIFLPSLQGSQTKMS

SEQ ID NO: 2340225 - protein, 19 aa, Cryptosporidium parvum
SIILLLIHGFCNKSLVEKQ

SEQ ID NO: 2340226 - protein, 24 aa, Cryptosporidium parvum
SILELYHFCIRDRFYSSLSYGQLK

SEQ ID NO: 2340227 - protein, 20 aa, Cryptosporidium parvum
SILILIYLSIFVDSASKDPP

SEQ ID NO: 2340228 - protein, 17 aa, Cryptosporidium parvum
SIMNVPLFSAISAENYS

SEQ ID NO: 2340229 - protein, 25 aa, Cryptosporidium parvum
SINSIDFFYYKNPAAKFTIIYSHSN

SEQ ID NO: 2340230 - protein, 28 aa, Cryptosporidium parvum
SINSLRKWELHYFYPLAKQILESIEKDP

SEQ ID NO: 2340231 - protein, 33 aa, Cryptosporidium parvum
SIQKKFEIHHPPKLLFFFGSINKFEAYPSHLTG

SEQ ID NO: 2340232 - protein, 23 aa, Cryptosporidium parvum
SIRPPPVQTMYPPQAYLQNGVYS

SEQ ID NO: 2340233 - protein, 27 aa, Cryptosporidium parvum
SIRSTRIATILLFIKEILLSFSENISS

SEQ ID NO: 2340234 - protein, 17 aa, Cryptosporidium parvum
SISFQYLMYLSEYLELP

SEQ ID NO: 2340235 - protein, 20 aa, Cryptosporidium parvum
SISLNLLYAIYLSAIMINDL

SEQ ID NO: 2340236 - protein, 37 aa, Cryptosporidium parvum; identical to SEQ ID NO: 2210517

SEQ ID NO: 2340237 - protein, 25 aa, Cryptosporidium parvum
SISSPNIFSPLRSPSFLNNNYSREG

SEQ ID NO: 2340238 - protein, 27 aa, Cryptosporidium parvum
SITDAISLVIIKLLRRNKISKKASEDA

SEQ ID NO: 2340239 - protein, 36 aa, Cryptosporidium parvum; identical to SEQ ID NO: 2197093

SEQ ID NO: 2340240 - protein, 20 aa, Cryptosporidium parvum
SITSDDIFFLSKSPGKTLVI

SEQ ID NO: 2340241 - protein, 19 aa, Cryptosporidium parvum
SIVFVLMEFIIKKIVELKA

SEQ ID NO: 2340242 - protein, 22 aa, Cryptosporidium parvum
SIYLFAFLYGNVPWMELSTWKS

SEQ ID NO: 2340243 - protein, 19 aa, Cryptosporidium parvum
SKALNLIPNKFRIVNIWNE

SEQ ID NO: 2340244 - protein, 27 aa, Cryptosporidium parvum
SKAYNPLKLGELFIVPLTSAIADNYYH

SEQ ID NO: 2340245 - protein, 20 aa, Cryptosporidium parvum
SKFGVFILNEKMNSLITFQT

SEQ ID NO: 2340246 - protein, 17 aa, Cryptosporidium parvum
SKFLKMFVKEPLEDSTP

SEQ ID NO: 2340247 - protein, 22 aa, Cryptosporidium parvum
SKFLTEFVASEFYYGLLAEMDF

SEQ ID NO: 2340248 - protein, 21 aa, Cryptosporidium parvum
SKIDSIWFSLKYLSKDDVLVK

SEQ ID NO: 2340249 - protein, 24 aa, Cryptosporidium parvum
SKINPLKFMNLLNFSFDSIKKQLI

SEQ ID NO: 2340250 - protein, 26 aa, Cryptosporidium parvum
SKKGNKFTRFFKRLFKKPSCIKCVKS

SEQ ID NO: 2340251 - protein, 21 aa, Cryptosporidium parvum
SKKKIFIPGFKKKKIMEKKQG

SEQ ID NO: 2340252 - protein, 38 aa, Cryptosporidium parvum
SKKKSKIIKAFKKIPVISPTISFLYSHLSNRGKKKRKA

SEQ ID NO: 2340253 - protein, 28 aa, Cryptosporidium parvum
SKKSTTIYWVYPIPPESYALSLFRYNVN

SEQ ID NO: 2340254 - protein, 19 aa, Cryptosporidium parvum
SKLFGRKSSYKLALSSLKR

SEQ ID NO: 2340255 - protein, 17 aa, Cryptosporidium parvum
SKLPTILTSLYTRLVHG

SEQ ID NO: 2340256 - protein, 27 aa, Cryptosporidium parvum
SKLQKFVKMLHLLANFELFLNGCFNSP

SEQ ID NO: 2340257 - protein, 34 aa, Cryptosporidium parvum
SKNEFFPDLVYGDSFPFYPPGVHPAPIVGDQLNT

SEQ ID NO: 2340258 - protein, 30 aa, Cryptosporidium parvum
SKNNEPSLWKSLPLILPKLPTYPEQIREYI

SEQ ID NO: 2340259 - protein, 21 aa, Cryptosporidium parvum
SKQMCLLLKPANHKSCIKLSS

SEQ ID NO: 2340260 - protein, 19 aa, Cryptosporidium parvum
SKRTLLRSINFRCPEKSVI

SEQ ID NO: 2340261 - protein, 28 aa, Cryptosporidium parvum
SKSAFSSLISPPLSKNLLVSAPSQEQMA

SEQ ID NO: 2340262 - protein, 21 aa, Cryptosporidium parvum
SKTFSVWHLFNKKIINNVVAT

SEQ ID NO: 2340263 - protein, 18 aa, Cryptosporidium parvum
SKTRGMVCFGWGKRYKMI

SEQ ID NO: 2340264 - protein, 20 aa, Cryptosporidium parvum
SKYKQFPMSSSKNYGFSSFI

SEQ ID NO: 2340265 - protein, 27 aa, Cryptosporidium parvum
SKYNEWLPILFIQRYTKPSTLINCYKH

SEQ ID NO: 2340266 - protein, 23 aa, Cryptosporidium parvum
SLAILILMFQREVNLIYTSYLLF

SEQ ID NO: 2340267 - protein, 18 aa, Cryptosporidium parvum
SLATLLVGASASGIFRQF

SEQ ID NO: 2340268 - protein, 25 aa, Cryptosporidium parvum
SLCMDYVAFFFIKCKKWSYDVEKKK

SEQ ID NO: 2340269 - protein, 41 aa, Cryptosporidium parvum
SLDVIRMVSMYRYGDIRYLLSREFLYLFGKFGELDDYNIYT

SEQ ID NO: 2340270 - protein, 23 aa, Cryptosporidium parvum
SLEIWDEHWPPYASTFIIEIYNN

SEQ ID NO: 2340271 - protein, 18 aa, Cryptosporidium parvum
SLFSLLSRRVLSQDNGFI

SEQ ID NO: 2340272 - protein, 17 aa, Cryptosporidium parvum
SLGIDHSYLLYLNIHDI

SEQ ID NO: 2340273 - protein, 31 aa, Cryptosporidium parvum
SLHSSIIKFCFKFGIFYILKSQLNKKQEIIT

SEQ ID NO: 2340274 - protein, 29 aa, Cryptosporidium parvum
SLHVGHLVPFLFTKYLQDTFKVPLVIQLT

SEQ ID NO: 2340275 - protein, 18 aa, Cryptosporidium parvum
SLIGYGGVSLKSTYLSSV

SEQ ID NO: 2340276 - protein, 19 aa, Cryptosporidium parvum
SLIIFCSAVLHQEPLGLVD

SEQ ID NO: 2340277 - protein, 36 aa, Cryptosporidium parvum; identical to SEQ ID NO: 2210542

SEQ ID NO: 2340278 - protein, 25 aa, Cryptosporidium parvum
SLIVLILAIVISSNYCFGKDNTDNK

SEQ ID NO: 2340279 - protein, 19 aa, Cryptosporidium parvum
SLKYDYNHSWMFEKGPRPY

SEQ ID NO: 2340280 - protein, 19 aa, Cryptosporidium parvum
SLLAILSLTLVGSNTLLNS

SEQ ID NO: 2340281 - protein, 25 aa, Cryptosporidium parvum
SLLFLFLLQFSFGSSLKSNPLGNEN

SEQ ID NO: 2340282 - protein, 17 aa, Cryptosporidium parvum
SLLLGLIVSVFAEKGVR

SEQ ID NO: 2340283 - protein, 32 aa, Cryptosporidium parvum
SLLLIRMRLLHIFWLFTQIVLAFSAKKFKNGK

SEQ ID NO: 2340284 - protein, 18 aa, Cryptosporidium parvum
SLNEFAINLLPKVRKGGY

SEQ ID NO: 2340285 - protein, 17 aa, Cryptosporidium parvum
SLNLDFSNLAFKPRNSY

SEQ ID NO: 2340286 - protein, 19 aa, Cryptosporidium parvum
SLQLFLGINLWNNQQIYQE

SEQ ID NO: 2340287 - protein, 23 aa, Cryptosporidium parvum
SLREYRLPIGYIPIARRYQRVKE

SEQ ID NO: 2340288 - protein, 27 aa, Cryptosporidium parvum
SLRQWADLYIILPLSANTLAKLSNGLC

SEQ ID NO: 2340289 - protein, 23 aa, Cryptosporidium parvum
SLSLIVPFDIKLFSKFVIKKNGK

SEQ ID NO: 2340290 - protein, 20 aa, Cryptosporidium parvum
SLTELYRYLMVHNYLHIIGS

SEQ ID NO: 2340291 - protein, 28 aa, Cryptosporidium parvum
SLWSTIGFPAILTPCSYMYPIVISLKNI

SEQ ID NO: 2340292 - protein, 18 aa, Cryptosporidium parvum
SLYDYLVEKANLNWPETS

SEQ ID NO: 2340293 - protein, 24 aa, Cryptosporidium parvum
SLYKQSFISKFINSLSKALNLIPN

SEQ ID NO: 2340294 - protein, 19 aa, Cryptosporidium parvum
SLYLELYRDGSKKINVSSM

SEQ ID NO: 2340295 - protein, 17 aa, Cryptosporidium parvum
SLYLIEKFVLNSKILSL

SEQ ID NO: 2340296 - protein, 21 aa, Cryptosporidium parvum
SLYVHAGLLPKYAKLGLDKLD

SEQ ID NO: 2340297 - protein, 18 aa, Cryptosporidium parvum
SMDYLARKGLPLNINEEA

SEQ ID NO: 2340298 - protein, 33 aa, Cryptosporidium parvum
SMEPKKFPGLATLLSELLFYDWKRPDVGRETPY

SEQ ID NO: 2340299 - protein, 21 aa, Cryptosporidium parvum
SMFRESTLPTPPPQTTESTEV

SEQ ID NO: 2340300 - protein, 20 aa, Cryptosporidium parvum
SMLANIWWNGPVKKSHKIGI

SEQ ID NO: 2340301 - protein, 25 aa, Cryptosporidium parvum
SMVRNPIRTLLHIPSFLGMCGNDID

SEQ ID NO: 2340302 - protein, 25 aa, Cryptosporidium parvum
SMYENKFFYCTIKTNLFSSTFETIR

SEQ ID NO: 2340303 - protein, 21 aa, Cryptosporidium parvum
SNALLLSFLTSNIPQYLRLPT

SEQ ID NO: 2340304 - protein, 28 aa, Cryptosporidium parvum
SNDHQNILSIYFFQSYLALRDLENQNIC

SEQ ID NO: 2340305 - protein, 17 aa, Cryptosporidium parvum
SNELGLSLFINFGIRFF

SEQ ID NO: 2340306 - protein, 24 aa, Cryptosporidium parvum
SNENSLYDLWIYYEHHRLPNLKEK

SEQ ID NO: 2340307 - protein, 23 aa, Cryptosporidium parvum
SNEYLIRCISAEGIVYSPDICPN

SEQ ID NO: 2340308 - protein, 18 aa, Cryptosporidium parvum
SNFKFINFGYMKSTLEVS

SEQ ID NO: 2340309 - protein, 19 aa, Cryptosporidium parvum
SNGFVCMGILNGTEIWSRE

SEQ ID NO: 2340310 - protein, 27 aa, Cryptosporidium parvum
SNIVENPLFLFYKLEDKTINKVCSIIS

SEQ ID NO: 2340311 - protein, 18 aa, Cryptosporidium parvum
SNLGMWWTMGNESEFLIL

SEQ ID NO: 2340312 - protein, 24 aa, Cryptosporidium parvum
SNLKECVGTSWLPKPCGLDPFSET

SEQ ID NO: 2340313 - protein, 27 aa, Cryptosporidium parvum
SNLSEAIFKLYLMNSRELDIRSLKANG

SEQ ID NO: 2340314 - protein, 24 aa, Cryptosporidium parvum
SNNEIVLVITPKNFFADKDGKLSL

SEQ ID NO: 2340315 - protein, 18 aa, Cryptosporidium parvum
SNNILFNYKYNFIKTDSA

SEQ ID NO: 2340316 - protein, 20 aa, Cryptosporidium parvum
SNPFNINYLKDLPPKRFISK

SEQ ID NO: 2340317 - protein, 33 aa, Cryptosporidium parvum
SNSGIMPNMKIKLLEKLFPRRNFTNDELDVIIL

SEQ ID NO: 2340318 - protein, 26 aa, Cryptosporidium parvum
SNSGLILFHLIINDNGLFLKGTSGTD

SEQ ID NO: 2340319 - protein, 23 aa, Cryptosporidium parvum
SNTLDLLWNNFLIFENSAFPKNS

SEQ ID NO: 2340320 - protein, 23 aa, Cryptosporidium parvum
SNVLGGKIKFTLSGAAPLDEHTQ

SEQ ID NO: 2340321 - protein, 20 aa, Cryptosporidium parvum
SNYIIGIYKKNPILVESSER

SEQ ID NO: 2340322 - protein, 19 aa, Cryptosporidium parvum
SNYSPLNPHRTPFYDYYLS

SEQ ID NO: 2340323 - protein, 30 aa, Cryptosporidium parvum
SNYYLEENFLYPNIFLFKGYETCGLYEECS

SEQ ID NO: 2340324 - protein, 19 aa, Cryptosporidium parvum
SNYYQAISEVSLVKLKTLP

SEQ ID NO: 2340325 - protein, 26 aa, Cryptosporidium parvum
SPCDGHLSFRLPLNHSFERSDIILSG

SEQ ID NO: 2340326 - protein, 26 aa, Cryptosporidium parvum
SPCNSILFPYLMIQEFVNPLGIENNN

SEQ ID NO: 2340327 - protein, 26 aa, Cryptosporidium parvum
SPFPPPSPPPSPLPPPLPPKVRVKKG

SEQ ID NO: 2340328 - protein, 19 aa, Cryptosporidium parvum
SPKFILGMFSRILDIPSTI

SEQ ID NO: 2340329 - protein, 21 aa, Cryptosporidium parvum
SPLLDLTRFLVQNYSKFPINS

SEQ ID NO: 2340330 - protein, 22 aa, Cryptosporidium parvum
SPLPPPLPPRPSPSPTPTPHSY

SEQ ID NO: 2340331 - protein, 24 aa, Cryptosporidium parvum
SPRPRRRNPWRYGNKGKPTHSNSE

SEQ ID NO: 2340332 - protein, 19 aa, Cryptosporidium parvum
SPSILPSIPYNKYQFDCND

SEQ ID NO: 2340333 - protein, 28 aa, Cryptosporidium parvum
SPVICSHPLLMPPPIYKHGRVKCIPKNL

SEQ ID NO: 2340334 - protein, 20 aa, Cryptosporidium parvum
SPYNLECPNGFILDRERSSC

SEQ ID NO: 2340335 - protein, 21 aa, Cryptosporidium parvum
SQFNKICPLGFNLDTDGNCTK

SEQ ID NO: 2340336 - protein, 26 aa, Cryptosporidium parvum
SQFSDLISPFYTVPLPIHNSEYWVNG

SEQ ID NO: 2340337 - protein, 32 aa, Cryptosporidium parvum
SQGLYWEDEFILPPTQFPFIKEEKESLGNKNS

SEQ ID NO: 2340338 - protein, 38 aa, Cryptosporidium parvum
SQKMCHEVDLIKPLWTMPLLLRIFLNNINLDKNNPQKE

SEQ ID NO: 2340339 - protein, 18 aa, Cryptosporidium parvum
SQLRNNALFINYLVNYFS

SEQ ID NO: 2340340 - protein, 24 aa, Cryptosporidium parvum
SQPNTKLMLLQPFIIFSCIEVVKQ

SEQ ID NO: 2340341 - protein, 22 aa, Cryptosporidium parvum
SQRFHSTPLAYTTLKPMKGMLS

SEQ ID NO: 2340342 - protein, 25 aa, Cryptosporidium parvum
SQSIVRPNIFYPGEYRAFGLAYIAF

SEQ ID NO: 2340343 - protein, 18 aa, Cryptosporidium parvum
SQTPAPEVPLTPQIPRIK

SEQ ID NO: 2340344 - protein, 17 aa, Cryptosporidium parvum
SRASFIMPEKHIYFGGT

SEQ ID NO: 2340345 - protein, 25 aa, Cryptosporidium parvum
SREMLPFKYLIPVGESPYSKMRVTQ

SEQ ID NO: 2340346 - protein, 36 aa, Cryptosporidium parvum
SRFHISLRRKWALFCWFFSILIREISSDLPPNCIHG

SEQ ID NO: 2340347 - protein, 29 aa, Cryptosporidium parvum
SRILFSRLRPFISFQSTFIPLKMSEFRSL

SEQ ID NO: 2340348 - protein, 20 aa, Cryptosporidium parvum
SRLGLFLMNSDFNSLIKIPT

SEQ ID NO: 2340349 - protein, 18 aa, Cryptosporidium parvum
SRLGLYLMNSKLQSLIQI

SEQ ID NO: 2340350 - protein, 18 aa, Cryptosporidium parvum
SRLLKKISDLNFVEVLNN

SEQ ID NO: 2340351 - protein, 22 aa, Cryptosporidium parvum
SRNRLRRFLDSLNKVELKLPKI

SEQ ID NO: 2340352 - protein, 23 aa, Cryptosporidium parvum
SRNRRFKFRFGEVPIDSSIETSS

SEQ ID NO: 2340353 - protein, 22 aa, Cryptosporidium parvum
SRQFEMLKLFSDLIFQIQHVDI

SEQ ID NO: 2340354 - protein, 23 aa, Cryptosporidium parvum
SRQPSVVPMIILPIFVDNNLKTS

SEQ ID NO: 2340355 - protein, 20 aa, Cryptosporidium parvum
SRREEILKKLKKIKETAAKM

SEQ ID NO: 2340356 - protein, 21 aa, Cryptosporidium parvum
SRRVLGWTIELPFPGSDESKA

SEQ ID NO: 2340357 - protein, 31 aa, Cryptosporidium parvum; identical to SEQ ID NO: 2210593

SEQ ID NO: 2340358 - protein, 21 aa, Cryptosporidium parvum
SRTELPFRKGSRFKIYLSCQD

SEQ ID NO: 2340359 - protein, 28 aa, Cryptosporidium parvum
SSAKENLIVYTILRPIPVDDSGACFKRI

SEQ ID NO: 2340360 - protein, 25 aa, Cryptosporidium parvum
SSASFLVMFLMEFAEKYLFFPGKVE

SEQ ID NO: 2340361 - protein, 23 aa, Cryptosporidium parvum
SSDQIYLEAFKYTYYPFISQMKM

SEQ ID NO: 2340362 - protein, 32 aa, Cryptosporidium parvum
SSDYKIQVLIQLVLICFFILLGQIKGDKTNTK

SEQ ID NO: 2340363 - protein, 21 aa, Cryptosporidium parvum
SSEIPRLGQYLVFYGHSESTS

SEQ ID NO: 2340364 - protein, 24 aa, Cryptosporidium parvum
SSGKKVIFHVPTLKMKDPDDPEQN

SEQ ID NO: 2340365 - protein, 25 aa, Cryptosporidium parvum
SSGLSSFWTPPAGFGGFFPMLVPND

SEQ ID NO: 2340366 - protein, 21 aa, Cryptosporidium parvum
SSITIILNTKKFKYLIVTTQE

SEQ ID NO: 2340367 - protein, 25 aa, Cryptosporidium parvum
SSKFQKFDITKFMKSALSSYFTDQA

SEQ ID NO: 2340368 - protein, 23 aa, Cryptosporidium parvum
SSKLFVRRALSEPPLRNKPSSNL

SEQ ID NO: 2340369 - protein, 20 aa, Cryptosporidium parvum
SSLLELHLPRSQRKYSFKFS

SEQ ID NO: 2340370 - protein, 25 aa, Cryptosporidium parvum
SSNTRFQINLPFYDKMDLEKYNIYC

SEQ ID NO: 2340371 - protein, 17 aa, Cryptosporidium parvum
SSPEEWWDHGPAQLFKQ

SEQ ID NO: 2340372 - protein, 21 aa, Cryptosporidium parvum
SSPVLECPPGYSLETGKQCVR

SEQ ID NO: 2340373 - protein, 21 aa, Cryptosporidium parvum
SSQAMLFFNVRMPNFKHITES

SEQ ID NO: 2340374 - protein, 37 aa, Cryptosporidium parvum
SSQFVEFLLELIELIQSIIYLITSYNLEISISDGFSS

SEQ ID NO: 2340375 - protein, 18 aa, Cryptosporidium parvum
SSQMALISVIKRLRLIYN

SEQ ID NO: 2340376 - protein, 33 aa, Cryptosporidium parvum
SSQNCFYDSVYEMCLFDCTLLNKKDACEEYLEC

SEQ ID NO: 2340377 - protein, 23 aa, Cryptosporidium parvum
SSSIPFHLVCHVFESMKASLQKN

SEQ ID NO: 2340378 - protein, 23 aa, Cryptosporidium parvum
SSSSYEYFLLHNTIIYLEETTLD

SEQ ID NO: 2340379 - protein, 23 aa, Cryptosporidium parvum
SSTDWIPCCLPGYGNYTVSLHDS

SEQ ID NO: 2340380 - protein, 21 aa, Cryptosporidium parvum
SSTSEPIPIPVRPGSNQGQST

SEQ ID NO: 2340381 - protein, 18 aa, Cryptosporidium parvum
STEKAWYVFLKASTPSNS

SEQ ID NO: 2340382 - protein, 25 aa, Cryptosporidium parvum
STKNKLSLLALGGCGLNPCLSVGLI

SEQ ID NO: 2340383 - protein, 26 aa, Cryptosporidium parvum
STNSQRRMWAPPSQLQPYDVGDTASR

SEQ ID NO: 2340384 - protein, 41 aa, Cryptosporidium parvum
STPTIPPPTLPPPTLPPPTLPPPTLPPPTLPPTPTPTPPTP

SEQ ID NO: 2340385 - protein, 21 aa, Cryptosporidium parvum
STRWWSTILHTFTNFGKKPIT

SEQ ID NO: 2340386 - protein, 30 aa, Cryptosporidium parvum
STSLPSKAILPGGAFLPLGGVLTGDILYPS

SEQ ID NO: 2340387 - protein, 17 aa, Cryptosporidium parvum
STWRKKVYYDEVFSYIN

SEQ ID NO: 2340388 - protein, 20 aa, Cryptosporidium parvum
STYLFKATSFPFKISVDYSE

SEQ ID NO: 2340389 - protein, 21 aa, Cryptosporidium parvum
STYSFFPSNLYNKIINKFSKL

SEQ ID NO: 2340390 - protein, 17 aa, Cryptosporidium parvum
SVFAFLALFSTSVESVK

SEQ ID NO: 2340391 - protein, 18 aa, Cryptosporidium parvum
SVFILASKIHCSSFRSFS

SEQ ID NO: 2340392 - protein, 18 aa, Cryptosporidium parvum
SVFNRLLNLLKSLTVIEV

SEQ ID NO: 2340393 - protein, 22 aa, Cryptosporidium parvum
SVFSALLLGLNSPVYAITTESN

SEQ ID NO: 2340394 - protein, 25 aa, Cryptosporidium parvum
SVKIPPFVLSKFYGSPTYCVLRAFI

SEQ ID NO: 2340395 - protein, 18 aa, Cryptosporidium parvum
SVLIFCNSSLESIPRFQL

SEQ ID NO: 2340396 - protein, 24 aa, Cryptosporidium parvum
SVNGLLKYRVSIWGIPLSSYKTNH

SEQ ID NO: 2340397 - protein, 18 aa, Cryptosporidium parvum
SVRSRLLKKISDLNFVEV

SEQ ID NO: 2340398 - protein, 26 aa, Cryptosporidium parvum
SVSKLKLILLYIDKHSRFSDKKKMIS

SEQ ID NO: 2340399 - protein, 27 aa, Cryptosporidium parvum
SVTLPPGTFIFGALLTPNVQLGGPSLV

SEQ ID NO: 2340400 - protein, 18 aa, Cryptosporidium parvum
SWAYKLLHRQSIIAYLQG

SEQ ID NO: 2340401 - protein, 21 aa, Cryptosporidium parvum
SWHHVRILLTGSRIQIWVGTE

SEQ ID NO: 2340402 - protein, 22 aa, Cryptosporidium parvum
SWLISTIIETYWTRGIDQQTIQ

SEQ ID NO: 2340403 - protein, 31 aa, Cryptosporidium parvum; identical to SEQ ID NO: 2210627

SEQ ID NO: 2340404 - protein, 25 aa, Cryptosporidium parvum
SYGHRLDLLPKKRTHPITWQLIMGV

SEQ ID NO: 2340405 - protein, 19 aa, Cryptosporidium parvum
SYIILSYNKELFSKNLLLH

SEQ ID NO: 2340406 - protein, 19 aa, Cryptosporidium parvum
SYPGAILEFERNRQWGVIA

SEQ ID NO: 2340407 - protein, 18 aa, Cryptosporidium parvum
SYPIRGELLIRGTTIFKG

SEQ ID NO: 2340408 - protein, 26 aa, Cryptosporidium parvum
SYQYAEPYLQLVLAKTTVVGCSFQTN

SEQ ID NO: 2340409 - protein, 21 aa, Cryptosporidium parvum
SYYHLKYGRKLPPKSQLPCSW

SEQ ID NO: 2340410 - protein, 17 aa, Cryptosporidium parvum
TAIIFTKDSGPFETLPL

SEQ ID NO: 2340411 - protein, 22 aa, Cryptosporidium parvum
TAIWDLKMKKSAISFRDPAQRS

SEQ ID NO: 2340412 - protein, 31 aa, Cryptosporidium parvum; identical to SEQ ID NO: 2210636

SEQ ID NO: 2340413 - protein, 20 aa, Cryptosporidium parvum
TARLISKYRPSQTIIACTAK

SEQ ID NO: 2340414 - protein, 20 aa, Cryptosporidium parvum
TAYLILARISFGFGEELRLS

SEQ ID NO: 2340415 - protein, 34 aa, Cryptosporidium parvum; identical to SEQ ID NO: 2210638

SEQ ID NO: 2340416 - protein, 18 aa, Cryptosporidium parvum
TCIAIYRAKRRKFQTFDN

SEQ ID NO: 2340417 - protein, 22 aa, Cryptosporidium parvum
TCIIFLTIIRVLIFNAHVVACK

SEQ ID NO: 2340418 - protein, 22 aa, Cryptosporidium parvum
TCIKFLLSIYLGESLKVLPTNT

SEQ ID NO: 2340419 - protein, 24 aa, Cryptosporidium parvum
TCLTLLIVTYITLFISLNNEIGNH

SEQ ID NO: 2340420 - protein, 24 aa, Cryptosporidium parvum
TCTDLGFFFASFTNRFSIFPPTAY

SEQ ID NO: 2340421 - protein, 23 aa, Cryptosporidium parvum
TDFVIEIFKKCAENYPLSGGIPI

SEQ ID NO: 2340422 - protein, 31 aa, Cryptosporidium parvum
TDLFREKYRYILNYLGYYYKIYQDFKEKKKI

SEQ ID NO: 2340423 - protein, 29 aa, Cryptosporidium parvum
TECLTALLLGPLFRWDYYPFEAAPENTEN

SEQ ID NO: 2340424 - protein, 17 aa, Cryptosporidium parvum
TEDVIVLPVPREVEVTS

SEQ ID NO: 2340425 - protein, 24 aa, Cryptosporidium parvum
TENYAMYNILFNDTNYNGAFNILN

SEQ ID NO: 2340426 - protein, 30 aa, Cryptosporidium parvum
TESILISLLERLFKCILSRKIKKYSKSSGY

SEQ ID NO: 2340427 - protein, 24 aa, Cryptosporidium parvum
TETFINEFTKYRPKIRELINFGQE

SEQ ID NO: 2340428 - protein, 21 aa, Cryptosporidium parvum
TETVLLLLVLLILSHNGTSAL

SEQ ID NO: 2340429 - protein, 23 aa, Cryptosporidium parvum
TEVSPLLPNDFYPAVEKLDFEYQ

SEQ ID NO: 2340430 - protein, 17 aa, Cryptosporidium parvum
TEYLSYLLKYNDNGPNR

SEQ ID NO: 2340431 - protein, 26 aa, Cryptosporidium parvum
TFDQFYKYWQYFGSSSKLFISYQSQN

SEQ ID NO: 2340432 - protein, 23 aa, Cryptosporidium parvum
TFFLYIFYLLSGSGILGQIQKDM

SEQ ID NO: 2340433 - protein, 20 aa, Cryptosporidium parvum
TFILLFNLLNLHSKHCIFSL

SEQ ID NO: 2340434 - protein, 23 aa, Cryptosporidium parvum
TFKEGWTLFVILSTGVPDYDETK

SEQ ID NO: 2340435 - protein, 24 aa, Cryptosporidium parvum
TFKLFFEILFFALASALDLDLNKS

SEQ ID NO: 2340436 - protein, 18 aa, Cryptosporidium parvum
TFLKDFICYSYLGGWIIY

SEQ ID NO: 2340437 - protein, 20 aa, Cryptosporidium parvum
TFVKMFGCKIYRSVPNVLEI

SEQ ID NO: 2340438 - protein, 26 aa, Cryptosporidium parvum
TGEGVPDLIYLIAQLTQNYMGLHCLQ

SEQ ID NO: 2340439 - protein, 29 aa, Cryptosporidium parvum
TGGNSAMILYIFWRLFEFSYMNFDKTLPD

SEQ ID NO: 2340440 - protein, 20 aa, Cryptosporidium parvum
TGMSRGRSRNRRFKFRFGEV

SEQ ID NO: 2340441 - protein, 24 aa, Cryptosporidium parvum
THFNFRYTGTGTSPCYLILGEIGC

SEQ ID NO: 2340442 - protein, 26 aa, Cryptosporidium parvum
TIASEYPWGFCPFPCGGFGNITSIVQ

SEQ ID NO: 2340443 - protein, 26 aa, Cryptosporidium parvum
TIEDFDWIHIFLKNMHLTEAAQINSI

SEQ ID NO: 2340444 - protein, 19 aa, Cryptosporidium parvum
TIHHPIDIFKIFFADENEL

SEQ ID NO: 2340445 - protein, 21 aa, Cryptosporidium parvum
TIIMMAMLPLSCYAGDHHHHH

SEQ ID NO: 2340446 - protein, 26 aa, Cryptosporidium parvum
TIKQLKRLIAWRRSYIPSSIHLEIIG

SEQ ID NO: 2340447 - protein, 17 aa, Cryptosporidium parvum
TINFLEIEKIFLTVFES

SEQ ID NO: 2340448 - protein, 22 aa, Cryptosporidium parvum
TIPDIFIYEFANLINTLFPGII

SEQ ID NO: 2340449 - protein, 17 aa, Cryptosporidium parvum
TIPKYRGCYVKGILQPS

SEQ ID NO: 2340450 - protein, 42 aa, Cryptosporidium parvum
TISKEDIETWMNLPLKLKLPVINYYFLLVATMGQSSEKEDRH

SEQ ID NO: 2340451 - protein, 19 aa, Cryptosporidium parvum
TISTYLTFSNNFLGGCYYN

SEQ ID NO: 2340452 - protein, 21 aa, Cryptosporidium parvum
TISVIPWKVIDNTILNLVPEI

SEQ ID NO: 2340453 - protein, 18 aa, Cryptosporidium parvum
TITSSPRLLCPEDYILQY

SEQ ID NO: 2340454 - protein, 17 aa, Cryptosporidium parvum
TIVLAFALIKDTRSQDV

SEQ ID NO: 2340455 - protein, 26 aa, Cryptosporidium parvum
TKCFLLILFFNLATFFLVHVVVSEST

SEQ ID NO: 2340456 - protein, 26 aa, Cryptosporidium parvum
TKKEEECFRFFPTYFSELGETELTGK

SEQ ID NO: 2340457 - protein, 24 aa, Cryptosporidium parvum
TKLKDIFIEWKYPAIDFNIDLSEN

SEQ ID NO: 2340458 - protein, 22 aa, Cryptosporidium parvum
TKLMKLLKKLIFREKNKDLRRS

SEQ ID NO: 2340459 - protein, 27 aa, Cryptosporidium parvum
TKLVERLKILLLYLKQEIIGKSSSSYE

SEQ ID NO: 2340460 - protein, 20 aa, Cryptosporidium parvum
TKNFGFLSSELARTLTIKLL

SEQ ID NO: 2340461 - protein, 25 aa, Cryptosporidium parvum
TKRCIDLMHYFALARGVRSPTQSQF

SEQ ID NO: 2340462 - protein, 17 aa, Cryptosporidium parvum
TKSWWLNISKLSDPTIN

SEQ ID NO: 2340463 - protein, 24 aa, Cryptosporidium parvum
TLADALLGFNLPLKYIDGKNINIE

SEQ ID NO: 2340464 - protein, 22 aa, Cryptosporidium parvum
TLEQFGVTVSALKSLLSSNSEK

SEQ ID NO: 2340465 - protein, 24 aa, Cryptosporidium parvum
TLEWNIIQSRWELLKMKHFYIEKK

SEQ ID NO: 2340466 - protein, 22 aa, Cryptosporidium parvum
TLFALLFGYISFIGGFEPWGAQ

SEQ ID NO: 2340467 - protein, 26 aa, Cryptosporidium parvum
TLFFFLLLQFSKYALCEVNTITYSEN

SEQ ID NO: 2340468 - protein, 20 aa, Cryptosporidium parvum
TLIKPEMLIPYLRGSHKTIR

SEQ ID NO: 2340469 - protein, 26 aa, Cryptosporidium parvum
TLIYNEEIFLLNKLLLINSNGEISTT

SEQ ID NO: 2340470 - protein, 20 aa, Cryptosporidium parvum
TLKSLLENMLIFSGIARNSL

SEQ ID NO: 2340471 - protein, 29 aa, Cryptosporidium parvum
TLNYEAKILASILFYYSNLLNIPITTEDA

SEQ ID NO: 2340472 - protein, 23 aa, Cryptosporidium parvum
TLPSGKIFLPYSKYGYPKISSNL

SEQ ID NO: 2340473 - protein, 26 aa, Cryptosporidium parvum
TLVTILFLIFMKKAKIVMADLTFMYD

SEQ ID NO: 2340474 - protein, 23 aa, Cryptosporidium parvum
TMECPPGYYRPQAGVAIRSHGHK

SEQ ID NO: 2340475 - protein, 26 aa, Cryptosporidium parvum
TNAIGIFGFQLQLAGVVFAIKSAKIY

SEQ ID NO: 2340476 - protein, 23 aa, Cryptosporidium parvum
TNELELLLDKLKFLLDLQLNRHN

SEQ ID NO: 2340477 - protein, 28 aa, Cryptosporidium parvum
TNFSTLLRIKPILLYWQDEGIVNQYPLR

SEQ ID NO: 2340478 - protein, 27 aa, Cryptosporidium parvum
TNKNFVSIFVPRLIDFTLKGKQGLVTL

SEQ ID NO: 2340479 - protein, 24 aa, Cryptosporidium parvum
TNKYKPFGFMPIPEDEWGAVVSWI

SEQ ID NO: 2340480 - protein, 26 aa, Cryptosporidium parvum
TNLNPKLRLTYFNGLPYPYHMNNEDL

SEQ ID NO: 2340481 - protein, 29 aa, Cryptosporidium parvum
TNLNSKLIRLEDFPCIIFSQNCFPTSNNK

SEQ ID NO: 2340482 - protein, 27 aa, Cryptosporidium parvum
TNPLKSAQYIWLIARMKFNVFILEAES

SEQ ID NO: 2340483 - protein, 21 aa, Cryptosporidium parvum
TNRFSIFPPTAYAGRIRIVEI

SEQ ID NO: 2340484 - protein, 29 aa, Cryptosporidium parvum
TNRMNIRKWILFYLNENLNLDYAITWAIN

SEQ ID NO: 2340485 - protein, 28 aa, Cryptosporidium parvum
TNTAKFKYLMQVLLRYKPNPYSQNAYPL

SEQ ID NO: 2340486 - protein, 23 aa, Cryptosporidium parvum
TPDSEMYSIWKLFNSKIQPTEVA

SEQ ID NO: 2340487 - protein, 23 aa, Cryptosporidium parvum
TPGERLVSMFRKSKISKCSKKTS

SEQ ID NO: 2340488 - protein, 19 aa, Cryptosporidium parvum
TPILRLIQVIKEETLPKGS

SEQ ID NO: 2340489 - protein, 22 aa, Cryptosporidium parvum
TPLSNFSIPCKEAIYLGDIPKL

SEQ ID NO: 2340490 - protein, 17 aa, Cryptosporidium parvum
TPYPIATYGYLFGLVNS

SEQ ID NO: 2340491 - protein, 17 aa, Cryptosporidium parvum
TQHLLIEKFPGLVIQSV

SEQ ID NO: 2340492 - protein, 21 aa, Cryptosporidium parvum
TQINGRLSENWKFPPILGNLF

SEQ ID NO: 2340493 - protein, 44 aa, Cryptosporidium parvum
TQKEEYRFKIHGKLNFLLPLKHDRLFLNKLLKSFYKSINDREKE

SEQ ID NO: 2340494 - protein, 25 aa, Cryptosporidium parvum
TQLRPELKVVKRTKPLISKFPIEEG

SEQ ID NO: 2340495 - protein, 21 aa, Cryptosporidium parvum
TQLTSLYRKNLLKYKQINNKS

SEQ ID NO: 2340496 - protein, 24 aa, Cryptosporidium parvum
TQPKPFKMYLVSLSIQCGDEFFKP

SEQ ID NO: 2340497 - protein, 20 aa, Cryptosporidium parvum
TQQHICEGIYLLNTYRGEGD

SEQ ID NO: 2340498 - protein, 33 aa, Cryptosporidium parvum
TQYKWRTSFLNLFTTFFLCFHFARLAEHNFQNE

SEQ ID NO: 2340499 - protein, 20 aa, Cryptosporidium parvum
TRFQVLSIILLLIHGFCNKS

SEQ ID NO: 2340500 - protein, 18 aa, Cryptosporidium parvum
TRGPGCKTPFVTFDLKLI

SEQ ID NO: 2340501 - protein, 23 aa, Cryptosporidium parvum
TRIPKIQALIKEFFDGKEPNRGI

SEQ ID NO: 2340502 - protein, 19 aa, Cryptosporidium parvum
TRKFKKIYPGNGLLHSLLI

SEQ ID NO: 2340503 - protein, 30 aa, Cryptosporidium parvum
TRKSLFYCIKIIILSYYKSSIQQFTGISYI

SEQ ID NO: 2340504 - protein, 20 aa, Cryptosporidium parvum
TSCFLIFTIILCCNICFTFE

SEQ ID NO: 2340505 - protein, 20 aa, Cryptosporidium parvum
TSFSLLEIFKKKSKRNKKQT

SEQ ID NO: 2340506 - protein, 26 aa, Cryptosporidium parvum
TSLPLPVEFWRTIFVQQLHSFNLYSK

SEQ ID NO: 2340507 - protein, 21 aa, Cryptosporidium parvum
TSNFAFRYLVSRVFGPKAGEA

SEQ ID NO: 2340508 - protein, 33 aa, Cryptosporidium parvum
TSNLDVSLFYDKRLRSWIFGDLENIGYNTEESI

SEQ ID NO: 2340509 - protein, 25 aa, Cryptosporidium parvum
TSNNDLMYKWRLLSNDISVYEISVF

SEQ ID NO: 2340510 - protein, 32 aa, Cryptosporidium parvum; identical to SEQ ID NO: 2210704

SEQ ID NO: 2340511 - protein, 19 aa, Cryptosporidium parvum
TSPIFNLKLEIVTMIIFYS

SEQ ID NO: 2340512 - protein, 23 aa, Cryptosporidium parvum
TSQPPPPPPPPSLPPPVVCKKCN

SEQ ID NO: 2340513 - protein, 22 aa, Cryptosporidium parvum
TSRMEFFDYLLNGSMRPPTYSC

SEQ ID NO: 2340514 - protein, 20 aa, Cryptosporidium parvum
TSSIKLFKLEPKLLPQRNVL

SEQ ID NO: 2340515 - protein, 19 aa, Cryptosporidium parvum
TSVFFQNLVIVCGRSSLGN

SEQ ID NO: 2340516 - protein, 30 aa, Cryptosporidium parvum; identical to SEQ ID NO: 2210710

SEQ ID NO: 2340517 - protein, 25 aa, Cryptosporidium parvum
TTAKLEKFIKPLNLIMKCSVVKETS

SEQ ID NO: 2340518 - protein, 34 aa, Cryptosporidium parvum; identical to SEQ ID NO: 2210713

SEQ ID NO: 2340519 - protein, 27 aa, Cryptosporidium parvum
TTFKQGWTLFILISTGIPIRDPNNVNN

SEQ ID NO: 2340520 - protein, 23 aa, Cryptosporidium parvum
TTFLVLTLSLLAGFVFGTNENPN

SEQ ID NO: 2340521 - protein, 32 aa, Cryptosporidium parvum
TTKTYHPELKYFNSYLYFPSSIVPAPIDGNEA

SEQ ID NO: 2340522 - protein, 24 aa, Cryptosporidium parvum
TTLLISLLIIYINVSWSNKYITPE

SEQ ID NO: 2340523 - protein, 21 aa, Cryptosporidium parvum
TTLPNGLRKDLFPYVIEHNKI

SEQ ID NO: 2340524 - protein, 19 aa, Cryptosporidium parvum
TTLPPWFETIYDECQLQTS

SEQ ID NO: 2340525 - protein, 24 aa, Cryptosporidium parvum
TTSTEMLKLVLLNGTEYALVNNET

SEQ ID NO: 2340526 - protein, 37 aa, Cryptosporidium parvum
TTTNNPESLLLLSRLTTKAPPKFLISSIKASSNSTLE

SEQ ID NO: 2340527 - protein, 26 aa, Cryptosporidium parvum
TTTPMPPTIPMRPPPRPPRPSRPPPP

SEQ ID NO: 2340528 - protein, 25 aa, Cryptosporidium parvum
TTYIPSWYHKPCGVNFTFSGKLVSF

SEQ ID NO: 2340529 - protein, 23 aa, Cryptosporidium parvum
TVACFVFFFYSKEINAAELPNSS

SEQ ID NO: 2340530 - protein, 25 aa, Cryptosporidium parvum
TVDSLDYLDFCKIGIWYSKEISNLE

SEQ ID NO: 2340531 - protein, 22 aa, Cryptosporidium parvum
TVEAFAKVIYKLNQFTVLESCT

SEQ ID NO: 2340532 - protein, 19 aa, Cryptosporidium parvum
TVFKIIVDGRLFLNMNMTF

SEQ ID NO: 2340533 - protein, 25 aa, Cryptosporidium parvum
TVGEYYYLTNYYSLSKELFVKINSF

SEQ ID NO: 2340534 - protein, 17 aa, Cryptosporidium parvum
TVGFVLISIYLNASNDA

SEQ ID NO: 2340535 - protein, 21 aa, Cryptosporidium parvum
TVLIAFEFCSVASNGLVGRDH

SEQ ID NO: 2340536 - protein, 17 aa, Cryptosporidium parvum
TVLLLIGLLVNNEKNSI

SEQ ID NO: 2340537 - protein, 42 aa, Cryptosporidium parvum
TVQTTATFEFLYRMIDPRIKDAPYKISLMKYTYSALSSQSKV

SEQ ID NO: 2340538 - protein, 20 aa, Cryptosporidium parvum
TWLSLFAHYAKLQMDSIDFS

SEQ ID NO: 2340539 - protein, 26 aa, Cryptosporidium parvum
TWYLELIHCMYLGMAPKFLGMVFSYS

SEQ ID NO: 2340540 - protein, 25 aa, Cryptosporidium parvum
TYCNDFLPIIIQLKNIPDFVPDESL

SEQ ID NO: 2340541 - protein, 27 aa, Cryptosporidium parvum
TYFNASYTPLVLPFEVLDLNMSVHRSL

SEQ ID NO: 2340542 - protein, 20 aa, Cryptosporidium parvum
TYILCKVESNCMVSSWSDWS

SEQ ID NO: 2340543 - protein, 29 aa, Cryptosporidium parvum
TYKLSVVLNSLHNLLLTAFNHFKYDPELD

SEQ ID NO: 2340544 - protein, 26 aa, Cryptosporidium parvum
TYQSSNGYIIMLLVSTEQMVNDSIFG

SEQ ID NO: 2340545 - protein, 20 aa, Cryptosporidium parvum
TYSLLFTFLESVIFCQEIDK

SEQ ID NO: 2340546 - protein, 17 aa, Cryptosporidium parvum
TYVICHYDFGNLGYIPY

SEQ ID NO: 2340547 - protein, 19 aa, Cryptosporidium parvum
VADRKERMLELLKLESFLI

SEQ ID NO: 2340548 - protein, 26 aa, Cryptosporidium parvum
VAHRYMGRLVEWFNIIQASLDDDIIK

SEQ ID NO: 2340549 - protein, 26 aa, Cryptosporidium parvum
VAKSRPYLLPPNTPIEYLTIKKFLQD

SEQ ID NO: 2340550 - protein, 17 aa, Cryptosporidium parvum
VCKVLNSVTIGERKNMN

SEQ ID NO: 2340551 - protein, 19 aa, Cryptosporidium parvum
VCLVLQFTNPKVECPPGLS

SEQ ID NO: 2340552 - protein, 18 aa, Cryptosporidium parvum
VCRQVWRESYTEMVRFYK

SEQ ID NO: 2340553 - protein, 17 aa, Cryptosporidium parvum
VCVILYLIHDTIEANSI

SEQ ID NO: 2340554 - protein, 23 aa, Cryptosporidium parvum
VDDPEIWTMWKAIITQKDRDLNM

SEQ ID NO: 2340555 - protein, 23 aa, Cryptosporidium parvum
VDFEFQIPCTFYSPIITVSVPKS

SEQ ID NO: 2340556 - protein, 18 aa, Cryptosporidium parvum
VDFRVYLGDLGLPHLFDL

SEQ ID NO: 2340557 - protein, 21 aa, Cryptosporidium parvum
VDIFSFFNIVNLDFLEITEVS

SEQ ID NO: 2340558 - protein, 32 aa, Cryptosporidium parvum; identical to SEQ ID NO: 2210741

SEQ ID NO: 2340559 - protein, 22 aa, Cryptosporidium parvum
VDPDVPLIWSAENKDYFASGYS

SEQ ID NO: 2340560 - protein, 33 aa, Cryptosporidium parvum; identical to SEQ ID NO: 2210744

SEQ ID NO: 2340561 - protein, 20 aa, Cryptosporidium parvum
VEAPLKVYTPKKPSLDAFKT

SEQ ID NO: 2340562 - protein, 19 aa, Cryptosporidium parvum
VECDILYNLIKLFIDDRMA

SEQ ID NO: 2340563 - protein, 23 aa, Cryptosporidium parvum
VEEKYIEHCLFLLQLYAKKKSIQ

SEQ ID NO: 2340564 - protein, 24 aa, Cryptosporidium parvum
VEICRRFLVSPLIGIARDVRSYFL

SEQ ID NO: 2340565 - protein, 25 aa, Cryptosporidium parvum
VENANLEIFLWFSPDEIYSYQRAID

SEQ ID NO: 2340566 - protein, 31 aa, Cryptosporidium parvum
VESLLDISPPYYIHSVLAGIPNIFSDRFLAK

SEQ ID NO: 2340567 - protein, 26 aa, Cryptosporidium parvum
VESLSLLFIVLLVHLNGVKSQIYGSA

SEQ ID NO: 2340568 - protein, 20 aa, Cryptosporidium parvum
VEVAKILYWRIKTDAELSAF

SEQ ID NO: 2340569 - protein, 21 aa, Cryptosporidium parvum
VFEYSFFPQCPNGIIGGIIHY

SEQ ID NO: 2340570 - protein, 19 aa, Cryptosporidium parvum
VFFCLIINLCFGSESTGVP

SEQ ID NO: 2340571 - protein, 20 aa, Cryptosporidium parvum
VFFIILNVFLQLSENGDRLS

SEQ ID NO: 2340572 - protein, 25 aa, Cryptosporidium parvum
VFGEIETLFLWIKSQEFEKLLDKLD

SEQ ID NO: 2340573 - protein, 23 aa, Cryptosporidium parvum
VFIAVPRLFTRIYKGKVLQEVRK

SEQ ID NO: 2340574 - protein, 20 aa, Cryptosporidium parvum
VFISGLRYQLELSTGIFINN

SEQ ID NO: 2340575 - protein, 17 aa, Cryptosporidium parvum
VFISRSISILIYQNKII

SEQ ID NO: 2340576 - protein, 25 aa, Cryptosporidium parvum
VFKMPEFNWNLFSEKLVFTSKNFLG

SEQ ID NO: 2340577 - protein, 20 aa, Cryptosporidium parvum
VFLIFLLSSTEIPSVDSKRK

SEQ ID NO: 2340578 - protein, 31 aa, Cryptosporidium parvum
VFLLLIIIVIFSFNMDDLLLEAAYNSNKSNN

SEQ ID NO: 2340579 - protein, 19 aa, Cryptosporidium parvum
VFTGFPGVYYNGALVFGPG

SEQ ID NO: 2340580 - protein, 31 aa, Cryptosporidium parvum
VGEINSEFYRYNYVLYRIRGPDCKKPCSSLD

SEQ ID NO: 2340581 - protein, 21 aa, Cryptosporidium parvum
VGLINGKWHWYTWCKRPDFNL

SEQ ID NO: 2340582 - protein, 17 aa, Cryptosporidium parvum
VGQFEKLNLYGAGSRNE

SEQ ID NO: 2340583 - protein, 23 aa, Cryptosporidium parvum
VGYFSFNHIIPNVPTFDDHQRFV

SEQ ID NO: 2340584 - protein, 28 aa, Cryptosporidium parvum
VHILILSVFCVLLFNIDLYNYCPHFEQS

SEQ ID NO: 2340585 - protein, 25 aa, Cryptosporidium parvum
VHVSKGAWNFWRSLLQQESRDQSIG

SEQ ID NO: 2340586 - protein, 26 aa, Cryptosporidium parvum
VICSFLVIFLCLGPEHVEFHLVNGNK

SEQ ID NO: 2340587 - protein, 18 aa, Cryptosporidium parvum
VIELFLKDELDLQYRSRR

SEQ ID NO: 2340588 - protein, 17 aa, Cryptosporidium parvum
VIFLSYGSIHSANNQTE

SEQ ID NO: 2340589 - protein, 25 aa, Cryptosporidium parvum
VIIDFKYLLLFFGSRMELAAEVLLA

SEQ ID NO: 2340590 - protein, 25 aa, Cryptosporidium parvum
VILPMLFELAMSYDYYFPMETVPLE

SEQ ID NO: 2340591 - protein, 22 aa, Cryptosporidium parvum
VILQIIIAIKLSVGRITINVHN

SEQ ID NO: 2340592 - protein, 19 aa, Cryptosporidium parvum
VIPSSYFYTGNPRQPLKLS

SEQ ID NO: 2340593 - protein, 21 aa, Cryptosporidium parvum
VISIPLPLFTEASNLKWRHVS

SEQ ID NO: 2340594 - protein, 20 aa, Cryptosporidium parvum
VISTRLGYISDLSAAMLVCQ

SEQ ID NO: 2340595 - protein, 32 aa, Cryptosporidium parvum
VISYFQPKSLILFTHKLLIIISQVLENLIQFD

SEQ ID NO: 2340596 - protein, 22 aa, Cryptosporidium parvum
VITFLSLSFIINQAYCIRVEPR

SEQ ID NO: 2340597 - protein, 35 aa, Cryptosporidium parvum; identical to SEQ ID NO: 2210762

SEQ ID NO: 2340598 - protein, 27 aa, Cryptosporidium parvum
VIVTINYRLGILGWLRTKNLSSGNMGF

SEQ ID NO: 2340599 - protein, 30 aa, Cryptosporidium parvum
VKAVRKIHPRHPFPLPSSPLYIKGKKFGIK

SEQ ID NO: 2340600 - protein, 18 aa, Cryptosporidium parvum
VKEFPFIINSKGPRAFFK

SEQ ID NO: 2340601 - protein, 22 aa, Cryptosporidium parvum
VKGCPYGFNLNELEQICVQENF

SEQ ID NO: 2340602 - protein, 24 aa, Cryptosporidium parvum
VKIRSLICLSFFKLMRFKEVSEEI

SEQ ID NO: 2340603 - protein, 29 aa, Cryptosporidium parvum
VKRYTSYLRGPTQRLPVSQIWRATPLENR

SEQ ID NO: 2340604 - protein, 31 aa, Cryptosporidium parvum
VKSLGGRDLLWLIWSFPARLISPVKQPLIYL

SEQ ID NO: 2340605 - protein, 41 aa, Cryptosporidium parvum
VKSSSFFNPMDLSHPFFQMKEQFFRPFRPVTTTTTTTTTTT

SEQ ID NO: 2340606 - protein, 34 aa, Cryptosporidium parvum
VKYFVDWLQISVNLIFKVILALSKSFLAYNLRNL

SEQ ID NO: 2340607 - protein, 25 aa, Cryptosporidium parvum
VLAHGKWLIKAPYPVFYPSTPLQKR

SEQ ID NO: 2340608 - protein, 21 aa, Cryptosporidium parvum
VLDELLKLRLAIISSHNLNDR

SEQ ID NO: 2340609 - protein, 20 aa, Cryptosporidium parvum
VLDIFYNLITFITNIRKEIF

SEQ ID NO: 2340610 - protein, 24 aa, Cryptosporidium parvum
VLEDDFFEKSILFAIKTYSKKSNT

SEQ ID NO: 2340611 - protein, 23 aa, Cryptosporidium parvum
VLEKIKIILKVDSNLNEIFICGD

SEQ ID NO: 2340612 - protein, 21 aa, Cryptosporidium parvum
VLFAFLFRAINIFAQNNDAKS

SEQ ID NO: 2340613 - protein, 19 aa, Cryptosporidium parvum
VLFECQFFNQCNYGNYVCQ

SEQ ID NO: 2340614 - protein, 18 aa, Cryptosporidium parvum
VLIILKTHCLNSSGNLNE

SEQ ID NO: 2340615 - protein, 20 aa, Cryptosporidium parvum
VLLLIIQLYLSRCSESSEDT

SEQ ID NO: 2340616 - protein, 18 aa, Cryptosporidium parvum
VLLNALIYDKSRLQEELS

SEQ ID NO: 2340617 - protein, 18 aa, Cryptosporidium parvum
VLPIKPSGLFRDTNECLA

SEQ ID NO: 2340618 - protein, 22 aa, Cryptosporidium parvum
VLPVLPVVPISFPQILRLNSMT

SEQ ID NO: 2340619 - protein, 26 aa, Cryptosporidium parvum
VLSKLVALKNYWKRLHKNRMKQPNNK

SEQ ID NO: 2340620 - protein, 19 aa, Cryptosporidium parvum
VLTCRKKLAACEYPTIAEE

SEQ ID NO: 2340621 - protein, 25 aa, Cryptosporidium parvum
VMEDFYSYSIFLFRQFERTNGRKKS

SEQ ID NO: 2340622 - protein, 26 aa, Cryptosporidium parvum
VMTEKEFLLYSIKLREREAYKLGFVS

SEQ ID NO: 2340623 - protein, 23 aa, Cryptosporidium parvum
VNDSIFGDYQNAWKGRHGQKDKK

SEQ ID NO: 2340624 - protein, 19 aa, Cryptosporidium parvum
VNEPTIIPEYVFPLHGNSH

SEQ ID NO: 2340625 - protein, 21 aa, Cryptosporidium parvum
VNEYLLQIYELPPSSKRSFID

SEQ ID NO: 2340626 - protein, 21 aa, Cryptosporidium parvum
VNFINSLTWILQQNNPYSDIW

SEQ ID NO: 2340627 - protein, 24 aa, Cryptosporidium parvum
VNFKPSFIFVPPTPNNRADSPRIL

SEQ ID NO: 2340628 - protein, 25 aa, Cryptosporidium parvum
VNHKKLFKILNFHVDKVIFSSLDKD

SEQ ID NO: 2340629 - protein, 19 aa, Cryptosporidium parvum
VNKQRFFPAAAIPRFDNFD

SEQ ID NO: 2340630 - protein, 24 aa, Cryptosporidium parvum
VNLPRSWYFLGEKIDEIYVSVNGF

SEQ ID NO: 2340631 - protein, 26 aa, Cryptosporidium parvum
VPNVVPEPRYIPTVKIYDSQIEDLSF

SEQ ID NO: 2340632 - protein, 27 aa, Cryptosporidium parvum
VQKNLPYYVRLLYNGLVITDKLKGCEG

SEQ ID NO: 2340633 - protein, 19 aa, Cryptosporidium parvum
VQNLYSLYLSLIEEPLTLK

SEQ ID NO: 2340634 - protein, 17 aa, Cryptosporidium parvum
VQQIFIIYPTVKAWDHL

SEQ ID NO: 2340635 - protein, 33 aa, Cryptosporidium parvum; identical to SEQ ID NO: 2210783

SEQ ID NO: 2340636 - protein, 24 aa, Cryptosporidium parvum
VQQTYVQPIPVIQEVPRKKCFDTQ

SEQ ID NO: 2340637 - protein, 32 aa, Cryptosporidium parvum
VQVGRWYRRMLRGIWLPFYTAAMFMLQNGNKV

SEQ ID NO: 2340638 - protein, 17 aa, Cryptosporidium parvum
VRDVAALNAIVKLEAEN

SEQ ID NO: 2340639 - protein, 18 aa, Cryptosporidium parvum
VRRSNWFVKHVCSFISQK

SEQ ID NO: 2340640 - protein, 17 aa, Cryptosporidium parvum
VRTKLLLSTLKQADFFV

SEQ ID NO: 2340641 - protein, 23 aa, Cryptosporidium parvum
VSAKFVFLISRQGGGKFIYTGNG

SEQ ID NO: 2340642 - protein, 18 aa, Cryptosporidium parvum
VSDKIKWSIGFGKNYLLY

SEQ ID NO: 2340643 - protein, 32 aa, Cryptosporidium parvum
VSFGSYFEKPPPLAVLPYKGFIQTGIPQIHLN

SEQ ID NO: 2340644 - protein, 23 aa, Cryptosporidium parvum
VSPYKDIFPYKDSIAFATFMGPF

SEQ ID NO: 2340645 - protein, 17 aa, Cryptosporidium parvum
VSRPIPIGGGALYLCSI

SEQ ID NO: 2340646 - protein, 45 aa, Cryptosporidium parvum
VSRYINKYMISPKKAYLIWKETLIAMNFAILPKWRDSWQDEIRKP

SEQ ID NO: 2340647 - protein, 23 aa, Cryptosporidium parvum
VSSLTLFTFNLLSQLRHFSGGNV

SEQ ID NO: 2340648 - protein, 29 aa, Cryptosporidium parvum
VSSRQNFVLFVPNYKSPFMKLSQISLEKS

SEQ ID NO: 2340649 - protein, 23 aa, Cryptosporidium parvum
VSTLWNALIFNKVGEIHPEVLSL

SEQ ID NO: 2340650 - protein, 27 aa, Cryptosporidium parvum
VSTSKYVHAFLLLYLASRFNTPEEIML

SEQ ID NO: 2340651 - protein, 23 aa, Cryptosporidium parvum
VSVFFFILPYLHATFFPQGCEIG

SEQ ID NO: 2340652 - protein, 18 aa, Cryptosporidium parvum
VTGSWHHVRILLTGSRIQ

SEQ ID NO: 2340653 - protein, 18 aa, Cryptosporidium parvum
VTTITFKVKCPVNCGSEK

SEQ ID NO: 2340654 - protein, 17 aa, Cryptosporidium parvum
VTTLDYILAFISKEKFD

SEQ ID NO: 2340655 - protein, 17 aa, Cryptosporidium parvum
VVFLTCLYDLRVFSAHP

SEQ ID NO: 2340656 - protein, 52 aa, Cryptosporidium parvum
VVGDSVSQYDLLAILFVVKTRQGEAPLVKKLPRSVPTMPIPNPTASSTTVDL

SEQ ID NO: 2340657 - protein, 25 aa, Cryptosporidium parvum
VVNNMTIFGIMKYNLLNNGNCSAKD

SEQ ID NO: 2340658 - protein, 17 aa, Cryptosporidium parvum
VVPYIKFSKPKSSKSIM

SEQ ID NO: 2340659 - protein, 23 aa, Cryptosporidium parvum
VVSQIFYGIFLQGPRVTWQSSLF

SEQ ID NO: 2340660 - protein, 19 aa, Cryptosporidium parvum
VVVFFGLVFSSVYSEENEL

SEQ ID NO: 2340661 - protein, 17 aa, Cryptosporidium parvum
VWDFVKANQIPLFGEIS

SEQ ID NO: 2340662 - protein, 17 aa, Cryptosporidium parvum
VYFTGILSEPRTVSGIV

SEQ ID NO: 2340663 - protein, 18 aa, Cryptosporidium parvum
VYHDGYRYRLNGNWYVKL

SEQ ID NO: 2340664 - protein, 19 aa, Cryptosporidium parvum
VYNNYLLIKEKHTKARRSA

SEQ ID NO: 2340665 - protein, 17 aa, Cryptosporidium parvum
VYVFFTNEEERLKQEGM

SEQ ID NO: 2340666 - protein, 18 aa, Cryptosporidium parvum
WAFVLGNEKKVFAYRTEN

SEQ ID NO: 2340667 - protein, 38 aa, Cryptosporidium parvum; identical to SEQ ID NO: 2210804

SEQ ID NO: 2340668 - protein, 17 aa, Cryptosporidium parvum
WEKLEPQSLLFLSVLMG

SEQ ID NO: 2340669 - protein, 28 aa, Cryptosporidium parvum
WENSEPHMILFRAPKYFSKFPQVFYVAC

SEQ ID NO: 2340670 - protein, 18 aa, Cryptosporidium parvum
WERIALFSKWSDFVKGIP

SEQ ID NO: 2340671 - protein, 17 aa, Cryptosporidium parvum
WFEYKFQKESDSVISLL

SEQ ID NO: 2340672 - protein, 17 aa, Cryptosporidium parvum
WFVKHVCSFISQKLNEI

SEQ ID NO: 2340673 - protein, 20 aa, Cryptosporidium parvum
WHLQYLYEDLPTQLTTPINN

SEQ ID NO: 2340674 - protein, 18 aa, Cryptosporidium parvum
WHYLELLLREVDKETFMS

SEQ ID NO: 2340675 - protein, 23 aa, Cryptosporidium parvum
WIDFSVVMDIKFRMKRRGMFLET

SEQ ID NO: 2340676 - protein, 24 aa, Cryptosporidium parvum
WKNPINFILRCRESLRVVSNGMKV

SEQ ID NO: 2340677 - protein, 17 aa, Cryptosporidium parvum
WKTYVICHYDFGNLGYI

SEQ ID NO: 2340678 - protein, 20 aa, Cryptosporidium parvum
WLALFILVAVVSFEVKYVGS

SEQ ID NO: 2340679 - protein, 25 aa, Cryptosporidium parvum
WLSQFENSWIFIPQGKAIPDNIIEN

SEQ ID NO: 2340680 - protein, 17 aa, Cryptosporidium parvum
WLYCQDLPKYLNKLDEV

SEQ ID NO: 2340681 - protein, 20 aa, Cryptosporidium parvum
WNDKYFLIDGFPRNQNNLDG

SEQ ID NO: 2340682 - protein, 19 aa, Cryptosporidium parvum
WNETLAIISIYTQPNGIRL

SEQ ID NO: 2340683 - protein, 18 aa, Cryptosporidium parvum
WNKIPFGANWYEQGFPVG

SEQ ID NO: 2340684 - protein, 24 aa, Cryptosporidium parvum
WTYNSKRRLPWSTFFSIKQNGLPT

SEQ ID NO: 2340685 - protein, 27 aa, Cryptosporidium parvum
YAEKYLIMSIGFAFKRKITRNRSTGAE

SEQ ID NO: 2340686 - protein, 19 aa, Cryptosporidium parvum
YARDDFFRNKFLQGLAEEA

SEQ ID NO: 2340687 - protein, 25 aa, Cryptosporidium parvum
YARLSDFIYLLKMILKKSKIHNSNL

SEQ ID NO: 2340688 - protein, 23 aa, Cryptosporidium parvum
YCSKIPMIPMIPTTVQQIFIIYP

SEQ ID NO: 2340689 - protein, 29 aa, Cryptosporidium parvum
YCSTYPKGYFAFWLTLDSINKKYIVSIEN

SEQ ID NO: 2340690 - protein, 28 aa, Cryptosporidium parvum
YCSTYPKGYFAFWLTYDSITNKYIISVE

SEQ ID NO: 2340691 - protein, 29 aa, Cryptosporidium parvum
YCSTYPKGYFAFWLTYDSKYNYFIISVNS

SEQ ID NO: 2340692 - protein, 30 aa, Cryptosporidium parvum
YCSTYPKGYFAFWLTYEPIRKMYSIGIENN

SEQ ID NO: 2340693 - protein, 19 aa, Cryptosporidium parvum
YCSTYPKGYFTFWLQKKFS

SEQ ID NO: 2340694 - protein, 24 aa, Cryptosporidium parvum
YDHMDLEILIGWSRLGLFLMDNNH

SEQ ID NO: 2340695 - protein, 20 aa, Cryptosporidium parvum
YDLPTFLNFVGDFSGTFSLP

SEQ ID NO: 2340696 - protein, 24 aa, Cryptosporidium parvum
YDNRFGRFKYIYPLGHAPSKVTFT

SEQ ID NO: 2340697 - protein, 32 aa, Cryptosporidium parvum
YEEFLLDRWIFSLYYQSNLSLSFTLIGLRYSF

SEQ ID NO: 2340698 - protein, 18 aa, Cryptosporidium parvum
YEGLCEKKIRRYIAHINS

SEQ ID NO: 2340699 - protein, 17 aa, Cryptosporidium parvum
YEILNAISPFDTLFLVS

SEQ ID NO: 2340700 - protein, 20 aa, Cryptosporidium parvum
YELTKNFLRKILISTRNSLF

SEQ ID NO: 2340701 - protein, 19 aa, Cryptosporidium parvum
YEQIKIPKEFKYSNGVLKK

SEQ ID NO: 2340702 - protein, 20 aa, Cryptosporidium parvum
YERTLRFLTFQAEQVDRIKQ

SEQ ID NO: 2340703 - protein, 18 aa, Cryptosporidium parvum
YETPQYVPLLLGPYGDQS

SEQ ID NO: 2340704 - protein, 27 aa, Cryptosporidium parvum
YETVWGAISVPPLITPCQFINPITLTV

SEQ ID NO: 2340705 - protein, 17 aa, Cryptosporidium parvum
YFAKFDYIQERRLYYKS

SEQ ID NO: 2340706 - protein, 24 aa, Cryptosporidium parvum
YFDDFFMVFAHNLINYRTIITNCY

SEQ ID NO: 2340707 - protein, 21 aa, Cryptosporidium parvum
YFGFLVYVIGSSVNANDLALP

SEQ ID NO: 2340708 - protein, 17 aa, Cryptosporidium parvum
YFSFYISTYSNIYKLPV

SEQ ID NO: 2340709 - protein, 18 aa, Cryptosporidium parvum
YGCYSLLGKLPRMSALSR

SEQ ID NO: 2340710 - protein, 24 aa, Cryptosporidium parvum
YGESYPFFPPGVQPAPIDGDENNT

SEQ ID NO: 2340711 - protein, 25 aa, Cryptosporidium parvum
YGHSYLLGSLFMRSYYTVYAKNIPK

SEQ ID NO: 2340712 - protein, 27 aa, Cryptosporidium parvum
YGRHYRYNWANLLGQKFFIPSNRINDE

SEQ ID NO: 2340713 - protein, 17 aa, Cryptosporidium parvum
YGTILPTGTFIADTIYL

SEQ ID NO: 2340714 - protein, 28 aa, Cryptosporidium parvum
YGVFLLTIFNILLLLKASENGKVCEPRE

SEQ ID NO: 2340715 - protein, 18 aa, Cryptosporidium parvum
YIAKKKILGLLEWNKDIL

SEQ ID NO: 2340716 - protein, 20 aa, Cryptosporidium parvum
YIFFIYQFVAAEAFTFRNRK

SEQ ID NO: 2340717 - protein, 17 aa, Cryptosporidium parvum
YIIFANIVPISSTRLLV

SEQ ID NO: 2340718 - protein, 23 aa, Cryptosporidium parvum
YILLLGIWIKTNTLVSANGAICN

SEQ ID NO: 2340719 - protein, 22 aa, Cryptosporidium parvum
YILLVILQKLSFSILSHSYNEN

SEQ ID NO: 2340720 - protein, 18 aa, Cryptosporidium parvum
YILQVLSLIAFINSLVRQ

SEQ ID NO: 2340721 - protein, 28 aa, Cryptosporidium parvum
YINGVPVYRPYAPFRYFAAETFNEMRNN

SEQ ID NO: 2340722 - protein, 18 aa, Cryptosporidium parvum
YKCGCYKGFRLNLTGPEE

SEQ ID NO: 2340723 - protein, 20 aa, Cryptosporidium parvum
YKFSNMFFVVPIYSDGNKVL

SEQ ID NO: 2340724 - protein, 22 aa, Cryptosporidium parvum
YKGAGFPVLCGESIRLLHSVTE

SEQ ID NO: 2340725 - protein, 21 aa, Cryptosporidium parvum
YKKFQLFPDFTNKSTPWISPF

SEQ ID NO: 2340726 - protein, 17 aa, Cryptosporidium parvum
YKLVKAVRKIHPRHPFP

SEQ ID NO: 2340727 - protein, 34 aa, Cryptosporidium parvum
YKNLSKIIVYFIQSYAALRYKFADKAVIENSFDE

SEQ ID NO: 2340728 - protein, 39 aa, Cryptosporidium parvum
YKRRQLFEKNLYRILPRKLWNRIHSLAAKGLHPLILAKI

SEQ ID NO: 2340729 - protein, 19 aa, Cryptosporidium parvum
YKYVDINMWSGFKYGKKLP

SEQ ID NO: 2340730 - protein, 20 aa, Cryptosporidium parvum
YLEFRFFDEVIKVGEGFKQG

SEQ ID NO: 2340731 - protein, 19 aa, Cryptosporidium parvum
YLELIHCMHFGMAPFFSGM

SEQ ID NO: 2340732 - protein, 32 aa, Cryptosporidium parvum
YLEMSPDLSLAKFLIIPLRIGKENLNEQLKLS

SEQ ID NO: 2340733 - protein, 24 aa, Cryptosporidium parvum
YLITLTFIIPFVLSQSTLLNLGAG

SEQ ID NO: 2340734 - protein, 25 aa, Cryptosporidium parvum
YLKKSKISWLMERCFIYTKKKDINN

SEQ ID NO: 2340735 - protein, 17 aa, Cryptosporidium parvum
YLLYLNVYDLNNNNKEY

SEQ ID NO: 2340736 - protein, 19 aa, Cryptosporidium parvum
YLMIHTEIWVHPEKQIREE

SEQ ID NO: 2340737 - protein, 19 aa, Cryptosporidium parvum
YLMVHNYLHIIGSIYRHTK

SEQ ID NO: 2340738 - protein, 26 aa, Cryptosporidium parvum
YLSIIFLWICFFSRNEIFVRSNNYYL

SEQ ID NO: 2340739 - protein, 19 aa, Cryptosporidium parvum
YMDTPIGNPLKLDSRTRCM

SEQ ID NO: 2340740 - protein, 21 aa, Cryptosporidium parvum
YMISIIILVVRGAPTLNVRNP

SEQ ID NO: 2340741 - protein, 17 aa, Cryptosporidium parvum
YNEYRRKYLEKNPLGPV

SEQ ID NO: 2340742 - protein, 20 aa, Cryptosporidium parvum
YNLIIELLISLLNNCDNLLK

SEQ ID NO: 2340743 - protein, 18 aa, Cryptosporidium parvum
YNLITFITNIRKEIFDQA

SEQ ID NO: 2340744 - protein, 22 aa, Cryptosporidium parvum
YNQAIQWLRLGKHIPKAVLFTN

SEQ ID NO: 2340745 - protein, 17 aa, Cryptosporidium parvum
YNQWFLRTQTCAYPSEI

SEQ ID NO: 2340746 - protein, 24 aa, Cryptosporidium parvum
YNSCMSFSFYKYLLKGALSEEQAF

SEQ ID NO: 2340747 - protein, 24 aa, Cryptosporidium parvum
YPHKNLLENFLTTGWKLSDSQAPS

SEQ ID NO: 2340748 - protein, 26 aa, Cryptosporidium parvum
YPIATYGYLFGLVNSHGLCLKLPGFE

SEQ ID NO: 2340749 - protein, 32 aa, Cryptosporidium parvum
YPNVKLRFIIRPKTLRFFPKSSYFFPENKDKL

SEQ ID NO: 2340750 - protein, 19 aa, Cryptosporidium parvum
YPPLTSELLPFQYSMAFNP

SEQ ID NO: 2340751 - protein, 17 aa, Cryptosporidium parvum
YPPPLKHSGFLTQPGHL

SEQ ID NO: 2340752 - protein, 25 aa, Cryptosporidium parvum
YPPVSGIFGIAFRVRDLSNYYLLEF

SEQ ID NO: 2340753 - protein, 29 aa, Cryptosporidium parvum
YPQSIYPGHLHRPVIPKKSVRRFYKDIEF

SEQ ID NO: 2340754 - protein, 18 aa, Cryptosporidium parvum
YPTIAEETIFITLGQYGH

SEQ ID NO: 2340755 - protein, 18 aa, Cryptosporidium parvum
YPTPFSDIPYLLKLVNVL

SEQ ID NO: 2340756 - protein, 28 aa, Cryptosporidium parvum
YQATALKNFWALLKLMVNLTECSNHYNI

SEQ ID NO: 2340757 - protein, 21 aa, Cryptosporidium parvum
YQGYPFVLLNGYLHSTLTNYC

SEQ ID NO: 2340758 - protein, 17 aa, Cryptosporidium parvum
YQQNLLNYLNKQSFNKS

SEQ ID NO: 2340759 - protein, 29 aa, Cryptosporidium parvum
YRDDIRKIFNDLYLPFLQGIHVCRSYPNT

SEQ ID NO: 2340760 - protein, 27 aa, Cryptosporidium parvum
YRMKNTLVLFYLIFSSEPEYLVSAFLL

SEQ ID NO: 2340761 - protein, 23 aa, Cryptosporidium parvum
YRNFWKRPNYVNKYRNIDSLYDY

SEQ ID NO: 2340762 - protein, 28 aa, Cryptosporidium parvum
YRNNISLHLIKPLMKISCAEYFGISVFL

SEQ ID NO: 2340763 - protein, 18 aa, Cryptosporidium parvum
YRPIRSLLIKACDDALFH

SEQ ID NO: 2340764 - protein, 24 aa, Cryptosporidium parvum
YRSCLDDLQILKQSLAASIEEFEA

SEQ ID NO: 2340765 - protein, 20 aa, Cryptosporidium parvum
YRVPEIISSLRSESNRLVFA

SEQ ID NO: 2340766 - protein, 23 aa, Cryptosporidium parvum
YRVPMDITPWRKSIPEYDYQKLS

SEQ ID NO: 2340767 - protein, 24 aa, Cryptosporidium parvum
YRWKTLSILIILFVISVDHDPARK

SEQ ID NO: 2340768 - protein, 24 aa, Cryptosporidium parvum
YRYRLNGNWYVKLGEMWYIDNSSS

SEQ ID NO: 2340769 - protein, 18 aa, Cryptosporidium parvum
YSDDGLVLPIQVLNEFIP

SEQ ID NO: 2340770 - protein, 17 aa, Cryptosporidium parvum
YSLLPKSVQIGSTVLIA

SEQ ID NO: 2340771 - protein, 21 aa, Cryptosporidium parvum
YSPYDLACPAGYALVGDKCAT

SEQ ID NO: 2340772 - protein, 25 aa, Cryptosporidium parvum
YSQLSLLLIILSPFSKIAECNNGPN

SEQ ID NO: 2340773 - protein, 25 aa, Cryptosporidium parvum
YSSDLLSMRTEWADLLFQISNNNRK

SEQ ID NO: 2340774 - protein, 17 aa, Cryptosporidium parvum
YSSLIFFQLLKKQTHDK

SEQ ID NO: 2340775 - protein, 27 aa, Cryptosporidium parvum
YSVVREVFFGIILYCLPNVSRFLHIFE

SEQ ID NO: 2340776 - protein, 21 aa, Cryptosporidium parvum
YTDYIQGNPIKYLNTIYTILT

SEQ ID NO: 2340777 - protein, 27 aa, Cryptosporidium parvum
YTEMVRFYKTFTPSTLRAIFKLSIQAD

SEQ ID NO: 2340778 - protein, 26 aa, Cryptosporidium parvum
YTKSMNLYTILLKSLLLLKNEKENVS

SEQ ID NO: 2340779 - protein, 25 aa, Cryptosporidium parvum
YTQLSVKYFPYSGEYIRLTPPVFKI

SEQ ID NO: 2340780 - protein, 18 aa, Cryptosporidium parvum
YVEKLQGIRIKEINSRRI

SEQ ID NO: 2340781 - protein, 18 aa, Cryptosporidium parvum
YVERYTFGPVFINVNEFV

SEQ ID NO: 2340782 - protein, 17 aa, Cryptosporidium parvum
YVFTRTADKWDQGCFVE

SEQ ID NO: 2340783 - protein, 22 aa, Cryptosporidium parvum
YVQNNFIRIFQKELSQYMSSLV

SEQ ID NO: 2340784 - protein, 18 aa, Cryptosporidium parvum
YWDLCSFVQEFYKFSTDL

SEQ ID NO: 2340785 - protein, 18 aa, Cryptosporidium parvum
YWDPVYFGPLSSNSSKIL

SEQ ID NO: 2340786 - protein, 19 aa, Cryptosporidium parvum
YYPIQTYVQQTYVQPIPVI

SEQ ID NO: 2340787 - protein, 25 aa, Cryptosporidium parvum
YYSNFSIPDLPPNCDWSISTLKILD

SEQ ID NO: 2340788 - protein, 21 aa, Cryptosporidium parvum
LLFIYFMFLFENVTDDFLVKK

SEQ ID NO: 2340789 - protein, 20 aa, Cryptosporidium parvum
ADTYWHLIGPYKASKIPGYV

SEQ ID NO: 2340790 - protein, 21 aa, Cryptosporidium parvum
AINEWLFLTVAYNFNEKRVVM

SEQ ID NO: 2340791 - protein, 23 aa, Cryptosporidium parvum
AKFKYLMQVLLRYKPNPYSQNAY

SEQ ID NO: 2340792 - protein, 28 aa, Cryptosporidium parvum
AKLAWLCIFLVLLFLTINQTLGSSPKKA

SEQ ID NO: 2340793 - protein, 20 aa, Cryptosporidium parvum
ALLLGPLFRWDYYPFEAAPE

SEQ ID NO: 2340794 - protein, 18 aa, Cryptosporidium parvum
ALLVFFVATNAVRIRGGE

SEQ ID NO: 2340795 - protein, 25 aa, Cryptosporidium parvum
ANLILKRIIIFWNPSLNFGVDISSK

SEQ ID NO: 2340796 - protein, 23 aa, Cryptosporidium parvum
ASNSRIVLFYWTGIKWICTRNDS

SEQ ID NO: 2340797 - protein, 17 aa, Cryptosporidium parvum
ATILLFIKEILLSFSEN

SEQ ID NO: 2340798 - protein, 24 aa, Cryptosporidium parvum
ATSFVYWHYYISLPKWVFYENWEG

SEQ ID NO: 2340799 - protein, 28 aa, Cryptosporidium parvum
AYPTPTPYPYLYPYPYHLTPFPYSPVPF

SEQ ID NO: 2340800 - protein, 24 aa, Cryptosporidium parvum
CEFSKIFEFYLISISKNIGLKSVS

SEQ ID NO: 2340801 - protein, 17 aa, Cryptosporidium parvum
CFLAFIIFFVVKVGGTN

SEQ ID NO: 2340802 - protein, 17 aa, Cryptosporidium parvum
CFRILRKLYREGSVSLR

SEQ ID NO: 2340803 - protein, 24 aa, Cryptosporidium parvum
CHILPLLLFIILAILFNSNVPSHG

SEQ ID NO: 2340804 - protein, 25 aa, Cryptosporidium parvum
CKGLFERFILRHIEWLKIIIKSIES

SEQ ID NO: 2340805 - protein, 17 aa, Cryptosporidium parvum
CLICLLNYTTFNQLGRV

SEQ ID NO: 2340806 - protein, 19 aa, Cryptosporidium parvum
CVFIIIFFGSLFSNILHIK

SEQ ID NO: 2340807 - protein, 18 aa, Cryptosporidium parvum
CVQRGFFAEALLLAVKFG

SEQ ID NO: 2340808 - protein, 19 aa, Cryptosporidium parvum
DFLIWLIAQPPKVIKFLFI

SEQ ID NO: 2340809 - protein, 18 aa, Cryptosporidium parvum
DFYFPLRPYTMVGNLIDD

SEQ ID NO: 2340810 - protein, 19 aa, Cryptosporidium parvum
DKIFPLPYNGDNFAPGLLL

SEQ ID NO: 2340811 - protein, 17 aa, Cryptosporidium parvum
DMLLFDQLPLDPQLSYT

SEQ ID NO: 2340812 - protein, 20 aa, Cryptosporidium parvum
DQFIVIVKKLKQKSNEIPTD

SEQ ID NO: 2340813 - protein, 32 aa, Cryptosporidium parvum
DSAKKIVFLALKTRIILQLLPSKYSRDYSSEE

SEQ ID NO: 2340814 - protein, 23 aa, Cryptosporidium parvum
DSVSQYDLLAILFVVKTRQGEAP

SEQ ID NO: 2340815 - protein, 17 aa, Cryptosporidium parvum
EDSFLYPINIMYLGYET

SEQ ID NO: 2340816 - protein, 24 aa, Cryptosporidium parvum
EEMDDLTIMLYLLAKEFPSKNHFA

SEQ ID NO: 2340817 - protein, 19 aa, Cryptosporidium parvum
EENFLYPNIFLFKGYETCG

SEQ ID NO: 2340818 - protein, 20 aa, Cryptosporidium parvum
EKFWYGYFFTNKDKAVLSIL

SEQ ID NO: 2340819 - protein, 18 aa, Cryptosporidium parvum
EKIKILPFWIFKVSDEFS

SEQ ID NO: 2340820 - protein, 23 aa, Cryptosporidium parvum
EKLAILMFLFQNTLYDVLPSHLN

SEQ ID NO: 2340821 - protein, 18 aa, Cryptosporidium parvum
EKLFVKNFIKFLVLLQSK

SEQ ID NO: 2340822 - protein, 21 aa, Cryptosporidium parvum
EKLVMDLFRKYGFNAATCQAL

SEQ ID NO: 2340823 - protein, 17 aa, Cryptosporidium parvum
ELYCLLFTNSMKPNIFS

SEQ ID NO: 2340824 - protein, 23 aa, Cryptosporidium parvum
ENIPFKHILLPFTTTTTTVTTTT

SEQ ID NO: 2340825 - protein, 23 aa, Cryptosporidium parvum
ENSEPHMILFRAPKYFSKFPQVF

SEQ ID NO: 2340826 - protein, 18 aa, Cryptosporidium parvum
ENTFKIIFFWGMKDDVVP

SEQ ID NO: 2340827 - protein, 18 aa, Cryptosporidium parvum
ESLPYYIRLLYNGQVITN

SEQ ID NO: 2340828 - protein, 20 aa, Cryptosporidium parvum
ETIYSYCEFLYLQCLISGYR

SEQ ID NO: 2340829 - protein, 23 aa, Cryptosporidium parvum
ETQVYFLCLKALKSSLDKIYNSP

SEQ ID NO: 2340830 - protein, 25 aa, Cryptosporidium parvum
EYNKGMLIIPLIDLALCIKGALQLN

SEQ ID NO: 2340831 - protein, 17 aa, Cryptosporidium parvum
FAYQLIDGSLIPSSALA

SEQ ID NO: 2340832 - protein, 18 aa, Cryptosporidium parvum
FFEINGVPPLTYLSPANE

SEQ ID NO: 2340833 - protein, 21 aa, Cryptosporidium parvum
FFIIYQFFFNSFFSNRVCLFE

SEQ ID NO: 2340834 - protein, 21 aa, Cryptosporidium parvum
FGLIFLFMGCGYIGSIRVNLL

SEQ ID NO: 2340835 - protein, 18 aa, Cryptosporidium parvum
FIACILYFISLVSANGVC

SEQ ID NO: 2340836 - protein, 24 aa, Cryptosporidium parvum
FIFICIFLVFCKLPYISRCEQLES

SEQ ID NO: 2340837 - protein, 17 aa, Cryptosporidium parvum
FIIELILNQFVVFGKFR

SEQ ID NO: 2340838 - protein, 19 aa, Cryptosporidium parvum
FIIFLLSALCLAFVPNFAV

SEQ ID NO: 2340839 - protein, 18 aa, Cryptosporidium parvum
FILGFFLIFLGVHSESSL

SEQ ID NO: 2340840 - protein, 18 aa, Cryptosporidium parvum
FILGLLFSVLSSLSLTNV

SEQ ID NO: 2340841 - protein, 18 aa, Cryptosporidium parvum
FKCTKVWEYPLCGSDGIT

SEQ ID NO: 2340842 - protein, 26 aa, Cryptosporidium parvum
FKWFFIATLVFIFGLLILSCRAEEIE

SEQ ID NO: 2340843 - protein, 18 aa, Cryptosporidium parvum
FLFIIYSSSRDVETKPGI

SEQ ID NO: 2340844 - protein, 19 aa, Cryptosporidium parvum
FLIILLLSISEVYSEQNDE

SEQ ID NO: 2340845 - protein, 22 aa, Cryptosporidium parvum
FLLFIKLGVFSLTINTSPKPNP

SEQ ID NO: 2340846 - protein, 20 aa, Cryptosporidium parvum
FLLKWIIFSYIVINNINGIK

SEQ ID NO: 2340847 - protein, 20 aa, Cryptosporidium parvum
FLLLFFTKYLKITIGAEAPI

SEQ ID NO: 2340848 - protein, 19 aa, Cryptosporidium parvum
FLLLLLLVLSKQGEALKVK

SEQ ID NO: 2340849 - protein, 18 aa, Cryptosporidium parvum
FSCLIIKWNFSLSQDSLH

SEQ ID NO: 2340850 - protein, 21 aa, Cryptosporidium parvum
FSVFLSLFLAFPVRSSDEKKY

SEQ ID NO: 2340851 - protein, 17 aa, Cryptosporidium parvum
FTRFFKRLFKKPSCIKC

SEQ ID NO: 2340852 - protein, 17 aa, Cryptosporidium parvum
FTRREFLPLFSAFFQKK

SEQ ID NO: 2340853 - protein, 20 aa, Cryptosporidium parvum
FYCIKIIILSYYKSSIQQFT

SEQ ID NO: 2340854 - protein, 20 aa, Cryptosporidium parvum
FYLFTLYTSLIYPVSYGSNY

SEQ ID NO: 2340855 - protein, 18 aa, Cryptosporidium parvum
FYLIVIVGLVVSVESGDL

SEQ ID NO: 2340856 - protein, 21 aa, Cryptosporidium parvum
GAKKIILNRILFMLSANESRY

SEQ ID NO: 2340857 - protein, 23 aa, Cryptosporidium parvum
GDQIPFFLNYWTDKYTYRYWVLE

SEQ ID NO: 2340858 - protein, 24 aa, Cryptosporidium parvum
GFSLYMIFIFLLGNVASIHINREL

SEQ ID NO: 2340859 - protein, 18 aa, Cryptosporidium parvum
GGFLSRLFGFFGRNNSGK

SEQ ID NO: 2340860 - protein, 22 aa, Cryptosporidium parvum
GIPLMEWFRYSSVLKLAAEFGS

SEQ ID NO: 2340861 - protein, 19 aa, Cryptosporidium parvum
GLVSVHSLSLRAGSQELII

SEQ ID NO: 2340862 - protein, 28 aa, Cryptosporidium parvum
GRLFLPILVIFSFVWLSESVRLENYEIL

SEQ ID NO: 2340863 - protein, 18 aa, Cryptosporidium parvum
GVLFLILSWVGLVVPKLE

SEQ ID NO: 2340864 - protein, 19 aa, Cryptosporidium parvum
GWTLFILISTGIPIRDPNN

SEQ ID NO: 2340865 - protein, 30 aa, Cryptosporidium parvum
HEVDLIKPLWTMPLLLRIFLNNINLDKNNP

SEQ ID NO: 2340866 - protein, 28 aa, Cryptosporidium parvum
HISLRRKWALFCWFFSILIREISSDLPP

SEQ ID NO: 2340867 - protein, 20 aa, Cryptosporidium parvum
HPRHPFPLPSSPLYIKGKKF

SEQ ID NO: 2340868 - protein, 21 aa, Cryptosporidium parvum
HQNILSIYFFQSYLALRDLEN

SEQ ID NO: 2340869 - protein, 27 aa, Cryptosporidium parvum
HSFEIWKSFGLVLQFEFLIAMTYSIEH

SEQ ID NO: 2340870 - protein, 18 aa, Cryptosporidium parvum
HTSIMEGLYKLDYKLKFL

SEQ ID NO: 2340871 - protein, 26 aa, Cryptosporidium parvum
HYTVFERQWFFLDSWYGGLGTAARKV

SEQ ID NO: 2340872 - protein, 24 aa, Cryptosporidium parvum
ICSHPLLMPPPIYKHGRVKCIPKN

SEQ ID NO: 2340873 - protein, 19 aa, Cryptosporidium parvum
IEFKSLLFIPSHPPFDMFD

SEQ ID NO: 2340874 - protein, 25 aa, Cryptosporidium parvum
IEILIQMMLIIYTFILRCNAVFNPE

SEQ ID NO: 2340875 - protein, 23 aa, Cryptosporidium parvum
IELIQSIIYLITSYNLEISISDG

SEQ ID NO: 2340876 - protein, 18 aa, Cryptosporidium parvum
IFIFFVLFDIFATSQHEV

SEQ ID NO: 2340877 - protein, 17 aa, Cryptosporidium parvum
IFIQLSWVFGTESQNAK

SEQ ID NO: 2340878 - protein, 24 aa, Cryptosporidium parvum
IFIYTWLILFKKVDGSFLTGNNIA

SEQ ID NO: 2340879 - protein, 21 aa, Cryptosporidium parvum
IFLILIFLICQTQGISNDLSS

SEQ ID NO: 2340880 - protein, 18 aa, Cryptosporidium parvum
IFLLFLISSPFGNSVYVT

SEQ ID NO: 2340881 - protein, 17 aa, Cryptosporidium parvum
IFLLLSIIIASEAQIKL

SEQ ID NO: 2340882 - protein, 18 aa, Cryptosporidium parvum
IFLSIIILFISCSTQLEL

SEQ ID NO: 2340883 - protein, 18 aa, Cryptosporidium parvum
IHHPPKLLFFFGSINKFE

SEQ ID NO: 2340884 - protein, 19 aa, Cryptosporidium parvum
IIFSILICKVRLEVVIENE

SEQ ID NO: 2340885 - protein, 17 aa, Cryptosporidium parvum
IIIPLLYLTFNYQSTFS

SEQ ID NO: 2340886 - protein, 17 aa, Cryptosporidium parvum
IILFLILHVLIKFKHVI

SEQ ID NO: 2340887 - protein, 17 aa, Cryptosporidium parvum
IILFSFLDLIYSQVNIM

SEQ ID NO: 2340888 - protein, 19 aa, Cryptosporidium parvum
IILLLLLFINFLFLFENIT

SEQ ID NO: 2340889 - protein, 24 aa, Cryptosporidium parvum
IITNLLLILFLYKIEVFESVEIEG

SEQ ID NO: 2340890 - protein, 17 aa, Cryptosporidium parvum
IIYLFKNRLVLKGLILD

SEQ ID NO: 2340891 - protein, 22 aa, Cryptosporidium parvum
IKRTFISHILFGLASKYRIIFK

SEQ ID NO: 2340892 - protein, 21 aa, Cryptosporidium parvum
ILILWILLLTQLISECTSSSL

SEQ ID NO: 2340893 - protein, 20 aa, Cryptosporidium parvum
ILLAFFYIVFVKCDLPIHVT

SEQ ID NO: 2340894 - protein, 18 aa, Cryptosporidium parvum
ILLFYPISTSLGKESELF

SEQ ID NO: 2340895 - protein, 17 aa, Cryptosporidium parvum
ILPMLFELAMSYDYYFP

SEQ ID NO: 2340896 - protein, 22 aa, Cryptosporidium parvum
ILVLNILLFELPIVVESSSFIR

SEQ ID NO: 2340897 - protein, 27 aa, Cryptosporidium parvum
INMGLKALMGCILLISGLLSIVDESFD

SEQ ID NO: 2340898 - protein, 19 aa, Cryptosporidium parvum
INPELLFKLIQTAILKNTN

SEQ ID NO: 2340899 - protein, 24 aa, Cryptosporidium parvum
INVSSMYRLLPPGPIKYLFHFKQS

SEQ ID NO: 2340900 - protein, 24 aa, Cryptosporidium parvum
IQVLIQLVLICFFILLGQIKGDKT

SEQ ID NO: 2340901 - protein, 17 aa, Cryptosporidium parvum
IQYFLQDVLNILIPFKP

SEQ ID NO: 2340902 - protein, 19 aa, Cryptosporidium parvum
IRLLFFIFTVANAANNSDQ

SEQ ID NO: 2340903 - protein, 17 aa, Cryptosporidium parvum
IRNTLVLFIIFFIHNIN

SEQ ID NO: 2340904 - protein, 19 aa, Cryptosporidium parvum
ITLILYLVILDYCICAEFV

SEQ ID NO: 2340905 - protein, 24 aa, Cryptosporidium parvum
IVENPLFLFYKLEDKTINKVCSII

SEQ ID NO: 2340906 - protein, 23 aa, Cryptosporidium parvum
IVKLLFSYSALLLKFSYFFNENV

SEQ ID NO: 2340907 - protein, 21 aa, Cryptosporidium parvum
IWLFYLFFGPCLGLRANTTHK

SEQ ID NO: 2340908 - protein, 18 aa, Cryptosporidium parvum
IYHFLFSGGFLFPGNTLY

SEQ ID NO: 2340909 - protein, 17 aa, Cryptosporidium parvum
IYRVFLPSDILPGKNVV

SEQ ID NO: 2340910 - protein, 27 aa, Cryptosporidium parvum
KAQAITLFFFLIAFISLNEFFSEASST

SEQ ID NO: 2340911 - protein, 20 aa, Cryptosporidium parvum
KEFYLHYLAVDFSLNYSLKT

SEQ ID NO: 2340912 - protein, 17 aa, Cryptosporidium parvum
KENLIVYTILRPIPVDD

SEQ ID NO: 2340913 - protein, 18 aa, Cryptosporidium parvum
KFFPFFISKYIRSLQKSN

SEQ ID NO: 2340914 - protein, 26 aa, Cryptosporidium parvum
KFPDKLFYVIRYFNFIMILTEYLIRQ

SEQ ID NO: 2340915 - protein, 20 aa, Cryptosporidium parvum
KHDRLFLNKLLKSFYKSIND

SEQ ID NO: 2340916 - protein, 18 aa, Cryptosporidium parvum
KIKNVFGPNIFKLFKKKE

SEQ ID NO: 2340917 - protein, 24 aa, Cryptosporidium parvum
KKVKLLLILLSALAIFEFCLGTDL

SEQ ID NO: 2340918 - protein, 17 aa, Cryptosporidium parvum
KLSAAFFRFILLKFASS

SEQ ID NO: 2340919 - protein, 18 aa, Cryptosporidium parvum
KNTLVLFYLIFSSEPEYL

SEQ ID NO: 2340920 - protein, 24 aa, Cryptosporidium parvum
KQNLLVQCKILYQAFYSYKNSVRS

SEQ ID NO: 2340921 - protein, 20 aa, Cryptosporidium parvum
KSSLFIVFFFEKSSLDTILN

SEQ ID NO: 2340922 - protein, 24 aa, Cryptosporidium parvum
KYQSNFFLFKLPNSINQLNFNFIE

SEQ ID NO: 2340923 - protein, 25 aa, Cryptosporidium parvum
KYRSSILILVLVFLAILDGSFSGEE

SEQ ID NO: 2340924 - protein, 17 aa, Cryptosporidium parvum
LATLLSELLFYDWKRPD

SEQ ID NO: 2340925 - protein, 33 aa, Cryptosporidium parvum
LDSVPLIKLPNFNLPIFGIPPIPPQVLKTTSTS

SEQ ID NO: 2340926 - protein, 24 aa, Cryptosporidium parvum
LELKLIFPIPYQKNLWRYKLTEYI

SEQ ID NO: 2340927 - protein, 17 aa, Cryptosporidium parvum
LFAFLKAIYATDHRGSL

SEQ ID NO: 2340928 - protein, 18 aa, Cryptosporidium parvum
LFFFAIYIMIGISNASDM

SEQ ID NO: 2340929 - protein, 21 aa, Cryptosporidium parvum
LFFLCVLFINKFDFLIGSDTP

SEQ ID NO: 2340930 - protein, 22 aa, Cryptosporidium parvum
LFFSFIILLCEYSFSLGNIQNQ

SEQ ID NO: 2340931 - protein, 24 aa, Cryptosporidium parvum
LFLLSLWLFLCDLHNFQDYSCLRI

SEQ ID NO: 2340932 - protein, 22 aa, Cryptosporidium parvum
LFSNIIILCLYLGILKCVNSHI

SEQ ID NO: 2340933 - protein, 20 aa, Cryptosporidium parvum
LGLLFGLVSVHSLSLRAGSQ

SEQ ID NO: 2340934 - protein, 25 aa, Cryptosporidium parvum
LHALICIWLLFRIILEPVNGKNDSK

SEQ ID NO: 2340935 - protein, 18 aa, Cryptosporidium parvum
LHIFWLFTQIVLAFSAKK

SEQ ID NO: 2340936 - protein, 21 aa, Cryptosporidium parvum
LIAFFLFFGVSLIEGKNDGGI

SEQ ID NO: 2340937 - protein, 20 aa, Cryptosporidium parvum
LICILIYLNIQVTLGGDAQT

SEQ ID NO: 2340938 - protein, 18 aa, Cryptosporidium parvum
LIFAILAGYLISLSACAE

SEQ ID NO: 2340939 - protein, 20 aa, Cryptosporidium parvum
LIFSLILLYSTFQICYSEEI

SEQ ID NO: 2340940 - protein, 20 aa, Cryptosporidium parvum
LIIFVFSLSFLSFEHRNERD

SEQ ID NO: 2340941 - protein, 19 aa, Cryptosporidium parvum
LIILLLAILGVASALDGVQ

SEQ ID NO: 2340942 - protein, 20 aa, Cryptosporidium parvum
LIKTIYCQMAYFGFSSLIPN

SEQ ID NO: 2340943 - protein, 17 aa, Cryptosporidium parvum
LIKWRLELIPSILNIFQ

SEQ ID NO: 2340944 - protein, 18 aa, Cryptosporidium parvum
LILFTLAIYSQSIHANED

SEQ ID NO: 2340945 - protein, 21 aa, Cryptosporidium parvum
LILVNLLTLMLLQGHFGQIGC

SEQ ID NO: 2340946 - protein, 17 aa, Cryptosporidium parvum
LIMSIGFAFKRKITRNR

SEQ ID NO: 2340947 - protein, 23 aa, Cryptosporidium parvum
LINLCIFLLVYLQSYQSSLQELL

SEQ ID NO: 2340948 - protein, 25 aa, Cryptosporidium parvum
LISKVRQFILYLSPKPKIQSSKSSY

SEQ ID NO: 2340949 - protein, 24 aa, Cryptosporidium parvum
LKCLQFILLLLSFVSFKIFMFGMA

SEQ ID NO: 2340950 - protein, 22 aa, Cryptosporidium parvum
LKKLYLIFTIKILNINNFDANK

SEQ ID NO: 2340951 - protein, 22 aa, Cryptosporidium parvum
LKTALILLLKFIGSSGISNYQG

SEQ ID NO: 2340952 - protein, 18 aa, Cryptosporidium parvum
LLAFLSISLIVTAKDGES

SEQ ID NO: 2340953 - protein, 20 aa, Cryptosporidium parvum
LLFCYIYLVAAINGTKRKRK

SEQ ID NO: 2340954 - protein, 19 aa, Cryptosporidium parvum
LLFLFKLFDGTFGKSYYDI

SEQ ID NO: 2340955 - protein, 21 aa, Cryptosporidium parvum
LLFLILSLFNIFIQFKEAYSN

SEQ ID NO: 2340956 - protein, 18 aa, Cryptosporidium parvum
LLIKYPWLRDRVGEAIYS

SEQ ID NO: 2340957 - protein, 20 aa, Cryptosporidium parvum
LLLIFLIQISWLKNSLVLSQ

SEQ ID NO: 2340958 - protein, 22 aa, Cryptosporidium parvum
LLLLFIFFSYCMCGDMISAIIE

SEQ ID NO: 2340959 - protein, 18 aa, Cryptosporidium parvum
LLLLFKYTYGLTFFDIFY

SEQ ID NO: 2340960 - protein, 23 aa, Cryptosporidium parvum
LLLLLLLLFINFLFFFENITDNF

SEQ ID NO: 2340961 - protein, 17 aa, Cryptosporidium parvum
LLNLWFTYSFVSGNDLD

SEQ ID NO: 2340962 - protein, 22 aa, Cryptosporidium parvum
LLSIFFLNWFLIIKRIKGIDLN

SEQ ID NO: 2340963 - protein, 17 aa, Cryptosporidium parvum
LLTFFSLSELICSQINE

SEQ ID NO: 2340964 - protein, 18 aa, Cryptosporidium parvum
LLTIFYFGLSASQDLSIL

SEQ ID NO: 2340965 - protein, 20 aa, Cryptosporidium parvum
LLTVIYPFLTPPSYKKVLTP

SEQ ID NO: 2340966 - protein, 18 aa, Cryptosporidium parvum
LLTVLFIGLFNDSVSQFT

SEQ ID NO: 2340967 - protein, 25 aa, Cryptosporidium parvum
LNDGFFDIFAFYFFKDYAAIQYLLD

SEQ ID NO: 2340968 - protein, 19 aa, Cryptosporidium parvum
LNLIFLGGALVLDGVFCTD

SEQ ID NO: 2340969 - protein, 19 aa, Cryptosporidium parvum
LQYLLGVILLIGIVHALIF

SEQ ID NO: 2340970 - protein, 29 aa, Cryptosporidium parvum
LSHPFFQMKEQFFRPFRPVTTTTTTTTTT

SEQ ID NO: 2340971 - protein, 17 aa, Cryptosporidium parvum
LSIFILLIKSLDNICFA

SEQ ID NO: 2340972 - protein, 23 aa, Cryptosporidium parvum
LSPPLRYTIFIALLKLVSELTFE

SEQ ID NO: 2340973 - protein, 23 aa, Cryptosporidium parvum
LSSFLLWLVSTSFLINLARSSLI

SEQ ID NO: 2340974 - protein, 18 aa, Cryptosporidium parvum
LTLLIYTIGKPHGCEAGL

SEQ ID NO: 2340975 - protein, 19 aa, Cryptosporidium parvum
LTLQTVLFFLYFSIVKGGN

SEQ ID NO: 2340976 - protein, 18 aa, Cryptosporidium parvum
LVFAFMMSINLIGSMKSK

SEQ ID NO: 2340977 - protein, 18 aa, Cryptosporidium parvum
LVHFFRNRVVLLDPSHGL

SEQ ID NO: 2340978 - protein, 20 aa, Cryptosporidium parvum
LVLLLLQLILWITLIQELSI

SEQ ID NO: 2340979 - protein, 18 aa, Cryptosporidium parvum
LYLAIYEYLVVYSTLEDN

SEQ ID NO: 2340980 - protein, 18 aa, Cryptosporidium parvum
LYLFFLLVFTATDAFNPI

SEQ ID NO: 2340981 - protein, 23 aa, Cryptosporidium parvum
LYWEDEFILPPTQFPFIKEEKES

SEQ ID NO: 2340982 - protein, 19 aa, Cryptosporidium parvum
MEGLYKLDYKLKFLRRMLR

SEQ ID NO: 2340983 - protein, 23 aa, Cryptosporidium parvum
MEVYSRQRLLLKNYLIYSKRSET

SEQ ID NO: 2340984 - protein, 18 aa, Cryptosporidium parvum
MIHKSGCKIVPFSTLLSL

SEQ ID NO: 2340985 - protein, 20 aa, Cryptosporidium parvum
MISFLSKYRLLLKRSFDLYK

SEQ ID NO: 2340986 - protein, 19 aa, Cryptosporidium parvum
MLERRWFIVPMSLGLPIGE

SEQ ID NO: 2340987 - protein, 17 aa, Cryptosporidium parvum
MLITYKQLLLVVAFLFH

SEQ ID NO: 2340988 - protein, 23 aa, Cryptosporidium parvum
MNIRKWILFYLNENLNLDYAITW

SEQ ID NO: 2340989 - protein, 17 aa, Cryptosporidium parvum
MPSFFKMKIRRLKCLQF

SEQ ID NO: 2340990 - protein, 18 aa, Cryptosporidium parvum
MTIPLIYRVFLPSDILPG

SEQ ID NO: 2340991 - protein, 22 aa, Cryptosporidium parvum
MVFKSFYNLSLFFLKWFKTGPE

SEQ ID NO: 2340992 - protein, 19 aa, Cryptosporidium parvum
NAIGLLRYGFLYALINEIN

SEQ ID NO: 2340993 - protein, 24 aa, Cryptosporidium parvum
NAISGFYWILPRCAPEPIRVWCDI

SEQ ID NO: 2340994 - protein, 18 aa, Cryptosporidium parvum
NCYRLIRYFQKSGIPFIF

SEQ ID NO: 2340995 - protein, 21 aa, Cryptosporidium parvum
NDVFMLIYLVGRLKGYYDDWK

SEQ ID NO: 2340996 - protein, 23 aa, Cryptosporidium parvum
NEPSLWKSLPLILPKLPTYPEQI

SEQ ID NO: 2340997 - protein, 17 aa, Cryptosporidium parvum
NEVPFLTGIKLIDEIIS

SEQ ID NO: 2340998 - protein, 17 aa, Cryptosporidium parvum
NFDFYFPLRPYTMVGNL

SEQ ID NO: 2340999 - protein, 20 aa, Cryptosporidium parvum
NFMIFLDVINYILVSTLSAS

SEQ ID NO: 2341000 - protein, 17 aa, Cryptosporidium parvum
NILFPWIYNSDFSIFES

SEQ ID NO: 2341001 - protein, 24 aa, Cryptosporidium parvum
NKQKLLLLSFLFKYSMNLSLADSN

SEQ ID NO: 2341002 - protein, 19 aa, Cryptosporidium parvum
NLIFPFLKIYKKSFLNIVN

SEQ ID NO: 2341003 - protein, 18 aa, Cryptosporidium parvum
NLSLFFLKWFKTGPERGD

SEQ ID NO: 2341004 - protein, 23 aa, Cryptosporidium parvum
NNDIYFIIKLLKYVYIKEKNIHK

SEQ ID NO: 2341005 - protein, 26 aa, Cryptosporidium parvum
NNPESLLLLSRLTTKAPPKFLISSIK

SEQ ID NO: 2341006 - protein, 19 aa, Cryptosporidium parvum
NPFLVVWDPSKLSASLQAP

SEQ ID NO: 2341007 - protein, 23 aa, Cryptosporidium parvum
NRCLLLIILLIILEILCANGEGR

SEQ ID NO: 2341008 - protein, 21 aa, Cryptosporidium parvum
NSEFYRYNYVLYRIRGPDCKK

SEQ ID NO: 2341009 - protein, 32 aa, Cryptosporidium parvum
NSGFQLYIKLIPAILLWIFFLSGKVLSSNTYE

SEQ ID NO: 2341010 - protein, 21 aa, Cryptosporidium parvum
NVFLILFFQAFLVVLASTEFE

SEQ ID NO: 2341011 - protein, 20 aa, Cryptosporidium parvum
NVYIQIFRDSYVTLYTNKVV

SEQ ID NO: 2341012 - protein, 18 aa, Cryptosporidium parvum
NYCFAFVWTLWKSGNEPD

SEQ ID NO: 2341013 - protein, 19 aa, Cryptosporidium parvum
PEHFQYIFRRSYLLVYIAS

SEQ ID NO: 2341014 - protein, 21 aa, Cryptosporidium parvum
PFFLKAIIAFGFILQLSFCQL

SEQ ID NO: 2341015 - protein, 18 aa, Cryptosporidium parvum
PHLRKCVSLFILSILVFN

SEQ ID NO: 2341016 - protein, 18 aa, Cryptosporidium parvum
PPIPGMPVPWPLPTATQQ

SEQ ID NO: 2341017 - protein, 28 aa, Cryptosporidium parvum
PSPTLPKLPPLPPLPPLPPTPKAPTIPP

SEQ ID NO: 2341018 - protein, 21 aa, Cryptosporidium parvum
QDLVTLLYYQNIFLALKNLFN

SEQ ID NO: 2341019 - protein, 26 aa, Cryptosporidium parvum
QEIAKPNFFLPIDLNNPFFQMKEKFL

SEQ ID NO: 2341020 - protein, 20 aa, Cryptosporidium parvum
QGIPCIIYKLISLDFEYSGQ

SEQ ID NO: 2341021 - protein, 25 aa, Cryptosporidium parvum
QKPKKLVLPAIPYFRRPAIPKSRIN

SEQ ID NO: 2341022 - protein, 24 aa, Cryptosporidium parvum
QLFEKNLYRILPRKLWNRIHSLAA

SEQ ID NO: 2341023 - protein, 18 aa, Cryptosporidium parvum
QLFLKYRSSILILVLVFL

SEQ ID NO: 2341024 - protein, 24 aa, Cryptosporidium parvum
QLLLVVAFLFHLFLVLNAIPIIQI

SEQ ID NO: 2341025 - protein, 21 aa, Cryptosporidium parvum
QLRGILLPLVDMFQVSIGCAA

SEQ ID NO: 2341026 - protein, 26 aa, Cryptosporidium parvum
QTMCFLKRLFVLAGALFVLICLSQKA

SEQ ID NO: 2341027 - protein, 24 aa, Cryptosporidium parvum
QTTATFEFLYRMIDPRIKDAPYKI

SEQ ID NO: 2341028 - protein, 18 aa, Cryptosporidium parvum
QWADLYIILPLSANTLAK

SEQ ID NO: 2341029 - protein, 18 aa, Cryptosporidium parvum
RFLPFQWYSQYLTALANL

SEQ ID NO: 2341030 - protein, 18 aa, Cryptosporidium parvum
RGYFLFHDYFECKDLTEA

SEQ ID NO: 2341031 - protein, 18 aa, Cryptosporidium parvum
RILLLLSTVSYAYSEKKR

SEQ ID NO: 2341032 - protein, 18 aa, Cryptosporidium parvum
RILLLSFIIGAFGAPQVK

SEQ ID NO: 2341033 - protein, 19 aa, Cryptosporidium parvum
RKRKSIGLVFRKSSYTDSF

SEQ ID NO: 2341034 - protein, 25 aa, Cryptosporidium parvum
RLELIPSILNIFQSPLSKLLIEINK

SEQ ID NO: 2341035 - protein, 23 aa, Cryptosporidium parvum
RLFSYAIGICKIPSLWYLELIYC

SEQ ID NO: 2341036 - protein, 18 aa, Cryptosporidium parvum
RLSKFYEPLLKFVKDEFP

SEQ ID NO: 2341037 - protein, 24 aa, Cryptosporidium parvum
RNEGALIILFLLSPIYRVINGENF

SEQ ID NO: 2341038 - protein, 21 aa, Cryptosporidium parvum
RPYLTNFRYLKTQLYFMMLIN

SEQ ID NO: 2341039 - protein, 19 aa, Cryptosporidium parvum
RSRKCPFIIALNKIDRLYG

SEQ ID NO: 2341040 - protein, 18 aa, Cryptosporidium parvum
RVDDQFIVIVKKLKQKSN

SEQ ID NO: 2341041 - protein, 25 aa, Cryptosporidium parvum
RVNQTYFLMILSLEKLILLSHEVLL

SEQ ID NO: 2341042 - protein, 19 aa, Cryptosporidium parvum
RWIFSLYYQSNLSLSFTLI

SEQ ID NO: 2341043 - protein, 28 aa, Cryptosporidium parvum
RYAGQFLLIIFLFVFYKLAFSSEISEIS

SEQ ID NO: 2341044 - protein, 23 aa, Cryptosporidium parvum
SAMILYIFWRLFEFSYMNFDKTL

SEQ ID NO: 2341045 - protein, 18 aa, Cryptosporidium parvum
SFFTVLFNFLLLLSDQVF

SEQ ID NO: 2341046 - protein, 24 aa, Cryptosporidium parvum
SFSVKILLFFLTSGYLIFSPVVFG

SEQ ID NO: 2341047 - protein, 19 aa, Cryptosporidium parvum
SFYIQYIVYFPNTGKLFGG

SEQ ID NO: 2341048 - protein, 21 aa, Cryptosporidium parvum
SGIYFLVFSVLLTFSFNSINV

SEQ ID NO: 2341049 - protein, 20 aa, Cryptosporidium parvum
SIFCQLMCLIKLLNLFNSLN

SEQ ID NO: 2341050 - protein, 17 aa, Cryptosporidium parvum
SIFYFVLGLILDFGKVS

SEQ ID NO: 2341051 - protein, 19 aa, Cryptosporidium parvum
SIIFLWICFFSRNEIFVRS

SEQ ID NO: 2341052 - protein, 37 aa, Cryptosporidium parvum
SKEDIETWMNLPLKLKLPVINYYFLLVATMGQSSEKE

SEQ ID NO: 2341053 - protein, 23 aa, Cryptosporidium parvum
SKHFNKILNLLINSITGGGEWIN

SEQ ID NO: 2341054 - protein, 17 aa, Cryptosporidium parvum
SLAKFLIIPLRIGKENL

SEQ ID NO: 2341055 - protein, 27 aa, Cryptosporidium parvum
SLGGRDLLWLIWSFPARLISPVKQPLI

SEQ ID NO: 2341056 - protein, 22 aa, Cryptosporidium parvum
SLIVLILAIVISSNYCFGKDNT

SEQ ID NO: 2341057 - protein, 25 aa, Cryptosporidium parvum
SLKSPRWYLPNFWYYTIEEFESPVN

SEQ ID NO: 2341058 - protein, 23 aa, Cryptosporidium parvum
SLLFLFLLQFSFGSSLKSNPLGN

SEQ ID NO: 2341059 - protein, 23 aa, Cryptosporidium parvum
SLLLIRMRLLHIFWLFTQIVLAF

SEQ ID NO: 2341060 - protein, 20 aa, Cryptosporidium parvum
SLNVNLLRLYRLICKLDSIL

SEQ ID NO: 2341061 - protein, 18 aa, Cryptosporidium parvum
SLPRHSFEIWKSFGLVLQ

SEQ ID NO: 2341062 - protein, 29 aa, Cryptosporidium parvum
SLSNSLYLFLFDYKTNYWRFLTPDLSISI

SEQ ID NO: 2341063 - protein, 23 aa, Cryptosporidium parvum
SNLCTLHLLLKKYSQNRSGSPNS

SEQ ID NO: 2341064 - protein, 19 aa, Cryptosporidium parvum
SNPKNPFLVVWDPSKLSAS

SEQ ID NO: 2341065 - protein, 27 aa, Cryptosporidium parvum
SNQLLLLFFSGLFLLNYVFCINTTKIA

SEQ ID NO: 2341066 - protein, 18 aa, Cryptosporidium parvum
SPFYLPPIKYLSAPSPIS

SEQ ID NO: 2341067 - protein, 21 aa, Cryptosporidium parvum
SPHQLPLYYIVLQSLGILSDM

SEQ ID NO: 2341068 - protein, 25 aa, Cryptosporidium parvum
SPVDPFWLIQAYRMLLIYSVLLDDA

SEQ ID NO: 2341069 - protein, 22 aa, Cryptosporidium parvum
SQQFLMLFLFICTFREFSGLSF

SEQ ID NO: 2341070 - protein, 23 aa, Cryptosporidium parvum
SSKLFPIDLIPLLSGATTISFYG

SEQ ID NO: 2341071 - protein, 17 aa, Cryptosporidium parvum
SSLLRPSAPPTAPVCSS

SEQ ID NO: 2341072 - protein, 17 aa, Cryptosporidium parvum
SSNFDFYFPLRPYTMVG

SEQ ID NO: 2341073 - protein, 24 aa, Cryptosporidium parvum
SSTLYWFGYQFLFDSNPIFSLLFN

SEQ ID NO: 2341074 - protein, 19 aa, Cryptosporidium parvum
SVFSALLLGLNSPVYAITT

SEQ ID NO: 2341075 - protein, 25 aa, Cryptosporidium parvum
SVNLYRRLLYLLDLFHRGGTSFYPE

SEQ ID NO: 2341076 - protein, 19 aa, Cryptosporidium parvum
SVYEMCLFDCTLLNKKDAC

SEQ ID NO: 2341077 - protein, 17 aa, Cryptosporidium parvum
SYAALRYKFADKAVIEN

SEQ ID NO: 2341078 - protein, 18 aa, Cryptosporidium parvum
TCIIFLTIIRVLIFNAHV

SEQ ID NO: 2341079 - protein, 18 aa, Cryptosporidium parvum
TEALLFELIKFYGSYYSS

SEQ ID NO: 2341080 - protein, 22 aa, Cryptosporidium parvum
TFFLYIFYLLSGSGILGQIQKD

SEQ ID NO: 2341081 - protein, 19 aa, Cryptosporidium parvum
TFILLFNLLNLHSKHCIFS

SEQ ID NO: 2341082 - protein, 22 aa, Cryptosporidium parvum
TFKLFFEILFFALASALDLDLN

SEQ ID NO: 2341083 - protein, 18 aa, Cryptosporidium parvum
TIISSLLRPSAPPTAPVC

SEQ ID NO: 2341084 - protein, 23 aa, Cryptosporidium parvum
TKCFLLILFFNLATFFLVHVVVS

SEQ ID NO: 2341085 - protein, 23 aa, Cryptosporidium parvum
TKDALFYYPLISPTKRGIVGFCE

SEQ ID NO: 2341086 - protein, 23 aa, Cryptosporidium parvum
TLFFFLLLQFSKYALCEVNTITY

SEQ ID NO: 2341087 - protein, 24 aa, Cryptosporidium parvum
TLVTILFLIFMKKAKIVMADLTFM

SEQ ID NO: 2341088 - protein, 26 aa, Cryptosporidium parvum
TMQKSLLFLTFLYLLCSIFVGSSHSE

SEQ ID NO: 2341089 - protein, 27 aa, Cryptosporidium parvum
TNFNQWNLLILLLHLQLLIVSVRSNGD

SEQ ID NO: 2341090 - protein, 18 aa, Cryptosporidium parvum
TSCFLIFTIILCCNICFT

SEQ ID NO: 2341091 - protein, 21 aa, Cryptosporidium parvum
TTFLVLTLSLLAGFVFGTNEN

SEQ ID NO: 2341092 - protein, 21 aa, Cryptosporidium parvum
TVACFVFFFYSKEINAAELPN

SEQ ID NO: 2341093 - protein, 23 aa, Cryptosporidium parvum
VDRLLFAIPFFFKSDVFTNPFVN

SEQ ID NO: 2341094 - protein, 18 aa, Cryptosporidium parvum
VFLIFLLSSTEIPSVDSK

SEQ ID NO: 2341095 - protein, 25 aa, Cryptosporidium parvum
VFLLLIIIVIFSFNMDDLLLEAAYN

SEQ ID NO: 2341096 - protein, 18 aa, Cryptosporidium parvum
VICSFLVIFLCLGPEHVE

SEQ ID NO: 2341097 - protein, 17 aa, Cryptosporidium parvum
VITFLSLSFIINQAYCI

SEQ ID NO: 2341098 - protein, 24 aa, Cryptosporidium parvum
VKWYQDYLLQCPPFLDLKDEIFAY

SEQ ID NO: 2341099 - protein, 17 aa, Cryptosporidium parvum
VLFAFLFRAINIFAQNN

SEQ ID NO: 2341100 - protein, 22 aa, Cryptosporidium parvum
VNYILLDNFLYPNGILYLGYDT

SEQ ID NO: 2341101 - protein, 20 aa, Cryptosporidium parvum
VPYILKCESPFILDGDKCIE

SEQ ID NO: 2341102 - protein, 17 aa, Cryptosporidium parvum
VRSEPMLHLFFYNSLNK

SEQ ID NO: 2341103 - protein, 26 aa, Cryptosporidium parvum
VSKAFDFILKFNLKLFPKGSPNNGTY

SEQ ID NO: 2341104 - protein, 25 aa, Cryptosporidium parvum
VVFPCILKIIPQYIFNARDPIICGV

SEQ ID NO: 2341105 - protein, 18 aa, Cryptosporidium parvum
WAVLAWLSILAYKNPDPT

SEQ ID NO: 2341106 - protein, 17 aa, Cryptosporidium parvum
WLALFILVAVVSFEVKY

SEQ ID NO: 2341107 - protein, 20 aa, Cryptosporidium parvum
WLFLSTVTFTVLVLSISYIG

SEQ ID NO: 2341108 - protein, 18 aa, Cryptosporidium parvum
YEDIIPVRLLLLGMSPKQ

SEQ ID NO: 2341109 - protein, 17 aa, Cryptosporidium parvum
YEPLLKFVKDEFPGEFL

SEQ ID NO: 2341110 - protein, 17 aa, Cryptosporidium parvum
YFCEYLWVIAYIIEEKK

SEQ ID NO: 2341111 - protein, 18 aa, Cryptosporidium parvum
YFGFLVYVIGSSVNANDL

SEQ ID NO: 2341112 - protein, 23 aa, Cryptosporidium parvum
YGSKIFLYLLTRLQGFTQIKECL

SEQ ID NO: 2341113 - protein, 23 aa, Cryptosporidium parvum
YGVFLLTIFNILLLLKASENGKV

SEQ ID NO: 2341114 - protein, 17 aa, Cryptosporidium parvum
YIFFIYQFVAAEAFTFR

SEQ ID NO: 2341115 - protein, 21 aa, Cryptosporidium parvum
YILLLGIWIKTNTLVSANGAI

SEQ ID NO: 2341116 - protein, 18 aa, Cryptosporidium parvum
YKKFGGIFWARNIPRVSI

SEQ ID NO: 2341117 - protein, 24 aa, Cryptosporidium parvum
YLKTQLYFMMLINLNYQTSCVNKP

SEQ ID NO: 2341118 - protein, 23 aa, Cryptosporidium parvum
YNNLLLSILLKLSFYIQYIVYFP

SEQ ID NO: 2341119 - protein, 24 aa, Cryptosporidium parvum
YNPQLYLILFRDLKHIFGFGNPKI

SEQ ID NO: 2341120 - protein, 23 aa, Cryptosporidium parvum
YNSSFPFFPVGIIPAPISGNYHN

SEQ ID NO: 2341121 - protein, 23 aa, Cryptosporidium parvum
YPKGYFAFWLTYDSKYNYFIISV

SEQ ID NO: 2341122 - protein, 22 aa, Cryptosporidium parvum
YSQLSLLLIILSPFSKIAECNN

SEQ ID NO: 2341123 - protein, 25 aa, Cryptosporidium parvum
YSSDFIPRIYLLSRSIPKENFYRVP

SEQ ID NO: 2341124 - protein, 17 aa, Cryptosporidium parvum
YVRLLYNGLVITDKLKG

SEQ ID NO: 2341125 - protein, 4 aa, Cryptosporidium parvum
NKEY

SEQ ID NO: 2341126 - protein, 4 aa, Cryptosporidium parvum
TNNL

SEQ ID NO: 2341127 - protein, 6 aa, Cryptosporidium parvum
AADKVN

SEQ ID NO: 2341128 - protein, 10 aa, Cryptosporidium parvum
AADPKYTISG

SEQ ID NO: 2341129 - protein, 8 aa, Cryptosporidium parvum
AALGRRGQ

SEQ ID NO: 2341130 - protein, 7 aa, Cryptosporidium parvum
AAQQQPS

SEQ ID NO: 2341131 - protein, 7 aa, Cryptosporidium parvum
AASSQEG

SEQ ID NO: 2341132 - protein, 13 aa, Cryptosporidium parvum
ADNSNESSSIGSS

SEQ ID NO: 2341133 - protein, 5 aa, Cryptosporidium parvum
ADQSN

SEQ ID NO: 2341134 - protein, 19 aa, Cryptosporidium parvum
ADTRASSDKNSKTSESCSC

SEQ ID NO: 2341135 - protein, 7 aa, Cryptosporidium parvum
AEDGGDC

SEQ ID NO: 2341136 - protein, 12 aa, Cryptosporidium parvum
AEFNNEKDSKEL

SEQ ID NO: 2341137 - protein, 6 aa, Cryptosporidium parvum
AEGFKK

SEQ ID NO: 2341138 - protein, 8 aa, Cryptosporidium parvum
AEKDFEED

SEQ ID NO: 2341139 - protein, 4 aa, Cryptosporidium parvum
AEKR

SEQ ID NO: 2341140 - protein, 6 aa, Cryptosporidium parvum
AENDEV

SEQ ID NO: 2341141 - protein, 4 aa, Cryptosporidium parvum
AENL

SEQ ID NO: 2341142 - protein, 4 aa, Cryptosporidium parvum
AENN

SEQ ID NO: 2341143 - protein, 13 aa, Cryptosporidium parvum
AENPESENREEEA

SEQ ID NO: 2341144 - protein, 24 aa, Cryptosporidium parvum
AENTSNSKKSKKSSKKSENAQNSA

SEQ ID NO: 2341145 - protein, 8 aa, Cryptosporidium parvum
AESHGFNQ

SEQ ID NO: 2341146 - protein, 9 aa, Cryptosporidium parvum
AESKPTVTG

SEQ ID NO: 2341147 - protein, 10 aa, Cryptosporidium parvum
AESQDYPKNE

SEQ ID NO: 2341148 - protein, 11 aa, Cryptosporidium parvum
AETEVKYSDET

SEQ ID NO: 2341149 - protein, 8 aa, Cryptosporidium parvum
AETQYNNE

SEQ ID NO: 2341150 - protein, 4 aa, Cryptosporidium parvum
AFGQ

SEQ ID NO: 2341151 - protein, 10 aa, Cryptosporidium parvum
AFQQSTTGIL

SEQ ID NO: 2341152 - protein, 5 aa, Cryptosporidium parvum
AGCAP

SEQ ID NO: 2341153 - protein, 4 aa, Cryptosporidium parvum
AGES

SEQ ID NO: 2341154 - protein, 8 aa, Cryptosporidium parvum
AGGSISDN

SEQ ID NO: 2341155 - protein, 9 aa, Cryptosporidium parvum
AGIGESDSD

SEQ ID NO: 2341156 - protein, 6 aa, Cryptosporidium parvum
AGPDYD

SEQ ID NO: 2341157 - protein, 9 aa, Cryptosporidium parvum
AGQPSQKNH

SEQ ID NO: 2341158 - protein, 6 aa, Cryptosporidium parvum
AGSSAF

SEQ ID NO: 2341159 - protein, 9 aa, Cryptosporidium parvum
AGTGTLGNN

SEQ ID NO: 2341160 - protein, 16 aa, Cryptosporidium parvum
AHQKSGSFASSNTKRR

SEQ ID NO: 2341161 - protein, 12 aa, Cryptosporidium parvum
AHTTEDTPNNYS

SEQ ID NO: 2341162 - protein, 14 aa, Cryptosporidium parvum
AIDTGSSVSTAPSS

SEQ ID NO: 2341163 - protein, 8 aa, Cryptosporidium parvum
AIPPPERE

SEQ ID NO: 2341164 - protein, 7 aa, Cryptosporidium parvum
AIPSNCS

SEQ ID NO: 2341165 - protein, 6 aa, Cryptosporidium parvum
AIYSSI

SEQ ID NO: 2341166 - protein, 7 aa, Cryptosporidium parvum
AKANVTD

SEQ ID NO: 2341167 - protein, 5 aa, Cryptosporidium parvum
AKDHE

SEQ ID NO: 2341168 - protein, 7 aa, Cryptosporidium parvum
AKGLYGP

SEQ ID NO: 2341169 - protein, 8 aa, Cryptosporidium parvum
AKIEGSSN

SEQ ID NO: 2341170 - protein, 8 aa, Cryptosporidium parvum
AKKHDYKK

SEQ ID NO: 2341171 - protein, 7 aa, Cryptosporidium parvum
AKPEENQ

SEQ ID NO: 2341172 - protein, 7 aa, Cryptosporidium parvum
AKRNPKV

SEQ ID NO: 2341173 - protein, 15 aa, Cryptosporidium parvum
AKSQPSVDSSARGSL

SEQ ID NO: 2341174 - protein, 8 aa, Cryptosporidium parvum
AKTRSSNV

SEQ ID NO: 2341175 - protein, 5 aa, Cryptosporidium parvum
ALGNN

SEQ ID NO: 2341176 - protein, 4 aa, Cryptosporidium parvum
ALGS

SEQ ID NO: 2341177 - protein, 9 aa, Cryptosporidium parvum
ALNERGEEI

SEQ ID NO: 2341178 - protein, 8 aa, Cryptosporidium parvum
ALPSQEPR

SEQ ID NO: 2341179 - protein, 5 aa, Cryptosporidium parvum
AMRNG

SEQ ID NO: 2341180 - protein, 10 aa, Cryptosporidium parvum
ANERRANNSK

SEQ ID NO: 2341181 - protein, 8 aa, Cryptosporidium parvum
ANGEDVES

SEQ ID NO: 2341182 - protein, 5 aa, Cryptosporidium parvum
ANLEN

SEQ ID NO: 2341183 - protein, 6 aa, Cryptosporidium parvum
ANNSNS

SEQ ID NO: 2341184 - protein, 8 aa, Cryptosporidium parvum
ANNTPPDE

SEQ ID NO: 2341185 - protein, 4 aa, Cryptosporidium parvum
ANPK

SEQ ID NO: 2341186 - protein, 5 aa, Cryptosporidium parvum
ANREK

SEQ ID NO: 2341187 - protein, 8 aa, Cryptosporidium parvum
ANSSRNND

SEQ ID NO: 2341188 - protein, 10 aa, Cryptosporidium parvum
APEGRGPSQP

SEQ ID NO: 2341189 - protein, 9 aa, Cryptosporidium parvum
APKRTGYRP

SEQ ID NO: 2341190 - protein, 5 aa, Cryptosporidium parvum
APLGT

SEQ ID NO: 2341191 - protein, 8 aa, Cryptosporidium parvum
APPKEGLQ

SEQ ID NO: 2341192 - protein, 6 aa, Cryptosporidium parvum
APPRCV

SEQ ID NO: 2341193 - protein, 4 aa, Cryptosporidium parvum
APSI

SEQ ID NO: 2341194 - protein, 6 aa, Cryptosporidium parvum
AQKDES

SEQ ID NO: 2341195 - protein, 7 aa, Cryptosporidium parvum
AQRPNSD

SEQ ID NO: 2341196 - protein, 5 aa, Cryptosporidium parvum
AQRRI

SEQ ID NO: 2341197 - protein, 12 aa, Cryptosporidium parvum
AQSASSQSIEAQ

SEQ ID NO: 2341198 - protein, 6 aa, Cryptosporidium parvum
AQSGSR

SEQ ID NO: 2341199 - protein, 7 aa, Cryptosporidium parvum
ARDHGPG

SEQ ID NO: 2341200 - protein, 9 aa, Cryptosporidium parvum
ARKDLNVSN

SEQ ID NO: 2341201 - protein, 7 aa, Cryptosporidium parvum
ARKRKNG

SEQ ID NO: 2341202 - protein, 21 aa, Cryptosporidium parvum
ARPITNQVKKPKNLSHSGENY

SEQ ID NO: 2341203 - protein, 6 aa, Cryptosporidium parvum
ARQEGR

SEQ ID NO: 2341204 - protein, 7 aa, Cryptosporidium parvum
ASCDGGL

SEQ ID NO: 2341205 - protein, 4 aa, Cryptosporidium parvum
ASGA

SEQ ID NO: 2341206 - protein, 6 aa, Cryptosporidium parvum
ASGPNL

SEQ ID NO: 2341207 - protein, 8 aa, Cryptosporidium parvum
ASGSDNIA

SEQ ID NO: 2341208 - protein, 7 aa, Cryptosporidium parvum
ASPEDEA

SEQ ID NO: 2341209 - protein, 9 aa, Cryptosporidium parvum
ASPMGGDPK

SEQ ID NO: 2341210 - protein, 8 aa, Cryptosporidium parvum
ASPQYDSN

SEQ ID NO: 2341211 - protein, 9 aa, Cryptosporidium parvum
ASQNSTDLK

SEQ ID NO: 2341212 - protein, 9 aa, Cryptosporidium parvum
ASSSISRNS

SEQ ID NO: 2341213 - protein, 10 aa, Cryptosporidium parvum
ASSSNKSSIS

SEQ ID NO: 2341214 - protein, 10 aa, Cryptosporidium parvum
ASSTLSSLDS

SEQ ID NO: 2341215 - protein, 8 aa, Cryptosporidium parvum
ASTSEQLN

SEQ ID NO: 2341216 - protein, 11 aa, Cryptosporidium parvum
ATDKKKAKVSA

SEQ ID NO: 2341217 - protein, 4 aa, Cryptosporidium parvum
ATDP

SEQ ID NO: 2341218 - protein, 5 aa, Cryptosporidium parvum
ATDPS

SEQ ID NO: 2341219 - protein, 12 aa, Cryptosporidium parvum
ATEFEPNYEAPT

SEQ ID NO: 2341220 - protein, 6 aa, Cryptosporidium parvum
ATNMKS

SEQ ID NO: 2341221 - protein, 12 aa, Cryptosporidium parvum
AVENPKQSKTIT

SEQ ID NO: 2341222 - protein, 71 aa, Cryptosporidium parvum; identical to SEQ ID NO: 2211805

SEQ ID NO: 2341223 - protein, 11 aa, Cryptosporidium parvum
AYNGNKTPLPE

SEQ ID NO: 2341224 - protein, 9 aa, Cryptosporidium parvum
CADNNPTGS

SEQ ID NO: 2341225 - protein, 9 aa, Cryptosporidium parvum
CDSNDTDKN

SEQ ID NO: 2341226 - protein, 7 aa, Cryptosporidium parvum
CDSSVEQ

SEQ ID NO: 2341227 - protein, 18 aa, Cryptosporidium parvum
CGEVSNEEFKKSQSYSNS

SEQ ID NO: 2341228 - protein, 6 aa, Cryptosporidium parvum
CLDKAS

SEQ ID NO: 2341229 - protein, 8 aa, Cryptosporidium parvum
CNYPRNNE

SEQ ID NO: 2341230 - protein, 12 aa, Cryptosporidium parvum
CPNPTPKPTNEF

SEQ ID NO: 2341231 - protein, 10 aa, Cryptosporidium parvum
CPSGTTLNAN

SEQ ID NO: 2341232 - protein, 8 aa, Cryptosporidium parvum
CQIGTRSR

SEQ ID NO: 2341233 - protein, 5 aa, Cryptosporidium parvum
CQSSD

SEQ ID NO: 2341234 - protein, 5 aa, Cryptosporidium parvum
CSEDA

SEQ ID NO: 2341235 - protein, 5 aa, Cryptosporidium parvum
CSPNQ

SEQ ID NO: 2341236 - protein, 12 aa, Cryptosporidium parvum
CSSSSQLEPLGE

SEQ ID NO: 2341237 - protein, 10 aa, Cryptosporidium parvum
CTNSSNSFLK

SEQ ID NO: 2341238 - protein, 7 aa, Cryptosporidium parvum
CTRGTES

SEQ ID NO: 2341239 - protein, 5 aa, Cryptosporidium parvum
CTRKS

SEQ ID NO: 2341240 - protein, 9 aa, Cryptosporidium parvum
DADISGNKS

SEQ ID NO: 2341241 - protein, 6 aa, Cryptosporidium parvum
DAFKRG

SEQ ID NO: 2341242 - protein, 36 aa, Cryptosporidium parvum
DAKESESNLTEVKNTQDSEDSSKKPESLDDGASSEA

SEQ ID NO: 2341243 - protein, 11 aa, Cryptosporidium parvum
DAKSIPSSIKN

SEQ ID NO: 2341244 - protein, 7 aa, Cryptosporidium parvum
DCTKDSL

SEQ ID NO: 2341245 - protein, 37 aa, Cryptosporidium parvum; identical to SEQ ID NO: 2212014

SEQ ID NO: 2341246 - protein, 26 aa, Cryptosporidium parvum
DDDDGNNDDGNNDDGNDNDNKENRKA

SEQ ID NO: 2341247 - protein, 9 aa, Cryptosporidium parvum
DDESYSNYR

SEQ ID NO: 2341248 - protein, 5 aa, Cryptosporidium parvum
DDHHR

SEQ ID NO: 2341249 - protein, 15 aa, Cryptosporidium parvum
DDINSKDEVIDSNSD

SEQ ID NO: 2341250 - protein, 4 aa, Cryptosporidium parvum
DDIS

SEQ ID NO: 2341251 - protein, 17 aa, Cryptosporidium parvum
DDLDRDQDHQFGKGNNR

SEQ ID NO: 2341252 - protein, 15 aa, Cryptosporidium parvum
DDLQDQDQDQQHDKG

SEQ ID NO: 2341253 - protein, 10 aa, Cryptosporidium parvum
DDNGKSKSAN

SEQ ID NO: 2341254 - protein, 5 aa, Cryptosporidium parvum
DDPSS

SEQ ID NO: 2341255 - protein, 4 aa, Cryptosporidium parvum
DDRY

SEQ ID NO: 2341256 - protein, 7 aa, Cryptosporidium parvum
DDSPNNQ

SEQ ID NO: 2341257 - protein, 4 aa, Cryptosporidium parvum
DDSY

SEQ ID NO: 2341258 - protein, 10 aa, Cryptosporidium parvum
DDTPLEDDDY

SEQ ID NO: 2341259 - protein, 9 aa, Cryptosporidium parvum
DEDNSSGGI

SEQ ID NO: 2341260 - protein, 27 aa, Cryptosporidium parvum
DEDQEVSSCGKLDQKKSRWDNGEVETL

SEQ ID NO: 2341261 - protein, 6 aa, Cryptosporidium parvum
DEDTNK

SEQ ID NO: 2341262 - protein, 8 aa, Cryptosporidium parvum
DEGGPSSF

SEQ ID NO: 2341263 - protein, 5 aa, Cryptosporidium parvum
DEGVY

SEQ ID NO: 2341264 - protein, 7 aa, Cryptosporidium parvum
DEHEAGN

SEQ ID NO: 2341265 - protein, 4 aa, Cryptosporidium parvum
DEHI

SEQ ID NO: 2341266 - protein, 18 aa, Cryptosporidium parvum
DEKDKRKCSESTENDNFE

SEQ ID NO: 2341267 - protein, 12 aa, Cryptosporidium parvum
DEKVQERKDDPV

SEQ ID NO: 2341268 - protein, 6 aa, Cryptosporidium parvum
DEKYQN

SEQ ID NO: 2341269 - protein, 21 aa, Cryptosporidium parvum
DENKEQKETKVYTKQSEEDTF

SEQ ID NO: 2341270 - protein, 18 aa, Cryptosporidium parvum
DENMSRNEKGCNGREEQY

SEQ ID NO: 2341271 - protein, 5 aa, Cryptosporidium parvum
DENSF

SEQ ID NO: 2341272 - protein, 6 aa, Cryptosporidium parvum
DERTAK

SEQ ID NO: 2341273 - protein, 7 aa, Cryptosporidium parvum
DESERNA

SEQ ID NO: 2341274 - protein, 4 aa, Cryptosporidium parvum
DETQ

SEQ ID NO: 2341275 - protein, 4 aa, Cryptosporidium parvum
DEVV

SEQ ID NO: 2341276 - protein, 10 aa, Cryptosporidium parvum
DFGSKGYRVT

SEQ ID NO: 2341277 - protein, 23 aa, Cryptosporidium parvum
DFQQTNMENNHQSSRNKEKTENL

SEQ ID NO: 2341278 - protein, 11 aa, Cryptosporidium parvum
DFRRESKNPSL

SEQ ID NO: 2341279 - protein, 9 aa, Cryptosporidium parvum
DFSDKDTNC

SEQ ID NO: 2341280 - protein, 10 aa, Cryptosporidium parvum
DFSPRKREGR

SEQ ID NO: 2341281 - protein, 8 aa, Cryptosporidium parvum
DGANGIPT

SEQ ID NO: 2341282 - protein, 34 aa, Cryptosporidium parvum
DGFDENQDTSIQSDSQDDTTGHKSDVKSPNSENF

SEQ ID NO: 2341283 - protein, 4 aa, Cryptosporidium parvum
DGGQ

SEQ ID NO: 2341284 - protein, 5 aa, Cryptosporidium parvum
DGIPH

SEQ ID NO: 2341285 - protein, 29 aa, Cryptosporidium parvum
DGMSNKPCLSSPINNNTNSQKAASTENVS

SEQ ID NO: 2341286 - protein, 11 aa, Cryptosporidium parvum
DGSISQTRGFR

SEQ ID NO: 2341287 - protein, 6 aa, Cryptosporidium parvum
DGSSIR

SEQ ID NO: 2341288 - protein, 25 aa, Cryptosporidium parvum
DGSTANNHTIKDTGNYNIDQPSKGT

SEQ ID NO: 2341289 - protein, 5 aa, Cryptosporidium parvum
DGTVK

SEQ ID NO: 2341290 - protein, 4 aa, Cryptosporidium parvum
DHEN

SEQ ID NO: 2341291 - protein, 7 aa, Cryptosporidium parvum
DHLTSQA

SEQ ID NO: 2341292 - protein, 12 aa, Cryptosporidium parvum
DHNNGLEPDESA

SEQ ID NO: 2341293 - protein, 5 aa, Cryptosporidium parvum
DHPGL

SEQ ID NO: 2341294 - protein, 6 aa, Cryptosporidium parvum
DHSTFK

SEQ ID NO: 2341295 - protein, 14 aa, Cryptosporidium parvum
DHVKPQKEPPLRSD

SEQ ID NO: 2341296 - protein, 9 aa, Cryptosporidium parvum
DIDPNTHEI

SEQ ID NO: 2341297 - protein, 22 aa, Cryptosporidium parvum
DINTNEKKEEQKSESENKDSDL

SEQ ID NO: 2341298 - protein, 25 aa, Cryptosporidium parvum
DIPLSSSSSLLSSPSSSSRSKTNRS

SEQ ID NO: 2341299 - protein, 29 aa, Cryptosporidium parvum
DIPRNTTIEEPATKIDSEQKVSASLDTET

SEQ ID NO: 2341300 - protein, 20 aa, Cryptosporidium parvum
DITQKKSNTNTNTNTTSKIE

SEQ ID NO: 2341301 - protein, 7 aa, Cryptosporidium parvum
DITTYSQ

SEQ ID NO: 2341302 - protein, 20 aa, Cryptosporidium parvum
DKAEKTSQVTPSDADIETRV

SEQ ID NO: 2341303 - protein, 5 aa, Cryptosporidium parvum
DKAKS

SEQ ID NO: 2341304 - protein, 8 aa, Cryptosporidium parvum
DKDDYDDD

SEQ ID NO: 2341305 - protein, 8 aa, Cryptosporidium parvum
DKDHGRSV

SEQ ID NO: 2341306 - protein, 5 aa, Cryptosporidium parvum
DKDKP

SEQ ID NO: 2341307 - protein, 5 aa, Cryptosporidium parvum
DKDSS

SEQ ID NO: 2341308 - protein, 8 aa, Cryptosporidium parvum
DKENSNFI

SEQ ID NO: 2341309 - protein, 5 aa, Cryptosporidium parvum
DKEQL

SEQ ID NO: 2341310 - protein, 15 aa, Cryptosporidium parvum
DKESSKRSEVTPEES

SEQ ID NO: 2341311 - protein, 7 aa, Cryptosporidium parvum
DKETNKY

SEQ ID NO: 2341312 - protein, 7 aa, Cryptosporidium parvum
DKSDSIT

SEQ ID NO: 2341313 - protein, 8 aa, Cryptosporidium parvum
DKSEIQGK

SEQ ID NO: 2341314 - protein, 11 aa, Cryptosporidium parvum
DKSSNESYQSF

SEQ ID NO: 2341315 - protein, 8 aa, Cryptosporidium parvum
DKSSSYTT

SEQ ID NO: 2341316 - protein, 6 aa, Cryptosporidium parvum
DLDSKD

SEQ ID NO: 2341317 - protein, 23 aa, Cryptosporidium parvum
DLETQKSHSAVEDDAEANIPYED

SEQ ID NO: 2341318 - protein, 24 aa, Cryptosporidium parvum
DLNSSKGGGDQSSYDAKGGSSAAA

SEQ ID NO: 2341319 - protein, 4 aa, Cryptosporidium parvum
DLPP

SEQ ID NO: 2341320 - protein, 13 aa, Cryptosporidium parvum
DLRSGGTQKRLSR

SEQ ID NO: 2341321 - protein, 8 aa, Cryptosporidium parvum
DLRSTKRP

SEQ ID NO: 2341322 - protein, 10 aa, Cryptosporidium parvum
DLSENEKEKK

SEQ ID NO: 2341323 - protein, 10 aa, Cryptosporidium parvum
DLTNDNNVGN

SEQ ID NO: 2341324 - protein, 8 aa, Cryptosporidium parvum
DNDCGSVS

SEQ ID NO: 2341325 - protein, 12 aa, Cryptosporidium parvum
DNDSDNFNPHET

SEQ ID NO: 2341326 - protein, 13 aa, Cryptosporidium parvum
DNDSTKEIKKEHD

SEQ ID NO: 2341327 - protein, 29 aa, Cryptosporidium parvum
DNENNNNNNNNDNNNEYNKLQEKDEKNNI

SEQ ID NO: 2341328 - protein, 6 aa, Cryptosporidium parvum
DNGSYS

SEQ ID NO: 2341329 - protein, 18 aa, Cryptosporidium parvum
DNGYNGGISTDSGKQLSP

SEQ ID NO: 2341330 - protein, 26 aa, Cryptosporidium parvum
DNNEDVEGNKTFEKSNDLGENDNIEN

SEQ ID NO: 2341331 - protein, 5 aa, Cryptosporidium parvum
DNNTS

SEQ ID NO: 2341332 - protein, 7 aa, Cryptosporidium parvum
DNPTTLY

SEQ ID NO: 2341333 - protein, 7 aa, Cryptosporidium parvum
DNRDNSI

SEQ ID NO: 2341334 - protein, 10 aa, Cryptosporidium parvum
DNSEKKSEKS

SEQ ID NO: 2341335 - protein, 4 aa, Cryptosporidium parvum
DNSL

SEQ ID NO: 2341336 - protein, 12 aa, Cryptosporidium parvum
DNSNINTNDQSI

SEQ ID NO: 2341337 - protein, 15 aa, Cryptosporidium parvum
DNTPLSSAPFHRIDN

SEQ ID NO: 2341338 - protein, 4 aa, Cryptosporidium parvum
DNYE

SEQ ID NO: 2341339 - protein, 7 aa, Cryptosporidium parvum
DNYRPSI

SEQ ID NO: 2341340 - protein, 11 aa, Cryptosporidium parvum
DPAAEGINPQE

SEQ ID NO: 2341341 - protein, 8 aa, Cryptosporidium parvum
DPATREYR

SEQ ID NO: 2341342 - protein, 6 aa, Cryptosporidium parvum
DPDDSI

SEQ ID NO: 2341343 - protein, 4 aa, Cryptosporidium parvum
DPFH

SEQ ID NO: 2341344 - protein, 7 aa, Cryptosporidium parvum
DPGGHNG

SEQ ID NO: 2341345 - protein, 6 aa, Cryptosporidium parvum
DPKKNT

SEQ ID NO: 2341346 - protein, 9 aa, Cryptosporidium parvum
DPKSPLYKG

SEQ ID NO: 2341347 - protein, 16 aa, Cryptosporidium parvum
DPKTGEKDRSTESLSR

SEQ ID NO: 2341348 - protein, 9 aa, Cryptosporidium parvum
DPNDPGSSF

SEQ ID NO: 2341349 - protein, 10 aa, Cryptosporidium parvum
DPPSEKPSEY

SEQ ID NO: 2341350 - protein, 14 aa, Cryptosporidium parvum
DPPSQGKHSSMQQQ

SEQ ID NO: 2341351 - protein, 8 aa, Cryptosporidium parvum
DPQQPRTS

SEQ ID NO: 2341352 - protein, 5 aa, Cryptosporidium parvum
DPSPI

SEQ ID NO: 2341353 - protein, 8 aa, Cryptosporidium parvum
DPSSNQTC

SEQ ID NO: 2341354 - protein, 10 aa, Cryptosporidium parvum
DPSTKNYRGD

SEQ ID NO: 2341355 - protein, 5 aa, Cryptosporidium parvum
DPTIG

SEQ ID NO: 2341356 - protein, 19 aa, Cryptosporidium parvum
DPTYRTDRTHRVSHDQKSA

SEQ ID NO: 2341357 - protein, 9 aa, Cryptosporidium parvum
DQDYEKDAN

SEQ ID NO: 2341358 - protein, 26 aa, Cryptosporidium parvum
DQGIDRYRNSQDPHKIKDDPIEKNSP

SEQ ID NO: 2341359 - protein, 8 aa, Cryptosporidium parvum
DQNNQGGI

SEQ ID NO: 2341360 - protein, 12 aa, Cryptosporidium parvum
DQPSPISPAPPP

SEQ ID NO: 2341361 - protein, 25 aa, Cryptosporidium parvum
DQQDNGLDSSSPSNSRSNKDREHAN

SEQ ID NO: 2341362 - protein, 6 aa, Cryptosporidium parvum
DQRKHE

SEQ ID NO: 2341363 - protein, 8 aa, Cryptosporidium parvum
DQRLVQEG

SEQ ID NO: 2341364 - protein, 5 aa, Cryptosporidium parvum
DQSSI

SEQ ID NO: 2341365 - protein, 4 aa, Cryptosporidium parvum
DQTP

SEQ ID NO: 2341366 - protein, 11 aa, Cryptosporidium parvum
DRAQDKCRAPN

SEQ ID NO: 2341367 - protein, 6 aa, Cryptosporidium parvum
DRKDQV

SEQ ID NO: 2341368 - protein, 7 aa, Cryptosporidium parvum
DRQYSDK

SEQ ID NO: 2341369 - protein, 7 aa, Cryptosporidium parvum
DSAGNNP

SEQ ID NO: 2341370 - protein, 4 aa, Cryptosporidium parvum
DSEN

SEQ ID NO: 2341371 - protein, 19 aa, Cryptosporidium parvum
DSESEYSANFSEKSQIDSR

SEQ ID NO: 2341372 - protein, 11 aa, Cryptosporidium parvum
DSGADSNPFAE

SEQ ID NO: 2341373 - protein, 6 aa, Cryptosporidium parvum
DSGESC

SEQ ID NO: 2341374 - protein, 14 aa, Cryptosporidium parvum
DSGLGDELKRSNQL

SEQ ID NO: 2341375 - protein, 11 aa, Cryptosporidium parvum
DSHSNKCPTRI

SEQ ID NO: 2341376 - protein, 4 aa, Cryptosporidium parvum
DSIS

SEQ ID NO: 2341377 - protein, 5 aa, Cryptosporidium parvum
DSKKL

SEQ ID NO: 2341378 - protein, 5 aa, Cryptosporidium parvum
DSKST

SEQ ID NO: 2341379 - protein, 7 aa, Cryptosporidium parvum
DSKTKDR

SEQ ID NO: 2341380 - protein, 9 aa, Cryptosporidium parvum
DSNCEENEG

SEQ ID NO: 2341381 - protein, 7 aa, Cryptosporidium parvum
DSPDGKY

SEQ ID NO: 2341382 - protein, 13 aa, Cryptosporidium parvum
DSQDHSKDSITNQ

SEQ ID NO: 2341383 - protein, 6 aa, Cryptosporidium parvum
DSSELK

SEQ ID NO: 2341384 - protein, 10 aa, Cryptosporidium parvum
DSSIRNPNEC

SEQ ID NO: 2341385 - protein, 6 aa, Cryptosporidium parvum
DSSNIE

SEQ ID NO: 2341386 - protein, 11 aa, Cryptosporidium parvum
DSSSSYGNQNN

SEQ ID NO: 2341387 - protein, 5 aa, Cryptosporidium parvum
DSSTF

SEQ ID NO: 2341388 - protein, 10 aa, Cryptosporidium parvum
DTARRGQITE

SEQ ID NO: 2341389 - protein, 5 aa, Cryptosporidium parvum
DTDDV

SEQ ID NO: 2341390 - protein, 5 aa, Cryptosporidium parvum
DTGKQ

SEQ ID NO: 2341391 - protein, 8 aa, Cryptosporidium parvum
DTGNKKSF

SEQ ID NO: 2341392 - protein, 5 aa, Cryptosporidium parvum
DTIVS

SEQ ID NO: 2341393 - protein, 13 aa, Cryptosporidium parvum
DTNNLQDKNNSLG

SEQ ID NO: 2341394 - protein, 6 aa, Cryptosporidium parvum
DTNPCS

SEQ ID NO: 2341395 - protein, 7 aa, Cryptosporidium parvum
DTQDTED

SEQ ID NO: 2341396 - protein, 5 aa, Cryptosporidium parvum
DTRDY

SEQ ID NO: 2341397 - protein, 4 aa, Cryptosporidium parvum
DTRL

SEQ ID NO: 2341398 - protein, 5 aa, Cryptosporidium parvum
DTRYS

SEQ ID NO: 2341399 - protein, 10 aa, Cryptosporidium parvum
DTSVPGSTRS

SEQ ID NO: 2341400 - protein, 4 aa, Cryptosporidium parvum
DTTE

SEQ ID NO: 2341401 - protein, 16 aa, Cryptosporidium parvum
DVEHRKEKLNEASENF

SEQ ID NO: 2341402 - protein, 12 aa, Cryptosporidium parvum
DVSSGQQIQAGQ

SEQ ID NO: 2341403 - protein, 4 aa, Cryptosporidium parvum
DVTP

SEQ ID NO: 2341404 - protein, 11 aa, Cryptosporidium parvum
DYGSNHSKNQI

SEQ ID NO: 2341405 - protein, 5 aa, Cryptosporidium parvum
EAAKY

SEQ ID NO: 2341406 - protein, 4 aa, Cryptosporidium parvum
EAEK

SEQ ID NO: 2341407 - protein, 9 aa, Cryptosporidium parvum
EAENEGNGF

SEQ ID NO: 2341408 - protein, 8 aa, Cryptosporidium parvum
EANEKNMT

SEQ ID NO: 2341409 - protein, 45 aa, Cryptosporidium parvum
EANESNSENNIEKEASHEEQSEVDDKKAQESDKGEDEQSTKPKSF

SEQ ID NO: 2341410 - protein, 6 aa, Cryptosporidium parvum
EAPPAL

SEQ ID NO: 2341411 - protein, 4 aa, Cryptosporidium parvum
EASN

SEQ ID NO: 2341412 - protein, 8 aa, Cryptosporidium parvum
EATPREQA

SEQ ID NO: 2341413 - protein, 5 aa, Cryptosporidium parvum
EAWGE

SEQ ID NO: 2341414 - protein, 7 aa, Cryptosporidium parvum
ECPEGYT

SEQ ID NO: 2341415 - protein, 10 aa, Cryptosporidium parvum
EDANSESSCL

SEQ ID NO: 2341416 - protein, 8 aa, Cryptosporidium parvum
EDDEDSEL

SEQ ID NO: 2341417 - protein, 5 aa, Cryptosporidium parvum
EDDPI

SEQ ID NO: 2341418 - protein, 10 aa, Cryptosporidium parvum
EDEAKQAGIS

SEQ ID NO: 2341419 - protein, 6 aa, Cryptosporidium parvum
EDEEKI

SEQ ID NO: 2341420 - protein, 7 aa, Cryptosporidium parvum
EDETSSV

SEQ ID NO: 2341421 - protein, 7 aa, Cryptosporidium parvum
EDGLENH

SEQ ID NO: 2341422 - protein, 6 aa, Cryptosporidium parvum
EDGRGE

SEQ ID NO: 2341423 - protein, 15 aa, Cryptosporidium parvum
EDNIEKLEKRDEREK

SEQ ID NO: 2341424 - protein, 6 aa, Cryptosporidium parvum
EDNPKI

SEQ ID NO: 2341425 - protein, 15 aa, Cryptosporidium parvum
EDPENGGSTISEQGT

SEQ ID NO: 2341426 - protein, 5 aa, Cryptosporidium parvum
EDTKS

SEQ ID NO: 2341427 - protein, 7 aa, Cryptosporidium parvum
EDYIDPE

SEQ ID NO: 2341428 - protein, 14 aa, Cryptosporidium parvum
EDYKLTKDTSYYQR

SEQ ID NO: 2341429 - protein, 9 aa, Cryptosporidium parvum
EEANSSNCT

SEQ ID NO: 2341430 - protein, 7 aa, Cryptosporidium parvum
EEDIDRN

SEQ ID NO: 2341431 - protein, 22 aa, Cryptosporidium parvum
EEDNDSEIEVEKDNNNSNTDEF

SEQ ID NO: 2341432 - protein, 16 aa, Cryptosporidium parvum
EEEDDNLSLSHDEGGL

SEQ ID NO: 2341433 - protein, 9 aa, Cryptosporidium parvum
EEEIPKNNT

SEQ ID NO: 2341434 - protein, 6 aa, Cryptosporidium parvum
EEEKTK

SEQ ID NO: 2341435 - protein, 4 aa, Cryptosporidium parvum
EEHE

SEQ ID NO: 2341436 - protein, 9 aa, Cryptosporidium parvum
EEITDSKDL

SEQ ID NO: 2341437 - protein, 13 aa, Cryptosporidium parvum
EEKLEKREEEIAN

SEQ ID NO: 2341438 - protein, 11 aa, Cryptosporidium parvum
EEKNNSNQTPL

SEQ ID NO: 2341439 - protein, 31 aa, Cryptosporidium parvum; identical to SEQ ID NO: 2213317

SEQ ID NO: 2341440 - protein, 8 aa, Cryptosporidium parvum
EELQPNRN

SEQ ID NO: 2341441 - protein, 8 aa, Cryptosporidium parvum
EESRGGRY

SEQ ID NO: 2341442 - protein, 6 aa, Cryptosporidium parvum
EESTKM

SEQ ID NO: 2341443 - protein, 13 aa, Cryptosporidium parvum
EETKTRGSELANK

SEQ ID NO: 2341444 - protein, 9 aa, Cryptosporidium parvum
EETNNEKKL

SEQ ID NO: 2341445 - protein, 9 aa, Cryptosporidium parvum
EEVEEATKM

SEQ ID NO: 2341446 - protein, 6 aa, Cryptosporidium parvum
EEYEED

SEQ ID NO: 2341447 - protein, 31 aa, Cryptosporidium parvum; identical to SEQ ID NO: 2213416

SEQ ID NO: 2341448 - protein, 4 aa, Cryptosporidium parvum
EFRS

SEQ ID NO: 2341449 - protein, 6 aa, Cryptosporidium parvum
EGCNTS

SEQ ID NO: 2341450 - protein, 12 aa, Cryptosporidium parvum
EGDASGSNSTRS

SEQ ID NO: 2341451 - protein, 5 aa, Cryptosporidium parvum
EGDRN

SEQ ID NO: 2341452 - protein, 10 aa, Cryptosporidium parvum
EGFASSRWTN

SEQ ID NO: 2341453 - protein, 5 aa, Cryptosporidium parvum
EGGNE

SEQ ID NO: 2341454 - protein, 8 aa, Cryptosporidium parvum
EGGSHDRT

SEQ ID NO: 2341455 - protein, 4 aa, Cryptosporidium parvum
EGIY

SEQ ID NO: 2341456 - protein, 8 aa, Cryptosporidium parvum
EGTQKSDF

SEQ ID NO: 2341457 - protein, 7 aa, Cryptosporidium parvum
EGVGNSY

SEQ ID NO: 2341458 - protein, 9 aa, Cryptosporidium parvum
EHKKSQLKS

SEQ ID NO: 2341459 - protein, 11 aa, Cryptosporidium parvum
EHNNESKVSNI

SEQ ID NO: 2341460 - protein, 6 aa, Cryptosporidium parvum
EHQATT

SEQ ID NO: 2341461 - protein, 6 aa, Cryptosporidium parvum
EHRSLS

SEQ ID NO: 2341462 - protein, 11 aa, Cryptosporidium parvum
EIKKSKTINVS

SEQ ID NO: 2341463 - protein, 13 aa, Cryptosporidium parvum
EIPNNANSVTGSN

SEQ ID NO: 2341464 - protein, 11 aa, Cryptosporidium parvum
EIPNYNNKNKF

SEQ ID NO: 2341465 - protein, 8 aa, Cryptosporidium parvum
EIQSKESV

SEQ ID NO: 2341466 - protein, 13 aa, Cryptosporidium parvum
EIQTNQNASEACN

SEQ ID NO: 2341467 - protein, 10 aa, Cryptosporidium parvum
EIRTKQQARD

SEQ ID NO: 2341468 - protein, 8 aa, Cryptosporidium parvum
EISPNEAY

SEQ ID NO: 2341469 - protein, 6 aa, Cryptosporidium parvum
EISSHS

SEQ ID NO: 2341470 - protein, 11 aa, Cryptosporidium parvum
EKAPTRPQRRK

SEQ ID NO: 2341471 - protein, 4 aa, Cryptosporidium parvum
EKAR

SEQ ID NO: 2341472 - protein, 5 aa, Cryptosporidium parvum
EKARN

SEQ ID NO: 2341473 - protein, 6 aa, Cryptosporidium parvum
EKERDD

SEQ ID NO: 2341474 - protein, 8 aa, Cryptosporidium parvum
EKKELNNL

SEQ ID NO: 2341475 - protein, 10 aa, Cryptosporidium parvum
EKKELSLRGP

SEQ ID NO: 2341476 - protein, 8 aa, Cryptosporidium parvum
EKKNYKKC

SEQ ID NO: 2341477 - protein, 26 aa, Cryptosporidium parvum
EKKSSSDTLFSKSGSNHQKSNNQQKI

SEQ ID NO: 2341478 - protein, 8 aa, Cryptosporidium parvum
EKKVTSNA

SEQ ID NO: 2341479 - protein, 8 aa, Cryptosporidium parvum
EKKYNGYR

SEQ ID NO: 2341480 - protein, 7 aa, Cryptosporidium parvum
EKMKNSS

SEQ ID NO: 2341481 - protein, 4 aa, Cryptosporidium parvum
EKNK

SEQ ID NO: 2341482 - protein, 11 aa, Cryptosporidium parvum
EKNQTVNNYQP

SEQ ID NO: 2341483 - protein, 13 aa, Cryptosporidium parvum
EKPVENNDTDLAK

SEQ ID NO: 2341484 - protein, 8 aa, Cryptosporidium parvum
EKQNSNII

SEQ ID NO: 2341485 - protein, 4 aa, Cryptosporidium parvum
EKRK

SEQ ID NO: 2341486 - protein, 8 aa, Cryptosporidium parvum
EKTESDIP

SEQ ID NO: 2341487 - protein, 4 aa, Cryptosporidium parvum
EKTI

SEQ ID NO: 2341488 - protein, 9 aa, Cryptosporidium parvum
ELEKSTTEE

SEQ ID NO: 2341489 - protein, 4 aa, Cryptosporidium parvum
ELGS

SEQ ID NO: 2341490 - protein, 17 aa, Cryptosporidium parvum
ELNNKDDPEKSSEKHST

SEQ ID NO: 2341491 - protein, 27 aa, Cryptosporidium parvum
ELPNKSNFPQIDNQKSPNRVTTGNIPN

SEQ ID NO: 2341492 - protein, 13 aa, Cryptosporidium parvum
EMEGGKHKKKEEA

SEQ ID NO: 2341493 - protein, 5 aa, Cryptosporidium parvum
EMSLK

SEQ ID NO: 2341494 - protein, 12 aa, Cryptosporidium parvum
ENAETTKIETND

SEQ ID NO: 2341495 - protein, 6 aa, Cryptosporidium parvum
ENDNKK

SEQ ID NO: 2341496 - protein, 24 aa, Cryptosporidium parvum
ENDSSTGTSAGVDNKGAYKKDSIP

SEQ ID NO: 2341497 - protein, 7 aa, Cryptosporidium parvum
ENDSYSD

SEQ ID NO: 2341498 - protein, 8 aa, Cryptosporidium parvum
ENEGSPDQ

SEQ ID NO: 2341499 - protein, 6 aa, Cryptosporidium parvum
ENFPPS

SEQ ID NO: 2341500 - protein, 8 aa, Cryptosporidium parvum
ENGKTNNF

SEQ ID NO: 2341501 - protein, 8 aa, Cryptosporidium parvum
ENHSTSNK

SEQ ID NO: 2341502 - protein, 8 aa, Cryptosporidium parvum
ENINGSGN

SEQ ID NO: 2341503 - protein, 13 aa, Cryptosporidium parvum
ENIQNSDRQPREL

SEQ ID NO: 2341504 - protein, 14 aa, Cryptosporidium parvum
ENKASKSENSEEID

SEQ ID NO: 2341505 - protein, 7 aa, Cryptosporidium parvum
ENKDNVK

SEQ ID NO: 2341506 - protein, 29 aa, Cryptosporidium parvum
ENMDVGNNSKSNSSLSSGTNKFSNSSKNY

SEQ ID NO: 2341507 - protein, 5 aa, Cryptosporidium parvum
ENNAI

SEQ ID NO: 2341508 - protein, 19 aa, Cryptosporidium parvum
ENNKEVEKQNELDEQNELE

SEQ ID NO: 2341509 - protein, 4 aa, Cryptosporidium parvum
ENPI

SEQ ID NO: 2341510 - protein, 16 aa, Cryptosporidium parvum
ENPYSYPYSSSPGGGY

SEQ ID NO: 2341511 - protein, 4 aa, Cryptosporidium parvum
ENSE

SEQ ID NO: 2341512 - protein, 6 aa, Cryptosporidium parvum
ENSNRG

SEQ ID NO: 2341513 - protein, 9 aa, Cryptosporidium parvum
ENTGNENYY

SEQ ID NO: 2341514 - protein, 6 aa, Cryptosporidium parvum
ENVENK

SEQ ID NO: 2341515 - protein, 4 aa, Cryptosporidium parvum
EPDY

SEQ ID NO: 2341516 - protein, 11 aa, Cryptosporidium parvum
EPIGSVTEESL

SEQ ID NO: 2341517 - protein, 4 aa, Cryptosporidium parvum
EPIN

SEQ ID NO: 2341518 - protein, 4 aa, Cryptosporidium parvum
EPMN

SEQ ID NO: 2341519 - protein, 7 aa, Cryptosporidium parvum
EQDEEIG

SEQ ID NO: 2341520 - protein, 21 aa, Cryptosporidium parvum
EQDSCQNHSNFSSKSFSTLEP

SEQ ID NO: 2341521 - protein, 10 aa, Cryptosporidium parvum
EQGSQNFNQP

SEQ ID NO: 2341522 - protein, 10 aa, Cryptosporidium parvum
EQGSRSELAT

SEQ ID NO: 2341523 - protein, 11 aa, Cryptosporidium parvum
EQKRNKNDEDY

SEQ ID NO: 2341524 - protein, 7 aa, Cryptosporidium parvum
EQPNQSA

SEQ ID NO: 2341525 - protein, 8 aa, Cryptosporidium parvum
EQTENCSP

SEQ ID NO: 2341526 - protein, 11 aa, Cryptosporidium parvum
EQTNNGASKAT

SEQ ID NO: 2341527 - protein, 4 aa, Cryptosporidium parvum
ERKS

SEQ ID NO: 2341528 - protein, 4 aa, Cryptosporidium parvum
ERNS

SEQ ID NO: 2341529 - protein, 35 aa, Cryptosporidium parvum
ERPGRYNPKNQEEQEIEYDDDTGGTTEYGKKPNSL

SEQ ID NO: 2341530 - protein, 10 aa, Cryptosporidium parvum
ERPNHSSFTS

SEQ ID NO: 2341531 - protein, 5 aa, Cryptosporidium parvum
ERRPS

SEQ ID NO: 2341532 - protein, 4 aa, Cryptosporidium parvum
ERRT

SEQ ID NO: 2341533 - protein, 12 aa, Cryptosporidium parvum
ERSNHTVGHTKN

SEQ ID NO: 2341534 - protein, 9 aa, Cryptosporidium parvum
ERSSRSASH

SEQ ID NO: 2341535 - protein, 10 aa, Cryptosporidium parvum
ERVKDEEREE

SEQ ID NO: 2341536 - protein, 10 aa, Cryptosporidium parvum
ERYSNENIRG

SEQ ID NO: 2341537 - protein, 12 aa, Cryptosporidium parvum
ESDENKGRSPTF

SEQ ID NO: 2341538 - protein, 12 aa, Cryptosporidium parvum
ESDHDETSYNGP

SEQ ID NO: 2341539 - protein, 4 aa, Cryptosporidium parvum
ESED

SEQ ID NO: 2341540 - protein, 6 aa, Cryptosporidium parvum
ESEPIP

SEQ ID NO: 2341541 - protein, 6 aa, Cryptosporidium parvum
ESETPR

SEQ ID NO: 2341542 - protein, 7 aa, Cryptosporidium parvum
ESGDPQR

SEQ ID NO: 2341543 - protein, 5 aa, Cryptosporidium parvum
ESGIE

SEQ ID NO: 2341544 - protein, 7 aa, Cryptosporidium parvum
ESGKYDP

SEQ ID NO: 2341545 - protein, 4 aa, Cryptosporidium parvum
ESGS

SEQ ID NO: 2341546 - protein, 7 aa, Cryptosporidium parvum
ESIPENK

SEQ ID NO: 2341547 - protein, 8 aa, Cryptosporidium parvum
ESKELTNR

SEQ ID NO: 2341548 - protein, 6 aa, Cryptosporidium parvum
ESKNDN

SEQ ID NO: 2341549 - protein, 5 aa, Cryptosporidium parvum
ESKNG

SEQ ID NO: 2341550 - protein, 9 aa, Cryptosporidium parvum
ESKNKQFNT

SEQ ID NO: 2341551 - protein, 9 aa, Cryptosporidium parvum
ESLSSESCG

SEQ ID NO: 2341552 - protein, 7 aa, Cryptosporidium parvum
ESLTPTG

SEQ ID NO: 2341553 - protein, 6 aa, Cryptosporidium parvum
ESNDPE

SEQ ID NO: 2341554 - protein, 6 aa, Cryptosporidium parvum
ESNQFA

SEQ ID NO: 2341555 - protein, 5 aa, Cryptosporidium parvum
ESNSH

SEQ ID NO: 2341556 - protein, 7 aa, Cryptosporidium parvum
ESQLEDY

SEQ ID NO: 2341557 - protein, 9 aa, Cryptosporidium parvum
ESSEAAELR

SEQ ID NO: 2341558 - protein, 5 aa, Cryptosporidium parvum
ESSIG

SEQ ID NO: 2341559 - protein, 10 aa, Cryptosporidium parvum
ESSIPNKKSL

SEQ ID NO: 2341560 - protein, 6 aa, Cryptosporidium parvum
ESTSPF

SEQ ID NO: 2341561 - protein, 10 aa, Cryptosporidium parvum
ESTSSSYSST

SEQ ID NO: 2341562 - protein, 11 aa, Cryptosporidium parvum
ESTTPDNLSEL

SEQ ID NO: 2341563 - protein, 9 aa, Cryptosporidium parvum
ETASNMTNI

SEQ ID NO: 2341564 - protein, 20 aa, Cryptosporidium parvum
ETDTSDSRMTSNDTNSVDGS

SEQ ID NO: 2341565 - protein, 9 aa, Cryptosporidium parvum
ETETNLEKN

SEQ ID NO: 2341566 - protein, 7 aa, Cryptosporidium parvum
ETGDDEI

SEQ ID NO: 2341567 - protein, 15 aa, Cryptosporidium parvum
ETGRLTDDPVEGKDI

SEQ ID NO: 2341568 - protein, 8 aa, Cryptosporidium parvum
ETISNNRK

SEQ ID NO: 2341569 - protein, 18 aa, Cryptosporidium parvum
ETKVGEGGTELSVGQKQR

SEQ ID NO: 2341570 - protein, 8 aa, Cryptosporidium parvum
ETLRKTAS

SEQ ID NO: 2341571 - protein, 7 aa, Cryptosporidium parvum
ETNDNIE

SEQ ID NO: 2341572 - protein, 7 aa, Cryptosporidium parvum
ETNHNKS

SEQ ID NO: 2341573 - protein, 6 aa, Cryptosporidium parvum
ETNTGI

SEQ ID NO: 2341574 - protein, 6 aa, Cryptosporidium parvum
ETPEIT

SEQ ID NO: 2341575 - protein, 29 aa, Cryptosporidium parvum
ETPKRTPHENLGETSSERASRREEEGTAF

SEQ ID NO: 2341576 - protein, 4 aa, Cryptosporidium parvum
ETPS

SEQ ID NO: 2341577 - protein, 8 aa, Cryptosporidium parvum
ETRRNLSQ

SEQ ID NO: 2341578 - protein, 6 aa, Cryptosporidium parvum
ETSQSK

SEQ ID NO: 2341579 - protein, 10 aa, Cryptosporidium parvum
ETSSCNSSPC

SEQ ID NO: 2341580 - protein, 22 aa, Cryptosporidium parvum
ETTNAPNLDGSYHGDDEFPSVS

SEQ ID NO: 2341581 - protein, 5 aa, Cryptosporidium parvum
EVDER

SEQ ID NO: 2341582 - protein, 6 aa, Cryptosporidium parvum
EVDGQP

SEQ ID NO: 2341583 - protein, 6 aa, Cryptosporidium parvum
EVSPEY

SEQ ID NO: 2341584 - protein, 5 aa, Cryptosporidium parvum
EVSTG

SEQ ID NO: 2341585 - protein, 31 aa, Cryptosporidium parvum; identical to SEQ ID NO: 2113150

SEQ ID NO: 2341586 - protein, 12 aa, Cryptosporidium parvum
EVVGDDDNKYQL

SEQ ID NO: 2341587 - protein, 12 aa, Cryptosporidium parvum
EVYNKGGRLFLE

SEQ ID NO: 2341588 - protein, 11 aa, Cryptosporidium parvum
EYADINSAKSY

SEQ ID NO: 2341589 - protein, 12 aa, Cryptosporidium parvum
EYISSNEKLPLN

SEQ ID NO: 2341590 - protein, 4 aa, Cryptosporidium parvum
EYKA

SEQ ID NO: 2341591 - protein, 5 aa, Cryptosporidium parvum
EYRSR

SEQ ID NO: 2341592 - protein, 4 aa, Cryptosporidium parvum
EYSS

SEQ ID NO: 2341593 - protein, 35 aa, Cryptosporidium parvum; identical to SEQ ID NO: 2214530

SEQ ID NO: 2341594 - protein, 9 aa, Cryptosporidium parvum
FDDDNDITS

SEQ ID NO: 2341595 - protein, 17 aa, Cryptosporidium parvum
FDDPKNPSKKSSVEIKD

SEQ ID NO: 2341596 - protein, 13 aa, Cryptosporidium parvum
FDGSSDVPSSTTG

SEQ ID NO: 2341597 - protein, 9 aa, Cryptosporidium parvum
FDKSNESKF

SEQ ID NO: 2341598 - protein, 38 aa, Cryptosporidium parvum; identical to SEQ ID NO: 2214560

SEQ ID NO: 2341599 - protein, 5 aa, Cryptosporidium parvum
FDTDK

SEQ ID NO: 2341600 - protein, 5 aa, Cryptosporidium parvum
FEGTT

SEQ ID NO: 2341601 - protein, 7 aa, Cryptosporidium parvum
FEKNEME

SEQ ID NO: 2341602 - protein, 6 aa, Cryptosporidium parvum
FERPNI

SEQ ID NO: 2341603 - protein, 6 aa, Cryptosporidium parvum
FGENTS

SEQ ID NO: 2341604 - protein, 7 aa, Cryptosporidium parvum
FGQENSG

SEQ ID NO: 2341605 - protein, 7 aa, Cryptosporidium parvum
FGSNQGE

SEQ ID NO: 2341606 - protein, 5 aa, Cryptosporidium parvum
FGTPE

SEQ ID NO: 2341607 - protein, 13 aa, Cryptosporidium parvum
FHSSSGPASLTEY

SEQ ID NO: 2341608 - protein, 5 aa, Cryptosporidium parvum
FKGTD

SEQ ID NO: 2341609 - protein, 8 aa, Cryptosporidium parvum
FKNKSNEI

SEQ ID NO: 2341610 - protein, 8 aa, Cryptosporidium parvum
FKNQTSPI

SEQ ID NO: 2341611 - protein, 7 aa, Cryptosporidium parvum
FKQGRQS

SEQ ID NO: 2341612 - protein, 4 aa, Cryptosporidium parvum
FKTR

SEQ ID NO: 2341613 - protein, 8 aa, Cryptosporidium parvum
FNASKKRT

SEQ ID NO: 2341614 - protein, 7 aa, Cryptosporidium parvum
FNGDRSD

SEQ ID NO: 2341615 - protein, 17 aa, Cryptosporidium parvum
FNKKQDIKTQKFSPSLG

SEQ ID NO: 2341616 - protein, 10 aa, Cryptosporidium parvum
FNTYDSEEIE

SEQ ID NO: 2341617 - protein, 12 aa, Cryptosporidium parvum
FPDKNSKKNNIP

SEQ ID NO: 2341618 - protein, 6 aa, Cryptosporidium parvum
FPDNYN

SEQ ID NO: 2341619 - protein, 10 aa, Cryptosporidium parvum
FPDSEITSKD

SEQ ID NO: 2341620 - protein, 9 aa, Cryptosporidium parvum
FPEDKKGEV

SEQ ID NO: 2341621 - protein, 13 aa, Cryptosporidium parvum
FPGLDRSSNMQSS

SEQ ID NO: 2341622 - protein, 5 aa, Cryptosporidium parvum
FPIND

SEQ ID NO: 2341623 - protein, 6 aa, Cryptosporidium parvum
FPMNDD

SEQ ID NO: 2341624 - protein, 5 aa, Cryptosporidium parvum
FPPIN

SEQ ID NO: 2341625 - protein, 9 aa, Cryptosporidium parvum
FPPNQNWGP

SEQ ID NO: 2341626 - protein, 8 aa, Cryptosporidium parvum
FPTGSSDI

SEQ ID NO: 2341627 - protein, 17 aa, Cryptosporidium parvum
FQDSSKSNESETKEQNL

SEQ ID NO: 2341628 - protein, 6 aa, Cryptosporidium parvum
FQKDES

SEQ ID NO: 2341629 - protein, 5 aa, Cryptosporidium parvum
FQNSN

SEQ ID NO: 2341630 - protein, 4 aa, Cryptosporidium parvum
FSED

SEQ ID NO: 2341631 - protein, 10 aa, Cryptosporidium parvum
FSEETRNEKI

SEQ ID NO: 2341632 - protein, 10 aa, Cryptosporidium parvum
FSGNNSKIND

SEQ ID NO: 2341633 - protein, 8 aa, Cryptosporidium parvum
FSNSNKEH

SEQ ID NO: 2341634 - protein, 6 aa, Cryptosporidium parvum
FSPSTI

SEQ ID NO: 2341635 - protein, 6 aa, Cryptosporidium parvum
FSQTKG

SEQ ID NO: 2341636 - protein, 12 aa, Cryptosporidium parvum
FSRSKSKDEKNQ

SEQ ID NO: 2341637 - protein, 6 aa, Cryptosporidium parvum
FSSLSS

SEQ ID NO: 2341638 - protein, 5 aa, Cryptosporidium parvum
FSSQE

SEQ ID NO: 2341639 - protein, 6 aa, Cryptosporidium parvum
FSTSTN

SEQ ID NO: 2341640 - protein, 4 aa, Cryptosporidium parvum
FTDE

SEQ ID NO: 2341641 - protein, 6 aa, Cryptosporidium parvum
FTESYS

SEQ ID NO: 2341642 - protein, 6 aa, Cryptosporidium parvum
FTKRND

SEQ ID NO: 2341643 - protein, 9 aa, Cryptosporidium parvum
FTQGQKNDD

SEQ ID NO: 2341644 - protein, 16 aa, Cryptosporidium parvum
FTSGNEDKSTENYSNS

SEQ ID NO: 2341645 - protein, 4 aa, Cryptosporidium parvum
FTTD

SEQ ID NO: 2341646 - protein, 9 aa, Cryptosporidium parvum
FVPSSNTQR

SEQ ID NO: 2341647 - protein, 6 aa, Cryptosporidium parvum
GAKHPK

SEQ ID NO: 2341648 - protein, 9 aa, Cryptosporidium parvum
GALRPSGAF

SEQ ID NO: 2341649 - protein, 4 aa, Cryptosporidium parvum
GAPI

SEQ ID NO: 2341650 - protein, 13 aa, Cryptosporidium parvum
GAPQNINKANPNV

SEQ ID NO: 2341651 - protein, 17 aa, Cryptosporidium parvum
GASGVSSVPNPYGVEMQ

SEQ ID NO: 2341652 - protein, 42 aa, Cryptosporidium parvum; identical to SEQ ID NO: 2214880

SEQ ID NO: 2341653 - protein, 6 aa, Cryptosporidium parvum
GDDSGD

SEQ ID NO: 2341654 - protein, 12 aa, Cryptosporidium parvum
GDEHRSNVTGGA

SEQ ID NO: 2341655 - protein, 4 aa, Cryptosporidium parvum
GDEM

SEQ ID NO: 2341656 - protein, 8 aa, Cryptosporidium parvum
GDESKRRR

SEQ ID NO: 2341657 - protein, 6 aa, Cryptosporidium parvum
GDKNLD

SEQ ID NO: 2341658 - protein, 6 aa, Cryptosporidium parvum
GDKNPF

SEQ ID NO: 2341659 - protein, 6 aa, Cryptosporidium parvum
GDKSGK

SEQ ID NO: 2341660 - protein, 7 aa, Cryptosporidium parvum
GDNRSGV

SEQ ID NO: 2341661 - protein, 9 aa, Cryptosporidium parvum
GDNTPLGEF

SEQ ID NO: 2341662 - protein, 5 aa, Cryptosporidium parvum
GDQAR

SEQ ID NO: 2341663 - protein, 9 aa, Cryptosporidium parvum
GDSNPTPLT

SEQ ID NO: 2341664 - protein, 12 aa, Cryptosporidium parvum
GDYLKGSSKLGG

SEQ ID NO: 2341665 - protein, 6 aa, Cryptosporidium parvum
GEDIKK

SEQ ID NO: 2341666 - protein, 5 aa, Cryptosporidium parvum
GEERE

SEQ ID NO: 2341667 - protein, 8 aa, Cryptosporidium parvum
GEEYPPIP

SEQ ID NO: 2341668 - protein, 5 aa, Cryptosporidium parvum
GEGNL

SEQ ID NO: 2341669 - protein, 7 aa, Cryptosporidium parvum
GEINTSE

SEQ ID NO: 2341670 - protein, 6 aa, Cryptosporidium parvum
GEIQDP

SEQ ID NO: 2341671 - protein, 19 aa, Cryptosporidium parvum
GEKETVGKASCTSSTNTQI

SEQ ID NO: 2341672 - protein, 11 aa, Cryptosporidium parvum
GEKTFSSHTDI

SEQ ID NO: 2341673 - protein, 7 aa, Cryptosporidium parvum
GENFKNK

SEQ ID NO: 2341674 - protein, 5 aa, Cryptosporidium parvum
GENQN

SEQ ID NO: 2341675 - protein, 17 aa, Cryptosporidium parvum
GESPSFEDVNEKESDGV

SEQ ID NO: 2341676 - protein, 10 aa, Cryptosporidium parvum
GETDSGPKKT

SEQ ID NO: 2341677 - protein, 11 aa, Cryptosporidium parvum
GETELTNDVET

SEQ ID NO: 2341678 - protein, 4 aa, Cryptosporidium parvum
GFNN

SEQ ID NO: 2341679 - protein, 5 aa, Cryptosporidium parvum
GFRSR

SEQ ID NO: 2341680 - protein, 4 aa, Cryptosporidium parvum
GGAI

SEQ ID NO: 2341681 - protein, 7 aa, Cryptosporidium parvum
GGATTGF

SEQ ID NO: 2341682 - protein, 8 aa, Cryptosporidium parvum
GGENTNNE

SEQ ID NO: 2341683 - protein, 9 aa, Cryptosporidium parvum
GGGGGVSEE

SEQ ID NO: 2341684 - protein, 5 aa, Cryptosporidium parvum
GGKQF

SEQ ID NO: 2341685 - protein, 11 aa, Cryptosporidium parvum
GGLLSGGQRQR

SEQ ID NO: 2341686 - protein, 40 aa, Cryptosporidium parvum; identical to SEQ ID NO: 2215114

SEQ ID NO: 2341687 - protein, 4 aa, Cryptosporidium parvum
GGPL

SEQ ID NO: 2341688 - protein, 26 aa, Cryptosporidium parvum
GGRSGENLLKGGSGSSKFGSKDEQQL

SEQ ID NO: 2341689 - protein, 8 aa, Cryptosporidium parvum
GGSGCGKS

SEQ ID NO: 2341690 - protein, 11 aa, Cryptosporidium parvum
GGSIGRERSRS

SEQ ID NO: 2341691 - protein, 8 aa, Cryptosporidium parvum
GGSPNYEG

SEQ ID NO: 2341692 - protein, 7 aa, Cryptosporidium parvum
GGTGGIG

SEQ ID NO: 2341693 - protein, 6 aa, Cryptosporidium parvum
GGTRTL

SEQ ID NO: 2341694 - protein, 22 aa, Cryptosporidium parvum
GGTSYTDGGSIPSFKPISNSNI

SEQ ID NO: 2341695 - protein, 15 aa, Cryptosporidium parvum
GGVQCPTEKEITERA

SEQ ID NO: 2341696 - protein, 11 aa, Cryptosporidium parvum
GGYENDQSQLN

SEQ ID NO: 2341697 - protein, 17 aa, Cryptosporidium parvum
GIKSDNRGQNTNQQEDI

SEQ ID NO: 2341698 - protein, 10 aa, Cryptosporidium parvum
GINPGKTQSD

SEQ ID NO: 2341699 - protein, 10 aa, Cryptosporidium parvum
GISGSNSPTV

SEQ ID NO: 2341700 - protein, 5 aa, Cryptosporidium parvum
GISNN

SEQ ID NO: 2341701 - protein, 6 aa, Cryptosporidium parvum
GIYSEN

SEQ ID NO: 2341702 - protein, 7 aa, Cryptosporidium parvum
GKDSPQI

SEQ ID NO: 2341703 - protein, 9 aa, Cryptosporidium parvum
GKDSTVKKN

SEQ ID NO: 2341704 - protein, 9 aa, Cryptosporidium parvum
GKEAPGITT

SEQ ID NO: 2341705 - protein, 9 aa, Cryptosporidium parvum
GKENSGEIG

SEQ ID NO: 2341706 - protein, 7 aa, Cryptosporidium parvum
GKGNNNI

SEQ ID NO: 2341707 - protein, 11 aa, Cryptosporidium parvum
GKKENNTINQT

SEQ ID NO: 2341708 - protein, 11 aa, Cryptosporidium parvum
GKKNDKDEYDY

SEQ ID NO: 2341709 - protein, 8 aa, Cryptosporidium parvum
GKRNFNNK

SEQ ID NO: 2341710 - protein, 9 aa, Cryptosporidium parvum
GKSGSGKST

SEQ ID NO: 2341711 - protein, 6 aa, Cryptosporidium parvum
GKTSKR

SEQ ID NO: 2341712 - protein, 6 aa, Cryptosporidium parvum
GLPPKS

SEQ ID NO: 2341713 - protein, 5 aa, Cryptosporidium parvum
GLQQK

SEQ ID NO: 2341714 - protein, 6 aa, Cryptosporidium parvum
GLSDSV

SEQ ID NO: 2341715 - protein, 7 aa, Cryptosporidium parvum
GLSGLGE

SEQ ID NO: 2341716 - protein, 6 aa, Cryptosporidium parvum
GLTVGG

SEQ ID NO: 2341717 - protein, 5 aa, Cryptosporidium parvum
GMSQD

SEQ ID NO: 2341718 - protein, 10 aa, Cryptosporidium parvum
GNDPNPAVNG

SEQ ID NO: 2341719 - protein, 7 aa, Cryptosporidium parvum
GNDQTTE

SEQ ID NO: 2341720 - protein, 19 aa, Cryptosporidium parvum
GNEDKNHNYGNTFNSEENM

SEQ ID NO: 2341721 - protein, 7 aa, Cryptosporidium parvum
GNEHEKR

SEQ ID NO: 2341722 - protein, 9 aa, Cryptosporidium parvum
GNETNTDIN

SEQ ID NO: 2341723 - protein, 9 aa, Cryptosporidium parvum
GNGQSETKF

SEQ ID NO: 2341724 - protein, 17 aa, Cryptosporidium parvum
GNIRGGGISSTGGMTVN

SEQ ID NO: 2341725 - protein, 12 aa, Cryptosporidium parvum
GNLSRNGSNEDL

SEQ ID NO: 2341726 - protein, 4 aa, Cryptosporidium parvum
GNRV

SEQ ID NO: 2341727 - protein, 5 aa, Cryptosporidium parvum
GNSKD

SEQ ID NO: 2341728 - protein, 15 aa, Cryptosporidium parvum
GNSKNVNKDKTNEIA

SEQ ID NO: 2341729 - protein, 6 aa, Cryptosporidium parvum
GNTDEI

SEQ ID NO: 2341730 - protein, 10 aa, Cryptosporidium parvum
GNTSNKKSSS

SEQ ID NO: 2341731 - protein, 5 aa, Cryptosporidium parvum
GPGSI

SEQ ID NO: 2341732 - protein, 5 aa, Cryptosporidium parvum
GPHKS

SEQ ID NO: 2341733 - protein, 6 aa, Cryptosporidium parvum
GPKEEM

SEQ ID NO: 2341734 - protein, 4 aa, Cryptosporidium parvum
GPRY

SEQ ID NO: 2341735 - protein, 10 aa, Cryptosporidium parvum
GPSGSGKSTL

SEQ ID NO: 2341736 - protein, 9 aa, Cryptosporidium parvum
GPSGSGKTS

SEQ ID NO: 2341737 - protein, 8 aa, Cryptosporidium parvum
GPSLTPGQ

SEQ ID NO: 2341738 - protein, 12 aa, Cryptosporidium parvum
GQAPNKTNLVNH

SEQ ID NO: 2341739 - protein, 7 aa, Cryptosporidium parvum
GQISPGR

SEQ ID NO: 2341740 - protein, 24 aa, Cryptosporidium parvum
GQKENLNSNTNSWKSKSKMSSNPQ

SEQ ID NO: 2341741 - protein, 10 aa, Cryptosporidium parvum
GQKSHTTKKF

SEQ ID NO: 2341742 - protein, 5 aa, Cryptosporidium parvum
GQNDF

SEQ ID NO: 2341743 - protein, 10 aa, Cryptosporidium parvum
GRETDESSTT

SEQ ID NO: 2341744 - protein, 13 aa, Cryptosporidium parvum
GRLDKSVASKVDG

SEQ ID NO: 2341745 - protein, 30 aa, Cryptosporidium parvum
GRSEKKISNKNQISSKKSTKDSENHSISTS

SEQ ID NO: 2341746 - protein, 8 aa, Cryptosporidium parvum
GSANHGIN

SEQ ID NO: 2341747 - protein, 5 aa, Cryptosporidium parvum
GSDEF

SEQ ID NO: 2341748 - protein, 8 aa, Cryptosporidium parvum
GSDEYSER

SEQ ID NO: 2341749 - protein, 14 aa, Cryptosporidium parvum
GSFHPSSSNNAINT

SEQ ID NO: 2341750 - protein, 8 aa, Cryptosporidium parvum
GSFSTNKN

SEQ ID NO: 2341751 - protein, 8 aa, Cryptosporidium parvum
GSGEFDQS

SEQ ID NO: 2341752 - protein, 8 aa, Cryptosporidium parvum
GSGTEEIC

SEQ ID NO: 2341753 - protein, 4 aa, Cryptosporidium parvum
GSIK

SEQ ID NO: 2341754 - protein, 22 aa, Cryptosporidium parvum
GSISNITNNELENSKFDGQETN

SEQ ID NO: 2341755 - protein, 17 aa, Cryptosporidium parvum
GSKDEIPKIQRPKPKLS

SEQ ID NO: 2341756 - protein, 7 aa, Cryptosporidium parvum
GSKKIDQ

SEQ ID NO: 2341757 - protein, 33 aa, Cryptosporidium parvum; identical to SEQ ID NO: 2215703

SEQ ID NO: 2341758 - protein, 22 aa, Cryptosporidium parvum
GSLDGWTQNKPQLLTSSSDKTF

SEQ ID NO: 2341759 - protein, 5 aa, Cryptosporidium parvum
GSLDP

SEQ ID NO: 2341760 - protein, 7 aa, Cryptosporidium parvum
GSLEGQT

SEQ ID NO: 2341761 - protein, 4 aa, Cryptosporidium parvum
GSNF

SEQ ID NO: 2341762 - protein, 14 aa, Cryptosporidium parvum
GSNIGNGNSTTGLG

SEQ ID NO: 2341763 - protein, 7 aa, Cryptosporidium parvum
GSQDDEM

SEQ ID NO: 2341764 - protein, 7 aa, Cryptosporidium parvum
GSSYTAA

SEQ ID NO: 2341765 - protein, 6 aa, Cryptosporidium parvum
GSTDLE

SEQ ID NO: 2341766 - protein, 4 aa, Cryptosporidium parvum
GSTV

SEQ ID NO: 2341767 - protein, 5 aa, Cryptosporidium parvum
GTAST

SEQ ID NO: 2341768 - protein, 5 aa, Cryptosporidium parvum
GTGCN

SEQ ID NO: 2341769 - protein, 11 aa, Cryptosporidium parvum
GTIPSSSENNM

SEQ ID NO: 2341770 - protein, 5 aa, Cryptosporidium parvum
GTKDK

SEQ ID NO: 2341771 - protein, 5 aa, Cryptosporidium parvum
GTKSR

SEQ ID NO: 2341772 - protein, 6 aa, Cryptosporidium parvum
GTPAAT

SEQ ID NO: 2341773 - protein, 11 aa, Cryptosporidium parvum
GTPNSSQEGEG

SEQ ID NO: 2341774 - protein, 7 aa, Cryptosporidium parvum
GTPQSYS

SEQ ID NO: 2341775 - protein, 9 aa, Cryptosporidium parvum
GTQEKDDNT

SEQ ID NO: 2341776 - protein, 4 aa, Cryptosporidium parvum
GTSK

SEQ ID NO: 2341777 - protein, 13 aa, Cryptosporidium parvum
GTSKNSQKNSSNI

SEQ ID NO: 2341778 - protein, 11 aa, Cryptosporidium parvum
GTSPDLKTASE

SEQ ID NO: 2341779 - protein, 9 aa, Cryptosporidium parvum
GTSSISSNN

SEQ ID NO: 2341780 - protein, 5 aa, Cryptosporidium parvum
GTTES

SEQ ID NO: 2341781 - protein, 5 aa, Cryptosporidium parvum
GVDSE

SEQ ID NO: 2341782 - protein, 4 aa, Cryptosporidium parvum
GVYS

SEQ ID NO: 2341783 - protein, 19 aa, Cryptosporidium parvum
GVYTPDTESQAKTTEKTYT

SEQ ID NO: 2341784 - protein, 8 aa, Cryptosporidium parvum
GYESTPIS

SEQ ID NO: 2341785 - protein, 6 aa, Cryptosporidium parvum
GYGKKE

SEQ ID NO: 2341786 - protein, 6 aa, Cryptosporidium parvum
GYSQSY

SEQ ID NO: 2341787 - protein, 24 aa, Cryptosporidium parvum
HANNSHNSISSTSNSTLNNQPIYP

SEQ ID NO: 2341788 - protein, 5 aa, Cryptosporidium parvum
HDSGF

SEQ ID NO: 2341789 - protein, 27 aa, Cryptosporidium parvum
HEESELKTLSQDSQESYSSTSQRGLRG

SEQ ID NO: 2341790 - protein, 6 aa, Cryptosporidium parvum
HEFDPS

SEQ ID NO: 2341791 - protein, 13 aa, Cryptosporidium parvum
HEGSESSEAEEIE

SEQ ID NO: 2341792 - protein, 8 aa, Cryptosporidium parvum
HEKSSFNN

SEQ ID NO: 2341793 - protein, 4 aa, Cryptosporidium parvum
HEKV

SEQ ID NO: 2341794 - protein, 19 aa, Cryptosporidium parvum
HERGETTEHLESRQGKKSP

SEQ ID NO: 2341795 - protein, 5 aa, Cryptosporidium parvum
HFQKK

SEQ ID NO: 2341796 - protein, 8 aa, Cryptosporidium parvum
HGDKDVAE

SEQ ID NO: 2341797 - protein, 11 aa, Cryptosporidium parvum
HGRNTVDDQKS

SEQ ID NO: 2341798 - protein, 17 aa, Cryptosporidium parvum
HGSNDQFNSQTQQWNNS

SEQ ID NO: 2341799 - protein, 10 aa, Cryptosporidium parvum
HGTDPTPLGR

SEQ ID NO: 2341800 - protein, 5 aa, Cryptosporidium parvum
HITGS

SEQ ID NO: 2341801 - protein, 14 aa, Cryptosporidium parvum
HKGITGKKSKLRNL

SEQ ID NO: 2341802 - protein, 8 aa, Cryptosporidium parvum
HKGNEESK

SEQ ID NO: 2341803 - protein, 12 aa, Cryptosporidium parvum
HLPKDSDITNIN

SEQ ID NO: 2341804 - protein, 20 aa, Cryptosporidium parvum
HNDDPASAAHPSHDSIKQQK

SEQ ID NO: 2341805 - protein, 8 aa, Cryptosporidium parvum
HNNNNEYD

SEQ ID NO: 2341806 - protein, 35 aa, Cryptosporidium parvum; identical to SEQ ID NO: 2216047

SEQ ID NO: 2341807 - protein, 26 aa, Cryptosporidium parvum
HNSSDSDALNNSISENANDSRNNMDP

SEQ ID NO: 2341808 - protein, 4 aa, Cryptosporidium parvum
HPGR

SEQ ID NO: 2341809 - protein, 5 aa, Cryptosporidium parvum
HPLSG

SEQ ID NO: 2341810 - protein, 16 aa, Cryptosporidium parvum
HQQQQQSSGAKQGWNT

SEQ ID NO: 2341811 - protein, 6 aa, Cryptosporidium parvum
HQQRNE

SEQ ID NO: 2341812 - protein, 5 aa, Cryptosporidium parvum
HQTNI

SEQ ID NO: 2341813 - protein, 16 aa, Cryptosporidium parvum
HRGPVTTNVNNTNPSQ

SEQ ID NO: 2341814 - protein, 7 aa, Cryptosporidium parvum
HSDNSKF

SEQ ID NO: 2341815 - protein, 8 aa, Cryptosporidium parvum
HSKIPYSR

SEQ ID NO: 2341816 - protein, 11 aa, Cryptosporidium parvum
HSKNPNNYTKE

SEQ ID NO: 2341817 - protein, 6 aa, Cryptosporidium parvum
HSKSKY

SEQ ID NO: 2341818 - protein, 7 aa, Cryptosporidium parvum
HSNYTET

SEQ ID NO: 2341819 - protein, 4 aa, Cryptosporidium parvum
HSPL

SEQ ID NO: 2341820 - protein, 28 aa, Cryptosporidium parvum
HSQRNNSSLNNLPAQSERKLSSETNRSN

SEQ ID NO: 2341821 - protein, 6 aa, Cryptosporidium parvum
HTDYTE

SEQ ID NO: 2341822 - protein, 12 aa, Cryptosporidium parvum
HTTIKQKKSRRN

SEQ ID NO: 2341823 - protein, 30 aa, Cryptosporidium parvum; identical to SEQ ID NO: 2216196

SEQ ID NO: 2341824 - protein, 29 aa, Cryptosporidium parvum
IDESTPDLKGKVRGNKEATGSESGQNTTS

SEQ ID NO: 2341825 - protein, 9 aa, Cryptosporidium parvum
IDGKGSSSF

SEQ ID NO: 2341826 - protein, 5 aa, Cryptosporidium parvum
IDHPD

SEQ ID NO: 2341827 - protein, 11 aa, Cryptosporidium parvum
IDKHGSKLRNS

SEQ ID NO: 2341828 - protein, 7 aa, Cryptosporidium parvum
IDNGTQK

SEQ ID NO: 2341829 - protein, 4 aa, Cryptosporidium parvum
IDNI

SEQ ID NO: 2341830 - protein, 9 aa, Cryptosporidium parvum
IDPRDDPNN

SEQ ID NO: 2341831 - protein, 15 aa, Cryptosporidium parvum
IDSNSETDSDETELD

SEQ ID NO: 2341832 - protein, 10 aa, Cryptosporidium parvum
IDTNQGQDTA

SEQ ID NO: 2341833 - protein, 9 aa, Cryptosporidium parvum
IDYSDNRDL

SEQ ID NO: 2341834 - protein, 11 aa, Cryptosporidium parvum
IEDSNGNPNIC

SEQ ID NO: 2341835 - protein, 5 aa, Cryptosporidium parvum
IEEIS

SEQ ID NO: 2341836 - protein, 8 aa, Cryptosporidium parvum
IEKGKEVS

SEQ ID NO: 2341837 - protein, 11 aa, Cryptosporidium parvum
IENTQSNNLNE

SEQ ID NO: 2341838 - protein, 7 aa, Cryptosporidium parvum
IESNTKI

SEQ ID NO: 2341839 - protein, 8 aa, Cryptosporidium parvum
IETDGTNE

SEQ ID NO: 2341840 - protein, 11 aa, Cryptosporidium parvum
IGAYGKDIGTN

SEQ ID NO: 2341841 - protein, 4 aa, Cryptosporidium parvum
IGDA

SEQ ID NO: 2341842 - protein, 11 aa, Cryptosporidium parvum
IGNENNEKGIE

SEQ ID NO: 2341843 - protein, 17 aa, Cryptosporidium parvum
IGNESRKTNKDSISDTS

SEQ ID NO: 2341844 - protein, 6 aa, Cryptosporidium parvum
IGNGES

SEQ ID NO: 2341845 - protein, 12 aa, Cryptosporidium parvum
IGPSSTSNQENF

SEQ ID NO: 2341846 - protein, 9 aa, Cryptosporidium parvum
IGQSSSVSN

SEQ ID NO: 2341847 - protein, 10 aa, Cryptosporidium parvum
IGSGQELGFE

SEQ ID NO: 2341848 - protein, 5 aa, Cryptosporidium parvum
IGSPN

SEQ ID NO: 2341849 - protein, 5 aa, Cryptosporidium parvum
IGTAG

SEQ ID NO: 2341850 - protein, 10 aa, Cryptosporidium parvum
IGTEYSATYT

SEQ ID NO: 2341851 - protein, 7 aa, Cryptosporidium parvum
IGTSSQA

SEQ ID NO: 2341852 - protein, 11 aa, Cryptosporidium parvum
IGVTENNPDEC

SEQ ID NO: 2341853 - protein, 26 aa, Cryptosporidium parvum
IIPQNQPPMQPPPGRQVFGYAVVPNI

SEQ ID NO: 2341854 - protein, 9 aa, Cryptosporidium parvum
IKCNKDEKI

SEQ ID NO: 2341855 - protein, 6 aa, Cryptosporidium parvum
IKDEKI

SEQ ID NO: 2341856 - protein, 19 aa, Cryptosporidium parvum
IKENENEENLSNATSNLNE

SEQ ID NO: 2341857 - protein, 8 aa, Cryptosporidium parvum
IKENEPNI

SEQ ID NO: 2341858 - protein, 6 aa, Cryptosporidium parvum
IKEYEE

SEQ ID NO: 2341859 - protein, 21 aa, Cryptosporidium parvum
IKGSTNRDFENTNSEGSRKQS

SEQ ID NO: 2341860 - protein, 9 aa, Cryptosporidium parvum
IKHKSTDNQ

SEQ ID NO: 2341861 - protein, 9 aa, Cryptosporidium parvum
IKISKEKRN

SEQ ID NO: 2341862 - protein, 15 aa, Cryptosporidium parvum
IKKEEEEEEEEEDPR

SEQ ID NO: 2341863 - protein, 8 aa, Cryptosporidium parvum
IKNDRTEG

SEQ ID NO: 2341864 - protein, 11 aa, Cryptosporidium parvum
IKNNNKKGINT

SEQ ID NO: 2341865 - protein, 9 aa, Cryptosporidium parvum
IKNTTEDNL

SEQ ID NO: 2341866 - protein, 14 aa, Cryptosporidium parvum
IKQDEKENSRFETK

SEQ ID NO: 2341867 - protein, 9 aa, Cryptosporidium parvum
IKSQSSTTS

SEQ ID NO: 2341868 - protein, 6 aa, Cryptosporidium parvum
IKTTTD

SEQ ID NO: 2341869 - protein, 5 aa, Cryptosporidium parvum
ILTED

SEQ ID NO: 2341870 - protein, 4 aa, Cryptosporidium parvum
INDG

SEQ ID NO: 2341871 - protein, 10 aa, Cryptosporidium parvum
INDKLKEKNI

SEQ ID NO: 2341872 - protein, 9 aa, Cryptosporidium parvum
INDRNTYHG

SEQ ID NO: 2341873 - protein, 5 aa, Cryptosporidium parvum
INGPT

SEQ ID NO: 2341874 - protein, 14 aa, Cryptosporidium parvum
INHESTEHNVKDEN

SEQ ID NO: 2341875 - protein, 14 aa, Cryptosporidium parvum
INIDNNTNIENEAV

SEQ ID NO: 2341876 - protein, 10 aa, Cryptosporidium parvum
INNIDPKDQD

SEQ ID NO: 2341877 - protein, 9 aa, Cryptosporidium parvum
INNNNNNKD

SEQ ID NO: 2341878 - protein, 7 aa, Cryptosporidium parvum
INNSQLD

SEQ ID NO: 2341879 - protein, 13 aa, Cryptosporidium parvum
INPRDNYQKPISE

SEQ ID NO: 2341880 - protein, 18 aa, Cryptosporidium parvum
INQEEEEIQTEEEPERDY

SEQ ID NO: 2341881 - protein, 7 aa, Cryptosporidium parvum
INQKTES

SEQ ID NO: 2341882 - protein, 21 aa, Cryptosporidium parvum
INQNYGNNSEIDQSQEKDEEI

SEQ ID NO: 2341883 - protein, 10 aa, Cryptosporidium parvum
INQTKTSQDE

SEQ ID NO: 2341884 - protein, 6 aa, Cryptosporidium parvum
INRTTG

SEQ ID NO: 2341885 - protein, 4 aa, Cryptosporidium parvum
INSD

SEQ ID NO: 2341886 - protein, 5 aa, Cryptosporidium parvum
INSEN

SEQ ID NO: 2341887 - protein, 5 aa, Cryptosporidium parvum
IPEDS

SEQ ID NO: 2341888 - protein, 7 aa, Cryptosporidium parvum
IPENDNQ

SEQ ID NO: 2341889 - protein, 6 aa, Cryptosporidium parvum
IPETGK

SEQ ID NO: 2341890 - protein, 13 aa, Cryptosporidium parvum
IPGLPDSKTDSLT

SEQ ID NO: 2341891 - protein, 5 aa, Cryptosporidium parvum
IPKEG

SEQ ID NO: 2341892 - protein, 24 aa, Cryptosporidium parvum
IPLPTEENHSSLKNSTNALNVEAR

SEQ ID NO: 2341893 - protein, 21 aa, Cryptosporidium parvum
IPPGSQNSDHITKNSSSQMNT

SEQ ID NO: 2341894 - protein, 8 aa, Cryptosporidium parvum
IPPKPESL

SEQ ID NO: 2341895 - protein, 4 aa, Cryptosporidium parvum
IPPM

SEQ ID NO: 2341896 - protein, 6 aa, Cryptosporidium parvum
IPPNGT

SEQ ID NO: 2341897 - protein, 18 aa, Cryptosporidium parvum
IPPPGTPNAPQNPPYNSR

SEQ ID NO: 2341898 - protein, 6 aa, Cryptosporidium parvum
IPSSHN

SEQ ID NO: 2341899 - protein, 5 aa, Cryptosporidium parvum
IPSTP

SEQ ID NO: 2341900 - protein, 11 aa, Cryptosporidium parvum
IPTKKPSKPCS

SEQ ID NO: 2341901 - protein, 8 aa, Cryptosporidium parvum
IQAGQSKE

SEQ ID NO: 2341902 - protein, 8 aa, Cryptosporidium parvum
IQDGISSQ

SEQ ID NO: 2341903 - protein, 5 aa, Cryptosporidium parvum
IQDQL

SEQ ID NO: 2341904 - protein, 5 aa, Cryptosporidium parvum
IQDSS

SEQ ID NO: 2341905 - protein, 5 aa, Cryptosporidium parvum
IQEVS

SEQ ID NO: 2341906 - protein, 9 aa, Cryptosporidium parvum
IQGSRKGSA

SEQ ID NO: 2341907 - protein, 4 aa, Cryptosporidium parvum
IQPE

SEQ ID NO: 2341908 - protein, 19 aa, Cryptosporidium parvum
IQTPGQEPKEGNQTQNTPY

SEQ ID NO: 2341909 - protein, 4 aa, Cryptosporidium parvum
IRGT

SEQ ID NO: 2341910 - protein, 6 aa, Cryptosporidium parvum
IRNQKN

SEQ ID NO: 2341911 - protein, 14 aa, Cryptosporidium parvum
IRPENSDLESERKS

SEQ ID NO: 2341912 - protein, 9 aa, Cryptosporidium parvum
IRSSKSSEY

SEQ ID NO: 2341913 - protein, 6 aa, Cryptosporidium parvum
ISADSE

SEQ ID NO: 2341914 - protein, 8 aa, Cryptosporidium parvum
ISANKNND

SEQ ID NO: 2341915 - protein, 5 aa, Cryptosporidium parvum
ISEES

SEQ ID NO: 2341916 - protein, 6 aa, Cryptosporidium parvum
ISGGIS

SEQ ID NO: 2341917 - protein, 4 aa, Cryptosporidium parvum
ISGK

SEQ ID NO: 2341918 - protein, 12 aa, Cryptosporidium parvum
ISKDEKNNQSIC

SEQ ID NO: 2341919 - protein, 5 aa, Cryptosporidium parvum
ISNEE

SEQ ID NO: 2341920 - protein, 14 aa, Cryptosporidium parvum
ISNGDVDADCPYRT

SEQ ID NO: 2341921 - protein, 22 aa, Cryptosporidium parvum
ISNSTDNELVSDAGESKYKTGS

SEQ ID NO: 2341922 - protein, 8 aa, Cryptosporidium parvum
ISNSTGET

SEQ ID NO: 2341923 - protein, 9 aa, Cryptosporidium parvum
ISPNSNSNL

SEQ ID NO: 2341924 - protein, 11 aa, Cryptosporidium parvum
ISQHDTSGEYE

SEQ ID NO: 2341925 - protein, 5 aa, Cryptosporidium parvum
ISQPI

SEQ ID NO: 2341926 - protein, 9 aa, Cryptosporidium parvum
ISQRNEKKV

SEQ ID NO: 2341927 - protein, 4 aa, Cryptosporidium parvum
ISSD

SEQ ID NO: 2341928 - protein, 5 aa, Cryptosporidium parvum
ISSNN

SEQ ID NO: 2341929 - protein, 20 aa, Cryptosporidium parvum
ISSNSHKHSASHSLKTQSGY

SEQ ID NO: 2341930 - protein, 6 aa, Cryptosporidium parvum
ISSNTH

SEQ ID NO: 2341931 - protein, 20 aa, Cryptosporidium parvum
ISSSSTSTPSISLNTSTPNI

SEQ ID NO: 2341932 - protein, 7 aa, Cryptosporidium parvum
ISSYRNS

SEQ ID NO: 2341933 - protein, 4 aa, Cryptosporidium parvum
ISTQ

SEQ ID NO: 2341934 - protein, 8 aa, Cryptosporidium parvum
ISTRSENI

SEQ ID NO: 2341935 - protein, 11 aa, Cryptosporidium parvum
ISTTQNGSDPT

SEQ ID NO: 2341936 - protein, 11 aa, Cryptosporidium parvum
ISYDDKSDLES

SEQ ID NO: 2341937 - protein, 10 aa, Cryptosporidium parvum
ITESCGGELQ

SEQ ID NO: 2341938 - protein, 17 aa, Cryptosporidium parvum
ITESEIRNSTESDSTTF

SEQ ID NO: 2341939 - protein, 12 aa, Cryptosporidium parvum
ITFSKGEQVRRG

SEQ ID NO: 2341940 - protein, 10 aa, Cryptosporidium parvum
ITPGGKASGI

SEQ ID NO: 2341941 - protein, 4 aa, Cryptosporidium parvum
ITPN

SEQ ID NO: 2341942 - protein, 10 aa, Cryptosporidium parvum
ITSDDNRKRK

SEQ ID NO: 2341943 - protein, 23 aa, Cryptosporidium parvum
IVDPSKSKNNRSKRKRPSRASTS

SEQ ID NO: 2341944 - protein, 9 aa, Cryptosporidium parvum
IYNNNNNNN

SEQ ID NO: 2341945 - protein, 12 aa, Cryptosporidium parvum
IYPKDSSDISTP

SEQ ID NO: 2341946 - protein, 8 aa, Cryptosporidium parvum
IYSEEDGG

SEQ ID NO: 2341947 - protein, 6 aa, Cryptosporidium parvum
KAASDD

SEQ ID NO: 2341948 - protein, 7 aa, Cryptosporidium parvum
KADHNGD

SEQ ID NO: 2341949 - protein, 16 aa, Cryptosporidium parvum
KAENSLDSDRKEIKKA

SEQ ID NO: 2341950 - protein, 12 aa, Cryptosporidium parvum
KALGEKQRGHNI

SEQ ID NO: 2341951 - protein, 5 aa, Cryptosporidium parvum
KALVS

SEQ ID NO: 2341952 - protein, 10 aa, Cryptosporidium parvum
KANKKSIRRA

SEQ ID NO: 2341953 - protein, 6 aa, Cryptosporidium parvum
KANKSL

SEQ ID NO: 2341954 - protein, 5 aa, Cryptosporidium parvum
KAQEI

SEQ ID NO: 2341955 - protein, 8 aa, Cryptosporidium parvum
KAQSSYSN

SEQ ID NO: 2341956 - protein, 7 aa, Cryptosporidium parvum
KASFENA

SEQ ID NO: 2341957 - protein, 11 aa, Cryptosporidium parvum
KASHSYSNEVN

SEQ ID NO: 2341958 - protein, 6 aa, Cryptosporidium parvum
KATARA

SEQ ID NO: 2341959 - protein, 15 aa, Cryptosporidium parvum
KCDKTSESDISTHPP

SEQ ID NO: 2341960 - protein, 9 aa, Cryptosporidium parvum
KCSEIEPQV

SEQ ID NO: 2341961 - protein, 8 aa, Cryptosporidium parvum
KDDQDYIK

SEQ ID NO: 2341962 - protein, 4 aa, Cryptosporidium parvum
KDEI

SEQ ID NO: 2341963 - protein, 4 aa, Cryptosporidium parvum
KDEL

SEQ ID NO: 2341964 - protein, 11 aa, Cryptosporidium parvum
KDEQEPAKFSR

SEQ ID NO: 2341965 - protein, 9 aa, Cryptosporidium parvum
KDETAKFTI

SEQ ID NO: 2341966 - protein, 8 aa, Cryptosporidium parvum
KDINTEQE

SEQ ID NO: 2341967 - protein, 12 aa, Cryptosporidium parvum
KDITNQKSLDEL

SEQ ID NO: 2341968 - protein, 17 aa, Cryptosporidium parvum
KDKSNEVGSNECEAVSS

SEQ ID NO: 2341969 - protein, 8 aa, Cryptosporidium parvum
KDKTGIIT

SEQ ID NO: 2341970 - protein, 4 aa, Cryptosporidium parvum
KDKW

SEQ ID NO: 2341971 - protein, 6 aa, Cryptosporidium parvum
KDNNQN

SEQ ID NO: 2341972 - protein, 14 aa, Cryptosporidium parvum
KDPNLSDQSNKEYE

SEQ ID NO: 2341973 - protein, 11 aa, Cryptosporidium parvum
KDQTDPAPRYI

SEQ ID NO: 2341974 - protein, 9 aa, Cryptosporidium parvum
KDSKDDERV

SEQ ID NO: 2341975 - protein, 30 aa, Cryptosporidium parvum; identical to SEQ ID NO: 2217255

SEQ ID NO: 2341976 - protein, 7 aa, Cryptosporidium parvum
KDTGENI

SEQ ID NO: 2341977 - protein, 13 aa, Cryptosporidium parvum
KDTGESDEKSENI

SEQ ID NO: 2341978 - protein, 12 aa, Cryptosporidium parvum
KDTNDKSKNNEL

SEQ ID NO: 2341979 - protein, 18 aa, Cryptosporidium parvum
KDVSSKNNFTKNKKPEDV

SEQ ID NO: 2341980 - protein, 7 aa, Cryptosporidium parvum
KDYGPAT

SEQ ID NO: 2341981 - protein, 6 aa, Cryptosporidium parvum
KDYSND

SEQ ID NO: 2341982 - protein, 6 aa, Cryptosporidium parvum
KEADAG

SEQ ID NO: 2341983 - protein, 8 aa, Cryptosporidium parvum
KEATEPKV

SEQ ID NO: 2341984 - protein, 12 aa, Cryptosporidium parvum
KEDDSSEYYSDK

SEQ ID NO: 2341985 - protein, 13 aa, Cryptosporidium parvum
KEDEDESEGTAET

SEQ ID NO: 2341986 - protein, 6 aa, Cryptosporidium parvum
KEDFEK

SEQ ID NO: 2341987 - protein, 6 aa, Cryptosporidium parvum
KEDNAS

SEQ ID NO: 2341988 - protein, 4 aa, Cryptosporidium parvum
KEED

SEQ ID NO: 2341989 - protein, 15 aa, Cryptosporidium parvum
KEELENDSDIKNSDI

SEQ ID NO: 2341990 - protein, 6 aa, Cryptosporidium parvum
KEEYSG

SEQ ID NO: 2341991 - protein, 9 aa, Cryptosporidium parvum
KEFENLSGN

SEQ ID NO: 2341992 - protein, 4 aa, Cryptosporidium parvum
KEKE

SEQ ID NO: 2341993 - protein, 19 aa, Cryptosporidium parvum
KEKIKKKINSNKKTKSGLI

SEQ ID NO: 2341994 - protein, 7 aa, Cryptosporidium parvum
KEMHNKK

SEQ ID NO: 2341995 - protein, 14 aa, Cryptosporidium parvum
KENYEDDNASTSSD

SEQ ID NO: 2341996 - protein, 5 aa, Cryptosporidium parvum
KEPGK

SEQ ID NO: 2341997 - protein, 6 aa, Cryptosporidium parvum
KEQNKT

SEQ ID NO: 2341998 - protein, 6 aa, Cryptosporidium parvum
KERREK

SEQ ID NO: 2341999 - protein, 7 aa, Cryptosporidium parvum
KERRNPQ

SEQ ID NO: 2342000 - protein, 11 aa, Cryptosporidium parvum
KESINKSSSAL

SEQ ID NO: 2342001 - protein, 5 aa, Cryptosporidium parvum
KESKN

SEQ ID NO: 2342002 - protein, 8 aa, Cryptosporidium parvum
KESNYSPE

SEQ ID NO: 2342003 - protein, 8 aa, Cryptosporidium parvum
KETDEVKY

SEQ ID NO: 2342004 - protein, 7 aa, Cryptosporidium parvum
KETKREF

SEQ ID NO: 2342005 - protein, 5 aa, Cryptosporidium parvum
KETNE

SEQ ID NO: 2342006 - protein, 7 aa, Cryptosporidium parvum
KETRSRN

SEQ ID NO: 2342007 - protein, 5 aa, Cryptosporidium parvum
KEVTE

SEQ ID NO: 2342008 - protein, 5 aa, Cryptosporidium parvum
KEYRN

SEQ ID NO: 2342009 - protein, 6 aa, Cryptosporidium parvum
KEYRND

SEQ ID NO: 2342010 - protein, 10 aa, Cryptosporidium parvum
KEYVPNKSSQ

SEQ ID NO: 2342011 - protein, 25 aa, Cryptosporidium parvum
KGCEPHNKYDPKLSTSYQKLGDGSL

SEQ ID NO: 2342012 - protein, 10 aa, Cryptosporidium parvum
KGDDSGMDHS

SEQ ID NO: 2342013 - protein, 10 aa, Cryptosporidium parvum
KGDSSGTEAF

SEQ ID NO: 2342014 - protein, 8 aa, Cryptosporidium parvum
KGEETKSL

SEQ ID NO: 2342015 - protein, 4 aa, Cryptosporidium parvum
KGEF

SEQ ID NO: 2342016 - protein, 4 aa, Cryptosporidium parvum
KGFY

SEQ ID NO: 2342017 - protein, 8 aa, Cryptosporidium parvum
KGGDFVSP

SEQ ID NO: 2342018 - protein, 8 aa, Cryptosporidium parvum
KGINSRKS

SEQ ID NO: 2342019 - protein, 14 aa, Cryptosporidium parvum
KGKSSYSDKNNNRS

SEQ ID NO: 2342020 - protein, 14 aa, Cryptosporidium parvum
KGLDSETDMENQTK

SEQ ID NO: 2342021 - protein, 8 aa, Cryptosporidium parvum
KGMNNNSN

SEQ ID NO: 2342022 - protein, 15 aa, Cryptosporidium parvum
KGPASLKMKSGSTFA

SEQ ID NO: 2342023 - protein, 19 aa, Cryptosporidium parvum
KGRCEDNESDIESCNEQSC

SEQ ID NO: 2342024 - protein, 4 aa, Cryptosporidium parvum
KGSN

SEQ ID NO: 2342025 - protein, 8 aa, Cryptosporidium parvum
KGTSPKLA

SEQ ID NO: 2342026 - protein, 9 aa, Cryptosporidium parvum
KHDSNTEQV

SEQ ID NO: 2342027 - protein, 12 aa, Cryptosporidium parvum
KHGNLSLQNHLN

SEQ ID NO: 2342028 - protein, 5 aa, Cryptosporidium parvum
KHQGP

SEQ ID NO: 2342029 - protein, 4 aa, Cryptosporidium parvum
KHSG

SEQ ID NO: 2342030 - protein, 7 aa, Cryptosporidium parvum
KHSPSKK

SEQ ID NO: 2342031 - protein, 11 aa, Cryptosporidium parvum
KHSRGDLGSYP

SEQ ID NO: 2342032 - protein, 6 aa, Cryptosporidium parvum
KHTEPS

SEQ ID NO: 2342033 - protein, 4 aa, Cryptosporidium parvum
KIGS

SEQ ID NO: 2342034 - protein, 9 aa, Cryptosporidium parvum
KIRSNARAE

SEQ ID NO: 2342035 - protein, 8 aa, Cryptosporidium parvum
KKALANSK

SEQ ID NO: 2342036 - protein, 10 aa, Cryptosporidium parvum
KKDDVESTNE

SEQ ID NO: 2342037 - protein, 8 aa, Cryptosporidium parvum
KKDQASSF

SEQ ID NO: 2342038 - protein, 7 aa, Cryptosporidium parvum
KKEANGK

SEQ ID NO: 2342039 - protein, 12 aa, Cryptosporidium parvum
KKFKSKEYIENK

SEQ ID NO: 2342040 - protein, 17 aa, Cryptosporidium parvum
KKHGKSSKQDESDNEQQ

SEQ ID NO: 2342041 - protein, 10 aa, Cryptosporidium parvum
KKINKSPDKR

SEQ ID NO: 2342042 - protein, 6 aa, Cryptosporidium parvum
KKKDNC

SEQ ID NO: 2342043 - protein, 7 aa, Cryptosporidium parvum
KKKSEQE

SEQ ID NO: 2342044 - protein, 15 aa, Cryptosporidium parvum
KKLPKTNTSNVEGGD

SEQ ID NO: 2342045 - protein, 5 aa, Cryptosporidium parvum
KKNSY

SEQ ID NO: 2342046 - protein, 6 aa, Cryptosporidium parvum
KKQFES

SEQ ID NO: 2342047 - protein, 9 aa, Cryptosporidium parvum
KKQTEDLTA

SEQ ID NO: 2342048 - protein, 6 aa, Cryptosporidium parvum
KKRAGS

SEQ ID NO: 2342049 - protein, 7 aa, Cryptosporidium parvum
KKRITKN

SEQ ID NO: 2342050 - protein, 11 aa, Cryptosporidium parvum
KKRSQDHITTQ

SEQ ID NO: 2342051 - protein, 24 aa, Cryptosporidium parvum
KKRTGEETKKETEAKGDAEVGIEG

SEQ ID NO: 2342052 - protein, 6 aa, Cryptosporidium parvum
KKSADR

SEQ ID NO: 2342053 - protein, 6 aa, Cryptosporidium parvum
KKSDFY

SEQ ID NO: 2342054 - protein, 6 aa, Cryptosporidium parvum
KKSLKE

SEQ ID NO: 2342055 - protein, 5 aa, Cryptosporidium parvum
KKSSS

SEQ ID NO: 2342056 - protein, 14 aa, Cryptosporidium parvum
KKVRKNKDSKANKL

SEQ ID NO: 2342057 - protein, 11 aa, Cryptosporidium parvum
KKVTSKDLKSR

SEQ ID NO: 2342058 - protein, 27 aa, Cryptosporidium parvum
KLDEEAPTADQDSEHKSIDLSGESSVP

SEQ ID NO: 2342059 - protein, 18 aa, Cryptosporidium parvum
KLDKSESKLKSSNQGNIA

SEQ ID NO: 2342060 - protein, 5 aa, Cryptosporidium parvum
KLENV

SEQ ID NO: 2342061 - protein, 14 aa, Cryptosporidium parvum
KLERSGSVGSSSGS

SEQ ID NO: 2342062 - protein, 16 aa, Cryptosporidium parvum
KLKNQNKSSNAVRTFI

SEQ ID NO: 2342063 - protein, 7 aa, Cryptosporidium parvum
KLNNGHK

SEQ ID NO: 2342064 - protein, 9 aa, Cryptosporidium parvum
KLPSATKNL

SEQ ID NO: 2342065 - protein, 7 aa, Cryptosporidium parvum
KLPSDPE

SEQ ID NO: 2342066 - protein, 18 aa, Cryptosporidium parvum
KLQKGGRYQGSMRETKAI

SEQ ID NO: 2342067 - protein, 17 aa, Cryptosporidium parvum
KLRHKDGVRKRLGSIFV

SEQ ID NO: 2342068 - protein, 7 aa, Cryptosporidium parvum
KLSNKYV

SEQ ID NO: 2342069 - protein, 7 aa, Cryptosporidium parvum
KNAPKGL

SEQ ID NO: 2342070 - protein, 7 aa, Cryptosporidium parvum
KNEEIPT

SEQ ID NO: 2342071 - protein, 6 aa, Cryptosporidium parvum
KNEIQR

SEQ ID NO: 2342072 - protein, 6 aa, Cryptosporidium parvum
KNITEL

SEQ ID NO: 2342073 - protein, 8 aa, Cryptosporidium parvum
KNKKSPFD

SEQ ID NO: 2342074 - protein, 8 aa, Cryptosporidium parvum
KNKSISSS

SEQ ID NO: 2342075 - protein, 7 aa, Cryptosporidium parvum
KNKSREG

SEQ ID NO: 2342076 - protein, 6 aa, Cryptosporidium parvum
KNKTIP

SEQ ID NO: 2342077 - protein, 13 aa, Cryptosporidium parvum
KNKTLQNDQLESS

SEQ ID NO: 2342078 - protein, 12 aa, Cryptosporidium parvum
KNKYKASVPKST

SEQ ID NO: 2342079 - protein, 10 aa, Cryptosporidium parvum
KNLGKNNLEE

SEQ ID NO: 2342080 - protein, 9 aa, Cryptosporidium parvum
KNNGENSLE

SEQ ID NO: 2342081 - protein, 6 aa, Cryptosporidium parvum
KNNKKD

SEQ ID NO: 2342082 - protein, 6 aa, Cryptosporidium parvum
KNNNIP

SEQ ID NO: 2342083 - protein, 8 aa, Cryptosporidium parvum
KNNSSKEF

SEQ ID NO: 2342084 - protein, 14 aa, Cryptosporidium parvum
KNPEGNKQIEGKSK

SEQ ID NO: 2342085 - protein, 8 aa, Cryptosporidium parvum
KNPPPEMH

SEQ ID NO: 2342086 - protein, 8 aa, Cryptosporidium parvum
KNPSSKWN

SEQ ID NO: 2342087 - protein, 4 aa, Cryptosporidium parvum
KNQI

SEQ ID NO: 2342088 - protein, 9 aa, Cryptosporidium parvum
KNQRNSGIK

SEQ ID NO: 2342089 - protein, 6 aa, Cryptosporidium parvum
KNQRVM

SEQ ID NO: 2342090 - protein, 7 aa, Cryptosporidium parvum
KNRNNGY

SEQ ID NO: 2342091 - protein, 6 aa, Cryptosporidium parvum
KNRTGQ

SEQ ID NO: 2342092 - protein, 8 aa, Cryptosporidium parvum
KNSISESI

SEQ ID NO: 2342093 - protein, 5 aa, Cryptosporidium parvum
KNSLN

SEQ ID NO: 2342094 - protein, 5 aa, Cryptosporidium parvum
KNSRH

SEQ ID NO: 2342095 - protein, 21 aa, Cryptosporidium parvum
KNSSNDTNEDDLDSSTNKDNF

SEQ ID NO: 2342096 - protein, 6 aa, Cryptosporidium parvum
KNSSNL

SEQ ID NO: 2342097 - protein, 12 aa, Cryptosporidium parvum
KNTTNTSSEKSN

SEQ ID NO: 2342098 - protein, 10 aa, Cryptosporidium parvum
KNYSDERPVD

SEQ ID NO: 2342099 - protein, 4 aa, Cryptosporidium parvum
KNYT

SEQ ID NO: 2342100 - protein, 14 aa, Cryptosporidium parvum
KPDNSHVFPFILDI

SEQ ID NO: 2342101 - protein, 14 aa, Cryptosporidium parvum
KPFYTGANSGTTNG

SEQ ID NO: 2342102 - protein, 6 aa, Cryptosporidium parvum
KPGNVN

SEQ ID NO: 2342103 - protein, 9 aa, Cryptosporidium parvum
KPIPQGNNN

SEQ ID NO: 2342104 - protein, 6 aa, Cryptosporidium parvum
KPISKK

SEQ ID NO: 2342105 - protein, 12 aa, Cryptosporidium parvum
KPKDFVWKNILL

SEQ ID NO: 2342106 - protein, 4 aa, Cryptosporidium parvum
KPKI

SEQ ID NO: 2342107 - protein, 8 aa, Cryptosporidium parvum
KPKKGWSE

SEQ ID NO: 2342108 - protein, 10 aa, Cryptosporidium parvum
KPKYAPPSHN

SEQ ID NO: 2342109 - protein, 33 aa, Cryptosporidium parvum
KPNSFQEKRGPEISPRQKVTNSNSPVASPSLRE

SEQ ID NO: 2342110 - protein, 8 aa, Cryptosporidium parvum
KPPEGYEK

SEQ ID NO: 2342111 - protein, 15 aa, Cryptosporidium parvum
KPPVDSPTLNEATTT

SEQ ID NO: 2342112 - protein, 5 aa, Cryptosporidium parvum
KPRNQ

SEQ ID NO: 2342113 - protein, 15 aa, Cryptosporidium parvum
KPSEKNNSVAKSNSS

SEQ ID NO: 2342114 - protein, 5 aa, Cryptosporidium parvum
KPVDF

SEQ ID NO: 2342115 - protein, 12 aa, Cryptosporidium parvum
KPVEFGKGDSDE

SEQ ID NO: 2342116 - protein, 8 aa, Cryptosporidium parvum
KQDATKAY

SEQ ID NO: 2342117 - protein, 9 aa, Cryptosporidium parvum
KQDSGNTEE

SEQ ID NO: 2342118 - protein, 5 aa, Cryptosporidium parvum
KQEKE

SEQ ID NO: 2342119 - protein, 8 aa, Cryptosporidium parvum
KQEKSQEL

SEQ ID NO: 2342120 - protein, 5 aa, Cryptosporidium parvum
KQENW

SEQ ID NO: 2342121 - protein, 8 aa, Cryptosporidium parvum
KQGFSEKE

SEQ ID NO: 2342122 - protein, 6 aa, Cryptosporidium parvum
KQGSVA

SEQ ID NO: 2342123 - protein, 10 aa, Cryptosporidium parvum
KQKRSSSISY

SEQ ID NO: 2342124 - protein, 8 aa, Cryptosporidium parvum
KQNDRIGV

SEQ ID NO: 2342125 - protein, 12 aa, Cryptosporidium parvum
KQNGNFGCDGGT

SEQ ID NO: 2342126 - protein, 8 aa, Cryptosporidium parvum
KQSNELKE

SEQ ID NO: 2342127 - protein, 8 aa, Cryptosporidium parvum
KQTATERT

SEQ ID NO: 2342128 - protein, 7 aa, Cryptosporidium parvum
KRASKDR

SEQ ID NO: 2342129 - protein, 11 aa, Cryptosporidium parvum
KRDKSIHGSGT

SEQ ID NO: 2342130 - protein, 11 aa, Cryptosporidium parvum
KREKSKSDQEH

SEQ ID NO: 2342131 - protein, 6 aa, Cryptosporidium parvum
KRGKKA

SEQ ID NO: 2342132 - protein, 4 aa, Cryptosporidium parvum
KRGV

SEQ ID NO: 2342133 - protein, 13 aa, Cryptosporidium parvum
KRIESKNPLGSKT

SEQ ID NO: 2342134 - protein, 22 aa, Cryptosporidium parvum
KRKPENNPIPELENSSSGSAEC

SEQ ID NO: 2342135 - protein, 9 aa, Cryptosporidium parvum
KRNINSFES

SEQ ID NO: 2342136 - protein, 6 aa, Cryptosporidium parvum
KRNPGL

SEQ ID NO: 2342137 - protein, 5 aa, Cryptosporidium parvum
KRNSI

SEQ ID NO: 2342138 - protein, 8 aa, Cryptosporidium parvum
KRPKRTHT

SEQ ID NO: 2342139 - protein, 10 aa, Cryptosporidium parvum
KRQKKIPSIN

SEQ ID NO: 2342140 - protein, 4 aa, Cryptosporidium parvum
KRRG

SEQ ID NO: 2342141 - protein, 6 aa, Cryptosporidium parvum
KRTISS

SEQ ID NO: 2342142 - protein, 6 aa, Cryptosporidium parvum
KRTRAK

SEQ ID NO: 2342143 - protein, 13 aa, Cryptosporidium parvum
KSAKGWRKKPPSF

SEQ ID NO: 2342144 - protein, 7 aa, Cryptosporidium parvum
KSASQRE

SEQ ID NO: 2342145 - protein, 8 aa, Cryptosporidium parvum
KSCSTGEI

SEQ ID NO: 2342146 - protein, 15 aa, Cryptosporidium parvum
KSDIDKNSNNKINSE

SEQ ID NO: 2342147 - protein, 9 aa, Cryptosporidium parvum
KSDQNLSSQ

SEQ ID NO: 2342148 - protein, 9 aa, Cryptosporidium parvum
KSEDNYKYD

SEQ ID NO: 2342149 - protein, 5 aa, Cryptosporidium parvum
KSELA

SEQ ID NO: 2342150 - protein, 35 aa, Cryptosporidium parvum; identical to SEQ ID NO: 2218588

SEQ ID NO: 2342151 - protein, 11 aa, Cryptosporidium parvum
KSGSSESFNET

SEQ ID NO: 2342152 - protein, 7 aa, Cryptosporidium parvum
KSHEGIK

SEQ ID NO: 2342153 - protein, 6 aa, Cryptosporidium parvum
KSHSEA

SEQ ID NO: 2342154 - protein, 6 aa, Cryptosporidium parvum
KSIDEL

SEQ ID NO: 2342155 - protein, 8 aa, Cryptosporidium parvum
KSIEPTSG

SEQ ID NO: 2342156 - protein, 14 aa, Cryptosporidium parvum
KSIKGAKGKITKKN

SEQ ID NO: 2342157 - protein, 10 aa, Cryptosporidium parvum
KSIPQNFRGS

SEQ ID NO: 2342158 - protein, 11 aa, Cryptosporidium parvum
KSIRNRQMNQG

SEQ ID NO: 2342159 - protein, 4 aa, Cryptosporidium parvum
KSKA

SEQ ID NO: 2342160 - protein, 25 aa, Cryptosporidium parvum
KSKDSDSNSKESSGSKIKSDQSKSL

SEQ ID NO: 2342161 - protein, 7 aa, Cryptosporidium parvum
KSKEFSN

SEQ ID NO: 2342162 - protein, 8 aa, Cryptosporidium parvum
KSKEKLKS

SEQ ID NO: 2342163 - protein, 10 aa, Cryptosporidium parvum
KSKQKAKYIE

SEQ ID NO: 2342164 - protein, 6 aa, Cryptosporidium parvum
KSKSLI

SEQ ID NO: 2342165 - protein, 12 aa, Cryptosporidium parvum
KSLAKSGLDGGT

SEQ ID NO: 2342166 - protein, 9 aa, Cryptosporidium parvum
KSLNKQSYT

SEQ ID NO: 2342167 - protein, 11 aa, Cryptosporidium parvum
KSLSNKRCNTK

SEQ ID NO: 2342168 - protein, 8 aa, Cryptosporidium parvum
KSMDLEQE

SEQ ID NO: 2342169 - protein, 7 aa, Cryptosporidium parvum
KSNANLN

SEQ ID NO: 2342170 - protein, 4 aa, Cryptosporidium parvum
KSNN

SEQ ID NO: 2342171 - protein, 6 aa, Cryptosporidium parvum
KSPLTN

SEQ ID NO: 2342172 - protein, 8 aa, Cryptosporidium parvum
KSQKNDDF

SEQ ID NO: 2342173 - protein, 5 aa, Cryptosporidium parvum
KSSCN

SEQ ID NO: 2342174 - protein, 6 aa, Cryptosporidium parvum
KSSEHL

SEQ ID NO: 2342175 - protein, 9 aa, Cryptosporidium parvum
KSSGAENSN

SEQ ID NO: 2342176 - protein, 6 aa, Cryptosporidium parvum
KSSKSV

SEQ ID NO: 2342177 - protein, 8 aa, Cryptosporidium parvum
KSSNNNSA

SEQ ID NO: 2342178 - protein, 9 aa, Cryptosporidium parvum
KSSRPVGDG

SEQ ID NO: 2342179 - protein, 14 aa, Cryptosporidium parvum
KSSSLNNKSFERSK

SEQ ID NO: 2342180 - protein, 14 aa, Cryptosporidium parvum
KSSVKVKKSSTGGE

SEQ ID NO: 2342181 - protein, 5 aa, Cryptosporidium parvum
KSSYV

SEQ ID NO: 2342182 - protein, 4 aa, Cryptosporidium parvum
KSTE

SEQ ID NO: 2342183 - protein, 7 aa, Cryptosporidium parvum
KSTGYKS

SEQ ID NO: 2342184 - protein, 5 aa, Cryptosporidium parvum
KSYQS

SEQ ID NO: 2342185 - protein, 7 aa, Cryptosporidium parvum
KSYRKKQ

SEQ ID NO: 2342186 - protein, 4 aa, Cryptosporidium parvum
KTAC

SEQ ID NO: 2342187 - protein, 6 aa, Cryptosporidium parvum
KTASIQ

SEQ ID NO: 2342188 - protein, 4 aa, Cryptosporidium parvum
KTEN

SEQ ID NO: 2342189 - protein, 8 aa, Cryptosporidium parvum
KTENNSEE

SEQ ID NO: 2342190 - protein, 4 aa, Cryptosporidium parvum
KTGR

SEQ ID NO: 2342191 - protein, 10 aa, Cryptosporidium parvum
KTIEENRAAP

SEQ ID NO: 2342192 - protein, 9 aa, Cryptosporidium parvum
KTKRNYDSI

SEQ ID NO: 2342193 - protein, 14 aa, Cryptosporidium parvum
KTKTEYRKTDSLGE

SEQ ID NO: 2342194 - protein, 9 aa, Cryptosporidium parvum
KTLENSRNL

SEQ ID NO: 2342195 - protein, 6 aa, Cryptosporidium parvum
KTPETL

SEQ ID NO: 2342196 - protein, 6 aa, Cryptosporidium parvum
KTQVGE

SEQ ID NO: 2342197 - protein, 4 aa, Cryptosporidium parvum
KTRW

SEQ ID NO: 2342198 - protein, 4 aa, Cryptosporidium parvum
KTSL

SEQ ID NO: 2342199 - protein, 5 aa, Cryptosporidium parvum
KVDSL

SEQ ID NO: 2342200 - protein, 7 aa, Cryptosporidium parvum
KVENKSE

SEQ ID NO: 2342201 - protein, 4 aa, Cryptosporidium parvum
KVET

SEQ ID NO: 2342202 - protein, 10 aa, Cryptosporidium parvum
KVIKSGSDSL

SEQ ID NO: 2342203 - protein, 11 aa, Cryptosporidium parvum
KVRSISGGERK

SEQ ID NO: 2342204 - protein, 4 aa, Cryptosporidium parvum
KVTK

SEQ ID NO: 2342205 - protein, 4 aa, Cryptosporidium parvum
KYDD

SEQ ID NO: 2342206 - protein, 12 aa, Cryptosporidium parvum
KYDKMNKSTSSS

SEQ ID NO: 2342207 - protein, 10 aa, Cryptosporidium parvum
KYEESPSDAV

SEQ ID NO: 2342208 - protein, 10 aa, Cryptosporidium parvum
KYGNNFNKES

SEQ ID NO: 2342209 - protein, 6 aa, Cryptosporidium parvum
KYIQSY

SEQ ID NO: 2342210 - protein, 4 aa, Cryptosporidium parvum
KYLN

SEQ ID NO: 2342211 - protein, 18 aa, Cryptosporidium parvum
KYMDNNDLTETSKDNDSY

SEQ ID NO: 2342212 - protein, 5 aa, Cryptosporidium parvum
KYNDK

SEQ ID NO: 2342213 - protein, 4 aa, Cryptosporidium parvum
KYSK

SEQ ID NO: 2342214 - protein, 6 aa, Cryptosporidium parvum
KYSSDD

SEQ ID NO: 2342215 - protein, 9 aa, Cryptosporidium parvum
LAEASSPYG

SEQ ID NO: 2342216 - protein, 6 aa, Cryptosporidium parvum
LANAKD

SEQ ID NO: 2342217 - protein, 12 aa, Cryptosporidium parvum
LAQDDQSNKKSK

SEQ ID NO: 2342218 - protein, 4 aa, Cryptosporidium parvum
LCGS

SEQ ID NO: 2342219 - protein, 6 aa, Cryptosporidium parvum
LDDTTD

SEQ ID NO: 2342220 - protein, 10 aa, Cryptosporidium parvum
LDPDTYTSKT

SEQ ID NO: 2342221 - protein, 6 aa, Cryptosporidium parvum
LDPKDK

SEQ ID NO: 2342222 - protein, 5 aa, Cryptosporidium parvum
LDPNT

SEQ ID NO: 2342223 - protein, 6 aa, Cryptosporidium parvum
LDQNNS

SEQ ID NO: 2342224 - protein, 17 aa, Cryptosporidium parvum
LDREKSCTQIKKGTGLN

SEQ ID NO: 2342225 - protein, 9 aa, Cryptosporidium parvum
LDSKPNNNK

SEQ ID NO: 2342226 - protein, 4 aa, Cryptosporidium parvum
LEEN

SEQ ID NO: 2342227 - protein, 5 aa, Cryptosporidium parvum
LEEQE

SEQ ID NO: 2342228 - protein, 7 aa, Cryptosporidium parvum
LEGKNIE

SEQ ID NO: 2342229 - protein, 5 aa, Cryptosporidium parvum
LEGQE

SEQ ID NO: 2342230 - protein, 12 aa, Cryptosporidium parvum
LENNYDLETKQE

SEQ ID NO: 2342231 - protein, 9 aa, Cryptosporidium parvum
LENSSNSSW

SEQ ID NO: 2342232 - protein, 6 aa, Cryptosporidium parvum
LEPGRI

SEQ ID NO: 2342233 - protein, 8 aa, Cryptosporidium parvum
LERNSNGM

SEQ ID NO: 2342234 - protein, 9 aa, Cryptosporidium parvum
LESDPKSSI

SEQ ID NO: 2342235 - protein, 9 aa, Cryptosporidium parvum
LESQKEDIS

SEQ ID NO: 2342236 - protein, 23 aa, Cryptosporidium parvum
LGEVGSSKKVFGEGATRREVGDE

SEQ ID NO: 2342237 - protein, 10 aa, Cryptosporidium parvum
LGGVPLSGNE

SEQ ID NO: 2342238 - protein, 5 aa, Cryptosporidium parvum
LGMST

SEQ ID NO: 2342239 - protein, 7 aa, Cryptosporidium parvum
LGPERNI

SEQ ID NO: 2342240 - protein, 10 aa, Cryptosporidium parvum
LGQSTPSLGS

SEQ ID NO: 2342241 - protein, 7 aa, Cryptosporidium parvum
LGSSSKS

SEQ ID NO: 2342242 - protein, 5 aa, Cryptosporidium parvum
LGSYE

SEQ ID NO: 2342243 - protein, 4 aa, Cryptosporidium parvum
LHSP

SEQ ID NO: 2342244 - protein, 9 aa, Cryptosporidium parvum
LKENNNDYK

SEQ ID NO: 2342245 - protein, 8 aa, Cryptosporidium parvum
LKGGSKRL

SEQ ID NO: 2342246 - protein, 7 aa, Cryptosporidium parvum
LKGVDSK

SEQ ID NO: 2342247 - protein, 9 aa, Cryptosporidium parvum
LKKRNQEEI

SEQ ID NO: 2342248 - protein, 9 aa, Cryptosporidium parvum
LKNASVDDA

SEQ ID NO: 2342249 - protein, 10 aa, Cryptosporidium parvum
LKNKEDVASQ

SEQ ID NO: 2342250 - protein, 6 aa, Cryptosporidium parvum
LKSGNN

SEQ ID NO: 2342251 - protein, 12 aa, Cryptosporidium parvum
LKSITPSSEQNE

SEQ ID NO: 2342252 - protein, 7 aa, Cryptosporidium parvum
LKSQNTT

SEQ ID NO: 2342253 - protein, 8 aa, Cryptosporidium parvum
LKTDKERI

SEQ ID NO: 2342254 - protein, 4 aa, Cryptosporidium parvum
LKTE

SEQ ID NO: 2342255 - protein, 15 aa, Cryptosporidium parvum
LKTGKNFEKLGGNPG

SEQ ID NO: 2342256 - protein, 7 aa, Cryptosporidium parvum
LKTNTTH

SEQ ID NO: 2342257 - protein, 7 aa, Cryptosporidium parvum
LKVPSNV

SEQ ID NO: 2342258 - protein, 10 aa, Cryptosporidium parvum
LLESPKNYTE

SEQ ID NO: 2342259 - protein, 6 aa, Cryptosporidium parvum
LLTTPK

SEQ ID NO: 2342260 - protein, 5 aa, Cryptosporidium parvum
LNGNE

SEQ ID NO: 2342261 - protein, 31 aa, Cryptosporidium parvum; identical to SEQ ID NO: 2116169

SEQ ID NO: 2342262 - protein, 8 aa, Cryptosporidium parvum
LNNSDGSL

SEQ ID NO: 2342263 - protein, 6 aa, Cryptosporidium parvum
LNNTNS

SEQ ID NO: 2342264 - protein, 6 aa, Cryptosporidium parvum
LNNTWQ

SEQ ID NO: 2342265 - protein, 20 aa, Cryptosporidium parvum
LNSEQGHPGLNNTSATGIST

SEQ ID NO: 2342266 - protein, 10 aa, Cryptosporidium parvum
LNSNNELDPD

SEQ ID NO: 2342267 - protein, 7 aa, Cryptosporidium parvum
LNSPETA

SEQ ID NO: 2342268 - protein, 5 aa, Cryptosporidium parvum
LNSPR

SEQ ID NO: 2342269 - protein, 11 aa, Cryptosporidium parvum
LNSSINNKKSL

SEQ ID NO: 2342270 - protein, 8 aa, Cryptosporidium parvum
LNTPPDSI

SEQ ID NO: 2342271 - protein, 5 aa, Cryptosporidium parvum
LPASF

SEQ ID NO: 2342272 - protein, 5 aa, Cryptosporidium parvum
LPENY

SEQ ID NO: 2342273 - protein, 21 aa, Cryptosporidium parvum
LPGMGSSSYGIPPSQGTPFPG

SEQ ID NO: 2342274 - protein, 9 aa, Cryptosporidium parvum
LPNQSSQIK

SEQ ID NO: 2342275 - protein, 8 aa, Cryptosporidium parvum
LPPPGVGS

SEQ ID NO: 2342276 - protein, 8 aa, Cryptosporidium parvum
LPQDGFNK

SEQ ID NO: 2342277 - protein, 13 aa, Cryptosporidium parvum
LPQEQNSFEKPNY

SEQ ID NO: 2342278 - protein, 30 aa, Cryptosporidium parvum; identical to SEQ ID NO: 2219570

SEQ ID NO: 2342279 - protein, 10 aa, Cryptosporidium parvum
LQDDKDKIEE

SEQ ID NO: 2342280 - protein, 11 aa, Cryptosporidium parvum
LQEKESALKTK

SEQ ID NO: 2342281 - protein, 8 aa, Cryptosporidium parvum
LQEPPKNT

SEQ ID NO: 2342282 - protein, 4 aa, Cryptosporidium parvum
LQTP

SEQ ID NO: 2342283 - protein, 10 aa, Cryptosporidium parvum
LRKKEDSDNN

SEQ ID NO: 2342284 - protein, 20 aa, Cryptosporidium parvum
LRSDSKDEENEKQGHIQPNN

SEQ ID NO: 2342285 - protein, 6 aa, Cryptosporidium parvum
LRSNHG

SEQ ID NO: 2342286 - protein, 7 aa, Cryptosporidium parvum
LRTSTRE

SEQ ID NO: 2342287 - protein, 5 aa, Cryptosporidium parvum
LSASP

SEQ ID NO: 2342288 - protein, 7 aa, Cryptosporidium parvum
LSDENQK

SEQ ID NO: 2342289 - protein, 8 aa, Cryptosporidium parvum
LSDHSPLN

SEQ ID NO: 2342290 - protein, 6 aa, Cryptosporidium parvum
LSDLNR

SEQ ID NO: 2342291 - protein, 6 aa, Cryptosporidium parvum
LSDNER

SEQ ID NO: 2342292 - protein, 15 aa, Cryptosporidium parvum
LSKQSEDLDNSNNTE

SEQ ID NO: 2342293 - protein, 9 aa, Cryptosporidium parvum
LSNNKNDQN

SEQ ID NO: 2342294 - protein, 5 aa, Cryptosporidium parvum
LSNNS

SEQ ID NO: 2342295 - protein, 5 aa, Cryptosporidium parvum
LSPPI

SEQ ID NO: 2342296 - protein, 7 aa, Cryptosporidium parvum
LSPSEKV

SEQ ID NO: 2342297 - protein, 7 aa, Cryptosporidium parvum
LSQTPST

SEQ ID NO: 2342298 - protein, 8 aa, Cryptosporidium parvum
LSRDPKVL

SEQ ID NO: 2342299 - protein, 4 aa, Cryptosporidium parvum
LSSE

SEQ ID NO: 2342300 - protein, 8 aa, Cryptosporidium parvum
LSSNSYSG

SEQ ID NO: 2342301 - protein, 8 aa, Cryptosporidium parvum
LSSQVNGD

SEQ ID NO: 2342302 - protein, 11 aa, Cryptosporidium parvum
LTASDSNGRDV

SEQ ID NO: 2342303 - protein, 8 aa, Cryptosporidium parvum
LTDDDYDK

SEQ ID NO: 2342304 - protein, 8 aa, Cryptosporidium parvum
LTDQSNYY

SEQ ID NO: 2342305 - protein, 9 aa, Cryptosporidium parvum
LTGGPTEDL

SEQ ID NO: 2342306 - protein, 11 aa, Cryptosporidium parvum
LTKPQETNTSY

SEQ ID NO: 2342307 - protein, 10 aa, Cryptosporidium parvum
LTPNYTEDQY

SEQ ID NO: 2342308 - protein, 5 aa, Cryptosporidium parvum
LTPSA

SEQ ID NO: 2342309 - protein, 12 aa, Cryptosporidium parvum
LYPDGPNSNINH

SEQ ID NO: 2342310 - protein, 9 aa, Cryptosporidium parvum
MANEQSDST

SEQ ID NO: 2342311 - protein, 10 aa, Cryptosporidium parvum
MANGNQVRKD

SEQ ID NO: 2342312 - protein, 29 aa, Cryptosporidium parvum
MAPSSEKKVINNKDEKSDNELENSSLSDT

SEQ ID NO: 2342313 - protein, 10 aa, Cryptosporidium parvum
MCSGSKTVAP

SEQ ID NO: 2342314 - protein, 10 aa, Cryptosporidium parvum
MDPTDGNSKL

SEQ ID NO: 2342315 - protein, 4 aa, Cryptosporidium parvum
MDSG

SEQ ID NO: 2342316 - protein, 8 aa, Cryptosporidium parvum
MEEKTNSK

SEQ ID NO: 2342317 - protein, 8 aa, Cryptosporidium parvum
MEGKSGQL

SEQ ID NO: 2342318 - protein, 4 aa, Cryptosporidium parvum
MEKY

SEQ ID NO: 2342319 - protein, 13 aa, Cryptosporidium parvum
MESEDDDLTDEEF

SEQ ID NO: 2342320 - protein, 7 aa, Cryptosporidium parvum
MESEKEQ

SEQ ID NO: 2342321 - protein, 7 aa, Cryptosporidium parvum
METEKKN

SEQ ID NO: 2342322 - protein, 11 aa, Cryptosporidium parvum
MKNNSNPEVQQ

SEQ ID NO: 2342323 - protein, 6 aa, Cryptosporidium parvum
MKRQEN

SEQ ID NO: 2342324 - protein, 10 aa, Cryptosporidium parvum
MNKNNSHDEN

SEQ ID NO: 2342325 - protein, 14 aa, Cryptosporidium parvum
MNKNSDSDSDSDSE

SEQ ID NO: 2342326 - protein, 14 aa, Cryptosporidium parvum
MNKNSGKLKSFNDE

SEQ ID NO: 2342327 - protein, 4 aa, Cryptosporidium parvum
MPRD

SEQ ID NO: 2342328 - protein, 6 aa, Cryptosporidium parvum
MPSKEM

SEQ ID NO: 2342329 - protein, 8 aa, Cryptosporidium parvum
MQETPPSV

SEQ ID NO: 2342330 - protein, 4 aa, Cryptosporidium parvum
MQIS

SEQ ID NO: 2342331 - protein, 4 aa, Cryptosporidium parvum
MSEK

SEQ ID NO: 2342332 - protein, 9 aa, Cryptosporidium parvum
MSKEKKRKL

SEQ ID NO: 2342333 - protein, 14 aa, Cryptosporidium parvum
MSSNGSIESPMSNG

SEQ ID NO: 2342334 - protein, 6 aa, Cryptosporidium parvum
MSTNTE

SEQ ID NO: 2342335 - protein, 5 aa, Cryptosporidium parvum
MTETG

SEQ ID NO: 2342336 - protein, 17 aa, Cryptosporidium parvum
MTPPTVQQLSEEDRDPI

SEQ ID NO: 2342337 - protein, 8 aa, Cryptosporidium parvum
MTYPSSSI

SEQ ID NO: 2342338 - protein, 6 aa, Cryptosporidium parvum
NADSEP

SEQ ID NO: 2342339 - protein, 14 aa, Cryptosporidium parvum
NANNNYYNSPSISN

SEQ ID NO: 2342340 - protein, 4 aa, Cryptosporidium parvum
NAPD

SEQ ID NO: 2342341 - protein, 5 aa, Cryptosporidium parvum
NAPDK

SEQ ID NO: 2342342 - protein, 5 aa, Cryptosporidium parvum
NAPEK

SEQ ID NO: 2342343 - protein, 7 aa, Cryptosporidium parvum
NAPESIT

SEQ ID NO: 2342344 - protein, 8 aa, Cryptosporidium parvum
NAPGGGKT

SEQ ID NO: 2342345 - protein, 4 aa, Cryptosporidium parvum
NAPI

SEQ ID NO: 2342346 - protein, 4 aa, Cryptosporidium parvum
NAPK

SEQ ID NO: 2342347 - protein, 16 aa, Cryptosporidium parvum
NAQNSQGNKGNPDFRK

SEQ ID NO: 2342348 - protein, 4 aa, Cryptosporidium parvum
NASN

SEQ ID NO: 2342349 - protein, 4 aa, Cryptosporidium parvum
NCEC

SEQ ID NO: 2342350 - protein, 15 aa, Cryptosporidium parvum
NCNSKTQSNSNFENE

SEQ ID NO: 2342351 - protein, 5 aa, Cryptosporidium parvum
NCPTE

SEQ ID NO: 2342352 - protein, 51 aa, Cryptosporidium parvum
NCSRDEKSLERKQNQRLSLSSSSSSSSSSSSSSSSSSSSSSSSSSSTSSSV

SEQ ID NO: 2342353 - protein, 6 aa, Cryptosporidium parvum
NDASDN

SEQ ID NO: 2342354 - protein, 5 aa, Cryptosporidium parvum
NDDSE

SEQ ID NO: 2342355 - protein, 16 aa, Cryptosporidium parvum
NDETETELEDSNNIEN

SEQ ID NO: 2342356 - protein, 5 aa, Cryptosporidium parvum
NDFGK

SEQ ID NO: 2342357 - protein, 7 aa, Cryptosporidium parvum
NDGQSIK

SEQ ID NO: 2342358 - protein, 4 aa, Cryptosporidium parvum
NDKK

SEQ ID NO: 2342359 - protein, 7 aa, Cryptosporidium parvum
NDKNVSE

SEQ ID NO: 2342360 - protein, 5 aa, Cryptosporidium parvum
NDKPT

SEQ ID NO: 2342361 - protein, 13 aa, Cryptosporidium parvum
NDNKSNNISDSNG

SEQ ID NO: 2342362 - protein, 8 aa, Cryptosporidium parvum
NDNNELKE

SEQ ID NO: 2342363 - protein, 9 aa, Cryptosporidium parvum
NDNQTNTEL

SEQ ID NO: 2342364 - protein, 5 aa, Cryptosporidium parvum
NDQSL

SEQ ID NO: 2342365 - protein, 5 aa, Cryptosporidium parvum
NDSIV

SEQ ID NO: 2342366 - protein, 6 aa, Cryptosporidium parvum
NDSKTI

SEQ ID NO: 2342367 - protein, 9 aa, Cryptosporidium parvum
NDSVGGKTI

SEQ ID NO: 2342368 - protein, 4 aa, Cryptosporidium parvum
NDTK

SEQ ID NO: 2342369 - protein, 9 aa, Cryptosporidium parvum
NDTTDTYDY

SEQ ID NO: 2342370 - protein, 9 aa, Cryptosporidium parvum
NEATNSTGT

SEQ ID NO: 2342371 - protein, 8 aa, Cryptosporidium parvum
NEENNEEK

SEQ ID NO: 2342372 - protein, 7 aa, Cryptosporidium parvum
NEESLVE

SEQ ID NO: 2342373 - protein, 5 aa, Cryptosporidium parvum
NEESW

SEQ ID NO: 2342374 - protein, 4 aa, Cryptosporidium parvum
NEGR

SEQ ID NO: 2342375 - protein, 6 aa, Cryptosporidium parvum
NEHHTG

SEQ ID NO: 2342376 - protein, 13 aa, Cryptosporidium parvum
NEIPGNSPINKTK

SEQ ID NO: 2342377 - protein, 6 aa, Cryptosporidium parvum
NEITPS

SEQ ID NO: 2342378 - protein, 8 aa, Cryptosporidium parvum
NEITSASK

SEQ ID NO: 2342379 - protein, 17 aa, Cryptosporidium parvum
NEKKAEDIKVEENNEQY

SEQ ID NO: 2342380 - protein, 13 aa, Cryptosporidium parvum
NEKNNTNTSLKGS

SEQ ID NO: 2342381 - protein, 23 aa, Cryptosporidium parvum
NELDSSRTPVNETINNPDDYEEW

SEQ ID NO: 2342382 - protein, 6 aa, Cryptosporidium parvum
NELEQS

SEQ ID NO: 2342383 - protein, 10 aa, Cryptosporidium parvum
NENATEKEIE

SEQ ID NO: 2342384 - protein, 11 aa, Cryptosporidium parvum
NENNYNRINNG

SEQ ID NO: 2342385 - protein, 5 aa, Cryptosporidium parvum
NEQDQ

SEQ ID NO: 2342386 - protein, 6 aa, Cryptosporidium parvum
NEQYSS

SEQ ID NO: 2342387 - protein, 6 aa, Cryptosporidium parvum
NERDSA

SEQ ID NO: 2342388 - protein, 11 aa, Cryptosporidium parvum
NERNNCTDTYS

SEQ ID NO: 2342389 - protein, 6 aa, Cryptosporidium parvum
NESDLS

SEQ ID NO: 2342390 - protein, 4 aa, Cryptosporidium parvum
NESL

SEQ ID NO: 2342391 - protein, 7 aa, Cryptosporidium parvum
NESNDQL

SEQ ID NO: 2342392 - protein, 6 aa, Cryptosporidium parvum
NESNSL

SEQ ID NO: 2342393 - protein, 22 aa, Cryptosporidium parvum
NESPGTGAKESLEEELSKTSKL

SEQ ID NO: 2342394 - protein, 16 aa, Cryptosporidium parvum
NESQQKNSNNSFSQSN

SEQ ID NO: 2342395 - protein, 7 aa, Cryptosporidium parvum
NETGKNI

SEQ ID NO: 2342396 - protein, 9 aa, Cryptosporidium parvum
NETNSRKTV

SEQ ID NO: 2342397 - protein, 8 aa, Cryptosporidium parvum
NFEQTRSE

SEQ ID NO: 2342398 - protein, 4 aa, Cryptosporidium parvum
NFGS

SEQ ID NO: 2342399 - protein, 4 aa, Cryptosporidium parvum
NFSK

SEQ ID NO: 2342400 - protein, 6 aa, Cryptosporidium parvum
NGDGSI

SEQ ID NO: 2342401 - protein, 6 aa, Cryptosporidium parvum
NGDKDK

SEQ ID NO: 2342402 - protein, 8 aa, Cryptosporidium parvum
NGDLVDKD

SEQ ID NO: 2342403 - protein, 6 aa, Cryptosporidium parvum
NGGSIK

SEQ ID NO: 2342404 - protein, 11 aa, Cryptosporidium parvum
NGGTACPSSNQ

SEQ ID NO: 2342405 - protein, 6 aa, Cryptosporidium parvum
NGGTLA

SEQ ID NO: 2342406 - protein, 6 aa, Cryptosporidium parvum
NGGTLE

SEQ ID NO: 2342407 - protein, 4 aa, Cryptosporidium parvum
NGIG

SEQ ID NO: 2342408 - protein, 10 aa, Cryptosporidium parvum
NGLSATDDPL

SEQ ID NO: 2342409 - protein, 13 aa, Cryptosporidium parvum
NGNESNSSIDGSH

SEQ ID NO: 2342410 - protein, 8 aa, Cryptosporidium parvum
NGNHSNKD

SEQ ID NO: 2342411 - protein, 12 aa, Cryptosporidium parvum
NGNKNDQDKYQP

SEQ ID NO: 2342412 - protein, 42 aa, Cryptosporidium parvum; identical to SEQ ID NO: 2220523

SEQ ID NO: 2342413 - protein, 7 aa, Cryptosporidium parvum
NGSNTSI

SEQ ID NO: 2342414 - protein, 5 aa, Cryptosporidium parvum
NGSPI

SEQ ID NO: 2342415 - protein, 8 aa, Cryptosporidium parvum
NGSSRDQG

SEQ ID NO: 2342416 - protein, 12 aa, Cryptosporidium parvum
NGTRIPSCDEKQ

SEQ ID NO: 2342417 - protein, 5 aa, Cryptosporidium parvum
NGVPA

SEQ ID NO: 2342418 - protein, 6 aa, Cryptosporidium parvum
NGYDYE

SEQ ID NO: 2342419 - protein, 12 aa, Cryptosporidium parvum
NHKNQNNNKNNN

SEQ ID NO: 2342420 - protein, 9 aa, Cryptosporidium parvum
NHNRSDSES

SEQ ID NO: 2342421 - protein, 10 aa, Cryptosporidium parvum
NHQKYNQNHD

SEQ ID NO: 2342422 - protein, 9 aa, Cryptosporidium parvum
NHSKDDEGE

SEQ ID NO: 2342423 - protein, 8 aa, Cryptosporidium parvum
NHSQNEQY

SEQ ID NO: 2342424 - protein, 4 aa, Cryptosporidium parvum
NIDS

SEQ ID NO: 2342425 - protein, 4 aa, Cryptosporidium parvum
NIED

SEQ ID NO: 2342426 - protein, 20 aa, Cryptosporidium parvum
NIEPSNIKNETSNENNSEEV

SEQ ID NO: 2342427 - protein, 5 aa, Cryptosporidium parvum
NIKKK

SEQ ID NO: 2342428 - protein, 10 aa, Cryptosporidium parvum
NIMPPTTSKY

SEQ ID NO: 2342429 - protein, 8 aa, Cryptosporidium parvum
NINSSYSS

SEQ ID NO: 2342430 - protein, 9 aa, Cryptosporidium parvum
NIPGEGTNN

SEQ ID NO: 2342431 - protein, 13 aa, Cryptosporidium parvum
NIQNSNNNLNSSL

SEQ ID NO: 2342432 - protein, 21 aa, Cryptosporidium parvum
NISGIREKKEINSSSTEEKPK

SEQ ID NO: 2342433 - protein, 15 aa, Cryptosporidium parvum
NKANHASPEEKTSPF

SEQ ID NO: 2342434 - protein, 26 aa, Cryptosporidium parvum
NKANSNKKTGIYESDTKSSIEAKSKE

SEQ ID NO: 2342435 - protein, 6 aa, Cryptosporidium parvum
NKDKLG

SEQ ID NO: 2342436 - protein, 31 aa, Cryptosporidium parvum; identical to SEQ ID NO: 2220717

SEQ ID NO: 2342437 - protein, 10 aa, Cryptosporidium parvum
NKDYSKDGKT

SEQ ID NO: 2342438 - protein, 9 aa, Cryptosporidium parvum
NKEGQKPDI

SEQ ID NO: 2342439 - protein, 19 aa, Cryptosporidium parvum
NKESVQKNLRAKRKEYNDR

SEQ ID NO: 2342440 - protein, 12 aa, Cryptosporidium parvum
NKEYSKSREGSL

SEQ ID NO: 2342441 - protein, 9 aa, Cryptosporidium parvum
NKKNTKEPI

SEQ ID NO: 2342442 - protein, 8 aa, Cryptosporidium parvum
NKKPLENE

SEQ ID NO: 2342443 - protein, 6 aa, Cryptosporidium parvum
NKMKQE

SEQ ID NO: 2342444 - protein, 7 aa, Cryptosporidium parvum
NKNDEKH

SEQ ID NO: 2342445 - protein, 9 aa, Cryptosporidium parvum
NKNHSNKWT

SEQ ID NO: 2342446 - protein, 13 aa, Cryptosporidium parvum
NKNNTGKNCESGN

SEQ ID NO: 2342447 - protein, 6 aa, Cryptosporidium parvum
NKNSSH

SEQ ID NO: 2342448 - protein, 7 aa, Cryptosporidium parvum
NKPYENL

SEQ ID NO: 2342449 - protein, 19 aa, Cryptosporidium parvum
NKRSGFKRSFGGDSQKHSH

SEQ ID NO: 2342450 - protein, 9 aa, Cryptosporidium parvum
NKSAPISNQ

SEQ ID NO: 2342451 - protein, 36 aa, Cryptosporidium parvum
NKSPGLEHTNNKYSEEIGGAYSPFRKRNKNNEKYSL

SEQ ID NO: 2342452 - protein, 49 aa, Cryptosporidium parvum; identical to SEQ ID NO: 2220869

SEQ ID NO: 2342453 - protein, 10 aa, Cryptosporidium parvum
NKSSGDNRNI

SEQ ID NO: 2342454 - protein, 7 aa, Cryptosporidium parvum
NLDGEEP

SEQ ID NO: 2342455 - protein, 6 aa, Cryptosporidium parvum
NLENVQ

SEQ ID NO: 2342456 - protein, 73 aa, Cryptosporidium parvum; identical to SEQ ID NO: 2220916

SEQ ID NO: 2342457 - protein, 10 aa, Cryptosporidium parvum
NLGSETSKEK

SEQ ID NO: 2342458 - protein, 6 aa, Cryptosporidium parvum
NLSEGM

SEQ ID NO: 2342459 - protein, 13 aa, Cryptosporidium parvum
NLSPYNNSGVYHQ

SEQ ID NO: 2342460 - protein, 5 aa, Cryptosporidium parvum
NLTDK

SEQ ID NO: 2342461 - protein, 5 aa, Cryptosporidium parvum
NLTME

SEQ ID NO: 2342462 - protein, 9 aa, Cryptosporidium parvum
NLTNKDDKF

SEQ ID NO: 2342463 - protein, 7 aa, Cryptosporidium parvum
NLVPGGG

SEQ ID NO: 2342464 - protein, 11 aa, Cryptosporidium parvum
NMETTPTHETG

SEQ ID NO: 2342465 - protein, 20 aa, Cryptosporidium parvum
NMNQNTPPIVNSNGNHFNSP

SEQ ID NO: 2342466 - protein, 9 aa, Cryptosporidium parvum
NMTQSQRDK

SEQ ID NO: 2342467 - protein, 11 aa, Cryptosporidium parvum
NNDDDKFNEPA

SEQ ID NO: 2342468 - protein, 17 aa, Cryptosporidium parvum
NNDSEHKNSTKINGKSE

SEQ ID NO: 2342469 - protein, 6 aa, Cryptosporidium parvum
NNEEYS

SEQ ID NO: 2342470 - protein, 12 aa, Cryptosporidium parvum
NNESNKVEQTQI

SEQ ID NO: 2342471 - protein, 8 aa, Cryptosporidium parvum
NNETPKME

SEQ ID NO: 2342472 - protein, 5 aa, Cryptosporidium parvum
NNGKD

SEQ ID NO: 2342473 - protein, 18 aa, Cryptosporidium parvum
NNHSGMSGTTNNSNTNNV

SEQ ID NO: 2342474 - protein, 7 aa, Cryptosporidium parvum
NNISENQ

SEQ ID NO: 2342475 - protein, 7 aa, Cryptosporidium parvum
NNKKNKW

SEQ ID NO: 2342476 - protein, 8 aa, Cryptosporidium parvum
NNKKNPSI

SEQ ID NO: 2342477 - protein, 10 aa, Cryptosporidium parvum
NNKNGMPSSF

SEQ ID NO: 2342478 - protein, 18 aa, Cryptosporidium parvum
NNLAQSSQSINTGNPNSH

SEQ ID NO: 2342479 - protein, 9 aa, Cryptosporidium parvum
NNLGSSQPL

SEQ ID NO: 2342480 - protein, 9 aa, Cryptosporidium parvum
NNLRDPDAD

SEQ ID NO: 2342481 - protein, 7 aa, Cryptosporidium parvum
NNNDDGN

SEQ ID NO: 2342482 - protein, 9 aa, Cryptosporidium parvum
NNNITGNSH

SEQ ID NO: 2342483 - protein, 14 aa, Cryptosporidium parvum
NNNNNNNKCQYKES

SEQ ID NO: 2342484 - protein, 6 aa, Cryptosporidium parvum
NNNSHL

SEQ ID NO: 2342485 - protein, 5 aa, Cryptosporidium parvum
NNQGN

SEQ ID NO: 2342486 - protein, 9 aa, Cryptosporidium parvum
NNQNSQNTV

SEQ ID NO: 2342487 - protein, 8 aa, Cryptosporidium parvum
NNQPISDK

SEQ ID NO: 2342488 - protein, 12 aa, Cryptosporidium parvum
NNQSISNGKYLY

SEQ ID NO: 2342489 - protein, 6 aa, Cryptosporidium parvum
NNQVKR

SEQ ID NO: 2342490 - protein, 6 aa, Cryptosporidium parvum
NNSEGG

SEQ ID NO: 2342491 - protein, 14 aa, Cryptosporidium parvum
NNSNQNDLSAISSN

SEQ ID NO: 2342492 - protein, 10 aa, Cryptosporidium parvum
NNSNRRNQDF

SEQ ID NO: 2342493 - protein, 9 aa, Cryptosporidium parvum
NNSQIQGNV

SEQ ID NO: 2342494 - protein, 12 aa, Cryptosporidium parvum
NNSQSGSSFSTS

SEQ ID NO: 2342495 - protein, 6 aa, Cryptosporidium parvum
NNTAGI

SEQ ID NO: 2342496 - protein, 7 aa, Cryptosporidium parvum
NNTETYQ

SEQ ID NO: 2342497 - protein, 4 aa, Cryptosporidium parvum
NNTL

SEQ ID NO: 2342498 - protein, 17 aa, Cryptosporidium parvum
NNTQTESNSFKNSPNNL

SEQ ID NO: 2342499 - protein, 7 aa, Cryptosporidium parvum
NNTSDKI

SEQ ID NO: 2342500 - protein, 17 aa, Cryptosporidium parvum
NNVEKEKDNLENEEYEK

SEQ ID NO: 2342501 - protein, 9 aa, Cryptosporidium parvum
NPDDPRGHE

SEQ ID NO: 2342502 - protein, 21 aa, Cryptosporidium parvum
NPESAGPRPPGVQATPQTSPF

SEQ ID NO: 2342503 - protein, 6 aa, Cryptosporidium parvum
NPGQPF

SEQ ID NO: 2342504 - protein, 5 aa, Cryptosporidium parvum
NPGTV

SEQ ID NO: 2342505 - protein, 4 aa, Cryptosporidium parvum
NPIN

SEQ ID NO: 2342506 - protein, 17 aa, Cryptosporidium parvum
NPKHETDLEDRARSAIE

SEQ ID NO: 2342507 - protein, 6 aa, Cryptosporidium parvum
NPLKSE

SEQ ID NO: 2342508 - protein, 7 aa, Cryptosporidium parvum
NPNHSKV

SEQ ID NO: 2342509 - protein, 8 aa, Cryptosporidium parvum
NPNKSPGI

SEQ ID NO: 2342510 - protein, 10 aa, Cryptosporidium parvum
NPNKTSYYKK

SEQ ID NO: 2342511 - protein, 8 aa, Cryptosporidium parvum
NPNPPSPT

SEQ ID NO: 2342512 - protein, 9 aa, Cryptosporidium parvum
NPNQNSKIA

SEQ ID NO: 2342513 - protein, 6 aa, Cryptosporidium parvum
NPNYRN

SEQ ID NO: 2342514 - protein, 4 aa, Cryptosporidium parvum
NPPI

SEQ ID NO: 2342515 - protein, 4 aa, Cryptosporidium parvum
NPPQ

SEQ ID NO: 2342516 - protein, 9 aa, Cryptosporidium parvum
NPRPINENS

SEQ ID NO: 2342517 - protein, 10 aa, Cryptosporidium parvum
NPTENRNRED

SEQ ID NO: 2342518 - protein, 4 aa, Cryptosporidium parvum
NPTF

SEQ ID NO: 2342519 - protein, 8 aa, Cryptosporidium parvum
NPTSKPFG

SEQ ID NO: 2342520 - protein, 6 aa, Cryptosporidium parvum
NQDGNG

SEQ ID NO: 2342521 - protein, 9 aa, Cryptosporidium parvum
NQDSKVPKL

SEQ ID NO: 2342522 - protein, 5 aa, Cryptosporidium parvum
NQEFY

SEQ ID NO: 2342523 - protein, 14 aa, Cryptosporidium parvum
NQETKEAKEAQDGN

SEQ ID NO: 2342524 - protein, 4 aa, Cryptosporidium parvum
NQGT

SEQ ID NO: 2342525 - protein, 14 aa, Cryptosporidium parvum
NQIEENSSGRIQAY

SEQ ID NO: 2342526 - protein, 6 aa, Cryptosporidium parvum
NQKNIS

SEQ ID NO: 2342527 - protein, 7 aa, Cryptosporidium parvum
NQLSSNN

SEQ ID NO: 2342528 - protein, 72 aa, Cryptosporidium parvum; identical to SEQ ID NO: 2221428

SEQ ID NO: 2342529 - protein, 6 aa, Cryptosporidium parvum
NQNPGS

SEQ ID NO: 2342530 - protein, 6 aa, Cryptosporidium parvum
NQPHAA

SEQ ID NO: 2342531 - protein, 115 aa, Cryptosporidium parvum; identical to SEQ ID NO: 2221459

SEQ ID NO: 2342532 - protein, 14 aa, Cryptosporidium parvum
NQTHEYQSKEAEKL

SEQ ID NO: 2342533 - protein, 11 aa, Cryptosporidium parvum
NQTKENTDDDN

SEQ ID NO: 2342534 - protein, 4 aa, Cryptosporidium parvum
NRFS

SEQ ID NO: 2342535 - protein, 5 aa, Cryptosporidium parvum
NRGEQ

SEQ ID NO: 2342536 - protein, 4 aa, Cryptosporidium parvum
NRLS

SEQ ID NO: 2342537 - protein, 12 aa, Cryptosporidium parvum
NRNNNSSTEGQD

SEQ ID NO: 2342538 - protein, 7 aa, Cryptosporidium parvum
NRNSNAS

SEQ ID NO: 2342539 - protein, 5 aa, Cryptosporidium parvum
NRNSP

SEQ ID NO: 2342540 - protein, 19 aa, Cryptosporidium parvum
NRPIKKNEIKRELTQSQPH

SEQ ID NO: 2342541 - protein, 6 aa, Cryptosporidium parvum
NRSASL

SEQ ID NO: 2342542 - protein, 5 aa, Cryptosporidium parvum
NRSSQ

SEQ ID NO: 2342543 - protein, 7 aa, Cryptosporidium parvum
NRTGDGV

SEQ ID NO: 2342544 - protein, 8 aa, Cryptosporidium parvum
NSDGDKIY

SEQ ID NO: 2342545 - protein, 10 aa, Cryptosporidium parvum
NSDNPSDSAY

SEQ ID NO: 2342546 - protein, 7 aa, Cryptosporidium parvum
NSDPSSA

SEQ ID NO: 2342547 - protein, 17 aa, Cryptosporidium parvum
NSDRRTRSKNVNNDLPN

SEQ ID NO: 2342548 - protein, 4 aa, Cryptosporidium parvum
NSDS

SEQ ID NO: 2342549 - protein, 7 aa, Cryptosporidium parvum
NSDSLQE

SEQ ID NO: 2342550 - protein, 6 aa, Cryptosporidium parvum
NSEEGI

SEQ ID NO: 2342551 - protein, 19 aa, Cryptosporidium parvum
NSETENTSQGPPPPPSSGI

SEQ ID NO: 2342552 - protein, 7 aa, Cryptosporidium parvum
NSGRYGS

SEQ ID NO: 2342553 - protein, 34 aa, Cryptosporidium parvum; identical to SEQ ID NO: 2221631

SEQ ID NO: 2342554 - protein, 5 aa, Cryptosporidium parvum
NSINE

SEQ ID NO: 2342555 - protein, 6 aa, Cryptosporidium parvum
NSIRRS

SEQ ID NO: 2342556 - protein, 5 aa, Cryptosporidium parvum
NSIRT

SEQ ID NO: 2342557 - protein, 9 aa, Cryptosporidium parvum
NSISPEKGD

SEQ ID NO: 2342558 - protein, 13 aa, Cryptosporidium parvum
NSKAEDAKKRKIE

SEQ ID NO: 2342559 - protein, 8 aa, Cryptosporidium parvum
NSKAPLGF

SEQ ID NO: 2342560 - protein, 4 aa, Cryptosporidium parvum
NSKR

SEQ ID NO: 2342561 - protein, 9 aa, Cryptosporidium parvum
NSKSDGSAL

SEQ ID NO: 2342562 - protein, 9 aa, Cryptosporidium parvum
NSKSENYEE

SEQ ID NO: 2342563 - protein, 8 aa, Cryptosporidium parvum
NSLDKRTS

SEQ ID NO: 2342564 - protein, 6 aa, Cryptosporidium parvum
NSLDRT

SEQ ID NO: 2342565 - protein, 10 aa, Cryptosporidium parvum
NSLEDSDNWG

SEQ ID NO: 2342566 - protein, 16 aa, Cryptosporidium parvum
NSLLNANDTYKQYGDK

SEQ ID NO: 2342567 - protein, 11 aa, Cryptosporidium parvum
NSNEYSYSDSG

SEQ ID NO: 2342568 - protein, 6 aa, Cryptosporidium parvum
NSNKIN

SEQ ID NO: 2342569 - protein, 9 aa, Cryptosporidium parvum
NSNPDNNNY

SEQ ID NO: 2342570 - protein, 6 aa, Cryptosporidium parvum
NSNSDQ

SEQ ID NO: 2342571 - protein, 18 aa, Cryptosporidium parvum
NSNSIESAHSTTSSSRIS

SEQ ID NO: 2342572 - protein, 7 aa, Cryptosporidium parvum
NSPEEGI

SEQ ID NO: 2342573 - protein, 8 aa, Cryptosporidium parvum
NSQDNNSI

SEQ ID NO: 2342574 - protein, 9 aa, Cryptosporidium parvum
NSQNNQTEI

SEQ ID NO: 2342575 - protein, 5 aa, Cryptosporidium parvum
NSQYA

SEQ ID NO: 2342576 - protein, 5 aa, Cryptosporidium parvum
NSRSI

SEQ ID NO: 2342577 - protein, 6 aa, Cryptosporidium parvum
NSSGQC

SEQ ID NO: 2342578 - protein, 9 aa, Cryptosporidium parvum
NSSKSSSFG

SEQ ID NO: 2342579 - protein, 23 aa, Cryptosporidium parvum
NSSNQASSSIRQAQNSSTGLANT

SEQ ID NO: 2342580 - protein, 17 aa, Cryptosporidium parvum
NSSNVNNNNQNDSDSSF

SEQ ID NO: 2342581 - protein, 14 aa, Cryptosporidium parvum
NSSQTTLKKNKLTQ

SEQ ID NO: 2342582 - protein, 7 aa, Cryptosporidium parvum
NSSRSTH

SEQ ID NO: 2342583 - protein, 20 aa, Cryptosporidium parvum
NSSSGNSLEGTSNSSDIKTR

SEQ ID NO: 2342584 - protein, 22 aa, Cryptosporidium parvum
NSSSNQMNQYSSSTSNQQDNYY

SEQ ID NO: 2342585 - protein, 5 aa, Cryptosporidium parvum
NSTLP

SEQ ID NO: 2342586 - protein, 7 aa, Cryptosporidium parvum
NSTRNNY

SEQ ID NO: 2342587 - protein, 7 aa, Cryptosporidium parvum
NSVSYPG

SEQ ID NO: 2342588 - protein, 4 aa, Cryptosporidium parvum
NTDF

SEQ ID NO: 2342589 - protein, 8 aa, Cryptosporidium parvum
NTEPGRVP

SEQ ID NO: 2342590 - protein, 11 aa, Cryptosporidium parvum
NTIPSSDISNK

SEQ ID NO: 2342591 - protein, 8 aa, Cryptosporidium parvum
NTKDENTY

SEQ ID NO: 2342592 - protein, 9 aa, Cryptosporidium parvum
NTKTESLEI

SEQ ID NO: 2342593 - protein, 10 aa, Cryptosporidium parvum
NTNHNQPPLV

SEQ ID NO: 2342594 - protein, 9 aa, Cryptosporidium parvum
NTNSNNPIG

SEQ ID NO: 2342595 - protein, 5 aa, Cryptosporidium parvum
NTPDC

SEQ ID NO: 2342596 - protein, 5 aa, Cryptosporidium parvum
NTPLR

SEQ ID NO: 2342597 - protein, 4 aa, Cryptosporidium parvum
NTPS

SEQ ID NO: 2342598 - protein, 5 aa, Cryptosporidium parvum
NTPYN

SEQ ID NO: 2342599 - protein, 7 aa, Cryptosporidium parvum
NTQSVKD

SEQ ID NO: 2342600 - protein, 10 aa, Cryptosporidium parvum
NTRENDKSRD

SEQ ID NO: 2342601 - protein, 7 aa, Cryptosporidium parvum
NTSKSGK

SEQ ID NO: 2342602 - protein, 9 aa, Cryptosporidium parvum
NTSKTKKKI

SEQ ID NO: 2342603 - protein, 44 aa, Cryptosporidium parvum; identical to SEQ ID NO: 2221993

SEQ ID NO: 2342604 - protein, 8 aa, Cryptosporidium parvum
NTSTSNAI

SEQ ID NO: 2342605 - protein, 18 aa, Cryptosporidium parvum
NTTFNEKVKSSSSVEGSI

SEQ ID NO: 2342606 - protein, 4 aa, Cryptosporidium parvum
NTTL

SEQ ID NO: 2342607 - protein, 21 aa, Cryptosporidium parvum
NTTLSSSYSNKIKKNPKIESL

SEQ ID NO: 2342608 - protein, 6 aa, Cryptosporidium parvum
NTVSFS

SEQ ID NO: 2342609 - protein, 12 aa, Cryptosporidium parvum
NVEDASKRDKYS

SEQ ID NO: 2342610 - protein, 11 aa, Cryptosporidium parvum
NVEGKKKLPIS

SEQ ID NO: 2342611 - protein, 5 aa, Cryptosporidium parvum
NVGQK

SEQ ID NO: 2342612 - protein, 15 aa, Cryptosporidium parvum
NVKGKTNEKEKNDDL

SEQ ID NO: 2342613 - protein, 18 aa, Cryptosporidium parvum
NVKKDGDHEIEEKRDGNT

SEQ ID NO: 2342614 - protein, 12 aa, Cryptosporidium parvum
NVKSPNKKKKGW

SEQ ID NO: 2342615 - protein, 10 aa, Cryptosporidium parvum
NVNNKDEAIE

SEQ ID NO: 2342616 - protein, 14 aa, Cryptosporidium parvum
NYGSYSQQPSSGYM

SEQ ID NO: 2342617 - protein, 11 aa, Cryptosporidium parvum
NYNGSDNKNSF

SEQ ID NO: 2342618 - protein, 19 aa, Cryptosporidium parvum
NYSNPIKSDGAKSERTTAK

SEQ ID NO: 2342619 - protein, 14 aa, Cryptosporidium parvum
NYSSNSRSIEVEAQ

SEQ ID NO: 2342620 - protein, 8 aa, Cryptosporidium parvum
NYSSRDLK

SEQ ID NO: 2342621 - protein, 9 aa, Cryptosporidium parvum
PAPITETPV

SEQ ID NO: 2342622 - protein, 7 aa, Cryptosporidium parvum
PAPPIPL

SEQ ID NO: 2342623 - protein, 5 aa, Cryptosporidium parvum
PAPRG

SEQ ID NO: 2342624 - protein, 25 aa, Cryptosporidium parvum
PAQVGTQSNHQNLQNVNQSKTQYPH

SEQ ID NO: 2342625 - protein, 14 aa, Cryptosporidium parvum
PDANESTNSDESQY

SEQ ID NO: 2342626 - protein, 4 aa, Cryptosporidium parvum
PDKG

SEQ ID NO: 2342627 - protein, 8 aa, Cryptosporidium parvum
PDKTDRDQ

SEQ ID NO: 2342628 - protein, 4 aa, Cryptosporidium parvum
PDPL

SEQ ID NO: 2342629 - protein, 10 aa, Cryptosporidium parvum
PDTDPTRRGR

SEQ ID NO: 2342630 - protein, 7 aa, Cryptosporidium parvum
PDTNPYD

SEQ ID NO: 2342631 - protein, 6 aa, Cryptosporidium parvum
PEDKTI

SEQ ID NO: 2342632 - protein, 5 aa, Cryptosporidium parvum
PEDVR

SEQ ID NO: 2342633 - protein, 5 aa, Cryptosporidium parvum
PEEDG

SEQ ID NO: 2342634 - protein, 6 aa, Cryptosporidium parvum
PEGENR

SEQ ID NO: 2342635 - protein, 4 aa, Cryptosporidium parvum
PEGF

SEQ ID NO: 2342636 - protein, 6 aa, Cryptosporidium parvum
PEGTSS

SEQ ID NO: 2342637 - protein, 6 aa, Cryptosporidium parvum
PEKEQE

SEQ ID NO: 2342638 - protein, 16 aa, Cryptosporidium parvum
PEKLSSSLDSTESVRE

SEQ ID NO: 2342639 - protein, 6 aa, Cryptosporidium parvum
PEKNPL

SEQ ID NO: 2342640 - protein, 8 aa, Cryptosporidium parvum
PENYNPTD

SEQ ID NO: 2342641 - protein, 20 aa, Cryptosporidium parvum
PEPTKSFQEELGESKDVPQQ

SEQ ID NO: 2342642 - protein, 17 aa, Cryptosporidium parvum
PEQIESGNQEKKIKGKR

SEQ ID NO: 2342643 - protein, 6 aa, Cryptosporidium parvum
PFSETE

SEQ ID NO: 2342644 - protein, 6 aa, Cryptosporidium parvum
PGEEET

SEQ ID NO: 2342645 - protein, 8 aa, Cryptosporidium parvum
PGESDQDH

SEQ ID NO: 2342646 - protein, 11 aa, Cryptosporidium parvum
PGHPGYVTPPQ

SEQ ID NO: 2342647 - protein, 26 aa, Cryptosporidium parvum
PGIRQKTQSYKYKRSQYSKKPKAKNK

SEQ ID NO: 2342648 - protein, 6 aa, Cryptosporidium parvum
PGKHTY

SEQ ID NO: 2342649 - protein, 11 aa, Cryptosporidium parvum
PGTSEASSDEV

SEQ ID NO: 2342650 - protein, 5 aa, Cryptosporidium parvum
PIDME

SEQ ID NO: 2342651 - protein, 10 aa, Cryptosporidium parvum
PIKPPPDISK

SEQ ID NO: 2342652 - protein, 10 aa, Cryptosporidium parvum
PINGGGLRSL

SEQ ID NO: 2342653 - protein, 5 aa, Cryptosporidium parvum
PKAQE

SEQ ID NO: 2342654 - protein, 20 aa, Cryptosporidium parvum
PKATDRSSDRISKPLTDKEE

SEQ ID NO: 2342655 - protein, 7 aa, Cryptosporidium parvum
PKCTTKE

SEQ ID NO: 2342656 - protein, 40 aa, Cryptosporidium parvum; identical to SEQ ID NO: 2222350

SEQ ID NO: 2342657 - protein, 7 aa, Cryptosporidium parvum
PKETPLD

SEQ ID NO: 2342658 - protein, 6 aa, Cryptosporidium parvum
PKGTVS

SEQ ID NO: 2342659 - protein, 9 aa, Cryptosporidium parvum
PKHKKIPKT

SEQ ID NO: 2342660 - protein, 12 aa, Cryptosporidium parvum
PKHYNNRNEDDF

SEQ ID NO: 2342661 - protein, 26 aa, Cryptosporidium parvum
PKKCSTNQNPNSSERSKKHDPNHSPA

SEQ ID NO: 2342662 - protein, 14 aa, Cryptosporidium parvum
PKKEFDNKDEDYRE

SEQ ID NO: 2342663 - protein, 5 aa, Cryptosporidium parvum
PKKHL

SEQ ID NO: 2342664 - protein, 7 aa, Cryptosporidium parvum
PKKLPSR

SEQ ID NO: 2342665 - protein, 6 aa, Cryptosporidium parvum
PKLGGR

SEQ ID NO: 2342666 - protein, 6 aa, Cryptosporidium parvum
PKNTNT

SEQ ID NO: 2342667 - protein, 4 aa, Cryptosporidium parvum
PKSN

SEQ ID NO: 2342668 - protein, 6 aa, Cryptosporidium parvum
PKTNTT

SEQ ID NO: 2342669 - protein, 10 aa, Cryptosporidium parvum
PKTQNSPVSV

SEQ ID NO: 2342670 - protein, 9 aa, Cryptosporidium parvum
PKTQTEHNS

SEQ ID NO: 2342671 - protein, 10 aa, Cryptosporidium parvum
PKVRNQKESV

SEQ ID NO: 2342672 - protein, 9 aa, Cryptosporidium parvum
PLKSSKNVN

SEQ ID NO: 2342673 - protein, 73 aa, Cryptosporidium parvum; identical to SEQ ID NO: 2222438

SEQ ID NO: 2342674 - protein, 8 aa, Cryptosporidium parvum
PNEESINT

SEQ ID NO: 2342675 - protein, 13 aa, Cryptosporidium parvum
PNEKSTENEISQS

SEQ ID NO: 2342676 - protein, 12 aa, Cryptosporidium parvum
PNETSKRSEEYT

SEQ ID NO: 2342677 - protein, 11 aa, Cryptosporidium parvum
PNLNSDEYNHY

SEQ ID NO: 2342678 - protein, 5 aa, Cryptosporidium parvum
PNLRP

SEQ ID NO: 2342679 - protein, 4 aa, Cryptosporidium parvum
PNNK

SEQ ID NO: 2342680 - protein, 6 aa, Cryptosporidium parvum
PNNSAN

SEQ ID NO: 2342681 - protein, 5 aa, Cryptosporidium parvum
PNQGQ

SEQ ID NO: 2342682 - protein, 9 aa, Cryptosporidium parvum
PNQTPAEVT

SEQ ID NO: 2342683 - protein, 15 aa, Cryptosporidium parvum
PNSKYYSNSSNFNKV

SEQ ID NO: 2342684 - protein, 14 aa, Cryptosporidium parvum
PNSLDQSGSNRRNN

SEQ ID NO: 2342685 - protein, 34 aa, Cryptosporidium parvum; identical to SEQ ID NO: 2222522

SEQ ID NO: 2342686 - protein, 7 aa, Cryptosporidium parvum
PNSSNFG

SEQ ID NO: 2342687 - protein, 10 aa, Cryptosporidium parvum
PPDRTALSQD

SEQ ID NO: 2342688 - protein, 22 aa, Cryptosporidium parvum
PPDSASLSSPTPASTLHAKTNA

SEQ ID NO: 2342689 - protein, 5 aa, Cryptosporidium parvum
PPEFP

SEQ ID NO: 2342690 - protein, 10 aa, Cryptosporidium parvum
PPKMDDDEEF

SEQ ID NO: 2342691 - protein, 9 aa, Cryptosporidium parvum
PPKNAKKGE

SEQ ID NO: 2342692 - protein, 6 aa, Cryptosporidium parvum
PPNADQ

SEQ ID NO: 2342693 - protein, 5 aa, Cryptosporidium parvum
PPNHS

SEQ ID NO: 2342694 - protein, 5 aa, Cryptosporidium parvum
PPPDW

SEQ ID NO: 2342695 - protein, 5 aa, Cryptosporidium parvum
PPPPL

SEQ ID NO: 2342696 - protein, 9 aa, Cryptosporidium parvum
PPPPPMQPE

SEQ ID NO: 2342697 - protein, 7 aa, Cryptosporidium parvum
PPPSSFI

SEQ ID NO: 2342698 - protein, 6 aa, Cryptosporidium parvum
PPSLSR

SEQ ID NO: 2342699 - protein, 4 aa, Cryptosporidium parvum
PPVS

SEQ ID NO: 2342700 - protein, 5 aa, Cryptosporidium parvum
PQDES

SEQ ID NO: 2342701 - protein, 8 aa, Cryptosporidium parvum
PQGTHTGS

SEQ ID NO: 2342702 - protein, 9 aa, Cryptosporidium parvum
PQNETRYPQ

SEQ ID NO: 2342703 - protein, 7 aa, Cryptosporidium parvum
PRDLSPN

SEQ ID NO: 2342704 - protein, 9 aa, Cryptosporidium parvum
PREQLENKS

SEQ ID NO: 2342705 - protein, 12 aa, Cryptosporidium parvum
PRNDTSSNSDGL

SEQ ID NO: 2342706 - protein, 27 aa, Cryptosporidium parvum
PRPGTPAAKMKPVPNGVSKSRSSEITN

SEQ ID NO: 2342707 - protein, 5 aa, Cryptosporidium parvum
PRPYC

SEQ ID NO: 2342708 - protein, 16 aa, Cryptosporidium parvum
PRWTSSEVNNDGFGGG

SEQ ID NO: 2342709 - protein, 4 aa, Cryptosporidium parvum
PSDI

SEQ ID NO: 2342710 - protein, 4 aa, Cryptosporidium parvum
PSEG

SEQ ID NO: 2342711 - protein, 9 aa, Cryptosporidium parvum
PSFEVKSND

SEQ ID NO: 2342712 - protein, 34 aa, Cryptosporidium parvum; identical to SEQ ID NO: 2222679

SEQ ID NO: 2342713 - protein, 9 aa, Cryptosporidium parvum
PSGPNIDTS

SEQ ID NO: 2342714 - protein, 7 aa, Cryptosporidium parvum
PSHPPSF

SEQ ID NO: 2342715 - protein, 4 aa, Cryptosporidium parvum
PSKL

SEQ ID NO: 2342716 - protein, 7 aa, Cryptosporidium parvum
PSNNNPR

SEQ ID NO: 2342717 - protein, 6 aa, Cryptosporidium parvum
PSPIGI

SEQ ID NO: 2342718 - protein, 11 aa, Cryptosporidium parvum
PSSGEERRLTG

SEQ ID NO: 2342719 - protein, 7 aa, Cryptosporidium parvum
PSSPAIS

SEQ ID NO: 2342720 - protein, 8 aa, Cryptosporidium parvum
PSTQLKDS

SEQ ID NO: 2342721 - protein, 10 aa, Cryptosporidium parvum
PTAPIGHDSN

SEQ ID NO: 2342722 - protein, 6 aa, Cryptosporidium parvum
PTASLD

SEQ ID NO: 2342723 - protein, 22 aa, Cryptosporidium parvum
PTEDPNVQKASDSIKDGISGNA

SEQ ID NO: 2342724 - protein, 10 aa, Cryptosporidium parvum
PTKNSLVPRS

SEQ ID NO: 2342725 - protein, 9 aa, Cryptosporidium parvum
PTKSSKPDI

SEQ ID NO: 2342726 - protein, 9 aa, Cryptosporidium parvum
PTPSRDGED

SEQ ID NO: 2342727 - protein, 5 aa, Cryptosporidium parvum
PTSGL

SEQ ID NO: 2342728 - protein, 11 aa, Cryptosporidium parvum
PTSSSNQESLS

SEQ ID NO: 2342729 - protein, 7 aa, Cryptosporidium parvum
PTTGLDA

SEQ ID NO: 2342730 - protein, 7 aa, Cryptosporidium parvum
PTTSGIK

SEQ ID NO: 2342731 - protein, 8 aa, Cryptosporidium parvum
PVENQELA

SEQ ID NO: 2342732 - protein, 6 aa, Cryptosporidium parvum
PVPQPS

SEQ ID NO: 2342733 - protein, 5 aa, Cryptosporidium parvum
PVTST

SEQ ID NO: 2342734 - protein, 4 aa, Cryptosporidium parvum
PYSA

SEQ ID NO: 2342735 - protein, 7 aa, Cryptosporidium parvum
QASAYTR

SEQ ID NO: 2342736 - protein, 5 aa, Cryptosporidium parvum
QATND

SEQ ID NO: 2342737 - protein, 9 aa, Cryptosporidium parvum
QDHKEGDRK

SEQ ID NO: 2342738 - protein, 6 aa, Cryptosporidium parvum
QDKQGD

SEQ ID NO: 2342739 - protein, 7 aa, Cryptosporidium parvum
QDLSERR

SEQ ID NO: 2342740 - protein, 8 aa, Cryptosporidium parvum
QDQSNSKL

SEQ ID NO: 2342741 - protein, 18 aa, Cryptosporidium parvum
QDQSYSSETNFKEQVPSS

SEQ ID NO: 2342742 - protein, 12 aa, Cryptosporidium parvum
QDVHKSQEETTE

SEQ ID NO: 2342743 - protein, 7 aa, Cryptosporidium parvum
QEANRNS

SEQ ID NO: 2342744 - protein, 16 aa, Cryptosporidium parvum
QEETLESDTRSNLGSR

SEQ ID NO: 2342745 - protein, 7 aa, Cryptosporidium parvum
QEIGGAT

SEQ ID NO: 2342746 - protein, 11 aa, Cryptosporidium parvum
QENDKSESSGM

SEQ ID NO: 2342747 - protein, 4 aa, Cryptosporidium parvum
QGHL

SEQ ID NO: 2342748 - protein, 4 aa, Cryptosporidium parvum
QGIS

SEQ ID NO: 2342749 - protein, 16 aa, Cryptosporidium parvum
QGPGIVDKQNNKTFPI

SEQ ID NO: 2342750 - protein, 15 aa, Cryptosporidium parvum
QGRDGSLGTGSYEDS

SEQ ID NO: 2342751 - protein, 4 aa, Cryptosporidium parvum
QGSP

SEQ ID NO: 2342752 - protein, 5 aa, Cryptosporidium parvum
QGWNE

SEQ ID NO: 2342753 - protein, 6 aa, Cryptosporidium parvum
QGYSKE

SEQ ID NO: 2342754 - protein, 10 aa, Cryptosporidium parvum
QINDNNSSLL

SEQ ID NO: 2342755 - protein, 18 aa, Cryptosporidium parvum
QINTSNSQANINKKENNF

SEQ ID NO: 2342756 - protein, 4 aa, Cryptosporidium parvum
QISG

SEQ ID NO: 2342757 - protein, 8 aa, Cryptosporidium parvum
QKENGYSN

SEQ ID NO: 2342758 - protein, 9 aa, Cryptosporidium parvum
QKETKSPYR

SEQ ID NO: 2342759 - protein, 12 aa, Cryptosporidium parvum
QKETSESPCKPN

SEQ ID NO: 2342760 - protein, 5 aa, Cryptosporidium parvum
QKIMT

SEQ ID NO: 2342761 - protein, 8 aa, Cryptosporidium parvum
QKIQPHNP

SEQ ID NO: 2342762 - protein, 13 aa, Cryptosporidium parvum
QKKSPKNSPFQTS

SEQ ID NO: 2342763 - protein, 4 aa, Cryptosporidium parvum
QKKY

SEQ ID NO: 2342764 - protein, 16 aa, Cryptosporidium parvum
QKNKINSNISLSSSNN

SEQ ID NO: 2342765 - protein, 5 aa, Cryptosporidium parvum
QKNLL

SEQ ID NO: 2342766 - protein, 10 aa, Cryptosporidium parvum
QKNSQKNTNL

SEQ ID NO: 2342767 - protein, 8 aa, Cryptosporidium parvum
QKRDQKME

SEQ ID NO: 2342768 - protein, 6 aa, Cryptosporidium parvum
QKSGSI

SEQ ID NO: 2342769 - protein, 22 aa, Cryptosporidium parvum
QLDYSREELNGQDEDKEPKRGL

SEQ ID NO: 2342770 - protein, 5 aa, Cryptosporidium parvum
QNDQI

SEQ ID NO: 2342771 - protein, 18 aa, Cryptosporidium parvum
QNETDTNNANTQSQSDQC

SEQ ID NO: 2342772 - protein, 9 aa, Cryptosporidium parvum
QNGGNPENI

SEQ ID NO: 2342773 - protein, 10 aa, Cryptosporidium parvum
QNKPKGSPNI

SEQ ID NO: 2342774 - protein, 10 aa, Cryptosporidium parvum
QNKQENAVKS

SEQ ID NO: 2342775 - protein, 8 aa, Cryptosporidium parvum
QNNDENQI

SEQ ID NO: 2342776 - protein, 7 aa, Cryptosporidium parvum
QNNQNEN

SEQ ID NO: 2342777 - protein, 10 aa, Cryptosporidium parvum
QNNSGSDSWN

SEQ ID NO: 2342778 - protein, 4 aa, Cryptosporidium parvum
QNPL

SEQ ID NO: 2342779 - protein, 6 aa, Cryptosporidium parvum
QNPQHE

SEQ ID NO: 2342780 - protein, 14 aa, Cryptosporidium parvum
QNQNNQENSTILTQ

SEQ ID NO: 2342781 - protein, 9 aa, Cryptosporidium parvum
QNSSDRNVS

SEQ ID NO: 2342782 - protein, 12 aa, Cryptosporidium parvum
QNSSKETPNADD

SEQ ID NO: 2342783 - protein, 9 aa, Cryptosporidium parvum
QNSSRSKLA

SEQ ID NO: 2342784 - protein, 5 aa, Cryptosporidium parvum
QNTAQ

SEQ ID NO: 2342785 - protein, 9 aa, Cryptosporidium parvum
QNVKTGSSQ

SEQ ID NO: 2342786 - protein, 8 aa, Cryptosporidium parvum
QPDFTGES

SEQ ID NO: 2342787 - protein, 5 aa, Cryptosporidium parvum
QPGHS

SEQ ID NO: 2342788 - protein, 19 aa, Cryptosporidium parvum
QPKYESNIEKNEQLSEDQH

SEQ ID NO: 2342789 - protein, 5 aa, Cryptosporidium parvum
QPPTT

SEQ ID NO: 2342790 - protein, 14 aa, Cryptosporidium parvum
QQIYQSDTNISSKT

SEQ ID NO: 2342791 - protein, 9 aa, Cryptosporidium parvum
QQQQIEEQE

SEQ ID NO: 2342792 - protein, 7 aa, Cryptosporidium parvum
QQSGDKK

SEQ ID NO: 2342793 - protein, 7 aa, Cryptosporidium parvum
QQTQQPI

SEQ ID NO: 2342794 - protein, 8 aa, Cryptosporidium parvum
QRQNSQRY

SEQ ID NO: 2342795 - protein, 98 aa, Cryptosporidium parvum; identical to SEQ ID NO: 2223393

SEQ ID NO: 2342796 - protein, 7 aa, Cryptosporidium parvum
QSAFPSN

SEQ ID NO: 2342797 - protein, 8 aa, Cryptosporidium parvum
QSEKNNKR

SEQ ID NO: 2342798 - protein, 6 aa, Cryptosporidium parvum
QSEKRK

SEQ ID NO: 2342799 - protein, 8 aa, Cryptosporidium parvum
QSENSKGL

SEQ ID NO: 2342800 - protein, 9 aa, Cryptosporidium parvum
QSGKTTALI

SEQ ID NO: 2342801 - protein, 5 aa, Cryptosporidium parvum
QSGSN

SEQ ID NO: 2342802 - protein, 4 aa, Cryptosporidium parvum
QSHP

SEQ ID NO: 2342803 - protein, 5 aa, Cryptosporidium parvum
QSIQQ

SEQ ID NO: 2342804 - protein, 34 aa, Cryptosporidium parvum; identical to SEQ ID NO: 2223444

SEQ ID NO: 2342805 - protein, 13 aa, Cryptosporidium parvum
QSLASDPNWKSGD

SEQ ID NO: 2342806 - protein, 13 aa, Cryptosporidium parvum
QSLEGSSNNVNNM

SEQ ID NO: 2342807 - protein, 26 aa, Cryptosporidium parvum
QSNYGANQHNNAVRQNNGAKPQQNSP

SEQ ID NO: 2342808 - protein, 5 aa, Cryptosporidium parvum
QTENV

SEQ ID NO: 2342809 - protein, 12 aa, Cryptosporidium parvum
QTKEQNHQRNDQ

SEQ ID NO: 2342810 - protein, 6 aa, Cryptosporidium parvum
QTNQTK

SEQ ID NO: 2342811 - protein, 13 aa, Cryptosporidium parvum
QTNSLSSLNSTHT

SEQ ID NO: 2342812 - protein, 9 aa, Cryptosporidium parvum
QTPQQIPSS

SEQ ID NO: 2342813 - protein, 53 aa, Cryptosporidium parvum
QVKEQTEDRAVDQENSDLPKSQINSSNGVSEDEPSQEVPQNEDFDDGSSVIST

SEQ ID NO: 2342814 - protein, 23 aa, Cryptosporidium parvum
QVNSNSNSNKVGVHSQSGSGLAP

SEQ ID NO: 2342815 - protein, 8 aa, Cryptosporidium parvum
QVSQVSPT

SEQ ID NO: 2342816 - protein, 7 aa, Cryptosporidium parvum
QVSSNEQ

SEQ ID NO: 2342817 - protein, 11 aa, Cryptosporidium parvum
QVTGSSVQQNI

SEQ ID NO: 2342818 - protein, 4 aa, Cryptosporidium parvum
QVYQ

SEQ ID NO: 2342819 - protein, 7 aa, Cryptosporidium parvum
QYAEKSE

SEQ ID NO: 2342820 - protein, 6 aa, Cryptosporidium parvum
RAEPPF

SEQ ID NO: 2342821 - protein, 9 aa, Cryptosporidium parvum
RAGEEIPDS

SEQ ID NO: 2342822 - protein, 14 aa, Cryptosporidium parvum
RAGENDFDTAQNAR

SEQ ID NO: 2342823 - protein, 8 aa, Cryptosporidium parvum
RAKDTEDK

SEQ ID NO: 2342824 - protein, 11 aa, Cryptosporidium parvum
RALETKEPISY

SEQ ID NO: 2342825 - protein, 5 aa, Cryptosporidium parvum
RAQRL

SEQ ID NO: 2342826 - protein, 10 aa, Cryptosporidium parvum
RDKRSGKSIL

SEQ ID NO: 2342827 - protein, 9 aa, Cryptosporidium parvum
RDQETGDED

SEQ ID NO: 2342828 - protein, 7 aa, Cryptosporidium parvum
RDQVHRQ

SEQ ID NO: 2342829 - protein, 20 aa, Cryptosporidium parvum
RDSLSTLKSSEMSPEQGSGV

SEQ ID NO: 2342830 - protein, 7 aa, Cryptosporidium parvum
RDSNRRE

SEQ ID NO: 2342831 - protein, 7 aa, Cryptosporidium parvum
RDSSKEN

SEQ ID NO: 2342832 - protein, 10 aa, Cryptosporidium parvum
RDSSTPGSIS

SEQ ID NO: 2342833 - protein, 16 aa, Cryptosporidium parvum
REAGGEDEKEQGREMS

SEQ ID NO: 2342834 - protein, 19 aa, Cryptosporidium parvum
REAKETVETNSSEQSSEVC

SEQ ID NO: 2342835 - protein, 19 aa, Cryptosporidium parvum
REKLTSRSIYNPKPSNASE

SEQ ID NO: 2342836 - protein, 12 aa, Cryptosporidium parvum
RESITSDNSKIK

SEQ ID NO: 2342837 - protein, 31 aa, Cryptosporidium parvum; identical to SEQ ID NO: 2223747

SEQ ID NO: 2342838 - protein, 5 aa, Cryptosporidium parvum
RGERY

SEQ ID NO: 2342839 - protein, 11 aa, Cryptosporidium parvum
RGGSCNDSESS

SEQ ID NO: 2342840 - protein, 20 aa, Cryptosporidium parvum
RGLTEDDKEQRKESKQRLGP

SEQ ID NO: 2342841 - protein, 9 aa, Cryptosporidium parvum
RGQISPPSL

SEQ ID NO: 2342842 - protein, 4 aa, Cryptosporidium parvum
RHHR

SEQ ID NO: 2342843 - protein, 9 aa, Cryptosporidium parvum
RINSNNDHD

SEQ ID NO: 2342844 - protein, 4 aa, Cryptosporidium parvum
RIYN

SEQ ID NO: 2342845 - protein, 10 aa, Cryptosporidium parvum
RKDSEDEDPV

SEQ ID NO: 2342846 - protein, 17 aa, Cryptosporidium parvum
RKESQETTGKKSEGEIN

SEQ ID NO: 2342847 - protein, 4 aa, Cryptosporidium parvum
RKGL

SEQ ID NO: 2342848 - protein, 19 aa, Cryptosporidium parvum
RKHSPSGKKMNKFSRKSRL

SEQ ID NO: 2342849 - protein, 6 aa, Cryptosporidium parvum
RKKKKN

SEQ ID NO: 2342850 - protein, 7 aa, Cryptosporidium parvum
RKNGRKS

SEQ ID NO: 2342851 - protein, 8 aa, Cryptosporidium parvum
RKNNNDPW

SEQ ID NO: 2342852 - protein, 11 aa, Cryptosporidium parvum
RKNTSGSTEHK

SEQ ID NO: 2342853 - protein, 4 aa, Cryptosporidium parvum
RKPF

SEQ ID NO: 2342854 - protein, 22 aa, Cryptosporidium parvum
RKRSIDDGEEPKSSKYLPTPTC

SEQ ID NO: 2342855 - protein, 37 aa, Cryptosporidium parvum
RKSQQFKRTQGKAPSPLISSSSSSPSPSPSPLSSQKN

SEQ ID NO: 2342856 - protein, 8 aa, Cryptosporidium parvum
RKSRETGH

SEQ ID NO: 2342857 - protein, 7 aa, Cryptosporidium parvum
RKTEESN

SEQ ID NO: 2342858 - protein, 12 aa, Cryptosporidium parvum
RKVEGDQLSSGV

SEQ ID NO: 2342859 - protein, 8 aa, Cryptosporidium parvum
RLKGREYN

SEQ ID NO: 2342860 - protein, 9 aa, Cryptosporidium parvum
RLPTGKEKG

SEQ ID NO: 2342861 - protein, 6 aa, Cryptosporidium parvum
RLRDGT

SEQ ID NO: 2342862 - protein, 6 aa, Cryptosporidium parvum
RLSPPE

SEQ ID NO: 2342863 - protein, 17 aa, Cryptosporidium parvum
RLSRPLNNNSINNNKAM

SEQ ID NO: 2342864 - protein, 9 aa, Cryptosporidium parvum
RLSSTGNKL

SEQ ID NO: 2342865 - protein, 5 aa, Cryptosporidium parvum
RNETG

SEQ ID NO: 2342866 - protein, 7 aa, Cryptosporidium parvum
RNEYYKS

SEQ ID NO: 2342867 - protein, 8 aa, Cryptosporidium parvum
RNFSKTQL

SEQ ID NO: 2342868 - protein, 7 aa, Cryptosporidium parvum
RNITDST

SEQ ID NO: 2342869 - protein, 7 aa, Cryptosporidium parvum
RNLENGK

SEQ ID NO: 2342870 - protein, 11 aa, Cryptosporidium parvum
RNNEKIRHSED

SEQ ID NO: 2342871 - protein, 6 aa, Cryptosporidium parvum
RNQQKM

SEQ ID NO: 2342872 - protein, 5 aa, Cryptosporidium parvum
RNRQH

SEQ ID NO: 2342873 - protein, 17 aa, Cryptosporidium parvum
RNRTERKFNTNKELPKS

SEQ ID NO: 2342874 - protein, 10 aa, Cryptosporidium parvum
RNSGRSELDN

SEQ ID NO: 2342875 - protein, 7 aa, Cryptosporidium parvum
RNSGSLV

SEQ ID NO: 2342876 - protein, 14 aa, Cryptosporidium parvum
RNSPQQSVKSLGYG

SEQ ID NO: 2342877 - protein, 9 aa, Cryptosporidium parvum
RNSSSNKRS

SEQ ID NO: 2342878 - protein, 5 aa, Cryptosporidium parvum
RNTDV

SEQ ID NO: 2342879 - protein, 12 aa, Cryptosporidium parvum
RNTGDQDNWDNK

SEQ ID NO: 2342880 - protein, 4 aa, Cryptosporidium parvum
RNTL

SEQ ID NO: 2342881 - protein, 15 aa, Cryptosporidium parvum
RNTPSPDADPNHKEN

SEQ ID NO: 2342882 - protein, 4 aa, Cryptosporidium parvum
RNTT

SEQ ID NO: 2342883 - protein, 4 aa, Cryptosporidium parvum
RPAE

SEQ ID NO: 2342884 - protein, 8 aa, Cryptosporidium parvum
RPEKLQKV

SEQ ID NO: 2342885 - protein, 7 aa, Cryptosporidium parvum
RPKKPSD

SEQ ID NO: 2342886 - protein, 10 aa, Cryptosporidium parvum
RPLVKKTPRP

SEQ ID NO: 2342887 - protein, 5 aa, Cryptosporidium parvum
RPRLN

SEQ ID NO: 2342888 - protein, 9 aa, Cryptosporidium parvum
RPSEESDSS

SEQ ID NO: 2342889 - protein, 8 aa, Cryptosporidium parvum
RQNGETSF

SEQ ID NO: 2342890 - protein, 29 aa, Cryptosporidium parvum
RQNKKEKKRGISGVTNESQNSNFKSKSSI

SEQ ID NO: 2342891 - protein, 6 aa, Cryptosporidium parvum
RQNREG

SEQ ID NO: 2342892 - protein, 8 aa, Cryptosporidium parvum
RQQAENNL

SEQ ID NO: 2342893 - protein, 6 aa, Cryptosporidium parvum
RQRGDT

SEQ ID NO: 2342894 - protein, 7 aa, Cryptosporidium parvum
RQRNYSE

SEQ ID NO: 2342895 - protein, 8 aa, Cryptosporidium parvum
RQSSSLKK

SEQ ID NO: 2342896 - protein, 7 aa, Cryptosporidium parvum
RRDSVTQ

SEQ ID NO: 2342897 - protein, 4 aa, Cryptosporidium parvum
RRPR

SEQ ID NO: 2342898 - protein, 17 aa, Cryptosporidium parvum
RRQTKKTTYGDGSQGNF

SEQ ID NO: 2342899 - protein, 7 aa, Cryptosporidium parvum
RRSCSPS

SEQ ID NO: 2342900 - protein, 5 aa, Cryptosporidium parvum
RRSTR

SEQ ID NO: 2342901 - protein, 4 aa, Cryptosporidium parvum
RSAE

SEQ ID NO: 2342902 - protein, 6 aa, Cryptosporidium parvum
RSAKTN

SEQ ID NO: 2342903 - protein, 5 aa, Cryptosporidium parvum
RSEVT

SEQ ID NO: 2342904 - protein, 6 aa, Cryptosporidium parvum
RSINDK

SEQ ID NO: 2342905 - protein, 6 aa, Cryptosporidium parvum
RSKITP

SEQ ID NO: 2342906 - protein, 6 aa, Cryptosporidium parvum
RSKNGE

SEQ ID NO: 2342907 - protein, 8 aa, Cryptosporidium parvum
RSKNVNED

SEQ ID NO: 2342908 - protein, 6 aa, Cryptosporidium parvum
RSKQYL

SEQ ID NO: 2342909 - protein, 6 aa, Cryptosporidium parvum
RSKSSH

SEQ ID NO: 2342910 - protein, 8 aa, Cryptosporidium parvum
RSNTANKR

SEQ ID NO: 2342911 - protein, 21 aa, Cryptosporidium parvum
RSPNWTSDNHLGSNSKEVVSS

SEQ ID NO: 2342912 - protein, 38 aa, Cryptosporidium parvum; identical to SEQ ID NO: 2279153

SEQ ID NO: 2342913 - protein, 6 aa, Cryptosporidium parvum
RSPSDH

SEQ ID NO: 2342914 - protein, 21 aa, Cryptosporidium parvum
RSQPSFSSNSYSTNPKPSGSC

SEQ ID NO: 2342915 - protein, 4 aa, Cryptosporidium parvum
RSSK

SEQ ID NO: 2342916 - protein, 7 aa, Cryptosporidium parvum
RSSPPKR

SEQ ID NO: 2342917 - protein, 8 aa, Cryptosporidium parvum
RSSVTSSK

SEQ ID NO: 2342918 - protein, 6 aa, Cryptosporidium parvum
RTETGK

SEQ ID NO: 2342919 - protein, 5 aa, Cryptosporidium parvum
RTGYE

SEQ ID NO: 2342920 - protein, 7 aa, Cryptosporidium parvum
RTNSQSS

SEQ ID NO: 2342921 - protein, 4 aa, Cryptosporidium parvum
RTNT

SEQ ID NO: 2342922 - protein, 6 aa, Cryptosporidium parvum
RTPPGA

SEQ ID NO: 2342923 - protein, 13 aa, Cryptosporidium parvum
RTPSISTVSHPSA

SEQ ID NO: 2342924 - protein, 16 aa, Cryptosporidium parvum
RTPVKKRYNKEYSFTQ

SEQ ID NO: 2342925 - protein, 6 aa, Cryptosporidium parvum
RTQSHN

SEQ ID NO: 2342926 - protein, 6 aa, Cryptosporidium parvum
RTSPTS

SEQ ID NO: 2342927 - protein, 14 aa, Cryptosporidium parvum
RVRSEKKVTKGASI

SEQ ID NO: 2342928 - protein, 4 aa, Cryptosporidium parvum
RYEE

SEQ ID NO: 2342929 - protein, 23 aa, Cryptosporidium parvum
SAAGSSSSNTAQAGSMDSEFKNK

SEQ ID NO: 2342930 - protein, 8 aa, Cryptosporidium parvum
SADHNLGP

SEQ ID NO: 2342931 - protein, 7 aa, Cryptosporidium parvum
SAEDNLS

SEQ ID NO: 2342932 - protein, 80 aa, Cryptosporidium parvum; identical to SEQ ID NO: 2224385

SEQ ID NO: 2342933 - protein, 7 aa, Cryptosporidium parvum
SAITSKA

SEQ ID NO: 2342934 - protein, 19 aa, Cryptosporidium parvum
SANDSANANNSVSANINGS

SEQ ID NO: 2342935 - protein, 4 aa, Cryptosporidium parvum
SAPE

SEQ ID NO: 2342936 - protein, 12 aa, Cryptosporidium parvum
SAQRTTSEEGRF

SEQ ID NO: 2342937 - protein, 10 aa, Cryptosporidium parvum
SARKGAPLSE

SEQ ID NO: 2342938 - protein, 16 aa, Cryptosporidium parvum
SASELTTKVTLNTSNS

SEQ ID NO: 2342939 - protein, 5 aa, Cryptosporidium parvum
SASSV

SEQ ID NO: 2342940 - protein, 5 aa, Cryptosporidium parvum
SATDP

SEQ ID NO: 2342941 - protein, 5 aa, Cryptosporidium parvum
SAYGA

SEQ ID NO: 2342942 - protein, 8 aa, Cryptosporidium parvum
SCASQNHS

SEQ ID NO: 2342943 - protein, 8 aa, Cryptosporidium parvum
SCGNTKKR

SEQ ID NO: 2342944 - protein, 5 aa, Cryptosporidium parvum
SCNPV

SEQ ID NO: 2342945 - protein, 17 aa, Cryptosporidium parvum
SCSNTEWHEPKNNNNFV

SEQ ID NO: 2342946 - protein, 11 aa, Cryptosporidium parvum
SDDDLSPEEVN

SEQ ID NO: 2342947 - protein, 19 aa, Cryptosporidium parvum
SDDGSGRGAAILASTTVNT

SEQ ID NO: 2342948 - protein, 5 aa, Cryptosporidium parvum
SDDNL

SEQ ID NO: 2342949 - protein, 13 aa, Cryptosporidium parvum
SDEEPELEEPRKE

SEQ ID NO: 2342950 - protein, 11 aa, Cryptosporidium parvum
SDFSQDLGPQM

SEQ ID NO: 2342951 - protein, 8 aa, Cryptosporidium parvum
SDKDESTY

SEQ ID NO: 2342952 - protein, 8 aa, Cryptosporidium parvum
SDLSSSTM

SEQ ID NO: 2342953 - protein, 4 aa, Cryptosporidium parvum
SDNS

SEQ ID NO: 2342954 - protein, 7 aa, Cryptosporidium parvum
SDNYSSS

SEQ ID NO: 2342955 - protein, 11 aa, Cryptosporidium parvum
SDPNSLPEYHD

SEQ ID NO: 2342956 - protein, 31 aa, Cryptosporidium parvum; identical to SEQ ID NO: 2224548

SEQ ID NO: 2342957 - protein, 9 aa, Cryptosporidium parvum
SDRLHGENS

SEQ ID NO: 2342958 - protein, 25 aa, Cryptosporidium parvum
SDSAAKLPPPFGNPAVKNEQKFPEY

SEQ ID NO: 2342959 - protein, 6 aa, Cryptosporidium parvum
SDSDFG

SEQ ID NO: 2342960 - protein, 8 aa, Cryptosporidium parvum
SDSEEALK

SEQ ID NO: 2342961 - protein, 4 aa, Cryptosporidium parvum
SDSR

SEQ ID NO: 2342962 - protein, 6 aa, Cryptosporidium parvum
SDSSLL

SEQ ID NO: 2342963 - protein, 19 aa, Cryptosporidium parvum
SDSTSENGLSSRKKSTDFL

SEQ ID NO: 2342964 - protein, 11 aa, Cryptosporidium parvum
SDTDDQASINP

SEQ ID NO: 2342965 - protein, 14 aa, Cryptosporidium parvum
SDTPPHAFPLYAIG

SEQ ID NO: 2342966 - protein, 4 aa, Cryptosporidium parvum
SDVR

SEQ ID NO: 2342967 - protein, 8 aa, Cryptosporidium parvum
SDYGNSEG

SEQ ID NO: 2342968 - protein, 14 aa, Cryptosporidium parvum
SEDNGITSDSQSIN

SEQ ID NO: 2342969 - protein, 4 aa, Cryptosporidium parvum
SEEA

SEQ ID NO: 2342970 - protein, 4 aa, Cryptosporidium parvum
SEEE

SEQ ID NO: 2342971 - protein, 23 aa, Cryptosporidium parvum
SEEEPEPPNQEIDIPEKKYGEME

SEQ ID NO: 2342972 - protein, 19 aa, Cryptosporidium parvum
SEESQGNITNNNQGTEYLT

SEQ ID NO: 2342973 - protein, 6 aa, Cryptosporidium parvum
SEFPAN

SEQ ID NO: 2342974 - protein, 13 aa, Cryptosporidium parvum
SEFSAKENFSEKT

SEQ ID NO: 2342975 - protein, 11 aa, Cryptosporidium parvum
SEGGMKYSEGN

SEQ ID NO: 2342976 - protein, 6 aa, Cryptosporidium parvum
SEGPTT

SEQ ID NO: 2342977 - protein, 7 aa, Cryptosporidium parvum
SEGVECE

SEQ ID NO: 2342978 - protein, 12 aa, Cryptosporidium parvum
SEKHRNDNSQSQ

SEQ ID NO: 2342979 - protein, 13 aa, Cryptosporidium parvum
SEKIENPNEATPF

SEQ ID NO: 2342980 - protein, 7 aa, Cryptosporidium parvum
SELSGPE

SEQ ID NO: 2342981 - protein, 21 aa, Cryptosporidium parvum
SENFNSSDFENQNKNQSTTQV

SEQ ID NO: 2342982 - protein, 33 aa, Cryptosporidium parvum; identical to SEQ ID NO: 2224730

SEQ ID NO: 2342983 - protein, 10 aa, Cryptosporidium parvum
SEPNATGSCP

SEQ ID NO: 2342984 - protein, 4 aa, Cryptosporidium parvum
SEQI

SEQ ID NO: 2342985 - protein, 10 aa, Cryptosporidium parvum
SEQTTNCSGR

SEQ ID NO: 2342986 - protein, 7 aa, Cryptosporidium parvum
SERIKEE

SEQ ID NO: 2342987 - protein, 4 aa, Cryptosporidium parvum
SESE

SEQ ID NO: 2342988 - protein, 7 aa, Cryptosporidium parvum
SESENEQ

SEQ ID NO: 2342989 - protein, 5 aa, Cryptosporidium parvum
SESGH

SEQ ID NO: 2342990 - protein, 5 aa, Cryptosporidium parvum
SESKD

SEQ ID NO: 2342991 - protein, 10 aa, Cryptosporidium parvum
SESLNVEAGD

SEQ ID NO: 2342992 - protein, 22 aa, Cryptosporidium parvum
SESQQEITNNIKDTNSEPQTVR

SEQ ID NO: 2342993 - protein, 6 aa, Cryptosporidium parvum
SESTQY

SEQ ID NO: 2342994 - protein, 4 aa, Cryptosporidium parvum
SETF

SEQ ID NO: 2342995 - protein, 6 aa, Cryptosporidium parvum
SEYDNS

SEQ ID NO: 2342996 - protein, 6 aa, Cryptosporidium parvum
SEYSHE

SEQ ID NO: 2342997 - protein, 8 aa, Cryptosporidium parvum
SFGSTKKN

SEQ ID NO: 2342998 - protein, 12 aa, Cryptosporidium parvum
SFNKDDSNNIQN

SEQ ID NO: 2342999 - protein, 11 aa, Cryptosporidium parvum
SFPNSNQIDPF

SEQ ID NO: 2343000 - protein, 5 aa, Cryptosporidium parvum
SFPSN

SEQ ID NO: 2343001 - protein, 5 aa, Cryptosporidium parvum
SFQGP

SEQ ID NO: 2343002 - protein, 6 aa, Cryptosporidium parvum
SFSTPS

SEQ ID NO: 2343003 - protein, 4 aa, Cryptosporidium parvum
SGAN

SEQ ID NO: 2343004 - protein, 8 aa, Cryptosporidium parvum
SGAYPIDE

SEQ ID NO: 2343005 - protein, 5 aa, Cryptosporidium parvum
SGDSF

SEQ ID NO: 2343006 - protein, 7 aa, Cryptosporidium parvum
SGEREEY

SEQ ID NO: 2343007 - protein, 4 aa, Cryptosporidium parvum
SGES

SEQ ID NO: 2343008 - protein, 10 aa, Cryptosporidium parvum
SGETEDYKGC

SEQ ID NO: 2343009 - protein, 8 aa, Cryptosporidium parvum
SGGDAYRA

SEQ ID NO: 2343010 - protein, 9 aa, Cryptosporidium parvum
SGGISTHGN

SEQ ID NO: 2343011 - protein, 10 aa, Cryptosporidium parvum
SGGKDNNSSF

SEQ ID NO: 2343012 - protein, 6 aa, Cryptosporidium parvum
SGHTGA

SEQ ID NO: 2343013 - protein, 12 aa, Cryptosporidium parvum
SGINGGAETVSD

SEQ ID NO: 2343014 - protein, 7 aa, Cryptosporidium parvum
SGKKGTC

SEQ ID NO: 2343015 - protein, 7 aa, Cryptosporidium parvum
SGKQIKD

SEQ ID NO: 2343016 - protein, 12 aa, Cryptosporidium parvum
SGMNNNDNNPVI

SEQ ID NO: 2343017 - protein, 8 aa, Cryptosporidium parvum
SGNDITGE

SEQ ID NO: 2343018 - protein, 9 aa, Cryptosporidium parvum
SGNLDSNSV

SEQ ID NO: 2343019 - protein, 9 aa, Cryptosporidium parvum
SGNNNNKLP

SEQ ID NO: 2343020 - protein, 11 aa, Cryptosporidium parvum
SGNNTNGALGS

SEQ ID NO: 2343021 - protein, 8 aa, Cryptosporidium parvum
SGNRDNDL

SEQ ID NO: 2343022 - protein, 19 aa, Cryptosporidium parvum
SGNSTTKSDKINSVNDDPD

SEQ ID NO: 2343023 - protein, 5 aa, Cryptosporidium parvum
SGNVN

SEQ ID NO: 2343024 - protein, 5 aa, Cryptosporidium parvum
SGPGA

SEQ ID NO: 2343025 - protein, 16 aa, Cryptosporidium parvum
SGQNQVESSKDDDDDI

SEQ ID NO: 2343026 - protein, 7 aa, Cryptosporidium parvum
SGQYSPI

SEQ ID NO: 2343027 - protein, 6 aa, Cryptosporidium parvum
SGSGDK

SEQ ID NO: 2343028 - protein, 6 aa, Cryptosporidium parvum
SGSSIS

SEQ ID NO: 2343029 - protein, 15 aa, Cryptosporidium parvum
SGSSQSKKKDQLESP

SEQ ID NO: 2343030 - protein, 10 aa, Cryptosporidium parvum
SGTNHSETLN

SEQ ID NO: 2343031 - protein, 7 aa, Cryptosporidium parvum
SGTNNEI

SEQ ID NO: 2343032 - protein, 10 aa, Cryptosporidium parvum
SGVGTSEHDL

SEQ ID NO: 2343033 - protein, 10 aa, Cryptosporidium parvum
SGYGGNVETA

SEQ ID NO: 2343034 - protein, 8 aa, Cryptosporidium parvum
SHNDPEYI

SEQ ID NO: 2343035 - protein, 8 aa, Cryptosporidium parvum
SHRGGGGC

SEQ ID NO: 2343036 - protein, 5 aa, Cryptosporidium parvum
SHRLP

SEQ ID NO: 2343037 - protein, 8 aa, Cryptosporidium parvum
SHTSDSSL

SEQ ID NO: 2343038 - protein, 6 aa, Cryptosporidium parvum
SIDKNI

SEQ ID NO: 2343039 - protein, 7 aa, Cryptosporidium parvum
SIDKSQV

SEQ ID NO: 2343040 - protein, 18 aa, Cryptosporidium parvum
SIENNEIGNEDDQVSENN

SEQ ID NO: 2343041 - protein, 6 aa, Cryptosporidium parvum
SIENQV

SEQ ID NO: 2343042 - protein, 12 aa, Cryptosporidium parvum
SIKDKESITSND

SEQ ID NO: 2343043 - protein, 7 aa, Cryptosporidium parvum
SIKSDSK

SEQ ID NO: 2343044 - protein, 12 aa, Cryptosporidium parvum
SINNQEGKNSLS

SEQ ID NO: 2343045 - protein, 4 aa, Cryptosporidium parvum
SIPH

SEQ ID NO: 2343046 - protein, 6 aa, Cryptosporidium parvum
SIPTPR

SEQ ID NO: 2343047 - protein, 6 aa, Cryptosporidium parvum
SISESD

SEQ ID NO: 2343048 - protein, 5 aa, Cryptosporidium parvum
SISNG

SEQ ID NO: 2343049 - protein, 9 aa, Cryptosporidium parvum
SIYPKSNED

SEQ ID NO: 2343050 - protein, 27 aa, Cryptosporidium parvum
SKCKSNGTNNFKKPKNLNGDDENNAIN

SEQ ID NO: 2343051 - protein, 7 aa, Cryptosporidium parvum
SKDAYLS

SEQ ID NO: 2343052 - protein, 7 aa, Cryptosporidium parvum
SKDPNIK

SEQ ID NO: 2343053 - protein, 11 aa, Cryptosporidium parvum
SKEIEDSEARF

SEQ ID NO: 2343054 - protein, 8 aa, Cryptosporidium parvum
SKGTNEKN

SEQ ID NO: 2343055 - protein, 7 aa, Cryptosporidium parvum
SKHLGQK

SEQ ID NO: 2343056 - protein, 11 aa, Cryptosporidium parvum
SKHNHSSKTGD

SEQ ID NO: 2343057 - protein, 21 aa, Cryptosporidium parvum
SKHPENDLDYPEGESSKDGFL

SEQ ID NO: 2343058 - protein, 6 aa, Cryptosporidium parvum
SKHSSC

SEQ ID NO: 2343059 - protein, 7 aa, Cryptosporidium parvum
SKIAQNA

SEQ ID NO: 2343060 - protein, 7 aa, Cryptosporidium parvum
SKIESND

SEQ ID NO: 2343061 - protein, 14 aa, Cryptosporidium parvum
SKINSANESQPIQW

SEQ ID NO: 2343062 - protein, 7 aa, Cryptosporidium parvum
SKKDKNN

SEQ ID NO: 2343063 - protein, 10 aa, Cryptosporidium parvum
SKKGISGGEM

SEQ ID NO: 2343064 - protein, 34 aa, Cryptosporidium parvum; identical to SEQ ID NO: 2225264

SEQ ID NO: 2343065 - protein, 19 aa, Cryptosporidium parvum
SKKNRVKCTKDRNARRSEI

SEQ ID NO: 2343066 - protein, 5 aa, Cryptosporidium parvum
SKKPL

SEQ ID NO: 2343067 - protein, 9 aa, Cryptosporidium parvum
SKKPSSSGM

SEQ ID NO: 2343068 - protein, 8 aa, Cryptosporidium parvum
SKKSWQAR

SEQ ID NO: 2343069 - protein, 4 aa, Cryptosporidium parvum
SKLS

SEQ ID NO: 2343070 - protein, 15 aa, Cryptosporidium parvum
SKNDEDKNQSDSSSW

SEQ ID NO: 2343071 - protein, 7 aa, Cryptosporidium parvum
SKNEELD

SEQ ID NO: 2343072 - protein, 12 aa, Cryptosporidium parvum
SKNKKDKKEHSF

SEQ ID NO: 2343073 - protein, 21 aa, Cryptosporidium parvum
SKNPSSNQNLNGLSASGSTNI

SEQ ID NO: 2343074 - protein, 12 aa, Cryptosporidium parvum
SKPENDDKSESY

SEQ ID NO: 2343075 - protein, 5 aa, Cryptosporidium parvum
SKPLG

SEQ ID NO: 2343076 - protein, 11 aa, Cryptosporidium parvum
SKQNEGGIKQP

SEQ ID NO: 2343077 - protein, 10 aa, Cryptosporidium parvum
SKQNNEDKNL

SEQ ID NO: 2343078 - protein, 4 aa, Cryptosporidium parvum
SKRT

SEQ ID NO: 2343079 - protein, 20 aa, Cryptosporidium parvum
SKSIKNSYSGIKNSKSNNFK

SEQ ID NO: 2343080 - protein, 9 aa, Cryptosporidium parvum
SKSIQDDSN

SEQ ID NO: 2343081 - protein, 9 aa, Cryptosporidium parvum
SKSSRISKS

SEQ ID NO: 2343082 - protein, 18 aa, Cryptosporidium parvum
SKSSSNGNNSYKGSNTST

SEQ ID NO: 2343083 - protein, 9 aa, Cryptosporidium parvum
SKSVENRKN

SEQ ID NO: 2343084 - protein, 8 aa, Cryptosporidium parvum
SKVTREKE

SEQ ID NO: 2343085 - protein, 8 aa, Cryptosporidium parvum
SKYDQEES

SEQ ID NO: 2343086 - protein, 4 aa, Cryptosporidium parvum
SKYG

SEQ ID NO: 2343087 - protein, 6 aa, Cryptosporidium parvum
SKYQTN

SEQ ID NO: 2343088 - protein, 18 aa, Cryptosporidium parvum
SKYSETMDSQDLRNYQNS

SEQ ID NO: 2343089 - protein, 4 aa, Cryptosporidium parvum
SLEP

SEQ ID NO: 2343090 - protein, 32 aa, Cryptosporidium parvum; identical to SEQ ID NO: 2225458

SEQ ID NO: 2343091 - protein, 21 aa, Cryptosporidium parvum
SLKENIKDKKSMNTIKTTKSN

SEQ ID NO: 2343092 - protein, 5 aa, Cryptosporidium parvum
SLKKE

SEQ ID NO: 2343093 - protein, 32 aa, Cryptosporidium parvum; identical to SEQ ID NO: 2225466

SEQ ID NO: 2343094 - protein, 5 aa, Cryptosporidium parvum
SLNEG

SEQ ID NO: 2343095 - protein, 6 aa, Cryptosporidium parvum
SLNEGL

SEQ ID NO: 2343096 - protein, 5 aa, Cryptosporidium parvum
SLNQD

SEQ ID NO: 2343097 - protein, 4 aa, Cryptosporidium parvum
SLPS

SEQ ID NO: 2343098 - protein, 7 aa, Cryptosporidium parvum
SLQSNQI

SEQ ID NO: 2343099 - protein, 11 aa, Cryptosporidium parvum
SLSPQSPEYGR

SEQ ID NO: 2343100 - protein, 10 aa, Cryptosporidium parvum
SLTQEKIESA

SEQ ID NO: 2343101 - protein, 4 aa, Cryptosporidium parvum
SLWS

SEQ ID NO: 2343102 - protein, 7 aa, Cryptosporidium parvum
SMEEENQ

SEQ ID NO: 2343103 - protein, 10 aa, Cryptosporidium parvum
SMNNTNNSQY

SEQ ID NO: 2343104 - protein, 22 aa, Cryptosporidium parvum
SNANENSQKSSSAQVNNNLNSD

SEQ ID NO: 2343105 - protein, 5 aa, Cryptosporidium parvum
SNAQK

SEQ ID NO: 2343106 - protein, 4 aa, Cryptosporidium parvum
SNAT

SEQ ID NO: 2343107 - protein, 5 aa, Cryptosporidium parvum
SNDEY

SEQ ID NO: 2343108 - protein, 15 aa, Cryptosporidium parvum
SNDSNSNNNSNNNCE

SEQ ID NO: 2343109 - protein, 13 aa, Cryptosporidium parvum
SNEEIKNKESDIQ

SEQ ID NO: 2343110 - protein, 6 aa, Cryptosporidium parvum
SNEHYN

SEQ ID NO: 2343111 - protein, 8 aa, Cryptosporidium parvum
SNENREKY

SEQ ID NO: 2343112 - protein, 12 aa, Cryptosporidium parvum
SNESVENDFEGK

SEQ ID NO: 2343113 - protein, 4 aa, Cryptosporidium parvum
SNEY

SEQ ID NO: 2343114 - protein, 18 aa, Cryptosporidium parvum
SNGESKRTSVSSKGSEEF

SEQ ID NO: 2343115 - protein, 8 aa, Cryptosporidium parvum
SNGNDPPI

SEQ ID NO: 2343116 - protein, 8 aa, Cryptosporidium parvum
SNGNTGIN

SEQ ID NO: 2343117 - protein, 7 aa, Cryptosporidium parvum
SNHPGKN

SEQ ID NO: 2343118 - protein, 5 aa, Cryptosporidium parvum
SNHQR

SEQ ID NO: 2343119 - protein, 5 aa, Cryptosporidium parvum
SNIEE

SEQ ID NO: 2343120 - protein, 7 aa, Cryptosporidium parvum
SNIPEKP

SEQ ID NO: 2343121 - protein, 73 aa, Cryptosporidium parvum; identical to SEQ ID NO: 2225653

SEQ ID NO: 2343122 - protein, 13 aa, Cryptosporidium parvum
SNKEEKSRSTPIQ

SEQ ID NO: 2343123 - protein, 6 aa, Cryptosporidium parvum
SNKLQS

SEQ ID NO: 2343124 - protein, 10 aa, Cryptosporidium parvum
SNKSDAMEQG

SEQ ID NO: 2343125 - protein, 8 aa, Cryptosporidium parvum
SNKTHRLS

SEQ ID NO: 2343126 - protein, 11 aa, Cryptosporidium parvum
SNLKKNKNELE

SEQ ID NO: 2343127 - protein, 13 aa, Cryptosporidium parvum
SNLNNTATTSTTT

SEQ ID NO: 2343128 - protein, 13 aa, Cryptosporidium parvum
SNLQNTSNSTPGY

SEQ ID NO: 2343129 - protein, 11 aa, Cryptosporidium parvum
SNLSDTKASDI

SEQ ID NO: 2343130 - protein, 8 aa, Cryptosporidium parvum
SNNEDNYN

SEQ ID NO: 2343131 - protein, 6 aa, Cryptosporidium parvum
SNNEEL

SEQ ID NO: 2343132 - protein, 5 aa, Cryptosporidium parvum
SNNEI

SEQ ID NO: 2343133 - protein, 13 aa, Cryptosporidium parvum
SNNPFHGNSAGTT

SEQ ID NO: 2343134 - protein, 7 aa, Cryptosporidium parvum
SNNVPNL

SEQ ID NO: 2343135 - protein, 5 aa, Cryptosporidium parvum
SNPEF

SEQ ID NO: 2343136 - protein, 7 aa, Cryptosporidium parvum
SNPFTPN

SEQ ID NO: 2343137 - protein, 6 aa, Cryptosporidium parvum
SNPNEK

SEQ ID NO: 2343138 - protein, 10 aa, Cryptosporidium parvum
SNPNIPDRNG

SEQ ID NO: 2343139 - protein, 7 aa, Cryptosporidium parvum
SNQEEIR

SEQ ID NO: 2343140 - protein, 6 aa, Cryptosporidium parvum
SNQIPK

SEQ ID NO: 2343141 - protein, 9 aa, Cryptosporidium parvum
SNQNSNPET

SEQ ID NO: 2343142 - protein, 23 aa, Cryptosporidium parvum
SNRKKEDSSSHISETFSDSNNRS

SEQ ID NO: 2343143 - protein, 8 aa, Cryptosporidium parvum
SNRNEEIN

SEQ ID NO: 2343144 - protein, 7 aa, Cryptosporidium parvum
SNSDTGI

SEQ ID NO: 2343145 - protein, 6 aa, Cryptosporidium parvum
SNSESV

SEQ ID NO: 2343146 - protein, 45 aa, Cryptosporidium parvum; identical to SEQ ID NO: 2225811

SEQ ID NO: 2343147 - protein, 18 aa, Cryptosporidium parvum
SNSNGKSFPVKQSPSKTH

SEQ ID NO: 2343148 - protein, 8 aa, Cryptosporidium parvum
SNSSSASL

SEQ ID NO: 2343149 - protein, 5 aa, Cryptosporidium parvum
SNSST

SEQ ID NO: 2343150 - protein, 8 aa, Cryptosporidium parvum
SNSTNTHK

SEQ ID NO: 2343151 - protein, 9 aa, Cryptosporidium parvum
SNSVDGTEK

SEQ ID NO: 2343152 - protein, 4 aa, Cryptosporidium parvum
SNSY

SEQ ID NO: 2343153 - protein, 16 aa, Cryptosporidium parvum
SNTQSEIEQQSGDEHD

SEQ ID NO: 2343154 - protein, 4 aa, Cryptosporidium parvum
SNTR

SEQ ID NO: 2343155 - protein, 8 aa, Cryptosporidium parvum
SNTSDLSR

SEQ ID NO: 2343156 - protein, 4 aa, Cryptosporidium parvum
SNTT

SEQ ID NO: 2343157 - protein, 5 aa, Cryptosporidium parvum
SPADN

SEQ ID NO: 2343158 - protein, 6 aa, Cryptosporidium parvum
SPALSD

SEQ ID NO: 2343159 - protein, 5 aa, Cryptosporidium parvum
SPASE

SEQ ID NO: 2343160 - protein, 9 aa, Cryptosporidium parvum
SPENESDKS

SEQ ID NO: 2343161 - protein, 6 aa, Cryptosporidium parvum
SPEPLN

SEQ ID NO: 2343162 - protein, 4 aa, Cryptosporidium parvum
SPEQ

SEQ ID NO: 2343163 - protein, 5 aa, Cryptosporidium parvum
SPHPK

SEQ ID NO: 2343164 - protein, 6 aa, Cryptosporidium parvum
SPINNK

SEQ ID NO: 2343165 - protein, 5 aa, Cryptosporidium parvum
SPIPG

SEQ ID NO: 2343166 - protein, 10 aa, Cryptosporidium parvum
SPISTCPSPD

SEQ ID NO: 2343167 - protein, 12 aa, Cryptosporidium parvum
SPLGGLSPISQS

SEQ ID NO: 2343168 - protein, 6 aa, Cryptosporidium parvum
SPLNTS

SEQ ID NO: 2343169 - protein, 10 aa, Cryptosporidium parvum
SPLSNFPSTV

SEQ ID NO: 2343170 - protein, 12 aa, Cryptosporidium parvum
SPNNSSESNTEL

SEQ ID NO: 2343171 - protein, 5 aa, Cryptosporidium parvum
SPQVK

SEQ ID NO: 2343172 - protein, 8 aa, Cryptosporidium parvum
SPSEKEYN

SEQ ID NO: 2343173 - protein, 4 aa, Cryptosporidium parvum
SPSF

SEQ ID NO: 2343174 - protein, 5 aa, Cryptosporidium parvum
SPSIK

SEQ ID NO: 2343175 - protein, 4 aa, Cryptosporidium parvum
SPSR

SEQ ID NO: 2343176 - protein, 8 aa, Cryptosporidium parvum
SPSVPSQA

SEQ ID NO: 2343177 - protein, 16 aa, Cryptosporidium parvum
SPTNNSLDTKTPLLKA

SEQ ID NO: 2343178 - protein, 7 aa, Cryptosporidium parvum
SPTSNDE

SEQ ID NO: 2343179 - protein, 10 aa, Cryptosporidium parvum
SPVNNNATYA

SEQ ID NO: 2343180 - protein, 4 aa, Cryptosporidium parvum
SPYT

SEQ ID NO: 2343181 - protein, 20 aa, Cryptosporidium parvum
SQATNTSQVSQGGGKRTFSF

SEQ ID NO: 2343182 - protein, 16 aa, Cryptosporidium parvum
SQDSGNLSSTNSNPRE

SEQ ID NO: 2343183 - protein, 8 aa, Cryptosporidium parvum
SQDSQTGL

SEQ ID NO: 2343184 - protein, 32 aa, Cryptosporidium parvum; identical to SEQ ID NO: 2226032

SEQ ID NO: 2343185 - protein, 12 aa, Cryptosporidium parvum
SQENTSLETYDK

SEQ ID NO: 2343186 - protein, 6 aa, Cryptosporidium parvum
SQESEF

SEQ ID NO: 2343187 - protein, 18 aa, Cryptosporidium parvum
SQFGNNDTNNLNATSQTT

SEQ ID NO: 2343188 - protein, 4 aa, Cryptosporidium parvum
SQFS

SEQ ID NO: 2343189 - protein, 4 aa, Cryptosporidium parvum
SQGL

SEQ ID NO: 2343190 - protein, 8 aa, Cryptosporidium parvum
SQIQNHEY

SEQ ID NO: 2343191 - protein, 12 aa, Cryptosporidium parvum
SQISGKDDSLIG

SEQ ID NO: 2343192 - protein, 6 aa, Cryptosporidium parvum
SQNNQI

SEQ ID NO: 2343193 - protein, 19 aa, Cryptosporidium parvum
SQNSELGLSSSISDEISSR

SEQ ID NO: 2343194 - protein, 5 aa, Cryptosporidium parvum
SQNSI

SEQ ID NO: 2343195 - protein, 4 aa, Cryptosporidium parvum
SQYK

SEQ ID NO: 2343196 - protein, 4 aa, Cryptosporidium parvum
SRAK

SEQ ID NO: 2343197 - protein, 8 aa, Cryptosporidium parvum
SRELNKEN

SEQ ID NO: 2343198 - protein, 6 aa, Cryptosporidium parvum
SRETKE

SEQ ID NO: 2343199 - protein, 11 aa, Cryptosporidium parvum
SRGINNSGGLN

SEQ ID NO: 2343200 - protein, 12 aa, Cryptosporidium parvum
SRGPNKSSTNQF

SEQ ID NO: 2343201 - protein, 7 aa, Cryptosporidium parvum
SRIEKSV

SEQ ID NO: 2343202 - protein, 6 aa, Cryptosporidium parvum
SRNREK

SEQ ID NO: 2343203 - protein, 9 aa, Cryptosporidium parvum
SRPSESTIR

SEQ ID NO: 2343204 - protein, 7 aa, Cryptosporidium parvum
SRPTGAE

SEQ ID NO: 2343205 - protein, 14 aa, Cryptosporidium parvum
SRQELDKPSSISDN

SEQ ID NO: 2343206 - protein, 6 aa, Cryptosporidium parvum
SRSKCC

SEQ ID NO: 2343207 - protein, 9 aa, Cryptosporidium parvum
SRSNSSISV

SEQ ID NO: 2343208 - protein, 10 aa, Cryptosporidium parvum
SRSQNENFQV

SEQ ID NO: 2343209 - protein, 7 aa, Cryptosporidium parvum
SRTDPQF

SEQ ID NO: 2343210 - protein, 15 aa, Cryptosporidium parvum
SRVSASESEEEFVPP

SEQ ID NO: 2343211 - protein, 7 aa, Cryptosporidium parvum
SSALESG

SEQ ID NO: 2343212 - protein, 6 aa, Cryptosporidium parvum
SSDGDP

SEQ ID NO: 2343213 - protein, 9 aa, Cryptosporidium parvum
SSDGGDSIA

SEQ ID NO: 2343214 - protein, 7 aa, Cryptosporidium parvum
SSDGTRE

SEQ ID NO: 2343215 - protein, 5 aa, Cryptosporidium parvum
SSDIP

SEQ ID NO: 2343216 - protein, 9 aa, Cryptosporidium parvum
SSDLANKIS

SEQ ID NO: 2343217 - protein, 9 aa, Cryptosporidium parvum
SSDLESSAV

SEQ ID NO: 2343218 - protein, 11 aa, Cryptosporidium parvum
SSDNNEIENTN

SEQ ID NO: 2343219 - protein, 8 aa, Cryptosporidium parvum
SSEEGDLR

SEQ ID NO: 2343220 - protein, 8 aa, Cryptosporidium parvum
SSEFNEND

SEQ ID NO: 2343221 - protein, 14 aa, Cryptosporidium parvum
SSERKESNNKVKEN

SEQ ID NO: 2343222 - protein, 7 aa, Cryptosporidium parvum
SSFSDNR

SEQ ID NO: 2343223 - protein, 6 aa, Cryptosporidium parvum
SSGEIS

SEQ ID NO: 2343224 - protein, 9 aa, Cryptosporidium parvum
SSGINSGDV

SEQ ID NO: 2343225 - protein, 4 aa, Cryptosporidium parvum
SSGS

SEQ ID NO: 2343226 - protein, 4 aa, Cryptosporidium parvum
SSII

SEQ ID NO: 2343227 - protein, 6 aa, Cryptosporidium parvum
SSIPNK

SEQ ID NO: 2343228 - protein, 8 aa, Cryptosporidium parvum
SSIQDSQE

SEQ ID NO: 2343229 - protein, 13 aa, Cryptosporidium parvum
SSISNNSDESKDK

SEQ ID NO: 2343230 - protein, 25 aa, Cryptosporidium parvum
SSKILRKGKTSSTLSKNNANHLQSE

SEQ ID NO: 2343231 - protein, 6 aa, Cryptosporidium parvum
SSKKYT

SEQ ID NO: 2343232 - protein, 7 aa, Cryptosporidium parvum
SSKYSKC

SEQ ID NO: 2343233 - protein, 5 aa, Cryptosporidium parvum
SSLES

SEQ ID NO: 2343234 - protein, 6 aa, Cryptosporidium parvum
SSLLNS

SEQ ID NO: 2343235 - protein, 8 aa, Cryptosporidium parvum
SSLNQSAG

SEQ ID NO: 2343236 - protein, 5 aa, Cryptosporidium parvum
SSLST

SEQ ID NO: 2343237 - protein, 6 aa, Cryptosporidium parvum
SSNESF

SEQ ID NO: 2343238 - protein, 8 aa, Cryptosporidium parvum
SSNESKIY

SEQ ID NO: 2343239 - protein, 7 aa, Cryptosporidium parvum
SSNFKRD

SEQ ID NO: 2343240 - protein, 21 aa, Cryptosporidium parvum
SSNFNQSNQLQHNSHQTNVNQ

SEQ ID NO: 2343241 - protein, 12 aa, Cryptosporidium parvum
SSNGFSANGGGV

SEQ ID NO: 2343242 - protein, 5 aa, Cryptosporidium parvum
SSNKN

SEQ ID NO: 2343243 - protein, 7 aa, Cryptosporidium parvum
SSNLDHN

SEQ ID NO: 2343244 - protein, 6 aa, Cryptosporidium parvum
SSNRNK

SEQ ID NO: 2343245 - protein, 6 aa, Cryptosporidium parvum
SSNRSA

SEQ ID NO: 2343246 - protein, 10 aa, Cryptosporidium parvum
SSNVTTFGSR

SEQ ID NO: 2343247 - protein, 31 aa, Cryptosporidium parvum; identical to SEQ ID NO: 2226472

SEQ ID NO: 2343248 - protein, 29 aa, Cryptosporidium parvum
SSPITFKPQQQQQQFQKQSSRNETGSSDP

SEQ ID NO: 2343249 - protein, 27 aa, Cryptosporidium parvum
SSPSSSSSNFNNPTVSSTSFSGGRQSS

SEQ ID NO: 2343250 - protein, 11 aa, Cryptosporidium parvum
SSQKLSSRNKS

SEQ ID NO: 2343251 - protein, 6 aa, Cryptosporidium parvum
SSQLYQ

SEQ ID NO: 2343252 - protein, 5 aa, Cryptosporidium parvum
SSRED

SEQ ID NO: 2343253 - protein, 6 aa, Cryptosporidium parvum
SSSDHK

SEQ ID NO: 2343254 - protein, 9 aa, Cryptosporidium parvum
SSSEDPEGL

SEQ ID NO: 2343255 - protein, 17 aa, Cryptosporidium parvum
SSSHTNPDSIQNEVANP

SEQ ID NO: 2343256 - protein, 4 aa, Cryptosporidium parvum
SSSQ

SEQ ID NO: 2343257 - protein, 8 aa, Cryptosporidium parvum
SSSQPMDT

SEQ ID NO: 2343258 - protein, 16 aa, Cryptosporidium parvum
SSSSDQSNSSLINRPQ

SEQ ID NO: 2343259 - protein, 5 aa, Cryptosporidium parvum
SSSYD

SEQ ID NO: 2343260 - protein, 10 aa, Cryptosporidium parvum
SSTDEDSSVV

SEQ ID NO: 2343261 - protein, 10 aa, Cryptosporidium parvum
SSTDKSDKWD

SEQ ID NO: 2343262 - protein, 6 aa, Cryptosporidium parvum
SSTKYS

SEQ ID NO: 2343263 - protein, 5 aa, Cryptosporidium parvum
SSTNL

SEQ ID NO: 2343264 - protein, 9 aa, Cryptosporidium parvum
SSTPTSSNF

SEQ ID NO: 2343265 - protein, 7 aa, Cryptosporidium parvum
SSTRGNK

SEQ ID NO: 2343266 - protein, 7 aa, Cryptosporidium parvum
SSTSFSP

SEQ ID NO: 2343267 - protein, 8 aa, Cryptosporidium parvum
STCGPGNK

SEQ ID NO: 2343268 - protein, 7 aa, Cryptosporidium parvum
STDEIGT

SEQ ID NO: 2343269 - protein, 17 aa, Cryptosporidium parvum
STDPKNLSAMKPTWMPW

SEQ ID NO: 2343270 - protein, 36 aa, Cryptosporidium parvum; identical to SEQ ID NO: 2226675

SEQ ID NO: 2343271 - protein, 5 aa, Cryptosporidium parvum
STETN

SEQ ID NO: 2343272 - protein, 12 aa, Cryptosporidium parvum
STETSYSTQTKN

SEQ ID NO: 2343273 - protein, 4 aa, Cryptosporidium parvum
STIS

SEQ ID NO: 2343274 - protein, 13 aa, Cryptosporidium parvum
STKNTGKQISGGI

SEQ ID NO: 2343275 - protein, 13 aa, Cryptosporidium parvum
STKSNSAFAQNKK

SEQ ID NO: 2343276 - protein, 8 aa, Cryptosporidium parvum
STLPISTK

SEQ ID NO: 2343277 - protein, 13 aa, Cryptosporidium parvum
STNLGADYDDDGN

SEQ ID NO: 2343278 - protein, 21 aa, Cryptosporidium parvum
STPNIRRTPNSSNSDINDQNI

SEQ ID NO: 2343279 - protein, 5 aa, Cryptosporidium parvum
STPTE

SEQ ID NO: 2343280 - protein, 16 aa, Cryptosporidium parvum
STQTRNTLTDSSRKYG

SEQ ID NO: 2343281 - protein, 5 aa, Cryptosporidium parvum
STRHK

SEQ ID NO: 2343282 - protein, 27 aa, Cryptosporidium parvum
STRRSEIENQDNMQEGEYDEGEEEDED

SEQ ID NO: 2343283 - protein, 6 aa, Cryptosporidium parvum
STRSKE

SEQ ID NO: 2343284 - protein, 5 aa, Cryptosporidium parvum
STSQS

SEQ ID NO: 2343285 - protein, 5 aa, Cryptosporidium parvum
STSSS

SEQ ID NO: 2343286 - protein, 8 aa, Cryptosporidium parvum
STTEPTLG

SEQ ID NO: 2343287 - protein, 4 aa, Cryptosporidium parvum
STVY

SEQ ID NO: 2343288 - protein, 22 aa, Cryptosporidium parvum
SVDNSTNSASIGGGIGRVGGGI

SEQ ID NO: 2343289 - protein, 10 aa, Cryptosporidium parvum
SVGKTQPIHS

SEQ ID NO: 2343290 - protein, 31 aa, Cryptosporidium parvum
SVGPDSDSGSKPPAGSASASNLASTSNSGSG

SEQ ID NO: 2343291 - protein, 16 aa, Cryptosporidium parvum
SVKPSSTITHHRTFTS

SEQ ID NO: 2343292 - protein, 12 aa, Cryptosporidium parvum
SVNEKDEKTLNN

SEQ ID NO: 2343293 - protein, 12 aa, Cryptosporidium parvum
SVNENQGSFEDR

SEQ ID NO: 2343294 - protein, 8 aa, Cryptosporidium parvum
SVPHSSTL

SEQ ID NO: 2343295 - protein, 9 aa, Cryptosporidium parvum
SVSESQISN

SEQ ID NO: 2343296 - protein, 18 aa, Cryptosporidium parvum
SVTSQPDSSSNFSSPNTA

SEQ ID NO: 2343297 - protein, 19 aa, Cryptosporidium parvum
SYDDHSSYSNLSKYPDQLE

SEQ ID NO: 2343298 - protein, 6 aa, Cryptosporidium parvum
SYGTNL

SEQ ID NO: 2343299 - protein, 13 aa, Cryptosporidium parvum
SYMDSSPKCTNSQ

SEQ ID NO: 2343300 - protein, 5 aa, Cryptosporidium parvum
SYPGT

SEQ ID NO: 2343301 - protein, 13 aa, Cryptosporidium parvum
SYRRDENKVYNPK

SEQ ID NO: 2343302 - protein, 5 aa, Cryptosporidium parvum
SYTTN

SEQ ID NO: 2343303 - protein, 12 aa, Cryptosporidium parvum
TAAPHGNPDDHP

SEQ ID NO: 2343304 - protein, 12 aa, Cryptosporidium parvum
TAFDQNTDISGV

SEQ ID NO: 2343305 - protein, 8 aa, Cryptosporidium parvum
TAKSSSEN

SEQ ID NO: 2343306 - protein, 7 aa, Cryptosporidium parvum
TAKTSVS

SEQ ID NO: 2343307 - protein, 33 aa, Cryptosporidium parvum; identical to SEQ ID NO: 2226918

SEQ ID NO: 2343308 - protein, 7 aa, Cryptosporidium parvum
TANASIR

SEQ ID NO: 2343309 - protein, 4 aa, Cryptosporidium parvum
TANF

SEQ ID NO: 2343310 - protein, 28 aa, Cryptosporidium parvum
TAREGQTEDKQEIVRSTEEVSKGKADIK

SEQ ID NO: 2343311 - protein, 15 aa, Cryptosporidium parvum
TAVAAEENIENQNGN

SEQ ID NO: 2343312 - protein, 13 aa, Cryptosporidium parvum
TCAQTNRGLPSLS

SEQ ID NO: 2343313 - protein, 5 aa, Cryptosporidium parvum
TCDRT

SEQ ID NO: 2343314 - protein, 7 aa, Cryptosporidium parvum
TCNGGTT

SEQ ID NO: 2343315 - protein, 9 aa, Cryptosporidium parvum
TCSRSESVP

SEQ ID NO: 2343316 - protein, 5 aa, Cryptosporidium parvum
TDEDS

SEQ ID NO: 2343317 - protein, 8 aa, Cryptosporidium parvum
TDEESFND

SEQ ID NO: 2343318 - protein, 9 aa, Cryptosporidium parvum
TDHGQEKLE

SEQ ID NO: 2343319 - protein, 4 aa, Cryptosporidium parvum
TDKL

SEQ ID NO: 2343320 - protein, 8 aa, Cryptosporidium parvum
TDKVNQKI

SEQ ID NO: 2343321 - protein, 6 aa, Cryptosporidium parvum
TDNDGS

SEQ ID NO: 2343322 - protein, 4 aa, Cryptosporidium parvum
TEDQ

SEQ ID NO: 2343323 - protein, 5 aa, Cryptosporidium parvum
TEETI

SEQ ID NO: 2343324 - protein, 4 aa, Cryptosporidium parvum
TEIN

SEQ ID NO: 2343325 - protein, 9 aa, Cryptosporidium parvum
TELDSTENV

SEQ ID NO: 2343326 - protein, 4 aa, Cryptosporidium parvum
TELS

SEQ ID NO: 2343327 - protein, 8 aa, Cryptosporidium parvum
TENTGNFP

SEQ ID NO: 2343328 - protein, 8 aa, Cryptosporidium parvum
TERQYSDS

SEQ ID NO: 2343329 - protein, 6 aa, Cryptosporidium parvum
TESSYE

SEQ ID NO: 2343330 - protein, 16 aa, Cryptosporidium parvum
TETSSQQLSSVASESL

SEQ ID NO: 2343331 - protein, 4 aa, Cryptosporidium parvum
TEYS

SEQ ID NO: 2343332 - protein, 10 aa, Cryptosporidium parvum
TFHNDNSTAA

SEQ ID NO: 2343333 - protein, 5 aa, Cryptosporidium parvum
TFTNT

SEQ ID NO: 2343334 - protein, 8 aa, Cryptosporidium parvum
TGANRNHG

SEQ ID NO: 2343335 - protein, 7 aa, Cryptosporidium parvum
TGEFDNA

SEQ ID NO: 2343336 - protein, 17 aa, Cryptosporidium parvum
TGEMPNGVEKEVNSRPF

SEQ ID NO: 2343337 - protein, 63 aa, Cryptosporidium parvum; identical to SEQ ID NO: 2227109

SEQ ID NO: 2343338 - protein, 12 aa, Cryptosporidium parvum
TGIATKQGPSIP

SEQ ID NO: 2343339 - protein, 23 aa, Cryptosporidium parvum
TGMDEDEQDEEDKQDEQEESVEY

SEQ ID NO: 2343340 - protein, 13 aa, Cryptosporidium parvum
TGNKGDLKNYTHK

SEQ ID NO: 2343341 - protein, 12 aa, Cryptosporidium parvum
TGNNGKQELDGS

SEQ ID NO: 2343342 - protein, 7 aa, Cryptosporidium parvum
TGNPSNI

SEQ ID NO: 2343343 - protein, 19 aa, Cryptosporidium parvum
TGPANSAENSKTQMKQVSS

SEQ ID NO: 2343344 - protein, 10 aa, Cryptosporidium parvum
TGSDTSSYTI

SEQ ID NO: 2343345 - protein, 13 aa, Cryptosporidium parvum
TGTRQDQNQGCSD

SEQ ID NO: 2343346 - protein, 5 aa, Cryptosporidium parvum
THDQV

SEQ ID NO: 2343347 - protein, 9 aa, Cryptosporidium parvum
THPNPTHPE

SEQ ID NO: 2343348 - protein, 7 aa, Cryptosporidium parvum
THSAPGC

SEQ ID NO: 2343349 - protein, 5 aa, Cryptosporidium parvum
THTSG

SEQ ID NO: 2343350 - protein, 5 aa, Cryptosporidium parvum
TIGPQ

SEQ ID NO: 2343351 - protein, 18 aa, Cryptosporidium parvum
TINPNQVTSNGKSNPDLK

SEQ ID NO: 2343352 - protein, 9 aa, Cryptosporidium parvum
TINSPSTSE

SEQ ID NO: 2343353 - protein, 4 aa, Cryptosporidium parvum
TISK

SEQ ID NO: 2343354 - protein, 12 aa, Cryptosporidium parvum
TISNDTSSGDKY

SEQ ID NO: 2343355 - protein, 6 aa, Cryptosporidium parvum
TISSKK

SEQ ID NO: 2343356 - protein, 9 aa, Cryptosporidium parvum
TKDKTSSFD

SEQ ID NO: 2343357 - protein, 7 aa, Cryptosporidium parvum
TKDYPNG

SEQ ID NO: 2343358 - protein, 10 aa, Cryptosporidium parvum
TKEDETPASV

SEQ ID NO: 2343359 - protein, 19 aa, Cryptosporidium parvum
TKGEEYCNNNNNNNNSNYE

SEQ ID NO: 2343360 - protein, 9 aa, Cryptosporidium parvum
TKNQDKTRN

SEQ ID NO: 2343361 - protein, 7 aa, Cryptosporidium parvum
TKNTECP

SEQ ID NO: 2343362 - protein, 10 aa, Cryptosporidium parvum
TKQNRDNTTE

SEQ ID NO: 2343363 - protein, 7 aa, Cryptosporidium parvum
TKQYNHH

SEQ ID NO: 2343364 - protein, 8 aa, Cryptosporidium parvum
TKTDPHKS

SEQ ID NO: 2343365 - protein, 7 aa, Cryptosporidium parvum
TKTDPVA

SEQ ID NO: 2343366 - protein, 9 aa, Cryptosporidium parvum
TKTGDLTKN

SEQ ID NO: 2343367 - protein, 9 aa, Cryptosporidium parvum
TKTKPHNKK

SEQ ID NO: 2343368 - protein, 15 aa, Cryptosporidium parvum
TKVKHEELKKKQEKT

SEQ ID NO: 2343369 - protein, 7 aa, Cryptosporidium parvum
TKWEKAG

SEQ ID NO: 2343370 - protein, 16 aa, Cryptosporidium parvum
TLKEKEENVKKGRYAI

SEQ ID NO: 2343371 - protein, 13 aa, Cryptosporidium parvum
TLNDSNPAIGGNS

SEQ ID NO: 2343372 - protein, 5 aa, Cryptosporidium parvum
TLPIN

SEQ ID NO: 2343373 - protein, 6 aa, Cryptosporidium parvum
TLRQTQ

SEQ ID NO: 2343374 - protein, 6 aa, Cryptosporidium parvum
TLSNQE

SEQ ID NO: 2343375 - protein, 17 aa, Cryptosporidium parvum
TLTPQSIERKEGTIIDQ

SEQ ID NO: 2343376 - protein, 7 aa, Cryptosporidium parvum
TMASQQQ

SEQ ID NO: 2343377 - protein, 4 aa, Cryptosporidium parvum
TNDF

SEQ ID NO: 2343378 - protein, 9 aa, Cryptosporidium parvum
TNELKKNNS

SEQ ID NO: 2343379 - protein, 7 aa, Cryptosporidium parvum
TNENGKD

SEQ ID NO: 2343380 - protein, 4 aa, Cryptosporidium parvum
TNLT

SEQ ID NO: 2343381 - protein, 10 aa, Cryptosporidium parvum
TNNNNNNNET

SEQ ID NO: 2343382 - protein, 7 aa, Cryptosporidium parvum
TNPPIER

SEQ ID NO: 2343383 - protein, 8 aa, Cryptosporidium parvum
TNQINENT

SEQ ID NO: 2343384 - protein, 10 aa, Cryptosporidium parvum
TNQQREPNKK

SEQ ID NO: 2343385 - protein, 5 aa, Cryptosporidium parvum
TNRTY

SEQ ID NO: 2343386 - protein, 8 aa, Cryptosporidium parvum
TNSNNKGN

SEQ ID NO: 2343387 - protein, 10 aa, Cryptosporidium parvum
TNSNSEHELN

SEQ ID NO: 2343388 - protein, 64 aa, Cryptosporidium parvum
TPINQEQVSTSTSSSGSSSNSSSDSSAAVSSSASTLESAPDSFSSSVQTSTFNHASSSNQADEE

SEQ ID NO: 2343389 - protein, 15 aa, Cryptosporidium parvum
TPISVSSKKSCNTIT

SEQ ID NO: 2343390 - protein, 5 aa, Cryptosporidium parvum
TPKDR

SEQ ID NO: 2343391 - protein, 6 aa, Cryptosporidium parvum
TPKLEN

SEQ ID NO: 2343392 - protein, 6 aa, Cryptosporidium parvum
TPKRID

SEQ ID NO: 2343393 - protein, 8 aa, Cryptosporidium parvum
TPKSTAHP

SEQ ID NO: 2343394 - protein, 39 aa, Cryptosporidium parvum; identical to SEQ ID NO: 2121094

SEQ ID NO: 2343395 - protein, 5 aa, Cryptosporidium parvum
TPRSQ

SEQ ID NO: 2343396 - protein, 5 aa, Cryptosporidium parvum
TPSEN

SEQ ID NO: 2343397 - protein, 11 aa, Cryptosporidium parvum
TPSPRARQTAA

SEQ ID NO: 2343398 - protein, 7 aa, Cryptosporidium parvum
TPTPNTV

SEQ ID NO: 2343399 - protein, 11 aa, Cryptosporidium parvum
TQDENDEDYST

SEQ ID NO: 2343400 - protein, 8 aa, Cryptosporidium parvum
TQPASSKL

SEQ ID NO: 2343401 - protein, 7 aa, Cryptosporidium parvum
TQRITAP

SEQ ID NO: 2343402 - protein, 5 aa, Cryptosporidium parvum
TQRSL

SEQ ID NO: 2343403 - protein, 21 aa, Cryptosporidium parvum
TQTDPIKTSRRSGSSKRRARK

SEQ ID NO: 2343404 - protein, 8 aa, Cryptosporidium parvum
TQTPAYQT

SEQ ID NO: 2343405 - protein, 20 aa, Cryptosporidium parvum
TQTSGQKKKKLSYSSPDPKI

SEQ ID NO: 2343406 - protein, 7 aa, Cryptosporidium parvum
TQTVPGE

SEQ ID NO: 2343407 - protein, 6 aa, Cryptosporidium parvum
TQYTEI

SEQ ID NO: 2343408 - protein, 16 aa, Cryptosporidium parvum
TRSFTSEPQTRPLQTQ

SEQ ID NO: 2343409 - protein, 7 aa, Cryptosporidium parvum
TRSGKTT

SEQ ID NO: 2343410 - protein, 4 aa, Cryptosporidium parvum
TRTN

SEQ ID NO: 2343411 - protein, 12 aa, Cryptosporidium parvum
TSAISQTKTGIS

SEQ ID NO: 2343412 - protein, 20 aa, Cryptosporidium parvum
TSDYSEESQNVTISKSRPIS

SEQ ID NO: 2343413 - protein, 5 aa, Cryptosporidium parvum
TSESI

SEQ ID NO: 2343414 - protein, 6 aa, Cryptosporidium parvum
TSGLDV

SEQ ID NO: 2343415 - protein, 10 aa, Cryptosporidium parvum
TSHEKEYDIG

SEQ ID NO: 2343416 - protein, 4 aa, Cryptosporidium parvum
TSIP

SEQ ID NO: 2343417 - protein, 4 aa, Cryptosporidium parvum
TSIQ

SEQ ID NO: 2343418 - protein, 19 aa, Cryptosporidium parvum
TSKYNKDPKYKEKGSDDFS

SEQ ID NO: 2343419 - protein, 11 aa, Cryptosporidium parvum
TSNMKGENGKE

SEQ ID NO: 2343420 - protein, 14 aa, Cryptosporidium parvum
TSNNFPSNANLGNS

SEQ ID NO: 2343421 - protein, 4 aa, Cryptosporidium parvum
TSNP

SEQ ID NO: 2343422 - protein, 8 aa, Cryptosporidium parvum
TSNSINDN

SEQ ID NO: 2343423 - protein, 5 aa, Cryptosporidium parvum
TSREN

SEQ ID NO: 2343424 - protein, 5 aa, Cryptosporidium parvum
TSSNE

SEQ ID NO: 2343425 - protein, 9 aa, Cryptosporidium parvum
TSSTLDSGA

SEQ ID NO: 2343426 - protein, 11 aa, Cryptosporidium parvum
TSYSSSSSKYF

SEQ ID NO: 2343427 - protein, 8 aa, Cryptosporidium parvum
TSYTVSGD

SEQ ID NO: 2343428 - protein, 6 aa, Cryptosporidium parvum
TTAPRG

SEQ ID NO: 2343429 - protein, 10 aa, Cryptosporidium parvum
TTEEGYGSNI

SEQ ID NO: 2343430 - protein, 4 aa, Cryptosporidium parvum
TTLP

SEQ ID NO: 2343431 - protein, 6 aa, Cryptosporidium parvum
TTNSQG

SEQ ID NO: 2343432 - protein, 4 aa, Cryptosporidium parvum
TTPE

SEQ ID NO: 2343433 - protein, 6 aa, Cryptosporidium parvum
TTPNNG

SEQ ID NO: 2343434 - protein, 5 aa, Cryptosporidium parvum
TTQLR

SEQ ID NO: 2343435 - protein, 5 aa, Cryptosporidium parvum
TTRST

SEQ ID NO: 2343436 - protein, 6 aa, Cryptosporidium parvum
TTSDGV

SEQ ID NO: 2343437 - protein, 6 aa, Cryptosporidium parvum
TTSPFS

SEQ ID NO: 2343438 - protein, 9 aa, Cryptosporidium parvum
TVNPPSDVS

SEQ ID NO: 2343439 - protein, 6 aa, Cryptosporidium parvum
TYNLPT

SEQ ID NO: 2343440 - protein, 4 aa, Cryptosporidium parvum
TYSD

SEQ ID NO: 2343441 - protein, 8 aa, Cryptosporidium parvum
TYSEKSTI

SEQ ID NO: 2343442 - protein, 13 aa, Cryptosporidium parvum
TYSINDNDSNFEE

SEQ ID NO: 2343443 - protein, 12 aa, Cryptosporidium parvum
TYSTKTNTPLPE

SEQ ID NO: 2343444 - protein, 8 aa, Cryptosporidium parvum
VAGSYDNE

SEQ ID NO: 2343445 - protein, 11 aa, Cryptosporidium parvum
VAQNPSNIDYT

SEQ ID NO: 2343446 - protein, 10 aa, Cryptosporidium parvum
VCSNNKSKTW

SEQ ID NO: 2343447 - protein, 6 aa, Cryptosporidium parvum
VDNSDE

SEQ ID NO: 2343448 - protein, 69 aa, Cryptosporidium parvum; identical to SEQ ID NO: 2227920

SEQ ID NO: 2343449 - protein, 13 aa, Cryptosporidium parvum
VDSNNKSSCNSDN

SEQ ID NO: 2343450 - protein, 9 aa, Cryptosporidium parvum
VDSSSKKPL

SEQ ID NO: 2343451 - protein, 41 aa, Cryptosporidium parvum; identical to SEQ ID NO: 2227942

SEQ ID NO: 2343452 - protein, 12 aa, Cryptosporidium parvum
VEGESSNNDTNL

SEQ ID NO: 2343453 - protein, 6 aa, Cryptosporidium parvum
VEKNSS

SEQ ID NO: 2343454 - protein, 7 aa, Cryptosporidium parvum
VENGEDE

SEQ ID NO: 2343455 - protein, 9 aa, Cryptosporidium parvum
VEPNSKFTE

SEQ ID NO: 2343456 - protein, 7 aa, Cryptosporidium parvum
VEQASPS

SEQ ID NO: 2343457 - protein, 21 aa, Cryptosporidium parvum
VEQISDSAEKAGEKDQEETQE

SEQ ID NO: 2343458 - protein, 6 aa, Cryptosporidium parvum
VESGDE

SEQ ID NO: 2343459 - protein, 4 aa, Cryptosporidium parvum
VESL

SEQ ID NO: 2343460 - protein, 4 aa, Cryptosporidium parvum
VESP

SEQ ID NO: 2343461 - protein, 110 aa, Cryptosporidium parvum; identical to SEQ ID NO: 2227978

SEQ ID NO: 2343462 - protein, 10 aa, Cryptosporidium parvum
VGGSERNNPY

SEQ ID NO: 2343463 - protein, 7 aa, Cryptosporidium parvum
VGNPTAL

SEQ ID NO: 2343464 - protein, 9 aa, Cryptosporidium parvum
VGPAARGLT

SEQ ID NO: 2343465 - protein, 23 aa, Cryptosporidium parvum
VGQNSSQSTSSSYAGSNSGMTNN

SEQ ID NO: 2343466 - protein, 27 aa, Cryptosporidium parvum
VGSADNSAEKFEEVASNKTSTIAPAEV

SEQ ID NO: 2343467 - protein, 7 aa, Cryptosporidium parvum
VGSGSRS

SEQ ID NO: 2343468 - protein, 7 aa, Cryptosporidium parvum
VGSKNEK

SEQ ID NO: 2343469 - protein, 8 aa, Cryptosporidium parvum
VGSSSPLM

SEQ ID NO: 2343470 - protein, 6 aa, Cryptosporidium parvum
VGTPPR

SEQ ID NO: 2343471 - protein, 8 aa, Cryptosporidium parvum
VGVPGKAA

SEQ ID NO: 2343472 - protein, 7 aa, Cryptosporidium parvum
VGVSPSP

SEQ ID NO: 2343473 - protein, 11 aa, Cryptosporidium parvum
VKGNDGKIIEN

SEQ ID NO: 2343474 - protein, 9 aa, Cryptosporidium parvum
VKGPSQDSC

SEQ ID NO: 2343475 - protein, 5 aa, Cryptosporidium parvum
VKRRK

SEQ ID NO: 2343476 - protein, 12 aa, Cryptosporidium parvum
VLENTKDHKFSN

SEQ ID NO: 2343477 - protein, 12 aa, Cryptosporidium parvum
VLSSNSNSNSIS

SEQ ID NO: 2343478 - protein, 30 aa, Cryptosporidium parvum; identical to SEQ ID NO: 2228072

SEQ ID NO: 2343479 - protein, 8 aa, Cryptosporidium parvum
VNAKDVPR

SEQ ID NO: 2343480 - protein, 14 aa, Cryptosporidium parvum
VNDSESGIQSKSIT

SEQ ID NO: 2343481 - protein, 13 aa, Cryptosporidium parvum
VNDSGKNQHNDIK

SEQ ID NO: 2343482 - protein, 18 aa, Cryptosporidium parvum
VNEKGNTQFSKKSGYVTQ

SEQ ID NO: 2343483 - protein, 23 aa, Cryptosporidium parvum
VNEPLSSSAVGTSSNASQGVPTS

SEQ ID NO: 2343484 - protein, 9 aa, Cryptosporidium parvum
VNGEKGNEF

SEQ ID NO: 2343485 - protein, 10 aa, Cryptosporidium parvum
VNKLDKKQFE

SEQ ID NO: 2343486 - protein, 5 aa, Cryptosporidium parvum
VNSRI

SEQ ID NO: 2343487 - protein, 14 aa, Cryptosporidium parvum
VNSTKSISSNSGAF

SEQ ID NO: 2343488 - protein, 7 aa, Cryptosporidium parvum
VNTYGPN

SEQ ID NO: 2343489 - protein, 4 aa, Cryptosporidium parvum
VNVN

SEQ ID NO: 2343490 - protein, 9 aa, Cryptosporidium parvum
VPKSPESKL

SEQ ID NO: 2343491 - protein, 8 aa, Cryptosporidium parvum
VPLDQQSK

SEQ ID NO: 2343492 - protein, 5 aa, Cryptosporidium parvum
VPNIS

SEQ ID NO: 2343493 - protein, 15 aa, Cryptosporidium parvum
VPSEIQKSQENEELE

SEQ ID NO: 2343494 - protein, 95 aa, Cryptosporidium parvum; identical to SEQ ID NO: 2228190

SEQ ID NO: 2343495 - protein, 9 aa, Cryptosporidium parvum
VQDDGPDSS

SEQ ID NO: 2343496 - protein, 8 aa, Cryptosporidium parvum
VQDVSPEI

SEQ ID NO: 2343497 - protein, 9 aa, Cryptosporidium parvum
VQQQGKGCP

SEQ ID NO: 2343498 - protein, 11 aa, Cryptosporidium parvum
VQSSEINERYK

SEQ ID NO: 2343499 - protein, 32 aa, Cryptosporidium parvum; identical to SEQ ID NO: 2228223

SEQ ID NO: 2343500 - protein, 5 aa, Cryptosporidium parvum
VSIPS

SEQ ID NO: 2343501 - protein, 14 aa, Cryptosporidium parvum
VSNETKRKTSNSSH

SEQ ID NO: 2343502 - protein, 16 aa, Cryptosporidium parvum
VSNYKSNNDNSSISTL

SEQ ID NO: 2343503 - protein, 7 aa, Cryptosporidium parvum
VSQDSSK

SEQ ID NO: 2343504 - protein, 4 aa, Cryptosporidium parvum
VSQE

SEQ ID NO: 2343505 - protein, 5 aa, Cryptosporidium parvum
VSRDD

SEQ ID NO: 2343506 - protein, 5 aa, Cryptosporidium parvum
VSSET

SEQ ID NO: 2343507 - protein, 21 aa, Cryptosporidium parvum
VSSSSSNSNQPPLLSNSDNHV

SEQ ID NO: 2343508 - protein, 17 aa, Cryptosporidium parvum
VSSTGKVVNSNKISKVD

SEQ ID NO: 2343509 - protein, 50 aa, Cryptosporidium parvum; identical to SEQ ID NO: 2228303

SEQ ID NO: 2343510 - protein, 7 aa, Cryptosporidium parvum
VTAQREA

SEQ ID NO: 2343511 - protein, 8 aa, Cryptosporidium parvum
VTEGTGIT

SEQ ID NO: 2343512 - protein, 6 aa, Cryptosporidium parvum
VTGNNN

SEQ ID NO: 2343513 - protein, 7 aa, Cryptosporidium parvum
VTNKNTE

SEQ ID NO: 2343514 - protein, 14 aa, Cryptosporidium parvum
VTSNNQTTTNDNSN

SEQ ID NO: 2343515 - protein, 5 aa, Cryptosporidium parvum
WEENR

SEQ ID NO: 2343516 - protein, 23 aa, Cryptosporidium parvum
WGKQSSAYQSTSSSASPPSYYAT

SEQ ID NO: 2343517 - protein, 12 aa, Cryptosporidium parvum
WGTTTQRVYSKS

SEQ ID NO: 2343518 - protein, 4 aa, Cryptosporidium parvum
WGVS

SEQ ID NO: 2343519 - protein, 8 aa, Cryptosporidium parvum
WKKEAQDV

SEQ ID NO: 2343520 - protein, 13 aa, Cryptosporidium parvum
WPTRIDGSTYSIP

SEQ ID NO: 2343521 - protein, 11 aa, Cryptosporidium parvum
WRNPIKKKPKE

SEQ ID NO: 2343522 - protein, 17 aa, Cryptosporidium parvum
WSGSAINRSPDGNQPVI

SEQ ID NO: 2343523 - protein, 8 aa, Cryptosporidium parvum
WSKDGSSL

SEQ ID NO: 2343524 - protein, 9 aa, Cryptosporidium parvum
WSSNSKSYS

SEQ ID NO: 2343525 - protein, 9 aa, Cryptosporidium parvum
WTGSDSAEK

SEQ ID NO: 2343526 - protein, 6 aa, Cryptosporidium parvum
YDGSNT

SEQ ID NO: 2343527 - protein, 14 aa, Cryptosporidium parvum
YDNQDISSSGYNSL

SEQ ID NO: 2343528 - protein, 4 aa, Cryptosporidium parvum
YEIN

SEQ ID NO: 2343529 - protein, 18 aa, Cryptosporidium parvum
YESQNKAFSYPGEKKYSI

SEQ ID NO: 2343530 - protein, 8 aa, Cryptosporidium parvum
YESSSLDN

SEQ ID NO: 2343531 - protein, 12 aa, Cryptosporidium parvum
YEYTNYSNSGYQ

SEQ ID NO: 2343532 - protein, 10 aa, Cryptosporidium parvum
YGENVKKGID

SEQ ID NO: 2343533 - protein, 7 aa, Cryptosporidium parvum
YGGESNR

SEQ ID NO: 2343534 - protein, 10 aa, Cryptosporidium parvum
YGGPNTQNSA

SEQ ID NO: 2343535 - protein, 5 aa, Cryptosporidium parvum
YGKTN

SEQ ID NO: 2343536 - protein, 18 aa, Cryptosporidium parvum
YGNHDTVDHEYENDDGYR

SEQ ID NO: 2343537 - protein, 9 aa, Cryptosporidium parvum
YISETSNSL

SEQ ID NO: 2343538 - protein, 4 aa, Cryptosporidium parvum
YKED

SEQ ID NO: 2343539 - protein, 48 aa, Cryptosporidium parvum; identical to SEQ ID NO: 2228523

SEQ ID NO: 2343540 - protein, 14 aa, Cryptosporidium parvum
YKNGEDGAKNTGII

SEQ ID NO: 2343541 - protein, 14 aa, Cryptosporidium parvum
YKNKNLPIKNKDND

SEQ ID NO: 2343542 - protein, 10 aa, Cryptosporidium parvum
YKNKTDETSI

SEQ ID NO: 2343543 - protein, 5 aa, Cryptosporidium parvum
YKPES

SEQ ID NO: 2343544 - protein, 17 aa, Cryptosporidium parvum
YLSDSGHYTVGKDASNA

SEQ ID NO: 2343545 - protein, 8 aa, Cryptosporidium parvum
YNGSKQNL

SEQ ID NO: 2343546 - protein, 9 aa, Cryptosporidium parvum
YNKGSPSTF

SEQ ID NO: 2343547 - protein, 14 aa, Cryptosporidium parvum
YNSSSKATNSNADC

SEQ ID NO: 2343548 - protein, 33 aa, Cryptosporidium parvum; identical to SEQ ID NO: 2228615

SEQ ID NO: 2343549 - protein, 4 aa, Cryptosporidium parvum
YNTP

SEQ ID NO: 2343550 - protein, 8 aa, Cryptosporidium parvum
YPKYPNQE

SEQ ID NO: 2343551 - protein, 5 aa, Cryptosporidium parvum
YPNIP

SEQ ID NO: 2343552 - protein, 31 aa, Cryptosporidium parvum; identical to SEQ ID NO: 2228647

SEQ ID NO: 2343553 - protein, 10 aa, Cryptosporidium parvum
YPTGRKIGGS

SEQ ID NO: 2343554 - protein, 4 aa, Cryptosporidium parvum
YPTN

SEQ ID NO: 2343555 - protein, 8 aa, Cryptosporidium parvum
YQDSSEQF

SEQ ID NO: 2343556 - protein, 19 aa, Cryptosporidium parvum
YQESKENSPSKDRESYHSV

SEQ ID NO: 2343557 - protein, 9 aa, Cryptosporidium parvum
YQGPSKSSV

SEQ ID NO: 2343558 - protein, 35 aa, Cryptosporidium parvum; identical to SEQ ID NO: 2228667

SEQ ID NO: 2343559 - protein, 6 aa, Cryptosporidium parvum
YRGDSD

SEQ ID NO: 2343560 - protein, 10 aa, Cryptosporidium parvum
YRPKSPRPKF

SEQ ID NO: 2343561 - protein, 11 aa, Cryptosporidium parvum
YSEDSKSFKND

SEQ ID NO: 2343562 - protein, 7 aa, Cryptosporidium parvum
YSEERKY

SEQ ID NO: 2343563 - protein, 5 aa, Cryptosporidium parvum
YSENG

SEQ ID NO: 2343564 - protein, 5 aa, Cryptosporidium parvum
YSGSF

SEQ ID NO: 2343565 - protein, 9 aa, Cryptosporidium parvum
YSKDDAPKF

SEQ ID NO: 2343566 - protein, 18 aa, Cryptosporidium parvum
YSKETIDKIKSNTSSTTC

SEQ ID NO: 2343567 - protein, 9 aa, Cryptosporidium parvum
YSKKDREEK

SEQ ID NO: 2343568 - protein, 8 aa, Cryptosporidium parvum
YSKKKNST

SEQ ID NO: 2343569 - protein, 7 aa, Cryptosporidium parvum
YSNEKEI

SEQ ID NO: 2343570 - protein, 9 aa, Cryptosporidium parvum
YSNKRKKSL

SEQ ID NO: 2343571 - protein, 9 aa, Cryptosporidium parvum
YSNNSSKSI

SEQ ID NO: 2343572 - protein, 7 aa, Cryptosporidium parvum
YSNQVSN

SEQ ID NO: 2343573 - protein, 4 aa, Cryptosporidium parvum
YSNT

SEQ ID NO: 2343574 - protein, 19 aa, Cryptosporidium parvum
YSRPETEYSEAMSSNQGNN

SEQ ID NO: 2343575 - protein, 5 aa, Cryptosporidium parvum
YSTDR

SEQ ID NO: 2343576 - protein, 4 aa, Cryptosporidium parvum
YSYN

SEQ ID NO: 2343577 - protein, 7 aa, Cryptosporidium parvum
YTDGDKG

SEQ ID NO: 2343578 - protein, 8 aa, Cryptosporidium parvum
YTDKNDEL

SEQ ID NO: 2343579 - protein, 4 aa, Cryptosporidium parvum
YTEN

SEQ ID NO: 2343580 - protein, 6 aa, Cryptosporidium parvum
YTETSE

SEQ ID NO: 2343581 - protein, 13 aa, Cryptosporidium parvum
YTGPEVPNQPKVA

SEQ ID NO: 2343582 - protein, 7 aa, Cryptosporidium parvum
YTKKHNQ

SEQ ID NO: 2343583 - protein, 9 aa, Cryptosporidium parvum
YTKNTNETL

SEQ ID NO: 2343584 - protein, 4 aa, Cryptosporidium parvum
YTLD

SEQ ID NO: 2343585 - protein, 10 aa, Cryptosporidium parvum
YTTTSHHGHG

SEQ ID NO: 2343586 - protein, 44 aa, Cryptosporidium parvum; identical to SEQ ID NO: 2228847

SEQ ID NO: 2343587 - protein, 8 aa, Cryptosporidium parvum
YYYPPNPW

SEQ ID NO: 2343588 - protein, 25 aa, Cryptosporidium parvum
AAGVGIYFGWKLFKKGKVCSMIKEI

SEQ ID NO: 2343589 - protein, 25 aa, Cryptosporidium parvum
ADTVFKAAVCLLLISLSAAFCSSIA

SEQ ID NO: 2343590 - protein, 19 aa, Cryptosporidium parvum
AEALKAFSQILYKHITEAT

SEQ ID NO: 2343591 - protein, 22 aa, Cryptosporidium parvum
AEGLVFWLFRVHNLVTLRVATE

SEQ ID NO: 2343592 - protein, 21 aa, Cryptosporidium parvum
AEYYGQVLFSLWIKTKLHAIA

SEQ ID NO: 2343593 - protein, 21 aa, Cryptosporidium parvum
AFFIHLKRFHRDISNVFPELH

SEQ ID NO: 2343594 - protein, 17 aa, Cryptosporidium parvum
AFGALFVGCSLVIAGFG

SEQ ID NO: 2343595 - protein, 21 aa, Cryptosporidium parvum
AFGLRYIVPSVFAIFAALFVL

SEQ ID NO: 2343596 - protein, 18 aa, Cryptosporidium parvum
AFIMKSIYSYSKKKNSTI

SEQ ID NO: 2343597 - protein, 17 aa, Cryptosporidium parvum
AFMAFQILQLLIKLAKT

SEQ ID NO: 2343598 - protein, 23 aa, Cryptosporidium parvum
AFVRETYEIFLFLSAISLLYFIL

SEQ ID NO: 2343599 - protein, 17 aa, Cryptosporidium parvum
AGGVPILVGFVSTCLLG

SEQ ID NO: 2343600 - protein, 25 aa, Cryptosporidium parvum
AIAACREPLRVAFTAQLRQVLHPTP

SEQ ID NO: 2343601 - protein, 20 aa, Cryptosporidium parvum
AIDLLTKCSETLRKTASDWN

SEQ ID NO: 2343602 - protein, 20 aa, Cryptosporidium parvum
AIIAAFFKRFNKPRNQITIA

SEQ ID NO: 2343603 - protein, 19 aa, Cryptosporidium parvum
AILHILNKIVLIFPQSIYF

SEQ ID NO: 2343604 - protein, 36 aa, Cryptosporidium parvum
AIMAPNCFDNKFILAARRYQCCFDQIKGGYYFQYDF

SEQ ID NO: 2343605 - protein, 23 aa, Cryptosporidium parvum
AITELKNSYYLSIESLIICYLIL

SEQ ID NO: 2343606 - protein, 23 aa, Cryptosporidium parvum
AIYSAQEFILFPISKIVATSHEK

SEQ ID NO: 2343607 - protein, 32 aa, Cryptosporidium parvum; identical to SEQ ID NO: 2229003

SEQ ID NO: 2343608 - protein, 30 aa, Cryptosporidium parvum; identical to SEQ ID NO: 2229006

SEQ ID NO: 2343609 - protein, 25 aa, Cryptosporidium parvum
AKSSSENWLALQFIKQYNVSIYIDH

SEQ ID NO: 2343610 - protein, 25 aa, Cryptosporidium parvum
AKVRDNLILLPRVIFIFVIQCLSLI

SEQ ID NO: 2343611 - protein, 20 aa, Cryptosporidium parvum
ALDAFRVALGPGVILNYLLQ

SEQ ID NO: 2343612 - protein, 26 aa, Cryptosporidium parvum
ALESFTRFRIIFSRERAKGLYGPATY

SEQ ID NO: 2343613 - protein, 18 aa, Cryptosporidium parvum
ALHPERLVGTVGVQANYN

SEQ ID NO: 2343614 - protein, 18 aa, Cryptosporidium parvum
ALHSGKKGTCGILVEPVY

SEQ ID NO: 2343615 - protein, 26 aa, Cryptosporidium parvum
ALQKTFAYMTLWPIAYSVKRSIRHSW

SEQ ID NO: 2343616 - protein, 24 aa, Cryptosporidium parvum
ANGKLKLFLTKTINIENFDTSCNP

SEQ ID NO: 2343617 - protein, 17 aa, Cryptosporidium parvum
APISHLILHLWVNNIPC

SEQ ID NO: 2343618 - protein, 25 aa, Cryptosporidium parvum
AQLPCLLESNIVNLCYDISWSKKTA

SEQ ID NO: 2343619 - protein, 19 aa, Cryptosporidium parvum
ASDIFPNIGTHFLEHNIIR

SEQ ID NO: 2343620 - protein, 19 aa, Cryptosporidium parvum
ASFNLAFMAQFGIGIVQDL

SEQ ID NO: 2343621 - protein, 18 aa, Cryptosporidium parvum
ASIALDLIKRHHLLLVTL

SEQ ID NO: 2343622 - protein, 25 aa, Cryptosporidium parvum
ASQSIFKFYLLESIGHQMAPSVKIV

SEQ ID NO: 2343623 - protein, 25 aa, Cryptosporidium parvum
ATFSILFEWSTSMSPQISLIFHYWG

SEQ ID NO: 2343624 - protein, 18 aa, Cryptosporidium parvum
ATKFLLPIEIGNIPEDSG

SEQ ID NO: 2343625 - protein, 17 aa, Cryptosporidium parvum
ATVMVMGIFIVKSTLIL

SEQ ID NO: 2343626 - protein, 28 aa, Cryptosporidium parvum
AVGNVIFKQSFDIYKEVGFGVPMEEYIE

SEQ ID NO: 2343627 - protein, 27 aa, Cryptosporidium parvum
AWISSDSKFFCWKKVRSKSSHLLNPSN

SEQ ID NO: 2343628 - protein, 19 aa, Cryptosporidium parvum
AYEQGHLPSAYALSQLNLN

SEQ ID NO: 2343629 - protein, 25 aa, Cryptosporidium parvum
AYSNTRFGDILTFPTKDYPNGLTLE

SEQ ID NO: 2343630 - protein, 33 aa, Cryptosporidium parvum; identical to SEQ ID NO: 2122176

SEQ ID NO: 2343631 - protein, 23 aa, Cryptosporidium parvum
AYVILRMIYEWVAPDDYSSMIGA

SEQ ID NO: 2343632 - protein, 19 aa, Cryptosporidium parvum
CAFSALRSFIFGSLNCFIG

SEQ ID NO: 2343633 - protein, 17 aa, Cryptosporidium parvum
CDIFEKIHIYMIGVLLY

SEQ ID NO: 2343634 - protein, 17 aa, Cryptosporidium parvum
CDLCSYNNCTNALFPES

SEQ ID NO: 2343635 - protein, 28 aa, Cryptosporidium parvum
CDSLLLNITCVLGYVSMEEHSLWVSIIS

SEQ ID NO: 2343636 - protein, 18 aa, Cryptosporidium parvum
CDYIHNIISSNWVDPNSL

SEQ ID NO: 2343637 - protein, 20 aa, Cryptosporidium parvum
CEYGFNILTTRSFKTELSNL

SEQ ID NO: 2343638 - protein, 31 aa, Cryptosporidium parvum; identical to SEQ ID NO: 2229224

SEQ ID NO: 2343639 - protein, 27 aa, Cryptosporidium parvum
CFGWIRKKLFAFSVIVKRSFMNNARNT

SEQ ID NO: 2343640 - protein, 25 aa, Cryptosporidium parvum
CFHIPQIKLVLSWISRIYGSNLTLL

SEQ ID NO: 2343641 - protein, 20 aa, Cryptosporidium parvum
CFLASLRPSPIGIPSTIIRR

SEQ ID NO: 2343642 - protein, 19 aa, Cryptosporidium parvum
CFTVANVFSIFFVITNASI

SEQ ID NO: 2343643 - protein, 19 aa, Cryptosporidium parvum
CGAYAAGIVSGILDSSEFP

SEQ ID NO: 2343644 - protein, 25 aa, Cryptosporidium parvum
CGIKDARFGLISNIYYIKENMDKID

SEQ ID NO: 2343645 - protein, 19 aa, Cryptosporidium parvum
CIIDLIFFKENCGIISLNS

SEQ ID NO: 2343646 - protein, 19 aa, Cryptosporidium parvum
CKLPFEPIKIFRLVTQAGL

SEQ ID NO: 2343647 - protein, 20 aa, Cryptosporidium parvum
CKMKGYTDFTIECPKGYKLD

SEQ ID NO: 2343648 - protein, 24 aa, Cryptosporidium parvum
CKSSLKKELKSICQNAQIDSQIFH

SEQ ID NO: 2343649 - protein, 19 aa, Cryptosporidium parvum
CKVQISWLDIGFNLSNNSH

SEQ ID NO: 2343650 - protein, 21 aa, Cryptosporidium parvum
CLNGGELMSDFNCMKTTNPIM

SEQ ID NO: 2343651 - protein, 24 aa, Cryptosporidium parvum
CLNLISLLSLCSFLVITGLQGTIE

SEQ ID NO: 2343652 - protein, 32 aa, Cryptosporidium parvum; identical to SEQ ID NO: 2229307

SEQ ID NO: 2343653 - protein, 24 aa, Cryptosporidium parvum
CLYFTHGFWTILFYFGLTANILAS

SEQ ID NO: 2343654 - protein, 29 aa, Cryptosporidium parvum
CMDNLNCWRKLLPCTTLDFSSKIGSYGIL

SEQ ID NO: 2343655 - protein, 25 aa, Cryptosporidium parvum
CMEALPLFLDRIIPSWVAVICSVTA

SEQ ID NO: 2343656 - protein, 32 aa, Cryptosporidium parvum; identical to SEQ ID NO: 2122283

SEQ ID NO: 2343657 - protein, 17 aa, Cryptosporidium parvum
CRSFCSVMVNCTHFIMD

SEQ ID NO: 2343658 - protein, 21 aa, Cryptosporidium parvum
CSCKHKKISFESCSEIYNLII

SEQ ID NO: 2343659 - protein, 21 aa, Cryptosporidium parvum
CSECGKCVLNMDHHCPWINNC

SEQ ID NO: 2343660 - protein, 18 aa, Cryptosporidium parvum
CSPSNVFLNRSKKFKSKE

SEQ ID NO: 2343661 - protein, 24 aa, Cryptosporidium parvum
CSTHIKNLLLLYLSIFWTDIGTTE

SEQ ID NO: 2343662 - protein, 21 aa, Cryptosporidium parvum
CSWETVGPAARGLTCSGSVHM

SEQ ID NO: 2343663 - protein, 30 aa, Cryptosporidium parvum
CSYNNCTNALFPESWIEFILMNNSRYEEFD

SEQ ID NO: 2343664 - protein, 17 aa, Cryptosporidium parvum
CTVKGPSQDSCQNLIEL

SEQ ID NO: 2343665 - protein, 19 aa, Cryptosporidium parvum
CVFGHPLMDAGLSIDPYSL

SEQ ID NO: 2343666 - protein, 27 aa, Cryptosporidium parvum
CYDISWSKKTAACILIIELLNHIPPIW

SEQ ID NO: 2343667 - protein, 25 aa, Cryptosporidium parvum
CYKATARAGVKIIYTPTILLSSSES

SEQ ID NO: 2343668 - protein, 22 aa, Cryptosporidium parvum
DAAMLIAIFPRQIRFLIAEASF

SEQ ID NO: 2343669 - protein, 36 aa, Cryptosporidium parvum; identical to SEQ ID NO: 2229418

SEQ ID NO: 2343670 - protein, 21 aa, Cryptosporidium parvum
DAGNIWNIISSPLIYPLFMET

SEQ ID NO: 2343671 - protein, 20 aa, Cryptosporidium parvum
DCTPAATAVRYTTTSHHGHG

SEQ ID NO: 2343672 - protein, 17 aa, Cryptosporidium parvum
DDFKRKVEFELKNSDLN

SEQ ID NO: 2343673 - protein, 24 aa, Cryptosporidium parvum
DDIFKSKLPKIGIFHTKGSCGLLI

SEQ ID NO: 2343674 - protein, 23 aa, Cryptosporidium parvum
DDKFKHLPSLIISISKRRGHKLH

SEQ ID NO: 2343675 - protein, 19 aa, Cryptosporidium parvum
DDSVAPLLIFKWFDQTTLD

SEQ ID NO: 2343676 - protein, 28 aa, Cryptosporidium parvum
DEIKEIAEFLIYYRFREVIRDKDDYDDD

SEQ ID NO: 2343677 - protein, 23 aa, Cryptosporidium parvum
DFEMKIPFSILKSIIESEFNGIN

SEQ ID NO: 2343678 - protein, 26 aa, Cryptosporidium parvum
DFPEFLCDYSCSFCDVLPVNCIQIRN

SEQ ID NO: 2343679 - protein, 25 aa, Cryptosporidium parvum
DFQYLLVRLCHLFSFRIECLATNVY

SEQ ID NO: 2343680 - protein, 22 aa, Cryptosporidium parvum
DGILKARGRFTIRNNESLNELI

SEQ ID NO: 2343681 - protein, 19 aa, Cryptosporidium parvum
DHEIKSCVSITYADSVAFC

SEQ ID NO: 2343682 - protein, 20 aa, Cryptosporidium parvum
DHLYFLSLQGHENQYIKLVN

SEQ ID NO: 2343683 - protein, 17 aa, Cryptosporidium parvum
DHYFGWLDIFKPRPVLV

SEQ ID NO: 2343684 - protein, 22 aa, Cryptosporidium parvum
DICNTCIFDSRIISNVKSLFSE

SEQ ID NO: 2343685 - protein, 22 aa, Cryptosporidium parvum
DIFWMNIFFPAWSVSSEEGDLR

SEQ ID NO: 2343686 - protein, 18 aa, Cryptosporidium parvum
DIFYKSWIHAIAVTVIAF

SEQ ID NO: 2343687 - protein, 19 aa, Cryptosporidium parvum
DIGLLLFQYSDDWPTRIDG

SEQ ID NO: 2343688 - protein, 19 aa, Cryptosporidium parvum
DISPIIMREYLLKVLINDS

SEQ ID NO: 2343689 - protein, 17 aa, Cryptosporidium parvum
DISRFTIDLNFFSIDTL

SEQ ID NO: 2343690 - protein, 26 aa, Cryptosporidium parvum
DKAASFKVFAARVVRRNLSLGSSQLY

SEQ ID NO: 2343691 - protein, 20 aa, Cryptosporidium parvum
DKGLCKSIVPSTLNCPSGTT

SEQ ID NO: 2343692 - protein, 17 aa, Cryptosporidium parvum
DKHKAFPILALTPNEII

SEQ ID NO: 2343693 - protein, 18 aa, Cryptosporidium parvum
DKIDFKWSIGRISYSLKP

SEQ ID NO: 2343694 - protein, 17 aa, Cryptosporidium parvum
DKLRMFYFRAVEVTINR

SEQ ID NO: 2343695 - protein, 18 aa, Cryptosporidium parvum
DKPGYWFIDTSIIHLISS

SEQ ID NO: 2343696 - protein, 23 aa, Cryptosporidium parvum
DLDFPILLHRKLINISLRKLNNI

SEQ ID NO: 2343697 - protein, 21 aa, Cryptosporidium parvum
DLFGRLRYLFTTSNFDVLAER

SEQ ID NO: 2343698 - protein, 25 aa, Cryptosporidium parvum
DLGPLISRSKLYGMMNKHPICDKSS

SEQ ID NO: 2343699 - protein, 21 aa, Cryptosporidium parvum
DLIFCFGSDVLFNISIALLDI

SEQ ID NO: 2343700 - protein, 21 aa, Cryptosporidium parvum
DLIKMSPCSVIRVKLYQLRTQ

SEQ ID NO: 2343701 - protein, 17 aa, Cryptosporidium parvum
DLKEFMDSPIFIIWCAN

SEQ ID NO: 2343702 - protein, 24 aa, Cryptosporidium parvum
DMLFKELMPSLAYHFDLLSITSDT

SEQ ID NO: 2343703 - protein, 18 aa, Cryptosporidium parvum
DMLRECDYIHNIISSNWV

SEQ ID NO: 2343704 - protein, 21 aa, Cryptosporidium parvum
DNLWIRNAINLIEMGIETLST

SEQ ID NO: 2343705 - protein, 25 aa, Cryptosporidium parvum
DNRSLYSLEWEFEWLNNNSEGGLSL

SEQ ID NO: 2343706 - protein, 19 aa, Cryptosporidium parvum
DNYLKRRWELQTMLDTCFR

SEQ ID NO: 2343707 - protein, 25 aa, Cryptosporidium parvum
DPLKIEILKLLILLVKNKYSLETIS

SEQ ID NO: 2343708 - protein, 31 aa, Cryptosporidium parvum; identical to SEQ ID NO: 2122480

SEQ ID NO: 2343709 - protein, 21 aa, Cryptosporidium parvum
DPVAVCPSGFTLTDGQMCSGS

SEQ ID NO: 2343710 - protein, 24 aa, Cryptosporidium parvum
DQCPEILNFYSVIQCNLDTILNPR

SEQ ID NO: 2343711 - protein, 33 aa, Cryptosporidium parvum; identical to SEQ ID NO: 2229698

SEQ ID NO: 2343712 - protein, 23 aa, Cryptosporidium parvum
DQENFVILEWLNKNCDEFFSLLL

SEQ ID NO: 2343713 - protein, 30 aa, Cryptosporidium parvum
DQESKLNFCCFTGYYYCDYCYGSNTCSILP

SEQ ID NO: 2343714 - protein, 22 aa, Cryptosporidium parvum
DQIKGGYYFQYDFISTIAQFDS

SEQ ID NO: 2343715 - protein, 22 aa, Cryptosporidium parvum
DQIKSGLLVTVFGTILLSVMIY

SEQ ID NO: 2343716 - protein, 24 aa, Cryptosporidium parvum
DQLRHCLRPVLVHLASATKLTVHV

SEQ ID NO: 2343717 - protein, 19 aa, Cryptosporidium parvum
DRRYFPNIFFYCTHLEIPL

SEQ ID NO: 2343718 - protein, 17 aa, Cryptosporidium parvum
DSDILIGRKSEMSLKGT

SEQ ID NO: 2343719 - protein, 18 aa, Cryptosporidium parvum
DSEFLLNRILWIPEYENF

SEQ ID NO: 2343720 - protein, 22 aa, Cryptosporidium parvum
DSIAKYNVCEHIKFKNYNKGSP

SEQ ID NO: 2343721 - protein, 22 aa, Cryptosporidium parvum
DSMLRISLKLSESKDMFDTIGA

SEQ ID NO: 2343722 - protein, 20 aa, Cryptosporidium parvum
DTDPTRRGRLKYTYMQPNDF

SEQ ID NO: 2343723 - protein, 18 aa, Cryptosporidium parvum
DTYLCIIGPIPPKLLFIT

SEQ ID NO: 2343724 - protein, 18 aa, Cryptosporidium parvum
DTYLISWLTSLFSTCIPI

SEQ ID NO: 2343725 - protein, 24 aa, Cryptosporidium parvum
DVADPLMRFHCFIFGAIYLESAHA

SEQ ID NO: 2343726 - protein, 22 aa, Cryptosporidium parvum
DVECLPCGFTDWGSWSPCSASC

SEQ ID NO: 2343727 - protein, 23 aa, Cryptosporidium parvum
DVFTLLFIFKFDVCYLENSYMNS

SEQ ID NO: 2343728 - protein, 17 aa, Cryptosporidium parvum
DVFTYIIIMCLRHIITL

SEQ ID NO: 2343729 - protein, 19 aa, Cryptosporidium parvum
DVGKLRSSISYVQQNPILF

SEQ ID NO: 2343730 - protein, 28 aa, Cryptosporidium parvum
DVPRIPLDIACTAMWFISQRWDFCPLVF

SEQ ID NO: 2343731 - protein, 25 aa, Cryptosporidium parvum
DVSVIPLFFEWCYILYRQKLNFSKN

SEQ ID NO: 2343732 - protein, 24 aa, Cryptosporidium parvum
DWIFPNVRFQLSVVNFLDPKANIT

SEQ ID NO: 2343733 - protein, 25 aa, Cryptosporidium parvum
DWKKVCRKYSYNFAKSIAIRKNISI

SEQ ID NO: 2343734 - protein, 20 aa, Cryptosporidium parvum
DWVSSLRITDKLAISEEVLK

SEQ ID NO: 2343735 - protein, 25 aa, Cryptosporidium parvum
DYDLCLPICEIHKICLNDHTSNNFP

SEQ ID NO: 2343736 - protein, 20 aa, Cryptosporidium parvum
DYIISKEITFFWTTLLLLGE

SEQ ID NO: 2343737 - protein, 21 aa, Cryptosporidium parvum
DYKCFTKHCENILEFDQESKL

SEQ ID NO: 2343738 - protein, 17 aa, Cryptosporidium parvum
DYMLPTFSLLNIQPYNA

SEQ ID NO: 2343739 - protein, 20 aa, Cryptosporidium parvum
DYPISLAFDLYYTFVLEEKY

SEQ ID NO: 2343740 - protein, 34 aa, Cryptosporidium parvum; identical to SEQ ID NO: 2229826

SEQ ID NO: 2343741 - protein, 24 aa, Cryptosporidium parvum
DYYRKLCSQVIFPTPLVSTDKVVV

SEQ ID NO: 2343742 - protein, 36 aa, Cryptosporidium parvum; identical to SEQ ID NO: 2122553

SEQ ID NO: 2343743 - protein, 24 aa, Cryptosporidium parvum
EALSIKGLLNDGGQFTITSLDQNI

SEQ ID NO: 2343744 - protein, 21 aa, Cryptosporidium parvum
ECLIVKSIIVSSTFGVIKMIT

SEQ ID NO: 2343745 - protein, 22 aa, Cryptosporidium parvum
EDEILKIILNYEGNLKAKIEGS

SEQ ID NO: 2343746 - protein, 30 aa, Cryptosporidium parvum; identical to SEQ ID NO: 2229879

SEQ ID NO: 2343747 - protein, 17 aa, Cryptosporidium parvum
EDLRVPTEFDNTCRVLF

SEQ ID NO: 2343748 - protein, 25 aa, Cryptosporidium parvum
EEALDRFSQSFIDPLFDEHFIEKEI

SEQ ID NO: 2343749 - protein, 24 aa, Cryptosporidium parvum
EEIELRKGEIVFKNVFFSYSDNID

SEQ ID NO: 2343750 - protein, 20 aa, Cryptosporidium parvum
EENKCFYSSSSILSFYYDEY

SEQ ID NO: 2343751 - protein, 18 aa, Cryptosporidium parvum
EFEFPVRVFRNITPDFDS

SEQ ID NO: 2343752 - protein, 19 aa, Cryptosporidium parvum
EFHVRNLLCSLLRDDLHAF

SEQ ID NO: 2343753 - protein, 29 aa, Cryptosporidium parvum
EFNSELPFWFERWLEAFNEKFNFLNHESI

SEQ ID NO: 2343754 - protein, 19 aa, Cryptosporidium parvum
EGEGFAFWFVSEAYGSIYP

SEQ ID NO: 2343755 - protein, 28 aa, Cryptosporidium parvum
EGGLSLFFHVLRTSFFILYESYGGAISD

SEQ ID NO: 2343756 - protein, 24 aa, Cryptosporidium parvum
EGGYFRIYDTFTWENIQICHKFGL

SEQ ID NO: 2343757 - protein, 27 aa, Cryptosporidium parvum
EGIKSELKFTWLGWLSFGRDQETGDED

SEQ ID NO: 2343758 - protein, 20 aa, Cryptosporidium parvum
EGRNLLWWMAHLGDEDLIRI

SEQ ID NO: 2343759 - protein, 24 aa, Cryptosporidium parvum
EGSPDQWLNLDWIHPMEPSCSNTE

SEQ ID NO: 2343760 - protein, 25 aa, Cryptosporidium parvum
EHKKYSWWVYFVFCIATQIIIGAIV

SEQ ID NO: 2343761 - protein, 22 aa, Cryptosporidium parvum
EIELKSSILIESLFMDSYNYFI

SEQ ID NO: 2343762 - protein, 18 aa, Cryptosporidium parvum
EIELSGNMSYCIKFDELI

SEQ ID NO: 2343763 - protein, 25 aa, Cryptosporidium parvum
EIENALRLSQAWDFVNSFRDGLETL

SEQ ID NO: 2343764 - protein, 22 aa, Cryptosporidium parvum
EIGDIESFLSFDSEFEKNEMEE

SEQ ID NO: 2343765 - protein, 22 aa, Cryptosporidium parvum
EILKMEKAIMAPNCFDNKFILA

SEQ ID NO: 2343766 - protein, 17 aa, Cryptosporidium parvum
EILSSFIEMCFRQTQTP

SEQ ID NO: 2343767 - protein, 24 aa, Cryptosporidium parvum
EILVCLRSILNTEFRQGFYDRIEI

SEQ ID NO: 2343768 - protein, 21 aa, Cryptosporidium parvum
EIPEISLCILRNSGFQLLQSI

SEQ ID NO: 2343769 - protein, 24 aa, Cryptosporidium parvum
EIYIARAAFPGNIMNDYDLCLPIC

SEQ ID NO: 2343770 - protein, 23 aa, Cryptosporidium parvum
EKEKKMTVCFELTQKEFIEKRDV

SEQ ID NO: 2343771 - protein, 28 aa, Cryptosporidium parvum
EKEYDIGPRFGVIMQIIFASSEKHRNDN

SEQ ID NO: 2343772 - protein, 23 aa, Cryptosporidium parvum
EKIIEILDIMGLRHVQDTYVGGI

SEQ ID NO: 2343773 - protein, 21 aa, Cryptosporidium parvum
EKKWYCIYTNSFSQIQNCVWL

SEQ ID NO: 2343774 - protein, 19 aa, Cryptosporidium parvum
EKLIIIYIIMKYINHNLNK

SEQ ID NO: 2343775 - protein, 19 aa, Cryptosporidium parvum
EKVKLCLSDTTQLRTGLNI

SEQ ID NO: 2343776 - protein, 22 aa, Cryptosporidium parvum
EKVPFRLTRNMEHLMGPFGKNG

SEQ ID NO: 2343777 - protein, 35 aa, Cryptosporidium parvum
EKYSHLRDLIEIVRICILHGILIGINYLNKSEDNY

SEQ ID NO: 2343778 - protein, 26 aa, Cryptosporidium parvum
ELEEFYSLLIQIFWKKTKFLNNTNSE

SEQ ID NO: 2343779 - protein, 20 aa, Cryptosporidium parvum
ELENLLLYNINKLRHERIKL

SEQ ID NO: 2343780 - protein, 22 aa, Cryptosporidium parvum
ELLEKLSRFKIQFENESPGTGA

SEQ ID NO: 2343781 - protein, 29 aa, Cryptosporidium parvum
ELLPVAITIRLKRLLFKSSDDLLFDPRLT

SEQ ID NO: 2343782 - protein, 19 aa, Cryptosporidium parvum
ELTNLAIKYFSKIQNKQLP

SEQ ID NO: 2343783 - protein, 25 aa, Cryptosporidium parvum
ELVYCIWSTLCLVLTMGEMNATIDP

SEQ ID NO: 2343784 - protein, 31 aa, Cryptosporidium parvum; identical to SEQ ID NO: 2122752

SEQ ID NO: 2343785 - protein, 18 aa, Cryptosporidium parvum
EMNNALCECKLNKRDKSI

SEQ ID NO: 2343786 - protein, 20 aa, Cryptosporidium parvum
EMSGCLDLRYNGVKHSMDLV

SEQ ID NO: 2343787 - protein, 18 aa, Cryptosporidium parvum
ENAKVEWNSIPIARISSP

SEQ ID NO: 2343788 - protein, 26 aa, Cryptosporidium parvum
ENGKEAFFKYIMRFYIFEKLSQFLVN

SEQ ID NO: 2343789 - protein, 25 aa, Cryptosporidium parvum
ENILLRIECCKKYEKKCLEIERYIT

SEQ ID NO: 2343790 - protein, 28 aa, Cryptosporidium parvum
ENINKWYLPQMFLEFSIYNENVDSIIRY

SEQ ID NO: 2343791 - protein, 18 aa, Cryptosporidium parvum
ENSWIVVNIENWIPDSHS

SEQ ID NO: 2343792 - protein, 17 aa, Cryptosporidium parvum
EPILDGLLIFLRDGSET

SEQ ID NO: 2343793 - protein, 23 aa, Cryptosporidium parvum
EPIPPVYIPIFWTSIHRNKVELD

SEQ ID NO: 2343794 - protein, 23 aa, Cryptosporidium parvum
EQGKPWLWGLSFSGIDHHNVNSI

SEQ ID NO: 2343795 - protein, 24 aa, Cryptosporidium parvum
EQIPEIIRSSSFKSLVQDYMIACS

SEQ ID NO: 2343796 - protein, 22 aa, Cryptosporidium parvum
EQLFEHRLSVIFKQENMGVNEP

SEQ ID NO: 2343797 - protein, 24 aa, Cryptosporidium parvum
EQSFRVWLCGGEIHVVRNSLVGHI

SEQ ID NO: 2343798 - protein, 30 aa, Cryptosporidium parvum; identical to SEQ ID NO: 2122802

SEQ ID NO: 2343799 - protein, 27 aa, Cryptosporidium parvum
ERIFSGQNLYIAMGILATVSIIVIVLM

SEQ ID NO: 2343800 - protein, 33 aa, Cryptosporidium parvum; identical to SEQ ID NO: 2230259

SEQ ID NO: 2343801 - protein, 22 aa, Cryptosporidium parvum
ERQLRVCTTIAIAIISEICMPY

SEQ ID NO: 2343802 - protein, 19 aa, Cryptosporidium parvum
ERRKELWIISKSLGAITLV

SEQ ID NO: 2343803 - protein, 29 aa, Cryptosporidium parvum
ERTTAKKILKFNIYIYRIYTDKYKRKIIK

SEQ ID NO: 2343804 - protein, 27 aa, Cryptosporidium parvum
ESDSDCACLYTCPSHIAHSPVCQSSRM

SEQ ID NO: 2343805 - protein, 18 aa, Cryptosporidium parvum
ESHFHFVKIFAHLANHLI

SEQ ID NO: 2343806 - protein, 23 aa, Cryptosporidium parvum
ESIAITCKWIKSTANASIRPLRH

SEQ ID NO: 2343807 - protein, 28 aa, Cryptosporidium parvum
ESIDYYHWWFLCIDIVFSGISISQNSEL

SEQ ID NO: 2343808 - protein, 23 aa, Cryptosporidium parvum
ESIHSCIQWLSIIIGSWTIFCNI

SEQ ID NO: 2343809 - protein, 25 aa, Cryptosporidium parvum
ESILTRFRAFVAISVILEYMEPLIL

SEQ ID NO: 2343810 - protein, 22 aa, Cryptosporidium parvum
ESIQIQKIRLILPPRGIDIQLN

SEQ ID NO: 2343811 - protein, 20 aa, Cryptosporidium parvum
ESKNGFVLDSVLFPCKYSFD

SEQ ID NO: 2343812 - protein, 18 aa, Cryptosporidium parvum
ESKQRLGPLKKMETEKKN

SEQ ID NO: 2343813 - protein, 25 aa, Cryptosporidium parvum
ESLYSCFNFWGAFLILKAESNSHKF

SEQ ID NO: 2343814 - protein, 22 aa, Cryptosporidium parvum
ESNYSPEIIGVVLDPKEVTEVS

SEQ ID NO: 2343815 - protein, 26 aa, Cryptosporidium parvum
ESPQIGYCRGFYYRLLVHPRGGSCND

SEQ ID NO: 2343816 - protein, 26 aa, Cryptosporidium parvum
ESQMVYRILERFSVSYIRDNPTTLYT

SEQ ID NO: 2343817 - protein, 19 aa, Cryptosporidium parvum
ETDKILVLHLFSAKEWSDY

SEQ ID NO: 2343818 - protein, 17 aa, Cryptosporidium parvum
ETIFISRTIFDNNFMIS

SEQ ID NO: 2343819 - protein, 26 aa, Cryptosporidium parvum
ETIFLTMGIVMFIFSSYVIRLLYQIN

SEQ ID NO: 2343820 - protein, 23 aa, Cryptosporidium parvum
ETKQELKGIVSHNLEYLLKMMEL

SEQ ID NO: 2343821 - protein, 22 aa, Cryptosporidium parvum
ETLRKTASDWNVFFSDKNTLII

SEQ ID NO: 2343822 - protein, 19 aa, Cryptosporidium parvum
ETMDIVAGLRLPHYSKKDR

SEQ ID NO: 2343823 - protein, 25 aa, Cryptosporidium parvum
ETPSFKFSCWRISSSSILAIQEAIL

SEQ ID NO: 2343824 - protein, 29 aa, Cryptosporidium parvum
ETTEIAVMFLRYFSPLIIYVLDKALAYYS

SEQ ID NO: 2343825 - protein, 18 aa, Cryptosporidium parvum
EVFLALCNQISYYSSKFW

SEQ ID NO: 2343826 - protein, 17 aa, Cryptosporidium parvum
EVTCRKSTIAWMDNPKL

SEQ ID NO: 2343827 - protein, 21 aa, Cryptosporidium parvum
EVVRKLSGSGFHWNLETELIN

SEQ ID NO: 2343828 - protein, 19 aa, Cryptosporidium parvum
EWDRICFDLLDSLKANKKS

SEQ ID NO: 2343829 - protein, 19 aa, Cryptosporidium parvum
EWVRFCVGIYDSRKKILRA

SEQ ID NO: 2343830 - protein, 21 aa, Cryptosporidium parvum
EYLKKKIIFAESIHKKNLITL

SEQ ID NO: 2343831 - protein, 20 aa, Cryptosporidium parvum
EYNIKGSVAINGFTDIDLGY

SEQ ID NO: 2343832 - protein, 17 aa, Cryptosporidium parvum
FALKLLSDNSIRTIKEK

SEQ ID NO: 2343833 - protein, 17 aa, Cryptosporidium parvum
FCINIIALFGHFISIYW

SEQ ID NO: 2343834 - protein, 17 aa, Cryptosporidium parvum
FCKYKLNKEIFLKFLAD

SEQ ID NO: 2343835 - protein, 17 aa, Cryptosporidium parvum
FCLISMVLSVVYRNKSS

SEQ ID NO: 2343836 - protein, 17 aa, Cryptosporidium parvum
FDCNEMEQLNSFIIDSI

SEQ ID NO: 2343837 - protein, 19 aa, Cryptosporidium parvum
FDEKPFFWCEYLRYLNLSR

SEQ ID NO: 2343838 - protein, 17 aa, Cryptosporidium parvum
FDELIYKEEFRFIENEL

SEQ ID NO: 2343839 - protein, 17 aa, Cryptosporidium parvum
FDFFSSWNLFNIRNSIS

SEQ ID NO: 2343840 - protein, 17 aa, Cryptosporidium parvum
FDIDRFLLKNALDNSNI

SEQ ID NO: 2343841 - protein, 20 aa, Cryptosporidium parvum
FDILKEISRLIELFNKEEIL

SEQ ID NO: 2343842 - protein, 28 aa, Cryptosporidium parvum
FDYLKIFKIPLILFILSFISVLFVDLFG

SEQ ID NO: 2343843 - protein, 17 aa, Cryptosporidium parvum
FEDFEFMALFEDNLATE

SEQ ID NO: 2343844 - protein, 18 aa, Cryptosporidium parvum
FEDLCFLIDSLLNMNRGF

SEQ ID NO: 2343845 - protein, 22 aa, Cryptosporidium parvum
FEEIINFLLCRVIGECKSNTVV

SEQ ID NO: 2343846 - protein, 22 aa, Cryptosporidium parvum
FEKWPFFDKWVISFQRQEYGIS

SEQ ID NO: 2343847 - protein, 27 aa, Cryptosporidium parvum
FELSLAYQGTVAWQHPWSFFHSNECFM

SEQ ID NO: 2343848 - protein, 18 aa, Cryptosporidium parvum
FENLSGNPLRIFIEEISM

SEQ ID NO: 2343849 - protein, 26 aa, Cryptosporidium parvum
FFHSNECFMLYKMLIGFYTATNNLEN

SEQ ID NO: 2343850 - protein, 25 aa, Cryptosporidium parvum
FFLILKLGHLLLFLLILKLLVYIYT

SEQ ID NO: 2343851 - protein, 17 aa, Cryptosporidium parvum
FFYISYMNWIPKIFINS

SEQ ID NO: 2343852 - protein, 25 aa, Cryptosporidium parvum
FHFDSLKYKLECISFSKTCKNYTKI

SEQ ID NO: 2343853 - protein, 18 aa, Cryptosporidium parvum
FHLNPSLCKLFFEMKQYI

SEQ ID NO: 2343854 - protein, 24 aa, Cryptosporidium parvum
FILSIYIILAFNCGGLFLNNCIHK

SEQ ID NO: 2343855 - protein, 26 aa, Cryptosporidium parvum
FINWDGEYYLRISYYNDYEYEHQHAF

SEQ ID NO: 2343856 - protein, 32 aa, Cryptosporidium parvum
FIRCALGGPLLGFLFGWGVHLFLKVAQATNDV

SEQ ID NO: 2343857 - protein, 22 aa, Cryptosporidium parvum
FISSICIPYFQALLKFDPEIVQ

SEQ ID NO: 2343858 - protein, 23 aa, Cryptosporidium parvum
FIWYICTWFVGAHLLRIETKEGI

SEQ ID NO: 2343859 - protein, 22 aa, Cryptosporidium parvum
FIYNFWRCSILVSKSEYIVTSV

SEQ ID NO: 2343860 - protein, 18 aa, Cryptosporidium parvum
FKFFSRIPRSYFFSPSKR

SEQ ID NO: 2343861 - protein, 17 aa, Cryptosporidium parvum
FKFVPLNTHIFNIFQQF

SEQ ID NO: 2343862 - protein, 25 aa, Cryptosporidium parvum
FKIGAILLCGLFVYDIFWVFGTDVM

SEQ ID NO: 2343863 - protein, 17 aa, Cryptosporidium parvum
FKLGTMGLIPVNRGDFF

SEQ ID NO: 2343864 - protein, 19 aa, Cryptosporidium parvum
FKLLLLLKKDIHFLILGII

SEQ ID NO: 2343865 - protein, 20 aa, Cryptosporidium parvum
FKMIECRIQNFIFFNFLLYL

SEQ ID NO: 2343866 - protein, 21 aa, Cryptosporidium parvum
FKPNRVEYWFKLLSAKVIPKI

SEQ ID NO: 2343867 - protein, 27 aa, Cryptosporidium parvum
FKQGRQSWRLKEWHHLQSILYLIYGAG

SEQ ID NO: 2343868 - protein, 21 aa, Cryptosporidium parvum
FKTSLFIVTFILNYVNINTSK

SEQ ID NO: 2343869 - protein, 20 aa, Cryptosporidium parvum
FKTVKIGFPSIVIYEKESVD

SEQ ID NO: 2343870 - protein, 17 aa, Cryptosporidium parvum
FKVSTIIKNISKILNIP

SEQ ID NO: 2343871 - protein, 21 aa, Cryptosporidium parvum
FLCIVLLKLAQNGMLATDVVN

SEQ ID NO: 2343872 - protein, 18 aa, Cryptosporidium parvum
FLEPSLILTSGWIFIRCA

SEQ ID NO: 2343873 - protein, 25 aa, Cryptosporidium parvum
FLISEYDYIWFLIGVIITATLCSSK

SEQ ID NO: 2343874 - protein, 19 aa, Cryptosporidium parvum
FLLNRILWIPEYENFNTIL

SEQ ID NO: 2343875 - protein, 25 aa, Cryptosporidium parvum
FLLTFKILFCIGTKQIFPIGCPLNS

SEQ ID NO: 2343876 - protein, 17 aa, Cryptosporidium parvum
FLLWMNGLNDLVCNLSL

SEQ ID NO: 2343877 - protein, 18 aa, Cryptosporidium parvum
FLRLKGIISNKLYPNYYI

SEQ ID NO: 2343878 - protein, 25 aa, Cryptosporidium parvum
FLVFIPFLIVILIKRLNNHSVKIKK

SEQ ID NO: 2343879 - protein, 20 aa, Cryptosporidium parvum
FLVILPWFLDTTIKMQKETK

SEQ ID NO: 2343880 - protein, 17 aa, Cryptosporidium parvum
FLVLLLFLNNLACENEI

SEQ ID NO: 2343881 - protein, 21 aa, Cryptosporidium parvum
FMRHLTEKILINFKGKNSISE

SEQ ID NO: 2343882 - protein, 17 aa, Cryptosporidium parvum
FNAHPGLLELCDTFIPN

SEQ ID NO: 2343883 - protein, 17 aa, Cryptosporidium parvum
FNCETHLIISCPPPKFK

SEQ ID NO: 2343884 - protein, 25 aa, Cryptosporidium parvum
FNEPRKTCVIETFAPGFPGCAEGSV

SEQ ID NO: 2343885 - protein, 26 aa, Cryptosporidium parvum
FNFVWKIILFFIIWKSRNDFIKFQQY

SEQ ID NO: 2343886 - protein, 29 aa, Cryptosporidium parvum
FNLGLKIVLPILMAFLIIVGYRITGIIVL

SEQ ID NO: 2343887 - protein, 18 aa, Cryptosporidium parvum
FNPNCNCSLFFDRCTSIL

SEQ ID NO: 2343888 - protein, 25 aa, Cryptosporidium parvum
FPCDDLTGMYAFCVGSINNKNGMPS

SEQ ID NO: 2343889 - protein, 19 aa, Cryptosporidium parvum
FPFLNAPSRMEFIEYLNSG

SEQ ID NO: 2343890 - protein, 30 aa, Cryptosporidium parvum; identical to SEQ ID NO: 2230931

SEQ ID NO: 2343891 - protein, 17 aa, Cryptosporidium parvum
FPLNDILQTSISLYNSG

SEQ ID NO: 2343892 - protein, 22 aa, Cryptosporidium parvum
FPQDEIVAIIGHEIGHWKNWDN

SEQ ID NO: 2343893 - protein, 19 aa, Cryptosporidium parvum
FPSIARFLLKKINKSLNKQ

SEQ ID NO: 2343894 - protein, 26 aa, Cryptosporidium parvum
FPTFSSRFGWRRVEEIIKSNTSDLSR

SEQ ID NO: 2343895 - protein, 19 aa, Cryptosporidium parvum
FPYNVYRLISKSGRFRDII

SEQ ID NO: 2343896 - protein, 20 aa, Cryptosporidium parvum
FQIFPLFSLVFALLAGYFVT

SEQ ID NO: 2343897 - protein, 21 aa, Cryptosporidium parvum
FQQGRCHVAILTNYVDEYTYS

SEQ ID NO: 2343898 - protein, 22 aa, Cryptosporidium parvum
FQTCVELAQKFCDILDNEININ

SEQ ID NO: 2343899 - protein, 17 aa, Cryptosporidium parvum
FQTRPSILVTLCKLLKP

SEQ ID NO: 2343900 - protein, 18 aa, Cryptosporidium parvum
FRGSEKFANLESSEGKDE

SEQ ID NO: 2343901 - protein, 19 aa, Cryptosporidium parvum
FRNKIPINLLINGNLTIDT

SEQ ID NO: 2343902 - protein, 17 aa, Cryptosporidium parvum
FRWSSCICDRNIMIGVR

SEQ ID NO: 2343903 - protein, 20 aa, Cryptosporidium parvum
FRYEHGLGVPRSCEAAISNY

SEQ ID NO: 2343904 - protein, 27 aa, Cryptosporidium parvum
FSDNSPFRIACQFSLIKCTLANIKSKC

SEQ ID NO: 2343905 - protein, 23 aa, Cryptosporidium parvum
FSDYSTCCLRAKHIHSIPKAIEH

SEQ ID NO: 2343906 - protein, 23 aa, Cryptosporidium parvum
FSISKINLVLSWILNENDQSLDH

SEQ ID NO: 2343907 - protein, 20 aa, Cryptosporidium parvum
FSKTQLQTRCRLFKTIRSAV

SEQ ID NO: 2343908 - protein, 17 aa, Cryptosporidium parvum
FSLCKFVSVIINAILSE

SEQ ID NO: 2343909 - protein, 21 aa, Cryptosporidium parvum
FSLLPRKSYQSTFISQLEKYS

SEQ ID NO: 2343910 - protein, 21 aa, Cryptosporidium parvum
FSNLETCTALLFSNNLLQVPH

SEQ ID NO: 2343911 - protein, 18 aa, Cryptosporidium parvum
FSRDFFLQYQFDFTENNK

SEQ ID NO: 2343912 - protein, 18 aa, Cryptosporidium parvum
FSYFSMINYILLGENSTN

SEQ ID NO: 2343913 - protein, 17 aa, Cryptosporidium parvum
FSYPGTNKIILKDFNLE

SEQ ID NO: 2343914 - protein, 17 aa, Cryptosporidium parvum
FTDLFLFRNKIPINLLI

SEQ ID NO: 2343915 - protein, 24 aa, Cryptosporidium parvum
FTFFPRYLSISIFSVVINNIDIFK

SEQ ID NO: 2343916 - protein, 23 aa, Cryptosporidium parvum
FTGESFPEFKMEKVVIPNEKSTE

SEQ ID NO: 2343917 - protein, 18 aa, Cryptosporidium parvum
FTIDLNFFSIDTLAPLSL

SEQ ID NO: 2343918 - protein, 18 aa, Cryptosporidium parvum
FTLFMCLLQGFSESSYIT

SEQ ID NO: 2343919 - protein, 23 aa, Cryptosporidium parvum
FTLTCNYLSLGQFELARSSILQL

SEQ ID NO: 2343920 - protein, 17 aa, Cryptosporidium parvum
FTNRLGFSPTFMGSLRL

SEQ ID NO: 2343921 - protein, 19 aa, Cryptosporidium parvum
FTTHLGLLSIFSYILGVND

SEQ ID NO: 2343922 - protein, 17 aa, Cryptosporidium parvum
FVEGIGIRDLEIHGTSK

SEQ ID NO: 2343923 - protein, 23 aa, Cryptosporidium parvum
FVFNRLVGIFEMCFQVIFFNGNN

SEQ ID NO: 2343924 - protein, 24 aa, Cryptosporidium parvum
FVKQRKRLCIVLVQHIPTQFKYSN

SEQ ID NO: 2343925 - protein, 17 aa, Cryptosporidium parvum
FVSEAYGSIYPKSNEDL

SEQ ID NO: 2343926 - protein, 30 aa, Cryptosporidium parvum; identical to SEQ ID NO: 2123379

SEQ ID NO: 2343927 - protein, 27 aa, Cryptosporidium parvum
FVYFLDLNYIWVLRLGFDPFRSKCKLG

SEQ ID NO: 2343928 - protein, 18 aa, Cryptosporidium parvum
FWLNYTALNSDSWKEIDF

SEQ ID NO: 2343929 - protein, 30 aa, Cryptosporidium parvum
FYAFWNWFDSRSWYPLGRIIGQTLFPGLML

SEQ ID NO: 2343930 - protein, 25 aa, Cryptosporidium parvum
FYFKTPFKFRYVFITILIKYLPMFF

SEQ ID NO: 2343931 - protein, 17 aa, Cryptosporidium parvum
FYISRVSFEMIMPLTRN

SEQ ID NO: 2343932 - protein, 17 aa, Cryptosporidium parvum
FYPRPGTPAAKMKPVPN

SEQ ID NO: 2343933 - protein, 18 aa, Cryptosporidium parvum
FYSSSSILSFYYDEYKLL

SEQ ID NO: 2343934 - protein, 23 aa, Cryptosporidium parvum
FYVKSIIFLLMLDFPNDRMDKTL

SEQ ID NO: 2343935 - protein, 18 aa, Cryptosporidium parvum
GACFLLFIMTMIALLYAC

SEQ ID NO: 2343936 - protein, 18 aa, Cryptosporidium parvum
GAMAPAVLFARVRAAIAS

SEQ ID NO: 2343937 - protein, 17 aa, Cryptosporidium parvum
GCGKSSILKLILRLYDP

SEQ ID NO: 2343938 - protein, 21 aa, Cryptosporidium parvum
GCIFKLPNIEFQKDHEFYLTL

SEQ ID NO: 2343939 - protein, 17 aa, Cryptosporidium parvum
GDLFSWGQGRDGSLGTG

SEQ ID NO: 2343940 - protein, 17 aa, Cryptosporidium parvum
GDLSLLLLWLVLLMNIC

SEQ ID NO: 2343941 - protein, 28 aa, Cryptosporidium parvum
GDRNTLAMYMEWIWLNNHIQSVIEQGYD

SEQ ID NO: 2343942 - protein, 17 aa, Cryptosporidium parvum
GEGTPAATLKCGAYTIV

SEQ ID NO: 2343943 - protein, 20 aa, Cryptosporidium parvum
GENLLLLPLEFKRSPNWTSD

SEQ ID NO: 2343944 - protein, 29 aa, Cryptosporidium parvum
GESNRAFEWYGDFEVLRDLLIQSLRNSGR

SEQ ID NO: 2343945 - protein, 23 aa, Cryptosporidium parvum
GEYICLPDLLSITSTISNDTSSG

SEQ ID NO: 2343946 - protein, 18 aa, Cryptosporidium parvum
GFCCKILPIIIRILNLFF

SEQ ID NO: 2343947 - protein, 19 aa, Cryptosporidium parvum
GFNNTKCGISIYSRPSEST

SEQ ID NO: 2343948 - protein, 22 aa, Cryptosporidium parvum
GFPGCAEGSVYYDLQTCIMAYQ

SEQ ID NO: 2343949 - protein, 18 aa, Cryptosporidium parvum
GGEMKRLSIALELIQNPP

SEQ ID NO: 2343950 - protein, 21 aa, Cryptosporidium parvum
GGGSLPPMIAFSETYLEKYCY

SEQ ID NO: 2343951 - protein, 18 aa, Cryptosporidium parvum
GGVSLALAMSLESEDYID

SEQ ID NO: 2343952 - protein, 32 aa, Cryptosporidium parvum
GHLLKQIDSLFSLKHSFLWPHNNATLISAISM

SEQ ID NO: 2343953 - protein, 18 aa, Cryptosporidium parvum
GIDFELLDEFNLIYEESF

SEQ ID NO: 2343954 - protein, 17 aa, Cryptosporidium parvum
GIELKFFYLDDLKNSIS

SEQ ID NO: 2343955 - protein, 22 aa, Cryptosporidium parvum
GIGAPFCQNSTFSLKYDYNHSW

SEQ ID NO: 2343956 - protein, 17 aa, Cryptosporidium parvum
GILRVFFVLLMFLLCVS

SEQ ID NO: 2343957 - protein, 22 aa, Cryptosporidium parvum
GILYRIFACIAFALFFRNLGLE

SEQ ID NO: 2343958 - protein, 17 aa, Cryptosporidium parvum
GISDPYFILSIIEVTSK

SEQ ID NO: 2343959 - protein, 19 aa, Cryptosporidium parvum
GKEVSRIMDNYALEELNKE

SEQ ID NO: 2343960 - protein, 17 aa, Cryptosporidium parvum
GKMIIKKSLSFNYNLHW

SEQ ID NO: 2343961 - protein, 21 aa, Cryptosporidium parvum
GKRYFLHLEIPSIEKELQDLQ

SEQ ID NO: 2343962 - protein, 19 aa, Cryptosporidium parvum
GKSSILKLILRLYDPDKGK

SEQ ID NO: 2343963 - protein, 20 aa, Cryptosporidium parvum
GKVRLPLSVVLFGYGIMMDY

SEQ ID NO: 2343964 - protein, 18 aa, Cryptosporidium parvum
GKYLKALSTLKHRIEDIP

SEQ ID NO: 2343965 - protein, 24 aa, Cryptosporidium parvum
GLCRGDVGIKEILGNVNWGIYFGQ

SEQ ID NO: 2343966 - protein, 18 aa, Cryptosporidium parvum
GLIQRCLIHQIRAYSELK

SEQ ID NO: 2343967 - protein, 23 aa, Cryptosporidium parvum
GLKICSVLCSLVARIEQVSSNEQ

SEQ ID NO: 2343968 - protein, 25 aa, Cryptosporidium parvum
GLKNHLRILWRRPRNDTSSNSDGLL

SEQ ID NO: 2343969 - protein, 17 aa, Cryptosporidium parvum
GLLHSSDFDSFIQEKEL

SEQ ID NO: 2343970 - protein, 19 aa, Cryptosporidium parvum
GLMLTAALMRYIAHQLGLL

SEQ ID NO: 2343971 - protein, 23 aa, Cryptosporidium parvum
GLTICSIFSGFGLHITKFLSPFN

SEQ ID NO: 2343972 - protein, 21 aa, Cryptosporidium parvum
GMRHFPIKKLIALIQSHSDSR

SEQ ID NO: 2343973 - protein, 18 aa, Cryptosporidium parvum
GNINLILKLFSDLDQNNQ

SEQ ID NO: 2343974 - protein, 20 aa, Cryptosporidium parvum
GNLELKCTSSNEVWSMTILD

SEQ ID NO: 2343975 - protein, 21 aa, Cryptosporidium parvum
GNLRFDVIYRNELITQITWYD

SEQ ID NO: 2343976 - protein, 19 aa, Cryptosporidium parvum
GNMSYCIKFDELIYKEEFR

SEQ ID NO: 2343977 - protein, 21 aa, Cryptosporidium parvum
GNNSIFMWVILGFIVLLLTLI

SEQ ID NO: 2343978 - protein, 20 aa, Cryptosporidium parvum
GPAARGLTCSGSVHMTTRMG

SEQ ID NO: 2343979 - protein, 21 aa, Cryptosporidium parvum
GPKEEMKRLPLGDYVTYNNDL

SEQ ID NO: 2343980 - protein, 20 aa, Cryptosporidium parvum
GPLKEAFFIHLKRFHRDISN

SEQ ID NO: 2343981 - protein, 18 aa, Cryptosporidium parvum
GPPPDWQLSVTISTSAHF

SEQ ID NO: 2343982 - protein, 17 aa, Cryptosporidium parvum
GQVKFDLLDDVIGNLKR

SEQ ID NO: 2343983 - protein, 21 aa, Cryptosporidium parvum
GRAEPPFPRIWSRSPKCRPWS

SEQ ID NO: 2343984 - protein, 18 aa, Cryptosporidium parvum
GRLKYTYMQPNDFLENHY

SEQ ID NO: 2343985 - protein, 17 aa, Cryptosporidium parvum
GSAFFSMAIAEILSDFD

SEQ ID NO: 2343986 - protein, 27 aa, Cryptosporidium parvum
GSIEFYLCILFSIALIFFGGILSGLTT

SEQ ID NO: 2343987 - protein, 27 aa, Cryptosporidium parvum
GSNTCSILPGLLAKYGNLTPVPVSIKS

SEQ ID NO: 2343988 - protein, 32 aa, Cryptosporidium parvum; identical to SEQ ID NO: 2231648

SEQ ID NO: 2343989 - protein, 19 aa, Cryptosporidium parvum
GTMGLIPVNRGDFFSDTPP

SEQ ID NO: 2343990 - protein, 21 aa, Cryptosporidium parvum
GTPAATLKCGAYTIVYAPIKD

SEQ ID NO: 2343991 - protein, 21 aa, Cryptosporidium parvum
GVFTIVLKFSEIHFKEPGKKV

SEQ ID NO: 2343992 - protein, 26 aa, Cryptosporidium parvum
GVKFYAFECGKGYSECSIWGIDGLPN

SEQ ID NO: 2343993 - protein, 25 aa, Cryptosporidium parvum
GWHKMVSHVRLTRAAGFVDDEGTVL

SEQ ID NO: 2343994 - protein, 18 aa, Cryptosporidium parvum
GYIKLALHSGKKGTCGIL

SEQ ID NO: 2343995 - protein, 26 aa, Cryptosporidium parvum
GYKNPQCVPLTILENGCPMKQVGFKV

SEQ ID NO: 2343996 - protein, 21 aa, Cryptosporidium parvum
HAIGTWIVVCYLFSKYKKKDN

SEQ ID NO: 2343997 - protein, 25 aa, Cryptosporidium parvum
HFPLFMAAITFIWAVSDSLCLYFTH

SEQ ID NO: 2343998 - protein, 23 aa, Cryptosporidium parvum
HGHSIAYEVCCRLRSTISADSEL

SEQ ID NO: 2343999 - protein, 17 aa, Cryptosporidium parvum
HHFRFSTQIKYFLISIF

SEQ ID NO: 2344000 - protein, 20 aa, Cryptosporidium parvum
HHGIFIQWENHWSLNSFINL

SEQ ID NO: 2344001 - protein, 25 aa, Cryptosporidium parvum
HHRVSSAMPSEWTIPHVILDSLLSC

SEQ ID NO: 2344002 - protein, 19 aa, Cryptosporidium parvum
HIQHYWVSKSFNYSFKPQI

SEQ ID NO: 2344003 - protein, 26 aa, Cryptosporidium parvum
HKDPFIVSGSYSFKGVESGLIYRSPS

SEQ ID NO: 2344004 - protein, 17 aa, Cryptosporidium parvum
HKKFFFFLVEKNFDTDK

SEQ ID NO: 2344005 - protein, 23 aa, Cryptosporidium parvum
HKPLYRLVDEVSYNTPYEYFNVV

SEQ ID NO: 2344006 - protein, 23 aa, Cryptosporidium parvum
HLDPINLSHCWSIHTAQAAQVFQ

SEQ ID NO: 2344007 - protein, 25 aa, Cryptosporidium parvum
HLIFYEIPRYSPIGLLSSLGAIYDD

SEQ ID NO: 2344008 - protein, 25 aa, Cryptosporidium parvum
HLLGIRCSINLLPEDFLVQIITKLL

SEQ ID NO: 2344009 - protein, 17 aa, Cryptosporidium parvum
HMECYDILSYINLNGVL

SEQ ID NO: 2344010 - protein, 17 aa, Cryptosporidium parvum
HNFHHAVSISITLNNWL

SEQ ID NO: 2344011 - protein, 23 aa, Cryptosporidium parvum
HPFSPGCILSIISISSQYKTTLQ

SEQ ID NO: 2344012 - protein, 22 aa, Cryptosporidium parvum
HPNFYLVLLYFHFVLESKFSLL

SEQ ID NO: 2344013 - protein, 20 aa, Cryptosporidium parvum
HQPHRFQTRPSILVTLCKLL

SEQ ID NO: 2344014 - protein, 24 aa, Cryptosporidium parvum
HRFKRFPETLFIYFTPPKNAKKGE

SEQ ID NO: 2344015 - protein, 17 aa, Cryptosporidium parvum
HRPLKYALKNAIEIAKQ

SEQ ID NO: 2344016 - protein, 18 aa, Cryptosporidium parvum
HRSLSGLGEVGSSKKVFG

SEQ ID NO: 2344017 - protein, 21 aa, Cryptosporidium parvum
HRTPPGAGIYIVIEKVLLVIN

SEQ ID NO: 2344018 - protein, 18 aa, Cryptosporidium parvum
HTGIRIVQQIAILHGSSV

SEQ ID NO: 2344019 - protein, 26 aa, Cryptosporidium parvum
HVVCTLQGMQCCVPQKSAKGWRKKPP

SEQ ID NO: 2344020 - protein, 25 aa, Cryptosporidium parvum
HYCIRSAAFLPDILKKEGFVPSSNT

SEQ ID NO: 2344021 - protein, 18 aa, Cryptosporidium parvum
IAELQGKLIRSHLNSQDN

SEQ ID NO: 2344022 - protein, 21 aa, Cryptosporidium parvum
IAKERGFLLLALIRLSLFLPF

SEQ ID NO: 2344023 - protein, 19 aa, Cryptosporidium parvum
IALCLELGIVLDIEDIHQI

SEQ ID NO: 2344024 - protein, 17 aa, Cryptosporidium parvum
IALNFINRLHILLWPHL

SEQ ID NO: 2344025 - protein, 21 aa, Cryptosporidium parvum
IALRYFLSRFFLPGESQMVYR

SEQ ID NO: 2344026 - protein, 27 aa, Cryptosporidium parvum
IANTNCYRRWKWKKRVKRRKMKKIKDE

SEQ ID NO: 2344027 - protein, 20 aa, Cryptosporidium parvum
IASAKLVIWTKEIETGRLTD

SEQ ID NO: 2344028 - protein, 18 aa, Cryptosporidium parvum
IASVLPFICKILENVKGG

SEQ ID NO: 2344029 - protein, 19 aa, Cryptosporidium parvum
IATVIGVFIILPPIFYISR

SEQ ID NO: 2344030 - protein, 18 aa, Cryptosporidium parvum
IAVSGIFSLIGTIWEGGY

SEQ ID NO: 2344031 - protein, 21 aa, Cryptosporidium parvum
ICGLIMAPVAIFFIAYSYYIY

SEQ ID NO: 2344032 - protein, 21 aa, Cryptosporidium parvum
ICIIPIFSIDIFYFRMLDILS

SEQ ID NO: 2344033 - protein, 20 aa, Cryptosporidium parvum
ICKKSLFCGIWLLFHSWSIS

SEQ ID NO: 2344034 - protein, 21 aa, Cryptosporidium parvum
ICLGLAFRILGYFLTAFTLRN

SEQ ID NO: 2344035 - protein, 34 aa, Cryptosporidium parvum; identical to SEQ ID NO: 2123862

SEQ ID NO: 2344036 - protein, 19 aa, Cryptosporidium parvum
ICSQIPSYLWYLPSDKIFP

SEQ ID NO: 2344037 - protein, 20 aa, Cryptosporidium parvum
IDLPLLCKIIINYSNSEKVH

SEQ ID NO: 2344038 - protein, 18 aa, Cryptosporidium parvum
IDLYICFGNKNSSNLFED

SEQ ID NO: 2344039 - protein, 17 aa, Cryptosporidium parvum
IDMNHHWDLLLKCDPEW

SEQ ID NO: 2344040 - protein, 22 aa, Cryptosporidium parvum
IDRRTDIEIGINIDTHPVISLL

SEQ ID NO: 2344041 - protein, 31 aa, Cryptosporidium parvum; identical to SEQ ID NO: 2123892

SEQ ID NO: 2344042 - protein, 21 aa, Cryptosporidium parvum
IECPKGYKLDEEALLLLPPEH

SEQ ID NO: 2344043 - protein, 37 aa, Cryptosporidium parvum; identical to SEQ ID NO: 2232014

SEQ ID NO: 2344044 - protein, 20 aa, Cryptosporidium parvum
IEGVFDLKVPNIISKELFMS

SEQ ID NO: 2344045 - protein, 19 aa, Cryptosporidium parvum
IEKYIPCIISISIPAASII

SEQ ID NO: 2344046 - protein, 23 aa, Cryptosporidium parvum
IELLNHIPPIWAQTYFQKLSDAL

SEQ ID NO: 2344047 - protein, 25 aa, Cryptosporidium parvum
IELQEGFRLSSDIERKLYPDGPNSN

SEQ ID NO: 2344048 - protein, 22 aa, Cryptosporidium parvum
IETLKSAFLMKEESLKCDKTSE

SEQ ID NO: 2344049 - protein, 19 aa, Cryptosporidium parvum
IFCIINLFCKYKLNKEIFL

SEQ ID NO: 2344050 - protein, 19 aa, Cryptosporidium parvum
IFEEILITLLFLAILHPKT

SEQ ID NO: 2344051 - protein, 23 aa, Cryptosporidium parvum
IFFIYWKIIKQISIYFSTHSIDY

SEQ ID NO: 2344052 - protein, 20 aa, Cryptosporidium parvum
IFGESDFNGIFIQRNLLNNK

SEQ ID NO: 2344053 - protein, 17 aa, Cryptosporidium parvum
IFGQAFMAFRMAIQKAV

SEQ ID NO: 2344054 - protein, 35 aa, Cryptosporidium parvum; identical to SEQ ID NO: 2232106

SEQ ID NO: 2344055 - protein, 21 aa, Cryptosporidium parvum
IFKVYCSSISTPVIGDLPLAP

SEQ ID NO: 2344056 - protein, 26 aa, Cryptosporidium parvum
IFLIFFFKRRLVIDLLLIVELILIDI

SEQ ID NO: 2344057 - protein, 19 aa, Cryptosporidium parvum
IFLKINWKNNIQKFIPFRF

SEQ ID NO: 2344058 - protein, 24 aa, Cryptosporidium parvum
IFNFKDCKNIISIPLEYKIKLIQR

SEQ ID NO: 2344059 - protein, 22 aa, Cryptosporidium parvum
IFPIGCPLNSISDSLVNVIQKN

SEQ ID NO: 2344060 - protein, 24 aa, Cryptosporidium parvum
IFQPLRYLFISAMNYGRRVVIPKL

SEQ ID NO: 2344061 - protein, 20 aa, Cryptosporidium parvum
IFRVQFLVLLLFLNNLACEN

SEQ ID NO: 2344062 - protein, 23 aa, Cryptosporidium parvum
IFSSYVIRLLYQINRTSVRTHSW

SEQ ID NO: 2344063 - protein, 18 aa, Cryptosporidium parvum
IFTILRNSRREHFFDARI

SEQ ID NO: 2344064 - protein, 24 aa, Cryptosporidium parvum
IFYFRMLDILSYFFLFWFTGFHPI

SEQ ID NO: 2344065 - protein, 18 aa, Cryptosporidium parvum
IFYQAFKGQWGVSGRDFV

SEQ ID NO: 2344066 - protein, 23 aa, Cryptosporidium parvum
IFYSSFCAYCHMASNPLKKVAES

SEQ ID NO: 2344067 - protein, 21 aa, Cryptosporidium parvum
IGFIAICFGPPISKSLISILF

SEQ ID NO: 2344068 - protein, 17 aa, Cryptosporidium parvum
IGFPSIVIYEKESVDKH

SEQ ID NO: 2344069 - protein, 23 aa, Cryptosporidium parvum
IGPQLFISFILFYSEIESIDTQA

SEQ ID NO: 2344070 - protein, 25 aa, Cryptosporidium parvum
IGSFELSYKWCFQVFSYDNRYCDAL

SEQ ID NO: 2344071 - protein, 26 aa, Cryptosporidium parvum
IGTAGAKMMIEWNFAFHWYDDGLPEI

SEQ ID NO: 2344072 - protein, 18 aa, Cryptosporidium parvum
IGVSFYFALDRLNKSIKG

SEQ ID NO: 2344073 - protein, 22 aa, Cryptosporidium parvum
IHKKRITPIIISRNSSSNKRSI

SEQ ID NO: 2344074 - protein, 26 aa, Cryptosporidium parvum
IIDLILNIILYRVFISGILVNDQLNK

SEQ ID NO: 2344075 - protein, 25 aa, Cryptosporidium parvum
IIEALRKGHWTKMFCFGVFAMEMFI

SEQ ID NO: 2344076 - protein, 18 aa, Cryptosporidium parvum
IIEYAVILSNIYKFKEIR

SEQ ID NO: 2344077 - protein, 19 aa, Cryptosporidium parvum
IIFAESIHKKNLITLYLPF

SEQ ID NO: 2344078 - protein, 27 aa, Cryptosporidium parvum
IILKKTPFREILLWTTLFSIPIYILPL

SEQ ID NO: 2344079 - protein, 24 aa, Cryptosporidium parvum
IILQCFDCGLIYYTDLPLNKQQLG

SEQ ID NO: 2344080 - protein, 18 aa, Cryptosporidium parvum
IIMGGVFFSLPRAGENDF

SEQ ID NO: 2344081 - protein, 20 aa, Cryptosporidium parvum
IISAFPAIITNLLFGIFDIV

SEQ ID NO: 2344082 - protein, 17 aa, Cryptosporidium parvum
IISLLIVFEIRSCQHTV

SEQ ID NO: 2344083 - protein, 17 aa, Cryptosporidium parvum
IITPHFFYDIIFGLTNI

SEQ ID NO: 2344084 - protein, 18 aa, Cryptosporidium parvum
IIVSSTFGVIKMITFPNF

SEQ ID NO: 2344085 - protein, 23 aa, Cryptosporidium parvum
IKALAGSIYRPAESRFMDLLNHE

SEQ ID NO: 2344086 - protein, 19 aa, Cryptosporidium parvum
IKALLRYASILNEVSSFLN

SEQ ID NO: 2344087 - protein, 18 aa, Cryptosporidium parvum
IKAYNKDICIVRDNEGRN

SEQ ID NO: 2344088 - protein, 18 aa, Cryptosporidium parvum
IKESLCRVQTIFNDDIKA

SEQ ID NO: 2344089 - protein, 24 aa, Cryptosporidium parvum
IKEYEERSIFPLAEGLKLIKKLDI

SEQ ID NO: 2344090 - protein, 24 aa, Cryptosporidium parvum
IKKFKHWFTYLGITNYILKVIKRL

SEQ ID NO: 2344091 - protein, 18 aa, Cryptosporidium parvum
IKKGTGLNRQICNNYDDT

SEQ ID NO: 2344092 - protein, 28 aa, Cryptosporidium parvum
IKLSLEFLKQVCGLKWIKDISALHPREQ

SEQ ID NO: 2344093 - protein, 22 aa, Cryptosporidium parvum
IKNGAPILRRKAMKQIVETARD

SEQ ID NO: 2344094 - protein, 25 aa, Cryptosporidium parvum
IKNILKFILHWSIAFIMFISTIFPF

SEQ ID NO: 2344095 - protein, 25 aa, Cryptosporidium parvum
IKRLRAECFYSMLYQDIKFHEQPNQ

SEQ ID NO: 2344096 - protein, 22 aa, Cryptosporidium parvum
IKRTEFDLLIGQMIADISDVKI

SEQ ID NO: 2344097 - protein, 18 aa, Cryptosporidium parvum
IKSDSKMEFLINNDMFSS

SEQ ID NO: 2344098 - protein, 25 aa, Cryptosporidium parvum
IKSVMIRISIIFPYSTLNDDFHFFS

SEQ ID NO: 2344099 - protein, 30 aa, Cryptosporidium parvum; identical to SEQ ID NO: 2232445

SEQ ID NO: 2344100 - protein, 26 aa, Cryptosporidium parvum
ILDQKKFCNHYFKPMNIEVPGTILRS

SEQ ID NO: 2344101 - protein, 17 aa, Cryptosporidium parvum
ILFKLGTMGLIPVNRGD

SEQ ID NO: 2344102 - protein, 20 aa, Cryptosporidium parvum
ILFYLCRVLYSIGKSASQRE

SEQ ID NO: 2344103 - protein, 26 aa, Cryptosporidium parvum
ILGIYLKGRNLMMNDLEHINCGAYAA

SEQ ID NO: 2344104 - protein, 23 aa, Cryptosporidium parvum
ILHIKRLKFPIYSIITQFTENYQ

SEQ ID NO: 2344105 - protein, 24 aa, Cryptosporidium parvum
ILICVPPELKLQIPPGSQNSDHIT

SEQ ID NO: 2344106 - protein, 17 aa, Cryptosporidium parvum
ILIFCNIHYLKYTNTKL

SEQ ID NO: 2344107 - protein, 17 aa, Cryptosporidium parvum
ILIFHFIVVIFVVIITL

SEQ ID NO: 2344108 - protein, 17 aa, Cryptosporidium parvum
ILILKLLSIQNYEKSIE

SEQ ID NO: 2344109 - protein, 21 aa, Cryptosporidium parvum
ILITSCCRLLFDSPEDVRPVL

SEQ ID NO: 2344110 - protein, 17 aa, Cryptosporidium parvum
ILLKAIWISCFLVSSSA

SEQ ID NO: 2344111 - protein, 25 aa, Cryptosporidium parvum
ILPKKIAEMIFEFHYLLEISLKYLL

SEQ ID NO: 2344112 - protein, 18 aa, Cryptosporidium parvum
ILQFCKKHNITLSELEDE

SEQ ID NO: 2344113 - protein, 25 aa, Cryptosporidium parvum
ILQYSEIFLPFVMLAYVILRMIYEW

SEQ ID NO: 2344114 - protein, 18 aa, Cryptosporidium parvum
ILSIFSLKIHQLRRQIYN

SEQ ID NO: 2344115 - protein, 29 aa, Cryptosporidium parvum
ILSLRPACRRMAQKCLITLSNITGVSVAT

SEQ ID NO: 2344116 - protein, 25 aa, Cryptosporidium parvum
ILSNIYKFKEIRILLSEVSEILYGN

SEQ ID NO: 2344117 - protein, 18 aa, Cryptosporidium parvum
ILTTRSFKTELSNLKLLT

SEQ ID NO: 2344118 - protein, 17 aa, Cryptosporidium parvum
IMFSPSIINFRRFTFSR

SEQ ID NO: 2344119 - protein, 21 aa, Cryptosporidium parvum
IMPERVCLNGGELMSDFNCMK

SEQ ID NO: 2344120 - protein, 20 aa, Cryptosporidium parvum
IMREYLLKVLINDSCGNTKK

SEQ ID NO: 2344121 - protein, 22 aa, Cryptosporidium parvum
INECVDWYSVIFTSRSFGQLII

SEQ ID NO: 2344122 - protein, 24 aa, Cryptosporidium parvum
INEPLKLNPCYNIQEYDMDLKINT

SEQ ID NO: 2344123 - protein, 21 aa, Cryptosporidium parvum
INIIALFGHFISIYWLNYKNP

SEQ ID NO: 2344124 - protein, 23 aa, Cryptosporidium parvum
ININVGVFQSCEFIILECLLSCC

SEQ ID NO: 2344125 - protein, 23 aa, Cryptosporidium parvum
INKDEIMNLLSLGEIQFQNFSTL

SEQ ID NO: 2344126 - protein, 25 aa, Cryptosporidium parvum
INKKFKEYLGLAVDYRFISSDKDES

SEQ ID NO: 2344127 - protein, 18 aa, Cryptosporidium parvum
INTIIMMAMLPLSCYAGD

SEQ ID NO: 2344128 - protein, 26 aa, Cryptosporidium parvum
INTYLGNCLIELPNICNIMQIKEVLW

SEQ ID NO: 2344129 - protein, 23 aa, Cryptosporidium parvum
INVIENLLSFSFIDEALRFITAI

SEQ ID NO: 2344130 - protein, 27 aa, Cryptosporidium parvum
IPFLPEMKRMIFGILIVITNWVCNFDA

SEQ ID NO: 2344131 - protein, 20 aa, Cryptosporidium parvum
IPLKEGVIIVGYDRIETKLM

SEQ ID NO: 2344132 - protein, 23 aa, Cryptosporidium parvum
IPSLPNGLFIFFSKKRAIKCNKD

SEQ ID NO: 2344133 - protein, 27 aa, Cryptosporidium parvum
IPSTMSILLRFLINKLISLESEIHSKN

SEQ ID NO: 2344134 - protein, 18 aa, Cryptosporidium parvum
IPSYLWYLPSDKIFPFPI

SEQ ID NO: 2344135 - protein, 27 aa, Cryptosporidium parvum
IPVDKFGIAMLRAFMNGLILVILILFV

SEQ ID NO: 2344136 - protein, 17 aa, Cryptosporidium parvum
IPVFRDIISRDELIEKG

SEQ ID NO: 2344137 - protein, 20 aa, Cryptosporidium parvum
IPVWIRWLGWISTVRYTYTG

SEQ ID NO: 2344138 - protein, 17 aa, Cryptosporidium parvum
IQEFKRNSGSLVNNKRP

SEQ ID NO: 2344139 - protein, 18 aa, Cryptosporidium parvum
IQGVKGFENLLIRMASYT

SEQ ID NO: 2344140 - protein, 25 aa, Cryptosporidium parvum
IQILSENIIQFWKSYFHPNYTNITP

SEQ ID NO: 2344141 - protein, 24 aa, Cryptosporidium parvum
IQPCIPLHPRCRIIEDTGNKKSFT

SEQ ID NO: 2344142 - protein, 20 aa, Cryptosporidium parvum
IQPIVFCLFSDLKNQILYGK

SEQ ID NO: 2344143 - protein, 25 aa, Cryptosporidium parvum
IQPSLRPLVPLALDRSIREILQVVI

SEQ ID NO: 2344144 - protein, 18 aa, Cryptosporidium parvum
IQWENHWSLNSFINLCNT

SEQ ID NO: 2344145 - protein, 28 aa, Cryptosporidium parvum
IRFSFIGKVCSIEFYLYNPLSFPIVCES

SEQ ID NO: 2344146 - protein, 19 aa, Cryptosporidium parvum
IRGKLRTTFYGYLISNNET

SEQ ID NO: 2344147 - protein, 21 aa, Cryptosporidium parvum
IRILEELMLKESRELNKENSL

SEQ ID NO: 2344148 - protein, 17 aa, Cryptosporidium parvum
IRILLSEVSEILYGNFI

SEQ ID NO: 2344149 - protein, 19 aa, Cryptosporidium parvum
IRKAMKYNISSNHIRKLRE

SEQ ID NO: 2344150 - protein, 22 aa, Cryptosporidium parvum
IRKEESCLLLGPLDLIDLDSKV

SEQ ID NO: 2344151 - protein, 20 aa, Cryptosporidium parvum
IRKGLPPKSVIDHAIQIYPE

SEQ ID NO: 2344152 - protein, 20 aa, Cryptosporidium parvum
IRKLVCPLFQDWVLELEREV

SEQ ID NO: 2344153 - protein, 25 aa, Cryptosporidium parvum
IRLILEGGGIPSVFLQSISDWTGSD

SEQ ID NO: 2344154 - protein, 17 aa, Cryptosporidium parvum
IRQILMASRISNSFQLK

SEQ ID NO: 2344155 - protein, 17 aa, Cryptosporidium parvum
IRTTFTFVYSIFIFTTA

SEQ ID NO: 2344156 - protein, 24 aa, Cryptosporidium parvum
ISCEDCAYSSWSPWSECSVTCQGG

SEQ ID NO: 2344157 - protein, 26 aa, Cryptosporidium parvum
ISFLSFILGFSFKFFSRIPRSYFFSP

SEQ ID NO: 2344158 - protein, 19 aa, Cryptosporidium parvum
ISFYSLFLFAFGSPFSETE

SEQ ID NO: 2344159 - protein, 18 aa, Cryptosporidium parvum
ISGYAGNINLILKLFSDL

SEQ ID NO: 2344160 - protein, 26 aa, Cryptosporidium parvum
ISIKRLAAYLLLCFVIGNGLGPLILF

SEQ ID NO: 2344161 - protein, 17 aa, Cryptosporidium parvum
ISIPVFRDIISRDELIE

SEQ ID NO: 2344162 - protein, 26 aa, Cryptosporidium parvum
ISISLWKTIFPWIWNNLEHQQRNELT

SEQ ID NO: 2344163 - protein, 20 aa, Cryptosporidium parvum
ISKKLVKLIPNFKVLNKSLN

SEQ ID NO: 2344164 - protein, 17 aa, Cryptosporidium parvum
ISMFVLFFRCGERNRQH

SEQ ID NO: 2344165 - protein, 39 aa, Cryptosporidium parvum; identical to SEQ ID NO: 2124447

SEQ ID NO: 2344166 - protein, 17 aa, Cryptosporidium parvum
ISPLALKGSNRFPILTV

SEQ ID NO: 2344167 - protein, 18 aa, Cryptosporidium parvum
ISQMVLMRAASLVSAIIA

SEQ ID NO: 2344168 - protein, 29 aa, Cryptosporidium parvum
ISRFTLYYIKHNITLIFAISVGLTCAIVY

SEQ ID NO: 2344169 - protein, 19 aa, Cryptosporidium parvum
ISRRHAISMFISEELNSNF

SEQ ID NO: 2344170 - protein, 17 aa, Cryptosporidium parvum
ISSNWSHHLRFCKSKIF

SEQ ID NO: 2344171 - protein, 18 aa, Cryptosporidium parvum
ISSVLMFPYNVYRLISKS

SEQ ID NO: 2344172 - protein, 21 aa, Cryptosporidium parvum
ISVILEYMEPLILLHEQNTDY

SEQ ID NO: 2344173 - protein, 23 aa, Cryptosporidium parvum
ISYLKVFYIKNMINDWSKEKIKK

SEQ ID NO: 2344174 - protein, 35 aa, Cryptosporidium parvum; identical to SEQ ID NO: 2233007

SEQ ID NO: 2344175 - protein, 27 aa, Cryptosporidium parvum
ISYSLKPIHSFYFLRSYVRQYLEYIFK

SEQ ID NO: 2344176 - protein, 18 aa, Cryptosporidium parvum
ITAIKRGFDKKVIFSLLL

SEQ ID NO: 2344177 - protein, 23 aa, Cryptosporidium parvum
ITFYFRLDFIMSINPQVSQFLRQ

SEQ ID NO: 2344178 - protein, 18 aa, Cryptosporidium parvum
ITGPCCWLDDKFKHLPSL

SEQ ID NO: 2344179 - protein, 28 aa, Cryptosporidium parvum
ITGSKLKRFFAEFIIRMEDFDVSVIPLF

SEQ ID NO: 2344180 - protein, 23 aa, Cryptosporidium parvum
ITHHLKLCWVFIFCLSLFGMLDI

SEQ ID NO: 2344181 - protein, 25 aa, Cryptosporidium parvum
ITIENSFPWFIPVKTSVQFFDLNST

SEQ ID NO: 2344182 - protein, 18 aa, Cryptosporidium parvum
ITMNFCKNLSQALLNIKP

SEQ ID NO: 2344183 - protein, 23 aa, Cryptosporidium parvum
ITMYCMHVAFMLVLRSGGCMALL

SEQ ID NO: 2344184 - protein, 23 aa, Cryptosporidium parvum
ITNTRIFSMKSFGRTVVPSYSQK

SEQ ID NO: 2344185 - protein, 27 aa, Cryptosporidium parvum
ITPYEWKCRWRGLHFKVYTLRFPNSFF

SEQ ID NO: 2344186 - protein, 25 aa, Cryptosporidium parvum
ITVYIIECIFTYWISNLIFEILKGL

SEQ ID NO: 2344187 - protein, 17 aa, Cryptosporidium parvum
IVGYRITGIIVLKRCAN

SEQ ID NO: 2344188 - protein, 23 aa, Cryptosporidium parvum
IVKSMLWSGVYIWATTKMYRKNN

SEQ ID NO: 2344189 - protein, 17 aa, Cryptosporidium parvum
IVLPGLYYKPYSYTTNL

SEQ ID NO: 2344190 - protein, 17 aa, Cryptosporidium parvum
IVLYRIILKKTPFREIL

SEQ ID NO: 2344191 - protein, 18 aa, Cryptosporidium parvum
IVNLCYDISWSKKTAACI

SEQ ID NO: 2344192 - protein, 17 aa, Cryptosporidium parvum
IVPKKYLDYTFRLRWYG

SEQ ID NO: 2344193 - protein, 27 aa, Cryptosporidium parvum
IVQVFRRMISIFSWFFTGIVILLMVGI

SEQ ID NO: 2344194 - protein, 21 aa, Cryptosporidium parvum
IVRQICDKFSIIFSTINQNLK

SEQ ID NO: 2344195 - protein, 20 aa, Cryptosporidium parvum
IVSPLFKAKLIDPLWSSTKF

SEQ ID NO: 2344196 - protein, 24 aa, Cryptosporidium parvum
IWFVKFYAPWCGHWNEKVKIAKVD

SEQ ID NO: 2344197 - protein, 19 aa, Cryptosporidium parvum
IWGGLRGGVSLALAMSLES

SEQ ID NO: 2344198 - protein, 17 aa, Cryptosporidium parvum
IWVSSTIVKKHFPVRKK

SEQ ID NO: 2344199 - protein, 20 aa, Cryptosporidium parvum
IYLAFLFGGLIQRCLIHQIR

SEQ ID NO: 2344200 - protein, 17 aa, Cryptosporidium parvum
IYLDILGIYLKGRNLMM

SEQ ID NO: 2344201 - protein, 19 aa, Cryptosporidium parvum
IYPNCKVQISWLDIGFNLS

SEQ ID NO: 2344202 - protein, 17 aa, Cryptosporidium parvum
IYYNLVENFPLLYFNRA

SEQ ID NO: 2344203 - protein, 21 aa, Cryptosporidium parvum
KALNCFHCSTSMFRNSEISSH

SEQ ID NO: 2344204 - protein, 19 aa, Cryptosporidium parvum
KANITSWAHWTFSHDAMSR

SEQ ID NO: 2344205 - protein, 18 aa, Cryptosporidium parvum
KASRVLSLNGSFPSNLDF

SEQ ID NO: 2344206 - protein, 17 aa, Cryptosporidium parvum
KCDEPFVFNEPRKTCVI

SEQ ID NO: 2344207 - protein, 18 aa, Cryptosporidium parvum
KCSHEFPTYDIIANYSVF

SEQ ID NO: 2344208 - protein, 17 aa, Cryptosporidium parvum
KDGYLDFYGDLHILLTP

SEQ ID NO: 2344209 - protein, 23 aa, Cryptosporidium parvum
KDIQILSSWSFFTGQHTEFKNID

SEQ ID NO: 2344210 - protein, 20 aa, Cryptosporidium parvum
KDKILRIITAIKRGFDKKVI

SEQ ID NO: 2344211 - protein, 25 aa, Cryptosporidium parvum
KDLSILRFVFSYHKFFNPQNETRYP

SEQ ID NO: 2344212 - protein, 23 aa, Cryptosporidium parvum
KDRVVELWIEMDLSGIRKGFVRN

SEQ ID NO: 2344213 - protein, 18 aa, Cryptosporidium parvum
KDVNFPLKNLYQMDASLR

SEQ ID NO: 2344214 - protein, 17 aa, Cryptosporidium parvum
KDVQYSYFIWKFAVKNR

SEQ ID NO: 2344215 - protein, 18 aa, Cryptosporidium parvum
KEDLMKISGYAGNINLIL

SEQ ID NO: 2344216 - protein, 25 aa, Cryptosporidium parvum
KEECGTSFVMWFGEGTPAATLKCGA

SEQ ID NO: 2344217 - protein, 20 aa, Cryptosporidium parvum
KEEGLECFDIPQTFSNIKLT

SEQ ID NO: 2344218 - protein, 21 aa, Cryptosporidium parvum
KEFMDSPIFIIWCANHIRSRL

SEQ ID NO: 2344219 - protein, 19 aa, Cryptosporidium parvum
KEGKMKFSKGINSRKSMQR

SEQ ID NO: 2344220 - protein, 19 aa, Cryptosporidium parvum
KEHERRTCCKKSHSEAISR

SEQ ID NO: 2344221 - protein, 25 aa, Cryptosporidium parvum
KEHLKRRRIDVILTIATLFGTSSTL

SEQ ID NO: 2344222 - protein, 18 aa, Cryptosporidium parvum
KEIIRLILEGGGIPSVFL

SEQ ID NO: 2344223 - protein, 18 aa, Cryptosporidium parvum
KEITFFWTTLLLLGETDT

SEQ ID NO: 2344224 - protein, 19 aa, Cryptosporidium parvum
KELVPLHFALEDQPSPISP

SEQ ID NO: 2344225 - protein, 21 aa, Cryptosporidium parvum
KELVPRLTPILKNRHEKVQEN

SEQ ID NO: 2344226 - protein, 26 aa, Cryptosporidium parvum
KESFWSFKLPLIIKNIIFFIYWKIIK

SEQ ID NO: 2344227 - protein, 21 aa, Cryptosporidium parvum
KEVILSIPYIFERTGEEYPPI

SEQ ID NO: 2344228 - protein, 31 aa, Cryptosporidium parvum; identical to SEQ ID NO: 2124674

SEQ ID NO: 2344229 - protein, 19 aa, Cryptosporidium parvum
KEYEMYAKLLSNIDTNQGQ

SEQ ID NO: 2344230 - protein, 22 aa, Cryptosporidium parvum
KFFNSRLITIYILFFNIYLNKF

SEQ ID NO: 2344231 - protein, 22 aa, Cryptosporidium parvum
KFHSELLYGCLLTYGIYLVYLI

SEQ ID NO: 2344232 - protein, 18 aa, Cryptosporidium parvum
KFIELGIFGYNWDTIPFS

SEQ ID NO: 2344233 - protein, 25 aa, Cryptosporidium parvum
KFIMFFRKLLMVFRYLKNSNLKKNK

SEQ ID NO: 2344234 - protein, 27 aa, Cryptosporidium parvum
KFLLESSCCPLNLIRFCDNKQLLNAAI

SEQ ID NO: 2344235 - protein, 26 aa, Cryptosporidium parvum
KFMNIQELFLFLSLFYHNYQREWILP

SEQ ID NO: 2344236 - protein, 19 aa, Cryptosporidium parvum
KFPTSLVSIWGFTLQAYQL

SEQ ID NO: 2344237 - protein, 22 aa, Cryptosporidium parvum
KGELKINSILLLHSGSKIRIGG

SEQ ID NO: 2344238 - protein, 19 aa, Cryptosporidium parvum
KGPGSIIGTCILMPDKQGS

SEQ ID NO: 2344239 - protein, 17 aa, Cryptosporidium parvum
KGSTLLVIPHFSNNFNI

SEQ ID NO: 2344240 - protein, 24 aa, Cryptosporidium parvum
KHELFGIHYLFGFNFVKSNQLFKQ

SEQ ID NO: 2344241 - protein, 33 aa, Cryptosporidium parvum; identical to SEQ ID NO: 2233433

SEQ ID NO: 2344242 - protein, 22 aa, Cryptosporidium parvum
KIELEMFSFLPKILEFQVKDGI

SEQ ID NO: 2344243 - protein, 24 aa, Cryptosporidium parvum
KIGEIKVSLEFNFINIFNKCFTFS

SEQ ID NO: 2344244 - protein, 17 aa, Cryptosporidium parvum
KIIKLGKNRVFCRTFLI

SEQ ID NO: 2344245 - protein, 23 aa, Cryptosporidium parvum
KILGEGFNNSWITKVKIDYTDAI

SEQ ID NO: 2344246 - protein, 29 aa, Cryptosporidium parvum
KILVGTLRAGFLLNYYPLINLWSGLNKFI

SEQ ID NO: 2344247 - protein, 21 aa, Cryptosporidium parvum
KINTIWAIFRVQFLVLLLFLN

SEQ ID NO: 2344248 - protein, 18 aa, Cryptosporidium parvum
KIPYSRGRISHFGTPIQF

SEQ ID NO: 2344249 - protein, 19 aa, Cryptosporidium parvum
KISDSFLTMRAVKILNYVE

SEQ ID NO: 2344250 - protein, 19 aa, Cryptosporidium parvum
KISMIKMKSGILVGILFAA

SEQ ID NO: 2344251 - protein, 29 aa, Cryptosporidium parvum
KISQQRGYIRLSIKQGFLGSAINNLVQYS

SEQ ID NO: 2344252 - protein, 18 aa, Cryptosporidium parvum
KITFLKKLFSRISNDDVN

SEQ ID NO: 2344253 - protein, 24 aa, Cryptosporidium parvum
KKAGCAPWRGAILNNYIDQILSTW

SEQ ID NO: 2344254 - protein, 17 aa, Cryptosporidium parvum
KKCYDIKEIPKYILDAY

SEQ ID NO: 2344255 - protein, 20 aa, Cryptosporidium parvum
KKKLYLLILLHSVDISNPLM

SEQ ID NO: 2344256 - protein, 17 aa, Cryptosporidium parvum
KKLFPTFSSRFGWRRVE

SEQ ID NO: 2344257 - protein, 18 aa, Cryptosporidium parvum
KKLLQGMFELDLINSQTL

SEQ ID NO: 2344258 - protein, 21 aa, Cryptosporidium parvum
KKLTILIHLFIIYFLVIYNNE

SEQ ID NO: 2344259 - protein, 20 aa, Cryptosporidium parvum
KKLWIIEQMDTFSSQEDIPF

SEQ ID NO: 2344260 - protein, 24 aa, Cryptosporidium parvum
KKNLKEWFIYLFNALYDFIIYQLP

SEQ ID NO: 2344261 - protein, 25 aa, Cryptosporidium parvum
KKRGKKAYFRIFFNIVLKGKPLYTI

SEQ ID NO: 2344262 - protein, 17 aa, Cryptosporidium parvum
KKSLSFNYNLHWKTPTP

SEQ ID NO: 2344263 - protein, 18 aa, Cryptosporidium parvum
KKVFSIAVGNVIFKQSFD

SEQ ID NO: 2344264 - protein, 18 aa, Cryptosporidium parvum
KKYKSLIINHSFNDQDYE

SEQ ID NO: 2344265 - protein, 19 aa, Cryptosporidium parvum
KKYLDYTFRLRWYGENEGS

SEQ ID NO: 2344266 - protein, 52 aa, Cryptosporidium parvum; identical to SEQ ID NO: 2124815

SEQ ID NO: 2344267 - protein, 24 aa, Cryptosporidium parvum
KLDKHLFDLFDFYISDGINNKIIV

SEQ ID NO: 2344268 - protein, 19 aa, Cryptosporidium parvum
KLEETFGIVGPATVFHKMK

SEQ ID NO: 2344269 - protein, 24 aa, Cryptosporidium parvum
KLFKKGKVCSMIKEIYSKNKKDKK

SEQ ID NO: 2344270 - protein, 19 aa, Cryptosporidium parvum
KLFSKPRIKIYYNSIYFNL

SEQ ID NO: 2344271 - protein, 17 aa, Cryptosporidium parvum
KLFSRISNDDVNLISTL

SEQ ID NO: 2344272 - protein, 17 aa, Cryptosporidium parvum
KLGPKEEMKRLPLGDYV

SEQ ID NO: 2344273 - protein, 23 aa, Cryptosporidium parvum
KLKFIKFKIENEIPGNSPINKTK

SEQ ID NO: 2344274 - protein, 21 aa, Cryptosporidium parvum
KLLTCTAFGALFVGCSLVIAG

SEQ ID NO: 2344275 - protein, 19 aa, Cryptosporidium parvum
KLNKEIFLKFLADQIEILK

SEQ ID NO: 2344276 - protein, 19 aa, Cryptosporidium parvum
KLNNELDVFLISRPGKHTY

SEQ ID NO: 2344277 - protein, 19 aa, Cryptosporidium parvum
KLPGIPSLQKSSIVKALNA

SEQ ID NO: 2344278 - protein, 21 aa, Cryptosporidium parvum
KLRNFYSVFLINGLDVKVPEL

SEQ ID NO: 2344279 - protein, 26 aa, Cryptosporidium parvum
KLSFPESICYIWNIKGHNALGEIQDP

SEQ ID NO: 2344280 - protein, 23 aa, Cryptosporidium parvum
KLTISPLYLLGMNLKGKNITELS

SEQ ID NO: 2344281 - protein, 18 aa, Cryptosporidium parvum
KLTSKKIRSLIEKIYQFQ

SEQ ID NO: 2344282 - protein, 19 aa, Cryptosporidium parvum
KLYIERSVMESLNLDIPPK

SEQ ID NO: 2344283 - protein, 24 aa, Cryptosporidium parvum
KMLFLMVLWIKHYLSNKVENKSEL

SEQ ID NO: 2344284 - protein, 23 aa, Cryptosporidium parvum
KMRRQIFIFPYIHYKYYLFCLIL

SEQ ID NO: 2344285 - protein, 26 aa, Cryptosporidium parvum
KMYIDFPIRNFWKIAKTPIDMESPQI

SEQ ID NO: 2344286 - protein, 26 aa, Cryptosporidium parvum
KNEFFKFMVHFIFSLIIFQIVNNINM

SEQ ID NO: 2344287 - protein, 31 aa, Cryptosporidium parvum
KNFHIPNNWMTYFAKLSLRWNNFGNDQTTEI

SEQ ID NO: 2344288 - protein, 18 aa, Cryptosporidium parvum
KNFIGFTLLSIIVSCDIW

SEQ ID NO: 2344289 - protein, 23 aa, Cryptosporidium parvum
KNHLKNQIPILLASVGISTQDNI

SEQ ID NO: 2344290 - protein, 25 aa, Cryptosporidium parvum
KNIAINWRKHLLKFGNGEEIIQRLK

SEQ ID NO: 2344291 - protein, 43 aa, Cryptosporidium parvum; identical to SEQ ID NO: 2233727

SEQ ID NO: 2344292 - protein, 23 aa, Cryptosporidium parvum
KNISSTFCLPSFINYYRNKVKSK

SEQ ID NO: 2344293 - protein, 22 aa, Cryptosporidium parvum
KNKDKIVEFLIHFQTSRTDPQF

SEQ ID NO: 2344294 - protein, 21 aa, Cryptosporidium parvum
KNKELCLILIRFNPAENNVCS

SEQ ID NO: 2344295 - protein, 18 aa, Cryptosporidium parvum
KNKISDFLSHPFSPGCIL

SEQ ID NO: 2344296 - protein, 29 aa, Cryptosporidium parvum
KNNELKHLFKIPMNYLPYIPKDTGESDEK

SEQ ID NO: 2344297 - protein, 17 aa, Cryptosporidium parvum
KNRFIIIRDIIDLILNI

SEQ ID NO: 2344298 - protein, 19 aa, Cryptosporidium parvum
KNRIILGSMTDYLYTELLE

SEQ ID NO: 2344299 - protein, 21 aa, Cryptosporidium parvum
KNSSLELLGVIKPDIDPNTHE

SEQ ID NO: 2344300 - protein, 20 aa, Cryptosporidium parvum
KNYSALFCNLNMKKLYEKIE

SEQ ID NO: 2344301 - protein, 19 aa, Cryptosporidium parvum
KPLLGREWIQREKSKKQTS

SEQ ID NO: 2344302 - protein, 20 aa, Cryptosporidium parvum
KPYLSCPENTVLVATNTCKM

SEQ ID NO: 2344303 - protein, 18 aa, Cryptosporidium parvum
KPYYWLQYFVNNVSVIPI

SEQ ID NO: 2344304 - protein, 23 aa, Cryptosporidium parvum
KQGSVALPNFQSGALGCPVSASI

SEQ ID NO: 2344305 - protein, 17 aa, Cryptosporidium parvum
KQLDPFKGTFAMLSHNI

SEQ ID NO: 2344306 - protein, 22 aa, Cryptosporidium parvum
KQLIFHRIYFDLGTYSDHKLTQ

SEQ ID NO: 2344307 - protein, 19 aa, Cryptosporidium parvum
KQLKCHIFSDILFDKDTGE

SEQ ID NO: 2344308 - protein, 19 aa, Cryptosporidium parvum
KQNCNVHSLLNSKSIRNRQ

SEQ ID NO: 2344309 - protein, 26 aa, Cryptosporidium parvum
KQPVYECIKLIITKFLLLILVSIVGG

SEQ ID NO: 2344310 - protein, 20 aa, Cryptosporidium parvum
KRKQENWDYLNALNDASDNL

SEQ ID NO: 2344311 - protein, 17 aa, Cryptosporidium parvum
KRRLFEIDSSTRGNKMV

SEQ ID NO: 2344312 - protein, 20 aa, Cryptosporidium parvum
KRSAEIQVGSVFDIFPVLYP

SEQ ID NO: 2344313 - protein, 17 aa, Cryptosporidium parvum
KRTFSFEGSKALVSSKT

SEQ ID NO: 2344314 - protein, 23 aa, Cryptosporidium parvum
KRTYFPIVLVSGIAYIATQILNK

SEQ ID NO: 2344315 - protein, 25 aa, Cryptosporidium parvum
KSFKCCWKEKRIILVRQRENYLFIE

SEQ ID NO: 2344316 - protein, 22 aa, Cryptosporidium parvum
KSFNEWSQYHILQLIFQNLSNI

SEQ ID NO: 2344317 - protein, 19 aa, Cryptosporidium parvum
KSGWCLFHSFFQVVSKDWL

SEQ ID NO: 2344318 - protein, 19 aa, Cryptosporidium parvum
KSKAKLCNWANYKDFTQKK

SEQ ID NO: 2344319 - protein, 24 aa, Cryptosporidium parvum
KSLISILFGPKWVRPENIQLFSAN

SEQ ID NO: 2344320 - protein, 26 aa, Cryptosporidium parvum
KSNEDLELWNLLGYKNAPKGLGVMFS

SEQ ID NO: 2344321 - protein, 18 aa, Cryptosporidium parvum
KSNSMAFAGEIVGKFKCN

SEQ ID NO: 2344322 - protein, 27 aa, Cryptosporidium parvum
KSQMIKDRHFLGAYTIFGSLLTALLLL

SEQ ID NO: 2344323 - protein, 21 aa, Cryptosporidium parvum
KSRRNFTWRFSFITILIHQII

SEQ ID NO: 2344324 - protein, 18 aa, Cryptosporidium parvum
KSTLSILLKQEFEQKINF

SEQ ID NO: 2344325 - protein, 17 aa, Cryptosporidium parvum
KSYSCIFHLKIILNAIN

SEQ ID NO: 2344326 - protein, 19 aa, Cryptosporidium parvum
KTACSYIKNLLMKIVPVRN

SEQ ID NO: 2344327 - protein, 24 aa, Cryptosporidium parvum
KTKFEMEDWIQLFLESIVIKDFMN

SEQ ID NO: 2344328 - protein, 22 aa, Cryptosporidium parvum
KTKLHAIAVLLLFIRLLEISLF

SEQ ID NO: 2344329 - protein, 17 aa, Cryptosporidium parvum
KTLETICDHFSTKSNSA

SEQ ID NO: 2344330 - protein, 20 aa, Cryptosporidium parvum
KVGRRSCSPSNVFLNRSKKF

SEQ ID NO: 2344331 - protein, 20 aa, Cryptosporidium parvum
KVTASLWYQAKLIFGFDDEL

SEQ ID NO: 2344332 - protein, 25 aa, Cryptosporidium parvum
KVYTLRFPNSFFGYPIQIFTKYIYK

SEQ ID NO: 2344333 - protein, 19 aa, Cryptosporidium parvum
KWIDCFKSDAKSIPSSIKN

SEQ ID NO: 2344334 - protein, 19 aa, Cryptosporidium parvum
KWIQLSTFIPVDIKYIENL

SEQ ID NO: 2344335 - protein, 20 aa, Cryptosporidium parvum
KWNYIYSVDLFKLNSISWSK

SEQ ID NO: 2344336 - protein, 22 aa, Cryptosporidium parvum
KYAFWSCSFVHLAPEVEKLFQS

SEQ ID NO: 2344337 - protein, 23 aa, Cryptosporidium parvum
KYFNYKLMPKYVIINNIETNQIN

SEQ ID NO: 2344338 - protein, 33 aa, Cryptosporidium parvum
KYKASVPKSTFSWKIMSIFSFLKLKKPKYAPPS

SEQ ID NO: 2344339 - protein, 23 aa, Cryptosporidium parvum
KYLIKHFRRHPSLIIDMNEISSQ

SEQ ID NO: 2344340 - protein, 26 aa, Cryptosporidium parvum
KYPFPEKILFSMLVALTRLYGVSEVR

SEQ ID NO: 2344341 - protein, 28 aa, Cryptosporidium parvum
KYSDHLPCAVWLPWIPQLIAGIDRIEGS

SEQ ID NO: 2344342 - protein, 19 aa, Cryptosporidium parvum
KYSVDIVIGALRYDLISSD

SEQ ID NO: 2344343 - protein, 21 aa, Cryptosporidium parvum
KYYLFCLILFNTLFLGLIQSF

SEQ ID NO: 2344344 - protein, 17 aa, Cryptosporidium parvum
LACNELGVFGIISNSTI

SEQ ID NO: 2344345 - protein, 19 aa, Cryptosporidium parvum
LAEGLKLIKKLDILNKADC

SEQ ID NO: 2344346 - protein, 19 aa, Cryptosporidium parvum
LAGIQAFTCFIFFQIMNFL

SEQ ID NO: 2344347 - protein, 24 aa, Cryptosporidium parvum
LAICSRLLCIFISFLTNDLFSTIR

SEQ ID NO: 2344348 - protein, 23 aa, Cryptosporidium parvum
LAIESCQFVNYIPIYLVCHCDSW

SEQ ID NO: 2344349 - protein, 23 aa, Cryptosporidium parvum
LANIEHFRFYTIRNITGNITDVI

SEQ ID NO: 2344350 - protein, 17 aa, Cryptosporidium parvum
LARIKIGYINPLGDSLP

SEQ ID NO: 2344351 - protein, 24 aa, Cryptosporidium parvum
LARLLELLCFCFNVTLGEKLLQHL

SEQ ID NO: 2344352 - protein, 27 aa, Cryptosporidium parvum
LASPHPKIKLGFLKWFNEKLPKDLFGR

SEQ ID NO: 2344353 - protein, 21 aa, Cryptosporidium parvum
LCIIGPIPPKLLFITKSLSLQ

SEQ ID NO: 2344354 - protein, 27 aa, Cryptosporidium parvum
LCIILKPPFWYCPIEGTGMDEDEQDEE

SEQ ID NO: 2344355 - protein, 26 aa, Cryptosporidium parvum
LCIVSWMPLMLENCSPALSDSEIIMP

SEQ ID NO: 2344356 - protein, 18 aa, Cryptosporidium parvum
LCKNSVLFFSTRNYYRHI

SEQ ID NO: 2344357 - protein, 18 aa, Cryptosporidium parvum
LCNTELPNAVSLSNKEVL

SEQ ID NO: 2344358 - protein, 27 aa, Cryptosporidium parvum
LCSLDSTFPSLLIWVRFFHQTILKNQE

SEQ ID NO: 2344359 - protein, 18 aa, Cryptosporidium parvum
LCSLLRDDLHAFSVHRAL

SEQ ID NO: 2344360 - protein, 32 aa, Cryptosporidium parvum
LCSNNGIGLSIIYRRLFSYFIQSIIRYHFENI

SEQ ID NO: 2344361 - protein, 20 aa, Cryptosporidium parvum
LDDLMAIPVTLLVRIIILSN

SEQ ID NO: 2344362 - protein, 17 aa, Cryptosporidium parvum
LDIEVLFSFITARVDLL

SEQ ID NO: 2344363 - protein, 25 aa, Cryptosporidium parvum
LDIFKPRPVLVYNMSSYYIPEHLLL

SEQ ID NO: 2344364 - protein, 18 aa, Cryptosporidium parvum
LDIPAPRGPLFVLGNNFI

SEQ ID NO: 2344365 - protein, 25 aa, Cryptosporidium parvum
LDMIDLILFHIKKIRSFSLDCLNLK

SEQ ID NO: 2344366 - protein, 17 aa, Cryptosporidium parvum
LDPSMSCFLSLIPSRKT

SEQ ID NO: 2344367 - protein, 18 aa, Cryptosporidium parvum
LDQFNLWTTDIWLNIIVA

SEQ ID NO: 2344368 - protein, 24 aa, Cryptosporidium parvum
LEAYYWKEGWILPKTTLDLQKSEL

SEQ ID NO: 2344369 - protein, 17 aa, Cryptosporidium parvum
LEEDLRVPTEFDNTCRV

SEQ ID NO: 2344370 - protein, 19 aa, Cryptosporidium parvum
LEHINCGAYAAGIVSGILD

SEQ ID NO: 2344371 - protein, 18 aa, Cryptosporidium parvum
LEKFQGYWVLLRSNSDSL

SEQ ID NO: 2344372 - protein, 17 aa, Cryptosporidium parvum
LELPIEGVFDLKVPNII

SEQ ID NO: 2344373 - protein, 28 aa, Cryptosporidium parvum
LENICWKSQCYVDILPLDFCDVNHSLLN

SEQ ID NO: 2344374 - protein, 26 aa, Cryptosporidium parvum
LENVVESFLGFASRLCTDVQHTLPQL

SEQ ID NO: 2344375 - protein, 18 aa, Cryptosporidium parvum
LEPCFKSIIYNIPQVGSG

SEQ ID NO: 2344376 - protein, 20 aa, Cryptosporidium parvum
LEPILKEIDIRNEIIRFYQN

SEQ ID NO: 2344377 - protein, 17 aa, Cryptosporidium parvum
LERGIRLLKPRLRQLTI

SEQ ID NO: 2344378 - protein, 20 aa, Cryptosporidium parvum
LETHMGLALMQQAEWSKAQE

SEQ ID NO: 2344379 - protein, 20 aa, Cryptosporidium parvum
LFAAICVIRGIMVFILSPLL

SEQ ID NO: 2344380 - protein, 22 aa, Cryptosporidium parvum
LFDVPFRLEASFLLENSNVNVN

SEQ ID NO: 2344381 - protein, 18 aa, Cryptosporidium parvum
LFIIYFLVIYNNEWNSLD

SEQ ID NO: 2344382 - protein, 17 aa, Cryptosporidium parvum
LFINWIINLIKNNEFRS

SEQ ID NO: 2344383 - protein, 30 aa, Cryptosporidium parvum; identical to SEQ ID NO: 2234330

SEQ ID NO: 2344384 - protein, 23 aa, Cryptosporidium parvum
LFMSAWGPTCFRPKAQESHFHFV

SEQ ID NO: 2344385 - protein, 18 aa, Cryptosporidium parvum
LFQLILISPYFTMKSLNS

SEQ ID NO: 2344386 - protein, 18 aa, Cryptosporidium parvum
LFSGTGIALAQSIGALNI

SEQ ID NO: 2344387 - protein, 19 aa, Cryptosporidium parvum
LFTACIERAIYLSLNHNSS

SEQ ID NO: 2344388 - protein, 22 aa, Cryptosporidium parvum
LFVFSWPISKFLDYFIGENGKT

SEQ ID NO: 2344389 - protein, 26 aa, Cryptosporidium parvum
LFYVVFTILIGFIFIIGILGAFFYLG

SEQ ID NO: 2344390 - protein, 19 aa, Cryptosporidium parvum
LGFSPTFMGSLRLTYGIAG

SEQ ID NO: 2344391 - protein, 19 aa, Cryptosporidium parvum
LGGVKKRPLVKKTPRPVFL

SEQ ID NO: 2344392 - protein, 25 aa, Cryptosporidium parvum
LGSPRIQLFSDLECNLYRGLSKINE

SEQ ID NO: 2344393 - protein, 22 aa, Cryptosporidium parvum
LHILLWPHLIHFIYELLPVAIT

SEQ ID NO: 2344394 - protein, 28 aa, Cryptosporidium parvum
LHMDRFSYKHIHRYLKLNSARLCQKLSL

SEQ ID NO: 2344395 - protein, 24 aa, Cryptosporidium parvum
LIDPRQMEHWENLHGMLYEDNKTA

SEQ ID NO: 2344396 - protein, 24 aa, Cryptosporidium parvum
LIEGIICSVEYCQCLQYTMSSSGL

SEQ ID NO: 2344397 - protein, 23 aa, Cryptosporidium parvum
LIFKAIKYIIKFFIINNYDGSAK

SEQ ID NO: 2344398 - protein, 18 aa, Cryptosporidium parvum
LIFPKIGQFFYGKRLYSL

SEQ ID NO: 2344399 - protein, 20 aa, Cryptosporidium parvum
LIICIWNVNIGFGHNDDPAS

SEQ ID NO: 2344400 - protein, 22 aa, Cryptosporidium parvum
LIIIMIFFFCRFYDNYKSYRKK

SEQ ID NO: 2344401 - protein, 26 aa, Cryptosporidium parvum
LIISCIIGGFCFCGATGANRNHGNMP

SEQ ID NO: 2344402 - protein, 17 aa, Cryptosporidium parvum
LIIVEFLVSFNLGLKIV

SEQ ID NO: 2344403 - protein, 18 aa, Cryptosporidium parvum
LIKGELWVQTKNRNNGYC

SEQ ID NO: 2344404 - protein, 27 aa, Cryptosporidium parvum
LIKNNEFRSSGILEYISPYSPLIILSC

SEQ ID NO: 2344405 - protein, 24 aa, Cryptosporidium parvum
LINDWIHFEISFIINIARMNQIDM

SEQ ID NO: 2344406 - protein, 29 aa, Cryptosporidium parvum
LINLWSGLNKFILILFYSYMQYKQIITKI

SEQ ID NO: 2344407 - protein, 17 aa, Cryptosporidium parvum
LIQLKIESFQLFHFDIK

SEQ ID NO: 2344408 - protein, 17 aa, Cryptosporidium parvum
LIRDKFKPVSKIFENLK

SEQ ID NO: 2344409 - protein, 19 aa, Cryptosporidium parvum
LISDCSFISPFISAALSSN

SEQ ID NO: 2344410 - protein, 23 aa, Cryptosporidium parvum
LITILGVFFMLLALFGVSFLLLL

SEQ ID NO: 2344411 - protein, 26 aa, Cryptosporidium parvum
LITVMCLTNLLGLKDKFFLIFYSSQV

SEQ ID NO: 2344412 - protein, 19 aa, Cryptosporidium parvum
LIVTCTWAFQFEPLLESNS

SEQ ID NO: 2344413 - protein, 20 aa, Cryptosporidium parvum
LIYCSYCSIQRAGVKQINTL

SEQ ID NO: 2344414 - protein, 25 aa, Cryptosporidium parvum
LIYGEAIGLLGYMHALGIGTSPDLK

SEQ ID NO: 2344415 - protein, 18 aa, Cryptosporidium parvum
LKALIALHRRTGEFDNAP

SEQ ID NO: 2344416 - protein, 19 aa, Cryptosporidium parvum
LKFMSMSNLIVFNAGGATT

SEQ ID NO: 2344417 - protein, 18 aa, Cryptosporidium parvum
LKGFENMKERSYCENAFD

SEQ ID NO: 2344418 - protein, 26 aa, Cryptosporidium parvum
LKHILKCKPFEWYIGKFRPAFERQGE

SEQ ID NO: 2344419 - protein, 20 aa, Cryptosporidium parvum
LKHYLTILLHMDRFSYKHIH

SEQ ID NO: 2344420 - protein, 21 aa, Cryptosporidium parvum
LKILPKIVGLPSYLSRLPSFS

SEQ ID NO: 2344421 - protein, 24 aa, Cryptosporidium parvum
LKILPQDIMIRIGMTNPPYILDQI

SEQ ID NO: 2344422 - protein, 19 aa, Cryptosporidium parvum
LKIMPEIDLELLIDEHSQR

SEQ ID NO: 2344423 - protein, 18 aa, Cryptosporidium parvum
LKKTGFSGSGPRSDSASA

SEQ ID NO: 2344424 - protein, 17 aa, Cryptosporidium parvum
LKLLVYIYTKWTKTRGD

SEQ ID NO: 2344425 - protein, 17 aa, Cryptosporidium parvum
LKLSLSEGGMKYSEGNY

SEQ ID NO: 2344426 - protein, 26 aa, Cryptosporidium parvum
LKNKLMDIGRFCDIFEKIHIYMIGVL

SEQ ID NO: 2344427 - protein, 17 aa, Cryptosporidium parvum
LKNKLYIERSVMESLNL

SEQ ID NO: 2344428 - protein, 25 aa, Cryptosporidium parvum
LKRIRLKHIFLIFIFTVLYVSCFLM

SEQ ID NO: 2344429 - protein, 19 aa, Cryptosporidium parvum
LKSDISGVVVYAIEDKTQV

SEQ ID NO: 2344430 - protein, 19 aa, Cryptosporidium parvum
LKVIKRLPPDIILKQNIES

SEQ ID NO: 2344431 - protein, 18 aa, Cryptosporidium parvum
LKYWKRLNSELDEFIERK

SEQ ID NO: 2344432 - protein, 24 aa, Cryptosporidium parvum
LLALIRLSLFLPFVPSNCLLSLTD

SEQ ID NO: 2344433 - protein, 20 aa, Cryptosporidium parvum
LLEISLKYLLCNRYDSSELK

SEQ ID NO: 2344434 - protein, 26 aa, Cryptosporidium parvum
LLESKARFKLAKIMISSFIYSPVDNH

SEQ ID NO: 2344435 - protein, 23 aa, Cryptosporidium parvum
LLGRAACTFGGSSFDISINKINR

SEQ ID NO: 2344436 - protein, 18 aa, Cryptosporidium parvum
LLKQEFEQKINFKDYNIF

SEQ ID NO: 2344437 - protein, 25 aa, Cryptosporidium parvum
LLKSWGYITMCYFVEKYPFPEKILF

SEQ ID NO: 2344438 - protein, 18 aa, Cryptosporidium parvum
LLLSFFVILFICFGVIDM

SEQ ID NO: 2344439 - protein, 19 aa, Cryptosporidium parvum
LLMNICIIPIFSIDIFYFR

SEQ ID NO: 2344440 - protein, 21 aa, Cryptosporidium parvum
LLMSILGRWIFNHQLNINSYL

SEQ ID NO: 2344441 - protein, 23 aa, Cryptosporidium parvum
LLNKKVMNFWGLETNKLINDHYN

SEQ ID NO: 2344442 - protein, 17 aa, Cryptosporidium parvum
LLNLHSKHCIFSLTNKT

SEQ ID NO: 2344443 - protein, 18 aa, Cryptosporidium parvum
LLNSLSFKSLRDSIPKFW

SEQ ID NO: 2344444 - protein, 25 aa, Cryptosporidium parvum
LLPPEHFRKAPPRCVSKQTVFTHYY

SEQ ID NO: 2344445 - protein, 20 aa, Cryptosporidium parvum
LLQFDYKIARNIILNDSIYY

SEQ ID NO: 2344446 - protein, 28 aa, Cryptosporidium parvum
LLSKCISNCPGFLPIMLHLIIPKNENML

SEQ ID NO: 2344447 - protein, 18 aa, Cryptosporidium parvum
LLSQRIVYYFTNNRIGFG

SEQ ID NO: 2344448 - protein, 27 aa, Cryptosporidium parvum
LLYGLPVCPLPSMPFNKMAIYNQSQIY

SEQ ID NO: 2344449 - protein, 18 aa, Cryptosporidium parvum
LMHCISMGTLDWIHCIQA

SEQ ID NO: 2344450 - protein, 22 aa, Cryptosporidium parvum
LMNTCRIRHGALTLALEHWVED

SEQ ID NO: 2344451 - protein, 17 aa, Cryptosporidium parvum
LNGILRSLILTKLELLE

SEQ ID NO: 2344452 - protein, 31 aa, Cryptosporidium parvum
LNHFRLDEQTIRWSIENMLSRGIIQIVTKEE

SEQ ID NO: 2344453 - protein, 22 aa, Cryptosporidium parvum
LNIYQLWSGLWITILRDVPFTA

SEQ ID NO: 2344454 - protein, 25 aa, Cryptosporidium parvum
LNKSLNILPFKGFEILDKYFNNSIL

SEQ ID NO: 2344455 - protein, 20 aa, Cryptosporidium parvum
LNSARLCQKLSLLAQSTLLY

SEQ ID NO: 2344456 - protein, 23 aa, Cryptosporidium parvum
LNTPFKILVKFSRSSVTSSKITL

SEQ ID NO: 2344457 - protein, 21 aa, Cryptosporidium parvum
LNTPIRLLRAMEFINSTETNQ

SEQ ID NO: 2344458 - protein, 37 aa, Cryptosporidium parvum
LPEKEQESIFTYIWNIIKAIFTRRRWSSNSKSYSMYA

SEQ ID NO: 2344459 - protein, 19 aa, Cryptosporidium parvum
LPENCEIIGIATLEDIIEE

SEQ ID NO: 2344460 - protein, 21 aa, Cryptosporidium parvum
LPFWCIYLYFCAFSALRSFIF

SEQ ID NO: 2344461 - protein, 19 aa, Cryptosporidium parvum
LPHLMLKLDTLAVEPNSKF

SEQ ID NO: 2344462 - protein, 19 aa, Cryptosporidium parvum
LPKSNILGLRYPNYRRDRH

SEQ ID NO: 2344463 - protein, 25 aa, Cryptosporidium parvum
LPLPKNLEIFSWWYRFILSTPSRVF

SEQ ID NO: 2344464 - protein, 24 aa, Cryptosporidium parvum
LPQISSIIRWRLNTPSPRARQTAA

SEQ ID NO: 2344465 - protein, 28 aa, Cryptosporidium parvum
LPTLEFSNWLLTNWVFRTISNLPILFSD

SEQ ID NO: 2344466 - protein, 24 aa, Cryptosporidium parvum
LQCEIKFFLKPERNIQIPYSQIVN

SEQ ID NO: 2344467 - protein, 26 aa, Cryptosporidium parvum
LQDLEAITAMLDRLCVNNINSISNST

SEQ ID NO: 2344468 - protein, 17 aa, Cryptosporidium parvum
LQFIQQWSDIIAKIINK

SEQ ID NO: 2344469 - protein, 17 aa, Cryptosporidium parvum
LQIIFKKLFNPHETLII

SEQ ID NO: 2344470 - protein, 18 aa, Cryptosporidium parvum
LQILKVFIYERYFKAQSA

SEQ ID NO: 2344471 - protein, 18 aa, Cryptosporidium parvum
LQKGGRYQGSMRETKAIG

SEQ ID NO: 2344472 - protein, 17 aa, Cryptosporidium parvum
LQNPRWTSSEVNNDGFG

SEQ ID NO: 2344473 - protein, 17 aa, Cryptosporidium parvum
LRDLLIQSLRNSGRSEL

SEQ ID NO: 2344474 - protein, 24 aa, Cryptosporidium parvum
LRDSIPKFWSLLFDIMLGPDLDSK

SEQ ID NO: 2344475 - protein, 22 aa, Cryptosporidium parvum
LREAMLQSFWCIHALQHALITA

SEQ ID NO: 2344476 - protein, 21 aa, Cryptosporidium parvum
LRGGVSMALAMVFEGDTSVPG

SEQ ID NO: 2344477 - protein, 19 aa, Cryptosporidium parvum
LRHSGCVALNGILRSLILT

SEQ ID NO: 2344478 - protein, 26 aa, Cryptosporidium parvum
LRIIRELYRYRGLRTFWTGLLPTMMF

SEQ ID NO: 2344479 - protein, 20 aa, Cryptosporidium parvum
LRITDKLAISEEVLKKTLET

SEQ ID NO: 2344480 - protein, 20 aa, Cryptosporidium parvum
LRKTLFTEFIPKISNEEKKW

SEQ ID NO: 2344481 - protein, 17 aa, Cryptosporidium parvum
LRLIKDPVEIKIALEEK

SEQ ID NO: 2344482 - protein, 19 aa, Cryptosporidium parvum
LRMFYFRAVEVTINRWEWC

SEQ ID NO: 2344483 - protein, 29 aa, Cryptosporidium parvum
LRNAPKRTGYRPVPGVLIYPQNFREPRVL

SEQ ID NO: 2344484 - protein, 28 aa, Cryptosporidium parvum
LRPDKYSILLSRVLWLLPHDSPDGKYLS

SEQ ID NO: 2344485 - protein, 24 aa, Cryptosporidium parvum
LRPNIFAFEYIYLLSPVLSTLTKL

SEQ ID NO: 2344486 - protein, 24 aa, Cryptosporidium parvum
LRRLLELLQHLIFYEIPRYSPIGL

SEQ ID NO: 2344487 - protein, 19 aa, Cryptosporidium parvum
LRSGGCMALLISNGLVMLL

SEQ ID NO: 2344488 - protein, 18 aa, Cryptosporidium parvum
LRSLSANIFLEIHRLLEE

SEQ ID NO: 2344489 - protein, 20 aa, Cryptosporidium parvum
LRSQLNVDFVPAFVHLLYHI

SEQ ID NO: 2344490 - protein, 17 aa, Cryptosporidium parvum
LRSSISYVQQNPILFSG

SEQ ID NO: 2344491 - protein, 26 aa, Cryptosporidium parvum
LRVPTEFDNTCRVLFSSVAEDGGDCF

SEQ ID NO: 2344492 - protein, 17 aa, Cryptosporidium parvum
LRYKLSPKLLENSSNSS

SEQ ID NO: 2344493 - protein, 20 aa, Cryptosporidium parvum
LSEIFCDSLLLNITCVLGYV

SEQ ID NO: 2344494 - protein, 17 aa, Cryptosporidium parvum
LSESILQPHMASIVCEA

SEQ ID NO: 2344495 - protein, 28 aa, Cryptosporidium parvum
LSEYKLDKSFLHIGSAFFSMAIAEILSD

SEQ ID NO: 2344496 - protein, 30 aa, Cryptosporidium parvum; identical to SEQ ID NO: 2125729

SEQ ID NO: 2344497 - protein, 24 aa, Cryptosporidium parvum
LSGFYGHLYFIFALLLIGVSFYFA

SEQ ID NO: 2344498 - protein, 17 aa, Cryptosporidium parvum
LSGNPLRIFIEEISMIY

SEQ ID NO: 2344499 - protein, 23 aa, Cryptosporidium parvum
LSICTEYPIITSFILMLNSGLTI

SEQ ID NO: 2344500 - protein, 18 aa, Cryptosporidium parvum
LSIISTCILSLILSLIWI

SEQ ID NO: 2344501 - protein, 17 aa, Cryptosporidium parvum
LSILRSLFRSITPGGKA

SEQ ID NO: 2344502 - protein, 21 aa, Cryptosporidium parvum
LSILVLFSWISIVIGGEGNLD

SEQ ID NO: 2344503 - protein, 26 aa, Cryptosporidium parvum
LSLLLVKINMTYKCEIFYIDAELLIT

SEQ ID NO: 2344504 - protein, 19 aa, Cryptosporidium parvum
LSQDMGWVSFMCLLSTFMT

SEQ ID NO: 2344505 - protein, 29 aa, Cryptosporidium parvum
LSRMLWSRYIFCCLLFFIWYICTWFVGAH

SEQ ID NO: 2344506 - protein, 24 aa, Cryptosporidium parvum
LSSGIICCAAFGSLLLIFRKYIPH

SEQ ID NO: 2344507 - protein, 28 aa, Cryptosporidium parvum
LSSLKVYPLFARGWITWAQYTDRLLYIH

SEQ ID NO: 2344508 - protein, 36 aa, Cryptosporidium parvum
LSVISSRLFSLWLFVQKRLTTIQIAIKVMKESKELT

SEQ ID NO: 2344509 - protein, 21 aa, Cryptosporidium parvum
LSVIVSAVFSAPAVPLRGTLK

SEQ ID NO: 2344510 - protein, 17 aa, Cryptosporidium parvum
LTALLLLSIATFHGRQY

SEQ ID NO: 2344511 - protein, 25 aa, Cryptosporidium parvum
LTCFLDCNYSYMFLSDYTKGEEYCN

SEQ ID NO: 2344512 - protein, 23 aa, Cryptosporidium parvum
LTLEGKDAISFIIESGNKKLLNK

SEQ ID NO: 2344513 - protein, 28 aa, Cryptosporidium parvum
LTLRNLFGLYCHVVFSLCKFVSVIINAI

SEQ ID NO: 2344514 - protein, 23 aa, Cryptosporidium parvum
LTMLPPKFSRNSWINHLPENLQN

SEQ ID NO: 2344515 - protein, 17 aa, Cryptosporidium parvum
LTVELILNTKIENCNSK

SEQ ID NO: 2344516 - protein, 26 aa, Cryptosporidium parvum
LTVPARLKSLLPYMGQLISPMLNALE

SEQ ID NO: 2344517 - protein, 20 aa, Cryptosporidium parvum
LVALTRLYGVSEVRLTVRRA

SEQ ID NO: 2344518 - protein, 24 aa, Cryptosporidium parvum
LVGRLLERVICRFSEISNRKKEDS

SEQ ID NO: 2344519 - protein, 24 aa, Cryptosporidium parvum
LVKSYCLESIMFNKYYKVITEVEN

SEQ ID NO: 2344520 - protein, 18 aa, Cryptosporidium parvum
LVPFCLISMVLSVVYRNK

SEQ ID NO: 2344521 - protein, 25 aa, Cryptosporidium parvum
LVPLPCLGFLTSVFEGEVSPEYTIA

SEQ ID NO: 2344522 - protein, 19 aa, Cryptosporidium parvum
LVSEELWSSILTRVSSMMC

SEQ ID NO: 2344523 - protein, 23 aa, Cryptosporidium parvum
LVSTRVISCLDISKTKRNYDSIN

SEQ ID NO: 2344524 - protein, 18 aa, Cryptosporidium parvum
LVYLKSYLSSLLIMNDNN

SEQ ID NO: 2344525 - protein, 20 aa, Cryptosporidium parvum
LWYLPSDKIFPFPITSNKCS

SEQ ID NO: 2344526 - protein, 19 aa, Cryptosporidium parvum
LYLFQCELFYKMKIKNVVF

SEQ ID NO: 2344527 - protein, 17 aa, Cryptosporidium parvum
LYLRFVRQTIIRNFVRS

SEQ ID NO: 2344528 - protein, 18 aa, Cryptosporidium parvum
LYLSRPFPFTLLNTIFFF

SEQ ID NO: 2344529 - protein, 28 aa, Cryptosporidium parvum
LYPRSSKRLKLIAVVPFKGIFSTNTIQL

SEQ ID NO: 2344530 - protein, 24 aa, Cryptosporidium parvum
LYSAELRLPFLSAKERREKVRILL

SEQ ID NO: 2344531 - protein, 21 aa, Cryptosporidium parvum
LYTECGYTFISKSNFVIKDWF

SEQ ID NO: 2344532 - protein, 18 aa, Cryptosporidium parvum
LYYKLDPFLKEWKNPDIQ

SEQ ID NO: 2344533 - protein, 22 aa, Cryptosporidium parvum
MCVHVFLGILFFCFLSSERSLM

SEQ ID NO: 2344534 - protein, 17 aa, Cryptosporidium parvum
MDEAIDLLTKCSETLRK

SEQ ID NO: 2344535 - protein, 23 aa, Cryptosporidium parvum
MDHHCPWINNCVGFYNRKFFIQL

SEQ ID NO: 2344536 - protein, 24 aa, Cryptosporidium parvum
MELEPERFQSLMIVQSLNDKIVPT

SEQ ID NO: 2344537 - protein, 26 aa, Cryptosporidium parvum
MFCFGVFAMEMFIDRFISFPQFLSAI

SEQ ID NO: 2344538 - protein, 23 aa, Cryptosporidium parvum
MGGDPKLTFSQFFDILKHGDDSG

SEQ ID NO: 2344539 - protein, 18 aa, Cryptosporidium parvum
MGLIFICIDYLIRTSNFS

SEQ ID NO: 2344540 - protein, 24 aa, Cryptosporidium parvum
MGLLFELMCYLGLTMISYNYTNQL

SEQ ID NO: 2344541 - protein, 28 aa, Cryptosporidium parvum
MIACSKIILWFVHFFRGFNGDEHISETL

SEQ ID NO: 2344542 - protein, 20 aa, Cryptosporidium parvum
MILITKFLKKILVGTLRAGF

SEQ ID NO: 2344543 - protein, 21 aa, Cryptosporidium parvum
MKAFEELKCHWLFGNHTNALD

SEQ ID NO: 2344544 - protein, 18 aa, Cryptosporidium parvum
MKTYLVPLPCLGFLTSVF

SEQ ID NO: 2344545 - protein, 17 aa, Cryptosporidium parvum
MLLDYPISLAFDLYYTF

SEQ ID NO: 2344546 - protein, 17 aa, Cryptosporidium parvum
MLLQVFYYLSFIFSLIN

SEQ ID NO: 2344547 - protein, 17 aa, Cryptosporidium parvum
MLMNLFLLFAAICVIRG

SEQ ID NO: 2344548 - protein, 17 aa, Cryptosporidium parvum
MNGDLAFQMIFEEFYME

SEQ ID NO: 2344549 - protein, 20 aa, Cryptosporidium parvum
MNLDPGDLFKMIECRIQNFI

SEQ ID NO: 2344550 - protein, 18 aa, Cryptosporidium parvum
MNQIPSLLFDGANCLFLK

SEQ ID NO: 2344551 - protein, 26 aa, Cryptosporidium parvum
MNRGFIPFILCGDLSPINNIDPKDQD

SEQ ID NO: 2344552 - protein, 18 aa, Cryptosporidium parvum
MNVSDCLSQILSRDKLDL

SEQ ID NO: 2344553 - protein, 17 aa, Cryptosporidium parvum
MRIFRPYWSDGRMWINL

SEQ ID NO: 2344554 - protein, 19 aa, Cryptosporidium parvum
MRISQDWSGSAINRSPDGN

SEQ ID NO: 2344555 - protein, 24 aa, Cryptosporidium parvum
MRTSSKFLVYFPSILIESLRSKEF

SEQ ID NO: 2344556 - protein, 18 aa, Cryptosporidium parvum
MSHIAMILLLFNINLMEA

SEQ ID NO: 2344557 - protein, 20 aa, Cryptosporidium parvum
MSLLFYIIFQKFREINQKTE

SEQ ID NO: 2344558 - protein, 20 aa, Cryptosporidium parvum
MSPQISLIFHYWGVQQHTAK

SEQ ID NO: 2344559 - protein, 17 aa, Cryptosporidium parvum
MTKIRLLLIESIPSDFD

SEQ ID NO: 2344560 - protein, 17 aa, Cryptosporidium parvum
MTVVCLFGICAPSSAFL

SEQ ID NO: 2344561 - protein, 17 aa, Cryptosporidium parvum
MTVYGIPIIDKGIESDL

SEQ ID NO: 2344562 - protein, 25 aa, Cryptosporidium parvum
MYTQWLQFYSCNTIEHSLHYILLSC

SEQ ID NO: 2344563 - protein, 18 aa, Cryptosporidium parvum
NCSLFFDRCTSILTISVC

SEQ ID NO: 2344564 - protein, 18 aa, Cryptosporidium parvum
NDFYAFFMITWSSCMIIT

SEQ ID NO: 2344565 - protein, 18 aa, Cryptosporidium parvum
NDGFGGGVNRIVGGGGGV

SEQ ID NO: 2344566 - protein, 20 aa, Cryptosporidium parvum
NDYKSFFISNGIFIINGKLI

SEQ ID NO: 2344567 - protein, 25 aa, Cryptosporidium parvum
NEDIWRNIFGLIWVIFYTKPFKPKD

SEQ ID NO: 2344568 - protein, 22 aa, Cryptosporidium parvum
NEGFCPNTLLELHKNLRPIYIY

SEQ ID NO: 2344569 - protein, 30 aa, Cryptosporidium parvum; identical to SEQ ID NO: 2235697

SEQ ID NO: 2344570 - protein, 25 aa, Cryptosporidium parvum
NELMYCFFCRIFIYLKKIKINNSII

SEQ ID NO: 2344571 - protein, 17 aa, Cryptosporidium parvum
NEQWQLLRLYGVLNSPQ

SEQ ID NO: 2344572 - protein, 28 aa, Cryptosporidium parvum
NFIEDCLKLNFKGSLIFQNNESNKVEQT

SEQ ID NO: 2344573 - protein, 26 aa, Cryptosporidium parvum
NFQWFALEWFLCFFVTSLPLKSIMEI

SEQ ID NO: 2344574 - protein, 18 aa, Cryptosporidium parvum
NFREPRVLEAISHKKLKG

SEQ ID NO: 2344575 - protein, 20 aa, Cryptosporidium parvum
NFSKVFTFFNFVWKIILFFI

SEQ ID NO: 2344576 - protein, 19 aa, Cryptosporidium parvum
NFVIKDWFASQSIFKFYLL

SEQ ID NO: 2344577 - protein, 19 aa, Cryptosporidium parvum
NGDNIFLKINWKNNIQKFI

SEQ ID NO: 2344578 - protein, 22 aa, Cryptosporidium parvum
NGLNDLVCNLSLIGGSKKIDQT

SEQ ID NO: 2344579 - protein, 19 aa, Cryptosporidium parvum
NGLTPFYFLLKDGMSTNTE

SEQ ID NO: 2344580 - protein, 33 aa, Cryptosporidium parvum
NGMGYVYFHGCEGFERNFRLAFHHFNESAFHLF

SEQ ID NO: 2344581 - protein, 31 aa, Cryptosporidium parvum; identical to SEQ ID NO: 2126133

SEQ ID NO: 2344582 - protein, 27 aa, Cryptosporidium parvum
NIAQGFEFWHIIAMIIVAIVALKLINY

SEQ ID NO: 2344583 - protein, 19 aa, Cryptosporidium parvum
NIFFYCTHLEIPLMQNNNV

SEQ ID NO: 2344584 - protein, 27 aa, Cryptosporidium parvum
NIQKVVYCLYSLLGIAFILFKLGTMGL

SEQ ID NO: 2344585 - protein, 23 aa, Cryptosporidium parvum
NISENQPLIGIVVGTGVNACYLE

SEQ ID NO: 2344586 - protein, 24 aa, Cryptosporidium parvum
NISSLRLSTAFSFAAFLICSLTLC

SEQ ID NO: 2344587 - protein, 22 aa, Cryptosporidium parvum
NKCPTRISSQLFLFDSDANLCG

SEQ ID NO: 2344588 - protein, 20 aa, Cryptosporidium parvum
NKFSENFKFVPLNTHIFNIF

SEQ ID NO: 2344589 - protein, 17 aa, Cryptosporidium parvum
NKIFWELFLNDFCSKKV

SEQ ID NO: 2344590 - protein, 19 aa, Cryptosporidium parvum
NKIQVSICGIKDARFGLIS

SEQ ID NO: 2344591 - protein, 20 aa, Cryptosporidium parvum
NKKKKGWIGKLLNGQKIEIP

SEQ ID NO: 2344592 - protein, 22 aa, Cryptosporidium parvum
NKLPLWVSWIKYISFQRYSYSA

SEQ ID NO: 2344593 - protein, 21 aa, Cryptosporidium parvum
NKRFKSVLSNYCNRIKNTQQI

SEQ ID NO: 2344594 - protein, 19 aa, Cryptosporidium parvum
NLAKAVGLATMIATMRPDI

SEQ ID NO: 2344595 - protein, 25 aa, Cryptosporidium parvum
NLEFPMSKFWMMGFFDAFSSILTLL

SEQ ID NO: 2344596 - protein, 18 aa, Cryptosporidium parvum
NLEYLLKMMELRKWINES

SEQ ID NO: 2344597 - protein, 18 aa, Cryptosporidium parvum
NLFLDIEVLFSFITARVD

SEQ ID NO: 2344598 - protein, 19 aa, Cryptosporidium parvum
NLFLLFAAICVIRGIMVFI

SEQ ID NO: 2344599 - protein, 26 aa, Cryptosporidium parvum
NLFWGDWPPSYSWVFFLGNILFYEIS

SEQ ID NO: 2344600 - protein, 24 aa, Cryptosporidium parvum
NLLQVPHWFNFMAIESESQQEITN

SEQ ID NO: 2344601 - protein, 20 aa, Cryptosporidium parvum
NLTPRLKILGSLGIATSIYY

SEQ ID NO: 2344602 - protein, 24 aa, Cryptosporidium parvum
NLVLKTLLLLLLEYLIINFPGVSS

SEQ ID NO: 2344603 - protein, 26 aa, Cryptosporidium parvum
NLVNRPSNIFSILITSCCRLLFDSPE

SEQ ID NO: 2344604 - protein, 17 aa, Cryptosporidium parvum
NLYFFKKIEQISGGNLF

SEQ ID NO: 2344605 - protein, 20 aa, Cryptosporidium parvum
NNIPCSYRGILWNISVGNNL

SEQ ID NO: 2344606 - protein, 22 aa, Cryptosporidium parvum
NNKIIVCALIMELIEVLSKKLT

SEQ ID NO: 2344607 - protein, 22 aa, Cryptosporidium parvum
NNKRIRFVAIRPIGNIIAIGYS

SEQ ID NO: 2344608 - protein, 26 aa, Cryptosporidium parvum
NNLGECPLRRVIYGFMTKIRLLLIES

SEQ ID NO: 2344609 - protein, 17 aa, Cryptosporidium parvum
NNSEFWLNYTALNSDSW

SEQ ID NO: 2344610 - protein, 24 aa, Cryptosporidium parvum
NNSEFWWSNSYRVYMEMLITESKD

SEQ ID NO: 2344611 - protein, 23 aa, Cryptosporidium parvum
NNSRYEEFDSFKIINEALENLSG

SEQ ID NO: 2344612 - protein, 20 aa, Cryptosporidium parvum
NPKINAIVVYKGSKDEIPKI

SEQ ID NO: 2344613 - protein, 22 aa, Cryptosporidium parvum
NPKRNICVHIDNNLKIMPEIDL

SEQ ID NO: 2344614 - protein, 18 aa, Cryptosporidium parvum
NPPILPATLLLHLSTKLR

SEQ ID NO: 2344615 - protein, 19 aa, Cryptosporidium parvum
NREGFKMIETRSIVPSYKL

SEQ ID NO: 2344616 - protein, 26 aa, Cryptosporidium parvum
NRFFPYLLRHVKGWQPYQALLLQIFI

SEQ ID NO: 2344617 - protein, 23 aa, Cryptosporidium parvum
NRFTYKHFVVYIVFYVIGTILNL

SEQ ID NO: 2344618 - protein, 27 aa, Cryptosporidium parvum
NRSIVFASLCFYFRDSVSMSCTVLPGE

SEQ ID NO: 2344619 - protein, 21 aa, Cryptosporidium parvum
NSFNLYWIIPHMVAVFFMGSF

SEQ ID NO: 2344620 - protein, 32 aa, Cryptosporidium parvum; identical to SEQ ID NO: 2236131

SEQ ID NO: 2344621 - protein, 17 aa, Cryptosporidium parvum
NSILNWFTISPKATDRS

SEQ ID NO: 2344622 - protein, 19 aa, Cryptosporidium parvum
NSIRRSSSFFKFDKSINDY

SEQ ID NO: 2344623 - protein, 26 aa, Cryptosporidium parvum
NSLCEEWPSLLVIDFLEYYASSNRSA

SEQ ID NO: 2344624 - protein, 21 aa, Cryptosporidium parvum
NSLEAYCLIISSLSHDLDHPG

SEQ ID NO: 2344625 - protein, 21 aa, Cryptosporidium parvum
NSLQVVDFVLRLIKDPVEIKI

SEQ ID NO: 2344626 - protein, 18 aa, Cryptosporidium parvum
NSNVFRQHIIVLLRDFGL

SEQ ID NO: 2344627 - protein, 26 aa, Cryptosporidium parvum
NSRKSMQRCCKMNKYQIYRILITILG

SEQ ID NO: 2344628 - protein, 22 aa, Cryptosporidium parvum
NSRKTVGMGWELQRKLTKLGYN

SEQ ID NO: 2344629 - protein, 21 aa, Cryptosporidium parvum
NSSPCPVDCVLSFWSPWTGCS

SEQ ID NO: 2344630 - protein, 24 aa, Cryptosporidium parvum
NSTAAFGLYWGCRNKDTIVSKHGE

SEQ ID NO: 2344631 - protein, 20 aa, Cryptosporidium parvum
NSTPPLLKICGFDITEKLSG

SEQ ID NO: 2344632 - protein, 19 aa, Cryptosporidium parvum
NTDFNGCRTFAIKKKHGKS

SEQ ID NO: 2344633 - protein, 26 aa, Cryptosporidium parvum
NTEPGRVPAKWGFRVGDESKRRRYCK

SEQ ID NO: 2344634 - protein, 36 aa, Cryptosporidium parvum; identical to SEQ ID NO: 2236202

SEQ ID NO: 2344635 - protein, 19 aa, Cryptosporidium parvum
NTPDCRYYSYGAFLKGPGS

SEQ ID NO: 2344636 - protein, 24 aa, Cryptosporidium parvum
NTTSFEAFHIFKLFVANPNKSPGI

SEQ ID NO: 2344637 - protein, 27 aa, Cryptosporidium parvum
NVGNLPLEVGFTFSFPIVQSKIASAKL

SEQ ID NO: 2344638 - protein, 20 aa, Cryptosporidium parvum
NVICNVFSVLVLKHGTASTG

SEQ ID NO: 2344639 - protein, 26 aa, Cryptosporidium parvum
NVLFKLLCKVLFYQGDFLECSIVLER

SEQ ID NO: 2344640 - protein, 21 aa, Cryptosporidium parvum
NVSLLIFKLIKNISMKYLNLV

SEQ ID NO: 2344641 - protein, 20 aa, Cryptosporidium parvum
NWFKEIYTFVQVYKTNSHLK

SEQ ID NO: 2344642 - protein, 26 aa, Cryptosporidium parvum
NWKNNIQKFIPFRFIKDCFISCIPVS

SEQ ID NO: 2344643 - protein, 26 aa, Cryptosporidium parvum
NWQNRICRESCPAFLSLKEVFQNKPK

SEQ ID NO: 2344644 - protein, 18 aa, Cryptosporidium parvum
NYDFKLANFDSIELNLVK

SEQ ID NO: 2344645 - protein, 19 aa, Cryptosporidium parvum
NYEKHSGIEITKFFNSRLI

SEQ ID NO: 2344646 - protein, 18 aa, Cryptosporidium parvum
NYVCLNFFLFKFDEESTK

SEQ ID NO: 2344647 - protein, 25 aa, Cryptosporidium parvum
PAIPWFLKPLFGMRRKPYLIFFSIL

SEQ ID NO: 2344648 - protein, 19 aa, Cryptosporidium parvum
PAPPIPLPVSQVLLSNFHR

SEQ ID NO: 2344649 - protein, 21 aa, Cryptosporidium parvum
PAVGVVFGFLISVWLRAAQAL

SEQ ID NO: 2344650 - protein, 30 aa, Cryptosporidium parvum; identical to SEQ ID NO: 2236300

SEQ ID NO: 2344651 - protein, 20 aa, Cryptosporidium parvum
PCKENFFLIVCMMSLLISSV

SEQ ID NO: 2344652 - protein, 20 aa, Cryptosporidium parvum
PCVRDSKFLVEMLLATECSS

SEQ ID NO: 2344653 - protein, 25 aa, Cryptosporidium parvum
PDADCELKWALSDSELALITKELIY

SEQ ID NO: 2344654 - protein, 21 aa, Cryptosporidium parvum
PDNIFKRSILRKFNSHDQSFL

SEQ ID NO: 2344655 - protein, 25 aa, Cryptosporidium parvum
PDPIDFRGLRGMLWSKINPEKFEMF

SEQ ID NO: 2344656 - protein, 24 aa, Cryptosporidium parvum
PEEDGPWFRICDGLVERLIPKIEF

SEQ ID NO: 2344657 - protein, 26 aa, Cryptosporidium parvum
PEEKELLELLASVLCYIHPQSFGDII

SEQ ID NO: 2344658 - protein, 17 aa, Cryptosporidium parvum
PEFPNLDDLMAIPVTLL

SEQ ID NO: 2344659 - protein, 26 aa, Cryptosporidium parvum
PEGAVKSLTGFGCLYTSTTEPTLGCA

SEQ ID NO: 2344660 - protein, 22 aa, Cryptosporidium parvum
PEVLIFMSLAKVVIEWEESSIP

SEQ ID NO: 2344661 - protein, 25 aa, Cryptosporidium parvum
PFAELPFDGLVGLGFPDKNSKKNNI

SEQ ID NO: 2344662 - protein, 20 aa, Cryptosporidium parvum
PFFWCEYLRYLNLSRNKFEE

SEQ ID NO: 2344663 - protein, 18 aa, Cryptosporidium parvum
PFIFLGLFQSIFLFCSGE

SEQ ID NO: 2344664 - protein, 25 aa, Cryptosporidium parvum
PGGKASGIYKEFLVILPWFLDTTIK

SEQ ID NO: 2344665 - protein, 20 aa, Cryptosporidium parvum
PGIIISLIISVATLRIGVIL

SEQ ID NO: 2344666 - protein, 20 aa, Cryptosporidium parvum
PGILSFSFKPMRFSDNSPFR

SEQ ID NO: 2344667 - protein, 23 aa, Cryptosporidium parvum
PGTEILRVFCGSPSVPSQAMEMT

SEQ ID NO: 2344668 - protein, 31 aa, Cryptosporidium parvum
PIGIGRRSICWTAFDFTELVPCVLKLYRLDF

SEQ ID NO: 2344669 - protein, 23 aa, Cryptosporidium parvum
PILCQSYCNLWYDACYEDYFDNI

SEQ ID NO: 2344670 - protein, 31 aa, Cryptosporidium parvum; identical to SEQ ID NO: 2126544

SEQ ID NO: 2344671 - protein, 18 aa, Cryptosporidium parvum
PISTCPSPDFTLVSNERC

SEQ ID NO: 2344672 - protein, 19 aa, Cryptosporidium parvum
PITDCDYSMDWFSDNRGEQ

SEQ ID NO: 2344673 - protein, 23 aa, Cryptosporidium parvum
PITKLCQAYHSLYDLLLGGINNN

SEQ ID NO: 2344674 - protein, 19 aa, Cryptosporidium parvum
PKSVIDHAIQIYPEVADQS

SEQ ID NO: 2344675 - protein, 19 aa, Cryptosporidium parvum
PKVSSFKLLLLLKKDIHFL

SEQ ID NO: 2344676 - protein, 19 aa, Cryptosporidium parvum
PKYISFCFFLGIMGSLHLM

SEQ ID NO: 2344677 - protein, 23 aa, Cryptosporidium parvum
PKYLSEEEFNIWIKNEKFPPINE

SEQ ID NO: 2344678 - protein, 21 aa, Cryptosporidium parvum
PLDEIKFIFLDLVDKQEKELN

SEQ ID NO: 2344679 - protein, 25 aa, Cryptosporidium parvum
PLDELLCAIRTLFQMTIEISPINDE

SEQ ID NO: 2344680 - protein, 18 aa, Cryptosporidium parvum
PLDVIKNYWIYKDSNEVF

SEQ ID NO: 2344681 - protein, 25 aa, Cryptosporidium parvum
PLMNTNIYLKWSRLVYEELENQKKL

SEQ ID NO: 2344682 - protein, 17 aa, Cryptosporidium parvum
PLTNCAKNLSSLYKNLK

SEQ ID NO: 2344683 - protein, 26 aa, Cryptosporidium parvum
PLWTMPLKMISLRKINTIIMMAMLPL

SEQ ID NO: 2344684 - protein, 17 aa, Cryptosporidium parvum
PNFKQKFIFAPKILEIL

SEQ ID NO: 2344685 - protein, 18 aa, Cryptosporidium parvum
PNIKDLWEYPDLIMYAKM

SEQ ID NO: 2344686 - protein, 17 aa, Cryptosporidium parvum
PNLGKTIFWDIIQVGDH

SEQ ID NO: 2344687 - protein, 22 aa, Cryptosporidium parvum
PPIGSCFDCYRPNQTPAEVTNQ

SEQ ID NO: 2344688 - protein, 17 aa, Cryptosporidium parvum
PPNCDWSISTLKILDKL

SEQ ID NO: 2344689 - protein, 17 aa, Cryptosporidium parvum
PPSVVGYFELIDCLENP

SEQ ID NO: 2344690 - protein, 19 aa, Cryptosporidium parvum
PREILKDILGLASVSEVNG

SEQ ID NO: 2344691 - protein, 17 aa, Cryptosporidium parvum
PRGPLFVLGNNFIRKYY

SEQ ID NO: 2344692 - protein, 19 aa, Cryptosporidium parvum
PRNLIYLVISLRFTNEKIS

SEQ ID NO: 2344693 - protein, 20 aa, Cryptosporidium parvum
PRPKFTVNKVLKLVLWLLGW

SEQ ID NO: 2344694 - protein, 26 aa, Cryptosporidium parvum
PRSTLNYLLYRALKLPNDFGKTRNFW

SEQ ID NO: 2344695 - protein, 21 aa, Cryptosporidium parvum
PSDFDLVLERYIFGILTFLSE

SEQ ID NO: 2344696 - protein, 19 aa, Cryptosporidium parvum
PSKPCSWETVGPAARGLTC

SEQ ID NO: 2344697 - protein, 20 aa, Cryptosporidium parvum
PSLILTSGWIFIRCALGGPL

SEQ ID NO: 2344698 - protein, 30 aa, Cryptosporidium parvum; identical to SEQ ID NO: 2236605

SEQ ID NO: 2344699 - protein, 26 aa, Cryptosporidium parvum
PSNPLDVFCLYSLRPDTDPTRRGRLK

SEQ ID NO: 2344700 - protein, 18 aa, Cryptosporidium parvum
PSSAFLESFFGHRTIFNG

SEQ ID NO: 2344701 - protein, 24 aa, Cryptosporidium parvum
PTEHHKLALSRYVVDPHIDNVESH

SEQ ID NO: 2344702 - protein, 22 aa, Cryptosporidium parvum
PTIDVLLCLFICFNATQISTFL

SEQ ID NO: 2344703 - protein, 24 aa, Cryptosporidium parvum
PVQQRSAILFTILLIKSLTILSPS

SEQ ID NO: 2344704 - protein, 17 aa, Cryptosporidium parvum
PVTKLLLSFFVILFICF

SEQ ID NO: 2344705 - protein, 19 aa, Cryptosporidium parvum
PVTTLVFFSPRLVGKEATE

SEQ ID NO: 2344706 - protein, 29 aa, Cryptosporidium parvum
PYEYSIKFANSFPIIFEKLIPEYCIAIDN

SEQ ID NO: 2344707 - protein, 21 aa, Cryptosporidium parvum
PYPRYWGLLTVIGRRTQSHNE

SEQ ID NO: 2344708 - protein, 21 aa, Cryptosporidium parvum
PYWSDGRMWINLVLVYIAMNI

SEQ ID NO: 2344709 - protein, 35 aa, Cryptosporidium parvum; identical to SEQ ID NO: 2236681

SEQ ID NO: 2344710 - protein, 20 aa, Cryptosporidium parvum
QAFMAFRMAIQKAVYFDTSS

SEQ ID NO: 2344711 - protein, 21 aa, Cryptosporidium parvum
QAGVFLSYSFSYVLSSFSTST

SEQ ID NO: 2344712 - protein, 19 aa, Cryptosporidium parvum
QAIQFRLQFIQQWSDIIAK

SEQ ID NO: 2344713 - protein, 21 aa, Cryptosporidium parvum
QAMFFLNIIKIIFIIHFFTLI

SEQ ID NO: 2344714 - protein, 25 aa, Cryptosporidium parvum
QAQMSVLIRCVRYYYGAHNGTRIPS

SEQ ID NO: 2344715 - protein, 18 aa, Cryptosporidium parvum
QCIYRVPMDITPWRKSIP

SEQ ID NO: 2344716 - protein, 18 aa, Cryptosporidium parvum
QDEYWSNGIFNYWRIEKF

SEQ ID NO: 2344717 - protein, 24 aa, Cryptosporidium parvum
QDKNRFPLLRILRGKDYGPATKFL

SEQ ID NO: 2344718 - protein, 26 aa, Cryptosporidium parvum
QEDIPFISGFLYGISLSGFFKADKSD

SEQ ID NO: 2344719 - protein, 20 aa, Cryptosporidium parvum
QEHYCSIGYIPLDIPAPRGP

SEQ ID NO: 2344720 - protein, 29 aa, Cryptosporidium parvum
QEIEISLICYREFIRSFVIYKQGGLKSIT

SEQ ID NO: 2344721 - protein, 17 aa, Cryptosporidium parvum
QEIKLCSNNGIGLSIIY

SEQ ID NO: 2344722 - protein, 18 aa, Cryptosporidium parvum
QEKTLGWYLPGFEETKTR

SEQ ID NO: 2344723 - protein, 26 aa, Cryptosporidium parvum
QETLFLWYSFYFLIIVSLYIIFRRLG

SEQ ID NO: 2344724 - protein, 32 aa, Cryptosporidium parvum; identical to SEQ ID NO: 2236749

SEQ ID NO: 2344725 - protein, 24 aa, Cryptosporidium parvum
QGEILKYYLGWSLSSALGSNIEML

SEQ ID NO: 2344726 - protein, 20 aa, Cryptosporidium parvum
QIHCQYIFLCHGQIQNSSDR

SEQ ID NO: 2344727 - protein, 34 aa, Cryptosporidium parvum; identical to SEQ ID NO: 2126795

SEQ ID NO: 2344728 - protein, 17 aa, Cryptosporidium parvum
QINPGILSFSFKPMRFS

SEQ ID NO: 2344729 - protein, 24 aa, Cryptosporidium parvum
QIQPRSPLMGGWQFDYIVEYNLPL

SEQ ID NO: 2344730 - protein, 20 aa, Cryptosporidium parvum
QITEEEWVRFCVGIYDSRKK

SEQ ID NO: 2344731 - protein, 19 aa, Cryptosporidium parvum
QKIKSRWLESIVFNNRKLR

SEQ ID NO: 2344732 - protein, 25 aa, Cryptosporidium parvum
QKMCHEVDLIKPLWTMPLKMISLRK

SEQ ID NO: 2344733 - protein, 18 aa, Cryptosporidium parvum
QKSLCSYCDADIGVGKKV

SEQ ID NO: 2344734 - protein, 20 aa, Cryptosporidium parvum
QLEKCALLGLASPHPKIKLG

SEQ ID NO: 2344735 - protein, 25 aa, Cryptosporidium parvum
QLFSYEYFTFMALFIYNFWRCSILV

SEQ ID NO: 2344736 - protein, 18 aa, Cryptosporidium parvum
QLIRLSIPDWEPMKKLFN

SEQ ID NO: 2344737 - protein, 23 aa, Cryptosporidium parvum
QLLKHGRLAIGIYRPIRVDDHQF

SEQ ID NO: 2344738 - protein, 23 aa, Cryptosporidium parvum
QLYPHFIERYFAIFAPNLVSCLN

SEQ ID NO: 2344739 - protein, 25 aa, Cryptosporidium parvum
QMRRSFFQFVISFCVVAVSLFGVSN

SEQ ID NO: 2344740 - protein, 23 aa, Cryptosporidium parvum
QNELACLDEPFLPKSNNLSLYSY

SEQ ID NO: 2344741 - protein, 22 aa, Cryptosporidium parvum
QNLFKVRWVIRGIYENNPWYSN

SEQ ID NO: 2344742 - protein, 23 aa, Cryptosporidium parvum
QNLLFKIVLEFDNILFNINFGIS

SEQ ID NO: 2344743 - protein, 19 aa, Cryptosporidium parvum
QNYLKRRLIVQRSHQSYFL

SEQ ID NO: 2344744 - protein, 17 aa, Cryptosporidium parvum
QRITMYYHHASILRYSE

SEQ ID NO: 2344745 - protein, 23 aa, Cryptosporidium parvum
QRVYSKSGALAFETFNNIKLVKS

SEQ ID NO: 2344746 - protein, 18 aa, Cryptosporidium parvum
QSIIKYLFFFIQIISLIY

SEQ ID NO: 2344747 - protein, 18 aa, Cryptosporidium parvum
QSYTLKRIGFITSSGSTI

SEQ ID NO: 2344748 - protein, 24 aa, Cryptosporidium parvum
QTAAWACKHLALGVAGTGCNDALI

SEQ ID NO: 2344749 - protein, 24 aa, Cryptosporidium parvum
QTSECVFISSGLFFICNFAHLLTC

SEQ ID NO: 2344750 - protein, 26 aa, Cryptosporidium parvum
QVIQRSTFHLCPRGFGRTSFRLYESV

SEQ ID NO: 2344751 - protein, 23 aa, Cryptosporidium parvum
QVTESRILLYQGISEQVKAFENQ

SEQ ID NO: 2344752 - protein, 17 aa, Cryptosporidium parvum
QVVIPRSVRIAAITTKE

SEQ ID NO: 2344753 - protein, 23 aa, Cryptosporidium parvum
QYMEKWYSLYGVIIKEGDASGSN

SEQ ID NO: 2344754 - protein, 18 aa, Cryptosporidium parvum
RAAPRILRHIMRRTSREN

SEQ ID NO: 2344755 - protein, 24 aa, Cryptosporidium parvum
RANIQSSINICWLSIISTCILSLI

SEQ ID NO: 2344756 - protein, 25 aa, Cryptosporidium parvum
RAVNDGRILSSFFAALAYNYMTMSW

SEQ ID NO: 2344757 - protein, 19 aa, Cryptosporidium parvum
RDEALKCGTKYSFPIITGL

SEQ ID NO: 2344758 - protein, 22 aa, Cryptosporidium parvum
RDILSFHSCLIFGLVRLLWNIV

SEQ ID NO: 2344759 - protein, 21 aa, Cryptosporidium parvum
RDIPFSIIQFSLWEKLNRTGD

SEQ ID NO: 2344760 - protein, 20 aa, Cryptosporidium parvum
RDKFFRKKVVPILKSVNFMA

SEQ ID NO: 2344761 - protein, 24 aa, Cryptosporidium parvum
RDKSIHGSGTWEYSVQAVQAAMSR

SEQ ID NO: 2344762 - protein, 24 aa, Cryptosporidium parvum
REDIRLGWNSSVFVEGVNKIMKIQ

SEQ ID NO: 2344763 - protein, 19 aa, Cryptosporidium parvum
REILGFASILLCKVSGIFM

SEQ ID NO: 2344764 - protein, 26 aa, Cryptosporidium parvum
REKNKSREGLKWVCMDIEKDFGDYVE

SEQ ID NO: 2344765 - protein, 17 aa, Cryptosporidium parvum
RFCFPKYLGEKARQYKF

SEQ ID NO: 2344766 - protein, 17 aa, Cryptosporidium parvum
RFISFPQFLSAIINMSQ

SEQ ID NO: 2344767 - protein, 17 aa, Cryptosporidium parvum
RFNKPRNQITIAIDGSV

SEQ ID NO: 2344768 - protein, 17 aa, Cryptosporidium parvum
RGEAILHSYQRKHSPSG

SEQ ID NO: 2344769 - protein, 19 aa, Cryptosporidium parvum
RGFDKKVIFSLLLPEIKAY

SEQ ID NO: 2344770 - protein, 19 aa, Cryptosporidium parvum
RGGRYIRRVGVTRTAHVTL

SEQ ID NO: 2344771 - protein, 21 aa, Cryptosporidium parvum
RGIRLLKPRLRQLTISERKLL

SEQ ID NO: 2344772 - protein, 17 aa, Cryptosporidium parvum
RGITVIMIAHRLQTIGF

SEQ ID NO: 2344773 - protein, 18 aa, Cryptosporidium parvum
RGQLKALIALHRRTGEFD

SEQ ID NO: 2344774 - protein, 39 aa, Cryptosporidium parvum
RIGDLPVLMKLVGFEHLWKKRVVYLLKMQSVNAVLFLEG

SEQ ID NO: 2344775 - protein, 19 aa, Cryptosporidium parvum
RIKKSFKTRVEDFKQGRQS

SEQ ID NO: 2344776 - protein, 20 aa, Cryptosporidium parvum
RILGKLGGKNRWFLKDSAVL

SEQ ID NO: 2344777 - protein, 25 aa, Cryptosporidium parvum
RINTLRILITLGFLFSSLAIHFGSE

SEQ ID NO: 2344778 - protein, 19 aa, Cryptosporidium parvum
RISQKIVYELISKKLVKLI

SEQ ID NO: 2344779 - protein, 18 aa, Cryptosporidium parvum
RKIGRKKNKGYGWTLTII

SEQ ID NO: 2344780 - protein, 18 aa, Cryptosporidium parvum
RKLLEPKITLYDIPEPTK

SEQ ID NO: 2344781 - protein, 18 aa, Cryptosporidium parvum
RKSGEIIFLESYQQLNYT

SEQ ID NO: 2344782 - protein, 17 aa, Cryptosporidium parvum
RKVGELLGGHSNLSLSI

SEQ ID NO: 2344783 - protein, 26 aa, Cryptosporidium parvum
RLLISKAVMFSSLFVRKLNESSIPNK

SEQ ID NO: 2344784 - protein, 17 aa, Cryptosporidium parvum
RLPNKWDSMILWNDLFV

SEQ ID NO: 2344785 - protein, 25 aa, Cryptosporidium parvum
RMANCVFGGVLICHGNFGDQAREFQ

SEQ ID NO: 2344786 - protein, 28 aa, Cryptosporidium parvum
RMNFNDHWRKGAGILPLNMLYNAPLKSL

SEQ ID NO: 2344787 - protein, 18 aa, Cryptosporidium parvum
RNASALAQYKPCITGTRQ

SEQ ID NO: 2344788 - protein, 19 aa, Cryptosporidium parvum
RNFWNWSTQMYTRISNKQA

SEQ ID NO: 2344789 - protein, 17 aa, Cryptosporidium parvum
RNIVNLVNRYLSIIEDE

SEQ ID NO: 2344790 - protein, 17 aa, Cryptosporidium parvum
RNNEIISAFPAIITNLL

SEQ ID NO: 2344791 - protein, 19 aa, Cryptosporidium parvum
RNQITIAIDGSVWTKIPKF

SEQ ID NO: 2344792 - protein, 25 aa, Cryptosporidium parvum
RNQKNCGSCWAFSAVAALEGATCAQ

SEQ ID NO: 2344793 - protein, 30 aa, Cryptosporidium parvum; identical to SEQ ID NO: 2237295

SEQ ID NO: 2344794 - protein, 18 aa, Cryptosporidium parvum
RNYIIMLICCDLEISTKY

SEQ ID NO: 2344795 - protein, 17 aa, Cryptosporidium parvum
RNYSENIHVFSFEDDEH

SEQ ID NO: 2344796 - protein, 24 aa, Cryptosporidium parvum
RNYYRHIYSGFKYSAFGSFISSSI

SEQ ID NO: 2344797 - protein, 17 aa, Cryptosporidium parvum
RPDMMKIPVLFETIKLI

SEQ ID NO: 2344798 - protein, 17 aa, Cryptosporidium parvum
RQIRFLIAEASFKRPII

SEQ ID NO: 2344799 - protein, 18 aa, Cryptosporidium parvum
RRAFLLKVMEGIDDEYMK

SEQ ID NO: 2344800 - protein, 19 aa, Cryptosporidium parvum
RRCIIRKGLTVRGSMILPF

SEQ ID NO: 2344801 - protein, 19 aa, Cryptosporidium parvum
RRQSILIFYGIGVQLETEY

SEQ ID NO: 2344802 - protein, 18 aa, Cryptosporidium parvum
RRSGSSKRRARKIMTKKG

SEQ ID NO: 2344803 - protein, 23 aa, Cryptosporidium parvum
RSKCCSSEIQFLISDTTSPFSIE

SEQ ID NO: 2344804 - protein, 17 aa, Cryptosporidium parvum
RSSPPKRRLFEIDSSTR

SEQ ID NO: 2344805 - protein, 25 aa, Cryptosporidium parvum
RSTKRPGFIFNMWQSDFEKILHDME

SEQ ID NO: 2344806 - protein, 19 aa, Cryptosporidium parvum
RSYLWEFLDSEWKTLPQFY

SEQ ID NO: 2344807 - protein, 17 aa, Cryptosporidium parvum
RTGLNILNMTDFQKCPE

SEQ ID NO: 2344808 - protein, 20 aa, Cryptosporidium parvum
RTSPTSKWIDCFKSDAKSIP

SEQ ID NO: 2344809 - protein, 20 aa, Cryptosporidium parvum
RVIFIFVIQCLSLIIVANSL

SEQ ID NO: 2344810 - protein, 17 aa, Cryptosporidium parvum
RWEWCYWATEGDYLKGS

SEQ ID NO: 2344811 - protein, 17 aa, Cryptosporidium parvum
RYPQDYDFYVIKHPNTD

SEQ ID NO: 2344812 - protein, 21 aa, Cryptosporidium parvum
SAAKLPPPFGNPAVKNEQKFP

SEQ ID NO: 2344813 - protein, 18 aa, Cryptosporidium parvum
SACNKQCKFCNPEFSCTN

SEQ ID NO: 2344814 - protein, 18 aa, Cryptosporidium parvum
SAIPIVLPGLYYKPYSYT

SEQ ID NO: 2344815 - protein, 19 aa, Cryptosporidium parvum
SALNKFRFINSNKKPLENE

SEQ ID NO: 2344816 - protein, 38 aa, Cryptosporidium parvum; identical to SEQ ID NO: 2237508

SEQ ID NO: 2344817 - protein, 25 aa, Cryptosporidium parvum
SASLPIVAAAGFLITKIHRSWGTTT

SEQ ID NO: 2344818 - protein, 21 aa, Cryptosporidium parvum
SCASILISAVFLVFSLENFSE

SEQ ID NO: 2344819 - protein, 22 aa, Cryptosporidium parvum
SCGELAIRVLIGLLKNELLQEE

SEQ ID NO: 2344820 - protein, 19 aa, Cryptosporidium parvum
SCITLRTGTLLQCASLLVL

SEQ ID NO: 2344821 - protein, 17 aa, Cryptosporidium parvum
SCKILAFINLNGCILVK

SEQ ID NO: 2344822 - protein, 22 aa, Cryptosporidium parvum
SCLPLNFLECELFSKYNEKIFV

SEQ ID NO: 2344823 - protein, 35 aa, Cryptosporidium parvum; identical to SEQ ID NO: 2336799

SEQ ID NO: 2344824 - protein, 20 aa, Cryptosporidium parvum
SDAFKRGEAILHSYQRKHSP

SEQ ID NO: 2344825 - protein, 23 aa, Cryptosporidium parvum
SDDPSSICQMILKSKSIVAQNPS

SEQ ID NO: 2344826 - protein, 18 aa, Cryptosporidium parvum
SDIKLFITTMQDIYPIAF

SEQ ID NO: 2344827 - protein, 28 aa, Cryptosporidium parvum
SDIVLCSGIFEWYTPLSLNSTIVEIYPH

SEQ ID NO: 2344828 - protein, 34 aa, Cryptosporidium parvum; identical to SEQ ID NO: 2181028

SEQ ID NO: 2344829 - protein, 18 aa, Cryptosporidium parvum
SDNLAFAININYWSSIIS

SEQ ID NO: 2344830 - protein, 25 aa, Cryptosporidium parvum
SEAAELRSQYILRRIKENNCIKNTN

SEQ ID NO: 2344831 - protein, 25 aa, Cryptosporidium parvum
SEAFLRFYSKGAFIVRSIYKFLMNE

SEQ ID NO: 2344832 - protein, 18 aa, Cryptosporidium parvum
SEELKSDISGVVVYAIED

SEQ ID NO: 2344833 - protein, 20 aa, Cryptosporidium parvum
SEFAQCIPLSVIKQLERQLG

SEQ ID NO: 2344834 - protein, 27 aa, Cryptosporidium parvum
SEGQFCMGMVYTLFPFLDSLECITNSH

SEQ ID NO: 2344835 - protein, 17 aa, Cryptosporidium parvum
SEHRSLSGLGEVGSSKK

SEQ ID NO: 2344836 - protein, 19 aa, Cryptosporidium parvum
SEICMPYTVLPAIMNEYRI

SEQ ID NO: 2344837 - protein, 21 aa, Cryptosporidium parvum
SEIKTLIRISNKIEYSFYNNI

SEQ ID NO: 2344838 - protein, 21 aa, Cryptosporidium parvum
SEILLFPSILILKLLSIQNYE

SEQ ID NO: 2344839 - protein, 24 aa, Cryptosporidium parvum
SELSEQVLEAWAMVSISAKNFVSD

SEQ ID NO: 2344840 - protein, 24 aa, Cryptosporidium parvum
SENLVFYIFKLVPLFKYTRQAIEK

SEQ ID NO: 2344841 - protein, 24 aa, Cryptosporidium parvum
SENSEVIEGFLFEEIMPEVKKRKR

SEQ ID NO: 2344842 - protein, 24 aa, Cryptosporidium parvum
SESDYKLFFRFLKARQFNVEKSTE

SEQ ID NO: 2344843 - protein, 20 aa, Cryptosporidium parvum
SESFPWVIEEVVGRYFYMIL

SEQ ID NO: 2344844 - protein, 22 aa, Cryptosporidium parvum
SESRPWCKSLIPNIYSFVQDEY

SEQ ID NO: 2344845 - protein, 25 aa, Cryptosporidium parvum
SESYKLLEISLIFAGIVTGILIFVP

SEQ ID NO: 2344846 - protein, 18 aa, Cryptosporidium parvum
SEVLRARWNELSNNKNDQ

SEQ ID NO: 2344847 - protein, 18 aa, Cryptosporidium parvum
SEYWSEFFKKYGGESNRA

SEQ ID NO: 2344848 - protein, 18 aa, Cryptosporidium parvum
SFELFTFCIVEDSQNSID

SEQ ID NO: 2344849 - protein, 53 aa, Cryptosporidium parvum; identical to SEQ ID NO: 2237663

SEQ ID NO: 2344850 - protein, 20 aa, Cryptosporidium parvum
SFIEMCFRQTQTPAYQTGHI

SEQ ID NO: 2344851 - protein, 18 aa, Cryptosporidium parvum
SFILGNRMLYNFKSKKCL

SEQ ID NO: 2344852 - protein, 19 aa, Cryptosporidium parvum
SFISVLFVDLFGKDYLGNE

SEQ ID NO: 2344853 - protein, 20 aa, Cryptosporidium parvum
SFKNDQCFNFSDILEEKSYF

SEQ ID NO: 2344854 - protein, 27 aa, Cryptosporidium parvum
SFPIVCESLQIWGHLRLHDGSTANNHT

SEQ ID NO: 2344855 - protein, 18 aa, Cryptosporidium parvum
SFSSLKIPIAIEYIEPIL

SEQ ID NO: 2344856 - protein, 22 aa, Cryptosporidium parvum
SFVLLFCLFFYQLDKLHAEVIY

SEQ ID NO: 2344857 - protein, 30 aa, Cryptosporidium parvum; identical to SEQ ID NO: 2127360

SEQ ID NO: 2344858 - protein, 18 aa, Cryptosporidium parvum
SFYKYEFSDHLLQIKYLI

SEQ ID NO: 2344859 - protein, 18 aa, Cryptosporidium parvum
SGALGCPVSASIAYAQAM

SEQ ID NO: 2344860 - protein, 19 aa, Cryptosporidium parvum
SGGDAYRAETFLATLEKVK

SEQ ID NO: 2344861 - protein, 25 aa, Cryptosporidium parvum
SGGRQSSLWNALNFLSSFSNKEEKS

SEQ ID NO: 2344862 - protein, 24 aa, Cryptosporidium parvum
SGIYPSFISLGWQRIESLMNTCRI

SEQ ID NO: 2344863 - protein, 18 aa, Cryptosporidium parvum
SGSGFHWNLETELINFEN

SEQ ID NO: 2344864 - protein, 23 aa, Cryptosporidium parvum
SGYMAAVCKYGCGEMGVTYPYYY

SEQ ID NO: 2344865 - protein, 20 aa, Cryptosporidium parvum
SHCMAFLVVCVIALNSSKYI

SEQ ID NO: 2344866 - protein, 25 aa, Cryptosporidium parvum
SHHLRFCKSKIFSRIFHYNYNFEDY

SEQ ID NO: 2344867 - protein, 26 aa, Cryptosporidium parvum
SHHLSDLFVYFGISRFTLYYIKHNIT

SEQ ID NO: 2344868 - protein, 26 aa, Cryptosporidium parvum
SHIITFSGTFLISFLVFIPFLIVILI

SEQ ID NO: 2344869 - protein, 25 aa, Cryptosporidium parvum
SHQLWKFIIDSSILFSISCFSSTPT

SEQ ID NO: 2344870 - protein, 24 aa, Cryptosporidium parvum
SIDYFPFAIALTILAKNLFSVINS

SEQ ID NO: 2344871 - protein, 30 aa, Cryptosporidium parvum
SIKRRLLREYDIIYQFGRYEYFSVNQLTEI

SEQ ID NO: 2344872 - protein, 23 aa, Cryptosporidium parvum
SIKSRLEVGVGYSMYQDVYILNS

SEQ ID NO: 2344873 - protein, 26 aa, Cryptosporidium parvum
SILECLRFSLFGEISIPVFRDIISRD

SEQ ID NO: 2344874 - protein, 17 aa, Cryptosporidium parvum
SILLMILITKFLKKILV

SEQ ID NO: 2344875 - protein, 26 aa, Cryptosporidium parvum
SILRYSEFLKEFILIINSFENCLRIK

SEQ ID NO: 2344876 - protein, 23 aa, Cryptosporidium parvum
SINTLIFFCIGKIMLVAIYNKKN

SEQ ID NO: 2344877 - protein, 42 aa, Cryptosporidium parvum; identical to SEQ ID NO: 2237823

SEQ ID NO: 2344878 - protein, 19 aa, Cryptosporidium parvum
SKCKLGGVKKRPLVKKTPR

SEQ ID NO: 2344879 - protein, 24 aa, Cryptosporidium parvum
SKELTNRMNSVFSMDEAIDLLTKC

SEQ ID NO: 2344880 - protein, 24 aa, Cryptosporidium parvum
SKFTELRSKLSPIQILLKSLNGKQ

SEQ ID NO: 2344881 - protein, 27 aa, Cryptosporidium parvum
SKFWLKLRKEAIGWFIYTIEDPKYSVD

SEQ ID NO: 2344882 - protein, 28 aa, Cryptosporidium parvum
SKHDCPYISYKIPNSFIAFPTSINTIIK

SEQ ID NO: 2344883 - protein, 24 aa, Cryptosporidium parvum
SKIVWPGTFSHPFKDFNPTFSANR

SEQ ID NO: 2344884 - protein, 20 aa, Cryptosporidium parvum
SKLRNSKCKIFVQTNIPYLL

SEQ ID NO: 2344885 - protein, 38 aa, Cryptosporidium parvum; identical to SEQ ID NO: 2237895

SEQ ID NO: 2344886 - protein, 21 aa, Cryptosporidium parvum
SKSKLLLFILHTLRQLGIQYT

SEQ ID NO: 2344887 - protein, 22 aa, Cryptosporidium parvum
SKTWQILSKFWASYLEKNKKSP

SEQ ID NO: 2344888 - protein, 26 aa, Cryptosporidium parvum
SKYQAFIVCPCIRNYNELLFYSHFRW

SEQ ID NO: 2344889 - protein, 17 aa, Cryptosporidium parvum
SLCKLFFEMKQYIQKSG

SEQ ID NO: 2344890 - protein, 19 aa, Cryptosporidium parvum
SLENIPLIKIHSLTAEIWE

SEQ ID NO: 2344891 - protein, 19 aa, Cryptosporidium parvum
SLFELKLWDERTCLCKIDD

SEQ ID NO: 2344892 - protein, 20 aa, Cryptosporidium parvum
SLFWKRCLNEPIVSVKVESK

SEQ ID NO: 2344893 - protein, 26 aa, Cryptosporidium parvum
SLHNFWKVVIGFIMSVLSGISIPLFL

SEQ ID NO: 2344894 - protein, 20 aa, Cryptosporidium parvum
SLHTSIKIISSFMVLGIALN

SEQ ID NO: 2344895 - protein, 17 aa, Cryptosporidium parvum
SLMAYCLSYLVLALAIL

SEQ ID NO: 2344896 - protein, 20 aa, Cryptosporidium parvum
SLNKKCFRRVALSEPIGSVT

SEQ ID NO: 2344897 - protein, 21 aa, Cryptosporidium parvum
SLNLFIWKFINTEYLKSNEEI

SEQ ID NO: 2344898 - protein, 23 aa, Cryptosporidium parvum
SLSLSRINGAIIQIVRLSKKSLK

SEQ ID NO: 2344899 - protein, 18 aa, Cryptosporidium parvum
SLVIAGFGIIFGTILIGV

SEQ ID NO: 2344900 - protein, 18 aa, Cryptosporidium parvum
SMILPFSNLIVIGKLIVG

SEQ ID NO: 2344901 - protein, 24 aa, Cryptosporidium parvum
SMVSRLGRCYLWLENKDLVTDQMK

SEQ ID NO: 2344902 - protein, 20 aa, Cryptosporidium parvum
SNFFSAVIFVIFLNPYNVGD

SEQ ID NO: 2344903 - protein, 17 aa, Cryptosporidium parvum
SNFKRDIATSFIYMLND

SEQ ID NO: 2344904 - protein, 20 aa, Cryptosporidium parvum
SNFWCGINAIQPGHSATVYM

SEQ ID NO: 2344905 - protein, 23 aa, Cryptosporidium parvum
SNIPIPIDCEGFDLSWIPSNPLD

SEQ ID NO: 2344906 - protein, 20 aa, Cryptosporidium parvum
SNKHWDILRKILLGETKDIN

SEQ ID NO: 2344907 - protein, 19 aa, Cryptosporidium parvum
SNKQAKMILINRATQLTLE

SEQ ID NO: 2344908 - protein, 21 aa, Cryptosporidium parvum
SNKRSGFKRSFGGDSQKHSHL

SEQ ID NO: 2344909 - protein, 21 aa, Cryptosporidium parvum
SNKSIKFHEMWIGDQCPEILN

SEQ ID NO: 2344910 - protein, 27 aa, Cryptosporidium parvum
SNLRIYSKYVHEFMGPILMGLLDGGFG

SEQ ID NO: 2344911 - protein, 19 aa, Cryptosporidium parvum
SNMVWLYCYLMSANTPSKL

SEQ ID NO: 2344912 - protein, 17 aa, Cryptosporidium parvum
SNRLFYVVFTILIGFIF

SEQ ID NO: 2344913 - protein, 28 aa, Cryptosporidium parvum
SNSHKFVLCMSVTCGIRSNGILNSIPLF

SEQ ID NO: 2344914 - protein, 32 aa, Cryptosporidium parvum; identical to SEQ ID NO: 2127633

SEQ ID NO: 2344915 - protein, 37 aa, Cryptosporidium parvum
SNVSQFLFGFIVGFYRGWKMALVMSASLPIVAAAGFL

SEQ ID NO: 2344916 - protein, 17 aa, Cryptosporidium parvum
SPDFTLVSNERCVREVL

SEQ ID NO: 2344917 - protein, 24 aa, Cryptosporidium parvum
SPEQGSGVPITFEILFEVLERTER

SEQ ID NO: 2344918 - protein, 25 aa, Cryptosporidium parvum
SPETAKLFGAVSCYKSFGSFLSIAV

SEQ ID NO: 2344919 - protein, 22 aa, Cryptosporidium parvum
SPKCRPWSIWGTLPYRNASALA

SEQ ID NO: 2344920 - protein, 17 aa, Cryptosporidium parvum
SPKSARLGSSRGDNPKT

SEQ ID NO: 2344921 - protein, 19 aa, Cryptosporidium parvum
SPPSYYATNGIKTINPNQV

SEQ ID NO: 2344922 - protein, 24 aa, Cryptosporidium parvum
SPYREIWLEISLTVPARLKSLLPY

SEQ ID NO: 2344923 - protein, 18 aa, Cryptosporidium parvum
SPYYCWGNLEPRDLSPNQ

SEQ ID NO: 2344924 - protein, 23 aa, Cryptosporidium parvum
SQAKCKRLIVISRFYSDSEEALK

SEQ ID NO: 2344925 - protein, 25 aa, Cryptosporidium parvum
SQDELRWKIIGVLFRCVTRKDLEIC

SEQ ID NO: 2344926 - protein, 25 aa, Cryptosporidium parvum
SQIQNCVWLPSLLESKARFKLAKIM

SEQ ID NO: 2344927 - protein, 25 aa, Cryptosporidium parvum
SQLFIQIWRNLRLLYIEDNIYQGLD

SEQ ID NO: 2344928 - protein, 24 aa, Cryptosporidium parvum
SQPNLRPRSLFSINKMDSQDHSKD

SEQ ID NO: 2344929 - protein, 23 aa, Cryptosporidium parvum
SQTKGDWCLYNFGIVCEAVSLIM

SEQ ID NO: 2344930 - protein, 24 aa, Cryptosporidium parvum
SRDLKSDFWSFALQIFKSLADENS

SEQ ID NO: 2344931 - protein, 21 aa, Cryptosporidium parvum
SRISKVPVIMFSPSIINFRRF

SEQ ID NO: 2344932 - protein, 24 aa, Cryptosporidium parvum
SRITSRIRRAFGMDISDLSCILLD

SEQ ID NO: 2344933 - protein, 20 aa, Cryptosporidium parvum
SRNLPSALLLAGPGAILTMV

SEQ ID NO: 2344934 - protein, 18 aa, Cryptosporidium parvum
SRSASHFGKVYNGLYPVG

SEQ ID NO: 2344935 - protein, 26 aa, Cryptosporidium parvum
SSFLNVLRHLGYWLGQITIGINRPII

SEQ ID NO: 2344936 - protein, 38 aa, Cryptosporidium parvum; identical to SEQ ID NO: 2238268

SEQ ID NO: 2344937 - protein, 18 aa, Cryptosporidium parvum
SSKKSFKMFEEFDQINEF

SEQ ID NO: 2344938 - protein, 25 aa, Cryptosporidium parvum
SSLILPISRYYLIGMLVLSSEINQN

SEQ ID NO: 2344939 - protein, 17 aa, Cryptosporidium parvum
SSLWSPGRFGVTGNNNI

SEQ ID NO: 2344940 - protein, 23 aa, Cryptosporidium parvum
SSNILRDVWFSEISREILNYVNG

SEQ ID NO: 2344941 - protein, 19 aa, Cryptosporidium parvum
SSQAAFKIIFGEITALKSM

SEQ ID NO: 2344942 - protein, 19 aa, Cryptosporidium parvum
SSVMIRLMLVFGPAACCLS

SEQ ID NO: 2344943 - protein, 24 aa, Cryptosporidium parvum
STFLKIPLPLLLAVGAVLILETDY

SEQ ID NO: 2344944 - protein, 25 aa, Cryptosporidium parvum
STILKDEFLPLFIKKNIFTESLEIS

SEQ ID NO: 2344945 - protein, 18 aa, Cryptosporidium parvum
STIPGIIISLIISVATLR

SEQ ID NO: 2344946 - protein, 18 aa, Cryptosporidium parvum
STLSGPAIRITRSNTANK

SEQ ID NO: 2344947 - protein, 30 aa, Cryptosporidium parvum
STSLMYIRSLLRLFFLFSSFKEDNASRVYI

SEQ ID NO: 2344948 - protein, 24 aa, Cryptosporidium parvum
SVIPFEAGELFLVGISFLLDGKIP

SEQ ID NO: 2344949 - protein, 20 aa, Cryptosporidium parvum
SVLPHLKSLVQIISHGLSDE

SEQ ID NO: 2344950 - protein, 17 aa, Cryptosporidium parvum
SWLNDYICEGIITRIIL

SEQ ID NO: 2344951 - protein, 19 aa, Cryptosporidium parvum
SWNPFSITRVKLFHASNSC

SEQ ID NO: 2344952 - protein, 24 aa, Cryptosporidium parvum
SWYLARLARESFMNMNLDLLLESL

SEQ ID NO: 2344953 - protein, 22 aa, Cryptosporidium parvum
SYFKQIISLFGINNLYISFEPF

SEQ ID NO: 2344954 - protein, 20 aa, Cryptosporidium parvum
SYITLILCRYLLSFSYGALE

SEQ ID NO: 2344955 - protein, 22 aa, Cryptosporidium parvum
SYLMPDFPNWVPIDQKYDDNIG

SEQ ID NO: 2344956 - protein, 22 aa, Cryptosporidium parvum
SYLNDFPLIYIFINDEKSNFDL

SEQ ID NO: 2344957 - protein, 17 aa, Cryptosporidium parvum
SYRGILWNISVGNNLQI

SEQ ID NO: 2344958 - protein, 19 aa, Cryptosporidium parvum
SYSNAWRVGASHTMLQIQP

SEQ ID NO: 2344959 - protein, 20 aa, Cryptosporidium parvum
TAQSFGLWYGSKMTVEKKIG

SEQ ID NO: 2344960 - protein, 24 aa, Cryptosporidium parvum
TCSNIKGAINILGITGKIFMDVLF

SEQ ID NO: 2344961 - protein, 21 aa, Cryptosporidium parvum
TCSSPLCIWYSHKCDAYRIVK

SEQ ID NO: 2344962 - protein, 22 aa, Cryptosporidium parvum
TDIPTHLGVYYNFINSEGPTTF

SEQ ID NO: 2344963 - protein, 23 aa, Cryptosporidium parvum
TEEFLELLLDYGASMTDLTLEGK

SEQ ID NO: 2344964 - protein, 25 aa, Cryptosporidium parvum
TEKFSDMYFCHFYKTNVELEKLDKA

SEQ ID NO: 2344965 - protein, 24 aa, Cryptosporidium parvum
TEKKNCSFYSIWQEFTDQVNNMCT

SEQ ID NO: 2344966 - protein, 21 aa, Cryptosporidium parvum
TELELPLLYECDWNLVMRARN

SEQ ID NO: 2344967 - protein, 25 aa, Cryptosporidium parvum
TEMLNKYFEWRGKKKVAELINTTQI

SEQ ID NO: 2344968 - protein, 32 aa, Cryptosporidium parvum; identical to SEQ ID NO: 2127902

SEQ ID NO: 2344969 - protein, 23 aa, Cryptosporidium parvum
TEYLELLGIQFQLLYGLPVCPLP

SEQ ID NO: 2344970 - protein, 30 aa, Cryptosporidium parvum; identical to SEQ ID NO: 2127907

SEQ ID NO: 2344971 - protein, 23 aa, Cryptosporidium parvum
TFGQILCGIAFVSYGLGFLLLEL

SEQ ID NO: 2344972 - protein, 22 aa, Cryptosporidium parvum
TFLEFIHEFGRDLVVLTHRCVN

SEQ ID NO: 2344973 - protein, 20 aa, Cryptosporidium parvum
TFLMCSIIRAFDLSNVFKPL

SEQ ID NO: 2344974 - protein, 24 aa, Cryptosporidium parvum
TFMGSLRLTYGIAGIIGIVLYRII

SEQ ID NO: 2344975 - protein, 19 aa, Cryptosporidium parvum
TFNNIKLVKSYCLESIMFN

SEQ ID NO: 2344976 - protein, 19 aa, Cryptosporidium parvum
TFPLMGYLIGKFVTSGVLP

SEQ ID NO: 2344977 - protein, 33 aa, Cryptosporidium parvum; identical to SEQ ID NO: 2238557

SEQ ID NO: 2344978 - protein, 21 aa, Cryptosporidium parvum
TFSTCISLYCKIIQDKENSNF

SEQ ID NO: 2344979 - protein, 18 aa, Cryptosporidium parvum
TFVRCLIICLFVFSWPIS

SEQ ID NO: 2344980 - protein, 25 aa, Cryptosporidium parvum
TFYGKGLMSLRIFGILLNNINVDRE

SEQ ID NO: 2344981 - protein, 23 aa, Cryptosporidium parvum
TGYKSIKSFVLLAYFLNVFGVKD

SEQ ID NO: 2344982 - protein, 40 aa, Cryptosporidium parvum; identical to SEQ ID NO: 2238583

SEQ ID NO: 2344983 - protein, 17 aa, Cryptosporidium parvum
THTLRLILANKIIQSNP

SEQ ID NO: 2344984 - protein, 26 aa, Cryptosporidium parvum
THYYCPPKFPENVFRPFEYNITKLYS

SEQ ID NO: 2344985 - protein, 19 aa, Cryptosporidium parvum
TIETRFVKSNSMAFAGEIV

SEQ ID NO: 2344986 - protein, 23 aa, Cryptosporidium parvum
TILEYLDRIPLIQMPLSIASTIR

SEQ ID NO: 2344987 - protein, 24 aa, Cryptosporidium parvum
TIPYYCYNLILSVLKKEEMKCDNI

SEQ ID NO: 2344988 - protein, 25 aa, Cryptosporidium parvum
TIQGSRKGSALFASFDSSMIRSSGI

SEQ ID NO: 2344989 - protein, 24 aa, Cryptosporidium parvum
TIRTCKGLRTSTREHRIICNLSQS

SEQ ID NO: 2344990 - protein, 18 aa, Cryptosporidium parvum
TISISFYSLFLFAFGSPF

SEQ ID NO: 2344991 - protein, 24 aa, Cryptosporidium parvum
TISSPFRLPLALFATHSPHNVVLF

SEQ ID NO: 2344992 - protein, 18 aa, Cryptosporidium parvum
TKDYPNGLTLELSLTKLP

SEQ ID NO: 2344993 - protein, 18 aa, Cryptosporidium parvum
TKKLICHNTSTSNAITIQ

SEQ ID NO: 2344994 - protein, 24 aa, Cryptosporidium parvum
TKKYPEIYGFYKFIHLHFGETSAF

SEQ ID NO: 2344995 - protein, 17 aa, Cryptosporidium parvum
TKLRCWHIASNYLSNQI

SEQ ID NO: 2344996 - protein, 27 aa, Cryptosporidium parvum
TKYSFPIITGLLLYIGIYLPNGNESNS

SEQ ID NO: 2344997 - protein, 20 aa, Cryptosporidium parvum
TLCKLLKPAPPIPLPVSQVL

SEQ ID NO: 2344998 - protein, 17 aa, Cryptosporidium parvum
TLFACFKTFGQTKEIIL

SEQ ID NO: 2344999 - protein, 20 aa, Cryptosporidium parvum
TLLITFGMLNPWYILFDWEY

SEQ ID NO: 2345000 - protein, 17 aa, Cryptosporidium parvum
TLLVMCLIISLTSVLLL

SEQ ID NO: 2345001 - protein, 23 aa, Cryptosporidium parvum
TLSEWDLAMATIPVRKSVVLVPG

SEQ ID NO: 2345002 - protein, 17 aa, Cryptosporidium parvum
TLYRVSSKLLPPEALYT

SEQ ID NO: 2345003 - protein, 24 aa, Cryptosporidium parvum
TMDSHILGLCWGFGQAIQNTAQSF

SEQ ID NO: 2345004 - protein, 27 aa, Cryptosporidium parvum
TNIQKWKLSLRFEKMMEFLILETKKRA

SEQ ID NO: 2345005 - protein, 19 aa, Cryptosporidium parvum
TNLRCVRVNLLGNGQSETK

SEQ ID NO: 2345006 - protein, 23 aa, Cryptosporidium parvum
TNPKPSGSCGMVIIETSEHLIFQ

SEQ ID NO: 2345007 - protein, 24 aa, Cryptosporidium parvum
TNREYPIVLIIGWCEQIDMLVKLT

SEQ ID NO: 2345008 - protein, 19 aa, Cryptosporidium parvum
TNTVFQIFPLFSLVFALLA

SEQ ID NO: 2345009 - protein, 40 aa, Cryptosporidium parvum; identical to SEQ ID NO: 2238727

SEQ ID NO: 2345010 - protein, 25 aa, Cryptosporidium parvum
TNYSLFRHCLNFNKITASLIRDIPF

SEQ ID NO: 2345011 - protein, 27 aa, Cryptosporidium parvum
TPETLFSNWLRLMIAILIQDSYNLPLQ

SEQ ID NO: 2345012 - protein, 17 aa, Cryptosporidium parvum
TPGVFTIVLKFSEIHFK

SEQ ID NO: 2345013 - protein, 29 aa, Cryptosporidium parvum
TPHGIPYWLVPVFEFLKLPASSTLSSLDS

SEQ ID NO: 2345014 - protein, 18 aa, Cryptosporidium parvum
TPIKIQFLISVLFSHSLS

SEQ ID NO: 2345015 - protein, 23 aa, Cryptosporidium parvum
TPKDRDLDCIYLTSTGMQTEIRV

SEQ ID NO: 2345016 - protein, 22 aa, Cryptosporidium parvum
TPLSIMDRLLWSSSNLFVPTLR

SEQ ID NO: 2345017 - protein, 19 aa, Cryptosporidium parvum
TPRGILFAIVDFVSYSSLF

SEQ ID NO: 2345018 - protein, 20 aa, Cryptosporidium parvum
TPTCSDVIEKFEWNKDLIGT

SEQ ID NO: 2345019 - protein, 21 aa, Cryptosporidium parvum
TRPSILVTLCKLLKPAPPIPL

SEQ ID NO: 2345020 - protein, 20 aa, Cryptosporidium parvum
TRSSPYLNHYIPEIEITTGL

SEQ ID NO: 2345021 - protein, 22 aa, Cryptosporidium parvum
TRYSRHLVCDYIYIHEKFPEAA

SEQ ID NO: 2345022 - protein, 18 aa, Cryptosporidium parvum
TSGLDFKVSTIIKNISKI

SEQ ID NO: 2345023 - protein, 23 aa, Cryptosporidium parvum
TSKDLKSRCSYVMQHEMTIPYLT

SEQ ID NO: 2345024 - protein, 24 aa, Cryptosporidium parvum
TSLWKGVTAHIIFRITEDLIKNSL

SEQ ID NO: 2345025 - protein, 17 aa, Cryptosporidium parvum
TSRENGILFALPTGNNG

SEQ ID NO: 2345026 - protein, 21 aa, Cryptosporidium parvum
TTSGACYRRLVRFERNKVQNC

SEQ ID NO: 2345027 - protein, 24 aa, Cryptosporidium parvum
TVALFCYGMFLSYICESFSLGTLA

SEQ ID NO: 2345028 - protein, 20 aa, Cryptosporidium parvum
TVLIRGRAEPPFPRIWSRSP

SEQ ID NO: 2345029 - protein, 22 aa, Cryptosporidium parvum
TVNKVLKLVLWLLGWLSVTFII

SEQ ID NO: 2345030 - protein, 19 aa, Cryptosporidium parvum
TWEIAKLILENGGTLEKYS

SEQ ID NO: 2345031 - protein, 25 aa, Cryptosporidium parvum
TWFCNREFGAEFLLNSVIVNQIAAN

SEQ ID NO: 2345032 - protein, 21 aa, Cryptosporidium parvum
TWKLFKSFINWDGEYYLRISY

SEQ ID NO: 2345033 - protein, 27 aa, Cryptosporidium parvum
TYIIIMCLRHIITLYTLSRFGEGRFFA

SEQ ID NO: 2345034 - protein, 17 aa, Cryptosporidium parvum
TYWISNLIFEILKGLII

SEQ ID NO: 2345035 - protein, 23 aa, Cryptosporidium parvum
VAENELKPLLSPSEKVYGRLSRD

SEQ ID NO: 2345036 - protein, 24 aa, Cryptosporidium parvum
VAGLTVFCCLIFFGDLADSYLLHD

SEQ ID NO: 2345037 - protein, 17 aa, Cryptosporidium parvum
VAICLGLAFRILGYFLT

SEQ ID NO: 2345038 - protein, 24 aa, Cryptosporidium parvum
VASRLLGSLPPEFPNLDDLMAIPV

SEQ ID NO: 2345039 - protein, 28 aa, Cryptosporidium parvum
VCHGFVPAKSWLPMMNLIGNEENNEEKL

SEQ ID NO: 2345040 - protein, 21 aa, Cryptosporidium parvum
VCVEVLKFSHDYFYDEIPEIS

SEQ ID NO: 2345041 - protein, 17 aa, Cryptosporidium parvum
VDCVLSFWSPWTGCSKF

SEQ ID NO: 2345042 - protein, 23 aa, Cryptosporidium parvum
VDDMCFLSFLLMNKVFTGFLESI

SEQ ID NO: 2345043 - protein, 26 aa, Cryptosporidium parvum
VEAETIKKLGFVGGKIKMISSHLSNS

SEQ ID NO: 2345044 - protein, 17 aa, Cryptosporidium parvum
VELQLLLKSSTYNLPTV

SEQ ID NO: 2345045 - protein, 24 aa, Cryptosporidium parvum
VFEAPVLIPHSWLSSQMIYNESRS

SEQ ID NO: 2345046 - protein, 18 aa, Cryptosporidium parvum
VFITYFLIIYTVSATELD

SEQ ID NO: 2345047 - protein, 18 aa, Cryptosporidium parvum
VFVSFGIGIVSLVIFSSY

SEQ ID NO: 2345048 - protein, 17 aa, Cryptosporidium parvum
VFYYLSFIFSLINPALP

SEQ ID NO: 2345049 - protein, 18 aa, Cryptosporidium parvum
VGFPRLDKFSDIQTMDDV

SEQ ID NO: 2345050 - protein, 24 aa, Cryptosporidium parvum
VGGSFFPLWAPIRYIPAFMAERHR

SEQ ID NO: 2345051 - protein, 21 aa, Cryptosporidium parvum
VGLTCAIVYISLNFKSGNLDS

SEQ ID NO: 2345052 - protein, 19 aa, Cryptosporidium parvum
VGRVKCWIPNQSIELPLRR

SEQ ID NO: 2345053 - protein, 26 aa, Cryptosporidium parvum
VHPEKALEFPLVLYSSVTTPLILENI

SEQ ID NO: 2345054 - protein, 24 aa, Cryptosporidium parvum
VHRPHPWGLLITFIELIKNPKYAF

SEQ ID NO: 2345055 - protein, 18 aa, Cryptosporidium parvum
VIEKFEWNKDLIGTSSQA

SEQ ID NO: 2345056 - protein, 27 aa, Cryptosporidium parvum
VIGSLLISCQWLYSRHILYKSYVREFK

SEQ ID NO: 2345057 - protein, 17 aa, Cryptosporidium parvum
VIIKLFLMKKRFFNKVN

SEQ ID NO: 2345058 - protein, 17 aa, Cryptosporidium parvum
VIKPCKENFFLIVCMMS

SEQ ID NO: 2345059 - protein, 25 aa, Cryptosporidium parvum
VILKSLRPSLDFGENTSHHIPIKSF

SEQ ID NO: 2345060 - protein, 23 aa, Cryptosporidium parvum
VINAPSIFGIIWNFLKPLIDERT

SEQ ID NO: 2345061 - protein, 17 aa, Cryptosporidium parvum
VIPRFQLFNLNKSSKSV

SEQ ID NO: 2345062 - protein, 20 aa, Cryptosporidium parvum
VIVIFKFQKYFLPLVYLGAK

SEQ ID NO: 2345063 - protein, 20 aa, Cryptosporidium parvum
VIVYSHMRLLFSYFSNYSKD

SEQ ID NO: 2345064 - protein, 22 aa, Cryptosporidium parvum
VKEYECPEGYTAQLEEDFFQKD

SEQ ID NO: 2345065 - protein, 20 aa, Cryptosporidium parvum
VKIYLEDELVFFLKEDLMKI

SEQ ID NO: 2345066 - protein, 18 aa, Cryptosporidium parvum
VKRKFLQVCNEINVNIIK

SEQ ID NO: 2345067 - protein, 24 aa, Cryptosporidium parvum
VKSMSGFLSRFPLNDILQTSISLY

SEQ ID NO: 2345068 - protein, 18 aa, Cryptosporidium parvum
VLASYRILVIIALLPMLT

SEQ ID NO: 2345069 - protein, 29 aa, Cryptosporidium parvum
VLHKYEVPLMFACETKKLICHNTSTSNAI

SEQ ID NO: 2345070 - protein, 26 aa, Cryptosporidium parvum
VLIMGLCIFVRLFAVVRYEAIIHEFD

SEQ ID NO: 2345071 - protein, 18 aa, Cryptosporidium parvum
VLLPICLYESSSQLNYHI

SEQ ID NO: 2345072 - protein, 23 aa, Cryptosporidium parvum
VLPPPPLRQIPMPSISVESLVIT

SEQ ID NO: 2345073 - protein, 25 aa, Cryptosporidium parvum
VLRELRPIIRATIIGARQTIFHITT

SEQ ID NO: 2345074 - protein, 22 aa, Cryptosporidium parvum
VLTHRCVNAFWSKAPCVRDSKF

SEQ ID NO: 2345075 - protein, 23 aa, Cryptosporidium parvum
VMKVKVLLAKIVPLVSIGLLNIE

SEQ ID NO: 2345076 - protein, 26 aa, Cryptosporidium parvum
VNDPLCVKVPILIRPSPINNKLDTTL

SEQ ID NO: 2345077 - protein, 23 aa, Cryptosporidium parvum
VNDSLMCPGVEFLSKGFIEKLIV

SEQ ID NO: 2345078 - protein, 23 aa, Cryptosporidium parvum
VNVPTMVCPTGYTLDSNRQCVAR

SEQ ID NO: 2345079 - protein, 22 aa, Cryptosporidium parvum
VPGELGCPVGYTDGDKGLCKSI

SEQ ID NO: 2345080 - protein, 30 aa, Cryptosporidium parvum; identical to SEQ ID NO: 2128399

SEQ ID NO: 2345081 - protein, 22 aa, Cryptosporidium parvum
VQIILLDYLVTWILINVSVFKD

SEQ ID NO: 2345082 - protein, 29 aa, Cryptosporidium parvum
VQIYSIRFLKLILLHPNWSEFLRSRSNSS

SEQ ID NO: 2345083 - protein, 22 aa, Cryptosporidium parvum
VRFSIEGFWSLITLIPKMVLSN

SEQ ID NO: 2345084 - protein, 28 aa, Cryptosporidium parvum
VRLSKKSLKEGFQWLISMEENTGNENYY

SEQ ID NO: 2345085 - protein, 22 aa, Cryptosporidium parvum
VRPVLGRLLAFSIERMDYPDVK

SEQ ID NO: 2345086 - protein, 17 aa, Cryptosporidium parvum
VRREMFLPIKFSESETP

SEQ ID NO: 2345087 - protein, 21 aa, Cryptosporidium parvum
VRRILFCRYVLPYILYIQHTA

SEQ ID NO: 2345088 - protein, 19 aa, Cryptosporidium parvum
VRSIYKFLMNEWKRGERYQ

SEQ ID NO: 2345089 - protein, 23 aa, Cryptosporidium parvum
VSILHICVFTGPIISSLTALASY

SEQ ID NO: 2345090 - protein, 23 aa, Cryptosporidium parvum
VSNMSLKLSKLVNYNKKRLSRPL

SEQ ID NO: 2345091 - protein, 18 aa, Cryptosporidium parvum
VSNWITGPCCWLDDKFKH

SEQ ID NO: 2345092 - protein, 22 aa, Cryptosporidium parvum
VSSKLLPPEALYTWPTSSSNQE

SEQ ID NO: 2345093 - protein, 18 aa, Cryptosporidium parvum
VSSLLFCGAMMLLDYPIS

SEQ ID NO: 2345094 - protein, 19 aa, Cryptosporidium parvum
VSTQGMWRTVNWGEPPVDI

SEQ ID NO: 2345095 - protein, 24 aa, Cryptosporidium parvum
VSTRLLKQLFRYIGQNPQHETILI

SEQ ID NO: 2345096 - protein, 23 aa, Cryptosporidium parvum
VTENCKKPFWVMVHERNQPHAAQ

SEQ ID NO: 2345097 - protein, 19 aa, Cryptosporidium parvum
VTFVINWLFVFYVIYPLMW

SEQ ID NO: 2345098 - protein, 40 aa, Cryptosporidium parvum; identical to SEQ ID NO: 2239355

SEQ ID NO: 2345099 - protein, 18 aa, Cryptosporidium parvum
VTIGPGLWGQHAAQQQPS

SEQ ID NO: 2345100 - protein, 20 aa, Cryptosporidium parvum
VTIMVFKQVVGLSILFIPSI

SEQ ID NO: 2345101 - protein, 17 aa, Cryptosporidium parvum
VTRSFHLLIAKRMANCV

SEQ ID NO: 2345102 - protein, 18 aa, Cryptosporidium parvum
VVALTCLSLLFLNGDIRR

SEQ ID NO: 2345103 - protein, 19 aa, Cryptosporidium parvum
VVCLFGICAPSSAFLESFF

SEQ ID NO: 2345104 - protein, 25 aa, Cryptosporidium parvum
VVCSLAKCRYMLKIDKIRSFSTPSN

SEQ ID NO: 2345105 - protein, 19 aa, Cryptosporidium parvum
VVDLCTLCTSMASKYQNNI

SEQ ID NO: 2345106 - protein, 23 aa, Cryptosporidium parvum
VVSMLCVYFIGVLFLAGFQEFIA

SEQ ID NO: 2345107 - protein, 18 aa, Cryptosporidium parvum
VWVLIYFYIHYLLLNTID

SEQ ID NO: 2345108 - protein, 22 aa, Cryptosporidium parvum
VYPKEKWRSITWEVQMHGMGLI

SEQ ID NO: 2345109 - protein, 21 aa, Cryptosporidium parvum
WALTRFFSFAIFDTTRNEACF

SEQ ID NO: 2345110 - protein, 23 aa, Cryptosporidium parvum
WDLLLKCDPEWVTVVFEVSAVQR

SEQ ID NO: 2345111 - protein, 30 aa, Cryptosporidium parvum
WDSMILWNDLFVWRNFVFSIIMNLISRSDH

SEQ ID NO: 2345112 - protein, 24 aa, Cryptosporidium parvum
WEQFPRYINPWFYNTRVLLARSKV

SEQ ID NO: 2345113 - protein, 27 aa, Cryptosporidium parvum
WEYIFRKAQIWRFLTSFFFVGPFSIGW

SEQ ID NO: 2345114 - protein, 26 aa, Cryptosporidium parvum
WFISQRWDFCPLVFKQLMQIKRSSSI

SEQ ID NO: 2345115 - protein, 20 aa, Cryptosporidium parvum
WILLLRITIFNGVGGSERNN

SEQ ID NO: 2345116 - protein, 30 aa, Cryptosporidium parvum
WISNLIFEILKGLIILLFFVKQRKRLCIVL

SEQ ID NO: 2345117 - protein, 25 aa, Cryptosporidium parvum
WKILKKDSFMLLSFVPIPTTAITYV

SEQ ID NO: 2345118 - protein, 21 aa, Cryptosporidium parvum
WKRNDFKYLVPHATQSLASDP

SEQ ID NO: 2345119 - protein, 19 aa, Cryptosporidium parvum
WKSSFSNQIPKEFEDLQTL

SEQ ID NO: 2345120 - protein, 17 aa, Cryptosporidium parvum
WLFVFYVIYPLMWEIIY

SEQ ID NO: 2345121 - protein, 22 aa, Cryptosporidium parvum
WLNKNCDEFFSLLLKQYSIIPI

SEQ ID NO: 2345122 - protein, 25 aa, Cryptosporidium parvum
WLRVIPILMIFLIYYRKVRVRRQSI

SEQ ID NO: 2345123 - protein, 25 aa, Cryptosporidium parvum
WNFKRIPEIYYFFESTFLWMLSYDY

SEQ ID NO: 2345124 - protein, 17 aa, Cryptosporidium parvum
WQHPWSFFHSNECFMLY

SEQ ID NO: 2345125 - protein, 18 aa, Cryptosporidium parvum
WRIEKFDKFILIIPFILV

SEQ ID NO: 2345126 - protein, 17 aa, Cryptosporidium parvum
WRTVNWGEPPVDIYTTG

SEQ ID NO: 2345127 - protein, 17 aa, Cryptosporidium parvum
WSSCMIITTSIRMGISY

SEQ ID NO: 2345128 - protein, 17 aa, Cryptosporidium parvum
WTGCSKFLCEGTKSRYR

SEQ ID NO: 2345129 - protein, 17 aa, Cryptosporidium parvum
WTIPHVILDSLLSCDNP

SEQ ID NO: 2345130 - protein, 19 aa, Cryptosporidium parvum
WTTDIWLNIIVAICLGLAF

SEQ ID NO: 2345131 - protein, 18 aa, Cryptosporidium parvum
WYMEIIIYLIKFIANNTQ

SEQ ID NO: 2345132 - protein, 18 aa, Cryptosporidium parvum
YANFLIDLIKMSPCSVIR

SEQ ID NO: 2345133 - protein, 25 aa, Cryptosporidium parvum
YCEIANWLCSSFVYFLDLNYIWVLR

SEQ ID NO: 2345134 - protein, 19 aa, Cryptosporidium parvum
YCQSMNFIAAILLINMKEE

SEQ ID NO: 2345135 - protein, 19 aa, Cryptosporidium parvum
YDYNHSWMFEKGPRPYCEY

SEQ ID NO: 2345136 - protein, 28 aa, Cryptosporidium parvum
YEEDLHMAIAMVCIFHLLPQGSDEFVSK

SEQ ID NO: 2345137 - protein, 20 aa, Cryptosporidium parvum
YEELYSFGFLLIGSCMTLLY

SEQ ID NO: 2345138 - protein, 27 aa, Cryptosporidium parvum
YENIKTRFNWDLSLFQTEFGYVKNINL

SEQ ID NO: 2345139 - protein, 17 aa, Cryptosporidium parvum
YFATYVFRPEGENRVQA

SEQ ID NO: 2345140 - protein, 20 aa, Cryptosporidium parvum
YFESIIYLFKCSNYKDYFQN

SEQ ID NO: 2345141 - protein, 24 aa, Cryptosporidium parvum
YFIQSIIRYHFENIINKDNNQNFQ

SEQ ID NO: 2345142 - protein, 20 aa, Cryptosporidium parvum
YFLEVVKLLIQFLGISSNGV

SEQ ID NO: 2345143 - protein, 17 aa, Cryptosporidium parvum
YFPDLYVDSSNGFSANG

SEQ ID NO: 2345144 - protein, 18 aa, Cryptosporidium parvum
YGGLRGGVSMALAMVFEG

SEQ ID NO: 2345145 - protein, 17 aa, Cryptosporidium parvum
YGLNGIKSFYIGSFLRA

SEQ ID NO: 2345146 - protein, 35 aa, Cryptosporidium parvum
YGYLSSLLHPIAHKMWGCVKYGHYYDSAGNNPLHL

SEQ ID NO: 2345147 - protein, 24 aa, Cryptosporidium parvum
YHGLRSPIGLTFLNGFAVSLACTP

SEQ ID NO: 2345148 - protein, 19 aa, Cryptosporidium parvum
YHIKEFRRAIFSWNPRIPK

SEQ ID NO: 2345149 - protein, 27 aa, Cryptosporidium parvum
YICDESFCIKSLFGIRTTESMITIENS

SEQ ID NO: 2345150 - protein, 24 aa, Cryptosporidium parvum
YIDPELKGQIAFYVAGTVLLTLLI

SEQ ID NO: 2345151 - protein, 18 aa, Cryptosporidium parvum
YIHYKYYLFCLILFNTLF

SEQ ID NO: 2345152 - protein, 22 aa, Cryptosporidium parvum
YIIFRRLGIIYILIQKPIILIF

SEQ ID NO: 2345153 - protein, 24 aa, Cryptosporidium parvum
YILKEIYSAIIYIKENISFEQILQ

SEQ ID NO: 2345154 - protein, 25 aa, Cryptosporidium parvum
YIPHPSEFFPFGWFFLKFGIHKHDN

SEQ ID NO: 2345155 - protein, 17 aa, Cryptosporidium parvum
YIRRVGVTRTAHVTLTE

SEQ ID NO: 2345156 - protein, 20 aa, Cryptosporidium parvum
YISYLKWYFVGINKLLTSDL

SEQ ID NO: 2345157 - protein, 26 aa, Cryptosporidium parvum
YITTSFGFLCIFSLIQFTQDLFQEKF

SEQ ID NO: 2345158 - protein, 33 aa, Cryptosporidium parvum
YKITKKNILLFIFACYTPIILIVGSIYLDILGI

SEQ ID NO: 2345159 - protein, 24 aa, Cryptosporidium parvum
YKNAPKGLGVMFSFLDRNNKKNPS

SEQ ID NO: 2345160 - protein, 23 aa, Cryptosporidium parvum
YKNELDFFYSRQFLSGQFFVDNI

SEQ ID NO: 2345161 - protein, 20 aa, Cryptosporidium parvum
YLEKYCYFTTPSVLDQQDNG

SEQ ID NO: 2345162 - protein, 22 aa, Cryptosporidium parvum
YLGEISRLLIINFLKNKTPEIF

SEQ ID NO: 2345163 - protein, 18 aa, Cryptosporidium parvum
YLIINFPGVSSIDEKVQE

SEQ ID NO: 2345164 - protein, 24 aa, Cryptosporidium parvum
YLINHCVLRYLYYFEQENKCNNFN

SEQ ID NO: 2345165 - protein, 17 aa, Cryptosporidium parvum
YLLQCEIKFFLKPERNI

SEQ ID NO: 2345166 - protein, 17 aa, Cryptosporidium parvum
YLMKLLYTECGYTFISK

SEQ ID NO: 2345167 - protein, 17 aa, Cryptosporidium parvum
YLSWKRNDFKYLVPHAT

SEQ ID NO: 2345168 - protein, 17 aa, Cryptosporidium parvum
YMEPLILLHEQNTDYLT

SEQ ID NO: 2345169 - protein, 23 aa, Cryptosporidium parvum
YMIGVLLYFCLTGEYYSFESKND

SEQ ID NO: 2345170 - protein, 17 aa, Cryptosporidium parvum
YNEECLIVKSIIVSSTF

SEQ ID NO: 2345171 - protein, 26 aa, Cryptosporidium parvum
YNELLFYSHFRWLKGEYIKKKRFEIS

SEQ ID NO: 2345172 - protein, 25 aa, Cryptosporidium parvum
YNLVENFPLLYFNRAFQTAQLPCLL

SEQ ID NO: 2345173 - protein, 18 aa, Cryptosporidium parvum
YNQFWAWKDIGDKSGKIV

SEQ ID NO: 2345174 - protein, 30 aa, Cryptosporidium parvum
YNWSLKRRVIDLIMEFPRSKSSILDLYITM

SEQ ID NO: 2345175 - protein, 25 aa, Cryptosporidium parvum
YPLWWKTKLHFTRSSPYLNHYIPEI

SEQ ID NO: 2345176 - protein, 28 aa, Cryptosporidium parvum
YPTGRKIGGSSLIFGIIYYWSKKFPTSL

SEQ ID NO: 2345177 - protein, 17 aa, Cryptosporidium parvum
YQHCILGSILVSNSSNM

SEQ ID NO: 2345178 - protein, 17 aa, Cryptosporidium parvum
YQRFLKKIDIFQVNIDS

SEQ ID NO: 2345179 - protein, 24 aa, Cryptosporidium parvum
YRAETFLATLEKVKLCLSDTTQLR

SEQ ID NO: 2345180 - protein, 24 aa, Cryptosporidium parvum
YRENCILSIFGVINYVISRVLYLS

SEQ ID NO: 2345181 - protein, 17 aa, Cryptosporidium parvum
YRGIGGLIWSSSSDVRI

SEQ ID NO: 2345182 - protein, 27 aa, Cryptosporidium parvum
YSDKPICIPNLFFGIELPKIIYQNNYS

SEQ ID NO: 2345183 - protein, 18 aa, Cryptosporidium parvum
YSECSIWGIDGLPNLRLI

SEQ ID NO: 2345184 - protein, 20 aa, Cryptosporidium parvum
YSKNCIGFKLGPKEEMKRLP

SEQ ID NO: 2345185 - protein, 23 aa, Cryptosporidium parvum
YSNLFSFESFCVLNYYNNSTRNN

SEQ ID NO: 2345186 - protein, 20 aa, Cryptosporidium parvum
YSNSYKWNWSSIPNNFVNFN

SEQ ID NO: 2345187 - protein, 20 aa, Cryptosporidium parvum
YSSTSQRGLRGYKEEIHPEL

SEQ ID NO: 2345188 - protein, 22 aa, Cryptosporidium parvum
YSTTILIKFDKSVLLRDKSIQS

SEQ ID NO: 2345189 - protein, 23 aa, Cryptosporidium parvum
YSVLRRIYEEFLSWYKFPKNEIN

SEQ ID NO: 2345190 - protein, 27 aa, Cryptosporidium parvum
YTDKYKRKIIKRVQGILRNLKIVNKSQ

SEQ ID NO: 2345191 - protein, 25 aa, Cryptosporidium parvum
YVDFIELVIFYFKKFNLKGVFVGNI

SEQ ID NO: 2345192 - protein, 22 aa, Cryptosporidium parvum
YVRQYLEYIFKAFYNKDDQDYI

SEQ ID NO: 2345193 - protein, 17 aa, Cryptosporidium parvum
YWNEFKNDFHVYLCNNT

SEQ ID NO: 2345194 - protein, 21 aa, Cryptosporidium parvum
YWSNGIFNYWRIEKFDKFILI

SEQ ID NO: 2345195 - protein, 20 aa, Cryptosporidium parvum
YYCKCAEGFYGRNCTISSDN

SEQ ID NO: 2345196 - protein, 25 aa, Cryptosporidium parvum
YYDEYKLLMLRNGDPFYIQDIKLDL

SEQ ID NO: 2345197 - protein, 19 aa, Cryptosporidium parvum
YYERSSRSASHFGKVYNGL

SEQ ID NO: 2345198 - protein, 19 aa, Cryptosporidium parvum
YYFSSLILWLFSKSNDSIV

SEQ ID NO: 2345199 - protein, 19 aa, Cryptosporidium parvum
YYIKEISPVLVREFGSQDD

SEQ ID NO: 2345200 - protein, 20 aa, Cryptosporidium parvum
YYISKTWVYHALIVSIVTII

SEQ ID NO: 2345201 - protein, 23 aa, Cryptosporidium parvum
YYKKRDLSVIILASCSSSIQDSQ

SEQ ID NO: 2345202 - protein, 23 aa, Cryptosporidium parvum
YYLLYPSCRIFEPLDNLKDEAFV

SEQ ID NO: 2345203 - protein, 18 aa, Cryptosporidium parvum
YYYTILLDRFMKSNLDIK

SEQ ID NO: 2345204 - protein, 20 aa, Cryptosporidium parvum
AELRSQYILRRIKENNCIKN

SEQ ID NO: 2345205 - protein, 20 aa, Cryptosporidium parvum
AETIKKLGFVGGKIKMISSH

SEQ ID NO: 2345206 - protein, 17 aa, Cryptosporidium parvum
AGAKMMIEWNFAFHWYD

SEQ ID NO: 2345207 - protein, 18 aa, Cryptosporidium parvum
AIGLLGYMHALGIGTSPD

SEQ ID NO: 2345208 - protein, 19 aa, Cryptosporidium parvum
AKMMIEWNFAFHWYDDGLP

SEQ ID NO: 2345209 - protein, 17 aa, Cryptosporidium parvum
ALFPESWIEFILMNNSR

SEQ ID NO: 2345210 - protein, 18 aa, Cryptosporidium parvum
APKGLGVMFSFLDRNNKK

SEQ ID NO: 2345211 - protein, 30 aa, Cryptosporidium parvum; identical to SEQ ID NO: 2240119

SEQ ID NO: 2345212 - protein, 18 aa, Cryptosporidium parvum
CGSCWAFSAVAALEGATC

SEQ ID NO: 2345213 - protein, 19 aa, Cryptosporidium parvum
CHRSLRILIELPLALLHIF

SEQ ID NO: 2345214 - protein, 17 aa, Cryptosporidium parvum
CPLPSMPFNKMAIYNQS

SEQ ID NO: 2345215 - protein, 19 aa, Cryptosporidium parvum
CPYISYKIPNSFIAFPTSI

SEQ ID NO: 2345216 - protein, 19 aa, Cryptosporidium parvum
CSGIFEWYTPLSLNSTIVE

SEQ ID NO: 2345217 - protein, 19 aa, Cryptosporidium parvum
CSILPGLLAKYGNLTPVPV

SEQ ID NO: 2345218 - protein, 25 aa, Cryptosporidium parvum
CSKCIKWKILMVLIVWYNLITTFKN

SEQ ID NO: 2345219 - protein, 18 aa, Cryptosporidium parvum
DCELKWALSDSELALITK

SEQ ID NO: 2345220 - protein, 20 aa, Cryptosporidium parvum
DEQTIRWSIENMLSRGIIQI

SEQ ID NO: 2345221 - protein, 26 aa, Cryptosporidium parvum
DGGTVFKGEFPVGGPFSSPSDSSTFS

SEQ ID NO: 2345222 - protein, 22 aa, Cryptosporidium parvum
DIGPRFGVIMQIIFASSEKHRN

SEQ ID NO: 2345223 - protein, 18 aa, Cryptosporidium parvum
DMYFCHFYKTNVELEKLD

SEQ ID NO: 2345224 - protein, 24 aa, Cryptosporidium parvum
DRNTLAMYMEWIWLNNHIQSVIEQ

SEQ ID NO: 2345225 - protein, 19 aa, Cryptosporidium parvum
DSKFFCWKKVRSKSSHLLN

SEQ ID NO: 2345226 - protein, 23 aa, Cryptosporidium parvum
DYYHWWFLCIDIVFSGISISQNS

SEQ ID NO: 2345227 - protein, 19 aa, Cryptosporidium parvum
ECFMLYKMLIGFYTATNNL

SEQ ID NO: 2345228 - protein, 24 aa, Cryptosporidium parvum
EDLHMAIAMVCIFHLLPQGSDEFV

SEQ ID NO: 2345229 - protein, 19 aa, Cryptosporidium parvum
EFFKFMVHFIFSLIIFQIV

SEQ ID NO: 2345230 - protein, 18 aa, Cryptosporidium parvum
EFTEWKCHGGFFCAAAVY

SEQ ID NO: 2345231 - protein, 17 aa, Cryptosporidium parvum
EFYSLLIQIFWKKTKFL

SEQ ID NO: 2345232 - protein, 23 aa, Cryptosporidium parvum
EHLKRRRIDVILTIATLFGTSST

SEQ ID NO: 2345233 - protein, 20 aa, Cryptosporidium parvum
EIAEFLIYYRFREVIRDKDD

SEQ ID NO: 2345234 - protein, 25 aa, Cryptosporidium parvum
EIEISLICYREFIRSFVIYKQGGLK

SEQ ID NO: 2345235 - protein, 18 aa, Cryptosporidium parvum
EIWLKIIPILSIPSGNLF

SEQ ID NO: 2345236 - protein, 19 aa, Cryptosporidium parvum
ELCIRVCLTSASLCFSGSG

SEQ ID NO: 2345237 - protein, 25 aa, Cryptosporidium parvum
ELKHLFKIPMNYLPYIPKDTGESDE

SEQ ID NO: 2345238 - protein, 20 aa, Cryptosporidium parvum
ELLELLASVLCYIHPQSFGD

SEQ ID NO: 2345239 - protein, 23 aa, Cryptosporidium parvum
ELMYCFFCRIFIYLKKIKINNSI

SEQ ID NO: 2345240 - protein, 19 aa, Cryptosporidium parvum
ENVVESFLGFASRLCTDVQ

SEQ ID NO: 2345241 - protein, 21 aa, Cryptosporidium parvum
EPGRVPAKWGFRVGDESKRRR

SEQ ID NO: 2345242 - protein, 17 aa, Cryptosporidium parvum
EPLRVAFTAQLRQVLHP

SEQ ID NO: 2345243 - protein, 18 aa, Cryptosporidium parvum
EQVLEAWAMVSISAKNFV

SEQ ID NO: 2345244 - protein, 18 aa, Cryptosporidium parvum
ERNFPVFIKRMVAQLIYL

SEQ ID NO: 2345245 - protein, 18 aa, Cryptosporidium parvum
ESFTRFRIIFSRERAKGL

SEQ ID NO: 2345246 - protein, 19 aa, Cryptosporidium parvum
ESSCCPLNLIRFCDNKQLL

SEQ ID NO: 2345247 - protein, 21 aa, Cryptosporidium parvum
ETLFSNWLRLMIAILIQDSYN

SEQ ID NO: 2345248 - protein, 17 aa, Cryptosporidium parvum
EWFLCFFVTSLPLKSIM

SEQ ID NO: 2345249 - protein, 17 aa, Cryptosporidium parvum
EYLGLAVDYRFISSDKD

SEQ ID NO: 2345250 - protein, 17 aa, Cryptosporidium parvum
FGDILTFPTKDYPNGLT

SEQ ID NO: 2345251 - protein, 19 aa, Cryptosporidium parvum
FHWRENFCRIIKEKGLSGL

SEQ ID NO: 2345252 - protein, 17 aa, Cryptosporidium parvum
FKEYLGLAVDYRFISSD

SEQ ID NO: 2345253 - protein, 22 aa, Cryptosporidium parvum
FKKISVIFLFIIVILLFLNFEL

SEQ ID NO: 2345254 - protein, 19 aa, Cryptosporidium parvum
FKLIPSFKLFLFIFFLFRF

SEQ ID NO: 2345255 - protein, 18 aa, Cryptosporidium parvum
FLFGFIVGFYRGWKMALV

SEQ ID NO: 2345256 - protein, 24 aa, Cryptosporidium parvum
FLLTFKILFCIGTKQIFPIGCPLN

SEQ ID NO: 2345257 - protein, 21 aa, Cryptosporidium parvum
FLPEMKRMIFGILIVITNWVC

SEQ ID NO: 2345258 - protein, 24 aa, Cryptosporidium parvum
FMNIQELFLFLSLFYHNYQREWIL

SEQ ID NO: 2345259 - protein, 17 aa, Cryptosporidium parvum
FMVHFIFSLIIFQIVNN

SEQ ID NO: 2345260 - protein, 17 aa, Cryptosporidium parvum
FRLRDFAEIFPVSASGK

SEQ ID NO: 2345261 - protein, 18 aa, Cryptosporidium parvum
FRSIFCLCREGSANHGIN

SEQ ID NO: 2345262 - protein, 17 aa, Cryptosporidium parvum
FSDMYFCHFYKTNVELE

SEQ ID NO: 2345263 - protein, 17 aa, Cryptosporidium parvum
FVLCMSVTCGIRSNGIL

SEQ ID NO: 2345264 - protein, 18 aa, Cryptosporidium parvum
FYRGWKMALVMSASLPIV

SEQ ID NO: 2345265 - protein, 19 aa, Cryptosporidium parvum
FYSHFRWLKGEYIKKKRFE

SEQ ID NO: 2345266 - protein, 17 aa, Cryptosporidium parvum
GCDCDRFPEGVACPMVL

SEQ ID NO: 2345267 - protein, 18 aa, Cryptosporidium parvum
GCICRFRKLLLIFNYEKN

SEQ ID NO: 2345268 - protein, 21 aa, Cryptosporidium parvum
GECPLRRVIYGFMTKIRLLLI

SEQ ID NO: 2345269 - protein, 25 aa, Cryptosporidium parvum
GFEHLWKKRVVYLLKMQSVNAVLFL

SEQ ID NO: 2345270 - protein, 26 aa, Cryptosporidium parvum
GIHLKREWHRLWLVRSFLAFAWESYL

SEQ ID NO: 2345271 - protein, 17 aa, Cryptosporidium parvum
GIYKEFLVILPWFLDTT

SEQ ID NO: 2345272 - protein, 18 aa, Cryptosporidium parvum
GLMSLRIFGILLNNINVD

SEQ ID NO: 2345273 - protein, 22 aa, Cryptosporidium parvum
GNLPLEVGFTFSFPIVQSKIAS

SEQ ID NO: 2345274 - protein, 17 aa, Cryptosporidium parvum
GPLISRSKLYGMMNKHP

SEQ ID NO: 2345275 - protein, 18 aa, Cryptosporidium parvum
GQFCMGMVYTLFPFLDSL

SEQ ID NO: 2345276 - protein, 22 aa, Cryptosporidium parvum
GRTFNCFCGYGIGLVDLTAIDG

SEQ ID NO: 2345277 - protein, 17 aa, Cryptosporidium parvum
HLRAICVHLGMKNDPIF

SEQ ID NO: 2345278 - protein, 30 aa, Cryptosporidium parvum
HLRDLIEIVRICILHGILIGINYLNKSEDN

SEQ ID NO: 2345279 - protein, 25 aa, Cryptosporidium parvum
IACSKIILWFVHFFRGFNGDEHISE

SEQ ID NO: 2345280 - protein, 25 aa, Cryptosporidium parvum
ICDESFCIKSLFGIRTTESMITIEN

SEQ ID NO: 2345281 - protein, 17 aa, Cryptosporidium parvum
ICEARKSLRDCIVSWVF

SEQ ID NO: 2345282 - protein, 18 aa, Cryptosporidium parvum
ICRESCPAFLSLKEVFQN

SEQ ID NO: 2345283 - protein, 18 aa, Cryptosporidium parvum
IDPYSLWMLVDYRWGWPL

SEQ ID NO: 2345284 - protein, 25 aa, Cryptosporidium parvum
IDSLFSLKHSFLWPHNNATLISAIS

SEQ ID NO: 2345285 - protein, 23 aa, Cryptosporidium parvum
IEDCLKLNFKGSLIFQNNESNKV

SEQ ID NO: 2345286 - protein, 23 aa, Cryptosporidium parvum
IENALRLSQAWDFVNSFRDGLET

SEQ ID NO: 2345287 - protein, 19 aa, Cryptosporidium parvum
IFFLFRFRKSIIKSLRDEV

SEQ ID NO: 2345288 - protein, 19 aa, Cryptosporidium parvum
IIGGFCFCGATGANRNHGN

SEQ ID NO: 2345289 - protein, 18 aa, Cryptosporidium parvum
IIIMCLRHIITLYTLSRF

SEQ ID NO: 2345290 - protein, 18 aa, Cryptosporidium parvum
IIPILSIPSGNLFKTRFY

SEQ ID NO: 2345291 - protein, 21 aa, Cryptosporidium parvum
IKFANSFPIIFEKLIPEYCIA

SEQ ID NO: 2345292 - protein, 17 aa, Cryptosporidium parvum
ILGFSFKFFSRIPRSYF

SEQ ID NO: 2345293 - protein, 18 aa, Cryptosporidium parvum
ILHICVFTGPIISSLTAL

SEQ ID NO: 2345294 - protein, 19 aa, Cryptosporidium parvum
ILIELPLALLHIFQLYPHF

SEQ ID NO: 2345295 - protein, 18 aa, Cryptosporidium parvum
ILIGFIFIIGILGAFFYL

SEQ ID NO: 2345296 - protein, 17 aa, Cryptosporidium parvum
ILITLGFLFSSLAIHFG

SEQ ID NO: 2345297 - protein, 20 aa, Cryptosporidium parvum
ILKKDSFMLLSFVPIPTTAI

SEQ ID NO: 2345298 - protein, 21 aa, Cryptosporidium parvum
ILKSLRPSLDFGENTSHHIPI

SEQ ID NO: 2345299 - protein, 17 aa, Cryptosporidium parvum
ILSRYSIRISMNLNENE

SEQ ID NO: 2345300 - protein, 22 aa, Cryptosporidium parvum
IMGLCIFVRLFAVVRYEAIIHE

SEQ ID NO: 2345301 - protein, 18 aa, Cryptosporidium parvum
IPEIYYFFESTFLWMLSY

SEQ ID NO: 2345302 - protein, 20 aa, Cryptosporidium parvum
IRYIISIIFYFIWGIELTPK

SEQ ID NO: 2345303 - protein, 23 aa, Cryptosporidium parvum
ISLWKTIFPWIWNNLEHQQRNEL

SEQ ID NO: 2345304 - protein, 17 aa, Cryptosporidium parvum
ISMGFEFSVLVLYLLEG

SEQ ID NO: 2345305 - protein, 22 aa, Cryptosporidium parvum
ISSRLFSLWLFVQKRLTTIQIA

SEQ ID NO: 2345306 - protein, 17 aa, Cryptosporidium parvum
ITAMLDRLCVNNINSIS

SEQ ID NO: 2345307 - protein, 21 aa, Cryptosporidium parvum
IVFASLCFYFRDSVSMSCTVL

SEQ ID NO: 2345308 - protein, 17 aa, Cryptosporidium parvum
IYHSCFKLIPSFKLFLF

SEQ ID NO: 2345309 - protein, 18 aa, Cryptosporidium parvum
KATARAGVKIIYTPTILL

SEQ ID NO: 2345310 - protein, 23 aa, Cryptosporidium parvum
KCHGGFFCAAAVYIAEDYIDSIA

SEQ ID NO: 2345311 - protein, 29 aa, Cryptosporidium parvum
KEKECLRCKLPPVPDCSWIMKALYMNDLQ

SEQ ID NO: 2345312 - protein, 17 aa, Cryptosporidium parvum
KIAEMIFEFHYLLEISL

SEQ ID NO: 2345313 - protein, 19 aa, Cryptosporidium parvum
KINTIWAIFRVQFLVLLLF

SEQ ID NO: 2345314 - protein, 17 aa, Cryptosporidium parvum
KKPFWVMVHERNQPHAA

SEQ ID NO: 2345315 - protein, 18 aa, Cryptosporidium parvum
KLFLPDWSPLGGFLLVIV

SEQ ID NO: 2345316 - protein, 22 aa, Cryptosporidium parvum
KLKRFFAEFIIRMEDFDVSVIP

SEQ ID NO: 2345317 - protein, 24 aa, Cryptosporidium parvum
KLNFCCFTGYYYCDYCYGSNTCSI

SEQ ID NO: 2345318 - protein, 17 aa, Cryptosporidium parvum
KLRCKGIGLDLRGNEKM

SEQ ID NO: 2345319 - protein, 24 aa, Cryptosporidium parvum
KMIKRIGLKLGVEIGGPILILKNE

SEQ ID NO: 2345320 - protein, 19 aa, Cryptosporidium parvum
KNCSFYSIWQEFTDQVNNM

SEQ ID NO: 2345321 - protein, 23 aa, Cryptosporidium parvum
KNILKFILHWSIAFIMFISTIFP

SEQ ID NO: 2345322 - protein, 22 aa, Cryptosporidium parvum
KNNEFRSSGILEYISPYSPLII

SEQ ID NO: 2345323 - protein, 20 aa, Cryptosporidium parvum
KRLAAYLLLCFVIGNGLGPL

SEQ ID NO: 2345324 - protein, 25 aa, Cryptosporidium parvum
KRRARKIMTKKGLSLLIKEFNTSKT

SEQ ID NO: 2345325 - protein, 19 aa, Cryptosporidium parvum
KRRVIDLIMEFPRSKSSIL

SEQ ID NO: 2345326 - protein, 22 aa, Cryptosporidium parvum
KSELKFTWLGWLSFGRDQETGD

SEQ ID NO: 2345327 - protein, 22 aa, Cryptosporidium parvum
KSLNILPFKGFEILDKYFNNSI

SEQ ID NO: 2345328 - protein, 19 aa, Cryptosporidium parvum
KWYLPQMFLEFSIYNENVD

SEQ ID NO: 2345329 - protein, 23 aa, Cryptosporidium parvum
KYLCYKYKFMLVPSMLILVIKNE

SEQ ID NO: 2345330 - protein, 19 aa, Cryptosporidium parvum
LCEEWPSLLVIDFLEYYAS

SEQ ID NO: 2345331 - protein, 19 aa, Cryptosporidium parvum
LDMEGRFVLISAMTNFLGY

SEQ ID NO: 2345332 - protein, 17 aa, Cryptosporidium parvum
LDVFCLYSLRPDTDPTR

SEQ ID NO: 2345333 - protein, 20 aa, Cryptosporidium parvum
LEFSNWLLTNWVFRTISNLP

SEQ ID NO: 2345334 - protein, 17 aa, Cryptosporidium parvum
LFKEMKSPIVGVGDICF

SEQ ID NO: 2345335 - protein, 23 aa, Cryptosporidium parvum
LHNFWKVVIGFIMSVLSGISIPL

SEQ ID NO: 2345336 - protein, 23 aa, Cryptosporidium parvum
LIFEILKGLIILLFFVKQRKRLC

SEQ ID NO: 2345337 - protein, 18 aa, Cryptosporidium parvum
LILEGGGIPSVFLQSISD

SEQ ID NO: 2345338 - protein, 19 aa, Cryptosporidium parvum
LISKAVMFSSLFVRKLNES

SEQ ID NO: 2345339 - protein, 17 aa, Cryptosporidium parvum
LKELSAMFWNNKYIGDF

SEQ ID NO: 2345340 - protein, 21 aa, Cryptosporidium parvum
LKIEILKLLILLVKNKYSLET

SEQ ID NO: 2345341 - protein, 20 aa, Cryptosporidium parvum
LKIVLPILMAFLIIVGYRIT

SEQ ID NO: 2345342 - protein, 17 aa, Cryptosporidium parvum
LLCKVLFYQGDFLECSI

SEQ ID NO: 2345343 - protein, 17 aa, Cryptosporidium parvum
LLFELMCYLGLTMISYN

SEQ ID NO: 2345344 - protein, 24 aa, Cryptosporidium parvum
LNISLHCNFTWSCIRNIFESNIRR

SEQ ID NO: 2345345 - protein, 17 aa, Cryptosporidium parvum
LPFDGLVGLGFPDKNSK

SEQ ID NO: 2345346 - protein, 18 aa, Cryptosporidium parvum
LPLFLDRIIPSWVAVICS

SEQ ID NO: 2345347 - protein, 18 aa, Cryptosporidium parvum
LQVPHWFNFMAIESESQQ

SEQ ID NO: 2345348 - protein, 18 aa, Cryptosporidium parvum
LRFSLFGEISIPVFRDII

SEQ ID NO: 2345349 - protein, 21 aa, Cryptosporidium parvum
LRNLFGLYCHVVFSLCKFVSV

SEQ ID NO: 2345350 - protein, 22 aa, Cryptosporidium parvum
LRYSEFLKEFILIINSFENCLR

SEQ ID NO: 2345351 - protein, 20 aa, Cryptosporidium parvum
LSILVLFSWISIVIGGEGNL

SEQ ID NO: 2345352 - protein, 17 aa, Cryptosporidium parvum
LSLRFEKMMEFLILETK

SEQ ID NO: 2345353 - protein, 18 aa, Cryptosporidium parvum
LVFIPFLIVILIKRLNNH

SEQ ID NO: 2345354 - protein, 19 aa, Cryptosporidium parvum
MKSPIVGVGDICFGNNCNY

SEQ ID NO: 2345355 - protein, 20 aa, Cryptosporidium parvum
NCVFGGVLICHGNFGDQARE

SEQ ID NO: 2345356 - protein, 20 aa, Cryptosporidium parvum
NCYRRWKWKKRVKRRKMKKI

SEQ ID NO: 2345357 - protein, 18 aa, Cryptosporidium parvum
NEDLELWNLLGYKNAPKG

SEQ ID NO: 2345358 - protein, 17 aa, Cryptosporidium parvum
NEPLKLNPCYNIQEYDM

SEQ ID NO: 2345359 - protein, 19 aa, Cryptosporidium parvum
NFNDHWRKGAGILPLNMLY

SEQ ID NO: 2345360 - protein, 23 aa, Cryptosporidium parvum
NFVWKIILFFIIWKSRNDFIKFQ

SEQ ID NO: 2345361 - protein, 17 aa, Cryptosporidium parvum
NIIQFWKSYFHPNYTNI

SEQ ID NO: 2345362 - protein, 23 aa, Cryptosporidium parvum
NIKTRFNWDLSLFQTEFGYVKNI

SEQ ID NO: 2345363 - protein, 19 aa, Cryptosporidium parvum
NLNCWRKLLPCTTLDFSSK

SEQ ID NO: 2345364 - protein, 20 aa, Cryptosporidium parvum
NPQCVPLTILENGCPMKQVG

SEQ ID NO: 2345365 - protein, 21 aa, Cryptosporidium parvum
NRAFEWYGDFEVLRDLLIQSL

SEQ ID NO: 2345366 - protein, 17 aa, Cryptosporidium parvum
NTLRILITLGFLFSSLA

SEQ ID NO: 2345367 - protein, 20 aa, Cryptosporidium parvum
NTNIYLKWSRLVYEELENQK

SEQ ID NO: 2345368 - protein, 21 aa, Cryptosporidium parvum
PDIQALFLLKICKTSYEINNR

SEQ ID NO: 2345369 - protein, 25 aa, Cryptosporidium parvum
PHGIPYWLVPVFEFLKLPASSTLSS

SEQ ID NO: 2345370 - protein, 22 aa, Cryptosporidium parvum
PHPKIKLGFLKWFNEKLPKDLF

SEQ ID NO: 2345371 - protein, 19 aa, Cryptosporidium parvum
PIFNWELLKNIWLPFRLIS

SEQ ID NO: 2345372 - protein, 21 aa, Cryptosporidium parvum
PKRTGYRPVPGVLIYPQNFRE

SEQ ID NO: 2345373 - protein, 26 aa, Cryptosporidium parvum
PKSTFSWKIMSIFSFLKLKKPKYAPP

SEQ ID NO: 2345374 - protein, 20 aa, Cryptosporidium parvum
PLPCLGFLTSVFEGEVSPEY

SEQ ID NO: 2345375 - protein, 17 aa, Cryptosporidium parvum
PPPLRQIPMPSISVESL

SEQ ID NO: 2345376 - protein, 17 aa, Cryptosporidium parvum
PQMFLEFSIYNENVDSI

SEQ ID NO: 2345377 - protein, 22 aa, Cryptosporidium parvum
PRIPLDIACTAMWFISQRWDFC

SEQ ID NO: 2345378 - protein, 19 aa, Cryptosporidium parvum
PVYECIKLIITKFLLLILV

SEQ ID NO: 2345379 - protein, 20 aa, Cryptosporidium parvum
QDLEAITAMLDRLCVNNINS

SEQ ID NO: 2345380 - protein, 24 aa, Cryptosporidium parvum
QKVVYCLYSLLGIAFILFKLGTMG

SEQ ID NO: 2345381 - protein, 19 aa, Cryptosporidium parvum
QMIKDRHFLGAYTIFGSLL

SEQ ID NO: 2345382 - protein, 23 aa, Cryptosporidium parvum
QPSLRPLVPLALDRSIREILQVV

SEQ ID NO: 2345383 - protein, 17 aa, Cryptosporidium parvum
QSIFKFYLLESIGHQMA

SEQ ID NO: 2345384 - protein, 25 aa, Cryptosporidium parvum
RDIISQIAFCYRISSVFLISKLNSL

SEQ ID NO: 2345385 - protein, 22 aa, Cryptosporidium parvum
RGFIPFILCGDLSPINNIDPKD

SEQ ID NO: 2345386 - protein, 17 aa, Cryptosporidium parvum
RGILRYFLIYGSNHRWV

SEQ ID NO: 2345387 - protein, 17 aa, Cryptosporidium parvum
RHFLGAYTIFGSLLTAL

SEQ ID NO: 2345388 - protein, 23 aa, Cryptosporidium parvum
RIIRELYRYRGLRTFWTGLLPTM

SEQ ID NO: 2345389 - protein, 21 aa, Cryptosporidium parvum
RIRLKHIFLIFIFTVLYVSCF

SEQ ID NO: 2345390 - protein, 27 aa, Cryptosporidium parvum
RKSLRDCIVSWVFPRARRMGLMPQNSS

SEQ ID NO: 2345391 - protein, 17 aa, Cryptosporidium parvum
RKTCVIETFAPGFPGCA

SEQ ID NO: 2345392 - protein, 21 aa, Cryptosporidium parvum
RLFNILCEWCDYFGPNIMTIF

SEQ ID NO: 2345393 - protein, 26 aa, Cryptosporidium parvum
RLSKKSLKEGFQWLISMEENTGNENY

SEQ ID NO: 2345394 - protein, 19 aa, Cryptosporidium parvum
RRSICWTAFDFTELVPCVL

SEQ ID NO: 2345395 - protein, 20 aa, Cryptosporidium parvum
RSLLRLFFLFSSFKEDNASR

SEQ ID NO: 2345396 - protein, 18 aa, Cryptosporidium parvum
RSLYSLEWEFEWLNNNSE

SEQ ID NO: 2345397 - protein, 25 aa, Cryptosporidium parvum
RYHISILMKAIFVFMFFDVSREFYI

SEQ ID NO: 2345398 - protein, 17 aa, Cryptosporidium parvum
SDCACLYTCPSHIAHSP

SEQ ID NO: 2345399 - protein, 24 aa, Cryptosporidium parvum
SDKPICIPNLFFGIELPKIIYQNN

SEQ ID NO: 2345400 - protein, 17 aa, Cryptosporidium parvum
SDYKLFFRFLKARQFNV

SEQ ID NO: 2345401 - protein, 24 aa, Cryptosporidium parvum
SELPFWFERWLEAFNEKFNFLNHE

SEQ ID NO: 2345402 - protein, 21 aa, Cryptosporidium parvum
SFELSYKWCFQVFSYDNRYCD

SEQ ID NO: 2345403 - protein, 23 aa, Cryptosporidium parvum
SFIGKVCSIEFYLYNPLSFPIVC

SEQ ID NO: 2345404 - protein, 22 aa, Cryptosporidium parvum
SFKLFLFIFFLFRFRKSIIKSL

SEQ ID NO: 2345405 - protein, 25 aa, Cryptosporidium parvum
SFNTGGICSFLWIMAKFPDYVYCDK

SEQ ID NO: 2345406 - protein, 19 aa, Cryptosporidium parvum
SFWSFKLPLIIKNIIFFIY

SEQ ID NO: 2345407 - protein, 17 aa, Cryptosporidium parvum
SILRFVFSYHKFFNPQN

SEQ ID NO: 2345408 - protein, 20 aa, Cryptosporidium parvum
SIQILESFLGYSLDYIISKE

SEQ ID NO: 2345409 - protein, 18 aa, Cryptosporidium parvum
SKRLKLIAVVPFKGIFST

SEQ ID NO: 2345410 - protein, 17 aa, Cryptosporidium parvum
SLFRHCLNFNKITASLI

SEQ ID NO: 2345411 - protein, 20 aa, Cryptosporidium parvum
SPFRIACQFSLIKCTLANIK

SEQ ID NO: 2345412 - protein, 17 aa, Cryptosporidium parvum
SPIGLTFLNGFAVSLAC

SEQ ID NO: 2345413 - protein, 18 aa, Cryptosporidium parvum
SPIPGPIRFCREVKYLTK

SEQ ID NO: 2345414 - protein, 18 aa, Cryptosporidium parvum
SREFYIVLISLYFLYIRG

SEQ ID NO: 2345415 - protein, 19 aa, Cryptosporidium parvum
SREGLKWVCMDIEKDFGDY

SEQ ID NO: 2345416 - protein, 17 aa, Cryptosporidium parvum
SRLGRCYLWLENKDLVT

SEQ ID NO: 2345417 - protein, 22 aa, Cryptosporidium parvum
SSSENWLALQFIKQYNVSIYID

SEQ ID NO: 2345418 - protein, 17 aa, Cryptosporidium parvum
SYVIRLLYQINRTSVRT

SEQ ID NO: 2345419 - protein, 24 aa, Cryptosporidium parvum
TEKLSGFCLYIFTPLAILTFFKFT

SEQ ID NO: 2345420 - protein, 21 aa, Cryptosporidium parvum
TFSSRFGWRRVEEIIKSNTSD

SEQ ID NO: 2345421 - protein, 23 aa, Cryptosporidium parvum
TNLRFTALSAFNWYLISMGFEFS

SEQ ID NO: 2345422 - protein, 18 aa, Cryptosporidium parvum
TRLLKQLFRYIGQNPQHE

SEQ ID NO: 2345423 - protein, 24 aa, Cryptosporidium parvum
TVPARLKSLLPYMGQLISPMLNAL

SEQ ID NO: 2345424 - protein, 17 aa, Cryptosporidium parvum
VCNFKFYTPCIKYLMQF

SEQ ID NO: 2345425 - protein, 23 aa, Cryptosporidium parvum
VGTLRAGFLLNYYPLINLWSGLN

SEQ ID NO: 2345426 - protein, 18 aa, Cryptosporidium parvum
VIEGFLFEEIMPEVKKRK

SEQ ID NO: 2345427 - protein, 18 aa, Cryptosporidium parvum
VLIPHSWLSSQMIYNESR

SEQ ID NO: 2345428 - protein, 18 aa, Cryptosporidium parvum
VMFLRYFSPLIIYVLDKA

SEQ ID NO: 2345429 - protein, 17 aa, Cryptosporidium parvum
VMIRISIIFPYSTLNDD

SEQ ID NO: 2345430 - protein, 20 aa, Cryptosporidium parvum
VPAKSWLPMMNLIGNEENNE

SEQ ID NO: 2345431 - protein, 17 aa, Cryptosporidium parvum
VPPELKLQIPPGSQNSD

SEQ ID NO: 2345432 - protein, 24 aa, Cryptosporidium parvum
VQVFRRMISIFSWFFTGIVILLMV

SEQ ID NO: 2345433 - protein, 26 aa, Cryptosporidium parvum
VSTCLLGSALLEWILSVVFVRQPPTT

SEQ ID NO: 2345434 - protein, 17 aa, Cryptosporidium parvum
VSWMPLMLENCSPALSD

SEQ ID NO: 2345435 - protein, 22 aa, Cryptosporidium parvum
VVCTLQGMQCCVPQKSAKGWRK

SEQ ID NO: 2345436 - protein, 17 aa, Cryptosporidium parvum
WELLKNIWLPFRLISKN

SEQ ID NO: 2345437 - protein, 19 aa, Cryptosporidium parvum
WFDSRSWYPLGRIIGQTLF

SEQ ID NO: 2345438 - protein, 26 aa, Cryptosporidium parvum
WIHCIQARIAILSGIIWGLGIVFAGK

SEQ ID NO: 2345439 - protein, 19 aa, Cryptosporidium parvum
WKSQCYVDILPLDFCDVNH

SEQ ID NO: 2345440 - protein, 17 aa, Cryptosporidium parvum
WLKLRKEAIGWFIYTIE

SEQ ID NO: 2345441 - protein, 23 aa, Cryptosporidium parvum
WMLVDYRWGWPLVNSYFQLQEPL

SEQ ID NO: 2345442 - protein, 19 aa, Cryptosporidium parvum
WRKLLPCTTLDFSSKIGSY

SEQ ID NO: 2345443 - protein, 18 aa, Cryptosporidium parvum
YKLLEISLIFAGIVTGIL

SEQ ID NO: 2345444 - protein, 17 aa, Cryptosporidium parvum
YKSGFINSGCICRFRKL

SEQ ID NO: 2345445 - protein, 25 aa, Cryptosporidium parvum
YPYYYRPFFGYGFPLLGTEPYFQSG

SEQ ID NO: 2345446 - protein, 18 aa, Cryptosporidium parvum
YSCFNFWGAFLILKAESN

SEQ ID NO: 2345447 - protein, 24 aa, Cryptosporidium parvum
YSDHLPCAVWLPWIPQLIAGIDRI

SEQ ID NO: 2345448 - protein, 20 aa, Cryptosporidium parvum
YSIRFLKLILLHPNWSEFLR

SEQ ID NO: 2345449 - protein, 20 aa, Cryptosporidium parvum
YSNTRFGDILTFPTKDYPNG

SEQ ID NO: 2345450 - protein, 17 aa, Cryptosporidium parvum
YYLRISYYNDYEYEHQH

SEQ ID NO: 2345451 - protein, 25 aa, Cryptosporidium parvum
AAGVGIYFGWKLFKKGKVCSMIKEI

SEQ ID NO: 2345452 - protein, 25 aa, Cryptosporidium parvum
AAMLLLFEILFVTILLNMFTTIIMN

SEQ ID NO: 2345453 - protein, 18 aa, Cryptosporidium parvum
AEIYNFMDDIYLAEFHGF

SEQ ID NO: 2345454 - protein, 30 aa, Cryptosporidium parvum
AEMIFEFHYLLEISLKYLLCNRYDSSELKK

SEQ ID NO: 2345455 - protein, 21 aa, Cryptosporidium parvum
AFSFAAFLICSLTLCLYAFLM

SEQ ID NO: 2345456 - protein, 19 aa, Cryptosporidium parvum
AGELFLVGISFLLDGKIPI

SEQ ID NO: 2345457 - protein, 21 aa, Cryptosporidium parvum
AGGVPILVGFVSTCLLGSALL

SEQ ID NO: 2345458 - protein, 23 aa, Cryptosporidium parvum
AGRISPVLLFLSVVLIMGLCIFV

SEQ ID NO: 2345459 - protein, 17 aa, Cryptosporidium parvum
AIPHFRIFERMLSITSR

SEQ ID NO: 2345460 - protein, 36 aa, Cryptosporidium parvum; identical to SEQ ID NO: 2129901

SEQ ID NO: 2345461 - protein, 21 aa, Cryptosporidium parvum
AKVIPKILLKFFPDLENINLD

SEQ ID NO: 2345462 - protein, 23 aa, Cryptosporidium parvum
ALDTNGLVWVWGQNNLKQLTGIP

SEQ ID NO: 2345463 - protein, 18 aa, Cryptosporidium parvum
ALFSLYLAYKFLPVYWVN

SEQ ID NO: 2345464 - protein, 22 aa, Cryptosporidium parvum
ALIRLSLFLPFVPSNCLLSLTD

SEQ ID NO: 2345465 - protein, 26 aa, Cryptosporidium parvum
ALLFSNNLLQVPHWFNFMAIESESQQ

SEQ ID NO: 2345466 - protein, 33 aa, Cryptosporidium parvum; identical to SEQ ID NO: 2241645

SEQ ID NO: 2345467 - protein, 24 aa, Cryptosporidium parvum
ALLYACYFVILLQPLFEIYYIGAS

SEQ ID NO: 2345468 - protein, 26 aa, Cryptosporidium parvum
ALNGILRSLILTKLELLEKLSRFKIQ

SEQ ID NO: 2345469 - protein, 20 aa, Cryptosporidium parvum
ANGKLKLFLTKTINIENFDT

SEQ ID NO: 2345470 - protein, 24 aa, Cryptosporidium parvum
ANIEHFRFYTIRNITGNITDVISK

SEQ ID NO: 2345471 - protein, 23 aa, Cryptosporidium parvum
ANVFSIFFVITNASIALGQSTPS

SEQ ID NO: 2345472 - protein, 22 aa, Cryptosporidium parvum
APNGRYILITLGQEYVAKALTM

SEQ ID NO: 2345473 - protein, 26 aa, Cryptosporidium parvum
AQKKKLYLLILLHSVDISNPLMNTNI

SEQ ID NO: 2345474 - protein, 28 aa, Cryptosporidium parvum
ASGIYKEFLVILPWFLDTTIKMQKETKS

SEQ ID NO: 2345475 - protein, 24 aa, Cryptosporidium parvum
ATARAGVKIIYTPTILLSSSESLN

SEQ ID NO: 2345476 - protein, 41 aa, Cryptosporidium parvum; identical to SEQ ID NO: 2241733

SEQ ID NO: 2345477 - protein, 27 aa, Cryptosporidium parvum
AVKSMSGFLSRFPLNDILQTSISLYNS

SEQ ID NO: 2345478 - protein, 20 aa, Cryptosporidium parvum
AWQHPWSFFHSNECFMLYKM

SEQ ID NO: 2345479 - protein, 23 aa, Cryptosporidium parvum
AYNNALGFLFLSAGHFSFSNKDK

SEQ ID NO: 2345480 - protein, 19 aa, Cryptosporidium parvum
AYSVKRSIRHSWQERIATD

SEQ ID NO: 2345481 - protein, 29 aa, Cryptosporidium parvum
CALGGPLLGFLFGWGVHLFLKVAQATNDV

SEQ ID NO: 2345482 - protein, 31 aa, Cryptosporidium parvum; identical to SEQ ID NO: 2129995

SEQ ID NO: 2345483 - protein, 24 aa, Cryptosporidium parvum
CDCDRFPEGVACPMVLSGEANIEC

SEQ ID NO: 2345484 - protein, 18 aa, Cryptosporidium parvum
CDVAILICVPPELKLQIP

SEQ ID NO: 2345485 - protein, 28 aa, Cryptosporidium parvum
CEHKKYSWWVYFVFCIATQIIIGAIVKS

SEQ ID NO: 2345486 - protein, 25 aa, Cryptosporidium parvum
CFFLIVCGWVINVFWPFVEGIGIRD

SEQ ID NO: 2345487 - protein, 26 aa, Cryptosporidium parvum
CFHIPQIKLVLSWISRIYGSNLTLLY

SEQ ID NO: 2345488 - protein, 20 aa, Cryptosporidium parvum
CFMLYKMLIGFYTATNNLEN

SEQ ID NO: 2345489 - protein, 23 aa, Cryptosporidium parvum
CIASVLPFICKILENVKGGYYYP

SEQ ID NO: 2345490 - protein, 26 aa, Cryptosporidium parvum
CICRFRKLLLIFNYEKNELKLILCEL

SEQ ID NO: 2345491 - protein, 29 aa, Cryptosporidium parvum
CIKLIITKFLLLILVSIVGGSFFPLWAPI

SEQ ID NO: 2345492 - protein, 26 aa, Cryptosporidium parvum
CIYRVPMDITPWRKSIPEYDYQKLSN

SEQ ID NO: 2345493 - protein, 18 aa, Cryptosporidium parvum
CKPLKRYSIPTPRSIPII

SEQ ID NO: 2345494 - protein, 33 aa, Cryptosporidium parvum
CKYDIEKIIFIITPLHLLINYFKNIGNYCIRIF

SEQ ID NO: 2345495 - protein, 35 aa, Cryptosporidium parvum; identical to SEQ ID NO: 2241819

SEQ ID NO: 2345496 - protein, 27 aa, Cryptosporidium parvum
CLRIVEFIYKLFFRSIEDWHYPITKKL

SEQ ID NO: 2345497 - protein, 24 aa, Cryptosporidium parvum
CMEALPLFLDRIIPSWVAVICSVT

SEQ ID NO: 2345498 - protein, 23 aa, Cryptosporidium parvum
CMKTTNPIMKCPVEYTLVGENMC

SEQ ID NO: 2345499 - protein, 23 aa, Cryptosporidium parvum
CPLRRVIYGFMTKIRLLLIESIP

SEQ ID NO: 2345500 - protein, 17 aa, Cryptosporidium parvum
CPRGFGRTSFRLYESVQ

SEQ ID NO: 2345501 - protein, 26 aa, Cryptosporidium parvum
CQYLSTKLISAIIYLAILGLTDHCIL

SEQ ID NO: 2345502 - protein, 33 aa, Cryptosporidium parvum; identical to SEQ ID NO: 2241847

SEQ ID NO: 2345503 - protein, 27 aa, Cryptosporidium parvum
CVIRGIMVFILSPLLTRIGYGLTIKEA

SEQ ID NO: 2345504 - protein, 17 aa, Cryptosporidium parvum
CVSKQTVFTHYYCPPKF

SEQ ID NO: 2345505 - protein, 31 aa, Cryptosporidium parvum
CWLSIISTCILSLILSLIWIAHPPSSIILDR

SEQ ID NO: 2345506 - protein, 25 aa, Cryptosporidium parvum
DAFMAFQILQLLIKLAKTGRTIICT

SEQ ID NO: 2345507 - protein, 25 aa, Cryptosporidium parvum
DAITTKFYILHNWVFFGNNVVNTSQ

SEQ ID NO: 2345508 - protein, 18 aa, Cryptosporidium parvum
DEKHLPYYFLNEFPICKE

SEQ ID NO: 2345509 - protein, 17 aa, Cryptosporidium parvum
DFCPLVFKQLMQIKRSS

SEQ ID NO: 2345510 - protein, 22 aa, Cryptosporidium parvum
DGIFTYTFDTRLMLGKTAVTMS

SEQ ID NO: 2345511 - protein, 24 aa, Cryptosporidium parvum
DGSLDFPCDDLTGMYAFCVGSINN

SEQ ID NO: 2345512 - protein, 33 aa, Cryptosporidium parvum; identical to SEQ ID NO: 2241965

SEQ ID NO: 2345513 - protein, 17 aa, Cryptosporidium parvum
DIRGEVWCYLLGSDRML

SEQ ID NO: 2345514 - protein, 17 aa, Cryptosporidium parvum
DISFFNLFLGNFAVIPA

SEQ ID NO: 2345515 - protein, 21 aa, Cryptosporidium parvum
DISPIIMREYLLKVLINDSCG

SEQ ID NO: 2345516 - protein, 18 aa, Cryptosporidium parvum
DITGNTLIIPIKKNQKNL

SEQ ID NO: 2345517 - protein, 17 aa, Cryptosporidium parvum
DIYLAEFHGFIDEKTWE

SEQ ID NO: 2345518 - protein, 20 aa, Cryptosporidium parvum
DKFFLIFYSSQVASLSKITG

SEQ ID NO: 2345519 - protein, 19 aa, Cryptosporidium parvum
DKITFSISKINLVLSWILN

SEQ ID NO: 2345520 - protein, 28 aa, Cryptosporidium parvum
DKNPFTYPFFILLLDVFTYIIIMCLRHI

SEQ ID NO: 2345521 - protein, 28 aa, Cryptosporidium parvum
DKPICIPNLFFGIELPKIIYQNNYSQGI

SEQ ID NO: 2345522 - protein, 27 aa, Cryptosporidium parvum
DKQYKIWIQTIPYYCYNLILSVLKKEE

SEQ ID NO: 2345523 - protein, 22 aa, Cryptosporidium parvum
DLDAILQVVPHLRSLSANIFLE

SEQ ID NO: 2345524 - protein, 24 aa, Cryptosporidium parvum
DLDEYEDLYYYGFENDYGSNHSKN

SEQ ID NO: 2345525 - protein, 25 aa, Cryptosporidium parvum
DLIEIVRICILHGILIGINYLNKSE

SEQ ID NO: 2345526 - protein, 17 aa, Cryptosporidium parvum
DLSLGIHLKREWHRLWL

SEQ ID NO: 2345527 - protein, 27 aa, Cryptosporidium parvum
DLSLLLLWLVLLMNICIIPIFSIDIFY

SEQ ID NO: 2345528 - protein, 23 aa, Cryptosporidium parvum
DLSPLFYSVISKNLRMTHFLLKC

SEQ ID NO: 2345529 - protein, 20 aa, Cryptosporidium parvum
DNFDHFYHLDFPILDNKIIK

SEQ ID NO: 2345530 - protein, 18 aa, Cryptosporidium parvum
DNYKLLFFSFIQTFVTLF

SEQ ID NO: 2345531 - protein, 17 aa, Cryptosporidium parvum
DPFLPTLKIGNLPEMKL

SEQ ID NO: 2345532 - protein, 21 aa, Cryptosporidium parvum
DPLCVKVPILIRPSPINNKLD

SEQ ID NO: 2345533 - protein, 26 aa, Cryptosporidium parvum
DPLKIEILKLLILLVKNKYSLETISN

SEQ ID NO: 2345534 - protein, 21 aa, Cryptosporidium parvum
DQIRKHWFFNAHPGLLELCDT

SEQ ID NO: 2345535 - protein, 22 aa, Cryptosporidium parvum
DRDLDCIYLTSTGMQTEIRVAD

SEQ ID NO: 2345536 - protein, 17 aa, Cryptosporidium parvum
DRIPLIQMPLSIASTIR

SEQ ID NO: 2345537 - protein, 20 aa, Cryptosporidium parvum
DRNGLTPFYFLLKDGMSTNT

SEQ ID NO: 2345538 - protein, 26 aa, Cryptosporidium parvum
DRVRRILFCRYVLPYILYIQHTAFVL

SEQ ID NO: 2345539 - protein, 24 aa, Cryptosporidium parvum
DRYSSPIFFPIYNSLLDTKCDNFA

SEQ ID NO: 2345540 - protein, 20 aa, Cryptosporidium parvum
DSFYIRLIDISTSGIWSLVN

SEQ ID NO: 2345541 - protein, 22 aa, Cryptosporidium parvum
DSLIPFLVPILDNNPINKSFIN

SEQ ID NO: 2345542 - protein, 18 aa, Cryptosporidium parvum
DSRSWYPLGRIIGQTLFP

SEQ ID NO: 2345543 - protein, 26 aa, Cryptosporidium parvum
DSWCEKFLQIIFKKLFNPHETLIIRE

SEQ ID NO: 2345544 - protein, 21 aa, Cryptosporidium parvum
DTILNPRYIALPTPIKPPPDI

SEQ ID NO: 2345545 - protein, 18 aa, Cryptosporidium parvum
DTLNFTNIQKWKLSLRFE

SEQ ID NO: 2345546 - protein, 17 aa, Cryptosporidium parvum
DVALLSDSIIFITKKTN

SEQ ID NO: 2345547 - protein, 23 aa, Cryptosporidium parvum
DYGSLYHFVRIFPELNELGKVDD

SEQ ID NO: 2345548 - protein, 25 aa, Cryptosporidium parvum
DYVIKIICLKVITAKPYLSCPENTV

SEQ ID NO: 2345549 - protein, 23 aa, Cryptosporidium parvum
DYYRKLCSQVIFPTPLVSTDKVV

SEQ ID NO: 2345550 - protein, 23 aa, Cryptosporidium parvum
EAAATVDLFAFTLDGGKRIEVAV

SEQ ID NO: 2345551 - protein, 23 aa, Cryptosporidium parvum
EAMLQSFWCIHALQHALITATIL

SEQ ID NO: 2345552 - protein, 26 aa, Cryptosporidium parvum
ECGTSFVMWFGEGTPAATLKCGAYTI

SEQ ID NO: 2345553 - protein, 21 aa, Cryptosporidium parvum
EDIPFISGFLYGISLSGFFKA

SEQ ID NO: 2345554 - protein, 36 aa, Cryptosporidium parvum; identical to SEQ ID NO: 2242216

SEQ ID NO: 2345555 - protein, 25 aa, Cryptosporidium parvum
EDNLIYGYKNPQCVPLTILENGCPM

SEQ ID NO: 2345556 - protein, 30 aa, Cryptosporidium parvum; identical to SEQ ID NO: 2130263

SEQ ID NO: 2345557 - protein, 18 aa, Cryptosporidium parvum
EDVISIVFMIFCIINLFC

SEQ ID NO: 2345558 - protein, 26 aa, Cryptosporidium parvum
EEFVDEIVDLLWLGPSSPAISSLLAE

SEQ ID NO: 2345559 - protein, 25 aa, Cryptosporidium parvum
EEHSLWVSIISLLIVFEIRSCQHTV

SEQ ID NO: 2345560 - protein, 20 aa, Cryptosporidium parvum
EFISIRKLVCPLFQDWVLEL

SEQ ID NO: 2345561 - protein, 23 aa, Cryptosporidium parvum
EFMDSPIFIIWCANHIRSRLGNE

SEQ ID NO: 2345562 - protein, 25 aa, Cryptosporidium parvum
EFPMSKFWMMGFFDAFSSILTLLAS

SEQ ID NO: 2345563 - protein, 24 aa, Cryptosporidium parvum
EFTDLFLFRNKIPINLLINGNLTI

SEQ ID NO: 2345564 - protein, 32 aa, Cryptosporidium parvum; identical to SEQ ID NO: 2242283

SEQ ID NO: 2345565 - protein, 23 aa, Cryptosporidium parvum
EGQFCMGMVYTLFPFLDSLECIT

SEQ ID NO: 2345566 - protein, 25 aa, Cryptosporidium parvum
EGRNLLWWMAHLGDEDLIRILEELM

SEQ ID NO: 2345567 - protein, 18 aa, Cryptosporidium parvum
EHYAHRFKRFPETLFIYF

SEQ ID NO: 2345568 - protein, 32 aa, Cryptosporidium parvum; identical to SEQ ID NO: 2242307

SEQ ID NO: 2345569 - protein, 25 aa, Cryptosporidium parvum
EIEEIWLKIIPILSIPSGNLFKTRF

SEQ ID NO: 2345570 - protein, 17 aa, Cryptosporidium parvum
EIFKKSLDLSLASNRNE

SEQ ID NO: 2345571 - protein, 22 aa, Cryptosporidium parvum
EIGDIESFLSFDSEFEKNEMEE

SEQ ID NO: 2345572 - protein, 20 aa, Cryptosporidium parvum
EIHKKYLIQYIYLSGNNIED

SEQ ID NO: 2345573 - protein, 24 aa, Cryptosporidium parvum
EIKFEAKFFSLHNFWKVVIGFIMS

SEQ ID NO: 2345574 - protein, 20 aa, Cryptosporidium parvum
EILKYYLGWSLSSALGSNIE

SEQ ID NO: 2345575 - protein, 26 aa, Cryptosporidium parvum
EISGKPYYWLQYFVNNVSVIPIKLNE

SEQ ID NO: 2345576 - protein, 25 aa, Cryptosporidium parvum
EISLIFAGIVTGILIFVPTSLIFPK

SEQ ID NO: 2345577 - protein, 17 aa, Cryptosporidium parvum
EKGVYYAIDMGGTNLRC

SEQ ID NO: 2345578 - protein, 27 aa, Cryptosporidium parvum
EKLPKDLFGRLRYLFTTSNFDVLAERF

SEQ ID NO: 2345579 - protein, 22 aa, Cryptosporidium parvum
EKQSLRLFLSLNGMPLASHFNF

SEQ ID NO: 2345580 - protein, 24 aa, Cryptosporidium parvum
EKVRREMFLPIKFSESETPRGILF

SEQ ID NO: 2345581 - protein, 23 aa, Cryptosporidium parvum
ELDHYFGWLDIFKPRPVLVYNMS

SEQ ID NO: 2345582 - protein, 17 aa, Cryptosporidium parvum
ELDVFLISRPGKHTYGT

SEQ ID NO: 2345583 - protein, 20 aa, Cryptosporidium parvum
ELELPLLYECDWNLVMRARN

SEQ ID NO: 2345584 - protein, 28 aa, Cryptosporidium parvum
ELGKVDDMCFLSFLLMNKVFTGFLESIK

SEQ ID NO: 2345585 - protein, 26 aa, Cryptosporidium parvum
ELLQMRRSFFQFVISFCVVAVSLFGV

SEQ ID NO: 2345586 - protein, 25 aa, Cryptosporidium parvum
ELPFSYVEFYEKLGVFVIDVRSSIK

SEQ ID NO: 2345587 - protein, 17 aa, Cryptosporidium parvum
ELPLRRALQIRKVMNNW

SEQ ID NO: 2345588 - protein, 19 aa, Cryptosporidium parvum
ELVLLALRSLDLWIDNLHH

SEQ ID NO: 2345589 - protein, 25 aa, Cryptosporidium parvum
ELVTLYEGIVIALCLELGIVLDIED

SEQ ID NO: 2345590 - protein, 32 aa, Cryptosporidium parvum; identical to SEQ ID NO: 2130383

SEQ ID NO: 2345591 - protein, 20 aa, Cryptosporidium parvum
EMRKVLLLVLHANVSRIEDL

SEQ ID NO: 2345592 - protein, 25 aa, Cryptosporidium parvum
EMYKFVIKDLRKLFANLNIPLIKIR

SEQ ID NO: 2345593 - protein, 27 aa, Cryptosporidium parvum
ENEIGWIFYAFPKLYQAFVLIDLYICF

SEQ ID NO: 2345594 - protein, 25 aa, Cryptosporidium parvum
ENGKDYCLKYFNYPKYLSEEEFNIW

SEQ ID NO: 2345595 - protein, 27 aa, Cryptosporidium parvum
ENLVFYIFKLVPLFKYTRQAIEKNKMS

SEQ ID NO: 2345596 - protein, 24 aa, Cryptosporidium parvum
ENVSLLIFKLIKNISMKYLNLVNN

SEQ ID NO: 2345597 - protein, 21 aa, Cryptosporidium parvum
EPILDGLLIFLRDGSETFRIQ

SEQ ID NO: 2345598 - protein, 22 aa, Cryptosporidium parvum
EQESIFTYIWNIIKAIFTRRRW

SEQ ID NO: 2345599 - protein, 33 aa, Cryptosporidium parvum; identical to SEQ ID NO: 2242502

SEQ ID NO: 2345600 - protein, 24 aa, Cryptosporidium parvum
EQYAYWMLTLFTLAGISELMMLFT

SEQ ID NO: 2345601 - protein, 23 aa, Cryptosporidium parvum
ERNFPVFIKRMVAQLIYLLQCEI

SEQ ID NO: 2345602 - protein, 19 aa, Cryptosporidium parvum
ERQLRVCTTIAIAIISEIC

SEQ ID NO: 2345603 - protein, 25 aa, Cryptosporidium parvum
ESDKSLFSLIPSPPKLFIKDKTPET

SEQ ID NO: 2345604 - protein, 34 aa, Cryptosporidium parvum; identical to SEQ ID NO: 2242526

SEQ ID NO: 2345605 - protein, 25 aa, Cryptosporidium parvum
ESKIYKEPLLLDKYQPDFTGESFPE

SEQ ID NO: 2345606 - protein, 24 aa, Cryptosporidium parvum
ESKLNFCCFTGYYYCDYCYGSNTC

SEQ ID NO: 2345607 - protein, 23 aa, Cryptosporidium parvum
ESNKYIKQLVYLKSYLSSLLIMN

SEQ ID NO: 2345608 - protein, 22 aa, Cryptosporidium parvum
ESQKWSFILGNRMLYNFKSKKC

SEQ ID NO: 2345609 - protein, 20 aa, Cryptosporidium parvum
ESSCCPLNLIRFCDNKQLLN

SEQ ID NO: 2345610 - protein, 33 aa, Cryptosporidium parvum
ESTSLMYIRSLLRLFFLFSSFKEDNASRVYIRK

SEQ ID NO: 2345611 - protein, 32 aa, Cryptosporidium parvum
ETIFLTMGIVMFIFSSYVIRLLYQINRTSVRT

SEQ ID NO: 2345612 - protein, 46 aa, Cryptosporidium parvum; identical to SEQ ID NO: 2242575

SEQ ID NO: 2345613 - protein, 25 aa, Cryptosporidium parvum
ETYEIFLFLSAISLLYFILSGYDGS

SEQ ID NO: 2345614 - protein, 26 aa, Cryptosporidium parvum
ETYFKNYHVLGYLPISYTKGLSERLS

SEQ ID NO: 2345615 - protein, 24 aa, Cryptosporidium parvum
EVNERLVLTLLLKIKNGAPILRRK

SEQ ID NO: 2345616 - protein, 27 aa, Cryptosporidium parvum
EVVGRYFYMILVEKLSFNTGGICSFLW

SEQ ID NO: 2345617 - protein, 18 aa, Cryptosporidium parvum
EVVLLSVFMNTNKQLKCH

SEQ ID NO: 2345618 - protein, 39 aa, Cryptosporidium parvum
EWKCRWRGLHFKVYTLRFPNSFFGYPIQIFTKYIYKHLG

SEQ ID NO: 2345619 - protein, 31 aa, Cryptosporidium parvum
EWLPIKRIIMLFLAGTFILSIYIILAFNCGG

SEQ ID NO: 2345620 - protein, 29 aa, Cryptosporidium parvum
EYYDYLDQFYYFPIDIKSVMIRISIIFPY

SEQ ID NO: 2345621 - protein, 18 aa, Cryptosporidium parvum
FAELPFDGLVGLGFPDKN

SEQ ID NO: 2345622 - protein, 29 aa, Cryptosporidium parvum
FALTSFSTALLWALLFEPSINEFSPAFGE

SEQ ID NO: 2345623 - protein, 17 aa, Cryptosporidium parvum
FANLNIPLIKIRGKKLE

SEQ ID NO: 2345624 - protein, 26 aa, Cryptosporidium parvum
FDFTELVPCVLKLYRLDFSAKNEIQR

SEQ ID NO: 2345625 - protein, 19 aa, Cryptosporidium parvum
FDLFDFYISDGINNKIIVC

SEQ ID NO: 2345626 - protein, 42 aa, Cryptosporidium parvum
FDSKRYLNIYQLWSGLWITILRDVPFTAVYWTLTEKLRSRIV

SEQ ID NO: 2345627 - protein, 17 aa, Cryptosporidium parvum
FDVLKKKLTILDNGTLN

SEQ ID NO: 2345628 - protein, 18 aa, Cryptosporidium parvum
FEEIINFLLCRVIGECKS

SEQ ID NO: 2345629 - protein, 21 aa, Cryptosporidium parvum
FEKQSILPPPGVGSPHVVCTL

SEQ ID NO: 2345630 - protein, 30 aa, Cryptosporidium parvum
FEKTILMIELILFSFPFNIPNLPLPKNLEI

SEQ ID NO: 2345631 - protein, 17 aa, Cryptosporidium parvum
FENLLIRMASYTIGLRQ

SEQ ID NO: 2345632 - protein, 27 aa, Cryptosporidium parvum
FFANERTLLQWMNMSVLLATISVSLLS

SEQ ID NO: 2345633 - protein, 18 aa, Cryptosporidium parvum
FFIGAGAVLGYRIWDKMK

SEQ ID NO: 2345634 - protein, 18 aa, Cryptosporidium parvum
FFSGWLSIAIFESLAEKF

SEQ ID NO: 2345635 - protein, 28 aa, Cryptosporidium parvum
FGISLKHYLTILLHMDRFSYKHIHRYLK

SEQ ID NO: 2345636 - protein, 21 aa, Cryptosporidium parvum
FHLVFALFLISFYQCTNTEPG

SEQ ID NO: 2345637 - protein, 18 aa, Cryptosporidium parvum
FIFSIIYPIIIVPIFNKL

SEQ ID NO: 2345638 - protein, 27 aa, Cryptosporidium parvum
FIGKVCSIEFYLYNPLSFPIVCESLQI

SEQ ID NO: 2345639 - protein, 24 aa, Cryptosporidium parvum
FIKQFPYNDLISSSLLYSGGKQFE

SEQ ID NO: 2345640 - protein, 17 aa, Cryptosporidium parvum
FILYRPDIGYVEGMSHI

SEQ ID NO: 2345641 - protein, 23 aa, Cryptosporidium parvum
FIPSGMRHFPIKKLIALIQSHSD

SEQ ID NO: 2345642 - protein, 25 aa, Cryptosporidium parvum
FIQGFIQVLLFCPPYCLHQRREILV

SEQ ID NO: 2345643 - protein, 18 aa, Cryptosporidium parvum
FIVLFITNKSFPINDNEI

SEQ ID NO: 2345644 - protein, 19 aa, Cryptosporidium parvum
FIYKKLQLYTTPKFHRMFF

SEQ ID NO: 2345645 - protein, 34 aa, Cryptosporidium parvum; identical to SEQ ID NO: 2242827

SEQ ID NO: 2345646 - protein, 34 aa, Cryptosporidium parvum; identical to SEQ ID NO: 2242833

SEQ ID NO: 2345647 - protein, 18 aa, Cryptosporidium parvum
FKTRFYQFINYKKATEFE

SEQ ID NO: 2345648 - protein, 30 aa, Cryptosporidium parvum
FKVESIQIQKIRLILPPRGIDIQLNTVINI

SEQ ID NO: 2345649 - protein, 33 aa, Cryptosporidium parvum; identical to SEQ ID NO: 2130619

SEQ ID NO: 2345650 - protein, 20 aa, Cryptosporidium parvum
FLCIVLLKLAQNGMLATDVV

SEQ ID NO: 2345651 - protein, 24 aa, Cryptosporidium parvum
FLLIGSCMTLLYKKDIFPEGISKR

SEQ ID NO: 2345652 - protein, 26 aa, Cryptosporidium parvum
FLLTFKILFCIGTKQIFPIGCPLNSI

SEQ ID NO: 2345653 - protein, 35 aa, Cryptosporidium parvum; identical to SEQ ID NO: 2242873

SEQ ID NO: 2345654 - protein, 18 aa, Cryptosporidium parvum
FMLTIPQYATSYLSYQGT

SEQ ID NO: 2345655 - protein, 24 aa, Cryptosporidium parvum
FMTKIRLLLIESIPSDFDLVLERY

SEQ ID NO: 2345656 - protein, 24 aa, Cryptosporidium parvum
FNLNTIRRFFYDLNVIISDIFYKS

SEQ ID NO: 2345657 - protein, 25 aa, Cryptosporidium parvum
FNSELPFWFERWLEAFNEKFNFLNH

SEQ ID NO: 2345658 - protein, 17 aa, Cryptosporidium parvum
FNTYYYFLNAMGFSPGI

SEQ ID NO: 2345659 - protein, 27 aa, Cryptosporidium parvum
FPENVFRPFEYNITKLYSLISEKMKNN

SEQ ID NO: 2345660 - protein, 25 aa, Cryptosporidium parvum
FPHALARTFRSIFCLCREGSANHGI

SEQ ID NO: 2345661 - protein, 26 aa, Cryptosporidium parvum
FPNFKQKFIFAPKILEILKMEKAIMA

SEQ ID NO: 2345662 - protein, 26 aa, Cryptosporidium parvum
FPSNNILNIPFLPEMKRMIFGILIVI

SEQ ID NO: 2345663 - protein, 28 aa, Cryptosporidium parvum
FRRMISIFSWFFTGIVILLMVGINVNTL

SEQ ID NO: 2345664 - protein, 19 aa, Cryptosporidium parvum
FSFLPKILEFQVKDGIFQA

SEQ ID NO: 2345665 - protein, 24 aa, Cryptosporidium parvum
FSKDWYMEIIIYLIKFIANNTQSV

SEQ ID NO: 2345666 - protein, 18 aa, Cryptosporidium parvum
FSSFFDDCYCEIANWLCS

SEQ ID NO: 2345667 - protein, 21 aa, Cryptosporidium parvum
FSSVMIRLMLVFGPAACCLSA

SEQ ID NO: 2345668 - protein, 21 aa, Cryptosporidium parvum
FTYKHFVVYIVFYVIGTILNL

SEQ ID NO: 2345669 - protein, 24 aa, Cryptosporidium parvum
FVDAAMLIAIFPRQIRFLIAEASF

SEQ ID NO: 2345670 - protein, 18 aa, Cryptosporidium parvum
FVIKDWFASQSIFKFYLL

SEQ ID NO: 2345671 - protein, 24 aa, Cryptosporidium parvum
FVINWLFVFYVIYPLMWEIIYTRI

SEQ ID NO: 2345672 - protein, 17 aa, Cryptosporidium parvum
FVVLVFNSILNIYKFRN

SEQ ID NO: 2345673 - protein, 19 aa, Cryptosporidium parvum
FYIQDIKLDLIPFLTSEDN

SEQ ID NO: 2345674 - protein, 17 aa, Cryptosporidium parvum
FYLTLWVNSQCSGNVYF

SEQ ID NO: 2345675 - protein, 25 aa, Cryptosporidium parvum
FYNRKFFIQLLIYAQLSLLFLFVQG

SEQ ID NO: 2345676 - protein, 25 aa, Cryptosporidium parvum
FYVKSIIFLLMLDFPNDRMDKTLIS

SEQ ID NO: 2345677 - protein, 21 aa, Cryptosporidium parvum
GAFIVRSIYKFLMNEWKRGER

SEQ ID NO: 2345678 - protein, 21 aa, Cryptosporidium parvum
GATFPLMGYLIGKFVTSGVLP

SEQ ID NO: 2345679 - protein, 28 aa, Cryptosporidium parvum
GCNDALIHLLNFLWPNVFENSPHLVQAV

SEQ ID NO: 2345680 - protein, 18 aa, Cryptosporidium parvum
GDMWCPMFDYSPISEKLY

SEQ ID NO: 2345681 - protein, 18 aa, Cryptosporidium parvum
GDNIFLKINWKNNIQKFI

SEQ ID NO: 2345682 - protein, 30 aa, Cryptosporidium parvum; identical to SEQ ID NO: 2243091

SEQ ID NO: 2345683 - protein, 18 aa, Cryptosporidium parvum
GEEYPPIPGYLQDKNRFP

SEQ ID NO: 2345684 - protein, 21 aa, Cryptosporidium parvum
GELFDVPFRLEASFLLENSNV

SEQ ID NO: 2345685 - protein, 27 aa, Cryptosporidium parvum
GFEHLWKKRVVYLLKMQSVNAVLFLEG

SEQ ID NO: 2345686 - protein, 19 aa, Cryptosporidium parvum
GFLLLALIRLSLFLPFVPS

SEQ ID NO: 2345687 - protein, 38 aa, Cryptosporidium parvum; identical to SEQ ID NO: 2130796

SEQ ID NO: 2345688 - protein, 25 aa, Cryptosporidium parvum
GGILASILRKFYSKPKLHISAVEID

SEQ ID NO: 2345689 - protein, 24 aa, Cryptosporidium parvum
GGSSLIFGIIYYWSKKFPTSLVSI

SEQ ID NO: 2345690 - protein, 17 aa, Cryptosporidium parvum
GGYFRIYDTFTWENIQI

SEQ ID NO: 2345691 - protein, 35 aa, Cryptosporidium parvum
GIEITKFFNSRLITIYILFFNIYLNKFPEKNPLYN

SEQ ID NO: 2345692 - protein, 22 aa, Cryptosporidium parvum
GIFLINLIKYLLYLYVDLRQKK

SEQ ID NO: 2345693 - protein, 23 aa, Cryptosporidium parvum
GIFSLIGTIWEGGYFRIYDTFTW

SEQ ID NO: 2345694 - protein, 18 aa, Cryptosporidium parvum
GIIISLIISVATLRIGVI

SEQ ID NO: 2345695 - protein, 23 aa, Cryptosporidium parvum
GIILIGLLFFLRFDNISSQIADF

SEQ ID NO: 2345696 - protein, 37 aa, Cryptosporidium parvum; identical to SEQ ID NO: 2243169

SEQ ID NO: 2345697 - protein, 17 aa, Cryptosporidium parvum
GIMIFMVNSLIKGIISE

SEQ ID NO: 2345698 - protein, 28 aa, Cryptosporidium parvum
GINTIFDEWILLLRITIFNGVGGSERNN

SEQ ID NO: 2345699 - protein, 17 aa, Cryptosporidium parvum
GIPEILSYFPDLYVDSS

SEQ ID NO: 2345700 - protein, 19 aa, Cryptosporidium parvum
GITWIPRTLNIVHPINGFN

SEQ ID NO: 2345701 - protein, 18 aa, Cryptosporidium parvum
GIVSLVIFSSYSLGFWYG

SEQ ID NO: 2345702 - protein, 28 aa, Cryptosporidium parvum
GKEAFFKYIMRFYIFEKLSQFLVNPMDA

SEQ ID NO: 2345703 - protein, 52 aa, Cryptosporidium parvum; identical to SEQ ID NO: 2130841

SEQ ID NO: 2345704 - protein, 17 aa, Cryptosporidium parvum
GLLLFQYSDDWPTRIDG

SEQ ID NO: 2345705 - protein, 39 aa, Cryptosporidium parvum; identical to SEQ ID NO: 2243243

SEQ ID NO: 2345706 - protein, 34 aa, Cryptosporidium parvum; identical to SEQ ID NO: 2243251

SEQ ID NO: 2345707 - protein, 26 aa, Cryptosporidium parvum
GMKNDPIFNWELLKNIWLPFRLISKN

SEQ ID NO: 2345708 - protein, 26 aa, Cryptosporidium parvum
GMLNPWYILFDWEYIFRKAQIWRFLT

SEQ ID NO: 2345709 - protein, 34 aa, Cryptosporidium parvum; identical to SEQ ID NO: 2130885

SEQ ID NO: 2345710 - protein, 25 aa, Cryptosporidium parvum
GPSQPLFFENFLVNNLKLGFGSMLL

SEQ ID NO: 2345711 - protein, 34 aa, Cryptosporidium parvum; identical to SEQ ID NO: 2243292

SEQ ID NO: 2345712 - protein, 18 aa, Cryptosporidium parvum
GRAEPPFPRIWSRSPKCR

SEQ ID NO: 2345713 - protein, 25 aa, Cryptosporidium parvum
GRLATIILITLTLVLLPHEFQRLKE

SEQ ID NO: 2345714 - protein, 21 aa, Cryptosporidium parvum
GRLFDPIRLLVARVGLEGEMV

SEQ ID NO: 2345715 - protein, 21 aa, Cryptosporidium parvum
GRMESILNFLKLRCKGIGLDL

SEQ ID NO: 2345716 - protein, 25 aa, Cryptosporidium parvum
GRQSSLWNALNFLSSFSNKEEKSRS

SEQ ID NO: 2345717 - protein, 25 aa, Cryptosporidium parvum
GSQDSLVPFFPPIPQIGNRNFDINE

SEQ ID NO: 2345718 - protein, 20 aa, Cryptosporidium parvum
GSRRIYLAFLFGGLIQRCLI

SEQ ID NO: 2345719 - protein, 33 aa, Cryptosporidium parvum; identical to SEQ ID NO: 2243338

SEQ ID NO: 2345720 - protein, 29 aa, Cryptosporidium parvum
GTISAIKSLLFLSLVILNSFNYKKRSQDH

SEQ ID NO: 2345721 - protein, 27 aa, Cryptosporidium parvum
GTKYSFPIITGLLLYIGIYLPNGNESN

SEQ ID NO: 2345722 - protein, 25 aa, Cryptosporidium parvum
GTQIACIQLILIPLLEYEFNRNNEK

SEQ ID NO: 2345723 - protein, 35 aa, Cryptosporidium parvum; identical to SEQ ID NO: 2130930

SEQ ID NO: 2345724 - protein, 24 aa, Cryptosporidium parvum
GVILNYLLQGLFHPAKKVRSVYWR

SEQ ID NO: 2345725 - protein, 24 aa, Cryptosporidium parvum
GVVFGFLISVWLRAAQALGGVQVI

SEQ ID NO: 2345726 - protein, 20 aa, Cryptosporidium parvum
GWCLFHSFFQVVSKDWLLGW

SEQ ID NO: 2345727 - protein, 27 aa, Cryptosporidium parvum
GYKLDEEALLLLPPEHFRKAPPRCVSK

SEQ ID NO: 2345728 - protein, 30 aa, Cryptosporidium parvum; identical to SEQ ID NO: 2243384

SEQ ID NO: 2345729 - protein, 30 aa, Cryptosporidium parvum; identical to SEQ ID NO: 2130950

SEQ ID NO: 2345730 - protein, 23 aa, Cryptosporidium parvum
GYWGLYRGFIPMTLHSYFTRILH

SEQ ID NO: 2345731 - protein, 17 aa, Cryptosporidium parvum
GYYYCDYCYGSNTCSIL

SEQ ID NO: 2345732 - protein, 19 aa, Cryptosporidium parvum
HAFLPLYPILVNQISKIVS

SEQ ID NO: 2345733 - protein, 17 aa, Cryptosporidium parvum
HHILVRSYNFHKGENVD

SEQ ID NO: 2345734 - protein, 23 aa, Cryptosporidium parvum
HHLKLCWVFIFCLSLFGMLDIIT

SEQ ID NO: 2345735 - protein, 34 aa, Cryptosporidium parvum
HHLSDLFVYFGISRFTLYYIKHNITLIFAISVGL

SEQ ID NO: 2345736 - protein, 18 aa, Cryptosporidium parvum
HHSILDVALLSDSIIFIT

SEQ ID NO: 2345737 - protein, 18 aa, Cryptosporidium parvum
HIGLFLYEYLGEEYPEVL

SEQ ID NO: 2345738 - protein, 19 aa, Cryptosporidium parvum
HIKEFRRAIFSWNPRIPKK

SEQ ID NO: 2345739 - protein, 24 aa, Cryptosporidium parvum
HIPPIWAQTYFQKLSDALFFISKD

SEQ ID NO: 2345740 - protein, 18 aa, Cryptosporidium parvum
HIQLYPRSSKRLKLIAVV

SEQ ID NO: 2345741 - protein, 24 aa, Cryptosporidium parvum
HKSAYLMSILIIKYIQIKVDNDSD

SEQ ID NO: 2345742 - protein, 34 aa, Cryptosporidium parvum
HKVTFLPSIEYISYLKWYFVGINKLLTSDLTLAE

SEQ ID NO: 2345743 - protein, 18 aa, Cryptosporidium parvum
HLATLAIYYLLKDDLRLS

SEQ ID NO: 2345744 - protein, 33 aa, Cryptosporidium parvum; identical to SEQ ID NO: 2131006

SEQ ID NO: 2345745 - protein, 20 aa, Cryptosporidium parvum
HMDPAPPILFKEMKSPIVGV

SEQ ID NO: 2345746 - protein, 17 aa, Cryptosporidium parvum
HMRIKLQQKIRDLVYTK

SEQ ID NO: 2345747 - protein, 17 aa, Cryptosporidium parvum
HNYQREWILPLLNNLKN

SEQ ID NO: 2345748 - protein, 27 aa, Cryptosporidium parvum
HNYTRYISYIIRLLPYKSHTSDSSLSI

SEQ ID NO: 2345749 - protein, 29 aa, Cryptosporidium parvum
HRFKRFPETLFIYFTPPKNAKKGELFDVP

SEQ ID NO: 2345750 - protein, 31 aa, Cryptosporidium parvum; identical to SEQ ID NO: 2131019

SEQ ID NO: 2345751 - protein, 24 aa, Cryptosporidium parvum
HSKDLSILRFVFSYHKFFNPQNET

SEQ ID NO: 2345752 - protein, 21 aa, Cryptosporidium parvum
HSWLQNILHRTPPGAGIYIVI

SEQ ID NO: 2345753 - protein, 35 aa, Cryptosporidium parvum; identical to SEQ ID NO: 2131034

SEQ ID NO: 2345754 - protein, 17 aa, Cryptosporidium parvum
HVWFLTQLTSALYIPLF

SEQ ID NO: 2345755 - protein, 27 aa, Cryptosporidium parvum
HWEQFPRYINPWFYNTRVLLARSKVIK

SEQ ID NO: 2345756 - protein, 20 aa, Cryptosporidium parvum
IAEFLIYYRFREVIRDKDDY

SEQ ID NO: 2345757 - protein, 19 aa, Cryptosporidium parvum
IAFFLILAIVLFVVISRTT

SEQ ID NO: 2345758 - protein, 25 aa, Cryptosporidium parvum
IALDLIKRHHLLLVTLLLANSICME

SEQ ID NO: 2345759 - protein, 33 aa, Cryptosporidium parvum; identical to SEQ ID NO: 2243553

SEQ ID NO: 2345760 - protein, 22 aa, Cryptosporidium parvum
IALKNLLHRPLKYALKNAIEIA

SEQ ID NO: 2345761 - protein, 35 aa, Cryptosporidium parvum; identical to SEQ ID NO: 2243557

SEQ ID NO: 2345762 - protein, 22 aa, Cryptosporidium parvum
IAPILIMELPTLSSLGLQILKV

SEQ ID NO: 2345763 - protein, 29 aa, Cryptosporidium parvum
IASLEPLLYSKYYYTILLDRFMKSNLDIK

SEQ ID NO: 2345764 - protein, 19 aa, Cryptosporidium parvum
IAWMDNPKLLIKTGQKSHT

SEQ ID NO: 2345765 - protein, 27 aa, Cryptosporidium parvum
ICCAAFGSLLLIFRKYIPHPSEFFPFG

SEQ ID NO: 2345766 - protein, 29 aa, Cryptosporidium parvum
ICKKSLFCGIWLLFHSWSISLLKGVQQQG

SEQ ID NO: 2345767 - protein, 24 aa, Cryptosporidium parvum
ICSAEGQCIWTLAKRLKELSAMFW

SEQ ID NO: 2345768 - protein, 22 aa, Cryptosporidium parvum
IDGGIELKFFYLDDLKNSISPE

SEQ ID NO: 2345769 - protein, 23 aa, Cryptosporidium parvum
IDPYVFIPLHTFHAVSTPLLVNI

SEQ ID NO: 2345770 - protein, 23 aa, Cryptosporidium parvum
IDSRKFSLLLYTIISQVLTEINS

SEQ ID NO: 2345771 - protein, 26 aa, Cryptosporidium parvum
IDSVLLALSLIFTSPWYIYKDNSLKE

SEQ ID NO: 2345772 - protein, 30 aa, Cryptosporidium parvum; identical to SEQ ID NO: 2243621

SEQ ID NO: 2345773 - protein, 32 aa, Cryptosporidium parvum
IECRIQNFIFFNFLLYLASIGPQLFISFILFY

SEQ ID NO: 2345774 - protein, 18 aa, Cryptosporidium parvum
IEFNKYKVLIVIFSALLA

SEQ ID NO: 2345775 - protein, 17 aa, Cryptosporidium parvum
IFFIFREGIQVIVSMIL

SEQ ID NO: 2345776 - protein, 27 aa, Cryptosporidium parvum
IFVCCGLLIWLLLTNIFEVLWIAKYLL

SEQ ID NO: 2345777 - protein, 33 aa, Cryptosporidium parvum
IFVLSGVVSMRIFRPYWSDGRMWINLVLVYIAM

SEQ ID NO: 2345778 - protein, 20 aa, Cryptosporidium parvum
IGDLPLAPPLSALSASPIQY

SEQ ID NO: 2345779 - protein, 27 aa, Cryptosporidium parvum
IGPLTISVIVIILIISCIIGGFCFCGA

SEQ ID NO: 2345780 - protein, 25 aa, Cryptosporidium parvum
IGPQLFISFILFYSEIESIDTQAIE

SEQ ID NO: 2345781 - protein, 25 aa, Cryptosporidium parvum
IHKKNLITLYLPFETKLNGNEKLII

SEQ ID NO: 2345782 - protein, 25 aa, Cryptosporidium parvum
IHTTLLDELIWLVFCSIEQEKEYVP

SEQ ID NO: 2345783 - protein, 25 aa, Cryptosporidium parvum
IHTYTLKWFDNILPSLKIPKVPWDL

SEQ ID NO: 2345784 - protein, 18 aa, Cryptosporidium parvum
IIHKYLNPRQLLIDSYSR

SEQ ID NO: 2345785 - protein, 18 aa, Cryptosporidium parvum
IILIYPNCKVQISWLDIG

SEQ ID NO: 2345786 - protein, 27 aa, Cryptosporidium parvum
IIPSLPNGLFIFFSKKRAIKCNKDEKI

SEQ ID NO: 2345787 - protein, 24 aa, Cryptosporidium parvum
IITAIKRGFDKKVIFSLLLPEIKA

SEQ ID NO: 2345788 - protein, 17 aa, Cryptosporidium parvum
IITLYTLSRFGEGRFFA

SEQ ID NO: 2345789 - protein, 19 aa, Cryptosporidium parvum
IIVCALIMELIEVLSKKLT

SEQ ID NO: 2345790 - protein, 19 aa, Cryptosporidium parvum
IIVMLVFVTPLLLALFPFS

SEQ ID NO: 2345791 - protein, 20 aa, Cryptosporidium parvum
IKIDLYQRAYHGIDRLGRPI

SEQ ID NO: 2345792 - protein, 30 aa, Cryptosporidium parvum
IKKFKHWFTYLGITNYILKVIKRLPPDIIL

SEQ ID NO: 2345793 - protein, 23 aa, Cryptosporidium parvum
IKSELKFTWLGWLSFGRDQETGD

SEQ ID NO: 2345794 - protein, 22 aa, Cryptosporidium parvum
ILDLYITMNYFPSSNILRDVWF

SEQ ID NO: 2345795 - protein, 17 aa, Cryptosporidium parvum
ILDVALLSDSIIFITKK

SEQ ID NO: 2345796 - protein, 19 aa, Cryptosporidium parvum
ILILNIYSIITRNIFNCGV

SEQ ID NO: 2345797 - protein, 17 aa, Cryptosporidium parvum
ILLEFACMLIITGGIII

SEQ ID NO: 2345798 - protein, 28 aa, Cryptosporidium parvum
ILPCHRSLRILIELPLALLHIFQLYPHF

SEQ ID NO: 2345799 - protein, 20 aa, Cryptosporidium parvum
ILQYYPIRPKKPSDLYFCEI

SEQ ID NO: 2345800 - protein, 18 aa, Cryptosporidium parvum
ILSVFIPGERFSKVTTDF

SEQ ID NO: 2345801 - protein, 25 aa, Cryptosporidium parvum
INKYKFPVINISKFYPRPGTPAAKM

SEQ ID NO: 2345802 - protein, 26 aa, Cryptosporidium parvum
INLLPEDFLVQIITKLLIRISNKEFS

SEQ ID NO: 2345803 - protein, 17 aa, Cryptosporidium parvum
INVFWPFVEGIGIRDLE

SEQ ID NO: 2345804 - protein, 19 aa, Cryptosporidium parvum
IPAPRGPLFVLGNNFIRKY

SEQ ID NO: 2345805 - protein, 39 aa, Cryptosporidium parvum; identical to SEQ ID NO: 2244077

SEQ ID NO: 2345806 - protein, 28 aa, Cryptosporidium parvum
IPLDIACTAMWFISQRWDFCPLVFKQLM

SEQ ID NO: 2345807 - protein, 17 aa, Cryptosporidium parvum
IPMEGECNRYLSSPRIT

SEQ ID NO: 2345808 - protein, 18 aa, Cryptosporidium parvum
IQHYLSYKDLKKAIKLIT

SEQ ID NO: 2345809 - protein, 26 aa, Cryptosporidium parvum
IQKFIPFRFIKDCFISCIPVSYMDRS

SEQ ID NO: 2345810 - protein, 25 aa, Cryptosporidium parvum
IQKWKLSLRFEKMMEFLILETKKRA

SEQ ID NO: 2345811 - protein, 24 aa, Cryptosporidium parvum
IQYLYFNNIIIYELNLINISKLSK

SEQ ID NO: 2345812 - protein, 22 aa, Cryptosporidium parvum
IREIALYPPIFSKQLIPPVSNN

SEQ ID NO: 2345813 - protein, 27 aa, Cryptosporidium parvum
IRFRFFTLLFTFILFTLAHSFIMVLNL

SEQ ID NO: 2345814 - protein, 20 aa, Cryptosporidium parvum
IRGKLRTTFYGYLISNNETP

SEQ ID NO: 2345815 - protein, 27 aa, Cryptosporidium parvum
ISESDYKLFFRFLKARQFNVEKSTEML

SEQ ID NO: 2345816 - protein, 25 aa, Cryptosporidium parvum
ISIVFMIFCIINLFCKYKLNKEIFL

SEQ ID NO: 2345817 - protein, 18 aa, Cryptosporidium parvum
ISNTLIASLPGLGFGLTP

SEQ ID NO: 2345818 - protein, 28 aa, Cryptosporidium parvum
ISNVSQFLFGFIVGFYRGWKMALVMSAS

SEQ ID NO: 2345819 - protein, 20 aa, Cryptosporidium parvum
ISPAPPPFYVPYRTNITESE

SEQ ID NO: 2345820 - protein, 23 aa, Cryptosporidium parvum
ISPNLIAFQLTLIAGLQVFCIHQ

SEQ ID NO: 2345821 - protein, 26 aa, Cryptosporidium parvum
ISREDYMLPTFSLLNIQPYNATYCSR

SEQ ID NO: 2345822 - protein, 24 aa, Cryptosporidium parvum
ISTIFPFLAYLIYSYFRYCVYISE

SEQ ID NO: 2345823 - protein, 17 aa, Cryptosporidium parvum
ISTLRCYLFVSPKITNE

SEQ ID NO: 2345824 - protein, 19 aa, Cryptosporidium parvum
ISVILEYMEPLILLHEQNT

SEQ ID NO: 2345825 - protein, 21 aa, Cryptosporidium parvum
ISVPGLLKTIPKYGNNFNKES

SEQ ID NO: 2345826 - protein, 26 aa, Cryptosporidium parvum
ITFQGGIVHLLMSILGRWIFNHQLNI

SEQ ID NO: 2345827 - protein, 23 aa, Cryptosporidium parvum
ITGKIFMDVLFQLVNAFDLDNRE

SEQ ID NO: 2345828 - protein, 27 aa, Cryptosporidium parvum
ITIENSFPWFIPVKTSVQFFDLNSTRS

SEQ ID NO: 2345829 - protein, 21 aa, Cryptosporidium parvum
IVAKYIRVHFPQAGNFSNMTM

SEQ ID NO: 2345830 - protein, 17 aa, Cryptosporidium parvum
IVFCLFSDLKNQILYGK

SEQ ID NO: 2345831 - protein, 26 aa, Cryptosporidium parvum
IVGGSFFPLWAPIRYIPAFMAERHRK

SEQ ID NO: 2345832 - protein, 26 aa, Cryptosporidium parvum
IVKLHKQFVIFLNKIDPKKNTVHLEE

SEQ ID NO: 2345833 - protein, 25 aa, Cryptosporidium parvum
IVLCSGIFEWYTPLSLNSTIVEIYP

SEQ ID NO: 2345834 - protein, 26 aa, Cryptosporidium parvum
IVSIALIIIIVVFGLVVWKKVKDIEK

SEQ ID NO: 2345835 - protein, 18 aa, Cryptosporidium parvum
IVTVLLGLTISFTSSLEL

SEQ ID NO: 2345836 - protein, 22 aa, Cryptosporidium parvum
IVYSHMRLLFSYFSNYSKDGVF

SEQ ID NO: 2345837 - protein, 19 aa, Cryptosporidium parvum
IYEESFNILYYLTSGGKDN

SEQ ID NO: 2345838 - protein, 25 aa, Cryptosporidium parvum
KAESILTRFRAFVAISVILEYMEPL

SEQ ID NO: 2345839 - protein, 18 aa, Cryptosporidium parvum
KAFLNTLPYSVFRLRDFA

SEQ ID NO: 2345840 - protein, 33 aa, Cryptosporidium parvum
KAINTPHGIPYWLVPVFEFLKLPASSTLSSLDS

SEQ ID NO: 2345841 - protein, 38 aa, Cryptosporidium parvum
KANGNFFLILKLGHLLLFLLILKLLVYIYTKWTKTRGD

SEQ ID NO: 2345842 - protein, 19 aa, Cryptosporidium parvum
KCGAYTIVYAPIKDQTDPA

SEQ ID NO: 2345843 - protein, 27 aa, Cryptosporidium parvum
KCIKWKILMVLIVWYNLITTFKNNQDL

SEQ ID NO: 2345844 - protein, 17 aa, Cryptosporidium parvum
KCSVILTDSPFLRSLRN

SEQ ID NO: 2345845 - protein, 30 aa, Cryptosporidium parvum; identical to SEQ ID NO: 2244383

SEQ ID NO: 2345846 - protein, 24 aa, Cryptosporidium parvum
KDKPYYLLYPSCRIFEPLDNLKDE

SEQ ID NO: 2345847 - protein, 23 aa, Cryptosporidium parvum
KDNDLFNTLYYSSNLYLLISAIF

SEQ ID NO: 2345848 - protein, 21 aa, Cryptosporidium parvum
KDNFRIPVDKFGIAMLRAFMN

SEQ ID NO: 2345849 - protein, 25 aa, Cryptosporidium parvum
KDNNQNFQLIPRITLKSLIEEISRN

SEQ ID NO: 2345850 - protein, 25 aa, Cryptosporidium parvum
KDQDGFIILPKFDPPSEKPSEYDLV

SEQ ID NO: 2345851 - protein, 19 aa, Cryptosporidium parvum
KDYFYRWKNENLFQKFNTC

SEQ ID NO: 2345852 - protein, 33 aa, Cryptosporidium parvum; identical to SEQ ID NO: 2131552

SEQ ID NO: 2345853 - protein, 26 aa, Cryptosporidium parvum
KESIKRRLLREYDIIYQFGRYEYFSV

SEQ ID NO: 2345854 - protein, 26 aa, Cryptosporidium parvum
KESNMVWLYCYLMSANTPSKLMLIGV

SEQ ID NO: 2345855 - protein, 19 aa, Cryptosporidium parvum
KETDIGLLLFQYSDDWPTR

SEQ ID NO: 2345856 - protein, 21 aa, Cryptosporidium parvum
KEWDRICFDLLDSLKANKKSI

SEQ ID NO: 2345857 - protein, 29 aa, Cryptosporidium parvum
KEYEERSIFPLAEGLKLIKKLDILNKADC

SEQ ID NO: 2345858 - protein, 27 aa, Cryptosporidium parvum
KFDEKPFFWCEYLRYLNLSRNKFEELP

SEQ ID NO: 2345859 - protein, 23 aa, Cryptosporidium parvum
KFFRKKVVPILKSVNFMASPGQL

SEQ ID NO: 2345860 - protein, 21 aa, Cryptosporidium parvum
KFILIIPFILVTIYSIKIFFI

SEQ ID NO: 2345861 - protein, 40 aa, Cryptosporidium parvum; identical to SEQ ID NO: 2244473

SEQ ID NO: 2345862 - protein, 31 aa, Cryptosporidium parvum; identical to SEQ ID NO: 2244485

SEQ ID NO: 2345863 - protein, 25 aa, Cryptosporidium parvum
KGAGILPLNMLYNAPLKSLENVDAI

SEQ ID NO: 2345864 - protein, 23 aa, Cryptosporidium parvum
KGIIKLFLDFLMTQNAPGGGKTV

SEQ ID NO: 2345865 - protein, 24 aa, Cryptosporidium parvum
KGLKNHLRILWRRPRNDTSSNSDG

SEQ ID NO: 2345866 - protein, 24 aa, Cryptosporidium parvum
KGNLTCFLDCNYSYMFLSDYTKGE

SEQ ID NO: 2345867 - protein, 24 aa, Cryptosporidium parvum
KHGFYAFWNWFDSRSWYPLGRIIG

SEQ ID NO: 2345868 - protein, 26 aa, Cryptosporidium parvum
KHKMVLKLLLTSLLGLLNIIVWANGE

SEQ ID NO: 2345869 - protein, 24 aa, Cryptosporidium parvum
KIKIIIIYFVIFLVGLFTNIVSEI

SEQ ID NO: 2345870 - protein, 22 aa, Cryptosporidium parvum
KIKLGFLKWFNEKLPKDLFGRL

SEQ ID NO: 2345871 - protein, 18 aa, Cryptosporidium parvum
KILNYVETVLKLNSKYFP

SEQ ID NO: 2345872 - protein, 19 aa, Cryptosporidium parvum
KINLINAFIGTGFDTILQM

SEQ ID NO: 2345873 - protein, 33 aa, Cryptosporidium parvum; identical to SEQ ID NO: 2244555

SEQ ID NO: 2345874 - protein, 49 aa, Cryptosporidium parvum; identical to SEQ ID NO: 2244585

SEQ ID NO: 2345875 - protein, 24 aa, Cryptosporidium parvum
KKGVLEIFIIPIEKNRYLVVYSKF

SEQ ID NO: 2345876 - protein, 21 aa, Cryptosporidium parvum
KKIFVPILEYSVLRRIYEEFL

SEQ ID NO: 2345877 - protein, 36 aa, Cryptosporidium parvum; identical to SEQ ID NO: 2244594

SEQ ID NO: 2345878 - protein, 19 aa, Cryptosporidium parvum
KKLGFVGGKIKMISSHLSN

SEQ ID NO: 2345879 - protein, 31 aa, Cryptosporidium parvum; identical to SEQ ID NO: 2244598

SEQ ID NO: 2345880 - protein, 25 aa, Cryptosporidium parvum
KKTAACILIIELLNHIPPIWAQTYF

SEQ ID NO: 2345881 - protein, 19 aa, Cryptosporidium parvum
KLDPFLKEWKNPDIQALFL

SEQ ID NO: 2345882 - protein, 38 aa, Cryptosporidium parvum; identical to SEQ ID NO: 2244671

SEQ ID NO: 2345883 - protein, 17 aa, Cryptosporidium parvum
KLWIIEQMDTFSSQEDI

SEQ ID NO: 2345884 - protein, 47 aa, Cryptosporidium parvum
KMNKYQIYRILITILGVFFMLLALFGVSFLLLLPKIAEIQIRNSKMD

SEQ ID NO: 2345885 - protein, 17 aa, Cryptosporidium parvum
KMQSVNAVLFLEGRKTE

SEQ ID NO: 2345886 - protein, 29 aa, Cryptosporidium parvum
KNDTYLCIIGPIPPKLLFITKSLSLQKQR

SEQ ID NO: 2345887 - protein, 27 aa, Cryptosporidium parvum
KNEFFKFMVHFIFSLIIFQIVNNINMN

SEQ ID NO: 2345888 - protein, 26 aa, Cryptosporidium parvum
KNFVNNKFYPLYKPSVFKINMYDSTR

SEQ ID NO: 2345889 - protein, 38 aa, Cryptosporidium parvum; identical to SEQ ID NO: 2131698

SEQ ID NO: 2345890 - protein, 17 aa, Cryptosporidium parvum
KNILKFILHWSIAFIMF

SEQ ID NO: 2345891 - protein, 27 aa, Cryptosporidium parvum
KNKGYGWTLTIIASLILIFTSFYESFI

SEQ ID NO: 2345892 - protein, 22 aa, Cryptosporidium parvum
KNLINLLIALFDFFKYSSTIEE

SEQ ID NO: 2345893 - protein, 17 aa, Cryptosporidium parvum
KNLRPIYIYFNSFKDRI

SEQ ID NO: 2345894 - protein, 30 aa, Cryptosporidium parvum; identical to SEQ ID NO: 2244719

SEQ ID NO: 2345895 - protein, 56 aa, Cryptosporidium parvum
KNTNLQSIIKYLFFFIQIISLIYLFTILFLISEYDYIWFLIGVIITATLCSSKSVE

SEQ ID NO: 2345896 - protein, 27 aa, Cryptosporidium parvum
KPKEYLNLFYHMAIPILIISIYVPFSN

SEQ ID NO: 2345897 - protein, 27 aa, Cryptosporidium parvum
KPSDLYFCEIFTDFFLGIGDVLCKSIV

SEQ ID NO: 2345898 - protein, 19 aa, Cryptosporidium parvum
KQRKRLCIVLVQHIPTQFK

SEQ ID NO: 2345899 - protein, 25 aa, Cryptosporidium parvum
KRAGSIYFNIIGLLSQLLMEIHLEG

SEQ ID NO: 2345900 - protein, 20 aa, Cryptosporidium parvum
KRHILNNYCILFPIIEEQTF

SEQ ID NO: 2345901 - protein, 18 aa, Cryptosporidium parvum
KRKLFTGLTYISNGSYFS

SEQ ID NO: 2345902 - protein, 25 aa, Cryptosporidium parvum
KRKLTVGLLVPLGEEQDWLYSTRKG

SEQ ID NO: 2345903 - protein, 23 aa, Cryptosporidium parvum
KRLKLIAVVPFKGIFSTNTIQLL

SEQ ID NO: 2345904 - protein, 20 aa, Cryptosporidium parvum
KRSIRHSWQERIATDPSLVD

SEQ ID NO: 2345905 - protein, 32 aa, Cryptosporidium parvum
KSADRKFIMFFRKLLMVFRYLKNSNLKKNKNE

SEQ ID NO: 2345906 - protein, 18 aa, Cryptosporidium parvum
KSDAKWQIAKPTVTLVGQ

SEQ ID NO: 2345907 - protein, 31 aa, Cryptosporidium parvum
KSKKSILLMILITKFLKKILVGTLRAGFLLN

SEQ ID NO: 2345908 - protein, 26 aa, Cryptosporidium parvum
KSLEYYNYLLKWLSIIITFFSLNCND

SEQ ID NO: 2345909 - protein, 24 aa, Cryptosporidium parvum
KTFTNLLHNSFFLDMFMLNHRNVK

SEQ ID NO: 2345910 - protein, 19 aa, Cryptosporidium parvum
KTILNFCTTFQRVAIVYKE

SEQ ID NO: 2345911 - protein, 31 aa, Cryptosporidium parvum
KTPETLFSNWLRLMIAILIQDSYNLPLQQQL

SEQ ID NO: 2345912 - protein, 20 aa, Cryptosporidium parvum
KTRNALILGLGGGILASILR

SEQ ID NO: 2345913 - protein, 32 aa, Cryptosporidium parvum; identical to SEQ ID NO: 2244863

SEQ ID NO: 2345914 - protein, 23 aa, Cryptosporidium parvum
KVFYESILPHLMLKLDTLAVEPN

SEQ ID NO: 2345915 - protein, 28 aa, Cryptosporidium parvum
KVGRVKCWIPNQSIELPLRRALQIRKVM

SEQ ID NO: 2345916 - protein, 21 aa, Cryptosporidium parvum
KVISRIFDLDLLPNPLKSEKY

SEQ ID NO: 2345917 - protein, 26 aa, Cryptosporidium parvum
KVLKYELVITLLTGWSLICDRNRRFE

SEQ ID NO: 2345918 - protein, 24 aa, Cryptosporidium parvum
KVNIDKFWITRDASILPLITETIK

SEQ ID NO: 2345919 - protein, 23 aa, Cryptosporidium parvum
KVPLPVIVFISIISIWIINQVIN

SEQ ID NO: 2345920 - protein, 28 aa, Cryptosporidium parvum
KVRFSIEGFWSLITLIPKMVLSNLNTKD

SEQ ID NO: 2345921 - protein, 18 aa, Cryptosporidium parvum
KVRLPLSVVLFGYGIMMD

SEQ ID NO: 2345922 - protein, 22 aa, Cryptosporidium parvum
KVRSVYWRIYNNLYIGSQDSLV

SEQ ID NO: 2345923 - protein, 26 aa, Cryptosporidium parvum
KVSELLYSIIYYGPPPDWQLSVTIST

SEQ ID NO: 2345924 - protein, 43 aa, Cryptosporidium parvum
KWNQRITMYYHHASILRYSEFLKEFILIINSFENCLRIKNFHI

SEQ ID NO: 2345925 - protein, 29 aa, Cryptosporidium parvum
KYIPHPSEFFPFGWFFLKFGIHKHDNFNL

SEQ ID NO: 2345926 - protein, 21 aa, Cryptosporidium parvum
KYLSLAFKKYSDHLPCAVWLP

SEQ ID NO: 2345927 - protein, 24 aa, Cryptosporidium parvum
KYPEIYGFYKFIHLHFGETSAFTD

SEQ ID NO: 2345928 - protein, 26 aa, Cryptosporidium parvum
KYQNNIFFLSILRSLFRSITPGGKAS

SEQ ID NO: 2345929 - protein, 23 aa, Cryptosporidium parvum
LAAYLLLCFVIGNGLGPLILFSN

SEQ ID NO: 2345930 - protein, 18 aa, Cryptosporidium parvum
LCARFLTESKFLLESSCC

SEQ ID NO: 2345931 - protein, 29 aa, Cryptosporidium parvum
LDDLMAIPVTLLVRIIILSNGIEGEIREI

SEQ ID NO: 2345932 - protein, 21 aa, Cryptosporidium parvum
LDFYGDLHILLTPPPHVFARL

SEQ ID NO: 2345933 - protein, 25 aa, Cryptosporidium parvum
LDMIDLILFHIKKIRSFSLDCLNLK

SEQ ID NO: 2345934 - protein, 24 aa, Cryptosporidium parvum
LDQFNLWTTDIWLNIIVAICLGLA

SEQ ID NO: 2345935 - protein, 27 aa, Cryptosporidium parvum
LEEFYSLLIQIFWKKTKFLNNTNSEAF

SEQ ID NO: 2345936 - protein, 20 aa, Cryptosporidium parvum
LELLASVLCYIHPQSFGDII

SEQ ID NO: 2345937 - protein, 28 aa, Cryptosporidium parvum
LELTTVILGFFIFLIPTGYAQSKVIKGS

SEQ ID NO: 2345938 - protein, 27 aa, Cryptosporidium parvum
LETNEKFLKILHIKRLKFPIYSIITQF

SEQ ID NO: 2345939 - protein, 19 aa, Cryptosporidium parvum
LFAALIPLKNTFFGDLPIC

SEQ ID NO: 2345940 - protein, 17 aa, Cryptosporidium parvum
LFFSFIQTFVTLFIFHL

SEQ ID NO: 2345941 - protein, 22 aa, Cryptosporidium parvum
LFKLLCKVLFYQGDFLECSIVL

SEQ ID NO: 2345942 - protein, 17 aa, Cryptosporidium parvum
LFMSILSINYKLNIFEK

SEQ ID NO: 2345943 - protein, 20 aa, Cryptosporidium parvum
LFTKQFTTHLGLLSIFSYIL

SEQ ID NO: 2345944 - protein, 21 aa, Cryptosporidium parvum
LGGIFLLLVAFIAYAQRYRKL

SEQ ID NO: 2345945 - protein, 34 aa, Cryptosporidium parvum
LGIHLKREWHRLWLVRSFLAFAWESYLEDLMIEN

SEQ ID NO: 2345946 - protein, 22 aa, Cryptosporidium parvum
LGKERIPLYGPVLFVGNHMNQF

SEQ ID NO: 2345947 - protein, 23 aa, Cryptosporidium parvum
LGTIPIYIWDDVNWIPYGNLMER

SEQ ID NO: 2345948 - protein, 25 aa, Cryptosporidium parvum
LHILNKIVLIFPQSIYFNIRSSYLE

SEQ ID NO: 2345949 - protein, 18 aa, Cryptosporidium parvum
LICVPPELKLQIPPGSQN

SEQ ID NO: 2345950 - protein, 18 aa, Cryptosporidium parvum
LIDFTRLLISKAVMFSSL

SEQ ID NO: 2345951 - protein, 31 aa, Cryptosporidium parvum
LIDSLLNMNRGFIPFILCGDLSPINNIDPKD

SEQ ID NO: 2345952 - protein, 18 aa, Cryptosporidium parvum
LIICIWNVNIGFGHNDDP

SEQ ID NO: 2345953 - protein, 24 aa, Cryptosporidium parvum
LIIIMIFFFCRFYDNYKSYRKKQV

SEQ ID NO: 2345954 - protein, 22 aa, Cryptosporidium parvum
LILLIFNINYSQGLGLRRNYNS

SEQ ID NO: 2345955 - protein, 24 aa, Cryptosporidium parvum
LILLNSIFYALLPFSFEPLIFLSA

SEQ ID NO: 2345956 - protein, 21 aa, Cryptosporidium parvum
LIQKPIILIFKAIKYIIKFFI

SEQ ID NO: 2345957 - protein, 17 aa, Cryptosporidium parvum
LISKSKLLLFILHTLRQ

SEQ ID NO: 2345958 - protein, 27 aa, Cryptosporidium parvum
LKRIRLKHIFLIFIFTVLYVSCFLMEH

SEQ ID NO: 2345959 - protein, 18 aa, Cryptosporidium parvum
LKTIPKYGNNFNKESFNN

SEQ ID NO: 2345960 - protein, 17 aa, Cryptosporidium parvum
LLAIPAALSLSIMHIRS

SEQ ID NO: 2345961 - protein, 25 aa, Cryptosporidium parvum
LLCKVSGIFMFLTIIFPDCKTIGSL

SEQ ID NO: 2345962 - protein, 17 aa, Cryptosporidium parvum
LLGLTISFTSSLELTTV

SEQ ID NO: 2345963 - protein, 17 aa, Cryptosporidium parvum
LLIKLSNILKLLESSPL

SEQ ID NO: 2345964 - protein, 20 aa, Cryptosporidium parvum
LLKAIWISCFLVSSSAFLVL

SEQ ID NO: 2345965 - protein, 18 aa, Cryptosporidium parvum
LLLVLHANVSRIEDLLFI

SEQ ID NO: 2345966 - protein, 20 aa, Cryptosporidium parvum
LLNRILWIPEYENFNTILDM

SEQ ID NO: 2345967 - protein, 28 aa, Cryptosporidium parvum
LLSCDNPPILPATLLLHLSTKLRCWHIA

SEQ ID NO: 2345968 - protein, 27 aa, Cryptosporidium parvum
LLSSLKVYPLFARGWITWAQYTDRLLY

SEQ ID NO: 2345969 - protein, 17 aa, Cryptosporidium parvum
LLSVIVSAVFSAPAVPL

SEQ ID NO: 2345970 - protein, 20 aa, Cryptosporidium parvum
LLVLIILYNVFGNKGLFTFD

SEQ ID NO: 2345971 - protein, 19 aa, Cryptosporidium parvum
LMLNSGLTIILLFSKILTD

SEQ ID NO: 2345972 - protein, 22 aa, Cryptosporidium parvum
LMSLRIFGILLNNINVDRELSY

SEQ ID NO: 2345973 - protein, 18 aa, Cryptosporidium parvum
LMVQIRGKLRTTFYGYLI

SEQ ID NO: 2345974 - protein, 26 aa, Cryptosporidium parvum
LNLISLLSLCSFLVITGLQGTIENNL

SEQ ID NO: 2345975 - protein, 27 aa, Cryptosporidium parvum
LNLNGKWNYIYSVDLFKLNSISWSKDG

SEQ ID NO: 2345976 - protein, 18 aa, Cryptosporidium parvum
LNNELDVFLISRPGKHTY

SEQ ID NO: 2345977 - protein, 24 aa, Cryptosporidium parvum
LPMLTVFYGIFFSLAFMHGQNLNS

SEQ ID NO: 2345978 - protein, 18 aa, Cryptosporidium parvum
LPYLTIKETMDIVAGLRL

SEQ ID NO: 2345979 - protein, 18 aa, Cryptosporidium parvum
LQILKVFIYERYFKAQSA

SEQ ID NO: 2345980 - protein, 17 aa, Cryptosporidium parvum
LQKYEFHVRNLLCSLLR

SEQ ID NO: 2345981 - protein, 25 aa, Cryptosporidium parvum
LQSDHILFYLCRVLYSIGKSASQRE

SEQ ID NO: 2345982 - protein, 27 aa, Cryptosporidium parvum
LQSVIVPFFWIIVYPKEKWRSITWEVQ

SEQ ID NO: 2345983 - protein, 24 aa, Cryptosporidium parvum
LRDCIVSWVFPRARRMGLMPQNSS

SEQ ID NO: 2345984 - protein, 29 aa, Cryptosporidium parvum
LRFDVIYRNELITQITWYDANLKSGNNLW

SEQ ID NO: 2345985 - protein, 25 aa, Cryptosporidium parvum
LRMGLLFELMCYLGLTMISYNYTNQ

SEQ ID NO: 2345986 - protein, 24 aa, Cryptosporidium parvum
LRVWHHGIFIQWENHWSLNSFINL

SEQ ID NO: 2345987 - protein, 17 aa, Cryptosporidium parvum
LSFKEAVILIYGGLRGG

SEQ ID NO: 2345988 - protein, 34 aa, Cryptosporidium parvum
LSFKSLRDSIPKFWSLLFDIMLGPDLDSKDLDAI

SEQ ID NO: 2345989 - protein, 22 aa, Cryptosporidium parvum
LSIFGVINYVISRVLYLSSSLS

SEQ ID NO: 2345990 - protein, 21 aa, Cryptosporidium parvum
LSILVLFSWISIVIGGEGNLD

SEQ ID NO: 2345991 - protein, 19 aa, Cryptosporidium parvum
LSKGFIEKLIVSLTKDGCI

SEQ ID NO: 2345992 - protein, 24 aa, Cryptosporidium parvum
LSKKLFPTFSSRFGWRRVEEIIKS

SEQ ID NO: 2345993 - protein, 25 aa, Cryptosporidium parvum
LSKKQLIFHRIYFDLGTYSDHKLTQ

SEQ ID NO: 2345994 - protein, 24 aa, Cryptosporidium parvum
LSLKHILKCKPFEWYIGKFRPAFE

SEQ ID NO: 2345995 - protein, 32 aa, Cryptosporidium parvum; identical to SEQ ID NO: 2132218

SEQ ID NO: 2345996 - protein, 31 aa, Cryptosporidium parvum; identical to SEQ ID NO: 2245542

SEQ ID NO: 2345997 - protein, 23 aa, Cryptosporidium parvum
LSSNLFIGVLYLFSDVYQNNSGS

SEQ ID NO: 2345998 - protein, 26 aa, Cryptosporidium parvum
LSTNLAGILFYFYKSFINLQSIKQFI

SEQ ID NO: 2345999 - protein, 29 aa, Cryptosporidium parvum
LSYVDFIELVIFYFKKFNLKGVFVGNIHP

SEQ ID NO: 2346000 - protein, 17 aa, Cryptosporidium parvum
LTDISFFNLFLGNFAVI

SEQ ID NO: 2346001 - protein, 19 aa, Cryptosporidium parvum
LTESKFLLESSCCPLNLIR

SEQ ID NO: 2346002 - protein, 18 aa, Cryptosporidium parvum
LTIILLFSKILTDSTRPW

SEQ ID NO: 2346003 - protein, 29 aa, Cryptosporidium parvum
LTQLTSALYIPLFGLVLLISYFRGELSRD

SEQ ID NO: 2346004 - protein, 17 aa, Cryptosporidium parvum
LTSIIVMLVFVTPLLLA

SEQ ID NO: 2346005 - protein, 26 aa, Cryptosporidium parvum
LTVRGSMILPFSNLIVIGKLIVGKNV

SEQ ID NO: 2346006 - protein, 27 aa, Cryptosporidium parvum
LTVRRALNLFIPLLHNIKPIIKDDTLN

SEQ ID NO: 2346007 - protein, 18 aa, Cryptosporidium parvum
LVCPLFQDWVLELEREVT

SEQ ID NO: 2346008 - protein, 17 aa, Cryptosporidium parvum
LVLVGIMIFMVNSLIKG

SEQ ID NO: 2346009 - protein, 30 aa, Cryptosporidium parvum; identical to SEQ ID NO: 2245624

SEQ ID NO: 2346010 - protein, 25 aa, Cryptosporidium parvum
LVPRSTLNYLLYRALKLPNDFGKTR

SEQ ID NO: 2346011 - protein, 23 aa, Cryptosporidium parvum
LVSCLNIVSLFPRDFHPKLMGSS

SEQ ID NO: 2346012 - protein, 17 aa, Cryptosporidium parvum
LYGYFKLLPFSLIQLES

SEQ ID NO: 2346013 - protein, 19 aa, Cryptosporidium parvum
LYIANFILHTDFLDKRKVG

SEQ ID NO: 2346014 - protein, 20 aa, Cryptosporidium parvum
LYKDFLQFTLMRNLERRDSV

SEQ ID NO: 2346015 - protein, 18 aa, Cryptosporidium parvum
LYKELDGYFLKKFNEASN

SEQ ID NO: 2346016 - protein, 29 aa, Cryptosporidium parvum
LYLAYKFLPVYWVNLLLTSYLFIIGAVAL

SEQ ID NO: 2346017 - protein, 17 aa, Cryptosporidium parvum
LYQAFVLIDLYICFGNK

SEQ ID NO: 2346018 - protein, 25 aa, Cryptosporidium parvum
LYTTPKFHRMFFKKVMKSINEEYRL

SEQ ID NO: 2346019 - protein, 24 aa, Cryptosporidium parvum
LYTTSFIFTTIAYLGLVSFFNIFT

SEQ ID NO: 2346020 - protein, 19 aa, Cryptosporidium parvum
LYYISDIKLLLHYQTIHEW

SEQ ID NO: 2346021 - protein, 18 aa, Cryptosporidium parvum
MCPGVEFLSKGFIEKLIV

SEQ ID NO: 2346022 - protein, 42 aa, Cryptosporidium parvum
MDRDILSFHSCLIFGLVRLLWNIVFILYGATSLVNIPNMERS

SEQ ID NO: 2346023 - protein, 18 aa, Cryptosporidium parvum
MENSLFFLLPSNTISKRS

SEQ ID NO: 2346024 - protein, 25 aa, Cryptosporidium parvum
MFENFFFYFFLILQINYISFLISIL

SEQ ID NO: 2346025 - protein, 18 aa, Cryptosporidium parvum
MFIDRFISFPQFLSAIIN

SEQ ID NO: 2346026 - protein, 18 aa, Cryptosporidium parvum
MGLCIFVRLFAVVRYEAI

SEQ ID NO: 2346027 - protein, 19 aa, Cryptosporidium parvum
MHLSPSFFQTLLDSNERFI

SEQ ID NO: 2346028 - protein, 17 aa, Cryptosporidium parvum
MIRIGMTNPPYILDQID

SEQ ID NO: 2346029 - protein, 31 aa, Cryptosporidium parvum
MIVINAPSIFGIIWNFLKPLIDERTAKKISV

SEQ ID NO: 2346030 - protein, 31 aa, Cryptosporidium parvum
MKHASVQIILLDYLVTWILINVSVFKDRKDQ

SEQ ID NO: 2346031 - protein, 19 aa, Cryptosporidium parvum
MKIPVLFETIKLISNQDSK

SEQ ID NO: 2346032 - protein, 19 aa, Cryptosporidium parvum
MLCVYFIGVLFLAGFQEFI

SEQ ID NO: 2346033 - protein, 27 aa, Cryptosporidium parvum
MLFTGFGSFFILFFAAALIVTCTWAFQ

SEQ ID NO: 2346034 - protein, 17 aa, Cryptosporidium parvum
MLLLYSGSELIINVNIT

SEQ ID NO: 2346035 - protein, 25 aa, Cryptosporidium parvum
MNYSTMIHLIAILYIPIIKRVNMSL

SEQ ID NO: 2346036 - protein, 38 aa, Cryptosporidium parvum
MRRQIFIFPYIHYKYYLFCLILFNTLFLGLIQSFPEDK

SEQ ID NO: 2346037 - protein, 19 aa, Cryptosporidium parvum
MSFLTISLIFIVLVGFVQS

SEQ ID NO: 2346038 - protein, 30 aa, Cryptosporidium parvum; identical to SEQ ID NO: 2132397

SEQ ID NO: 2346039 - protein, 21 aa, Cryptosporidium parvum
NAKYLLIYLNKVKVLSKHNFN

SEQ ID NO: 2346040 - protein, 21 aa, Cryptosporidium parvum
NALFPESWIEFILMNNSRYEE

SEQ ID NO: 2346041 - protein, 25 aa, Cryptosporidium parvum
NAVVLVVLGILYRIFACIAFALFFR

SEQ ID NO: 2346042 - protein, 27 aa, Cryptosporidium parvum
NCDEFFSLLLKQYSIIPITYKIGEVLR

SEQ ID NO: 2346043 - protein, 25 aa, Cryptosporidium parvum
NCEKILIDEIPSLYLPFITSPNIEH

SEQ ID NO: 2346044 - protein, 23 aa, Cryptosporidium parvum
NCPGFLPIMLHLIIPKNENMLKK

SEQ ID NO: 2346045 - protein, 30 aa, Cryptosporidium parvum
NDLSLYIFSNKIFWELFLNDFCSKKVSQEC

SEQ ID NO: 2346046 - protein, 19 aa, Cryptosporidium parvum
NDLYKKFIELGIFGYNWDT

SEQ ID NO: 2346047 - protein, 33 aa, Cryptosporidium parvum; identical to SEQ ID NO: 2245879

SEQ ID NO: 2346048 - protein, 24 aa, Cryptosporidium parvum
NEDLELWNLLGYKNAPKGLGVMFS

SEQ ID NO: 2346049 - protein, 30 aa, Cryptosporidium parvum; identical to SEQ ID NO: 2245895

SEQ ID NO: 2346050 - protein, 23 aa, Cryptosporidium parvum
NEKLIIIYIIMKYINHNLNKLTI

SEQ ID NO: 2346051 - protein, 17 aa, Cryptosporidium parvum
NELDFFYSRQFLSGQFF

SEQ ID NO: 2346052 - protein, 23 aa, Cryptosporidium parvum
NELLGLLQIPLLDDLLVVSTQGM

SEQ ID NO: 2346053 - protein, 26 aa, Cryptosporidium parvum
NEQWQLLRLYGVLNSPQLVLIYPVYT

SEQ ID NO: 2346054 - protein, 24 aa, Cryptosporidium parvum
NEVSSFLNVLRHLGYWLGQITIGI

SEQ ID NO: 2346055 - protein, 19 aa, Cryptosporidium parvum
NFEPLSISNTLIASLPGLG

SEQ ID NO: 2346056 - protein, 20 aa, Cryptosporidium parvum
NFFLIVCMMSLLISSVFNSV

SEQ ID NO: 2346057 - protein, 26 aa, Cryptosporidium parvum
NFGILRVFFVLLMFLLCVSYVVHSVW

SEQ ID NO: 2346058 - protein, 29 aa, Cryptosporidium parvum
NFHIPNNWMTYFAKLSLRWNNFGNDQTTE

SEQ ID NO: 2346059 - protein, 17 aa, Cryptosporidium parvum
NFLLLEKIIYPPRISQK

SEQ ID NO: 2346060 - protein, 28 aa, Cryptosporidium parvum
NFSDWSFPPVLLDKLYFFTRFSKNNKKD

SEQ ID NO: 2346061 - protein, 35 aa, Cryptosporidium parvum; identical to SEQ ID NO: 2132472

SEQ ID NO: 2346062 - protein, 23 aa, Cryptosporidium parvum
NFSNLGLLIWISSAFLLLPLFFL

SEQ ID NO: 2346063 - protein, 24 aa, Cryptosporidium parvum
NFSNMTMVKLLNKETKREFAAKMI

SEQ ID NO: 2346064 - protein, 33 aa, Cryptosporidium parvum; identical to SEQ ID NO: 2132474

SEQ ID NO: 2346065 - protein, 19 aa, Cryptosporidium parvum
NFVFSIIMNLISRSDHLTS

SEQ ID NO: 2346066 - protein, 19 aa, Cryptosporidium parvum
NGIFIQRNLLNNKNKIQLT

SEQ ID NO: 2346067 - protein, 31 aa, Cryptosporidium parvum; identical to SEQ ID NO: 2245961

SEQ ID NO: 2346068 - protein, 20 aa, Cryptosporidium parvum
NGYIWANMAGTPIFKDKPKI

SEQ ID NO: 2346069 - protein, 25 aa, Cryptosporidium parvum
NIETPLFIIAIMDYIRARLVYMTYA

SEQ ID NO: 2346070 - protein, 33 aa, Cryptosporidium parvum; identical to SEQ ID NO: 2246001

SEQ ID NO: 2346071 - protein, 31 aa, Cryptosporidium parvum
NIKSLIRTTFTFVYSIFIFTTAVLVLNKYYS

SEQ ID NO: 2346072 - protein, 25 aa, Cryptosporidium parvum
NITIHSIIICSLICNSKFLTSQGLQ

SEQ ID NO: 2346073 - protein, 32 aa, Cryptosporidium parvum; identical to SEQ ID NO: 2246051

SEQ ID NO: 2346074 - protein, 20 aa, Cryptosporidium parvum
NKHWDILRKILLGETKDINT

SEQ ID NO: 2346075 - protein, 30 aa, Cryptosporidium parvum; identical to SEQ ID NO: 2246060

SEQ ID NO: 2346076 - protein, 17 aa, Cryptosporidium parvum
NKRIRFVAIRPIGNIIA

SEQ ID NO: 2346077 - protein, 24 aa, Cryptosporidium parvum
NKVDIYEIYLMKLLYTECGYTFIS

SEQ ID NO: 2346078 - protein, 30 aa, Cryptosporidium parvum; identical to SEQ ID NO: 2246089

SEQ ID NO: 2346079 - protein, 26 aa, Cryptosporidium parvum
NLDSFIERFNFYKIPYFGTEKKYNGY

SEQ ID NO: 2346080 - protein, 26 aa, Cryptosporidium parvum
NLFGLYCHVVFSLCKFVSVIINAILS

SEQ ID NO: 2346081 - protein, 19 aa, Cryptosporidium parvum
NLFINWIINLIKNNEFRSS

SEQ ID NO: 2346082 - protein, 30 aa, Cryptosporidium parvum
NLGLKIVLPILMAFLIIVGYRITGIIVLKR

SEQ ID NO: 2346083 - protein, 31 aa, Cryptosporidium parvum
NLVLKTLLLLLLEYLIINFPGVSSIDEKVQE

SEQ ID NO: 2346084 - protein, 22 aa, Cryptosporidium parvum
NLYWIIPHMVAVFFMGSFLTTL

SEQ ID NO: 2346085 - protein, 17 aa, Cryptosporidium parvum
NMPLIPPPGTPNAPQNP

SEQ ID NO: 2346086 - protein, 32 aa, Cryptosporidium parvum; identical to SEQ ID NO: 2246166

SEQ ID NO: 2346087 - protein, 26 aa, Cryptosporidium parvum
NNCADLFQLILISPYFTMKSLNSNVF

SEQ ID NO: 2346088 - protein, 22 aa, Cryptosporidium parvum
NNHTILLGKYLKALSTLKHRIE

SEQ ID NO: 2346089 - protein, 31 aa, Cryptosporidium parvum
NNWGKIGRIILFIYISFLSMLHDITGIVIPN

SEQ ID NO: 2346090 - protein, 24 aa, Cryptosporidium parvum
NNYSTTILIKFDKSVLLRDKSIQS

SEQ ID NO: 2346091 - protein, 55 aa, Cryptosporidium parvum; identical to SEQ ID NO: 2132645

SEQ ID NO: 2346092 - protein, 20 aa, Cryptosporidium parvum
NPYRNLFLQRLSRQGLLRMD

SEQ ID NO: 2346093 - protein, 25 aa, Cryptosporidium parvum
NQDSKLFFIGLQIILNYMYKRRNNE

SEQ ID NO: 2346094 - protein, 19 aa, Cryptosporidium parvum
NQIHCQYIFLCHGQIQNSS

SEQ ID NO: 2346095 - protein, 23 aa, Cryptosporidium parvum
NQILLLLGILSRYSIRISMNLNE

SEQ ID NO: 2346096 - protein, 18 aa, Cryptosporidium parvum
NQISDFIPFISTNNKKNK

SEQ ID NO: 2346097 - protein, 36 aa, Cryptosporidium parvum
NQISYYSSKFWLKLRKEAIGWFIYTIEDPKYSVDIV

SEQ ID NO: 2346098 - protein, 24 aa, Cryptosporidium parvum
NQLDIRKLFLRNAPKRTGYRPVPG

SEQ ID NO: 2346099 - protein, 26 aa, Cryptosporidium parvum
NQYLLIPNIFLLSVPFILNLLKAKRN

SEQ ID NO: 2346100 - protein, 21 aa, Cryptosporidium parvum
NREKNHVLRRALSSNIPEKPL

SEQ ID NO: 2346101 - protein, 17 aa, Cryptosporidium parvum
NRIQILRSILICIETKD

SEQ ID NO: 2346102 - protein, 26 aa, Cryptosporidium parvum
NRVEYWFKLLSAKVIPKILLKFFPDL

SEQ ID NO: 2346103 - protein, 29 aa, Cryptosporidium parvum
NSDDKMYIDFPIRNFWKIAKTPIDMESPQ

SEQ ID NO: 2346104 - protein, 20 aa, Cryptosporidium parvum
NSEFWLNYTALNSDSWKEID

SEQ ID NO: 2346105 - protein, 19 aa, Cryptosporidium parvum
NSIFNMRPSILYNTYIVCP

SEQ ID NO: 2346106 - protein, 22 aa, Cryptosporidium parvum
NSIINLIRYLTYLEFSFEFVKD

SEQ ID NO: 2346107 - protein, 24 aa, Cryptosporidium parvum
NSISILSLLLLLNKNYTSKVVLQS

SEQ ID NO: 2346108 - protein, 28 aa, Cryptosporidium parvum
NSKHEKMLFLMVLWIKHYLSNKVENKSE

SEQ ID NO: 2346109 - protein, 44 aa, Cryptosporidium parvum
NSLDSYILYSKLLFHGIKLIPSTMSILLRFLINKLISLESEIHS

SEQ ID NO: 2346110 - protein, 24 aa, Cryptosporidium parvum
NSLHQPHRFQTRPSILVTLCKLLK

SEQ ID NO: 2346111 - protein, 22 aa, Cryptosporidium parvum
NSPFRIACQFSLIKCTLANIKS

SEQ ID NO: 2346112 - protein, 27 aa, Cryptosporidium parvum
NTSKTKKKITFLKKLFSRISNDDVNLI

SEQ ID NO: 2346113 - protein, 30 aa, Cryptosporidium parvum
NVQEFIQIVSYWRSAIQHILYKNTKLWTSF

SEQ ID NO: 2346114 - protein, 37 aa, Cryptosporidium parvum
NYIINYLNYHFFTSINIIIIIIIQMSSSFLSASSSIS

SEQ ID NO: 2346115 - protein, 26 aa, Cryptosporidium parvum
NYSEILLFPSILILKLLSIQNYEKSI

SEQ ID NO: 2346116 - protein, 17 aa, Cryptosporidium parvum
NYVCLNFFLFKFDEEST

SEQ ID NO: 2346117 - protein, 29 aa, Cryptosporidium parvum
PCIRNYNELLFYSHFRWLKGEYIKKKRFE

SEQ ID NO: 2346118 - protein, 24 aa, Cryptosporidium parvum
PDIALRYFLSRFFLPGESQMVYRI

SEQ ID NO: 2346119 - protein, 20 aa, Cryptosporidium parvum
PDQWLNLDWIHPMEPSCSNT

SEQ ID NO: 2346120 - protein, 26 aa, Cryptosporidium parvum
PEKALEFPLVLYSSVTTPLILENITS

SEQ ID NO: 2346121 - protein, 26 aa, Cryptosporidium parvum
PEMKRMIFGILIVITNWVCNFDAEVN

SEQ ID NO: 2346122 - protein, 27 aa, Cryptosporidium parvum
PEVLYKYVIFISFLLQWIASATRSCYL

SEQ ID NO: 2346123 - protein, 22 aa, Cryptosporidium parvum
PFEPIKIFRLVTQAGLKNASVD

SEQ ID NO: 2346124 - protein, 22 aa, Cryptosporidium parvum
PFIFLGLFQSIFLFCSGEEILQ

SEQ ID NO: 2346125 - protein, 25 aa, Cryptosporidium parvum
PFKFRYVFITILIKYLPMFFVVLFV

SEQ ID NO: 2346126 - protein, 26 aa, Cryptosporidium parvum
PGGGYYYYYNFYPPPPPMQPEPFPYY

SEQ ID NO: 2346127 - protein, 21 aa, Cryptosporidium parvum
PGSNIFFLTMAAHGQLVLSGT

SEQ ID NO: 2346128 - protein, 18 aa, Cryptosporidium parvum
PHPKIKLGFLKWFNEKLP

SEQ ID NO: 2346129 - protein, 28 aa, Cryptosporidium parvum
PIKDLDFPILLHRKLINISLRKLNNINN

SEQ ID NO: 2346130 - protein, 19 aa, Cryptosporidium parvum
PILCQSYCNLWYDACYEDY

SEQ ID NO: 2346131 - protein, 17 aa, Cryptosporidium parvum
PINLELLFDDFSKSSLL

SEQ ID NO: 2346132 - protein, 20 aa, Cryptosporidium parvum
PIQIFTKYIYKHLGIFLIGV

SEQ ID NO: 2346133 - protein, 22 aa, Cryptosporidium parvum
PISPISLYDAIIGKTDYVIKII

SEQ ID NO: 2346134 - protein, 46 aa, Cryptosporidium parvum; identical to SEQ ID NO: 2246523

SEQ ID NO: 2346135 - protein, 33 aa, Cryptosporidium parvum
PKIVSPLFKAKLIDPLWSSTKFPMNDDSVAPLL

SEQ ID NO: 2346136 - protein, 24 aa, Cryptosporidium parvum
PKKHLGKYLAKIKKVIPTKKPSKP

SEQ ID NO: 2346137 - protein, 24 aa, Cryptosporidium parvum
PKKYLDYTFRLRWYGENEGSPDQW

SEQ ID NO: 2346138 - protein, 32 aa, Cryptosporidium parvum
PKSTFSWKIMSIFSFLKLKKPKYAPPSHNLHN

SEQ ID NO: 2346139 - protein, 21 aa, Cryptosporidium parvum
PKYISFCFFLGIMGSLHLMSF

SEQ ID NO: 2346140 - protein, 18 aa, Cryptosporidium parvum
PLEVGFTFSFPIVQSKIA

SEQ ID NO: 2346141 - protein, 18 aa, Cryptosporidium parvum
PLNLIRFCDNKQLLNAAI

SEQ ID NO: 2346142 - protein, 31 aa, Cryptosporidium parvum; identical to SEQ ID NO: 2246553

SEQ ID NO: 2346143 - protein, 48 aa, Cryptosporidium parvum; identical to SEQ ID NO: 2246555

SEQ ID NO: 2346144 - protein, 18 aa, Cryptosporidium parvum
PLSLPKIRRNPFVEIITI

SEQ ID NO: 2346145 - protein, 35 aa, Cryptosporidium parvum
PLSSMKFMNIQELFLFLSLFYHNYQREWILPLLNN

SEQ ID NO: 2346146 - protein, 18 aa, Cryptosporidium parvum
PLVALLLLNGANIDYSDN

SEQ ID NO: 2346147 - protein, 31 aa, Cryptosporidium parvum; identical to SEQ ID NO: 2246569

SEQ ID NO: 2346148 - protein, 17 aa, Cryptosporidium parvum
PNGLTLELSLTKLPEKL

SEQ ID NO: 2346149 - protein, 17 aa, Cryptosporidium parvum
PNHVWFLTQLTSALYIP

SEQ ID NO: 2346150 - protein, 34 aa, Cryptosporidium parvum; identical to SEQ ID NO: 2132843

SEQ ID NO: 2346151 - protein, 17 aa, Cryptosporidium parvum
PPILFKEMKSPIVGVGD

SEQ ID NO: 2346152 - protein, 23 aa, Cryptosporidium parvum
PRFEKWPFFDKWVISFQRQEYGI

SEQ ID NO: 2346153 - protein, 30 aa, Cryptosporidium parvum; identical to SEQ ID NO: 2246621

SEQ ID NO: 2346154 - protein, 26 aa, Cryptosporidium parvum
PSDHKKFFFFLVEKNFDTDKALELVS

SEQ ID NO: 2346155 - protein, 23 aa, Cryptosporidium parvum
PSLILTSGWIFIRCALGGPLLGF

SEQ ID NO: 2346156 - protein, 29 aa, Cryptosporidium parvum
PTLEFSNWLLTNWVFRTISNLPILFSDYS

SEQ ID NO: 2346157 - protein, 20 aa, Cryptosporidium parvum
PVRVPLVFELAYLPLMMRVD

SEQ ID NO: 2346158 - protein, 23 aa, Cryptosporidium parvum
PVTKLLLSFFVILFICFGVIDMI

SEQ ID NO: 2346159 - protein, 23 aa, Cryptosporidium parvum
PYQLAFLDTLCFLASLRPSPIGI

SEQ ID NO: 2346160 - protein, 17 aa, Cryptosporidium parvum
PYREIWLEISLTVPARL

SEQ ID NO: 2346161 - protein, 31 aa, Cryptosporidium parvum
QAMFFLNIIKIIFIIHFFTLIHGTEFKLDHD

SEQ ID NO: 2346162 - protein, 26 aa, Cryptosporidium parvum
QAPISHLILHLWVNNIPCSYRGILWN

SEQ ID NO: 2346163 - protein, 23 aa, Cryptosporidium parvum
QCSGNVYFLLLNSNKPYENLGVS

SEQ ID NO: 2346164 - protein, 21 aa, Cryptosporidium parvum
QDELRWKIIGVLFRCVTRKDL

SEQ ID NO: 2346165 - protein, 23 aa, Cryptosporidium parvum
QDKNRFPLLRILRGKDYGPATKF

SEQ ID NO: 2346166 - protein, 27 aa, Cryptosporidium parvum
QEHYCSIGYIPLDIPAPRGPLFVLGNN

SEQ ID NO: 2346167 - protein, 37 aa, Cryptosporidium parvum; identical to SEQ ID NO: 2246718

SEQ ID NO: 2346168 - protein, 27 aa, Cryptosporidium parvum
QFANTLYSLLYLPKLITEKISDLVIKS

SEQ ID NO: 2346169 - protein, 21 aa, Cryptosporidium parvum
QFRLQFIQQWSDIIAKIINKV

SEQ ID NO: 2346170 - protein, 25 aa, Cryptosporidium parvum
QGLARLLELLCFCFNVTLGEKLLQH

SEQ ID NO: 2346171 - protein, 27 aa, Cryptosporidium parvum
QGPVVAFLEAYYWKEGWILPKTTLDLQ

SEQ ID NO: 2346172 - protein, 25 aa, Cryptosporidium parvum
QGSLVILLGLILIVVTLYSNVGYYE

SEQ ID NO: 2346173 - protein, 27 aa, Cryptosporidium parvum
QIERINSFQLLLKLINDLMPNIVEELN

SEQ ID NO: 2346174 - protein, 23 aa, Cryptosporidium parvum
QIIDKYFNYKLMPKYVIINNIET

SEQ ID NO: 2346175 - protein, 20 aa, Cryptosporidium parvum
QIIQLPHLLQNPNPPSPTHV

SEQ ID NO: 2346176 - protein, 20 aa, Cryptosporidium parvum
QILMQIKYFRAQLLESAQLL

SEQ ID NO: 2346177 - protein, 38 aa, Cryptosporidium parvum; identical to SEQ ID NO: 2132959

SEQ ID NO: 2346178 - protein, 30 aa, Cryptosporidium parvum; identical to SEQ ID NO: 2246776

SEQ ID NO: 2346179 - protein, 23 aa, Cryptosporidium parvum
QIRNLILSAFPRNMKLPDPFLPT

SEQ ID NO: 2346180 - protein, 23 aa, Cryptosporidium parvum
QIWRFLTSFFFVGPFSIGWIMSQ

SEQ ID NO: 2346181 - protein, 26 aa, Cryptosporidium parvum
QKTFAYMTLWPIAYSVKRSIRHSWQE

SEQ ID NO: 2346182 - protein, 35 aa, Cryptosporidium parvum; identical to SEQ ID NO: 2246834

SEQ ID NO: 2346183 - protein, 27 aa, Cryptosporidium parvum
QLSLSTLFKYLKLLNMNLFLMDNYDLN

SEQ ID NO: 2346184 - protein, 20 aa, Cryptosporidium parvum
QLTILLTSWASYGLVYFICG

SEQ ID NO: 2346185 - protein, 21 aa, Cryptosporidium parvum
QLYQMRIFCTHIPVIHMKSIH

SEQ ID NO: 2346186 - protein, 26 aa, Cryptosporidium parvum
QMCMHAYFEGGPLKEAFFIHLKRFHR

SEQ ID NO: 2346187 - protein, 26 aa, Cryptosporidium parvum
QNARNIIGLIFFVSTSISFFSIKGLV

SEQ ID NO: 2346188 - protein, 18 aa, Cryptosporidium parvum
QNCVWLPSLLESKARFKL

SEQ ID NO: 2346189 - protein, 27 aa, Cryptosporidium parvum
QQRSAILFTILLIKSLTILSPSSIIEM

SEQ ID NO: 2346190 - protein, 18 aa, Cryptosporidium parvum
QQTYVQPIPVIQEVPRKK

SEQ ID NO: 2346191 - protein, 19 aa, Cryptosporidium parvum
QREIIQLLRRLLSTETSSQ

SEQ ID NO: 2346192 - protein, 20 aa, Cryptosporidium parvum
QRPYYRIFYSLLQEYESIGF

SEQ ID NO: 2346193 - protein, 24 aa, Cryptosporidium parvum
QSDPQLHLYKFYRETMHGAYNGNK

SEQ ID NO: 2346194 - protein, 24 aa, Cryptosporidium parvum
QTGLMKTYLVPLPCLGFLTSVFEG

SEQ ID NO: 2346195 - protein, 38 aa, Cryptosporidium parvum
QVGRICGLIMAPVAIFFIAYSYYIYLKRNRALETKEPI

SEQ ID NO: 2346196 - protein, 17 aa, Cryptosporidium parvum
QYHILQLIFQNLSNILQ

SEQ ID NO: 2346197 - protein, 18 aa, Cryptosporidium parvum
QYLCYQLTILLTSWASYG

SEQ ID NO: 2346198 - protein, 49 aa, Cryptosporidium parvum
RAVSFVYSVDLSNYLLGLPQHTLPLIDELIRKGLPPKSVIDHAIQIYPE

SEQ ID NO: 2346199 - protein, 17 aa, Cryptosporidium parvum
RDKINLINAFIGTGFDT

SEQ ID NO: 2346200 - protein, 22 aa, Cryptosporidium parvum
RDLSPNQIEFLRKIDLRKQNRF

SEQ ID NO: 2346201 - protein, 17 aa, Cryptosporidium parvum
RFVAIRPIGNIIAIGYS

SEQ ID NO: 2346202 - protein, 26 aa, Cryptosporidium parvum
RGKKAYFRIFFNIVLKGKPLYTIEKE

SEQ ID NO: 2346203 - protein, 17 aa, Cryptosporidium parvum
RIFIEEISMIYFSKDLS

SEQ ID NO: 2346204 - protein, 26 aa, Cryptosporidium parvum
RIIKLNNPYYLYRLITRAQGISDPYF

SEQ ID NO: 2346205 - protein, 27 aa, Cryptosporidium parvum
RIKIYYNSIYFNLLEISINLICACFSS

SEQ ID NO: 2346206 - protein, 24 aa, Cryptosporidium parvum
RITESVCHGFVPAKSWLPMMNLIG

SEQ ID NO: 2346207 - protein, 21 aa, Cryptosporidium parvum
RKPYLIFFSILQVIGFLLLAT

SEQ ID NO: 2346208 - protein, 26 aa, Cryptosporidium parvum
RKYLCYKYKFMLVPSMLILVIKNEIT

SEQ ID NO: 2346209 - protein, 23 aa, Cryptosporidium parvum
RLEENNEILLHLSNGLAKCAQSL

SEQ ID NO: 2346210 - protein, 27 aa, Cryptosporidium parvum
RLFDLYEEYFFLSNLKLLELVDDFHKS

SEQ ID NO: 2346211 - protein, 34 aa, Cryptosporidium parvum; identical to SEQ ID NO: 2196376

SEQ ID NO: 2346212 - protein, 20 aa, Cryptosporidium parvum
RLLKQLFRYIGQNPQHETIL

SEQ ID NO: 2346213 - protein, 19 aa, Cryptosporidium parvum
RLPNKWDSMILWNDLFVWR

SEQ ID NO: 2346214 - protein, 31 aa, Cryptosporidium parvum; identical to SEQ ID NO: 2247131

SEQ ID NO: 2346215 - protein, 36 aa, Cryptosporidium parvum; identical to SEQ ID NO: 2133178

SEQ ID NO: 2346216 - protein, 26 aa, Cryptosporidium parvum
RMVAQLIYLLQCEIKFFLKPERNIQI

SEQ ID NO: 2346217 - protein, 51 aa, Cryptosporidium parvum
RNIQYKITKKNILLFIFACYTPIILIVGSIYLDILGIYLKGRNLMMNDLEH

SEQ ID NO: 2346218 - protein, 24 aa, Cryptosporidium parvum
RNRRFEMHLIYHSFLEEILNNHED

SEQ ID NO: 2346219 - protein, 26 aa, Cryptosporidium parvum
RNTLAMYMEWIWLNNHIQSVIEQGYD

SEQ ID NO: 2346220 - protein, 34 aa, Cryptosporidium parvum
RNVKMRLDFFDMLFKELMPSLAYHFDLLSITSDT

SEQ ID NO: 2346221 - protein, 17 aa, Cryptosporidium parvum
RPEVLIFMSLAKVVIEW

SEQ ID NO: 2346222 - protein, 24 aa, Cryptosporidium parvum
RPSILVTLCKLLKPAPPIPLPVSQ

SEQ ID NO: 2346223 - protein, 20 aa, Cryptosporidium parvum
RQRENYLFIELISHGTFTSS

SEQ ID NO: 2346224 - protein, 29 aa, Cryptosporidium parvum
RRLLELLQHLIFYEIPRYSPIGLLSSLGA

SEQ ID NO: 2346225 - protein, 44 aa, Cryptosporidium parvum; identical to SEQ ID NO: 2133219

SEQ ID NO: 2346226 - protein, 19 aa, Cryptosporidium parvum
RSFGQLIIPSLPNGLFIFF

SEQ ID NO: 2346227 - protein, 21 aa, Cryptosporidium parvum
RSILTITFFSTLLITFGMLNP

SEQ ID NO: 2346228 - protein, 24 aa, Cryptosporidium parvum
RSSGILEYISPYSPLIILSCNIFQ

SEQ ID NO: 2346229 - protein, 21 aa, Cryptosporidium parvum
RSYLWEFLDSEWKTLPQFYKM

SEQ ID NO: 2346230 - protein, 30 aa, Cryptosporidium parvum; identical to SEQ ID NO: 2133241

SEQ ID NO: 2346231 - protein, 17 aa, Cryptosporidium parvum
RTLLHMRIKLQQKIRDL

SEQ ID NO: 2346232 - protein, 23 aa, Cryptosporidium parvum
RTSRENGILFALPTGNNGKQELD

SEQ ID NO: 2346233 - protein, 46 aa, Cryptosporidium parvum
RTTAKKILKFNIYIYRIYTDKYKRKIIKRVQGILRNLKIVNKSQMI

SEQ ID NO: 2346234 - protein, 17 aa, Cryptosporidium parvum
RVHFPQAGNFSNMTMVK

SEQ ID NO: 2346235 - protein, 22 aa, Cryptosporidium parvum
RWFLLLLYFLISFSVCGLVGSF

SEQ ID NO: 2346236 - protein, 17 aa, Cryptosporidium parvum
SAFLLLPLFFLNLVVNE

SEQ ID NO: 2346237 - protein, 22 aa, Cryptosporidium parvum
SAIPIVLPGLYYKPYSYTTNLG

SEQ ID NO: 2346238 - protein, 17 aa, Cryptosporidium parvum
SALSFMLTIPQYATSYL

SEQ ID NO: 2346239 - protein, 22 aa, Cryptosporidium parvum
SANRCFILKGRVYLIPPEIMDN

SEQ ID NO: 2346240 - protein, 18 aa, Cryptosporidium parvum
SDMYFCHFYKTNVELEKL

SEQ ID NO: 2346241 - protein, 23 aa, Cryptosporidium parvum
SEALYVLICKIIQIIPHPSTQLK

SEQ ID NO: 2346242 - protein, 32 aa, Cryptosporidium parvum; identical to SEQ ID NO: 2247368

SEQ ID NO: 2346243 - protein, 21 aa, Cryptosporidium parvum
SELALITKELIYWTCTNRSKN

SEQ ID NO: 2346244 - protein, 25 aa, Cryptosporidium parvum
SEPIPPVYIPIFWTSIHRNKVELDL

SEQ ID NO: 2346245 - protein, 23 aa, Cryptosporidium parvum
SETAMRVGLPFYPKKDLKSTLFP

SEQ ID NO: 2346246 - protein, 27 aa, Cryptosporidium parvum
SFNTGGICSFLWIMAKFPDYVYCDKGE

SEQ ID NO: 2346247 - protein, 23 aa, Cryptosporidium parvum
SFPESICYIWNIKGHNALGEIQD

SEQ ID NO: 2346248 - protein, 25 aa, Cryptosporidium parvum
SFVLLFCLFFYQLDKLHAEVIYAVN

SEQ ID NO: 2346249 - protein, 25 aa, Cryptosporidium parvum
SGFSNYYVGVILVSSLILDTKNQDK

SEQ ID NO: 2346250 - protein, 33 aa, Cryptosporidium parvum; identical to SEQ ID NO: 2247452

SEQ ID NO: 2346251 - protein, 24 aa, Cryptosporidium parvum
SGSYLYFILILMTGINIIGTAFDY

SEQ ID NO: 2346252 - protein, 31 aa, Cryptosporidium parvum
SHESIDYYHWWFLCIDIVFSGISISQNSELG

SEQ ID NO: 2346253 - protein, 24 aa, Cryptosporidium parvum
SHFGKVYNGLYPVGPRLPSFSSSN

SEQ ID NO: 2346254 - protein, 17 aa, Cryptosporidium parvum
SICQMILKSKSIVAQNP

SEQ ID NO: 2346255 - protein, 23 aa, Cryptosporidium parvum
SIGILKLNNIILTADLRIPECKK

SEQ ID NO: 2346256 - protein, 24 aa, Cryptosporidium parvum
SIGQFIYSLIFLSSTLFACFKTFG

SEQ ID NO: 2346257 - protein, 23 aa, Cryptosporidium parvum
SIIEMHLGLLPKTDYIRSNSLIK

SEQ ID NO: 2346258 - protein, 18 aa, Cryptosporidium parvum
SIIGLVERLFFNLNNLKE

SEQ ID NO: 2346259 - protein, 17 aa, Cryptosporidium parvum
SIKTFFNFLTSYLEKHS

SEQ ID NO: 2346260 - protein, 21 aa, Cryptosporidium parvum
SILFTDMFQHKYLRDLVLNFN

SEQ ID NO: 2346261 - protein, 24 aa, Cryptosporidium parvum
SILKQLISDIKLFSKPRIKIYYNS

SEQ ID NO: 2346262 - protein, 21 aa, Cryptosporidium parvum
SILPEQSLWEYVWGDVPVSHE

SEQ ID NO: 2346263 - protein, 23 aa, Cryptosporidium parvum
SINTLIFFCIGKIMLVAIYNKKN

SEQ ID NO: 2346264 - protein, 28 aa, Cryptosporidium parvum
SISISLWKTIFPWIWNNLEHQQRNELTL

SEQ ID NO: 2346265 - protein, 28 aa, Cryptosporidium parvum
SITSDTYLISWLTSLFSTCIPIQVIPKN

SEQ ID NO: 2346266 - protein, 19 aa, Cryptosporidium parvum
SITTFPLILEPKEIYKILE

SEQ ID NO: 2346267 - protein, 19 aa, Cryptosporidium parvum
SIVLFQIQPSLRPLVPLAL

SEQ ID NO: 2346268 - protein, 21 aa, Cryptosporidium parvum
SKFLPYYIEIINKSDFQNFEK

SEQ ID NO: 2346269 - protein, 21 aa, Cryptosporidium parvum
SKIELEMFSFLPKILEFQVKD

SEQ ID NO: 2346270 - protein, 22 aa, Cryptosporidium parvum
SKLLLFILHTLRQLGIQYTLPV

SEQ ID NO: 2346271 - protein, 24 aa, Cryptosporidium parvum
SKLVLGVVFLSFIASVLLFSSIEL

SEQ ID NO: 2346272 - protein, 31 aa, Cryptosporidium parvum; identical to SEQ ID NO: 2133492

SEQ ID NO: 2346273 - protein, 19 aa, Cryptosporidium parvum
SLDRTWPISASPMGGDPKL

SEQ ID NO: 2346274 - protein, 30 aa, Cryptosporidium parvum
SLDSTFPSLLIWVRFFHQTILKNQETKEAK

SEQ ID NO: 2346275 - protein, 19 aa, Cryptosporidium parvum
SLFFLLPSNTISKRSIFNF

SEQ ID NO: 2346276 - protein, 19 aa, Cryptosporidium parvum
SLIFAILYKNLFGLTKKFK

SEQ ID NO: 2346277 - protein, 25 aa, Cryptosporidium parvum
SLILQNFIILLNKLLNKFSENFKFV

SEQ ID NO: 2346278 - protein, 22 aa, Cryptosporidium parvum
SLIREILLNRSNKHWDILRKIL

SEQ ID NO: 2346279 - protein, 22 aa, Cryptosporidium parvum
SLISILFGPKWVRPENIQLFSA

SEQ ID NO: 2346280 - protein, 18 aa, Cryptosporidium parvum
SLREPLNYFEKTGIHIVT

SEQ ID NO: 2346281 - protein, 26 aa, Cryptosporidium parvum
SLVIFSSYSLGFWYGGVLVADSMDSG

SEQ ID NO: 2346282 - protein, 27 aa, Cryptosporidium parvum
SLVLHKYEVPLMFACETKKLICHNTST

SEQ ID NO: 2346283 - protein, 26 aa, Cryptosporidium parvum
SMILTTFFMYYFVGGIFDWTCSLLIS

SEQ ID NO: 2346284 - protein, 24 aa, Cryptosporidium parvum
SMVLLMMSIFLSSWLYNAAGKGFY

SEQ ID NO: 2346285 - protein, 19 aa, Cryptosporidium parvum
SNFIEDCLKLNFKGSLIFQ

SEQ ID NO: 2346286 - protein, 40 aa, Cryptosporidium parvum; identical to SEQ ID NO: 2133562

SEQ ID NO: 2346287 - protein, 17 aa, Cryptosporidium parvum
SNLPLVALLLLNGANID

SEQ ID NO: 2346288 - protein, 33 aa, Cryptosporidium parvum
SNNGIGLSIIYRRLFSYFIQSIIRYHFENIINK

SEQ ID NO: 2346289 - protein, 30 aa, Cryptosporidium parvum; identical to SEQ ID NO: 2247773

SEQ ID NO: 2346290 - protein, 23 aa, Cryptosporidium parvum
SNPAKLFDLHYLNAYFKQSDIIK

SEQ ID NO: 2346291 - protein, 24 aa, Cryptosporidium parvum
SNSYKWNWSSIPNNFVNFNRILKS

SEQ ID NO: 2346292 - protein, 42 aa, Cryptosporidium parvum; identical to SEQ ID NO: 2133581

SEQ ID NO: 2346293 - protein, 26 aa, Cryptosporidium parvum
SNVFRQHIIVLLRDFGLITFQGGIVH

SEQ ID NO: 2346294 - protein, 27 aa, Cryptosporidium parvum
SPKCRPWSIWGTLPYRNASALAQYKPC

SEQ ID NO: 2346295 - protein, 21 aa, Cryptosporidium parvum
SPLYPSGIIYPQSPITLPGMG

SEQ ID NO: 2346296 - protein, 27 aa, Cryptosporidium parvum
SPQIGYCRGFYYRLLVHPRGGSCNDSE

SEQ ID NO: 2346297 - protein, 22 aa, Cryptosporidium parvum
SPQISLIFHYWGVQQHTAKVFY

SEQ ID NO: 2346298 - protein, 21 aa, Cryptosporidium parvum
SPQLVLIYPVYTIQLKSMCLP

SEQ ID NO: 2346299 - protein, 28 aa, Cryptosporidium parvum
SQDNYYLLHQLFSQFFWALHDDPELEHL

SEQ ID NO: 2346300 - protein, 25 aa, Cryptosporidium parvum
SQEGEGFAFWFVSEAYGSIYPKSNE

SEQ ID NO: 2346301 - protein, 29 aa, Cryptosporidium parvum
SQELPVFSLILIDTGMLLLYSGSELIINV

SEQ ID NO: 2346302 - protein, 43 aa, Cryptosporidium parvum; identical to SEQ ID NO: 2247825

SEQ ID NO: 2346303 - protein, 23 aa, Cryptosporidium parvum
SQNSIDLPLLCKIIINYSNSEKV

SEQ ID NO: 2346304 - protein, 29 aa, Cryptosporidium parvum
SQNTTLLRLYLMHIPSILPSIYTKSLQIS

SEQ ID NO: 2346305 - protein, 22 aa, Cryptosporidium parvum
SQYIFDLHITAIFFPLGIFVCA

SEQ ID NO: 2346306 - protein, 26 aa, Cryptosporidium parvum
SRFINEALLTMLPPKFSRNSWINHLP

SEQ ID NO: 2346307 - protein, 25 aa, Cryptosporidium parvum
SRHLVCDYIYIHEKFPEAALGRRGQ

SEQ ID NO: 2346308 - protein, 20 aa, Cryptosporidium parvum
SRIYYFYILLSMLHKVMAQS

SEQ ID NO: 2346309 - protein, 19 aa, Cryptosporidium parvum
SRNYFLEVVKLLIQFLGIS

SEQ ID NO: 2346310 - protein, 19 aa, Cryptosporidium parvum
SRSILECLRFSLFGEISIP

SEQ ID NO: 2346311 - protein, 24 aa, Cryptosporidium parvum
SSDEVELQLLLKSSTYNLPTVDSA

SEQ ID NO: 2346312 - protein, 31 aa, Cryptosporidium parvum
SSHTIIAWISSDSKFFCWKKVRSKSSHLLNP

SEQ ID NO: 2346313 - protein, 24 aa, Cryptosporidium parvum
SSILKLILRLYDPDKGKILLDGLN

SEQ ID NO: 2346314 - protein, 33 aa, Cryptosporidium parvum
SSIYSILFYALISFIILILLLIKLVLCKRSSKR

SEQ ID NO: 2346315 - protein, 27 aa, Cryptosporidium parvum
SSKRRARKIMTKKGLSLLIKEFNTSKT

SEQ ID NO: 2346316 - protein, 21 aa, Cryptosporidium parvum
SSLILPISRYYLIGMLVLSSE

SEQ ID NO: 2346317 - protein, 23 aa, Cryptosporidium parvum
SSNIPEKPLLGREWIQREKSKKQ

SEQ ID NO: 2346318 - protein, 24 aa, Cryptosporidium parvum
SSPCPVDCVLSFWSPWTGCSKFLC

SEQ ID NO: 2346319 - protein, 23 aa, Cryptosporidium parvum
SSQAAFKIIFGEITALKSMTNIQ

SEQ ID NO: 2346320 - protein, 26 aa, Cryptosporidium parvum
SSYSHYIWTFIRLAIGGPAVGVVFGF

SEQ ID NO: 2346321 - protein, 21 aa, Cryptosporidium parvum
STFYNLFSQLLKHGRLAIGIY

SEQ ID NO: 2346322 - protein, 23 aa, Cryptosporidium parvum
STHIKNLLLLYLSIFWTDIGTTE

SEQ ID NO: 2346323 - protein, 28 aa, Cryptosporidium parvum
STNTVFQIFPLFSLVFALLAGYFVTFDQ

SEQ ID NO: 2346324 - protein, 25 aa, Cryptosporidium parvum
STPLSIMDRLLWSSSNLFVPTLRSQ

SEQ ID NO: 2346325 - protein, 23 aa, Cryptosporidium parvum
STRPWLLIITLSHQLWKFIIDSS

SEQ ID NO: 2346326 - protein, 21 aa, Cryptosporidium parvum
SVAFCPLSYSHSKLWGSHRGG

SEQ ID NO: 2346327 - protein, 20 aa, Cryptosporidium parvum
SVALPNFQSGALGCPVSASI

SEQ ID NO: 2346328 - protein, 27 aa, Cryptosporidium parvum
SVDQVYRVYLYYNSIYKFFSSDVFIDS

SEQ ID NO: 2346329 - protein, 22 aa, Cryptosporidium parvum
SVDYIVFFVTNYQIVCNFKFYT

SEQ ID NO: 2346330 - protein, 32 aa, Cryptosporidium parvum; identical to SEQ ID NO: 2247998

SEQ ID NO: 2346331 - protein, 17 aa, Cryptosporidium parvum
SVLCYIHPQSFGDIIQA

SEQ ID NO: 2346332 - protein, 23 aa, Cryptosporidium parvum
SVMIRISIIFPYSTLNDDFHFFS

SEQ ID NO: 2346333 - protein, 27 aa, Cryptosporidium parvum
SVSIIDLVITIWFRLALLASSSDHKIV

SEQ ID NO: 2346334 - protein, 21 aa, Cryptosporidium parvum
SVVIFFMLNLILIHFIFEIPN

SEQ ID NO: 2346335 - protein, 28 aa, Cryptosporidium parvum
SVVSNYFWYIFLLIPIYIIYKIGKLIIN

SEQ ID NO: 2346336 - protein, 34 aa, Cryptosporidium parvum; identical to SEQ ID NO: 2133725

SEQ ID NO: 2346337 - protein, 22 aa, Cryptosporidium parvum
SYGYINFLAFSASGASLLLHAT

SEQ ID NO: 2346338 - protein, 19 aa, Cryptosporidium parvum
SYIKNLLMKIVPVRNLDLK

SEQ ID NO: 2346339 - protein, 27 aa, Cryptosporidium parvum
SYLIRDSTLYFLYNKSPITVYIIECIF

SEQ ID NO: 2346340 - protein, 21 aa, Cryptosporidium parvum
SYLQDMPWTMIKFASIARKSH

SEQ ID NO: 2346341 - protein, 53 aa, Cryptosporidium parvum; identical to SEQ ID NO: 2248048

SEQ ID NO: 2346342 - protein, 20 aa, Cryptosporidium parvum
SYRILVIIALLPMLTVFYGI

SEQ ID NO: 2346343 - protein, 23 aa, Cryptosporidium parvum
SYSSLFREFGITNFNFIQGYEIV

SEQ ID NO: 2346344 - protein, 28 aa, Cryptosporidium parvum
SYYIPEHLLLNYKFQAYYRIKSHIITFS

SEQ ID NO: 2346345 - protein, 26 aa, Cryptosporidium parvum
SYYLSIESLIICYLILSGNTDEIDTF

SEQ ID NO: 2346346 - protein, 25 aa, Cryptosporidium parvum
TASDWNVFFSDKNTLIIKKLHKETL

SEQ ID NO: 2346347 - protein, 30 aa, Cryptosporidium parvum; identical to SEQ ID NO: 2133759

SEQ ID NO: 2346348 - protein, 23 aa, Cryptosporidium parvum
TEKKNCSFYSIWQEFTDQVNNMC

SEQ ID NO: 2346349 - protein, 33 aa, Cryptosporidium parvum
TETGKYSLYFLFLAILIFLTTFAQNSFLQISGE

SEQ ID NO: 2346350 - protein, 26 aa, Cryptosporidium parvum
TEYLELLGIQFQLLYGLPVCPLPSMP

SEQ ID NO: 2346351 - protein, 20 aa, Cryptosporidium parvum
TFILLFNLLNLHSKHCIFSL

SEQ ID NO: 2346352 - protein, 25 aa, Cryptosporidium parvum
TFSLKYDYNHSWMFEKGPRPYCEYK

SEQ ID NO: 2346353 - protein, 20 aa, Cryptosporidium parvum
TGPCCWLDDKFKHLPSLIIS

SEQ ID NO: 2346354 - protein, 32 aa, Cryptosporidium parvum; identical to SEQ ID NO: 2248153

SEQ ID NO: 2346355 - protein, 33 aa, Cryptosporidium parvum
THTLRLILANKIIQSNPILYPFEIEYKNISSCQ

SEQ ID NO: 2346356 - protein, 23 aa, Cryptosporidium parvum
TIGLINYLFPIYSISRTNTVDKI

SEQ ID NO: 2346357 - protein, 21 aa, Cryptosporidium parvum
TIGMYIFTLMPWWNPDPTYLV

SEQ ID NO: 2346358 - protein, 19 aa, Cryptosporidium parvum
TIHFLIQPYSGLQQKVEER

SEQ ID NO: 2346359 - protein, 25 aa, Cryptosporidium parvum
TILKDEFLPLFIKKNIFTESLEISA

SEQ ID NO: 2346360 - protein, 20 aa, Cryptosporidium parvum
TINRWEWCYWATEGDYLKGS

SEQ ID NO: 2346361 - protein, 21 aa, Cryptosporidium parvum
TISFLSFILGFSFKFFSRIPR

SEQ ID NO: 2346362 - protein, 22 aa, Cryptosporidium parvum
TISISFYSLFLFAFGSPFSETE

SEQ ID NO: 2346363 - protein, 38 aa, Cryptosporidium parvum; identical to SEQ ID NO: 2248205

SEQ ID NO: 2346364 - protein, 21 aa, Cryptosporidium parvum
TKILVECFILYRPDIGYVEGM

SEQ ID NO: 2346365 - protein, 18 aa, Cryptosporidium parvum
TKIQPIVFCLFSDLKNQI

SEQ ID NO: 2346366 - protein, 26 aa, Cryptosporidium parvum
TKLHAIAVLLLFIRLLEISLFSSNTS

SEQ ID NO: 2346367 - protein, 18 aa, Cryptosporidium parvum
TKNMLGIYTLSWPTYNGI

SEQ ID NO: 2346368 - protein, 31 aa, Cryptosporidium parvum; identical to SEQ ID NO: 2248212

SEQ ID NO: 2346369 - protein, 20 aa, Cryptosporidium parvum
TKVLLLTITIKYGLFSNLSV

SEQ ID NO: 2346370 - protein, 19 aa, Cryptosporidium parvum
TLAIYYLLKDDLRLSPPEV

SEQ ID NO: 2346371 - protein, 23 aa, Cryptosporidium parvum
TLCFLASLRPSPIGIPSTIIRRF

SEQ ID NO: 2346372 - protein, 18 aa, Cryptosporidium parvum
TLELSLTKLPEKLSSSLD

SEQ ID NO: 2346373 - protein, 32 aa, Cryptosporidium parvum
TLKTKIIIGIILHIVLFIIALVFTRNRKYHKM

SEQ ID NO: 2346374 - protein, 22 aa, Cryptosporidium parvum
TLNFMQQYRFPFLNAPSRMEFI

SEQ ID NO: 2346375 - protein, 18 aa, Cryptosporidium parvum
TLRCYLFVSPKITNEYIL

SEQ ID NO: 2346376 - protein, 18 aa, Cryptosporidium parvum
TNCYRRWKWKKRVKRRKM

SEQ ID NO: 2346377 - protein, 24 aa, Cryptosporidium parvum
TNFQDFLINIFPIKLEFSTMNTLS

SEQ ID NO: 2346378 - protein, 20 aa, Cryptosporidium parvum
TNKEYWLVRNSWGEAWGEKG

SEQ ID NO: 2346379 - protein, 26 aa, Cryptosporidium parvum
TNLLLYYQKFLLLNKKVMNFWGLETN

SEQ ID NO: 2346380 - protein, 30 aa, Cryptosporidium parvum
TNTIQLLIREKYPFFPNYIKTGNKGDLKNY

SEQ ID NO: 2346381 - protein, 22 aa, Cryptosporidium parvum
TPCIKYLMQFLHDFVAHWSIEK

SEQ ID NO: 2346382 - protein, 23 aa, Cryptosporidium parvum
TPDCRYYSYGAFLKGPGSIIGTC

SEQ ID NO: 2346383 - protein, 32 aa, Cryptosporidium parvum
TPFREILLWTTLFSIPIYILPLALVTGLNLNM

SEQ ID NO: 2346384 - protein, 17 aa, Cryptosporidium parvum
TPFYFLLKDGMSTNTEE

SEQ ID NO: 2346385 - protein, 24 aa, Cryptosporidium parvum
TPGIIFQPLRYLFISAMNYGRRVV

SEQ ID NO: 2346386 - protein, 32 aa, Cryptosporidium parvum; identical to SEQ ID NO: 2248307

SEQ ID NO: 2346387 - protein, 30 aa, Cryptosporidium parvum; identical to SEQ ID NO: 2248314

SEQ ID NO: 2346388 - protein, 23 aa, Cryptosporidium parvum
TREYFESIIYLFKCSNYKDYFQN

SEQ ID NO: 2346389 - protein, 19 aa, Cryptosporidium parvum
TRILLERLIVHRPHPWGLL

SEQ ID NO: 2346390 - protein, 21 aa, Cryptosporidium parvum
TSFEAFHIFKLFVANPNKSPG

SEQ ID NO: 2346391 - protein, 28 aa, Cryptosporidium parvum
TSFISSICIPYFQALLKFDPEIVQECIQ

SEQ ID NO: 2346392 - protein, 19 aa, Cryptosporidium parvum
TSKARNIILPLKFDTKTIE

SEQ ID NO: 2346393 - protein, 25 aa, Cryptosporidium parvum
TSSFDQLAILYSAPKKLPSRNFLEQ

SEQ ID NO: 2346394 - protein, 22 aa, Cryptosporidium parvum
TSSKFLVYFPSILIESLRSKEF

SEQ ID NO: 2346395 - protein, 20 aa, Cryptosporidium parvum
TSSSWYLARLARESFMNMNL

SEQ ID NO: 2346396 - protein, 19 aa, Cryptosporidium parvum
TTEDNLYPDFDYFNTSNFK

SEQ ID NO: 2346397 - protein, 22 aa, Cryptosporidium parvum
TTLCIVSWMPLMLENCSPALSD

SEQ ID NO: 2346398 - protein, 20 aa, Cryptosporidium parvum
TTLHFPLFMAAITFIWAVSD

SEQ ID NO: 2346399 - protein, 24 aa, Cryptosporidium parvum
TTMQDIYPIAFRNSLDSYILYSKL

SEQ ID NO: 2346400 - protein, 23 aa, Cryptosporidium parvum
TTSFGFLCIFSLIQFTQDLFQEK

SEQ ID NO: 2346401 - protein, 28 aa, Cryptosporidium parvum
TTSMTISSPFRLPLALFATHSPHNVVLF

SEQ ID NO: 2346402 - protein, 17 aa, Cryptosporidium parvum
TTYRWRYPLNEVMAGGL

SEQ ID NO: 2346403 - protein, 20 aa, Cryptosporidium parvum
TVFKGEFPVGGPFSSPSDSS

SEQ ID NO: 2346404 - protein, 17 aa, Cryptosporidium parvum
TWHRLTGSHYWEIKIKD

SEQ ID NO: 2346405 - protein, 19 aa, Cryptosporidium parvum
TWRFSFITILIHQIIWHFT

SEQ ID NO: 2346406 - protein, 23 aa, Cryptosporidium parvum
TYFSVLWMMMFLDCGPNYFSFFY

SEQ ID NO: 2346407 - protein, 20 aa, Cryptosporidium parvum
TYTGMILSVFIPGERFSKVT

SEQ ID NO: 2346408 - protein, 26 aa, Cryptosporidium parvum
VADQSNISVLYRQITNRQQYIRKRQR

SEQ ID NO: 2346409 - protein, 28 aa, Cryptosporidium parvum
VAISLLIFIVLIIVEFLVSFNLGLKIVL

SEQ ID NO: 2346410 - protein, 35 aa, Cryptosporidium parvum
VAKVRDNLILLPRVIFIFVIQCLSLIIVANSLPWI

SEQ ID NO: 2346411 - protein, 23 aa, Cryptosporidium parvum
VAMAFNRYLRFLESIISKIVCEK

SEQ ID NO: 2346412 - protein, 18 aa, Cryptosporidium parvum
VCTTIAIAIISEICMPYT

SEQ ID NO: 2346413 - protein, 27 aa, Cryptosporidium parvum
VDFVPAFVHLLYHIKEFRRAIFSWNPR

SEQ ID NO: 2346414 - protein, 38 aa, Cryptosporidium parvum
VDKFGIAMLRAFMNGLILVILILFVLNSINISQCNISS

SEQ ID NO: 2346415 - protein, 23 aa, Cryptosporidium parvum
VDSLLSYAFVMVYSFYIYYDTQK

SEQ ID NO: 2346416 - protein, 23 aa, Cryptosporidium parvum
VDYLLDKPGYWFIDTSIIHLISS

SEQ ID NO: 2346417 - protein, 20 aa, Cryptosporidium parvum
VEAETIKKLGFVGGKIKMIS

SEQ ID NO: 2346418 - protein, 28 aa, Cryptosporidium parvum
VEGMSHIAMILLLFNINLMEAFKTFTNL

SEQ ID NO: 2346419 - protein, 25 aa, Cryptosporidium parvum
VEKFHNFYVILPKKIAEMIFEFHYL

SEQ ID NO: 2346420 - protein, 24 aa, Cryptosporidium parvum
VESPSKFLWPPNETSKRSEEYTLD

SEQ ID NO: 2346421 - protein, 20 aa, Cryptosporidium parvum
VFEEILLQNAKLRNIQILKG

SEQ ID NO: 2346422 - protein, 19 aa, Cryptosporidium parvum
VFELAYLPLMMRVDECLGQ

SEQ ID NO: 2346423 - protein, 21 aa, Cryptosporidium parvum
VFIILPPIFYISRVSFEMIMP

SEQ ID NO: 2346424 - protein, 24 aa, Cryptosporidium parvum
VFITYFLIIYTVSATELDSTENVV

SEQ ID NO: 2346425 - protein, 18 aa, Cryptosporidium parvum
VFTHYYCPPKFPENVFRP

SEQ ID NO: 2346426 - protein, 24 aa, Cryptosporidium parvum
VFVTPLLLALFPFSRLHIGFIVRN

SEQ ID NO: 2346427 - protein, 35 aa, Cryptosporidium parvum; identical to SEQ ID NO: 2134025

SEQ ID NO: 2346428 - protein, 45 aa, Cryptosporidium parvum
VGTLRAGFLLNYYPLINLWSGLNKFILILFYSYMQYKQIITKINL

SEQ ID NO: 2346429 - protein, 18 aa, Cryptosporidium parvum
VKLEKLRYDLIIEKEKIA

SEQ ID NO: 2346430 - protein, 24 aa, Cryptosporidium parvum
VLAERFYITQFLELLMPTMTFSEK

SEQ ID NO: 2346431 - protein, 40 aa, Cryptosporidium parvum; identical to SEQ ID NO: 2134070

SEQ ID NO: 2346432 - protein, 31 aa, Cryptosporidium parvum; identical to SEQ ID NO: 2134082

SEQ ID NO: 2346433 - protein, 30 aa, Cryptosporidium parvum
VLSVISSRLFSLWLFVQKRLTTIQIAIKVM

SEQ ID NO: 2346434 - protein, 31 aa, Cryptosporidium parvum
VLVLYLLEGFYIVSIIPFISLLVSMFYVISK

SEQ ID NO: 2346435 - protein, 24 aa, Cryptosporidium parvum
VMKVKVLLAKIVPLVSIGLLNIED

SEQ ID NO: 2346436 - protein, 25 aa, Cryptosporidium parvum
VPARLKSLLPYMGQLISPMLNALES

SEQ ID NO: 2346437 - protein, 24 aa, Cryptosporidium parvum
VPDCSWIMKALYMNDLQRIDVADP

SEQ ID NO: 2346438 - protein, 19 aa, Cryptosporidium parvum
VPGVLIYPQNFREPRVLEA

SEQ ID NO: 2346439 - protein, 20 aa, Cryptosporidium parvum
VPKELLIYDISAYPSKWVEK

SEQ ID NO: 2346440 - protein, 24 aa, Cryptosporidium parvum
VPYNKVKMILYPSIPSHPPSFQLN

SEQ ID NO: 2346441 - protein, 29 aa, Cryptosporidium parvum
VQDYMIACSKIILWFVHFFRGFNGDEHIS

SEQ ID NO: 2346442 - protein, 21 aa, Cryptosporidium parvum
VQYSYFIWKFAVKNRINFSLE

SEQ ID NO: 2346443 - protein, 24 aa, Cryptosporidium parvum
VSAIIAAFFKRFNKPRNQITIAID

SEQ ID NO: 2346444 - protein, 20 aa, Cryptosporidium parvum
VSEILYGNFISLSLSRINGA

SEQ ID NO: 2346445 - protein, 34 aa, Cryptosporidium parvum; identical to SEQ ID NO: 2248708

SEQ ID NO: 2346446 - protein, 29 aa, Cryptosporidium parvum
VSSTIIVYLIWGLFSFIFTVVISGSIEKY

SEQ ID NO: 2346447 - protein, 28 aa, Cryptosporidium parvum
VSVIPLFFEWCYILYRQKLNFSKNQIRE

SEQ ID NO: 2346448 - protein, 25 aa, Cryptosporidium parvum
VSVIYAIPAIPWFLKPLFGMRRKPY

SEQ ID NO: 2346449 - protein, 29 aa, Cryptosporidium parvum
VTVIAFLIVAGLTVFCCLIFFGDLADSYL

SEQ ID NO: 2346450 - protein, 26 aa, Cryptosporidium parvum
VTVNKLPLWVSWIKYISFQRYSYSAL

SEQ ID NO: 2346451 - protein, 29 aa, Cryptosporidium parvum
VVYCLYSLLGIAFILFKLGTMGLIPVNRG

SEQ ID NO: 2346452 - protein, 26 aa, Cryptosporidium parvum
VWVLIYFYIHYLLLNTIDCTFNFKDS

SEQ ID NO: 2346453 - protein, 17 aa, Cryptosporidium parvum
VYAPIKDQTDPAPRYIS

SEQ ID NO: 2346454 - protein, 17 aa, Cryptosporidium parvum
VYTLFPFLDSLECITNS

SEQ ID NO: 2346455 - protein, 35 aa, Cryptosporidium parvum
VYYSNFSIPDLPPNCDWSISTLKILDKLFGNETNT

SEQ ID NO: 2346456 - protein, 28 aa, Cryptosporidium parvum
WDSMILWNDLFVWRNFVFSIIMNLISRS

SEQ ID NO: 2346457 - protein, 25 aa, Cryptosporidium parvum
WHHLQSILYLIYGAGALVFVRLIAN

SEQ ID NO: 2346458 - protein, 23 aa, Cryptosporidium parvum
WIAKYLLSLSWLFLGIGRKLSKI

SEQ ID NO: 2346459 - protein, 25 aa, Cryptosporidium parvum
WIDNLHHDFLYPILTNSLHQPHRFQ

SEQ ID NO: 2346460 - protein, 30 aa, Cryptosporidium parvum; identical to SEQ ID NO: 2134218

SEQ ID NO: 2346461 - protein, 17 aa, Cryptosporidium parvum
WITGPCCWLDDKFKHLP

SEQ ID NO: 2346462 - protein, 24 aa, Cryptosporidium parvum
WTKMFCFGVFAMEMFIDRFISFPQ

SEQ ID NO: 2346463 - protein, 40 aa, Cryptosporidium parvum; identical to SEQ ID NO: 2134252

SEQ ID NO: 2346464 - protein, 18 aa, Cryptosporidium parvum
YALLFFSFSIISMSLLFY

SEQ ID NO: 2346465 - protein, 21 aa, Cryptosporidium parvum
YCFHFLIYEPGVIYMAMTDRS

SEQ ID NO: 2346466 - protein, 17 aa, Cryptosporidium parvum
YDIIKECELLIRATLQL

SEQ ID NO: 2346467 - protein, 27 aa, Cryptosporidium parvum
YDSNSQLFIQIWRNLRLLYIEDNIYQG

SEQ ID NO: 2346468 - protein, 23 aa, Cryptosporidium parvum
YENIKTRFNWDLSLFQTEFGYVK

SEQ ID NO: 2346469 - protein, 39 aa, Cryptosporidium parvum; identical to SEQ ID NO: 2248886

SEQ ID NO: 2346470 - protein, 30 aa, Cryptosporidium parvum; identical to SEQ ID NO: 2248888

SEQ ID NO: 2346471 - protein, 17 aa, Cryptosporidium parvum
YFQIFKNMLLFLSIQPI

SEQ ID NO: 2346472 - protein, 19 aa, Cryptosporidium parvum
YFSFFYYLTNWGCTSTLIF

SEQ ID NO: 2346473 - protein, 27 aa, Cryptosporidium parvum
YFVEKYPFPEKILFSMLVALTRLYGVS

SEQ ID NO: 2346474 - protein, 32 aa, Cryptosporidium parvum
YFVTFDQIPVWIRWLGWISTVRYTYTGMILSV

SEQ ID NO: 2346475 - protein, 19 aa, Cryptosporidium parvum
YGDFEVLRDLLIQSLRNSG

SEQ ID NO: 2346476 - protein, 26 aa, Cryptosporidium parvum
YGIAPLIIIFFVIVSGFYVTVNKLPL

SEQ ID NO: 2346477 - protein, 19 aa, Cryptosporidium parvum
YGNFISLSLSRINGAIIQI

SEQ ID NO: 2346478 - protein, 25 aa, Cryptosporidium parvum
YGSNLTLLYDYIYNLASRVIGSGQE

SEQ ID NO: 2346479 - protein, 20 aa, Cryptosporidium parvum
YIAHQLGLLVSILHICVFTG

SEQ ID NO: 2346480 - protein, 29 aa, Cryptosporidium parvum
YIEIPVKAYKYVFPRNINALKTALAKYGP

SEQ ID NO: 2346481 - protein, 35 aa, Cryptosporidium parvum; identical to SEQ ID NO: 2134330

SEQ ID NO: 2346482 - protein, 27 aa, Cryptosporidium parvum
YLGEISRLLIINFLKNKTPEIFFQKNS

SEQ ID NO: 2346483 - protein, 17 aa, Cryptosporidium parvum
YLLPYLTIKETMDIVAG

SEQ ID NO: 2346484 - protein, 22 aa, Cryptosporidium parvum
YLPMFFVVLFVVMPFSSYLMPD

SEQ ID NO: 2346485 - protein, 17 aa, Cryptosporidium parvum
YLSENLVFYIFKLVPLF

SEQ ID NO: 2346486 - protein, 19 aa, Cryptosporidium parvum
YLTILLSTFSTCISLYCKI

SEQ ID NO: 2346487 - protein, 24 aa, Cryptosporidium parvum
YMKLLEFFHLNPSLCKLFFEMKQY

SEQ ID NO: 2346488 - protein, 26 aa, Cryptosporidium parvum
YNDFMRYIYYLIGVTLNSFFSGWLSI

SEQ ID NO: 2346489 - protein, 18 aa, Cryptosporidium parvum
YNYGINLPSLRKPISLIS

SEQ ID NO: 2346490 - protein, 30 aa, Cryptosporidium parvum
YPDVKDLALFYYRLLQFDYKIARNIILNDS

SEQ ID NO: 2346491 - protein, 23 aa, Cryptosporidium parvum
YQREWILPLLNNLKNLEIIFFTP

SEQ ID NO: 2346492 - protein, 39 aa, Cryptosporidium parvum
YQRHYPISTLLPVVTLLLFSWLLFPGAISSVLMFPYNVY

SEQ ID NO: 2346493 - protein, 18 aa, Cryptosporidium parvum
YRENCILSIFGVINYVIS

SEQ ID NO: 2346494 - protein, 18 aa, Cryptosporidium parvum
YSAPKKLPSRNFLEQLFA

SEQ ID NO: 2346495 - protein, 28 aa, Cryptosporidium parvum
YSDHLPCAVWLPWIPQLIAGIDRIEGSA

SEQ ID NO: 2346496 - protein, 29 aa, Cryptosporidium parvum
YSKKITPYLILMIPIITSIGLIFLKSILD

SEQ ID NO: 2346497 - protein, 25 aa, Cryptosporidium parvum
YSLKPIHSFYFLRSYVRQYLEYIFK

SEQ ID NO: 2346498 - protein, 49 aa, Cryptosporidium parvum
YSQKMCHEVDLIKPLWTMPLKMISLRKINTIIMMAMLPLSCYAGDHHHH

SEQ ID NO: 2346499 - protein, 43 aa, Cryptosporidium parvum
YTHIYHSCFKLIPSFKLFLFIFFLFRFRKSIIKSLRDEVKTLE

SEQ ID NO: 2346500 - protein, 17 aa, Cryptosporidium parvum
YTLFFLSELIHSSGVLA

SEQ ID NO: 2346501 - protein, 22 aa, Cryptosporidium parvum
YVAKALTMGLYNKGLEVIVEPL

SEQ ID NO: 2346502 - protein, 24 aa, Cryptosporidium parvum
YYIGLFVFFIALFSELDAYSGSFT

SEQ ID NO: 2346503 - protein, 21 aa, Cryptosporidium parvum
YYKQILSEYKLDKSFLHIGSA

SEQ ID NO: 2346504 - protein, 17 aa, Cryptosporidium parvum
YYLLFQVNKQIQKEILL

SEQ ID NO: 2346505 - protein, 19 aa, Cryptosporidium parvum
YYYRFRRDRRFDESFPSFV

SEQ ID NO: 2346506 - protein, 25 aa, Cryptosporidium parvum
AFMNGLILVILILFVLNSINISQCN

SEQ ID NO: 2346507 - protein, 18 aa, Cryptosporidium parvum
ALIHLLNFLWPNVFENSP

SEQ ID NO: 2346508 - protein, 19 aa, Cryptosporidium parvum
CFFLIVCGWVINVFWPFVE

SEQ ID NO: 2346509 - protein, 24 aa, Cryptosporidium parvum
DDSVAPLLIFKWFDQTTLDITLLS

SEQ ID NO: 2346510 - protein, 22 aa, Cryptosporidium parvum
DEKPFFWCEYLRYLNLSRNKFE

SEQ ID NO: 2346511 - protein, 20 aa, Cryptosporidium parvum
DFIELVIFYFKKFNLKGVFV

SEQ ID NO: 2346512 - protein, 17 aa, Cryptosporidium parvum
DFPILLHRKLINISLRK

SEQ ID NO: 2346513 - protein, 22 aa, Cryptosporidium parvum
DLALFYYRLLQFDYKIARNIIL

SEQ ID NO: 2346514 - protein, 25 aa, Cryptosporidium parvum
DLIKPLWTMPLKMISLRKINTIIMM

SEQ ID NO: 2346515 - protein, 17 aa, Cryptosporidium parvum
DLYEEYFFLSNLKLLEL

SEQ ID NO: 2346516 - protein, 21 aa, Cryptosporidium parvum
DPLMRFHCFIFGAIYLESAHA

SEQ ID NO: 2346517 - protein, 23 aa, Cryptosporidium parvum
DYYHWWFLCIDIVFSGISISQNS

SEQ ID NO: 2346518 - protein, 17 aa, Cryptosporidium parvum
ENSFPWFIPVKTSVQFF

SEQ ID NO: 2346519 - protein, 28 aa, Cryptosporidium parvum
ETGKYSLYFLFLAILIFLTTFAQNSFLQ

SEQ ID NO: 2346520 - protein, 21 aa, Cryptosporidium parvum
FIFFNFLLYLASIGPQLFISF

SEQ ID NO: 2346521 - protein, 18 aa, Cryptosporidium parvum
FIQIWRNLRLLYIEDNIY

SEQ ID NO: 2346522 - protein, 32 aa, Cryptosporidium parvum; identical to SEQ ID NO: 2249318

SEQ ID NO: 2346523 - protein, 18 aa, Cryptosporidium parvum
FLCIVLLKLAQNGMLATD

SEQ ID NO: 2346524 - protein, 31 aa, Cryptosporidium parvum; identical to SEQ ID NO: 2249322

SEQ ID NO: 2346525 - protein, 29 aa, Cryptosporidium parvum
FLILKLGHLLLFLLILKLLVYIYTKWTKT

SEQ ID NO: 2346526 - protein, 24 aa, Cryptosporidium parvum
FLISFLVFIPFLIVILIKRLNNHS

SEQ ID NO: 2346527 - protein, 25 aa, Cryptosporidium parvum
FPVLYPILTFFIFSLTVFYLVETGP

SEQ ID NO: 2346528 - protein, 20 aa, Cryptosporidium parvum
FSLKHSFLWPHNNATLISAI

SEQ ID NO: 2346529 - protein, 36 aa, Cryptosporidium parvum; identical to SEQ ID NO: 2134564

SEQ ID NO: 2346530 - protein, 17 aa, Cryptosporidium parvum
FYAFPKLYQAFVLIDLY

SEQ ID NO: 2346531 - protein, 27 aa, Cryptosporidium parvum
FYGHLYFIFALLLIGVSFYFALDRLNK

SEQ ID NO: 2346532 - protein, 22 aa, Cryptosporidium parvum
GGYYYYYNFYPPPPPMQPEPFP

SEQ ID NO: 2346533 - protein, 22 aa, Cryptosporidium parvum
GIKSFYIGSFLRALWLTIGGII

SEQ ID NO: 2346534 - protein, 24 aa, Cryptosporidium parvum
GISIPLFLLYFGLALQKIPLTPNY

SEQ ID NO: 2346535 - protein, 24 aa, Cryptosporidium parvum
GIYKEFLVILPWFLDTTIKMQKET

SEQ ID NO: 2346536 - protein, 22 aa, Cryptosporidium parvum
GMSHIAMILLLFNINLMEAFKT

SEQ ID NO: 2346537 - protein, 23 aa, Cryptosporidium parvum
HIPNNWMTYFAKLSLRWNNFGND

SEQ ID NO: 2346538 - protein, 20 aa, Cryptosporidium parvum
HLFKIPMNYLPYIPKDTGES

SEQ ID NO: 2346539 - protein, 28 aa, Cryptosporidium parvum
HSCLIFGLVRLLWNIVFILYGATSLVNI

SEQ ID NO: 2346540 - protein, 17 aa, Cryptosporidium parvum
HTLPLIDELIRKGLPPK

SEQ ID NO: 2346541 - protein, 24 aa, Cryptosporidium parvum
HYKYYLFCLILFNTLFLGLIQSFP

SEQ ID NO: 2346542 - protein, 24 aa, Cryptosporidium parvum
ICSQIPSYLWYLPSDKIFPFPITS

SEQ ID NO: 2346543 - protein, 23 aa, Cryptosporidium parvum
IDPYSLWMLVDYRWGWPLVNSYF

SEQ ID NO: 2346544 - protein, 17 aa, Cryptosporidium parvum
IESLIICYLILSGNTDE

SEQ ID NO: 2346545 - protein, 20 aa, Cryptosporidium parvum
IFSWWYRFILSTPSRVFNTG

SEQ ID NO: 2346546 - protein, 29 aa, Cryptosporidium parvum
IHLKREWHRLWLVRSFLAFAWESYLEDLM

SEQ ID NO: 2346547 - protein, 18 aa, Cryptosporidium parvum
IIFIITPLHLLINYFKNI

SEQ ID NO: 2346548 - protein, 17 aa, Cryptosporidium parvum
IILLDYLVTWILINVSV

SEQ ID NO: 2346549 - protein, 17 aa, Cryptosporidium parvum
IIMLFLAGTFILSIYII

SEQ ID NO: 2346550 - protein, 19 aa, Cryptosporidium parvum
IIYFISSLIFIYYGIDFEL

SEQ ID NO: 2346551 - protein, 19 aa, Cryptosporidium parvum
IIYQLPLALIFYSFAIYLL

SEQ ID NO: 2346552 - protein, 18 aa, Cryptosporidium parvum
IIYRRLFSYFIQSIIRYH

SEQ ID NO: 2346553 - protein, 20 aa, Cryptosporidium parvum
ILLMILITKFLKKILVGTLR

SEQ ID NO: 2346554 - protein, 26 aa, Cryptosporidium parvum
ILLTSIIYILLWAIISYLKVFYIKNM

SEQ ID NO: 2346555 - protein, 25 aa, Cryptosporidium parvum
IRILNLFFILLLVIPFIYITTSGAC

SEQ ID NO: 2346556 - protein, 20 aa, Cryptosporidium parvum
ISLWKTIFPWIWNNLEHQQR

SEQ ID NO: 2346557 - protein, 18 aa, Cryptosporidium parvum
IVLPILMAFLIIVGYRIT

SEQ ID NO: 2346558 - protein, 22 aa, Cryptosporidium parvum
IWRNIFGLIWVIFYTKPFKPKD

SEQ ID NO: 2346559 - protein, 17 aa, Cryptosporidium parvum
KFWLKLRKEAIGWFIYT

SEQ ID NO: 2346560 - protein, 24 aa, Cryptosporidium parvum
KHEKMLFLMVLWIKHYLSNKVENK

SEQ ID NO: 2346561 - protein, 18 aa, Cryptosporidium parvum
KIGQFFYGKRLYSLLSGN

SEQ ID NO: 2346562 - protein, 29 aa, Cryptosporidium parvum
KINTIWAIFRVQFLVLLLFLNNLACENEI

SEQ ID NO: 2346563 - protein, 17 aa, Cryptosporidium parvum
KITFLKKLFSRISNDDV

SEQ ID NO: 2346564 - protein, 25 aa, Cryptosporidium parvum
KKILKFNIYIYRIYTDKYKRKIIKR

SEQ ID NO: 2346565 - protein, 27 aa, Cryptosporidium parvum
KKLTILIHLFIIYFLVIYNNEWNSLDS

SEQ ID NO: 2346566 - protein, 21 aa, Cryptosporidium parvum
KMRLDFFDMLFKELMPSLAYH

SEQ ID NO: 2346567 - protein, 33 aa, Cryptosporidium parvum; identical to SEQ ID NO: 2249564

SEQ ID NO: 2346568 - protein, 19 aa, Cryptosporidium parvum
KRFPETLFIYFTPPKNAKK

SEQ ID NO: 2346569 - protein, 17 aa, Cryptosporidium parvum
KRRLVIDLLLIVELILI

SEQ ID NO: 2346570 - protein, 20 aa, Cryptosporidium parvum
KSFVLLAYFLNVFGVKDAMD

SEQ ID NO: 2346571 - protein, 17 aa, Cryptosporidium parvum
KTKKKITFLKKLFSRIS

SEQ ID NO: 2346572 - protein, 17 aa, Cryptosporidium parvum
KYSILLSRVLWLLPHDS

SEQ ID NO: 2346573 - protein, 25 aa, Cryptosporidium parvum
LDILSYFFLFWFTGFHPIFIFINAI

SEQ ID NO: 2346574 - protein, 17 aa, Cryptosporidium parvum
LGFLFGWGVHLFLKVAQ

SEQ ID NO: 2346575 - protein, 17 aa, Cryptosporidium parvum
LGIFLLNILVLFSGLFR

SEQ ID NO: 2346576 - protein, 17 aa, Cryptosporidium parvum
LHKQFVIFLNKIDPKKN

SEQ ID NO: 2346577 - protein, 19 aa, Cryptosporidium parvum
LIIIMIFFFCRFYDNYKSY

SEQ ID NO: 2346578 - protein, 19 aa, Cryptosporidium parvum
LIIKNIIFFIYWKIIKQIS

SEQ ID NO: 2346579 - protein, 30 aa, Cryptosporidium parvum; identical to SEQ ID NO: 2249635

SEQ ID NO: 2346580 - protein, 17 aa, Cryptosporidium parvum
LIWVIFYTKPFKPKDFV

SEQ ID NO: 2346581 - protein, 18 aa, Cryptosporidium parvum
LLHQLFSQFFWALHDDPE

SEQ ID NO: 2346582 - protein, 19 aa, Cryptosporidium parvum
LLIVELILIDILFSKFLKK

SEQ ID NO: 2346583 - protein, 17 aa, Cryptosporidium parvum
LLLLKKDIHFLILGIIS

SEQ ID NO: 2346584 - protein, 19 aa, Cryptosporidium parvum
LLRLYLMHIPSILPSIYTK

SEQ ID NO: 2346585 - protein, 32 aa, Cryptosporidium parvum
LNFINRLHILLWPHLIHFIYELLPVAITIRLK

SEQ ID NO: 2346586 - protein, 17 aa, Cryptosporidium parvum
LQHLIFYEIPRYSPIGL

SEQ ID NO: 2346587 - protein, 24 aa, Cryptosporidium parvum
LRVIPILMIFLIYYRKVRVRRQSI

SEQ ID NO: 2346588 - protein, 20 aa, Cryptosporidium parvum
LVIDLLLIVELILIDILFSK

SEQ ID NO: 2346589 - protein, 19 aa, Cryptosporidium parvum
LYEAEGLVFWLFRVHNLVT

SEQ ID NO: 2346590 - protein, 19 aa, Cryptosporidium parvum
LYRCYMKFFRGILRYFLIY

SEQ ID NO: 2346591 - protein, 20 aa, Cryptosporidium parvum
MCHEVDLIKPLWTMPLKMIS

SEQ ID NO: 2346592 - protein, 20 aa, Cryptosporidium parvum
MIVRYLLYSLIFTIITFITL

SEQ ID NO: 2346593 - protein, 23 aa, Cryptosporidium parvum
MSNFDYLKIFKIPLILFILSFIS

SEQ ID NO: 2346594 - protein, 21 aa, Cryptosporidium parvum
NFYLVLLYFHFVLESKFSLLP

SEQ ID NO: 2346595 - protein, 26 aa, Cryptosporidium parvum
NIMTIFWLLLVFFIISILIFCINIIA

SEQ ID NO: 2346596 - protein, 22 aa, Cryptosporidium parvum
NIQELFLFLSLFYHNYQREWIL

SEQ ID NO: 2346597 - protein, 29 aa, Cryptosporidium parvum
NLKEWFIYLFNALYDFIIYQLPLALIFYS

SEQ ID NO: 2346598 - protein, 38 aa, Cryptosporidium parvum
NLQSIIKYLFFFIQIISLIYLFTILFLISEYDYIWFLI

SEQ ID NO: 2346599 - protein, 28 aa, Cryptosporidium parvum
NLVLKTLLLLLLEYLIINFPGVSSIDEK

SEQ ID NO: 2346600 - protein, 25 aa, Cryptosporidium parvum
NNDDLCIILKPPFWYCPIEGTGMDE

SEQ ID NO: 2346601 - protein, 25 aa, Cryptosporidium parvum
NNSIFMWVILGFIVLLLTLICICGM

SEQ ID NO: 2346602 - protein, 17 aa, Cryptosporidium parvum
NVFRPFEYNITKLYSLI

SEQ ID NO: 2346603 - protein, 25 aa, Cryptosporidium parvum
NYNYNIFFYISYMNWIPKIFINSND

SEQ ID NO: 2346604 - protein, 20 aa, Cryptosporidium parvum
PCAVWLPWIPQLIAGIDRIE

SEQ ID NO: 2346605 - protein, 19 aa, Cryptosporidium parvum
PFIFLGLFQSIFLFCSGEE

SEQ ID NO: 2346606 - protein, 22 aa, Cryptosporidium parvum
PFTYPFFILLLDVFTYIIIMCL

SEQ ID NO: 2346607 - protein, 24 aa, Cryptosporidium parvum
PHGIPYWLVPVFEFLKLPASSTLS

SEQ ID NO: 2346608 - protein, 19 aa, Cryptosporidium parvum
PKFWSLLFDIMLGPDLDSK

SEQ ID NO: 2346609 - protein, 18 aa, Cryptosporidium parvum
PNIFAFEYIYLLSPVLST

SEQ ID NO: 2346610 - protein, 20 aa, Cryptosporidium parvum
PSIEYISYLKWYFVGINKLL

SEQ ID NO: 2346611 - protein, 17 aa, Cryptosporidium parvum
PWFIPVKTSVQFFDLNS

SEQ ID NO: 2346612 - protein, 26 aa, Cryptosporidium parvum
PYQALLLQIFIFISPFLRSVQLSSNI

SEQ ID NO: 2346613 - protein, 20 aa, Cryptosporidium parvum
QAMFFLNIIKIIFIIHFFTL

SEQ ID NO: 2346614 - protein, 17 aa, Cryptosporidium parvum
QIPVWIRWLGWISTVRY

SEQ ID NO: 2346615 - protein, 24 aa, Cryptosporidium parvum
QWFALEWFLCFFVTSLPLKSIMEI

SEQ ID NO: 2346616 - protein, 19 aa, Cryptosporidium parvum
RIILFIYISFLSMLHDITG

SEQ ID NO: 2346617 - protein, 17 aa, Cryptosporidium parvum
RILFCRYVLPYILYIQH

SEQ ID NO: 2346618 - protein, 31 aa, Cryptosporidium parvum
RILITILGVFFMLLALFGVSFLLLLPKIAEI

SEQ ID NO: 2346619 - protein, 22 aa, Cryptosporidium parvum
RKFIMFFRKLLMVFRYLKNSNL

SEQ ID NO: 2346620 - protein, 18 aa, Cryptosporidium parvum
RLFDLYEEYFFLSNLKLL

SEQ ID NO: 2346621 - protein, 22 aa, Cryptosporidium parvum
RSAILFTILLIKSLTILSPSSI

SEQ ID NO: 2346622 - protein, 20 aa, Cryptosporidium parvum
RYFSPLIIYVLDKALAYYSS

SEQ ID NO: 2346623 - protein, 19 aa, Cryptosporidium parvum
SEILLFPSILILKLLSIQN

SEQ ID NO: 2346624 - protein, 17 aa, Cryptosporidium parvum
SFPWFIPVKTSVQFFDL

SEQ ID NO: 2346625 - protein, 23 aa, Cryptosporidium parvum
SFVLLFCLFFYQLDKLHAEVIYA

SEQ ID NO: 2346626 - protein, 25 aa, Cryptosporidium parvum
SFVYFLDLNYIWVLRLGFDPFRSKC

SEQ ID NO: 2346627 - protein, 24 aa, Cryptosporidium parvum
SGLNKFILILFYSYMQYKQIITKI

SEQ ID NO: 2346628 - protein, 23 aa, Cryptosporidium parvum
SIFVFMLISLIFWALTRFFSFAI

SEQ ID NO: 2346629 - protein, 28 aa, Cryptosporidium parvum
SKVFTFFNFVWKIILFFIIWKSRNDFIK

SEQ ID NO: 2346630 - protein, 22 aa, Cryptosporidium parvum
SLFCGIWLLFHSWSISLLKGVQ

SEQ ID NO: 2346631 - protein, 20 aa, Cryptosporidium parvum
SSAFGLRYIVPSVFAIFAAL

SEQ ID NO: 2346632 - protein, 23 aa, Cryptosporidium parvum
STNRILIFHFIVVIFVVIITLIV

SEQ ID NO: 2346633 - protein, 25 aa, Cryptosporidium parvum
SVISSRLFSLWLFVQKRLTTIQIAI

SEQ ID NO: 2346634 - protein, 19 aa, Cryptosporidium parvum
SWKIMSIFSFLKLKKPKYA

SEQ ID NO: 2346635 - protein, 22 aa, Cryptosporidium parvum
SYTYYFSSLILWLFSKSNDSIV

SEQ ID NO: 2346636 - protein, 18 aa, Cryptosporidium parvum
TFILLFNLLNLHSKHCIF

SEQ ID NO: 2346637 - protein, 28 aa, Cryptosporidium parvum
TFLITILIFLIFFFKRRLVIDLLLIVEL

SEQ ID NO: 2346638 - protein, 23 aa, Cryptosporidium parvum
TFPSLLIWVRFFHQTILKNQETK

SEQ ID NO: 2346639 - protein, 23 aa, Cryptosporidium parvum
TFVRCLIICLFVFSWPISKFLDY

SEQ ID NO: 2346640 - protein, 26 aa, Cryptosporidium parvum
TGSIEFYLCILFSIALIFFGGILSGL

SEQ ID NO: 2346641 - protein, 23 aa, Cryptosporidium parvum
TILMIELILFSFPFNIPNLPLPK

SEQ ID NO: 2346642 - protein, 25 aa, Cryptosporidium parvum
TKKNILLFIFACYTPIILIVGSIYL

SEQ ID NO: 2346643 - protein, 19 aa, Cryptosporidium parvum
VDDMCFLSFLLMNKVFTGF

SEQ ID NO: 2346644 - protein, 19 aa, Cryptosporidium parvum
VFITYFLIIYTVSATELDS

SEQ ID NO: 2346645 - protein, 19 aa, Cryptosporidium parvum
VLERYIFGILTFLSEKILN

SEQ ID NO: 2346646 - protein, 30 aa, Cryptosporidium parvum; identical to SEQ ID NO: 2135003

SEQ ID NO: 2346647 - protein, 24 aa, Cryptosporidium parvum
VTYPYYYRPFFGYGFPLLGTEPYF

SEQ ID NO: 2346648 - protein, 25 aa, Cryptosporidium parvum
VVGRYFYMILVEKLSFNTGGICSFL

SEQ ID NO: 2346649 - protein, 20 aa, Cryptosporidium parvum
VWVLIYFYIHYLLLNTIDCT

SEQ ID NO: 2346650 - protein, 17 aa, Cryptosporidium parvum
WKILMVLIVWYNLITTF

SEQ ID NO: 2346651 - protein, 18 aa, Cryptosporidium parvum
WLKLRKEAIGWFIYTIED

SEQ ID NO: 2346652 - protein, 17 aa, Cryptosporidium parvum
YCFFCRIFIYLKKIKIN

SEQ ID NO: 2346653 - protein, 17 aa, Cryptosporidium parvum
YEEYFFLSNLKLLELVD

SEQ ID NO: 2346654 - protein, 19 aa, Cryptosporidium parvum
YFWYIFLLIPIYIIYKIGK

SEQ ID NO: 2346655 - protein, 28 aa, Cryptosporidium parvum
YIFCCLLFFIWYICTWFVGAHLLRIETK

SEQ ID NO: 2346656 - protein, 17 aa, Cryptosporidium parvum
YIGLFVFFIALFSELDA

SEQ ID NO: 2346657 - protein, 20 aa, Cryptosporidium parvum
YIRSLLRLFFLFSSFKEDNA

SEQ ID NO: 2346658 - protein, 37 aa, Cryptosporidium parvum; identical to SEQ ID NO: 2250102

SEQ ID NO: 2346659 - protein, 18 aa, Cryptosporidium parvum
YNELLFYSHFRWLKGEYI

SEQ ID NO: 2346660 - protein, 17 aa, Cryptosporidium parvum
YVDFIELVIFYFKKFNL

SEQ ID NO: 2346661 - protein, 6 aa, Cryptosporidium parvum
AGQERF

SEQ ID NO: 2346662 - protein, 4 aa, Cryptosporidium parvum
NDTN

SEQ ID NO: 2346663 - protein, 4 aa, Cryptosporidium parvum
QYTE

SEQ ID NO: 2346664 - protein, 4 aa, Cryptosporidium parvum
SGVG

SEQ ID NO: 2346665 - protein, 4 aa, Cryptosporidium parvum
STPI

SEQ ID NO: 2346666 - protein, 35 aa, Cryptosporidium parvum; identical to SEQ ID NO: 2250349

SEQ ID NO: 2346667 - protein, 26 aa, Cryptosporidium parvum
AAAATAATSTGSGGQAQIPAQPQNMP

SEQ ID NO: 2346668 - protein, 10 aa, Cryptosporidium parvum
AAAEVDSEMS

SEQ ID NO: 2346669 - protein, 8 aa, Cryptosporidium parvum
AAASPSMQ

SEQ ID NO: 2346670 - protein, 7 aa, Cryptosporidium parvum
AAESNQR

SEQ ID NO: 2346671 - protein, 19 aa, Cryptosporidium parvum
AAHHNGSQYNEFSTEDARH

SEQ ID NO: 2346672 - protein, 6 aa, Cryptosporidium parvum
AAITNS

SEQ ID NO: 2346673 - protein, 14 aa, Cryptosporidium parvum
AALEQRKKRENKNS

SEQ ID NO: 2346674 - protein, 4 aa, Cryptosporidium parvum
AALG

SEQ ID NO: 2346675 - protein, 12 aa, Cryptosporidium parvum
AANSKSNQKNLG

SEQ ID NO: 2346676 - protein, 9 aa, Cryptosporidium parvum
AAPGGKTTY

SEQ ID NO: 2346677 - protein, 8 aa, Cryptosporidium parvum
AARGNGTS

SEQ ID NO: 2346678 - protein, 24 aa, Cryptosporidium parvum
AASPPKPVSGAAAGGAAPAQPKED

SEQ ID NO: 2346679 - protein, 4 aa, Cryptosporidium parvum
AATS

SEQ ID NO: 2346680 - protein, 6 aa, Cryptosporidium parvum
AAYRAT

SEQ ID NO: 2346681 - protein, 4 aa, Cryptosporidium parvum
ACTH

SEQ ID NO: 2346682 - protein, 9 aa, Cryptosporidium parvum
ADGASYEGE

SEQ ID NO: 2346683 - protein, 16 aa, Cryptosporidium parvum
ADHNQNLERGSSNHNL

SEQ ID NO: 2346684 - protein, 6 aa, Cryptosporidium parvum
ADITEK

SEQ ID NO: 2346685 - protein, 26 aa, Cryptosporidium parvum
ADLSGSDKELDTNSQIPPHSEVGQNM

SEQ ID NO: 2346686 - protein, 6 aa, Cryptosporidium parvum
ADNSPW

SEQ ID NO: 2346687 - protein, 6 aa, Cryptosporidium parvum
ADRIAE

SEQ ID NO: 2346688 - protein, 29 aa, Cryptosporidium parvum
ADTSIQDQCRQNSNKSGNSQNGNPNTNKN

SEQ ID NO: 2346689 - protein, 13 aa, Cryptosporidium parvum
ADVNAKDKYGRTP

SEQ ID NO: 2346690 - protein, 9 aa, Cryptosporidium parvum
ADVPGEGEH

SEQ ID NO: 2346691 - protein, 7 aa, Cryptosporidium parvum
AEAEVEA

SEQ ID NO: 2346692 - protein, 10 aa, Cryptosporidium parvum
AECQKQGKEL

SEQ ID NO: 2346693 - protein, 4 aa, Cryptosporidium parvum
AEDC

SEQ ID NO: 2346694 - protein, 7 aa, Cryptosporidium parvum
AEEKEEQ

SEQ ID NO: 2346695 - protein, 6 aa, Cryptosporidium parvum
AEGSGI

SEQ ID NO: 2346696 - protein, 10 aa, Cryptosporidium parvum
AEKNTNDNPV

SEQ ID NO: 2346697 - protein, 10 aa, Cryptosporidium parvum
AELNEKSHSE

SEQ ID NO: 2346698 - protein, 13 aa, Cryptosporidium parvum
AELSGSSKLEDEN

SEQ ID NO: 2346699 - protein, 6 aa, Cryptosporidium parvum
AENITK

SEQ ID NO: 2346700 - protein, 5 aa, Cryptosporidium parvum
AENNG

SEQ ID NO: 2346701 - protein, 8 aa, Cryptosporidium parvum
AENNTLRG

SEQ ID NO: 2346702 - protein, 23 aa, Cryptosporidium parvum
AESDLDENMEGNNNSSDDEFNMT

SEQ ID NO: 2346703 - protein, 7 aa, Cryptosporidium parvum
AESQHRI

SEQ ID NO: 2346704 - protein, 33 aa, Cryptosporidium parvum; identical to SEQ ID NO: 2250679

SEQ ID NO: 2346705 - protein, 7 aa, Cryptosporidium parvum
AETNIEP

SEQ ID NO: 2346706 - protein, 8 aa, Cryptosporidium parvum
AETPGSLG

SEQ ID NO: 2346707 - protein, 8 aa, Cryptosporidium parvum
AETSTSGL

SEQ ID NO: 2346708 - protein, 10 aa, Cryptosporidium parvum
AEVNEEDQSN

SEQ ID NO: 2346709 - protein, 5 aa, Cryptosporidium parvum
AEYPT

SEQ ID NO: 2346710 - protein, 10 aa, Cryptosporidium parvum
AFDNSEDSFG

SEQ ID NO: 2346711 - protein, 9 aa, Cryptosporidium parvum
AFKPGEKVS

SEQ ID NO: 2346712 - protein, 14 aa, Cryptosporidium parvum
AFNKPTKTITDSFN

SEQ ID NO: 2346713 - protein, 4 aa, Cryptosporidium parvum
AFST

SEQ ID NO: 2346714 - protein, 8 aa, Cryptosporidium parvum
AGAGKTSM

SEQ ID NO: 2346715 - protein, 10 aa, Cryptosporidium parvum
AGANPNAVSA

SEQ ID NO: 2346716 - protein, 6 aa, Cryptosporidium parvum
AGDANG

SEQ ID NO: 2346717 - protein, 4 aa, Cryptosporidium parvum
AGET

SEQ ID NO: 2346718 - protein, 12 aa, Cryptosporidium parvum
AGGDLTQLDKPE

SEQ ID NO: 2346719 - protein, 4 aa, Cryptosporidium parvum
AGGL

SEQ ID NO: 2346720 - protein, 41 aa, Cryptosporidium parvum
AGGLADDTSFTPVKKTSSRASASKGAVFTPKRRDSQGADGS

SEQ ID NO: 2346721 - protein, 13 aa, Cryptosporidium parvum
AGGSLGGAQSVNE

SEQ ID NO: 2346722 - protein, 6 aa, Cryptosporidium parvum
AGGSNL

SEQ ID NO: 2346723 - protein, 18 aa, Cryptosporidium parvum
AGGTSKNSLNSSSNERSR

SEQ ID NO: 2346724 - protein, 6 aa, Cryptosporidium parvum
AGKEEM

SEQ ID NO: 2346725 - protein, 11 aa, Cryptosporidium parvum
AGKSFRKSAPA

SEQ ID NO: 2346726 - protein, 12 aa, Cryptosporidium parvum
AGNDEESGNSEL

SEQ ID NO: 2346727 - protein, 18 aa, Cryptosporidium parvum
AGNKSSVAGRDTKENVSS

SEQ ID NO: 2346728 - protein, 33 aa, Cryptosporidium parvum; identical to SEQ ID NO: 2250803

SEQ ID NO: 2346729 - protein, 5 aa, Cryptosporidium parvum
AGSSG

SEQ ID NO: 2346730 - protein, 7 aa, Cryptosporidium parvum
AGSVDEN

SEQ ID NO: 2346731 - protein, 6 aa, Cryptosporidium parvum
AGTEEA

SEQ ID NO: 2346732 - protein, 56 aa, Cryptosporidium parvum
AGTSGGGSRAPMPKFSGGSGSSPRSSITPLSPQRSSSFKRNSSLSGSNLGVDSKAN

SEQ ID NO: 2346733 - protein, 6 aa, Cryptosporidium parvum
AGVTTE

SEQ ID NO: 2346734 - protein, 4 aa, Cryptosporidium parvum
AGYV

SEQ ID NO: 2346735 - protein, 6 aa, Cryptosporidium parvum
AHPNDV

SEQ ID NO: 2346736 - protein, 14 aa, Cryptosporidium parvum
AHRADAQCSSCGGT

SEQ ID NO: 2346737 - protein, 7 aa, Cryptosporidium parvum
AHSKGQL

SEQ ID NO: 2346738 - protein, 5 aa, Cryptosporidium parvum
AIERE

SEQ ID NO: 2346739 - protein, 16 aa, Cryptosporidium parvum
AIESQNYETKKVNSSL

SEQ ID NO: 2346740 - protein, 6 aa, Cryptosporidium parvum
AINNQS

SEQ ID NO: 2346741 - protein, 5 aa, Cryptosporidium parvum
AINSA

SEQ ID NO: 2346742 - protein, 10 aa, Cryptosporidium parvum
AIPETEKESI

SEQ ID NO: 2346743 - protein, 11 aa, Cryptosporidium parvum
AIPPGPPGVHG

SEQ ID NO: 2346744 - protein, 5 aa, Cryptosporidium parvum
AISRK

SEQ ID NO: 2346745 - protein, 5 aa, Cryptosporidium parvum
AKDGG

SEQ ID NO: 2346746 - protein, 8 aa, Cryptosporidium parvum
AKDIGSLP

SEQ ID NO: 2346747 - protein, 6 aa, Cryptosporidium parvum
AKEDKV

SEQ ID NO: 2346748 - protein, 11 aa, Cryptosporidium parvum
AKEKAVKQKRE

SEQ ID NO: 2346749 - protein, 9 aa, Cryptosporidium parvum
AKESERRNI

SEQ ID NO: 2346750 - protein, 5 aa, Cryptosporidium parvum
AKESP

SEQ ID NO: 2346751 - protein, 8 aa, Cryptosporidium parvum
AKESSLRR

SEQ ID NO: 2346752 - protein, 8 aa, Cryptosporidium parvum
AKFSKNPS

SEQ ID NO: 2346753 - protein, 7 aa, Cryptosporidium parvum
AKGPEER

SEQ ID NO: 2346754 - protein, 12 aa, Cryptosporidium parvum
AKGQPQYDRAED

SEQ ID NO: 2346755 - protein, 6 aa, Cryptosporidium parvum
AKKIQN

SEQ ID NO: 2346756 - protein, 14 aa, Cryptosporidium parvum
AKMKREKSKHSSNM

SEQ ID NO: 2346757 - protein, 7 aa, Cryptosporidium parvum
AKNEFEA

SEQ ID NO: 2346758 - protein, 14 aa, Cryptosporidium parvum
AKNSFRGGGKRGKR

SEQ ID NO: 2346759 - protein, 7 aa, Cryptosporidium parvum
AKPEEPC

SEQ ID NO: 2346760 - protein, 8 aa, Cryptosporidium parvum
AKQPNSAV

SEQ ID NO: 2346761 - protein, 8 aa, Cryptosporidium parvum
AKRSEASG

SEQ ID NO: 2346762 - protein, 12 aa, Cryptosporidium parvum
AKRSKEKYKDSM

SEQ ID NO: 2346763 - protein, 8 aa, Cryptosporidium parvum
AKSGTGKT

SEQ ID NO: 2346764 - protein, 9 aa, Cryptosporidium parvum
AKSKSERDG

SEQ ID NO: 2346765 - protein, 10 aa, Cryptosporidium parvum
AKSQLKESQK

SEQ ID NO: 2346766 - protein, 12 aa, Cryptosporidium parvum
AKSSSRTSTETD

SEQ ID NO: 2346767 - protein, 6 aa, Cryptosporidium parvum
AKTINK

SEQ ID NO: 2346768 - protein, 9 aa, Cryptosporidium parvum
AKTNNAFSK

SEQ ID NO: 2346769 - protein, 9 aa, Cryptosporidium parvum
AKYGKEAAS

SEQ ID NO: 2346770 - protein, 27 aa, Cryptosporidium parvum
ALGRDDCSADSNTPEHREGPQSNQNNV

SEQ ID NO: 2346771 - protein, 20 aa, Cryptosporidium parvum
ALPTEPEKEKNLETPPSEEY

SEQ ID NO: 2346772 - protein, 10 aa, Cryptosporidium parvum
ALQEKEGGGK

SEQ ID NO: 2346773 - protein, 12 aa, Cryptosporidium parvum
ALRETEKEINNK

SEQ ID NO: 2346774 - protein, 7 aa, Cryptosporidium parvum
ALSDSEG

SEQ ID NO: 2346775 - protein, 16 aa, Cryptosporidium parvum
AMGRNDKTKARSIREN

SEQ ID NO: 2346776 - protein, 10 aa, Cryptosporidium parvum
AMKSGSGDRY

SEQ ID NO: 2346777 - protein, 10 aa, Cryptosporidium parvum
AMPQNQNRPL

SEQ ID NO: 2346778 - protein, 11 aa, Cryptosporidium parvum
ANAEGDANDHT

SEQ ID NO: 2346779 - protein, 17 aa, Cryptosporidium parvum
ANAESTFSSENKPHTEI

SEQ ID NO: 2346780 - protein, 6 aa, Cryptosporidium parvum
ANASEE

SEQ ID NO: 2346781 - protein, 8 aa, Cryptosporidium parvum
ANDAARHE

SEQ ID NO: 2346782 - protein, 5 aa, Cryptosporidium parvum
ANDLA

SEQ ID NO: 2346783 - protein, 16 aa, Cryptosporidium parvum
ANDPDHITAESSEIPS

SEQ ID NO: 2346784 - protein, 9 aa, Cryptosporidium parvum
ANEKTNKQR

SEQ ID NO: 2346785 - protein, 9 aa, Cryptosporidium parvum
ANGRKDGKG

SEQ ID NO: 2346786 - protein, 5 aa, Cryptosporidium parvum
ANGTG

SEQ ID NO: 2346787 - protein, 24 aa, Cryptosporidium parvum
ANKLTENSRAQRPKKKKRRQQGSI

SEQ ID NO: 2346788 - protein, 4 aa, Cryptosporidium parvum
ANLS

SEQ ID NO: 2346789 - protein, 15 aa, Cryptosporidium parvum
ANNPENSSNAINQNS

SEQ ID NO: 2346790 - protein, 35 aa, Cryptosporidium parvum
ANNTTNTTSTTNNNTNSTNAALGQNSQFKDTKYTS

SEQ ID NO: 2346791 - protein, 9 aa, Cryptosporidium parvum
ANQGIQRDD

SEQ ID NO: 2346792 - protein, 16 aa, Cryptosporidium parvum
ANQQLKSSKQLGSQKL

SEQ ID NO: 2346793 - protein, 13 aa, Cryptosporidium parvum
ANRMKEKGGQCYK

SEQ ID NO: 2346794 - protein, 25 aa, Cryptosporidium parvum
ANRPQSHTGGASNSRTTTASQHSGL

SEQ ID NO: 2346795 - protein, 8 aa, Cryptosporidium parvum
ANSKTGGY

SEQ ID NO: 2346796 - protein, 13 aa, Cryptosporidium parvum
ANSQSINKQFEEK

SEQ ID NO: 2346797 - protein, 11 aa, Cryptosporidium parvum
ANSRNNKANID

SEQ ID NO: 2346798 - protein, 7 aa, Cryptosporidium parvum
ANSSEFK

SEQ ID NO: 2346799 - protein, 8 aa, Cryptosporidium parvum
ANTNTHSS

SEQ ID NO: 2346800 - protein, 9 aa, Cryptosporidium parvum
APGAPNTWP

SEQ ID NO: 2346801 - protein, 8 aa, Cryptosporidium parvum
APGDDPDI

SEQ ID NO: 2346802 - protein, 4 aa, Cryptosporidium parvum
APGQ

SEQ ID NO: 2346803 - protein, 5 aa, Cryptosporidium parvum
APGSP

SEQ ID NO: 2346804 - protein, 12 aa, Cryptosporidium parvum
APIEKKNPHDND

SEQ ID NO: 2346805 - protein, 7 aa, Cryptosporidium parvum
APITPRM

SEQ ID NO: 2346806 - protein, 26 aa, Cryptosporidium parvum
APKSSLKLDPTKSKAKSKAAQTGPKL

SEQ ID NO: 2346807 - protein, 5 aa, Cryptosporidium parvum
APNCC

SEQ ID NO: 2346808 - protein, 11 aa, Cryptosporidium parvum
APNSNVGSLES

SEQ ID NO: 2346809 - protein, 5 aa, Cryptosporidium parvum
APPGC

SEQ ID NO: 2346810 - protein, 5 aa, Cryptosporidium parvum
APPKS

SEQ ID NO: 2346811 - protein, 5 aa, Cryptosporidium parvum
APRRP

SEQ ID NO: 2346812 - protein, 42 aa, Cryptosporidium parvum
APSESESTKDNLTDNFQEQNKSKSNNQNSTTNSQISGNNDHF

SEQ ID NO: 2346813 - protein, 20 aa, Cryptosporidium parvum
APSKSDLEQLNEETGGKVTY

SEQ ID NO: 2346814 - protein, 6 aa, Cryptosporidium parvum
APTGQI

SEQ ID NO: 2346815 - protein, 4 aa, Cryptosporidium parvum
APWK

SEQ ID NO: 2346816 - protein, 14 aa, Cryptosporidium parvum
APYYSTPCDKSRYG

SEQ ID NO: 2346817 - protein, 6 aa, Cryptosporidium parvum
AQALQQ

SEQ ID NO: 2346818 - protein, 6 aa, Cryptosporidium parvum
AQDTGK

SEQ ID NO: 2346819 - protein, 10 aa, Cryptosporidium parvum
AQGREWKENR

SEQ ID NO: 2346820 - protein, 10 aa, Cryptosporidium parvum
AQGSHAQKNF

SEQ ID NO: 2346821 - protein, 15 aa, Cryptosporidium parvum
AQIYSSSQNFNNPGK

SEQ ID NO: 2346822 - protein, 8 aa, Cryptosporidium parvum
AQKKNERQ

SEQ ID NO: 2346823 - protein, 24 aa, Cryptosporidium parvum
AQKKSNNKKENQSKRQNGNLKDER

SEQ ID NO: 2346824 - protein, 8 aa, Cryptosporidium parvum
AQKNNEEV

SEQ ID NO: 2346825 - protein, 4 aa, Cryptosporidium parvum
AQNG

SEQ ID NO: 2346826 - protein, 6 aa, Cryptosporidium parvum
AQPGDM

SEQ ID NO: 2346827 - protein, 7 aa, Cryptosporidium parvum
AQTETNY

SEQ ID NO: 2346828 - protein, 4 aa, Cryptosporidium parvum
AQVT

SEQ ID NO: 2346829 - protein, 6 aa, Cryptosporidium parvum
AQYEPY

SEQ ID NO: 2346830 - protein, 4 aa, Cryptosporidium parvum
ARDR

SEQ ID NO: 2346831 - protein, 5 aa, Cryptosporidium parvum
ARERR

SEQ ID NO: 2346832 - protein, 7 aa, Cryptosporidium parvum
ARIDPDS

SEQ ID NO: 2346833 - protein, 7 aa, Cryptosporidium parvum
ASADDGR

SEQ ID NO: 2346834 - protein, 4 aa, Cryptosporidium parvum
ASAT

SEQ ID NO: 2346835 - protein, 4 aa, Cryptosporidium parvum
ASCG

SEQ ID NO: 2346836 - protein, 6 aa, Cryptosporidium parvum
ASDKPM

SEQ ID NO: 2346837 - protein, 18 aa, Cryptosporidium parvum
ASDQGIAKVSSPQSSTSY

SEQ ID NO: 2346838 - protein, 15 aa, Cryptosporidium parvum
ASDQSEDSNSTNEAI

SEQ ID NO: 2346839 - protein, 11 aa, Cryptosporidium parvum
ASDTSSLEFGP

SEQ ID NO: 2346840 - protein, 9 aa, Cryptosporidium parvum
ASDVYEESP

SEQ ID NO: 2346841 - protein, 4 aa, Cryptosporidium parvum
ASGD

SEQ ID NO: 2346842 - protein, 7 aa, Cryptosporidium parvum
ASGGRYV

SEQ ID NO: 2346843 - protein, 10 aa, Cryptosporidium parvum
ASIPDERGDI

SEQ ID NO: 2346844 - protein, 14 aa, Cryptosporidium parvum
ASKLRDSLKGNGMD

SEQ ID NO: 2346845 - protein, 11 aa, Cryptosporidium parvum
ASKNERTSSKL

SEQ ID NO: 2346846 - protein, 5 aa, Cryptosporidium parvum
ASKVT

SEQ ID NO: 2346847 - protein, 16 aa, Cryptosporidium parvum
ASMISGSETSDSEEIQ

SEQ ID NO: 2346848 - protein, 9 aa, Cryptosporidium parvum
ASNDRKPLD

SEQ ID NO: 2346849 - protein, 53 aa, Cryptosporidium parvum; identical to SEQ ID NO: 2251697

SEQ ID NO: 2346850 - protein, 7 aa, Cryptosporidium parvum
ASNPSNV

SEQ ID NO: 2346851 - protein, 39 aa, Cryptosporidium parvum
ASNTRSNNSNKNTRKNKTDFATKSPECNTKNKNKSYVDG

SEQ ID NO: 2346852 - protein, 6 aa, Cryptosporidium parvum
ASPKEF

SEQ ID NO: 2346853 - protein, 13 aa, Cryptosporidium parvum
ASPPNERKHPKGI

SEQ ID NO: 2346854 - protein, 5 aa, Cryptosporidium parvum
ASRDE

SEQ ID NO: 2346855 - protein, 6 aa, Cryptosporidium parvum
ASRPGK

SEQ ID NO: 2346856 - protein, 14 aa, Cryptosporidium parvum
ASSKADFSNTASAR

SEQ ID NO: 2346857 - protein, 14 aa, Cryptosporidium parvum
ASSMGKFSTDRTIE

SEQ ID NO: 2346858 - protein, 46 aa, Cryptosporidium parvum; identical to SEQ ID NO: 2251796

SEQ ID NO: 2346859 - protein, 16 aa, Cryptosporidium parvum
ASTGFKNDARKTVNRD

SEQ ID NO: 2346860 - protein, 5 aa, Cryptosporidium parvum
ASTPS

SEQ ID NO: 2346861 - protein, 4 aa, Cryptosporidium parvum
ASTR

SEQ ID NO: 2346862 - protein, 15 aa, Cryptosporidium parvum
ASTTAREVESSEPEE

SEQ ID NO: 2346863 - protein, 5 aa, Cryptosporidium parvum
ATADS

SEQ ID NO: 2346864 - protein, 7 aa, Cryptosporidium parvum
ATAPGTA

SEQ ID NO: 2346865 - protein, 12 aa, Cryptosporidium parvum
ATARKRTRDADY

SEQ ID NO: 2346866 - protein, 4 aa, Cryptosporidium parvum
ATGC

SEQ ID NO: 2346867 - protein, 34 aa, Cryptosporidium parvum
ATLKANSRAQKEKNKLAKRTKKDSVIRDNTNKSL

SEQ ID NO: 2346868 - protein, 28 aa, Cryptosporidium parvum
ATNGSENYKRMSSKSKNSPRSHNKYTGN

SEQ ID NO: 2346869 - protein, 12 aa, Cryptosporidium parvum
ATPQPPAQQYGT

SEQ ID NO: 2346870 - protein, 4 aa, Cryptosporidium parvum
ATQI

SEQ ID NO: 2346871 - protein, 6 aa, Cryptosporidium parvum
ATSPKR

SEQ ID NO: 2346872 - protein, 9 aa, Cryptosporidium parvum
ATSSSEPME

SEQ ID NO: 2346873 - protein, 12 aa, Cryptosporidium parvum
ATSTAGTHVTGG

SEQ ID NO: 2346874 - protein, 9 aa, Cryptosporidium parvum
ATTASSGII

SEQ ID NO: 2346875 - protein, 5 aa, Cryptosporidium parvum
ATTNI

SEQ ID NO: 2346876 - protein, 31 aa, Cryptosporidium parvum; identical to SEQ ID NO: 2136637

SEQ ID NO: 2346877 - protein, 19 aa, Cryptosporidium parvum
AVANAEKQKNGFGSNSGLN

SEQ ID NO: 2346878 - protein, 12 aa, Cryptosporidium parvum
AVNGSEVSVSAA

SEQ ID NO: 2346879 - protein, 11 aa, Cryptosporidium parvum
AVNPESETIET

SEQ ID NO: 2346880 - protein, 9 aa, Cryptosporidium parvum
AVSNDTGLK

SEQ ID NO: 2346881 - protein, 6 aa, Cryptosporidium parvum
AYKEGG

SEQ ID NO: 2346882 - protein, 19 aa, Cryptosporidium parvum
AYNGPEGSNHRVRESSVGE

SEQ ID NO: 2346883 - protein, 11 aa, Cryptosporidium parvum
AYNSSKEGFLG

SEQ ID NO: 2346884 - protein, 6 aa, Cryptosporidium parvum
AYQSAS

SEQ ID NO: 2346885 - protein, 6 aa, Cryptosporidium parvum
AYRDQT

SEQ ID NO: 2346886 - protein, 10 aa, Cryptosporidium parvum
AYWNSGNNAT

SEQ ID NO: 2346887 - protein, 8 aa, Cryptosporidium parvum
CAKEESKK

SEQ ID NO: 2346888 - protein, 4 aa, Cryptosporidium parvum
CDAL

SEQ ID NO: 2346889 - protein, 8 aa, Cryptosporidium parvum
CDKSDNEC

SEQ ID NO: 2346890 - protein, 13 aa, Cryptosporidium parvum
CDSSTLKKENPGN

SEQ ID NO: 2346891 - protein, 38 aa, Cryptosporidium parvum; identical to SEQ ID NO: 2252026

SEQ ID NO: 2346892 - protein, 5 aa, Cryptosporidium parvum
CEGLN

SEQ ID NO: 2346893 - protein, 12 aa, Cryptosporidium parvum
CERGGSKQPLQV

SEQ ID NO: 2346894 - protein, 9 aa, Cryptosporidium parvum
CESTSEGSF

SEQ ID NO: 2346895 - protein, 10 aa, Cryptosporidium parvum
CGAKSGIGEK

SEQ ID NO: 2346896 - protein, 5 aa, Cryptosporidium parvum
CGDRS

SEQ ID NO: 2346897 - protein, 4 aa, Cryptosporidium parvum
CGDS

SEQ ID NO: 2346898 - protein, 4 aa, Cryptosporidium parvum
CGNQ

SEQ ID NO: 2346899 - protein, 4 aa, Cryptosporidium parvum
CGNV

SEQ ID NO: 2346900 - protein, 16 aa, Cryptosporidium parvum
CGTSSSSSSASSFAAS

SEQ ID NO: 2346901 - protein, 4 aa, Cryptosporidium parvum
CHPS

SEQ ID NO: 2346902 - protein, 10 aa, Cryptosporidium parvum
CKKDSQEGYR

SEQ ID NO: 2346903 - protein, 7 aa, Cryptosporidium parvum
CKNDNKL

SEQ ID NO: 2346904 - protein, 8 aa, Cryptosporidium parvum
CKQTGSVK

SEQ ID NO: 2346905 - protein, 10 aa, Cryptosporidium parvum
CKRERAEKKI

SEQ ID NO: 2346906 - protein, 14 aa, Cryptosporidium parvum
CKSITDSNGQTRTA

SEQ ID NO: 2346907 - protein, 7 aa, Cryptosporidium parvum
CNESSSS

SEQ ID NO: 2346908 - protein, 33 aa, Cryptosporidium parvum; identical to SEQ ID NO: 2252152

SEQ ID NO: 2346909 - protein, 7 aa, Cryptosporidium parvum
CNPNPGF

SEQ ID NO: 2346910 - protein, 7 aa, Cryptosporidium parvum
CNPNSQA

SEQ ID NO: 2346911 - protein, 8 aa, Cryptosporidium parvum
CNSQNKSK

SEQ ID NO: 2346912 - protein, 14 aa, Cryptosporidium parvum
CNTDNTNSSLETGQ

SEQ ID NO: 2346913 - protein, 4 aa, Cryptosporidium parvum
CPLE

SEQ ID NO: 2346914 - protein, 4 aa, Cryptosporidium parvum
CQTK

SEQ ID NO: 2346915 - protein, 10 aa, Cryptosporidium parvum
CRKTKNKTEI

SEQ ID NO: 2346916 - protein, 8 aa, Cryptosporidium parvum
CSGSDGPH

SEQ ID NO: 2346917 - protein, 11 aa, Cryptosporidium parvum
CSSNPNVSTNT

SEQ ID NO: 2346918 - protein, 8 aa, Cryptosporidium parvum
CSTDTEKI

SEQ ID NO: 2346919 - protein, 10 aa, Cryptosporidium parvum
CSTPPRSSVS

SEQ ID NO: 2346920 - protein, 9 aa, Cryptosporidium parvum
CTSPQQPIK

SEQ ID NO: 2346921 - protein, 5 aa, Cryptosporidium parvum
CTTNT

SEQ ID NO: 2346922 - protein, 4 aa, Cryptosporidium parvum
CVNG

SEQ ID NO: 2346923 - protein, 10 aa, Cryptosporidium parvum
DADKTTELKR

SEQ ID NO: 2346924 - protein, 9 aa, Cryptosporidium parvum
DAFKKSQRL

SEQ ID NO: 2346925 - protein, 6 aa, Cryptosporidium parvum
DAGNQG

SEQ ID NO: 2346926 - protein, 6 aa, Cryptosporidium parvum
DALENE

SEQ ID NO: 2346927 - protein, 9 aa, Cryptosporidium parvum
DANNTTFSK

SEQ ID NO: 2346928 - protein, 6 aa, Cryptosporidium parvum
DAPGVN

SEQ ID NO: 2346929 - protein, 12 aa, Cryptosporidium parvum
DARAASKSKELY

SEQ ID NO: 2346930 - protein, 4 aa, Cryptosporidium parvum
DASD

SEQ ID NO: 2346931 - protein, 6 aa, Cryptosporidium parvum
DASTKK

SEQ ID NO: 2346932 - protein, 11 aa, Cryptosporidium parvum
DASTSEIKKSY

SEQ ID NO: 2346933 - protein, 4 aa, Cryptosporidium parvum
DAVA

SEQ ID NO: 2346934 - protein, 6 aa, Cryptosporidium parvum
DDAKIE

SEQ ID NO: 2346935 - protein, 7 aa, Cryptosporidium parvum
DDANQLT

SEQ ID NO: 2346936 - protein, 4 aa, Cryptosporidium parvum
DDCR

SEQ ID NO: 2346937 - protein, 18 aa, Cryptosporidium parvum
DDDDRRESIGKSTYSRKL

SEQ ID NO: 2346938 - protein, 11 aa, Cryptosporidium parvum
DDDTEKKDGVS

SEQ ID NO: 2346939 - protein, 8 aa, Cryptosporidium parvum
DDEELTKH

SEQ ID NO: 2346940 - protein, 9 aa, Cryptosporidium parvum
DDEGEYYEE

SEQ ID NO: 2346941 - protein, 39 aa, Cryptosporidium parvum; identical to SEQ ID NO: 2252473

SEQ ID NO: 2346942 - protein, 7 aa, Cryptosporidium parvum
DDGPGKY

SEQ ID NO: 2346943 - protein, 5 aa, Cryptosporidium parvum
DDHSE

SEQ ID NO: 2346944 - protein, 7 aa, Cryptosporidium parvum
DDKATLQ

SEQ ID NO: 2346945 - protein, 6 aa, Cryptosporidium parvum
DDKTGN

SEQ ID NO: 2346946 - protein, 13 aa, Cryptosporidium parvum
DDKVITSQKDYPE

SEQ ID NO: 2346947 - protein, 10 aa, Cryptosporidium parvum
DDNKSSIKSV

SEQ ID NO: 2346948 - protein, 7 aa, Cryptosporidium parvum
DDPEKNQ

SEQ ID NO: 2346949 - protein, 19 aa, Cryptosporidium parvum
DDPKDLSSTKIENKTDNRI

SEQ ID NO: 2346950 - protein, 10 aa, Cryptosporidium parvum
DDPNKKSNSL

SEQ ID NO: 2346951 - protein, 19 aa, Cryptosporidium parvum
DDPNPTSMENSKKRNAEEV

SEQ ID NO: 2346952 - protein, 7 aa, Cryptosporidium parvum
DDPSASL

SEQ ID NO: 2346953 - protein, 4 aa, Cryptosporidium parvum
DDQI

SEQ ID NO: 2346954 - protein, 7 aa, Cryptosporidium parvum
DDQNSSV

SEQ ID NO: 2346955 - protein, 5 aa, Cryptosporidium parvum
DDSDL

SEQ ID NO: 2346956 - protein, 5 aa, Cryptosporidium parvum
DDSET

SEQ ID NO: 2346957 - protein, 9 aa, Cryptosporidium parvum
DDSFEEVDE

SEQ ID NO: 2346958 - protein, 6 aa, Cryptosporidium parvum
DDSFTD

SEQ ID NO: 2346959 - protein, 8 aa, Cryptosporidium parvum
DDSKRNEI

SEQ ID NO: 2346960 - protein, 33 aa, Cryptosporidium parvum
DDTGVGTSGVGGSQYRSKPYSQQSNKYTHQQQM

SEQ ID NO: 2346961 - protein, 9 aa, Cryptosporidium parvum
DDTVSSGGA

SEQ ID NO: 2346962 - protein, 16 aa, Cryptosporidium parvum
DEDDEKKDNEEKPTIS

SEQ ID NO: 2346963 - protein, 4 aa, Cryptosporidium parvum
DEDF

SEQ ID NO: 2346964 - protein, 21 aa, Cryptosporidium parvum
DEDHSSSTQRVEQENSSHPAF

SEQ ID NO: 2346965 - protein, 9 aa, Cryptosporidium parvum
DEDQMEDSE

SEQ ID NO: 2346966 - protein, 7 aa, Cryptosporidium parvum
DEDTERS

SEQ ID NO: 2346967 - protein, 9 aa, Cryptosporidium parvum
DEDTSSKRE

SEQ ID NO: 2346968 - protein, 9 aa, Cryptosporidium parvum
DEEFTDGDL

SEQ ID NO: 2346969 - protein, 6 aa, Cryptosporidium parvum
DEEGIK

SEQ ID NO: 2346970 - protein, 8 aa, Cryptosporidium parvum
DEEYYSGE

SEQ ID NO: 2346971 - protein, 14 aa, Cryptosporidium parvum
DEGPGTINEDNKCE

SEQ ID NO: 2346972 - protein, 5 aa, Cryptosporidium parvum
DEGRN

SEQ ID NO: 2346973 - protein, 9 aa, Cryptosporidium parvum
DEGSISESQ

SEQ ID NO: 2346974 - protein, 4 aa, Cryptosporidium parvum
DEGY

SEQ ID NO: 2346975 - protein, 32 aa, Cryptosporidium parvum
DEIISSKGKDRYSVGGDSISSIDSSSSAISRS

SEQ ID NO: 2346976 - protein, 14 aa, Cryptosporidium parvum
DEKEPVSDKPRSVQ

SEQ ID NO: 2346977 - protein, 5 aa, Cryptosporidium parvum
DEKEY

SEQ ID NO: 2346978 - protein, 11 aa, Cryptosporidium parvum
DEKGNKEYAHQ

SEQ ID NO: 2346979 - protein, 7 aa, Cryptosporidium parvum
DEKNKEN

SEQ ID NO: 2346980 - protein, 8 aa, Cryptosporidium parvum
DELEEGEA

SEQ ID NO: 2346981 - protein, 5 aa, Cryptosporidium parvum
DENSH

SEQ ID NO: 2346982 - protein, 12 aa, Cryptosporidium parvum
DEQDSSVNDQTN

SEQ ID NO: 2346983 - protein, 5 aa, Cryptosporidium parvum
DERAL

SEQ ID NO: 2346984 - protein, 5 aa, Cryptosporidium parvum
DERDM

SEQ ID NO: 2346985 - protein, 7 aa, Cryptosporidium parvum
DERKGNL

SEQ ID NO: 2346986 - protein, 4 aa, Cryptosporidium parvum
DESE

SEQ ID NO: 2346987 - protein, 12 aa, Cryptosporidium parvum
DESIRLGSNGDF

SEQ ID NO: 2346988 - protein, 21 aa, Cryptosporidium parvum
DESSTDSESEESTVKKRVNRR

SEQ ID NO: 2346989 - protein, 4 aa, Cryptosporidium parvum
DEST

SEQ ID NO: 2346990 - protein, 14 aa, Cryptosporidium parvum
DETNKNVSSHSKSA

SEQ ID NO: 2346991 - protein, 6 aa, Cryptosporidium parvum
DETSNK

SEQ ID NO: 2346992 - protein, 7 aa, Cryptosporidium parvum
DEVDTVR

SEQ ID NO: 2346993 - protein, 18 aa, Cryptosporidium parvum
DEYDEDGDEEEEEEEENV

SEQ ID NO: 2346994 - protein, 5 aa, Cryptosporidium parvum
DFDGD

SEQ ID NO: 2346995 - protein, 6 aa, Cryptosporidium parvum
DFKNEL

SEQ ID NO: 2346996 - protein, 5 aa, Cryptosporidium parvum
DFKSG

SEQ ID NO: 2346997 - protein, 8 aa, Cryptosporidium parvum
DFNPANGR

SEQ ID NO: 2346998 - protein, 10 aa, Cryptosporidium parvum
DFPDSNEFSN

SEQ ID NO: 2346999 - protein, 4 aa, Cryptosporidium parvum
DFRG

SEQ ID NO: 2347000 - protein, 5 aa, Cryptosporidium parvum
DFSNE

SEQ ID NO: 2347001 - protein, 30 aa, Cryptosporidium parvum; identical to SEQ ID NO: 2212230

SEQ ID NO: 2347002 - protein, 4 aa, Cryptosporidium parvum
DFTD

SEQ ID NO: 2347003 - protein, 6 aa, Cryptosporidium parvum
DFTGAK

SEQ ID NO: 2347004 - protein, 7 aa, Cryptosporidium parvum
DGAFGGV

SEQ ID NO: 2347005 - protein, 6 aa, Cryptosporidium parvum
DGAPIT

SEQ ID NO: 2347006 - protein, 5 aa, Cryptosporidium parvum
DGATL

SEQ ID NO: 2347007 - protein, 24 aa, Cryptosporidium parvum
DGCENTNIEQNYKRDLGESLNSDF

SEQ ID NO: 2347008 - protein, 7 aa, Cryptosporidium parvum
DGDNKTM

SEQ ID NO: 2347009 - protein, 14 aa, Cryptosporidium parvum
DGGKEEEDQSRPLD

SEQ ID NO: 2347010 - protein, 10 aa, Cryptosporidium parvum
DGIDKSGLKE

SEQ ID NO: 2347011 - protein, 7 aa, Cryptosporidium parvum
DGKAQGE

SEQ ID NO: 2347012 - protein, 10 aa, Cryptosporidium parvum
DGKKQTEDEY

SEQ ID NO: 2347013 - protein, 7 aa, Cryptosporidium parvum
DGKPLIE

SEQ ID NO: 2347014 - protein, 4 aa, Cryptosporidium parvum
DGQE

SEQ ID NO: 2347015 - protein, 6 aa, Cryptosporidium parvum
DGSAFS

SEQ ID NO: 2347016 - protein, 7 aa, Cryptosporidium parvum
DGSFHSK

SEQ ID NO: 2347017 - protein, 7 aa, Cryptosporidium parvum
DGSFKSQ

SEQ ID NO: 2347018 - protein, 7 aa, Cryptosporidium parvum
DGSSEAV

SEQ ID NO: 2347019 - protein, 18 aa, Cryptosporidium parvum
DHATNYQENSFKKQCSNK

SEQ ID NO: 2347020 - protein, 25 aa, Cryptosporidium parvum
DHDHNQDQNQNKNQVSQNIDSSNSI

SEQ ID NO: 2347021 - protein, 6 aa, Cryptosporidium parvum
DHENGL

SEQ ID NO: 2347022 - protein, 9 aa, Cryptosporidium parvum
DHNSDNQDT

SEQ ID NO: 2347023 - protein, 12 aa, Cryptosporidium parvum
DHPESEEELGEL

SEQ ID NO: 2347024 - protein, 20 aa, Cryptosporidium parvum
DHPPITPVRSATQNDLDGDS

SEQ ID NO: 2347025 - protein, 14 aa, Cryptosporidium parvum
DHYKQQNPSSETRY

SEQ ID NO: 2347026 - protein, 12 aa, Cryptosporidium parvum
DIESNGSSSNEL

SEQ ID NO: 2347027 - protein, 8 aa, Cryptosporidium parvum
DIESRPRK

SEQ ID NO: 2347028 - protein, 23 aa, Cryptosporidium parvum
DIKSEQSSQSTQGNSFYDILSML

SEQ ID NO: 2347029 - protein, 6 aa, Cryptosporidium parvum
DINDEL

SEQ ID NO: 2347030 - protein, 5 aa, Cryptosporidium parvum
DINED

SEQ ID NO: 2347031 - protein, 4 aa, Cryptosporidium parvum
DIPA

SEQ ID NO: 2347032 - protein, 9 aa, Cryptosporidium parvum
DIPNKEREY

SEQ ID NO: 2347033 - protein, 19 aa, Cryptosporidium parvum
DIPTKDQGVKSFDWISSLL

SEQ ID NO: 2347034 - protein, 4 aa, Cryptosporidium parvum
DISD

SEQ ID NO: 2347035 - protein, 7 aa, Cryptosporidium parvum
DISSVQA

SEQ ID NO: 2347036 - protein, 7 aa, Cryptosporidium parvum
DISYKRR

SEQ ID NO: 2347037 - protein, 10 aa, Cryptosporidium parvum
DKAQESNTKR

SEQ ID NO: 2347038 - protein, 5 aa, Cryptosporidium parvum
DKAYN

SEQ ID NO: 2347039 - protein, 31 aa, Cryptosporidium parvum; identical to SEQ ID NO: 2253235

SEQ ID NO: 2347040 - protein, 5 aa, Cryptosporidium parvum
DKEGR

SEQ ID NO: 2347041 - protein, 6 aa, Cryptosporidium parvum
DKESMH

SEQ ID NO: 2347042 - protein, 18 aa, Cryptosporidium parvum
DKFNEEVSTKNKEFSEDR

SEQ ID NO: 2347043 - protein, 6 aa, Cryptosporidium parvum
DKITDQ

SEQ ID NO: 2347044 - protein, 9 aa, Cryptosporidium parvum
DKKAKSGLS

SEQ ID NO: 2347045 - protein, 7 aa, Cryptosporidium parvum
DKKDLEV

SEQ ID NO: 2347046 - protein, 17 aa, Cryptosporidium parvum
DKKPSNIQDSSSAEAVS

SEQ ID NO: 2347047 - protein, 6 aa, Cryptosporidium parvum
DKKSPL

SEQ ID NO: 2347048 - protein, 6 aa, Cryptosporidium parvum
DKKSQS

SEQ ID NO: 2347049 - protein, 9 aa, Cryptosporidium parvum
DKNMGNDRQ

SEQ ID NO: 2347050 - protein, 8 aa, Cryptosporidium parvum
DKNTNKID

SEQ ID NO: 2347051 - protein, 18 aa, Cryptosporidium parvum
DKPDVTYNDIGGAKEQLE

SEQ ID NO: 2347052 - protein, 6 aa, Cryptosporidium parvum
DKPYDE

SEQ ID NO: 2347053 - protein, 8 aa, Cryptosporidium parvum
DKQAEKQD

SEQ ID NO: 2347054 - protein, 8 aa, Cryptosporidium parvum
DKQAEPGA

SEQ ID NO: 2347055 - protein, 30 aa, Cryptosporidium parvum; identical to SEQ ID NO: 2137865

SEQ ID NO: 2347056 - protein, 10 aa, Cryptosporidium parvum
DKRNNQYSND

SEQ ID NO: 2347057 - protein, 7 aa, Cryptosporidium parvum
DKSFETQ

SEQ ID NO: 2347058 - protein, 15 aa, Cryptosporidium parvum
DKSISPEKSDGDKEL

SEQ ID NO: 2347059 - protein, 4 aa, Cryptosporidium parvum
DKSN

SEQ ID NO: 2347060 - protein, 4 aa, Cryptosporidium parvum
DKSP

SEQ ID NO: 2347061 - protein, 4 aa, Cryptosporidium parvum
DKST

SEQ ID NO: 2347062 - protein, 6 aa, Cryptosporidium parvum
DKTAET

SEQ ID NO: 2347063 - protein, 8 aa, Cryptosporidium parvum
DKTKIKKK

SEQ ID NO: 2347064 - protein, 25 aa, Cryptosporidium parvum
DKTSNSSESTSKRRQNKTSSSNNME

SEQ ID NO: 2347065 - protein, 8 aa, Cryptosporidium parvum
DLDNEDSR

SEQ ID NO: 2347066 - protein, 6 aa, Cryptosporidium parvum
DLDNTN

SEQ ID NO: 2347067 - protein, 10 aa, Cryptosporidium parvum
DLGRTSPSLG

SEQ ID NO: 2347068 - protein, 13 aa, Cryptosporidium parvum
DLHPGDLKKGLSD

SEQ ID NO: 2347069 - protein, 20 aa, Cryptosporidium parvum
DLKSDRDNSVVESQKSENNC

SEQ ID NO: 2347070 - protein, 8 aa, Cryptosporidium parvum
DLNNTKDL

SEQ ID NO: 2347071 - protein, 12 aa, Cryptosporidium parvum
DLNQLGDNDNRK

SEQ ID NO: 2347072 - protein, 13 aa, Cryptosporidium parvum
DLQEGLNEEERRK

SEQ ID NO: 2347073 - protein, 4 aa, Cryptosporidium parvum
DLRQ

SEQ ID NO: 2347074 - protein, 6 aa, Cryptosporidium parvum
DLSETH

SEQ ID NO: 2347075 - protein, 5 aa, Cryptosporidium parvum
DLSFD

SEQ ID NO: 2347076 - protein, 5 aa, Cryptosporidium parvum
DLSKD

SEQ ID NO: 2347077 - protein, 29 aa, Cryptosporidium parvum
DLSPQKADQGFSSPASNKLSSSDLSNQST

SEQ ID NO: 2347078 - protein, 11 aa, Cryptosporidium parvum
DLTSGTESEEC

SEQ ID NO: 2347079 - protein, 18 aa, Cryptosporidium parvum
DMESPEDFDEDDNSHFEQ

SEQ ID NO: 2347080 - protein, 7 aa, Cryptosporidium parvum
DNDEDVR

SEQ ID NO: 2347081 - protein, 6 aa, Cryptosporidium parvum
DNDYDE

SEQ ID NO: 2347082 - protein, 7 aa, Cryptosporidium parvum
DNEITDE

SEQ ID NO: 2347083 - protein, 20 aa, Cryptosporidium parvum
DNESSTQCKNNPKRRSSEYE

SEQ ID NO: 2347084 - protein, 6 aa, Cryptosporidium parvum
DNETPC

SEQ ID NO: 2347085 - protein, 16 aa, Cryptosporidium parvum
DNFEENQPKTLEERTF

SEQ ID NO: 2347086 - protein, 5 aa, Cryptosporidium parvum
DNFGE

SEQ ID NO: 2347087 - protein, 4 aa, Cryptosporidium parvum
DNGQ

SEQ ID NO: 2347088 - protein, 5 aa, Cryptosporidium parvum
DNIPP

SEQ ID NO: 2347089 - protein, 8 aa, Cryptosporidium parvum
DNKGSYDG

SEQ ID NO: 2347090 - protein, 6 aa, Cryptosporidium parvum
DNKSRL

SEQ ID NO: 2347091 - protein, 13 aa, Cryptosporidium parvum
DNMTLSNKTNVEE

SEQ ID NO: 2347092 - protein, 7 aa, Cryptosporidium parvum
DNNNEKV

SEQ ID NO: 2347093 - protein, 4 aa, Cryptosporidium parvum
DNNP

SEQ ID NO: 2347094 - protein, 6 aa, Cryptosporidium parvum
DNQELN

SEQ ID NO: 2347095 - protein, 7 aa, Cryptosporidium parvum
DNQENSM

SEQ ID NO: 2347096 - protein, 7 aa, Cryptosporidium parvum
DNQGCPA

SEQ ID NO: 2347097 - protein, 9 aa, Cryptosporidium parvum
DNSDEIQSS

SEQ ID NO: 2347098 - protein, 20 aa, Cryptosporidium parvum
DNTEEKKSSCCGKKKSKFKE

SEQ ID NO: 2347099 - protein, 51 aa, Cryptosporidium parvum; identical to SEQ ID NO: 2253815

SEQ ID NO: 2347100 - protein, 7 aa, Cryptosporidium parvum
DPAYDKC

SEQ ID NO: 2347101 - protein, 6 aa, Cryptosporidium parvum
DPETQI

SEQ ID NO: 2347102 - protein, 7 aa, Cryptosporidium parvum
DPFPESS

SEQ ID NO: 2347103 - protein, 11 aa, Cryptosporidium parvum
DPGSTNSRSKT

SEQ ID NO: 2347104 - protein, 6 aa, Cryptosporidium parvum
DPGVNP

SEQ ID NO: 2347105 - protein, 5 aa, Cryptosporidium parvum
DPGYS

SEQ ID NO: 2347106 - protein, 8 aa, Cryptosporidium parvum
DPKPFPPP

SEQ ID NO: 2347107 - protein, 4 aa, Cryptosporidium parvum
DPNN

SEQ ID NO: 2347108 - protein, 8 aa, Cryptosporidium parvum
DPNPNTRW

SEQ ID NO: 2347109 - protein, 20 aa, Cryptosporidium parvum
DPNSKSAVKVPTDVDPTEVP

SEQ ID NO: 2347110 - protein, 4 aa, Cryptosporidium parvum
DPPK

SEQ ID NO: 2347111 - protein, 6 aa, Cryptosporidium parvum
DPPPTT

SEQ ID NO: 2347112 - protein, 6 aa, Cryptosporidium parvum
DPRHGR

SEQ ID NO: 2347113 - protein, 9 aa, Cryptosporidium parvum
DPRLQAPEG

SEQ ID NO: 2347114 - protein, 5 aa, Cryptosporidium parvum
DPSDI

SEQ ID NO: 2347115 - protein, 8 aa, Cryptosporidium parvum
DPSKQIYG

SEQ ID NO: 2347116 - protein, 7 aa, Cryptosporidium parvum
DPSTAKS

SEQ ID NO: 2347117 - protein, 6 aa, Cryptosporidium parvum
DPSVKV

SEQ ID NO: 2347118 - protein, 8 aa, Cryptosporidium parvum
DPTADKRR

SEQ ID NO: 2347119 - protein, 8 aa, Cryptosporidium parvum
DPTEEEIN

SEQ ID NO: 2347120 - protein, 8 aa, Cryptosporidium parvum
DPTRDEHA

SEQ ID NO: 2347121 - protein, 6 aa, Cryptosporidium parvum
DPTTIN

SEQ ID NO: 2347122 - protein, 6 aa, Cryptosporidium parvum
DPYAAD

SEQ ID NO: 2347123 - protein, 8 aa, Cryptosporidium parvum
DQADSAKI

SEQ ID NO: 2347124 - protein, 13 aa, Cryptosporidium parvum
DQAYSRNQSEFER

SEQ ID NO: 2347125 - protein, 4 aa, Cryptosporidium parvum
DQER

SEQ ID NO: 2347126 - protein, 9 aa, Cryptosporidium parvum
DQERDDEDE

SEQ ID NO: 2347127 - protein, 12 aa, Cryptosporidium parvum
DQEREERRRGRL

SEQ ID NO: 2347128 - protein, 7 aa, Cryptosporidium parvum
DQGENNR

SEQ ID NO: 2347129 - protein, 4 aa, Cryptosporidium parvum
DQGL

SEQ ID NO: 2347130 - protein, 10 aa, Cryptosporidium parvum
DQKINGKNDY

SEQ ID NO: 2347131 - protein, 14 aa, Cryptosporidium parvum
DQKNDKIIKQESEI

SEQ ID NO: 2347132 - protein, 4 aa, Cryptosporidium parvum
DQKT

SEQ ID NO: 2347133 - protein, 14 aa, Cryptosporidium parvum
DQLSKRKKKEKIQP

SEQ ID NO: 2347134 - protein, 6 aa, Cryptosporidium parvum
DQMNSN

SEQ ID NO: 2347135 - protein, 4 aa, Cryptosporidium parvum
DQMR

SEQ ID NO: 2347136 - protein, 5 aa, Cryptosporidium parvum
DQNIK

SEQ ID NO: 2347137 - protein, 8 aa, Cryptosporidium parvum
DQNKQNSL

SEQ ID NO: 2347138 - protein, 10 aa, Cryptosporidium parvum
DQNKSNEEEL

SEQ ID NO: 2347139 - protein, 10 aa, Cryptosporidium parvum
DQNSPNFQSP

SEQ ID NO: 2347140 - protein, 8 aa, Cryptosporidium parvum
DQRNGTIG

SEQ ID NO: 2347141 - protein, 6 aa, Cryptosporidium parvum
DQSQLD

SEQ ID NO: 2347142 - protein, 7 aa, Cryptosporidium parvum
DQTANDC

SEQ ID NO: 2347143 - protein, 4 aa, Cryptosporidium parvum
DQVS

SEQ ID NO: 2347144 - protein, 21 aa, Cryptosporidium parvum
DQVSEESVSGIRQKSKEKDET

SEQ ID NO: 2347145 - protein, 8 aa, Cryptosporidium parvum
DRDGSEIE

SEQ ID NO: 2347146 - protein, 6 aa, Cryptosporidium parvum
DRDSFD

SEQ ID NO: 2347147 - protein, 4 aa, Cryptosporidium parvum
DRFK

SEQ ID NO: 2347148 - protein, 5 aa, Cryptosporidium parvum
DRGPY

SEQ ID NO: 2347149 - protein, 20 aa, Cryptosporidium parvum
DRLQTGMRGAYGKPTGTAAR

SEQ ID NO: 2347150 - protein, 5 aa, Cryptosporidium parvum
DRNNT

SEQ ID NO: 2347151 - protein, 8 aa, Cryptosporidium parvum
DRNPVEGN

SEQ ID NO: 2347152 - protein, 16 aa, Cryptosporidium parvum
DRNSENKNAKNDSSHI

SEQ ID NO: 2347153 - protein, 5 aa, Cryptosporidium parvum
DRRHG

SEQ ID NO: 2347154 - protein, 8 aa, Cryptosporidium parvum
DRSNYTPG

SEQ ID NO: 2347155 - protein, 5 aa, Cryptosporidium parvum
DRVPM

SEQ ID NO: 2347156 - protein, 8 aa, Cryptosporidium parvum
DSAKEAIS

SEQ ID NO: 2347157 - protein, 6 aa, Cryptosporidium parvum
DSCEKE

SEQ ID NO: 2347158 - protein, 6 aa, Cryptosporidium parvum
DSDASI

SEQ ID NO: 2347159 - protein, 10 aa, Cryptosporidium parvum
DSDDELDPSE

SEQ ID NO: 2347160 - protein, 16 aa, Cryptosporidium parvum
DSDLVKDSDFEKDEKL

SEQ ID NO: 2347161 - protein, 65 aa, Cryptosporidium parvum
DSDRFTDTSIQNQKLESETKNHNYKDSHLENSKVKKTNGTHATHSDIQEHTSMSDQEKKSTREVN

SEQ ID NO: 2347162 - protein, 12 aa, Cryptosporidium parvum
DSDWNMSLKKLW

SEQ ID NO: 2347163 - protein, 20 aa, Cryptosporidium parvum
DSEDEQQNCGVGGNGGGELK

SEQ ID NO: 2347164 - protein, 7 aa, Cryptosporidium parvum
DSEIEDS

SEQ ID NO: 2347165 - protein, 4 aa, Cryptosporidium parvum
DSEK

SEQ ID NO: 2347166 - protein, 8 aa, Cryptosporidium parvum
DSFKRAEA

SEQ ID NO: 2347167 - protein, 6 aa, Cryptosporidium parvum
DSFSSS

SEQ ID NO: 2347168 - protein, 20 aa, Cryptosporidium parvum
DSFTEKGGYAIPGSNSSTIY

SEQ ID NO: 2347169 - protein, 4 aa, Cryptosporidium parvum
DSGD

SEQ ID NO: 2347170 - protein, 12 aa, Cryptosporidium parvum
DSGEDSINNGTY

SEQ ID NO: 2347171 - protein, 7 aa, Cryptosporidium parvum
DSGGIQI

SEQ ID NO: 2347172 - protein, 9 aa, Cryptosporidium parvum
DSGKSTTTG

SEQ ID NO: 2347173 - protein, 6 aa, Cryptosporidium parvum
DSGNDA

SEQ ID NO: 2347174 - protein, 9 aa, Cryptosporidium parvum
DSGNEIESE

SEQ ID NO: 2347175 - protein, 5 aa, Cryptosporidium parvum
DSGVG

SEQ ID NO: 2347176 - protein, 12 aa, Cryptosporidium parvum
DSIADENSSLEW

SEQ ID NO: 2347177 - protein, 8 aa, Cryptosporidium parvum
DSIDNTPL

SEQ ID NO: 2347178 - protein, 10 aa, Cryptosporidium parvum
DSIDSDKISS

SEQ ID NO: 2347179 - protein, 7 aa, Cryptosporidium parvum
DSIEQDK

SEQ ID NO: 2347180 - protein, 7 aa, Cryptosporidium parvum
DSINEED

SEQ ID NO: 2347181 - protein, 13 aa, Cryptosporidium parvum
DSKDYREKHSNQY

SEQ ID NO: 2347182 - protein, 8 aa, Cryptosporidium parvum
DSKENNEM

SEQ ID NO: 2347183 - protein, 10 aa, Cryptosporidium parvum
DSKGPGKATI

SEQ ID NO: 2347184 - protein, 15 aa, Cryptosporidium parvum
DSKQKASNTKNRLEI

SEQ ID NO: 2347185 - protein, 5 aa, Cryptosporidium parvum
DSLGY

SEQ ID NO: 2347186 - protein, 7 aa, Cryptosporidium parvum
DSLSGDR

SEQ ID NO: 2347187 - protein, 12 aa, Cryptosporidium parvum
DSMQNGNQGANI

SEQ ID NO: 2347188 - protein, 16 aa, Cryptosporidium parvum
DSNNIYSASSPSMGNN

SEQ ID NO: 2347189 - protein, 7 aa, Cryptosporidium parvum
DSNSNSI

SEQ ID NO: 2347190 - protein, 19 aa, Cryptosporidium parvum
DSQKGYDYENDSLAGKSTY

SEQ ID NO: 2347191 - protein, 8 aa, Cryptosporidium parvum
DSQPKLRS

SEQ ID NO: 2347192 - protein, 29 aa, Cryptosporidium parvum
DSSEQQAQGQGQGQGQGQTQNENKIPSGP

SEQ ID NO: 2347193 - protein, 17 aa, Cryptosporidium parvum
DSSIQNDKVEKIKSEDI

SEQ ID NO: 2347194 - protein, 18 aa, Cryptosporidium parvum
DSSKGRRWSNNSTTSTIS

SEQ ID NO: 2347195 - protein, 9 aa, Cryptosporidium parvum
DSSKVESKN

SEQ ID NO: 2347196 - protein, 19 aa, Cryptosporidium parvum
DSSPNKENDKSIGTDSSSN

SEQ ID NO: 2347197 - protein, 9 aa, Cryptosporidium parvum
DSSSARKNI

SEQ ID NO: 2347198 - protein, 11 aa, Cryptosporidium parvum
DSSSSKSSYSV

SEQ ID NO: 2347199 - protein, 8 aa, Cryptosporidium parvum
DSSSTSDW

SEQ ID NO: 2347200 - protein, 5 aa, Cryptosporidium parvum
DSSYR

SEQ ID NO: 2347201 - protein, 69 aa, Cryptosporidium parvum; identical to SEQ ID NO: 2254567

SEQ ID NO: 2347202 - protein, 4 aa, Cryptosporidium parvum
DSTE

SEQ ID NO: 2347203 - protein, 5 aa, Cryptosporidium parvum
DSTLQ

SEQ ID NO: 2347204 - protein, 9 aa, Cryptosporidium parvum
DSTQGYIPT

SEQ ID NO: 2347205 - protein, 6 aa, Cryptosporidium parvum
DSTTAA

SEQ ID NO: 2347206 - protein, 11 aa, Cryptosporidium parvum
DSTTAEGKEVP

SEQ ID NO: 2347207 - protein, 4 aa, Cryptosporidium parvum
DSVD

SEQ ID NO: 2347208 - protein, 7 aa, Cryptosporidium parvum
DSVRGDR

SEQ ID NO: 2347209 - protein, 9 aa, Cryptosporidium parvum
DSYKDETDR

SEQ ID NO: 2347210 - protein, 6 aa, Cryptosporidium parvum
DSYKEI

SEQ ID NO: 2347211 - protein, 11 aa, Cryptosporidium parvum
DSYNTNNSTAI

SEQ ID NO: 2347212 - protein, 13 aa, Cryptosporidium parvum
DSYSRSRDREPTY

SEQ ID NO: 2347213 - protein, 7 aa, Cryptosporidium parvum
DTASTKI

SEQ ID NO: 2347214 - protein, 12 aa, Cryptosporidium parvum
DTEDKARNQEGR

SEQ ID NO: 2347215 - protein, 13 aa, Cryptosporidium parvum
DTEKETTDSSLKP

SEQ ID NO: 2347216 - protein, 6 aa, Cryptosporidium parvum
DTEPRI

SEQ ID NO: 2347217 - protein, 25 aa, Cryptosporidium parvum
DTESKLNKVNSDSLKLQKSDSNNDN

SEQ ID NO: 2347218 - protein, 5 aa, Cryptosporidium parvum
DTGDF

SEQ ID NO: 2347219 - protein, 9 aa, Cryptosporidium parvum
DTGNNNKGF

SEQ ID NO: 2347220 - protein, 11 aa, Cryptosporidium parvum
DTGSDLTDEKA

SEQ ID NO: 2347221 - protein, 5 aa, Cryptosporidium parvum
DTHPT

SEQ ID NO: 2347222 - protein, 9 aa, Cryptosporidium parvum
DTIEQARQK

SEQ ID NO: 2347223 - protein, 69 aa, Cryptosporidium parvum
DTLKSNSPKNSTNQTGGSSKDNLDSNKAKDSKKSREKFNSLENSKSSKREASKKSDLDEKQKVKKPESS

SEQ ID NO: 2347224 - protein, 6 aa, Cryptosporidium parvum
DTNEKS

SEQ ID NO: 2347225 - protein, 6 aa, Cryptosporidium parvum
DTNEYF

SEQ ID NO: 2347226 - protein, 5 aa, Cryptosporidium parvum
DTNIG

SEQ ID NO: 2347227 - protein, 8 aa, Cryptosporidium parvum
DTNKYTQE

SEQ ID NO: 2347228 - protein, 7 aa, Cryptosporidium parvum
DTNQHQQ

SEQ ID NO: 2347229 - protein, 7 aa, Cryptosporidium parvum
DTPEYEP

SEQ ID NO: 2347230 - protein, 23 aa, Cryptosporidium parvum
DTPKQQTTINSSNDMRTSIKYDD

SEQ ID NO: 2347231 - protein, 4 aa, Cryptosporidium parvum
DTPT

SEQ ID NO: 2347232 - protein, 10 aa, Cryptosporidium parvum
DTSESENPFN

SEQ ID NO: 2347233 - protein, 9 aa, Cryptosporidium parvum
DTSGTKSNL

SEQ ID NO: 2347234 - protein, 10 aa, Cryptosporidium parvum
DTSHTNENDS

SEQ ID NO: 2347235 - protein, 8 aa, Cryptosporidium parvum
DTSKPQIQ

SEQ ID NO: 2347236 - protein, 7 aa, Cryptosporidium parvum
DTTERTL

SEQ ID NO: 2347237 - protein, 6 aa, Cryptosporidium parvum
DTTKIS

SEQ ID NO: 2347238 - protein, 22 aa, Cryptosporidium parvum
DTTNNSNNNNNNNNNNNNNNMA

SEQ ID NO: 2347239 - protein, 6 aa, Cryptosporidium parvum
DTTNPE

SEQ ID NO: 2347240 - protein, 6 aa, Cryptosporidium parvum
DTYTDS

SEQ ID NO: 2347241 - protein, 4 aa, Cryptosporidium parvum
DVED

SEQ ID NO: 2347242 - protein, 11 aa, Cryptosporidium parvum
DVEEEEEKTDF

SEQ ID NO: 2347243 - protein, 8 aa, Cryptosporidium parvum
DVNPTQNT

SEQ ID NO: 2347244 - protein, 13 aa, Cryptosporidium parvum
DVQEEKKKEKSQK

SEQ ID NO: 2347245 - protein, 6 aa, Cryptosporidium parvum
DVSPNK

SEQ ID NO: 2347246 - protein, 8 aa, Cryptosporidium parvum
DVSTQQSF

SEQ ID NO: 2347247 - protein, 4 aa, Cryptosporidium parvum
DVTE

SEQ ID NO: 2347248 - protein, 7 aa, Cryptosporidium parvum
DYDGSPP

SEQ ID NO: 2347249 - protein, 5 aa, Cryptosporidium parvum
DYDTG

SEQ ID NO: 2347250 - protein, 14 aa, Cryptosporidium parvum
DYEAGSKSPNVSTK

SEQ ID NO: 2347251 - protein, 17 aa, Cryptosporidium parvum
DYGKRKYTASTQSSTED

SEQ ID NO: 2347252 - protein, 9 aa, Cryptosporidium parvum
DYGNGASVE

SEQ ID NO: 2347253 - protein, 11 aa, Cryptosporidium parvum
DYKPDPTPAYN

SEQ ID NO: 2347254 - protein, 7 aa, Cryptosporidium parvum
DYSHSDY

SEQ ID NO: 2347255 - protein, 45 aa, Cryptosporidium parvum; identical to SEQ ID NO: 2139112

SEQ ID NO: 2347256 - protein, 7 aa, Cryptosporidium parvum
EAESNMN

SEQ ID NO: 2347257 - protein, 10 aa, Cryptosporidium parvum
EAETGSGKTA

SEQ ID NO: 2347258 - protein, 18 aa, Cryptosporidium parvum
EAETRNEDTIDNRRKRGS

SEQ ID NO: 2347259 - protein, 7 aa, Cryptosporidium parvum
EAGNDPL

SEQ ID NO: 2347260 - protein, 16 aa, Cryptosporidium parvum
EAIGRTKEEKLKTEEF

SEQ ID NO: 2347261 - protein, 4 aa, Cryptosporidium parvum
EAKD

SEQ ID NO: 2347262 - protein, 11 aa, Cryptosporidium parvum
EANPEKDIQTK

SEQ ID NO: 2347263 - protein, 7 aa, Cryptosporidium parvum
EANSRQS

SEQ ID NO: 2347264 - protein, 9 aa, Cryptosporidium parvum
EARNNPSYF

SEQ ID NO: 2347265 - protein, 7 aa, Cryptosporidium parvum
EATSKGP

SEQ ID NO: 2347266 - protein, 8 aa, Cryptosporidium parvum
EAVPGDNV

SEQ ID NO: 2347267 - protein, 15 aa, Cryptosporidium parvum
ECEEVSKDLNKEGIS

SEQ ID NO: 2347268 - protein, 6 aa, Cryptosporidium parvum
EDCRNN

SEQ ID NO: 2347269 - protein, 18 aa, Cryptosporidium parvum
EDDFPHKEKGYIYLYRRT

SEQ ID NO: 2347270 - protein, 29 aa, Cryptosporidium parvum
EDDVPDDEDDEEPKGEPDCSNKCCDSEHK

SEQ ID NO: 2347271 - protein, 13 aa, Cryptosporidium parvum
EDEEDDEEDEEDD

SEQ ID NO: 2347272 - protein, 4 aa, Cryptosporidium parvum
EDEI

SEQ ID NO: 2347273 - protein, 5 aa, Cryptosporidium parvum
EDEIP

SEQ ID NO: 2347274 - protein, 6 aa, Cryptosporidium parvum
EDFAAP

SEQ ID NO: 2347275 - protein, 4 aa, Cryptosporidium parvum
EDFK

SEQ ID NO: 2347276 - protein, 7 aa, Cryptosporidium parvum
EDGDKPL

SEQ ID NO: 2347277 - protein, 35 aa, Cryptosporidium parvum; identical to SEQ ID NO: 2139300

SEQ ID NO: 2347278 - protein, 14 aa, Cryptosporidium parvum
EDISPEEKEEKRNL

SEQ ID NO: 2347279 - protein, 27 aa, Cryptosporidium parvum
EDKSSKNDKDSSPEKDSKNNKEDIISS

SEQ ID NO: 2347280 - protein, 8 aa, Cryptosporidium parvum
EDKSTNIY

SEQ ID NO: 2347281 - protein, 8 aa, Cryptosporidium parvum
EDKSVDPF

SEQ ID NO: 2347282 - protein, 7 aa, Cryptosporidium parvum
EDKTQTA

SEQ ID NO: 2347283 - protein, 5 aa, Cryptosporidium parvum
EDLET

SEQ ID NO: 2347284 - protein, 6 aa, Cryptosporidium parvum
EDLPDD

SEQ ID NO: 2347285 - protein, 17 aa, Cryptosporidium parvum
EDLSDKPDNKNGIENNK

SEQ ID NO: 2347286 - protein, 24 aa, Cryptosporidium parvum
EDNEKLNYKDTCDSAYDNSKVEEL

SEQ ID NO: 2347287 - protein, 12 aa, Cryptosporidium parvum
EDNKEESQNGSI

SEQ ID NO: 2347288 - protein, 8 aa, Cryptosporidium parvum
EDNSEECK

SEQ ID NO: 2347289 - protein, 8 aa, Cryptosporidium parvum
EDPTGAQY

SEQ ID NO: 2347290 - protein, 7 aa, Cryptosporidium parvum
EDRQHER

SEQ ID NO: 2347291 - protein, 9 aa, Cryptosporidium parvum
EDSLTSDEL

SEQ ID NO: 2347292 - protein, 8 aa, Cryptosporidium parvum
EDSQGRTH

SEQ ID NO: 2347293 - protein, 13 aa, Cryptosporidium parvum
EDTGESQSNAQSN

SEQ ID NO: 2347294 - protein, 16 aa, Cryptosporidium parvum
EDTKKTSGAAVSDDNY

SEQ ID NO: 2347295 - protein, 14 aa, Cryptosporidium parvum
EDTQKSLTRAITSE

SEQ ID NO: 2347296 - protein, 12 aa, Cryptosporidium parvum
EDVNKEQTNTIR

SEQ ID NO: 2347297 - protein, 13 aa, Cryptosporidium parvum
EEARENWSQNGDL

SEQ ID NO: 2347298 - protein, 4 aa, Cryptosporidium parvum
EEAT

SEQ ID NO: 2347299 - protein, 12 aa, Cryptosporidium parvum
EEAYSRKAHNRA

SEQ ID NO: 2347300 - protein, 4 aa, Cryptosporidium parvum
EECG

SEQ ID NO: 2347301 - protein, 5 aa, Cryptosporidium parvum
EEDAK

SEQ ID NO: 2347302 - protein, 7 aa, Cryptosporidium parvum
EEDARAA

SEQ ID NO: 2347303 - protein, 9 aa, Cryptosporidium parvum
EEDESRQQI

SEQ ID NO: 2347304 - protein, 11 aa, Cryptosporidium parvum
EEEIKKETARL

SEQ ID NO: 2347305 - protein, 80 aa, Cryptosporidium parvum
EEELPQRSEDEEEEEEEEEEEEEESQDDEIDSEDSDNDSPPKKRKKSSEGRDRSVSSLKHSKRSSNSGKKKSSKKRSYNN

SEQ ID NO: 2347306 - protein, 4 aa, Cryptosporidium parvum
EEFS

SEQ ID NO: 2347307 - protein, 10 aa, Cryptosporidium parvum
EEGENNSSII

SEQ ID NO: 2347308 - protein, 12 aa, Cryptosporidium parvum
EEGGANGINNGY

SEQ ID NO: 2347309 - protein, 9 aa, Cryptosporidium parvum
EEGNTTQSE

SEQ ID NO: 2347310 - protein, 5 aa, Cryptosporidium parvum
EEGTE

SEQ ID NO: 2347311 - protein, 10 aa, Cryptosporidium parvum
EEGVDEGGVQ

SEQ ID NO: 2347312 - protein, 10 aa, Cryptosporidium parvum
EEGVNTSTSV

SEQ ID NO: 2347313 - protein, 4 aa, Cryptosporidium parvum
EEHG

SEQ ID NO: 2347314 - protein, 30 aa, Cryptosporidium parvum; identical to SEQ ID NO: 2255410

SEQ ID NO: 2347315 - protein, 4 aa, Cryptosporidium parvum
EEID

SEQ ID NO: 2347316 - protein, 4 aa, Cryptosporidium parvum
EEIT

SEQ ID NO: 2347317 - protein, 7 aa, Cryptosporidium parvum
EEITSKE

SEQ ID NO: 2347318 - protein, 6 aa, Cryptosporidium parvum
EEKENL

SEQ ID NO: 2347319 - protein, 7 aa, Cryptosporidium parvum
EEKERIN

SEQ ID NO: 2347320 - protein, 6 aa, Cryptosporidium parvum
EEKRQH

SEQ ID NO: 2347321 - protein, 12 aa, Cryptosporidium parvum
EELDRSSGSRGV

SEQ ID NO: 2347322 - protein, 44 aa, Cryptosporidium parvum; identical to SEQ ID NO: 2255473

SEQ ID NO: 2347323 - protein, 6 aa, Cryptosporidium parvum
EENAGV

SEQ ID NO: 2347324 - protein, 21 aa, Cryptosporidium parvum
EENEQNHKKDLNNKKSKNQRK

SEQ ID NO: 2347325 - protein, 4 aa, Cryptosporidium parvum
EENG

SEQ ID NO: 2347326 - protein, 9 aa, Cryptosporidium parvum
EENKSLERK

SEQ ID NO: 2347327 - protein, 4 aa, Cryptosporidium parvum
EENS

SEQ ID NO: 2347328 - protein, 16 aa, Cryptosporidium parvum
EENTRLRSGNNSTNLQ

SEQ ID NO: 2347329 - protein, 20 aa, Cryptosporidium parvum
EENTTDNSGEKQEASKPNLQ

SEQ ID NO: 2347330 - protein, 10 aa, Cryptosporidium parvum
EENVKDPREI

SEQ ID NO: 2347331 - protein, 15 aa, Cryptosporidium parvum
EEQDPTMNFDINGDE

SEQ ID NO: 2347332 - protein, 20 aa, Cryptosporidium parvum
EEQIEEEEHATPSSNDSFST

SEQ ID NO: 2347333 - protein, 18 aa, Cryptosporidium parvum
EEQKPAGKPEESKENESL

SEQ ID NO: 2347334 - protein, 4 aa, Cryptosporidium parvum
EERK

SEQ ID NO: 2347335 - protein, 10 aa, Cryptosporidium parvum
EERNLSNSEL

SEQ ID NO: 2347336 - protein, 4 aa, Cryptosporidium parvum
EERT

SEQ ID NO: 2347337 - protein, 8 aa, Cryptosporidium parvum
EESAKETN

SEQ ID NO: 2347338 - protein, 9 aa, Cryptosporidium parvum
EESRGDGEI

SEQ ID NO: 2347339 - protein, 4 aa, Cryptosporidium parvum
EESS

SEQ ID NO: 2347340 - protein, 4 aa, Cryptosporidium parvum
EETI

SEQ ID NO: 2347341 - protein, 7 aa, Cryptosporidium parvum
EETKNEL

SEQ ID NO: 2347342 - protein, 31 aa, Cryptosporidium parvum; identical to SEQ ID NO: 2255621

SEQ ID NO: 2347343 - protein, 7 aa, Cryptosporidium parvum
EETRQGL

SEQ ID NO: 2347344 - protein, 6 aa, Cryptosporidium parvum
EETTRL

SEQ ID NO: 2347345 - protein, 5 aa, Cryptosporidium parvum
EEVET

SEQ ID NO: 2347346 - protein, 10 aa, Cryptosporidium parvum
EEYAGNPNAC

SEQ ID NO: 2347347 - protein, 9 aa, Cryptosporidium parvum
EEYKHSLGS

SEQ ID NO: 2347348 - protein, 26 aa, Cryptosporidium parvum
EEYKSEESQRRNEEKENESNKAFQSL

SEQ ID NO: 2347349 - protein, 6 aa, Cryptosporidium parvum
EEYNTN

SEQ ID NO: 2347350 - protein, 9 aa, Cryptosporidium parvum
EFKRSDKDL

SEQ ID NO: 2347351 - protein, 9 aa, Cryptosporidium parvum
EFNNENEYN

SEQ ID NO: 2347352 - protein, 6 aa, Cryptosporidium parvum
EFPGQD

SEQ ID NO: 2347353 - protein, 27 aa, Cryptosporidium parvum
EGEEDDDDEDDDDEMVDEEVDDGASSR

SEQ ID NO: 2347354 - protein, 7 aa, Cryptosporidium parvum
EGEEDVR

SEQ ID NO: 2347355 - protein, 9 aa, Cryptosporidium parvum
EGEGELGEH

SEQ ID NO: 2347356 - protein, 7 aa, Cryptosporidium parvum
EGEVQTP

SEQ ID NO: 2347357 - protein, 9 aa, Cryptosporidium parvum
EGGDNENNN

SEQ ID NO: 2347358 - protein, 24 aa, Cryptosporidium parvum
EGKNKLEVQDEDEDKKSRIDPKDL

SEQ ID NO: 2347359 - protein, 4 aa, Cryptosporidium parvum
EGKV

SEQ ID NO: 2347360 - protein, 12 aa, Cryptosporidium parvum
EGKWGHPERPLS

SEQ ID NO: 2347361 - protein, 4 aa, Cryptosporidium parvum
EGNG

SEQ ID NO: 2347362 - protein, 25 aa, Cryptosporidium parvum
EGNNFSPEKENAQQGADYTNSVPPP

SEQ ID NO: 2347363 - protein, 13 aa, Cryptosporidium parvum
EGNNTISERDTDH

SEQ ID NO: 2347364 - protein, 9 aa, Cryptosporidium parvum
EGNSEEEKV

SEQ ID NO: 2347365 - protein, 11 aa, Cryptosporidium parvum
EGRDNNNLNSQ

SEQ ID NO: 2347366 - protein, 12 aa, Cryptosporidium parvum
EGRFSPDESTSR

SEQ ID NO: 2347367 - protein, 22 aa, Cryptosporidium parvum
EGRVDTQLDSSNLQSKLSSREF

SEQ ID NO: 2347368 - protein, 7 aa, Cryptosporidium parvum
EGSESTI

SEQ ID NO: 2347369 - protein, 6 aa, Cryptosporidium parvum
EGSLED

SEQ ID NO: 2347370 - protein, 6 aa, Cryptosporidium parvum
EGSNRE

SEQ ID NO: 2347371 - protein, 6 aa, Cryptosporidium parvum
EGSVPD

SEQ ID NO: 2347372 - protein, 7 aa, Cryptosporidium parvum
EGVPNSH

SEQ ID NO: 2347373 - protein, 10 aa, Cryptosporidium parvum
EHKNSNSTDV

SEQ ID NO: 2347374 - protein, 4 aa, Cryptosporidium parvum
EHSG

SEQ ID NO: 2347375 - protein, 6 aa, Cryptosporidium parvum
EHYQRS

SEQ ID NO: 2347376 - protein, 8 aa, Cryptosporidium parvum
EIAAPSPY

SEQ ID NO: 2347377 - protein, 4 aa, Cryptosporidium parvum
EIDE

SEQ ID NO: 2347378 - protein, 21 aa, Cryptosporidium parvum
EIDPKTSESSPLKTNSGAELD

SEQ ID NO: 2347379 - protein, 11 aa, Cryptosporidium parvum
EIEEDGRGNRV

SEQ ID NO: 2347380 - protein, 21 aa, Cryptosporidium parvum
EIEGTGEAEADMEQNIETETE

SEQ ID NO: 2347381 - protein, 9 aa, Cryptosporidium parvum
EIENPKNHC

SEQ ID NO: 2347382 - protein, 11 aa, Cryptosporidium parvum
EIEQAEKKKMY

SEQ ID NO: 2347383 - protein, 6 aa, Cryptosporidium parvum
EIGESI

SEQ ID NO: 2347384 - protein, 18 aa, Cryptosporidium parvum
EIKKREKEFDSLKAEQEK

SEQ ID NO: 2347385 - protein, 16 aa, Cryptosporidium parvum
EIPETESKKENESNDI

SEQ ID NO: 2347386 - protein, 16 aa, Cryptosporidium parvum
EIPKGSVPGSSSQKNI

SEQ ID NO: 2347387 - protein, 6 aa, Cryptosporidium parvum
EIPQNE

SEQ ID NO: 2347388 - protein, 9 aa, Cryptosporidium parvum
EIRANSEKT

SEQ ID NO: 2347389 - protein, 4 aa, Cryptosporidium parvum
EISD

SEQ ID NO: 2347390 - protein, 9 aa, Cryptosporidium parvum
EISKSSINE

SEQ ID NO: 2347391 - protein, 10 aa, Cryptosporidium parvum
EISRKDNKLE

SEQ ID NO: 2347392 - protein, 4 aa, Cryptosporidium parvum
EITN

SEQ ID NO: 2347393 - protein, 12 aa, Cryptosporidium parvum
EITNSNNGTMNG

SEQ ID NO: 2347394 - protein, 16 aa, Cryptosporidium parvum
EITQKTEYNKSDLNEN

SEQ ID NO: 2347395 - protein, 4 aa, Cryptosporidium parvum
EKAK

SEQ ID NO: 2347396 - protein, 5 aa, Cryptosporidium parvum
EKCGS

SEQ ID NO: 2347397 - protein, 25 aa, Cryptosporidium parvum
EKCQNSNGNENNNNDEFEDDEFGDA

SEQ ID NO: 2347398 - protein, 6 aa, Cryptosporidium parvum
EKCSCE

SEQ ID NO: 2347399 - protein, 10 aa, Cryptosporidium parvum
EKDEDNITSL

SEQ ID NO: 2347400 - protein, 8 aa, Cryptosporidium parvum
EKDESTGL

SEQ ID NO: 2347401 - protein, 8 aa, Cryptosporidium parvum
EKDNENRL

SEQ ID NO: 2347402 - protein, 7 aa, Cryptosporidium parvum
EKEKLKD

SEQ ID NO: 2347403 - protein, 11 aa, Cryptosporidium parvum
EKESDEQDSEV

SEQ ID NO: 2347404 - protein, 7 aa, Cryptosporidium parvum
EKESKGC

SEQ ID NO: 2347405 - protein, 11 aa, Cryptosporidium parvum
EKESSEMGKGS

SEQ ID NO: 2347406 - protein, 10 aa, Cryptosporidium parvum
EKESSNELSK

SEQ ID NO: 2347407 - protein, 5 aa, Cryptosporidium parvum
EKETK

SEQ ID NO: 2347408 - protein, 7 aa, Cryptosporidium parvum
EKGLRGD

SEQ ID NO: 2347409 - protein, 5 aa, Cryptosporidium parvum
EKGNG

SEQ ID NO: 2347410 - protein, 5 aa, Cryptosporidium parvum
EKIKS

SEQ ID NO: 2347411 - protein, 4 aa, Cryptosporidium parvum
EKIS

SEQ ID NO: 2347412 - protein, 22 aa, Cryptosporidium parvum
EKKEGNSNWSKSDTTSSISKSN

SEQ ID NO: 2347413 - protein, 7 aa, Cryptosporidium parvum
EKKNSYV

SEQ ID NO: 2347414 - protein, 6 aa, Cryptosporidium parvum
EKKPNG

SEQ ID NO: 2347415 - protein, 21 aa, Cryptosporidium parvum
EKKPSVKKEKPTVQEKDPRIV

SEQ ID NO: 2347416 - protein, 8 aa, Cryptosporidium parvum
EKKQKNSN

SEQ ID NO: 2347417 - protein, 7 aa, Cryptosporidium parvum
EKKQSEF

SEQ ID NO: 2347418 - protein, 8 aa, Cryptosporidium parvum
EKKSGIQS

SEQ ID NO: 2347419 - protein, 5 aa, Cryptosporidium parvum
EKKSI

SEQ ID NO: 2347420 - protein, 15 aa, Cryptosporidium parvum
EKKSRSDLQVNNETE

SEQ ID NO: 2347421 - protein, 5 aa, Cryptosporidium parvum
EKLET

SEQ ID NO: 2347422 - protein, 8 aa, Cryptosporidium parvum
EKLKQEEN

SEQ ID NO: 2347423 - protein, 41 aa, Cryptosporidium parvum; identical to SEQ ID NO: 2256217

SEQ ID NO: 2347424 - protein, 9 aa, Cryptosporidium parvum
EKNKKFEKK

SEQ ID NO: 2347425 - protein, 12 aa, Cryptosporidium parvum
EKNNSIDTTQNN

SEQ ID NO: 2347426 - protein, 6 aa, Cryptosporidium parvum
EKNSEY

SEQ ID NO: 2347427 - protein, 43 aa, Cryptosporidium parvum; identical to SEQ ID NO: 2256239

SEQ ID NO: 2347428 - protein, 28 aa, Cryptosporidium parvum
EKNTTSKPTSKSVKPKKSPVAKLTTKTN

SEQ ID NO: 2347429 - protein, 5 aa, Cryptosporidium parvum
EKPRN

SEQ ID NO: 2347430 - protein, 11 aa, Cryptosporidium parvum
EKPSWKPEEGK

SEQ ID NO: 2347431 - protein, 24 aa, Cryptosporidium parvum
EKPSYNDSESNSDTIDCSQESISV

SEQ ID NO: 2347432 - protein, 9 aa, Cryptosporidium parvum
EKQNTTCEQ

SEQ ID NO: 2347433 - protein, 23 aa, Cryptosporidium parvum
EKQPRSFSNSSRASRTNVTTPKG

SEQ ID NO: 2347434 - protein, 9 aa, Cryptosporidium parvum
EKQPSTNEG

SEQ ID NO: 2347435 - protein, 10 aa, Cryptosporidium parvum
EKQSQIISQQ

SEQ ID NO: 2347436 - protein, 10 aa, Cryptosporidium parvum
EKREDNEKPV

SEQ ID NO: 2347437 - protein, 16 aa, Cryptosporidium parvum
EKRRSISKKRSEEDLS

SEQ ID NO: 2347438 - protein, 9 aa, Cryptosporidium parvum
EKRTKDNIK

SEQ ID NO: 2347439 - protein, 13 aa, Cryptosporidium parvum
EKSAEEKKTEMIE

SEQ ID NO: 2347440 - protein, 7 aa, Cryptosporidium parvum
EKSEEQN

SEQ ID NO: 2347441 - protein, 8 aa, Cryptosporidium parvum
EKSGINKN

SEQ ID NO: 2347442 - protein, 7 aa, Cryptosporidium parvum
EKSKSQV

SEQ ID NO: 2347443 - protein, 5 aa, Cryptosporidium parvum
EKSKW

SEQ ID NO: 2347444 - protein, 8 aa, Cryptosporidium parvum
EKSNSELE

SEQ ID NO: 2347445 - protein, 14 aa, Cryptosporidium parvum
EKSRHSNQNITTKT

SEQ ID NO: 2347446 - protein, 16 aa, Cryptosporidium parvum
EKTDDSSKKGPQLSLK

SEQ ID NO: 2347447 - protein, 8 aa, Cryptosporidium parvum
EKTGKETE

SEQ ID NO: 2347448 - protein, 14 aa, Cryptosporidium parvum
EKTTEKSSKYVKTP

SEQ ID NO: 2347449 - protein, 7 aa, Cryptosporidium parvum
EKVDAGL

SEQ ID NO: 2347450 - protein, 12 aa, Cryptosporidium parvum
EKVETGTARSSC

SEQ ID NO: 2347451 - protein, 7 aa, Cryptosporidium parvum
EKVGQQG

SEQ ID NO: 2347452 - protein, 6 aa, Cryptosporidium parvum
EKVSTL

SEQ ID NO: 2347453 - protein, 10 aa, Cryptosporidium parvum
ELAQSEAHYD

SEQ ID NO: 2347454 - protein, 7 aa, Cryptosporidium parvum
ELARSES

SEQ ID NO: 2347455 - protein, 5 aa, Cryptosporidium parvum
ELEHS

SEQ ID NO: 2347456 - protein, 11 aa, Cryptosporidium parvum
ELEPPSEREED

SEQ ID NO: 2347457 - protein, 11 aa, Cryptosporidium parvum
ELKSKDSQQCP

SEQ ID NO: 2347458 - protein, 49 aa, Cryptosporidium parvum
ELPPPPPSEELPPPPPPSEELPPPPPPSEELPPPPPPSSGELPPPLPPS

SEQ ID NO: 2347459 - protein, 14 aa, Cryptosporidium parvum
ELQRQEDELASNIF

SEQ ID NO: 2347460 - protein, 5 aa, Cryptosporidium parvum
ELRDI

SEQ ID NO: 2347461 - protein, 9 aa, Cryptosporidium parvum
ELRSKNDNC

SEQ ID NO: 2347462 - protein, 21 aa, Cryptosporidium parvum
ELSISTEEANVNESAPESEHY

SEQ ID NO: 2347463 - protein, 28 aa, Cryptosporidium parvum
ELSSSGSSTVSSSSMTDAFPTSQSSSSL

SEQ ID NO: 2347464 - protein, 6 aa, Cryptosporidium parvum
ELTERK

SEQ ID NO: 2347465 - protein, 7 aa, Cryptosporidium parvum
EMGRKDQ

SEQ ID NO: 2347466 - protein, 7 aa, Cryptosporidium parvum
ENAASLT

SEQ ID NO: 2347467 - protein, 7 aa, Cryptosporidium parvum
ENADGSA

SEQ ID NO: 2347468 - protein, 6 aa, Cryptosporidium parvum
ENAPKS

SEQ ID NO: 2347469 - protein, 6 aa, Cryptosporidium parvum
ENAQDT

SEQ ID NO: 2347470 - protein, 4 aa, Cryptosporidium parvum
ENAT

SEQ ID NO: 2347471 - protein, 15 aa, Cryptosporidium parvum
ENDDDSSPGKKKAKS

SEQ ID NO: 2347472 - protein, 7 aa, Cryptosporidium parvum
ENDHDKI

SEQ ID NO: 2347473 - protein, 4 aa, Cryptosporidium parvum
ENDK

SEQ ID NO: 2347474 - protein, 7 aa, Cryptosporidium parvum
ENDKDFT

SEQ ID NO: 2347475 - protein, 10 aa, Cryptosporidium parvum
ENDNSVSYEQ

SEQ ID NO: 2347476 - protein, 7 aa, Cryptosporidium parvum
ENDQSIN

SEQ ID NO: 2347477 - protein, 6 aa, Cryptosporidium parvum
ENDSDF

SEQ ID NO: 2347478 - protein, 6 aa, Cryptosporidium parvum
ENDTFE

SEQ ID NO: 2347479 - protein, 7 aa, Cryptosporidium parvum
ENDVSTE

SEQ ID NO: 2347480 - protein, 23 aa, Cryptosporidium parvum
ENEDPSSKITDIGGEGNVTTMGG

SEQ ID NO: 2347481 - protein, 15 aa, Cryptosporidium parvum
ENEELRSKLELTRTT

SEQ ID NO: 2347482 - protein, 10 aa, Cryptosporidium parvum
ENEIGAKESM

SEQ ID NO: 2347483 - protein, 9 aa, Cryptosporidium parvum
ENEKIKDNS

SEQ ID NO: 2347484 - protein, 6 aa, Cryptosporidium parvum
ENEKSY

SEQ ID NO: 2347485 - protein, 8 aa, Cryptosporidium parvum
ENENTLQK

SEQ ID NO: 2347486 - protein, 6 aa, Cryptosporidium parvum
ENEPNM

SEQ ID NO: 2347487 - protein, 10 aa, Cryptosporidium parvum
ENESKEIPKS

SEQ ID NO: 2347488 - protein, 6 aa, Cryptosporidium parvum
ENGADG

SEQ ID NO: 2347489 - protein, 12 aa, Cryptosporidium parvum
ENHSSSCPSAEN

SEQ ID NO: 2347490 - protein, 5 aa, Cryptosporidium parvum
ENIGS

SEQ ID NO: 2347491 - protein, 4 aa, Cryptosporidium parvum
ENIQ

SEQ ID NO: 2347492 - protein, 4 aa, Cryptosporidium parvum
ENKE

SEQ ID NO: 2347493 - protein, 6 aa, Cryptosporidium parvum
ENKFHP

SEQ ID NO: 2347494 - protein, 5 aa, Cryptosporidium parvum
ENKKM

SEQ ID NO: 2347495 - protein, 19 aa, Cryptosporidium parvum
ENKNTTKEESKGEENNTNN

SEQ ID NO: 2347496 - protein, 7 aa, Cryptosporidium parvum
ENKYSRS

SEQ ID NO: 2347497 - protein, 6 aa, Cryptosporidium parvum
ENLTRS

SEQ ID NO: 2347498 - protein, 4 aa, Cryptosporidium parvum
ENNE

SEQ ID NO: 2347499 - protein, 15 aa, Cryptosporidium parvum
ENNIKENSNYTKKGN

SEQ ID NO: 2347500 - protein, 7 aa, Cryptosporidium parvum
ENNKETK

SEQ ID NO: 2347501 - protein, 7 aa, Cryptosporidium parvum
ENNSASL

SEQ ID NO: 2347502 - protein, 4 aa, Cryptosporidium parvum
ENPD

SEQ ID NO: 2347503 - protein, 9 aa, Cryptosporidium parvum
ENPDSAKAA

SEQ ID NO: 2347504 - protein, 9 aa, Cryptosporidium parvum
ENPNSNEYR

SEQ ID NO: 2347505 - protein, 17 aa, Cryptosporidium parvum
ENQDNDQNLSSNSVPTN

SEQ ID NO: 2347506 - protein, 16 aa, Cryptosporidium parvum
ENQDSSKDPENSNNYS

SEQ ID NO: 2347507 - protein, 7 aa, Cryptosporidium parvum
ENQNSNL

SEQ ID NO: 2347508 - protein, 7 aa, Cryptosporidium parvum
ENRSKEN

SEQ ID NO: 2347509 - protein, 11 aa, Cryptosporidium parvum
ENSERNQDMET

SEQ ID NO: 2347510 - protein, 10 aa, Cryptosporidium parvum
ENSESENIRP

SEQ ID NO: 2347511 - protein, 6 aa, Cryptosporidium parvum
ENSGNS

SEQ ID NO: 2347512 - protein, 8 aa, Cryptosporidium parvum
ENSIGNNN

SEQ ID NO: 2347513 - protein, 14 aa, Cryptosporidium parvum
ENSNTLDSKHHRSR

SEQ ID NO: 2347514 - protein, 24 aa, Cryptosporidium parvum
ENSNVQNQANIKSNTNSNRITTNS

SEQ ID NO: 2347515 - protein, 5 aa, Cryptosporidium parvum
ENSPL

SEQ ID NO: 2347516 - protein, 5 aa, Cryptosporidium parvum
ENSPR

SEQ ID NO: 2347517 - protein, 8 aa, Cryptosporidium parvum
ENSRFEKK

SEQ ID NO: 2347518 - protein, 10 aa, Cryptosporidium parvum
ENSSNFPNDK

SEQ ID NO: 2347519 - protein, 9 aa, Cryptosporidium parvum
ENSTGEEKL

SEQ ID NO: 2347520 - protein, 8 aa, Cryptosporidium parvum
EPEDDDPL

SEQ ID NO: 2347521 - protein, 5 aa, Cryptosporidium parvum
EPGEK

SEQ ID NO: 2347522 - protein, 5 aa, Cryptosporidium parvum
EPIAS

SEQ ID NO: 2347523 - protein, 6 aa, Cryptosporidium parvum
EPIDTH

SEQ ID NO: 2347524 - protein, 4 aa, Cryptosporidium parvum
EPPG

SEQ ID NO: 2347525 - protein, 5 aa, Cryptosporidium parvum
EPQNT

SEQ ID NO: 2347526 - protein, 7 aa, Cryptosporidium parvum
EPQTRES

SEQ ID NO: 2347527 - protein, 4 aa, Cryptosporidium parvum
EPSG

SEQ ID NO: 2347528 - protein, 11 aa, Cryptosporidium parvum
EPSKELSGGTF

SEQ ID NO: 2347529 - protein, 30 aa, Cryptosporidium parvum; identical to SEQ ID NO: 2140927

SEQ ID NO: 2347530 - protein, 6 aa, Cryptosporidium parvum
EPSSDW

SEQ ID NO: 2347531 - protein, 6 aa, Cryptosporidium parvum
EPTDRR

SEQ ID NO: 2347532 - protein, 5 aa, Cryptosporidium parvum
EPVDD

SEQ ID NO: 2347533 - protein, 8 aa, Cryptosporidium parvum
EQARATKT

SEQ ID NO: 2347534 - protein, 11 aa, Cryptosporidium parvum
EQEKSWKQREA

SEQ ID NO: 2347535 - protein, 20 aa, Cryptosporidium parvum
EQELETSPTNKQDQPNNPVE

SEQ ID NO: 2347536 - protein, 6 aa, Cryptosporidium parvum
EQHNQL

SEQ ID NO: 2347537 - protein, 5 aa, Cryptosporidium parvum
EQKED

SEQ ID NO: 2347538 - protein, 9 aa, Cryptosporidium parvum
EQKSGNNSE

SEQ ID NO: 2347539 - protein, 12 aa, Cryptosporidium parvum
EQLGSKGEMRRQ

SEQ ID NO: 2347540 - protein, 9 aa, Cryptosporidium parvum
EQNRRTDEK

SEQ ID NO: 2347541 - protein, 7 aa, Cryptosporidium parvum
EQQTQAK

SEQ ID NO: 2347542 - protein, 25 aa, Cryptosporidium parvum
EQRHQEQFNSEAPKVQSSGNEYSVP

SEQ ID NO: 2347543 - protein, 5 aa, Cryptosporidium parvum
EQRNV

SEQ ID NO: 2347544 - protein, 5 aa, Cryptosporidium parvum
EQRQE

SEQ ID NO: 2347545 - protein, 47 aa, Cryptosporidium parvum; identical to SEQ ID NO: 2257172

SEQ ID NO: 2347546 - protein, 4 aa, Cryptosporidium parvum
EQTI

SEQ ID NO: 2347547 - protein, 9 aa, Cryptosporidium parvum
EQVEDQQAD

SEQ ID NO: 2347548 - protein, 7 aa, Cryptosporidium parvum
EQYQDEL

SEQ ID NO: 2347549 - protein, 6 aa, Cryptosporidium parvum
ERAHTP

SEQ ID NO: 2347550 - protein, 10 aa, Cryptosporidium parvum
ERDYDSKSDL

SEQ ID NO: 2347551 - protein, 9 aa, Cryptosporidium parvum
ERGNSTNNT

SEQ ID NO: 2347552 - protein, 4 aa, Cryptosporidium parvum
ERIE

SEQ ID NO: 2347553 - protein, 8 aa, Cryptosporidium parvum
ERKEREKL

SEQ ID NO: 2347554 - protein, 18 aa, Cryptosporidium parvum
ERKNQAQQALEKKKHELE

SEQ ID NO: 2347555 - protein, 29 aa, Cryptosporidium parvum
ERKRGKRYKSSANCSSTSNSCNNSGAGTG

SEQ ID NO: 2347556 - protein, 5 aa, Cryptosporidium parvum
ERKSK

SEQ ID NO: 2347557 - protein, 11 aa, Cryptosporidium parvum
ERLREKNEELR

SEQ ID NO: 2347558 - protein, 5 aa, Cryptosporidium parvum
ERLTK

SEQ ID NO: 2347559 - protein, 7 aa, Cryptosporidium parvum
ERPAPEA

SEQ ID NO: 2347560 - protein, 4 aa, Cryptosporidium parvum
ERSL

SEQ ID NO: 2347561 - protein, 4 aa, Cryptosporidium parvum
ERTI

SEQ ID NO: 2347562 - protein, 13 aa, Cryptosporidium parvum
ERTKGDKEDVRSK

SEQ ID NO: 2347563 - protein, 9 aa, Cryptosporidium parvum
ERTSNTRER

SEQ ID NO: 2347564 - protein, 17 aa, Cryptosporidium parvum
ERVETKEGDEEKVTKDV

SEQ ID NO: 2347565 - protein, 6 aa, Cryptosporidium parvum
ERYRET

SEQ ID NO: 2347566 - protein, 7 aa, Cryptosporidium parvum
ERYRNSN

SEQ ID NO: 2347567 - protein, 7 aa, Cryptosporidium parvum
ESAINQE

SEQ ID NO: 2347568 - protein, 17 aa, Cryptosporidium parvum
ESASDAPKVRDDQMDSF

SEQ ID NO: 2347569 - protein, 18 aa, Cryptosporidium parvum
ESAVSQRFRTDQVEILWR

SEQ ID NO: 2347570 - protein, 9 aa, Cryptosporidium parvum
ESCNEREYN

SEQ ID NO: 2347571 - protein, 5 aa, Cryptosporidium parvum
ESDDC

SEQ ID NO: 2347572 - protein, 20 aa, Cryptosporidium parvum
ESDSYHSSESDSNHSENSQS

SEQ ID NO: 2347573 - protein, 9 aa, Cryptosporidium parvum
ESEGAKKLN

SEQ ID NO: 2347574 - protein, 8 aa, Cryptosporidium parvum
ESESENDI

SEQ ID NO: 2347575 - protein, 26 aa, Cryptosporidium parvum
ESEYASNAAEIGARRRADLERDENMG

SEQ ID NO: 2347576 - protein, 6 aa, Cryptosporidium parvum
ESFEPF

SEQ ID NO: 2347577 - protein, 8 aa, Cryptosporidium parvum
ESFRSNQR

SEQ ID NO: 2347578 - protein, 9 aa, Cryptosporidium parvum
ESGKNSLSD

SEQ ID NO: 2347579 - protein, 6 aa, Cryptosporidium parvum
ESGKYA

SEQ ID NO: 2347580 - protein, 10 aa, Cryptosporidium parvum
ESGSCPKSIK

SEQ ID NO: 2347581 - protein, 7 aa, Cryptosporidium parvum
ESHRDKN

SEQ ID NO: 2347582 - protein, 56 aa, Cryptosporidium parvum; identical to SEQ ID NO: 2257479

SEQ ID NO: 2347583 - protein, 6 aa, Cryptosporidium parvum
ESIDQF

SEQ ID NO: 2347584 - protein, 14 aa, Cryptosporidium parvum
ESIKTNSGKGKCEA

SEQ ID NO: 2347585 - protein, 41 aa, Cryptosporidium parvum; identical to SEQ ID NO: 2257495

SEQ ID NO: 2347586 - protein, 7 aa, Cryptosporidium parvum
ESISPET

SEQ ID NO: 2347587 - protein, 5 aa, Cryptosporidium parvum
ESKNE

SEQ ID NO: 2347588 - protein, 17 aa, Cryptosporidium parvum
ESKNKQDPTAKKESKLS

SEQ ID NO: 2347589 - protein, 9 aa, Cryptosporidium parvum
ESKSLKEFN

SEQ ID NO: 2347590 - protein, 8 aa, Cryptosporidium parvum
ESLATEDI

SEQ ID NO: 2347591 - protein, 7 aa, Cryptosporidium parvum
ESLHESK

SEQ ID NO: 2347592 - protein, 5 aa, Cryptosporidium parvum
ESLVN

SEQ ID NO: 2347593 - protein, 5 aa, Cryptosporidium parvum
ESMEE

SEQ ID NO: 2347594 - protein, 5 aa, Cryptosporidium parvum
ESNDS

SEQ ID NO: 2347595 - protein, 25 aa, Cryptosporidium parvum
ESNDTSLSLSSSCNSNIDSNIPSAP

SEQ ID NO: 2347596 - protein, 5 aa, Cryptosporidium parvum
ESNGE

SEQ ID NO: 2347597 - protein, 13 aa, Cryptosporidium parvum
ESNPSSNSNSGLE

SEQ ID NO: 2347598 - protein, 5 aa, Cryptosporidium parvum
ESNQL

SEQ ID NO: 2347599 - protein, 6 aa, Cryptosporidium parvum
ESNQLN

SEQ ID NO: 2347600 - protein, 5 aa, Cryptosporidium parvum
ESNQN

SEQ ID NO: 2347601 - protein, 10 aa, Cryptosporidium parvum
ESNSENEQLK

SEQ ID NO: 2347602 - protein, 10 aa, Cryptosporidium parvum
ESNSNENSNS

SEQ ID NO: 2347603 - protein, 12 aa, Cryptosporidium parvum
ESNTLSSETKDN

SEQ ID NO: 2347604 - protein, 8 aa, Cryptosporidium parvum
ESPFEGQE

SEQ ID NO: 2347605 - protein, 8 aa, Cryptosporidium parvum
ESPHKKLS

SEQ ID NO: 2347606 - protein, 4 aa, Cryptosporidium parvum
ESPQ

SEQ ID NO: 2347607 - protein, 8 aa, Cryptosporidium parvum
ESPTGTGK

SEQ ID NO: 2347608 - protein, 6 aa, Cryptosporidium parvum
ESPTKP

SEQ ID NO: 2347609 - protein, 6 aa, Cryptosporidium parvum
ESQANK

SEQ ID NO: 2347610 - protein, 6 aa, Cryptosporidium parvum
ESQDAE

SEQ ID NO: 2347611 - protein, 29 aa, Cryptosporidium parvum
ESQNDENSHHSHNNCQKSCKGSDALQPAI

SEQ ID NO: 2347612 - protein, 6 aa, Cryptosporidium parvum
ESQPKF

SEQ ID NO: 2347613 - protein, 23 aa, Cryptosporidium parvum
ESRGTDSSSSEDGNEENKESQIK

SEQ ID NO: 2347614 - protein, 4 aa, Cryptosporidium parvum
ESRY

SEQ ID NO: 2347615 - protein, 7 aa, Cryptosporidium parvum
ESSAESA

SEQ ID NO: 2347616 - protein, 7 aa, Cryptosporidium parvum
ESSANKV

SEQ ID NO: 2347617 - protein, 9 aa, Cryptosporidium parvum
ESSDPDQNM

SEQ ID NO: 2347618 - protein, 8 aa, Cryptosporidium parvum
ESSESLSN

SEQ ID NO: 2347619 - protein, 8 aa, Cryptosporidium parvum
ESSKCRSK

SEQ ID NO: 2347620 - protein, 6 aa, Cryptosporidium parvum
ESSNNF

SEQ ID NO: 2347621 - protein, 7 aa, Cryptosporidium parvum
ESSSEKI

SEQ ID NO: 2347622 - protein, 9 aa, Cryptosporidium parvum
ESSYITESG

SEQ ID NO: 2347623 - protein, 6 aa, Cryptosporidium parvum
ESTAWQ

SEQ ID NO: 2347624 - protein, 8 aa, Cryptosporidium parvum
ESTESNIE

SEQ ID NO: 2347625 - protein, 5 aa, Cryptosporidium parvum
ESTGE

SEQ ID NO: 2347626 - protein, 6 aa, Cryptosporidium parvum
ESTINS

SEQ ID NO: 2347627 - protein, 10 aa, Cryptosporidium parvum
ESTSGAKAEQ

SEQ ID NO: 2347628 - protein, 6 aa, Cryptosporidium parvum
ESVNNL

SEQ ID NO: 2347629 - protein, 17 aa, Cryptosporidium parvum
ESYNPMEENVDNKTFDP

SEQ ID NO: 2347630 - protein, 6 aa, Cryptosporidium parvum
ESYPNT

SEQ ID NO: 2347631 - protein, 17 aa, Cryptosporidium parvum
ETAESSSKKEADPPNSS

SEQ ID NO: 2347632 - protein, 6 aa, Cryptosporidium parvum
ETAEYT

SEQ ID NO: 2347633 - protein, 4 aa, Cryptosporidium parvum
ETDN

SEQ ID NO: 2347634 - protein, 9 aa, Cryptosporidium parvum
ETDNDQRLN

SEQ ID NO: 2347635 - protein, 7 aa, Cryptosporidium parvum
ETDPLSQ

SEQ ID NO: 2347636 - protein, 6 aa, Cryptosporidium parvum
ETDTKM

SEQ ID NO: 2347637 - protein, 25 aa, Cryptosporidium parvum
ETEDHFSNEGFSDSDLQSEEGEEIN

SEQ ID NO: 2347638 - protein, 14 aa, Cryptosporidium parvum
ETEGKDKLRIGESP

SEQ ID NO: 2347639 - protein, 15 aa, Cryptosporidium parvum
ETETQKEKETESKVV

SEQ ID NO: 2347640 - protein, 33 aa, Cryptosporidium parvum; identical to SEQ ID NO: 2257823

SEQ ID NO: 2347641 - protein, 10 aa, Cryptosporidium parvum
ETGSGKTTQI

SEQ ID NO: 2347642 - protein, 10 aa, Cryptosporidium parvum
ETKQSQNQKS

SEQ ID NO: 2347643 - protein, 15 aa, Cryptosporidium parvum
ETLNEPKTNSELPKV

SEQ ID NO: 2347644 - protein, 12 aa, Cryptosporidium parvum
ETLNSDNNSSFI

SEQ ID NO: 2347645 - protein, 4 aa, Cryptosporidium parvum
ETNN

SEQ ID NO: 2347646 - protein, 16 aa, Cryptosporidium parvum
ETRKDLDYSNATKPVA

SEQ ID NO: 2347647 - protein, 9 aa, Cryptosporidium parvum
ETSIGESSN

SEQ ID NO: 2347648 - protein, 7 aa, Cryptosporidium parvum
ETSKAEY

SEQ ID NO: 2347649 - protein, 14 aa, Cryptosporidium parvum
ETSRLSSKEEDYKS

SEQ ID NO: 2347650 - protein, 6 aa, Cryptosporidium parvum
ETTDSM

SEQ ID NO: 2347651 - protein, 6 aa, Cryptosporidium parvum
ETTGRY

SEQ ID NO: 2347652 - protein, 4 aa, Cryptosporidium parvum
ETVP

SEQ ID NO: 2347653 - protein, 5 aa, Cryptosporidium parvum
ETVRK

SEQ ID NO: 2347654 - protein, 98 aa, Cryptosporidium parvum
ETYQTDGTYTSKKEQTNTDRTKCVTTTSTTPVQTGTTEKSYKGTVTRETYSVDGKQTSKTEETFDQTVSTNTQSGETVTKTTTRFASGNVDGVTTRTE

SEQ ID NO: 2347655 - protein, 6 aa, Cryptosporidium parvum
EVAHAR

SEQ ID NO: 2347656 - protein, 12 aa, Cryptosporidium parvum
EVERNSEISSQE

SEQ ID NO: 2347657 - protein, 16 aa, Cryptosporidium parvum
EVNESSRDSQNVESEN

SEQ ID NO: 2347658 - protein, 6 aa, Cryptosporidium parvum
EVPDIP

SEQ ID NO: 2347659 - protein, 10 aa, Cryptosporidium parvum
EVQKQQDRQA

SEQ ID NO: 2347660 - protein, 10 aa, Cryptosporidium parvum
EVRNQGEKEF

SEQ ID NO: 2347661 - protein, 7 aa, Cryptosporidium parvum
EVSNEGQ

SEQ ID NO: 2347662 - protein, 15 aa, Cryptosporidium parvum
EVTDNSQDSDKENDF

SEQ ID NO: 2347663 - protein, 4 aa, Cryptosporidium parvum
EVTT

SEQ ID NO: 2347664 - protein, 4 aa, Cryptosporidium parvum
EYDQ

SEQ ID NO: 2347665 - protein, 8 aa, Cryptosporidium parvum
EYDTQKSI

SEQ ID NO: 2347666 - protein, 13 aa, Cryptosporidium parvum
EYEKQGRGRKTMK

SEQ ID NO: 2347667 - protein, 17 aa, Cryptosporidium parvum
EYGQHGSKGEEVSPGPH

SEQ ID NO: 2347668 - protein, 11 aa, Cryptosporidium parvum
EYGTASNIKSR

SEQ ID NO: 2347669 - protein, 6 aa, Cryptosporidium parvum
EYGTKK

SEQ ID NO: 2347670 - protein, 12 aa, Cryptosporidium parvum
EYMNGESAKSGI

SEQ ID NO: 2347671 - protein, 8 aa, Cryptosporidium parvum
EYNSNNHT

SEQ ID NO: 2347672 - protein, 11 aa, Cryptosporidium parvum
EYPIESDSEGY

SEQ ID NO: 2347673 - protein, 9 aa, Cryptosporidium parvum
EYPTKPPDV

SEQ ID NO: 2347674 - protein, 5 aa, Cryptosporidium parvum
EYQKE

SEQ ID NO: 2347675 - protein, 4 aa, Cryptosporidium parvum
EYRN

SEQ ID NO: 2347676 - protein, 8 aa, Cryptosporidium parvum
EYSGKNTR

SEQ ID NO: 2347677 - protein, 4 aa, Cryptosporidium parvum
EYSR

SEQ ID NO: 2347678 - protein, 32 aa, Cryptosporidium parvum
EYVGGRKGRGKSSKYGSGAVGGGSSSGEDEHG

SEQ ID NO: 2347679 - protein, 4 aa, Cryptosporidium parvum
EYYP

SEQ ID NO: 2347680 - protein, 9 aa, Cryptosporidium parvum
FARQGTNPG

SEQ ID NO: 2347681 - protein, 7 aa, Cryptosporidium parvum
FASDTNI

SEQ ID NO: 2347682 - protein, 9 aa, Cryptosporidium parvum
FATGGSDGA

SEQ ID NO: 2347683 - protein, 14 aa, Cryptosporidium parvum
FATKTAKKAKRRVK

SEQ ID NO: 2347684 - protein, 4 aa, Cryptosporidium parvum
FDAR

SEQ ID NO: 2347685 - protein, 21 aa, Cryptosporidium parvum
FDDDGSGVNNVQSKGGVLKLN

SEQ ID NO: 2347686 - protein, 8 aa, Cryptosporidium parvum
FDGKDEGA

SEQ ID NO: 2347687 - protein, 7 aa, Cryptosporidium parvum
FDNPEKT

SEQ ID NO: 2347688 - protein, 4 aa, Cryptosporidium parvum
FDPF

SEQ ID NO: 2347689 - protein, 8 aa, Cryptosporidium parvum
FDSKDNEL

SEQ ID NO: 2347690 - protein, 4 aa, Cryptosporidium parvum
FDSY

SEQ ID NO: 2347691 - protein, 6 aa, Cryptosporidium parvum
FDTTNK

SEQ ID NO: 2347692 - protein, 4 aa, Cryptosporidium parvum
FEEE

SEQ ID NO: 2347693 - protein, 14 aa, Cryptosporidium parvum
FEENSKNDNNPQLN

SEQ ID NO: 2347694 - protein, 4 aa, Cryptosporidium parvum
FEGS

SEQ ID NO: 2347695 - protein, 5 aa, Cryptosporidium parvum
FENAK

SEQ ID NO: 2347696 - protein, 9 aa, Cryptosporidium parvum
FERAVSESR

SEQ ID NO: 2347697 - protein, 6 aa, Cryptosporidium parvum
FESENY

SEQ ID NO: 2347698 - protein, 15 aa, Cryptosporidium parvum
FESPKPKKVKDESGF

SEQ ID NO: 2347699 - protein, 7 aa, Cryptosporidium parvum
FGDDGQY

SEQ ID NO: 2347700 - protein, 4 aa, Cryptosporidium parvum
FGDF

SEQ ID NO: 2347701 - protein, 5 aa, Cryptosporidium parvum
FGHKN

SEQ ID NO: 2347702 - protein, 15 aa, Cryptosporidium parvum
FGKKNVTASISEQRK

SEQ ID NO: 2347703 - protein, 13 aa, Cryptosporidium parvum
FGSDSIDKSFEGM

SEQ ID NO: 2347704 - protein, 11 aa, Cryptosporidium parvum
FGSQNKASEID

SEQ ID NO: 2347705 - protein, 11 aa, Cryptosporidium parvum
FGSRKSSATMD

SEQ ID NO: 2347706 - protein, 4 aa, Cryptosporidium parvum
FGST

SEQ ID NO: 2347707 - protein, 4 aa, Cryptosporidium parvum
FGTH

SEQ ID NO: 2347708 - protein, 8 aa, Cryptosporidium parvum
FGVGGEPA

SEQ ID NO: 2347709 - protein, 9 aa, Cryptosporidium parvum
FHGNGGRHL

SEQ ID NO: 2347710 - protein, 13 aa, Cryptosporidium parvum
FIEDEGKKTAKNL

SEQ ID NO: 2347711 - protein, 7 aa, Cryptosporidium parvum
FKDSDKS

SEQ ID NO: 2347712 - protein, 7 aa, Cryptosporidium parvum
FKDSPMA

SEQ ID NO: 2347713 - protein, 25 aa, Cryptosporidium parvum
FKTEGRSDNIEKKRRAKSLSRSLSL

SEQ ID NO: 2347714 - protein, 4 aa, Cryptosporidium parvum
FKTP

SEQ ID NO: 2347715 - protein, 9 aa, Cryptosporidium parvum
FKYSSGEST

SEQ ID NO: 2347716 - protein, 6 aa, Cryptosporidium parvum
FLPPNS

SEQ ID NO: 2347717 - protein, 21 aa, Cryptosporidium parvum
FNEPSRSSRGFSRSRGSRLSP

SEQ ID NO: 2347718 - protein, 12 aa, Cryptosporidium parvum
FNHETQDHRNDY

SEQ ID NO: 2347719 - protein, 7 aa, Cryptosporidium parvum
FNKPNSE

SEQ ID NO: 2347720 - protein, 6 aa, Cryptosporidium parvum
FNPKDS

SEQ ID NO: 2347721 - protein, 4 aa, Cryptosporidium parvum
FNQP

SEQ ID NO: 2347722 - protein, 4 aa, Cryptosporidium parvum
FNQR

SEQ ID NO: 2347723 - protein, 14 aa, Cryptosporidium parvum
FNSQTGGTSQSPKH

SEQ ID NO: 2347724 - protein, 15 aa, Cryptosporidium parvum
FNTPNPGNGSKFDSS

SEQ ID NO: 2347725 - protein, 38 aa, Cryptosporidium parvum; identical to SEQ ID NO: 2258497

SEQ ID NO: 2347726 - protein, 6 aa, Cryptosporidium parvum
FPGTGA

SEQ ID NO: 2347727 - protein, 5 aa, Cryptosporidium parvum
FPNDK

SEQ ID NO: 2347728 - protein, 11 aa, Cryptosporidium parvum
FPNKNESDAVD

SEQ ID NO: 2347729 - protein, 8 aa, Cryptosporidium parvum
FPNPNEDA

SEQ ID NO: 2347730 - protein, 4 aa, Cryptosporidium parvum
FPNT

SEQ ID NO: 2347731 - protein, 6 aa, Cryptosporidium parvum
FPPGSD

SEQ ID NO: 2347732 - protein, 11 aa, Cryptosporidium parvum
FPSTNKESDTA

SEQ ID NO: 2347733 - protein, 9 aa, Cryptosporidium parvum
FPSTQGRSV

SEQ ID NO: 2347734 - protein, 7 aa, Cryptosporidium parvum
FPTPKIE

SEQ ID NO: 2347735 - protein, 4 aa, Cryptosporidium parvum
FQDN

SEQ ID NO: 2347736 - protein, 6 aa, Cryptosporidium parvum
FQNGSI

SEQ ID NO: 2347737 - protein, 12 aa, Cryptosporidium parvum
FQSSQGASQSFN

SEQ ID NO: 2347738 - protein, 11 aa, Cryptosporidium parvum
FRSEKSNNAND

SEQ ID NO: 2347739 - protein, 5 aa, Cryptosporidium parvum
FSATG

SEQ ID NO: 2347740 - protein, 9 aa, Cryptosporidium parvum
FSEGTPSFE

SEQ ID NO: 2347741 - protein, 11 aa, Cryptosporidium parvum
FSERSQDESIE

SEQ ID NO: 2347742 - protein, 10 aa, Cryptosporidium parvum
FSKATTVPKP

SEQ ID NO: 2347743 - protein, 9 aa, Cryptosporidium parvum
FSKEGQTRE

SEQ ID NO: 2347744 - protein, 4 aa, Cryptosporidium parvum
FSKL

SEQ ID NO: 2347745 - protein, 11 aa, Cryptosporidium parvum
FSLSNGNSNQK

SEQ ID NO: 2347746 - protein, 9 aa, Cryptosporidium parvum
FSNNAGKEM

SEQ ID NO: 2347747 - protein, 5 aa, Cryptosporidium parvum
FSPSG

SEQ ID NO: 2347748 - protein, 7 aa, Cryptosporidium parvum
FSPSIPN

SEQ ID NO: 2347749 - protein, 25 aa, Cryptosporidium parvum
FSPSSSKALRKGNGEITGSATNSEI

SEQ ID NO: 2347750 - protein, 10 aa, Cryptosporidium parvum
FSQSKNLNNS

SEQ ID NO: 2347751 - protein, 6 aa, Cryptosporidium parvum
FSQTRN

SEQ ID NO: 2347752 - protein, 15 aa, Cryptosporidium parvum
FSRENHENSTKNNEK

SEQ ID NO: 2347753 - protein, 12 aa, Cryptosporidium parvum
FSRNSGSNRQYS

SEQ ID NO: 2347754 - protein, 10 aa, Cryptosporidium parvum
FSSCSPESTS

SEQ ID NO: 2347755 - protein, 12 aa, Cryptosporidium parvum
FSTNQIQRNNQK

SEQ ID NO: 2347756 - protein, 12 aa, Cryptosporidium parvum
FTANRNTSIKEA

SEQ ID NO: 2347757 - protein, 10 aa, Cryptosporidium parvum
FTGNNRNDIL

SEQ ID NO: 2347758 - protein, 4 aa, Cryptosporidium parvum
FTPS

SEQ ID NO: 2347759 - protein, 5 aa, Cryptosporidium parvum
FTPTK

SEQ ID NO: 2347760 - protein, 6 aa, Cryptosporidium parvum
FTPTKF

SEQ ID NO: 2347761 - protein, 11 aa, Cryptosporidium parvum
FTSSNKEERNK

SEQ ID NO: 2347762 - protein, 6 aa, Cryptosporidium parvum
FTTEEK

SEQ ID NO: 2347763 - protein, 15 aa, Cryptosporidium parvum
FYNNETLDKLEWIDY

SEQ ID NO: 2347764 - protein, 8 aa, Cryptosporidium parvum
GAANISPK

SEQ ID NO: 2347765 - protein, 7 aa, Cryptosporidium parvum
GADDNYS

SEQ ID NO: 2347766 - protein, 6 aa, Cryptosporidium parvum
GADETI

SEQ ID NO: 2347767 - protein, 31 aa, Cryptosporidium parvum; identical to SEQ ID NO: 2258848

SEQ ID NO: 2347768 - protein, 5 aa, Cryptosporidium parvum
GADSS

SEQ ID NO: 2347769 - protein, 8 aa, Cryptosporidium parvum
GAEDSPLE

SEQ ID NO: 2347770 - protein, 4 aa, Cryptosporidium parvum
GAEK

SEQ ID NO: 2347771 - protein, 4 aa, Cryptosporidium parvum
GAGN

SEQ ID NO: 2347772 - protein, 5 aa, Cryptosporidium parvum
GAGSA

SEQ ID NO: 2347773 - protein, 13 aa, Cryptosporidium parvum
GAISSSSSTGAKD

SEQ ID NO: 2347774 - protein, 7 aa, Cryptosporidium parvum
GAKQNFN

SEQ ID NO: 2347775 - protein, 10 aa, Cryptosporidium parvum
GANSGKSGKV

SEQ ID NO: 2347776 - protein, 9 aa, Cryptosporidium parvum
GAQESKGEL

SEQ ID NO: 2347777 - protein, 23 aa, Cryptosporidium parvum
GASDSSETKNGIKEKNSNELSNK

SEQ ID NO: 2347778 - protein, 11 aa, Cryptosporidium parvum
GASSENPYKSN

SEQ ID NO: 2347779 - protein, 7 aa, Cryptosporidium parvum
GATSQID

SEQ ID NO: 2347780 - protein, 6 aa, Cryptosporidium parvum
GAVPRG

SEQ ID NO: 2347781 - protein, 5 aa, Cryptosporidium parvum
GCGPG

SEQ ID NO: 2347782 - protein, 9 aa, Cryptosporidium parvum
GDATSGAKA

SEQ ID NO: 2347783 - protein, 9 aa, Cryptosporidium parvum
GDEEISDES

SEQ ID NO: 2347784 - protein, 4 aa, Cryptosporidium parvum
GDGA

SEQ ID NO: 2347785 - protein, 4 aa, Cryptosporidium parvum
GDGV

SEQ ID NO: 2347786 - protein, 11 aa, Cryptosporidium parvum
GDHNKNPPHPR

SEQ ID NO: 2347787 - protein, 8 aa, Cryptosporidium parvum
GDIQNTSI

SEQ ID NO: 2347788 - protein, 7 aa, Cryptosporidium parvum
GDKAEEI

SEQ ID NO: 2347789 - protein, 6 aa, Cryptosporidium parvum
GDKKGS

SEQ ID NO: 2347790 - protein, 5 aa, Cryptosporidium parvum
GDLNQ

SEQ ID NO: 2347791 - protein, 4 aa, Cryptosporidium parvum
GDMS

SEQ ID NO: 2347792 - protein, 15 aa, Cryptosporidium parvum
GDPPRKRKLPTDEDG

SEQ ID NO: 2347793 - protein, 4 aa, Cryptosporidium parvum
GDPS

SEQ ID NO: 2347794 - protein, 5 aa, Cryptosporidium parvum
GDQAC

SEQ ID NO: 2347795 - protein, 5 aa, Cryptosporidium parvum
GDQEI

SEQ ID NO: 2347796 - protein, 4 aa, Cryptosporidium parvum
GDQL

SEQ ID NO: 2347797 - protein, 9 aa, Cryptosporidium parvum
GDQPSNNST

SEQ ID NO: 2347798 - protein, 4 aa, Cryptosporidium parvum
GDRS

SEQ ID NO: 2347799 - protein, 10 aa, Cryptosporidium parvum
GDTLGSPPSD

SEQ ID NO: 2347800 - protein, 4 aa, Cryptosporidium parvum
GDTP

SEQ ID NO: 2347801 - protein, 7 aa, Cryptosporidium parvum
GDVPEDA

SEQ ID NO: 2347802 - protein, 11 aa, Cryptosporidium parvum
GEAPKITKDGV

SEQ ID NO: 2347803 - protein, 6 aa, Cryptosporidium parvum
GEATSS

SEQ ID NO: 2347804 - protein, 11 aa, Cryptosporidium parvum
GEDDEEDEGEY

SEQ ID NO: 2347805 - protein, 12 aa, Cryptosporidium parvum
GEDGKRFGSEIP

SEQ ID NO: 2347806 - protein, 9 aa, Cryptosporidium parvum
GEDLKTQDN

SEQ ID NO: 2347807 - protein, 7 aa, Cryptosporidium parvum
GEDSDVK

SEQ ID NO: 2347808 - protein, 12 aa, Cryptosporidium parvum
GEEEDEAAARSR

SEQ ID NO: 2347809 - protein, 13 aa, Cryptosporidium parvum
GEFGISSSTYSSE

SEQ ID NO: 2347810 - protein, 5 aa, Cryptosporidium parvum
GEGSR

SEQ ID NO: 2347811 - protein, 6 aa, Cryptosporidium parvum
GEHNKK

SEQ ID NO: 2347812 - protein, 48 aa, Cryptosporidium parvum; identical to SEQ ID NO: 2259162

SEQ ID NO: 2347813 - protein, 8 aa, Cryptosporidium parvum
GEIKNGYS

SEQ ID NO: 2347814 - protein, 13 aa, Cryptosporidium parvum
GEKGKDNADTKEM

SEQ ID NO: 2347815 - protein, 20 aa, Cryptosporidium parvum
GEKITSEGSLENESEDEFRE

SEQ ID NO: 2347816 - protein, 13 aa, Cryptosporidium parvum
GEKLNNENQEELE

SEQ ID NO: 2347817 - protein, 16 aa, Cryptosporidium parvum
GELKNQYNQDETNNES

SEQ ID NO: 2347818 - protein, 5 aa, Cryptosporidium parvum
GELKP

SEQ ID NO: 2347819 - protein, 5 aa, Cryptosporidium parvum
GENGN

SEQ ID NO: 2347820 - protein, 13 aa, Cryptosporidium parvum
GENIQGEKDSIEI

SEQ ID NO: 2347821 - protein, 5 aa, Cryptosporidium parvum
GENNL

SEQ ID NO: 2347822 - protein, 4 aa, Cryptosporidium parvum
GENQ

SEQ ID NO: 2347823 - protein, 6 aa, Cryptosporidium parvum
GENSEL

SEQ ID NO: 2347824 - protein, 4 aa, Cryptosporidium parvum
GEPI

SEQ ID NO: 2347825 - protein, 7 aa, Cryptosporidium parvum
GEPSPGC

SEQ ID NO: 2347826 - protein, 9 aa, Cryptosporidium parvum
GERQTAKVD

SEQ ID NO: 2347827 - protein, 9 aa, Cryptosporidium parvum
GESDPNALN

SEQ ID NO: 2347828 - protein, 11 aa, Cryptosporidium parvum
GESGAGKTEAT

SEQ ID NO: 2347829 - protein, 11 aa, Cryptosporidium parvum
GESGAGKTETT

SEQ ID NO: 2347830 - protein, 7 aa, Cryptosporidium parvum
GESSREK

SEQ ID NO: 2347831 - protein, 5 aa, Cryptosporidium parvum
GETAS

SEQ ID NO: 2347832 - protein, 5 aa, Cryptosporidium parvum
GETGT

SEQ ID NO: 2347833 - protein, 5 aa, Cryptosporidium parvum
GETTD

SEQ ID NO: 2347834 - protein, 20 aa, Cryptosporidium parvum
GFDENGGQNSFVDPETTDQG

SEQ ID NO: 2347835 - protein, 9 aa, Cryptosporidium parvum
GFEHPNTSQ

SEQ ID NO: 2347836 - protein, 6 aa, Cryptosporidium parvum
GFESTQ

SEQ ID NO: 2347837 - protein, 12 aa, Cryptosporidium parvum
GFNNNNSTSTRI

SEQ ID NO: 2347838 - protein, 6 aa, Cryptosporidium parvum
GFPEPH

SEQ ID NO: 2347839 - protein, 7 aa, Cryptosporidium parvum
GFPNQNA

SEQ ID NO: 2347840 - protein, 13 aa, Cryptosporidium parvum
GFSDGDKNKITVD

SEQ ID NO: 2347841 - protein, 4 aa, Cryptosporidium parvum
GGAV

SEQ ID NO: 2347842 - protein, 9 aa, Cryptosporidium parvum
GGCDGKPWK

SEQ ID NO: 2347843 - protein, 5 aa, Cryptosporidium parvum
GGDAN

SEQ ID NO: 2347844 - protein, 4 aa, Cryptosporidium parvum
GGDC

SEQ ID NO: 2347845 - protein, 7 aa, Cryptosporidium parvum
GGDPETT

SEQ ID NO: 2347846 - protein, 16 aa, Cryptosporidium parvum
GGELPENKPSGDKGGS

SEQ ID NO: 2347847 - protein, 10 aa, Cryptosporidium parvum
GGGADPPYSP

SEQ ID NO: 2347848 - protein, 6 aa, Cryptosporidium parvum
GGGATN

SEQ ID NO: 2347849 - protein, 8 aa, Cryptosporidium parvum
GGGDTGWG

SEQ ID NO: 2347850 - protein, 8 aa, Cryptosporidium parvum
GGGGGISA

SEQ ID NO: 2347851 - protein, 9 aa, Cryptosporidium parvum
GGGGSGGIE

SEQ ID NO: 2347852 - protein, 66 aa, Cryptosporidium parvum
GGGIEGNSTTVLEGGSTCRNTTDDHSSSMTISGTNINSNSGSSSSLTTALNGGGVGNGISSSYGGV

SEQ ID NO: 2347853 - protein, 20 aa, Cryptosporidium parvum
GGGINSANAGVGGGNNNAGF

SEQ ID NO: 2347854 - protein, 24 aa, Cryptosporidium parvum
GGLASTGSSTGTGCPLSSQRPCEA

SEQ ID NO: 2347855 - protein, 14 aa, Cryptosporidium parvum
GGLDSQEANEMRNA

SEQ ID NO: 2347856 - protein, 4 aa, Cryptosporidium parvum
GGNC

SEQ ID NO: 2347857 - protein, 11 aa, Cryptosporidium parvum
GGNDFGSRISN

SEQ ID NO: 2347858 - protein, 9 aa, Cryptosporidium parvum
GGNGSGKTT

SEQ ID NO: 2347859 - protein, 5 aa, Cryptosporidium parvum
GGNKK

SEQ ID NO: 2347860 - protein, 13 aa, Cryptosporidium parvum
GGNSNNINNTSNA

SEQ ID NO: 2347861 - protein, 8 aa, Cryptosporidium parvum
GGNSNSNE

SEQ ID NO: 2347862 - protein, 4 aa, Cryptosporidium parvum
GGNV

SEQ ID NO: 2347863 - protein, 6 aa, Cryptosporidium parvum
GGNWPK

SEQ ID NO: 2347864 - protein, 5 aa, Cryptosporidium parvum
GGPFP

SEQ ID NO: 2347865 - protein, 6 aa, Cryptosporidium parvum
GGQKSR

SEQ ID NO: 2347866 - protein, 4 aa, Cryptosporidium parvum
GGRE

SEQ ID NO: 2347867 - protein, 7 aa, Cryptosporidium parvum
GGSGNFN

SEQ ID NO: 2347868 - protein, 12 aa, Cryptosporidium parvum
GGSGTETKTKDE

SEQ ID NO: 2347869 - protein, 5 aa, Cryptosporidium parvum
GGSLQ

SEQ ID NO: 2347870 - protein, 8 aa, Cryptosporidium parvum
GGSPEYPQ

SEQ ID NO: 2347871 - protein, 9 aa, Cryptosporidium parvum
GGSSPLQSP

SEQ ID NO: 2347872 - protein, 25 aa, Cryptosporidium parvum
GGVGVGGNNNGIGNISSSGGGIGGV

SEQ ID NO: 2347873 - protein, 15 aa, Cryptosporidium parvum
GGVPPQMTGGPQMTA

SEQ ID NO: 2347874 - protein, 6 aa, Cryptosporidium parvum
GGYDSA

SEQ ID NO: 2347875 - protein, 6 aa, Cryptosporidium parvum
GHGDSI

SEQ ID NO: 2347876 - protein, 5 aa, Cryptosporidium parvum
GHIST

SEQ ID NO: 2347877 - protein, 4 aa, Cryptosporidium parvum
GHNH

SEQ ID NO: 2347878 - protein, 24 aa, Cryptosporidium parvum
GHNSGNIQNNQNLSHSNSGSNHSA

SEQ ID NO: 2347879 - protein, 15 aa, Cryptosporidium parvum
GHPNYSSKTAENVEH

SEQ ID NO: 2347880 - protein, 4 aa, Cryptosporidium parvum
GHSD

SEQ ID NO: 2347881 - protein, 9 aa, Cryptosporidium parvum
GHYGKTASH

SEQ ID NO: 2347882 - protein, 11 aa, Cryptosporidium parvum
GIDKDGKSHRL

SEQ ID NO: 2347883 - protein, 5 aa, Cryptosporidium parvum
GIELG

SEQ ID NO: 2347884 - protein, 11 aa, Cryptosporidium parvum
GIEPIGDGKGK

SEQ ID NO: 2347885 - protein, 14 aa, Cryptosporidium parvum
GIESNSIQKGSLPA

SEQ ID NO: 2347886 - protein, 7 aa, Cryptosporidium parvum
GIGDQTR

SEQ ID NO: 2347887 - protein, 7 aa, Cryptosporidium parvum
GIGGSSI

SEQ ID NO: 2347888 - protein, 4 aa, Cryptosporidium parvum
GIGP

SEQ ID NO: 2347889 - protein, 10 aa, Cryptosporidium parvum
GIGTDASMPT

SEQ ID NO: 2347890 - protein, 7 aa, Cryptosporidium parvum
GINNENN

SEQ ID NO: 2347891 - protein, 17 aa, Cryptosporidium parvum
GISESSDSSEDFTPKPI

SEQ ID NO: 2347892 - protein, 8 aa, Cryptosporidium parvum
GISSPGLA

SEQ ID NO: 2347893 - protein, 7 aa, Cryptosporidium parvum
GKDIPQS

SEQ ID NO: 2347894 - protein, 6 aa, Cryptosporidium parvum
GKEESI

SEQ ID NO: 2347895 - protein, 8 aa, Cryptosporidium parvum
GKEGSSDL

SEQ ID NO: 2347896 - protein, 5 aa, Cryptosporidium parvum
GKEYV

SEQ ID NO: 2347897 - protein, 11 aa, Cryptosporidium parvum
GKFDPNKHGRR

SEQ ID NO: 2347898 - protein, 7 aa, Cryptosporidium parvum
GKGKAYS

SEQ ID NO: 2347899 - protein, 23 aa, Cryptosporidium parvum
GKHANSKYMKSSENGGEDEDDDI

SEQ ID NO: 2347900 - protein, 5 aa, Cryptosporidium parvum
GKIHD

SEQ ID NO: 2347901 - protein, 12 aa, Cryptosporidium parvum
GKIISDSKTAIQ

SEQ ID NO: 2347902 - protein, 6 aa, Cryptosporidium parvum
GKINGY

SEQ ID NO: 2347903 - protein, 7 aa, Cryptosporidium parvum
GKKHEAS

SEQ ID NO: 2347904 - protein, 14 aa, Cryptosporidium parvum
GKKKKDKQSKGSLK

SEQ ID NO: 2347905 - protein, 4 aa, Cryptosporidium parvum
GKKS

SEQ ID NO: 2347906 - protein, 10 aa, Cryptosporidium parvum
GKKTNQNEKH

SEQ ID NO: 2347907 - protein, 7 aa, Cryptosporidium parvum
GKKYNSL

SEQ ID NO: 2347908 - protein, 8 aa, Cryptosporidium parvum
GKLPEEVA

SEQ ID NO: 2347909 - protein, 7 aa, Cryptosporidium parvum
GKLRGAS

SEQ ID NO: 2347910 - protein, 6 aa, Cryptosporidium parvum
GKMRNR

SEQ ID NO: 2347911 - protein, 9 aa, Cryptosporidium parvum
GKNHSGKNI

SEQ ID NO: 2347912 - protein, 6 aa, Cryptosporidium parvum
GKNISN

SEQ ID NO: 2347913 - protein, 11 aa, Cryptosporidium parvum
GKNNTKPDVNQ

SEQ ID NO: 2347914 - protein, 9 aa, Cryptosporidium parvum
GKNTIEDSN

SEQ ID NO: 2347915 - protein, 16 aa, Cryptosporidium parvum
GKPQETFKEASERAQK

SEQ ID NO: 2347916 - protein, 4 aa, Cryptosporidium parvum
GKPS

SEQ ID NO: 2347917 - protein, 9 aa, Cryptosporidium parvum
GKPSSGKST

SEQ ID NO: 2347918 - protein, 7 aa, Cryptosporidium parvum
GKPYPKS

SEQ ID NO: 2347919 - protein, 9 aa, Cryptosporidium parvum
GKQREQGTL

SEQ ID NO: 2347920 - protein, 26 aa, Cryptosporidium parvum
GKQRESSSFGLSSDKIKKKQKEEEYG

SEQ ID NO: 2347921 - protein, 5 aa, Cryptosporidium parvum
GKRGL

SEQ ID NO: 2347922 - protein, 5 aa, Cryptosporidium parvum
GKRPI

SEQ ID NO: 2347923 - protein, 6 aa, Cryptosporidium parvum
GKRSQK

SEQ ID NO: 2347924 - protein, 28 aa, Cryptosporidium parvum
GKRTKSTGNLDDKDEKNEKLKEGKDLTK

SEQ ID NO: 2347925 - protein, 9 aa, Cryptosporidium parvum
GKSDSNLVK

SEQ ID NO: 2347926 - protein, 9 aa, Cryptosporidium parvum
GKSEFSKSI

SEQ ID NO: 2347927 - protein, 9 aa, Cryptosporidium parvum
GKSKNGKSY

SEQ ID NO: 2347928 - protein, 7 aa, Cryptosporidium parvum
GKSRDEF

SEQ ID NO: 2347929 - protein, 40 aa, Cryptosporidium parvum; identical to SEQ ID NO: 2259911

SEQ ID NO: 2347930 - protein, 4 aa, Cryptosporidium parvum
GKTT

SEQ ID NO: 2347931 - protein, 30 aa, Cryptosporidium parvum
GKVKNQTPRVEKQEKKKALTGRAKKRQQYN

SEQ ID NO: 2347932 - protein, 16 aa, Cryptosporidium parvum
GKVNGKGTLTYSRGDK

SEQ ID NO: 2347933 - protein, 5 aa, Cryptosporidium parvum
GKWAT

SEQ ID NO: 2347934 - protein, 5 aa, Cryptosporidium parvum
GKYNH

SEQ ID NO: 2347935 - protein, 14 aa, Cryptosporidium parvum
GLDNTIPNNSTPGN

SEQ ID NO: 2347936 - protein, 7 aa, Cryptosporidium parvum
GLGDDEK

SEQ ID NO: 2347937 - protein, 11 aa, Cryptosporidium parvum
GLNDNTDPSSL

SEQ ID NO: 2347938 - protein, 12 aa, Cryptosporidium parvum
GLNSKKASRSEL

SEQ ID NO: 2347939 - protein, 25 aa, Cryptosporidium parvum
GLNSSNNDDEPNNNKNSSNNFGNNT

SEQ ID NO: 2347940 - protein, 6 aa, Cryptosporidium parvum
GLPSKI

SEQ ID NO: 2347941 - protein, 12 aa, Cryptosporidium parvum
GLSKGKPTERGI

SEQ ID NO: 2347942 - protein, 9 aa, Cryptosporidium parvum
GLSKTSEEF

SEQ ID NO: 2347943 - protein, 12 aa, Cryptosporidium parvum
GLTEGSNKADIR

SEQ ID NO: 2347944 - protein, 31 aa, Cryptosporidium parvum; identical to SEQ ID NO: 2143492

SEQ ID NO: 2347945 - protein, 6 aa, Cryptosporidium parvum
GNCESE

SEQ ID NO: 2347946 - protein, 6 aa, Cryptosporidium parvum
GNCNNG

SEQ ID NO: 2347947 - protein, 5 aa, Cryptosporidium parvum
GNCSR

SEQ ID NO: 2347948 - protein, 7 aa, Cryptosporidium parvum
GNDDDTL

SEQ ID NO: 2347949 - protein, 7 aa, Cryptosporidium parvum
GNDGSDY

SEQ ID NO: 2347950 - protein, 13 aa, Cryptosporidium parvum
GNDQSSQSPKNSA

SEQ ID NO: 2347951 - protein, 26 aa, Cryptosporidium parvum
GNDSKSARNSENSRRLDGKSDNQVSP

SEQ ID NO: 2347952 - protein, 5 aa, Cryptosporidium parvum
GNEES

SEQ ID NO: 2347953 - protein, 16 aa, Cryptosporidium parvum
GNEGDSIDYGENESSL

SEQ ID NO: 2347954 - protein, 11 aa, Cryptosporidium parvum
GNGASTSPQNL

SEQ ID NO: 2347955 - protein, 5 aa, Cryptosporidium parvum
GNGGS

SEQ ID NO: 2347956 - protein, 14 aa, Cryptosporidium parvum
GNGNPGRSGSINRV

SEQ ID NO: 2347957 - protein, 5 aa, Cryptosporidium parvum
GNGNR

SEQ ID NO: 2347958 - protein, 9 aa, Cryptosporidium parvum
GNGQERSDL

SEQ ID NO: 2347959 - protein, 7 aa, Cryptosporidium parvum
GNIGTTV

SEQ ID NO: 2347960 - protein, 4 aa, Cryptosporidium parvum
GNIP

SEQ ID NO: 2347961 - protein, 6 aa, Cryptosporidium parvum
GNKDYC

SEQ ID NO: 2347962 - protein, 12 aa, Cryptosporidium parvum
GNKTSKNNTRNE

SEQ ID NO: 2347963 - protein, 14 aa, Cryptosporidium parvum
GNLKNENSSQTQPT

SEQ ID NO: 2347964 - protein, 12 aa, Cryptosporidium parvum
GNNMSADNKSEL

SEQ ID NO: 2347965 - protein, 8 aa, Cryptosporidium parvum
GNNNMSST

SEQ ID NO: 2347966 - protein, 5 aa, Cryptosporidium parvum
GNNRD

SEQ ID NO: 2347967 - protein, 6 aa, Cryptosporidium parvum
GNNSKC

SEQ ID NO: 2347968 - protein, 7 aa, Cryptosporidium parvum
GNNSNIS

SEQ ID NO: 2347969 - protein, 4 aa, Cryptosporidium parvum
GNPI

SEQ ID NO: 2347970 - protein, 6 aa, Cryptosporidium parvum
GNPQEK

SEQ ID NO: 2347971 - protein, 9 aa, Cryptosporidium parvum
GNQSQRLSI

SEQ ID NO: 2347972 - protein, 6 aa, Cryptosporidium parvum
GNRGNC

SEQ ID NO: 2347973 - protein, 8 aa, Cryptosporidium parvum
GNRGRNTT

SEQ ID NO: 2347974 - protein, 60 aa, Cryptosporidium parvum; identical to SEQ ID NO: 2260209

SEQ ID NO: 2347975 - protein, 4 aa, Cryptosporidium parvum
GNSF

SEQ ID NO: 2347976 - protein, 15 aa, Cryptosporidium parvum
GNSSTNACVSTGTSL

SEQ ID NO: 2347977 - protein, 7 aa, Cryptosporidium parvum
GNSVNTR

SEQ ID NO: 2347978 - protein, 15 aa, Cryptosporidium parvum
GNTNEKGEYTTNYNP

SEQ ID NO: 2347979 - protein, 10 aa, Cryptosporidium parvum
GNTNGSLNTP

SEQ ID NO: 2347980 - protein, 8 aa, Cryptosporidium parvum
GNTNINTN

SEQ ID NO: 2347981 - protein, 11 aa, Cryptosporidium parvum
GNTRIYDTPNR

SEQ ID NO: 2347982 - protein, 13 aa, Cryptosporidium parvum
GNTSGDDRDRQIS

SEQ ID NO: 2347983 - protein, 9 aa, Cryptosporidium parvum
GNTSNDNSD

SEQ ID NO: 2347984 - protein, 9 aa, Cryptosporidium parvum
GNTSNGRGY

SEQ ID NO: 2347985 - protein, 6 aa, Cryptosporidium parvum
GNVPQS

SEQ ID NO: 2347986 - protein, 4 aa, Cryptosporidium parvum
GNVS

SEQ ID NO: 2347987 - protein, 7 aa, Cryptosporidium parvum
GPENHSS

SEQ ID NO: 2347988 - protein, 7 aa, Cryptosporidium parvum
GPGEKYG

SEQ ID NO: 2347989 - protein, 16 aa, Cryptosporidium parvum
GPGNNSTVHASHGGRV

SEQ ID NO: 2347990 - protein, 7 aa, Cryptosporidium parvum
GPKDTFW

SEQ ID NO: 2347991 - protein, 9 aa, Cryptosporidium parvum
GPKSFSERA

SEQ ID NO: 2347992 - protein, 6 aa, Cryptosporidium parvum
GPNGGQ

SEQ ID NO: 2347993 - protein, 8 aa, Cryptosporidium parvum
GPNSNSMT

SEQ ID NO: 2347994 - protein, 8 aa, Cryptosporidium parvum
GPPGTGKT

SEQ ID NO: 2347995 - protein, 11 aa, Cryptosporidium parvum
GPPGTGKTLTA

SEQ ID NO: 2347996 - protein, 6 aa, Cryptosporidium parvum
GPRNQS

SEQ ID NO: 2347997 - protein, 5 aa, Cryptosporidium parvum
GPSDE

SEQ ID NO: 2347998 - protein, 7 aa, Cryptosporidium parvum
GPSKSRS

SEQ ID NO: 2347999 - protein, 8 aa, Cryptosporidium parvum
GPSSWSET

SEQ ID NO: 2348000 - protein, 10 aa, Cryptosporidium parvum
GQAPPQPQGI

SEQ ID NO: 2348001 - protein, 7 aa, Cryptosporidium parvum
GQDGRKR

SEQ ID NO: 2348002 - protein, 13 aa, Cryptosporidium parvum
GQEKMSKSDTSSA

SEQ ID NO: 2348003 - protein, 11 aa, Cryptosporidium parvum
GQEPRQTTSNI

SEQ ID NO: 2348004 - protein, 9 aa, Cryptosporidium parvum
GQESSLNQS

SEQ ID NO: 2348005 - protein, 4 aa, Cryptosporidium parvum
GQGG

SEQ ID NO: 2348006 - protein, 12 aa, Cryptosporidium parvum
GQIDDEEHISRE

SEQ ID NO: 2348007 - protein, 8 aa, Cryptosporidium parvum
GQNDGGLL

SEQ ID NO: 2348008 - protein, 11 aa, Cryptosporidium parvum
GQNKTQSPTHF

SEQ ID NO: 2348009 - protein, 6 aa, Cryptosporidium parvum
GQNVQR

SEQ ID NO: 2348010 - protein, 4 aa, Cryptosporidium parvum
GQRK

SEQ ID NO: 2348011 - protein, 9 aa, Cryptosporidium parvum
GQSGDRLTR

SEQ ID NO: 2348012 - protein, 4 aa, Cryptosporidium parvum
GQSM

SEQ ID NO: 2348013 - protein, 22 aa, Cryptosporidium parvum
GQTQGQSYLQNSSSSHHSPSSF

SEQ ID NO: 2348014 - protein, 9 aa, Cryptosporidium parvum
GQTSSGKTF

SEQ ID NO: 2348015 - protein, 22 aa, Cryptosporidium parvum
GQVQETKNVTSLSESNNTRKSQ

SEQ ID NO: 2348016 - protein, 10 aa, Cryptosporidium parvum
GQVSEGFDDT

SEQ ID NO: 2348017 - protein, 7 aa, Cryptosporidium parvum
GRAGRTG

SEQ ID NO: 2348018 - protein, 16 aa, Cryptosporidium parvum
GREAGRGSENIKSSLY

SEQ ID NO: 2348019 - protein, 4 aa, Cryptosporidium parvum
GRED

SEQ ID NO: 2348020 - protein, 18 aa, Cryptosporidium parvum
GRFPTSSSLEKKGGFSAF

SEQ ID NO: 2348021 - protein, 9 aa, Cryptosporidium parvum
GRKNREETE

SEQ ID NO: 2348022 - protein, 7 aa, Cryptosporidium parvum
GRKYDNE

SEQ ID NO: 2348023 - protein, 14 aa, Cryptosporidium parvum
GRLKAPSSSEAGGA

SEQ ID NO: 2348024 - protein, 5 aa, Cryptosporidium parvum
GRQNW

SEQ ID NO: 2348025 - protein, 7 aa, Cryptosporidium parvum
GRRLEPT

SEQ ID NO: 2348026 - protein, 8 aa, Cryptosporidium parvum
GRSGRFGQ

SEQ ID NO: 2348027 - protein, 5 aa, Cryptosporidium parvum
GRSKI

SEQ ID NO: 2348028 - protein, 12 aa, Cryptosporidium parvum
GRSKNEYRDHRR

SEQ ID NO: 2348029 - protein, 13 aa, Cryptosporidium parvum
GRSKTKKNNLTNL

SEQ ID NO: 2348030 - protein, 22 aa, Cryptosporidium parvum
GRSLPSNTATNDKNNNSSYSNA

SEQ ID NO: 2348031 - protein, 5 aa, Cryptosporidium parvum
GRSRG

SEQ ID NO: 2348032 - protein, 9 aa, Cryptosporidium parvum
GRTSESKAS

SEQ ID NO: 2348033 - protein, 4 aa, Cryptosporidium parvum
GRVR

SEQ ID NO: 2348034 - protein, 8 aa, Cryptosporidium parvum
GSEEPLKR

SEQ ID NO: 2348035 - protein, 14 aa, Cryptosporidium parvum
GSEKISKTGAEGLT

SEQ ID NO: 2348036 - protein, 22 aa, Cryptosporidium parvum
GSENIQRSGANAVKDRAKEAGM

SEQ ID NO: 2348037 - protein, 10 aa, Cryptosporidium parvum
GSEQSDKSEL

SEQ ID NO: 2348038 - protein, 20 aa, Cryptosporidium parvum
GSESIKRTQLEGDRRKEGMS

SEQ ID NO: 2348039 - protein, 6 aa, Cryptosporidium parvum
GSEVRA

SEQ ID NO: 2348040 - protein, 10 aa, Cryptosporidium parvum
GSGALASSQD

SEQ ID NO: 2348041 - protein, 13 aa, Cryptosporidium parvum
GSGFPQNQPNKPI

SEQ ID NO: 2348042 - protein, 9 aa, Cryptosporidium parvum
GSGKSTYCS

SEQ ID NO: 2348043 - protein, 6 aa, Cryptosporidium parvum
GSHQQF

SEQ ID NO: 2348044 - protein, 6 aa, Cryptosporidium parvum
GSIDGA

SEQ ID NO: 2348045 - protein, 4 aa, Cryptosporidium parvum
GSIG

SEQ ID NO: 2348046 - protein, 12 aa, Cryptosporidium parvum
GSKDESSGIQNN

SEQ ID NO: 2348047 - protein, 17 aa, Cryptosporidium parvum
GSKELDRDGGHRGRGWS

SEQ ID NO: 2348048 - protein, 9 aa, Cryptosporidium parvum
GSKKDSVGR

SEQ ID NO: 2348049 - protein, 9 aa, Cryptosporidium parvum
GSKSNSHIK

SEQ ID NO: 2348050 - protein, 8 aa, Cryptosporidium parvum
GSLSESSA

SEQ ID NO: 2348051 - protein, 10 aa, Cryptosporidium parvum
GSLTVNGPFS

SEQ ID NO: 2348052 - protein, 5 aa, Cryptosporidium parvum
GSNGI

SEQ ID NO: 2348053 - protein, 5 aa, Cryptosporidium parvum
GSNND

SEQ ID NO: 2348054 - protein, 7 aa, Cryptosporidium parvum
GSNPTNL

SEQ ID NO: 2348055 - protein, 5 aa, Cryptosporidium parvum
GSNQV

SEQ ID NO: 2348056 - protein, 10 aa, Cryptosporidium parvum
GSNTNEATDK

SEQ ID NO: 2348057 - protein, 6 aa, Cryptosporidium parvum
GSNTQI

SEQ ID NO: 2348058 - protein, 16 aa, Cryptosporidium parvum
GSPDSEYSAADAPKGY

SEQ ID NO: 2348059 - protein, 18 aa, Cryptosporidium parvum
GSSGGSGNIGITNNNGLT

SEQ ID NO: 2348060 - protein, 9 aa, Cryptosporidium parvum
GSSGSGDKQ

SEQ ID NO: 2348061 - protein, 6 aa, Cryptosporidium parvum
GSSIST

SEQ ID NO: 2348062 - protein, 4 aa, Cryptosporidium parvum
GSSR

SEQ ID NO: 2348063 - protein, 14 aa, Cryptosporidium parvum
GSSSASSSTQNAFS

SEQ ID NO: 2348064 - protein, 18 aa, Cryptosporidium parvum
GSSTKNTNSNAGNSSGTN

SEQ ID NO: 2348065 - protein, 13 aa, Cryptosporidium parvum
GSSTRDGDFWTEG

SEQ ID NO: 2348066 - protein, 10 aa, Cryptosporidium parvum
GSVSNNNRYA

SEQ ID NO: 2348067 - protein, 8 aa, Cryptosporidium parvum
GTDDESFS

SEQ ID NO: 2348068 - protein, 11 aa, Cryptosporidium parvum
GTEESPGEKEL

SEQ ID NO: 2348069 - protein, 11 aa, Cryptosporidium parvum
GTEGDNSNSIK

SEQ ID NO: 2348070 - protein, 4 aa, Cryptosporidium parvum
GTEN

SEQ ID NO: 2348071 - protein, 9 aa, Cryptosporidium parvum
GTESSNESI

SEQ ID NO: 2348072 - protein, 10 aa, Cryptosporidium parvum
GTESTTEDIY

SEQ ID NO: 2348073 - protein, 5 aa, Cryptosporidium parvum
GTGDI

SEQ ID NO: 2348074 - protein, 15 aa, Cryptosporidium parvum
GTGGCNNNASSNTQD

SEQ ID NO: 2348075 - protein, 7 aa, Cryptosporidium parvum
GTGMPAS

SEQ ID NO: 2348076 - protein, 20 aa, Cryptosporidium parvum
GTGTGSFSRTTSNLSPAQQN

SEQ ID NO: 2348077 - protein, 9 aa, Cryptosporidium parvum
GTHPTHGRG

SEQ ID NO: 2348078 - protein, 6 aa, Cryptosporidium parvum
GTISDS

SEQ ID NO: 2348079 - protein, 10 aa, Cryptosporidium parvum
GTKDNDFNNS

SEQ ID NO: 2348080 - protein, 5 aa, Cryptosporidium parvum
GTLDS

SEQ ID NO: 2348081 - protein, 19 aa, Cryptosporidium parvum
GTLEGSKENFKNSEENSPI

SEQ ID NO: 2348082 - protein, 35 aa, Cryptosporidium parvum
GTNCQSSEGNNNKEIPTKTLPSNITGNKTTLYGRN

SEQ ID NO: 2348083 - protein, 8 aa, Cryptosporidium parvum
GTNETLPY

SEQ ID NO: 2348084 - protein, 10 aa, Cryptosporidium parvum
GTNRTSTVPS

SEQ ID NO: 2348085 - protein, 18 aa, Cryptosporidium parvum
GTPTYEYGDPREGEHKQW

SEQ ID NO: 2348086 - protein, 14 aa, Cryptosporidium parvum
GTQNNTPNKPTNTY

SEQ ID NO: 2348087 - protein, 7 aa, Cryptosporidium parvum
GTQPDLE

SEQ ID NO: 2348088 - protein, 20 aa, Cryptosporidium parvum
GTRNNSISAVSSSNSSNITN

SEQ ID NO: 2348089 - protein, 7 aa, Cryptosporidium parvum
GTSCEPP

SEQ ID NO: 2348090 - protein, 12 aa, Cryptosporidium parvum
GTSFTNGRKSRE

SEQ ID NO: 2348091 - protein, 11 aa, Cryptosporidium parvum
GTSLRPANPPI

SEQ ID NO: 2348092 - protein, 17 aa, Cryptosporidium parvum
GTTIGGSGIGQNGQINM

SEQ ID NO: 2348093 - protein, 11 aa, Cryptosporidium parvum
GTTPNTGAHSG

SEQ ID NO: 2348094 - protein, 24 aa, Cryptosporidium parvum
GTTQVGGKGTARRKKRAQKPTGVD

SEQ ID NO: 2348095 - protein, 34 aa, Cryptosporidium parvum; identical to SEQ ID NO: 2144396

SEQ ID NO: 2348096 - protein, 5 aa, Cryptosporidium parvum
GVGGG

SEQ ID NO: 2348097 - protein, 5 aa, Cryptosporidium parvum
GVGQP

SEQ ID NO: 2348098 - protein, 12 aa, Cryptosporidium parvum
GVKNSGKGTATV

SEQ ID NO: 2348099 - protein, 13 aa, Cryptosporidium parvum
GVKQNSGKQNSNF

SEQ ID NO: 2348100 - protein, 9 aa, Cryptosporidium parvum
GVKSGKALS

SEQ ID NO: 2348101 - protein, 5 aa, Cryptosporidium parvum
GVQDA

SEQ ID NO: 2348102 - protein, 8 aa, Cryptosporidium parvum
GVSSRKRR

SEQ ID NO: 2348103 - protein, 5 aa, Cryptosporidium parvum
GVTPR

SEQ ID NO: 2348104 - protein, 33 aa, Cryptosporidium parvum; identical to SEQ ID NO: 2328434

SEQ ID NO: 2348105 - protein, 5 aa, Cryptosporidium parvum
GYDTA

SEQ ID NO: 2348106 - protein, 10 aa, Cryptosporidium parvum
GYESGSSGNI

SEQ ID NO: 2348107 - protein, 32 aa, Cryptosporidium parvum; identical to SEQ ID NO: 2144471

SEQ ID NO: 2348108 - protein, 7 aa, Cryptosporidium parvum
GYNPSEL

SEQ ID NO: 2348109 - protein, 5 aa, Cryptosporidium parvum
GYNTE

SEQ ID NO: 2348110 - protein, 34 aa, Cryptosporidium parvum; identical to SEQ ID NO: 2261159

SEQ ID NO: 2348111 - protein, 38 aa, Cryptosporidium parvum; identical to SEQ ID NO: 2261166

SEQ ID NO: 2348112 - protein, 9 aa, Cryptosporidium parvum
GYSDTEISE

SEQ ID NO: 2348113 - protein, 4 aa, Cryptosporidium parvum
GYTK

SEQ ID NO: 2348114 - protein, 8 aa, Cryptosporidium parvum
HAAKENRL

SEQ ID NO: 2348115 - protein, 9 aa, Cryptosporidium parvum
HADNKGSIE

SEQ ID NO: 2348116 - protein, 7 aa, Cryptosporidium parvum
HAGDDES

SEQ ID NO: 2348117 - protein, 8 aa, Cryptosporidium parvum
HANTGIEN

SEQ ID NO: 2348118 - protein, 6 aa, Cryptosporidium parvum
HAQGKK

SEQ ID NO: 2348119 - protein, 7 aa, Cryptosporidium parvum
HDATPNM

SEQ ID NO: 2348120 - protein, 4 aa, Cryptosporidium parvum
HDEF

SEQ ID NO: 2348121 - protein, 8 aa, Cryptosporidium parvum
HDETNNSA

SEQ ID NO: 2348122 - protein, 29 aa, Cryptosporidium parvum
HDPNPPKKETSKSIYSEKKYDTLESRNPN

SEQ ID NO: 2348123 - protein, 19 aa, Cryptosporidium parvum
HDQAGNRCNGGNPSGDDRI

SEQ ID NO: 2348124 - protein, 11 aa, Cryptosporidium parvum
HEAVKESHQRY

SEQ ID NO: 2348125 - protein, 4 aa, Cryptosporidium parvum
HEFP

SEQ ID NO: 2348126 - protein, 18 aa, Cryptosporidium parvum
HEKSGNNEKKDSSSPVKD

SEQ ID NO: 2348127 - protein, 10 aa, Cryptosporidium parvum
HEKSVESELE

SEQ ID NO: 2348128 - protein, 22 aa, Cryptosporidium parvum
HENDQTEEIGEKAPKKRKSSAH

SEQ ID NO: 2348129 - protein, 7 aa, Cryptosporidium parvum
HENENTD

SEQ ID NO: 2348130 - protein, 5 aa, Cryptosporidium parvum
HENKT

SEQ ID NO: 2348131 - protein, 23 aa, Cryptosporidium parvum
HESDANSKSRAESISFSPNKPHK

SEQ ID NO: 2348132 - protein, 21 aa, Cryptosporidium parvum
HESNSNCSINSESAPKSNPKR

SEQ ID NO: 2348133 - protein, 32 aa, Cryptosporidium parvum; identical to SEQ ID NO: 2261323

SEQ ID NO: 2348134 - protein, 6 aa, Cryptosporidium parvum
HFSSNT

SEQ ID NO: 2348135 - protein, 15 aa, Cryptosporidium parvum
HGDGGLISGVLSSCC

SEQ ID NO: 2348136 - protein, 14 aa, Cryptosporidium parvum
HGFSQGSKCNTENL

SEQ ID NO: 2348137 - protein, 14 aa, Cryptosporidium parvum
HGIDPTGTYHGESD

SEQ ID NO: 2348138 - protein, 7 aa, Cryptosporidium parvum
HGPDSDL

SEQ ID NO: 2348139 - protein, 10 aa, Cryptosporidium parvum
HHNDSISEFN

SEQ ID NO: 2348140 - protein, 37 aa, Cryptosporidium parvum
HISPKTQKTSDLTKSKETSSTSSDEEAPPAPPAPLPL

SEQ ID NO: 2348141 - protein, 23 aa, Cryptosporidium parvum
HKKDKKVKLDEDDNIRDNKSQTF

SEQ ID NO: 2348142 - protein, 8 aa, Cryptosporidium parvum
HKNGYFNN

SEQ ID NO: 2348143 - protein, 8 aa, Cryptosporidium parvum
HKPPGRAD

SEQ ID NO: 2348144 - protein, 10 aa, Cryptosporidium parvum
HKQNNNEVPV

SEQ ID NO: 2348145 - protein, 10 aa, Cryptosporidium parvum
HKRTRTRSLE

SEQ ID NO: 2348146 - protein, 6 aa, Cryptosporidium parvum
HKTNGG

SEQ ID NO: 2348147 - protein, 13 aa, Cryptosporidium parvum
HLEDNERTTTRIY

SEQ ID NO: 2348148 - protein, 10 aa, Cryptosporidium parvum
HLNDSSNNEH

SEQ ID NO: 2348149 - protein, 5 aa, Cryptosporidium parvum
HLPQL

SEQ ID NO: 2348150 - protein, 15 aa, Cryptosporidium parvum
HLTDDDLKTPLPRTY

SEQ ID NO: 2348151 - protein, 16 aa, Cryptosporidium parvum
HNEKNYDRSDSDRQMS

SEQ ID NO: 2348152 - protein, 9 aa, Cryptosporidium parvum
HNGDGTREK

SEQ ID NO: 2348153 - protein, 12 aa, Cryptosporidium parvum
HNLPGPNPKKEY

SEQ ID NO: 2348154 - protein, 6 aa, Cryptosporidium parvum
HNNGIT

SEQ ID NO: 2348155 - protein, 10 aa, Cryptosporidium parvum
HNTNVQSSIQ

SEQ ID NO: 2348156 - protein, 14 aa, Cryptosporidium parvum
HPESGYNLDNSPHL

SEQ ID NO: 2348157 - protein, 32 aa, Cryptosporidium parvum; identical to SEQ ID NO: 2261537

SEQ ID NO: 2348158 - protein, 4 aa, Cryptosporidium parvum
HPNG

SEQ ID NO: 2348159 - protein, 6 aa, Cryptosporidium parvum
HPQPHT

SEQ ID NO: 2348160 - protein, 12 aa, Cryptosporidium parvum
HQAQGGEARNSI

SEQ ID NO: 2348161 - protein, 4 aa, Cryptosporidium parvum
HQSS

SEQ ID NO: 2348162 - protein, 8 aa, Cryptosporidium parvum
HQTGRDTH

SEQ ID NO: 2348163 - protein, 7 aa, Cryptosporidium parvum
HRDPDQG

SEQ ID NO: 2348164 - protein, 8 aa, Cryptosporidium parvum
HRNNKTAT

SEQ ID NO: 2348165 - protein, 27 aa, Cryptosporidium parvum
HRNSRHNDSRYNDKGDNSGSLESQRFE

SEQ ID NO: 2348166 - protein, 6 aa, Cryptosporidium parvum
HRPERN

SEQ ID NO: 2348167 - protein, 11 aa, Cryptosporidium parvum
HRQSYSGEGRA

SEQ ID NO: 2348168 - protein, 13 aa, Cryptosporidium parvum
HRTRSHRQSRTQN

SEQ ID NO: 2348169 - protein, 8 aa, Cryptosporidium parvum
HSDSGEMS

SEQ ID NO: 2348170 - protein, 22 aa, Cryptosporidium parvum
HSENLSDSSSYSSEESKSIEIE

SEQ ID NO: 2348171 - protein, 7 aa, Cryptosporidium parvum
HSESFRE

SEQ ID NO: 2348172 - protein, 7 aa, Cryptosporidium parvum
HSETSQE

SEQ ID NO: 2348173 - protein, 15 aa, Cryptosporidium parvum
HSGHQKFKADTDLSS

SEQ ID NO: 2348174 - protein, 11 aa, Cryptosporidium parvum
HSIKGQQNHPV

SEQ ID NO: 2348175 - protein, 11 aa, Cryptosporidium parvum
HSKKDDPIKND

SEQ ID NO: 2348176 - protein, 22 aa, Cryptosporidium parvum
HSKTSTSATEGPKLGKETNQNA

SEQ ID NO: 2348177 - protein, 14 aa, Cryptosporidium parvum
HSNSNNINSKVPDT

SEQ ID NO: 2348178 - protein, 11 aa, Cryptosporidium parvum
HSPNRDSNYRH

SEQ ID NO: 2348179 - protein, 23 aa, Cryptosporidium parvum
HSPTSSSRSIGNNANMNPPKSPS

SEQ ID NO: 2348180 - protein, 14 aa, Cryptosporidium parvum
HSRNRFDRTPHGNY

SEQ ID NO: 2348181 - protein, 20 aa, Cryptosporidium parvum
HSRSGTPGKESCLENESERS

SEQ ID NO: 2348182 - protein, 4 aa, Cryptosporidium parvum
HSSI

SEQ ID NO: 2348183 - protein, 12 aa, Cryptosporidium parvum
HSSNAKSNSKKK

SEQ ID NO: 2348184 - protein, 18 aa, Cryptosporidium parvum
HSSSNPCPSCSSSAKSCS

SEQ ID NO: 2348185 - protein, 4 aa, Cryptosporidium parvum
HSST

SEQ ID NO: 2348186 - protein, 19 aa, Cryptosporidium parvum
HTNGGSEKHSKNINSPNSI

SEQ ID NO: 2348187 - protein, 41 aa, Cryptosporidium parvum; identical to SEQ ID NO: 2261754

SEQ ID NO: 2348188 - protein, 42 aa, Cryptosporidium parvum
HTQPNNNMQPPSHPRTQPLPHPYSQGNPGHQVSSQNFSSSSI

SEQ ID NO: 2348189 - protein, 8 aa, Cryptosporidium parvum
HTYPSDTV

SEQ ID NO: 2348190 - protein, 5 aa, Cryptosporidium parvum
HVPNA

SEQ ID NO: 2348191 - protein, 12 aa, Cryptosporidium parvum
HYEEEKNKIDSE

SEQ ID NO: 2348192 - protein, 13 aa, Cryptosporidium parvum
HYSKSNRKPVENY

SEQ ID NO: 2348193 - protein, 6 aa, Cryptosporidium parvum
HYTEGA

SEQ ID NO: 2348194 - protein, 9 aa, Cryptosporidium parvum
IAENYPNSN

SEQ ID NO: 2348195 - protein, 5 aa, Cryptosporidium parvum
IAERE

SEQ ID NO: 2348196 - protein, 14 aa, Cryptosporidium parvum
IAKESQNREAADDD

SEQ ID NO: 2348197 - protein, 19 aa, Cryptosporidium parvum
IAQSPLSENVSKSSPKIEK

SEQ ID NO: 2348198 - protein, 23 aa, Cryptosporidium parvum
IASGNIEPSGNSNNCSGNTQNGT

SEQ ID NO: 2348199 - protein, 8 aa, Cryptosporidium parvum
IASSSDSG

SEQ ID NO: 2348200 - protein, 6 aa, Cryptosporidium parvum
IASTSY

SEQ ID NO: 2348201 - protein, 10 aa, Cryptosporidium parvum
IDAKKRLNAD

SEQ ID NO: 2348202 - protein, 10 aa, Cryptosporidium parvum
IDDDSEDELE

SEQ ID NO: 2348203 - protein, 8 aa, Cryptosporidium parvum
IDDPSVST

SEQ ID NO: 2348204 - protein, 12 aa, Cryptosporidium parvum
IDEKDETETSEE

SEQ ID NO: 2348205 - protein, 10 aa, Cryptosporidium parvum
IDENASTRSQ

SEQ ID NO: 2348206 - protein, 5 aa, Cryptosporidium parvum
IDNNT

SEQ ID NO: 2348207 - protein, 5 aa, Cryptosporidium parvum
IDNPA

SEQ ID NO: 2348208 - protein, 8 aa, Cryptosporidium parvum
IDNSASSN

SEQ ID NO: 2348209 - protein, 6 aa, Cryptosporidium parvum
IDNSGI

SEQ ID NO: 2348210 - protein, 9 aa, Cryptosporidium parvum
IDPESPPDL

SEQ ID NO: 2348211 - protein, 11 aa, Cryptosporidium parvum
IDQGGGKRKGA

SEQ ID NO: 2348212 - protein, 10 aa, Cryptosporidium parvum
IDQRDLENGT

SEQ ID NO: 2348213 - protein, 5 aa, Cryptosporidium parvum
IDSNK

SEQ ID NO: 2348214 - protein, 11 aa, Cryptosporidium parvum
IDSNTNNRPNI

SEQ ID NO: 2348215 - protein, 5 aa, Cryptosporidium parvum
IDSSD

SEQ ID NO: 2348216 - protein, 17 aa, Cryptosporidium parvum
IDSSINPSNQPTESSCS

SEQ ID NO: 2348217 - protein, 9 aa, Cryptosporidium parvum
IDTSGEGSV

SEQ ID NO: 2348218 - protein, 14 aa, Cryptosporidium parvum
IEAENQQRNEIQSN

SEQ ID NO: 2348219 - protein, 4 aa, Cryptosporidium parvum
IEDS

SEQ ID NO: 2348220 - protein, 10 aa, Cryptosporidium parvum
IEEDDNPSAL

SEQ ID NO: 2348221 - protein, 35 aa, Cryptosporidium parvum; identical to SEQ ID NO: 2145237

SEQ ID NO: 2348222 - protein, 10 aa, Cryptosporidium parvum
IEESPKTNHI

SEQ ID NO: 2348223 - protein, 12 aa, Cryptosporidium parvum
IEESPSPIKQGE

SEQ ID NO: 2348224 - protein, 9 aa, Cryptosporidium parvum
IEGEEGKKF

SEQ ID NO: 2348225 - protein, 6 aa, Cryptosporidium parvum
IEGNPD

SEQ ID NO: 2348226 - protein, 23 aa, Cryptosporidium parvum
IEKPSKKYYTSKNNSSNNKSTID

SEQ ID NO: 2348227 - protein, 5 aa, Cryptosporidium parvum
IENDD

SEQ ID NO: 2348228 - protein, 5 aa, Cryptosporidium parvum
IENEI

SEQ ID NO: 2348229 - protein, 9 aa, Cryptosporidium parvum
IEPEESNEL

SEQ ID NO: 2348230 - protein, 6 aa, Cryptosporidium parvum
IEPGHV

SEQ ID NO: 2348231 - protein, 9 aa, Cryptosporidium parvum
IEPNNNPKE

SEQ ID NO: 2348232 - protein, 4 aa, Cryptosporidium parvum
IEQK

SEQ ID NO: 2348233 - protein, 11 aa, Cryptosporidium parvum
IEREEGEVENI

SEQ ID NO: 2348234 - protein, 7 aa, Cryptosporidium parvum
IERKDPV

SEQ ID NO: 2348235 - protein, 10 aa, Cryptosporidium parvum
IESDNTDIYS

SEQ ID NO: 2348236 - protein, 8 aa, Cryptosporidium parvum
IESERPKR

SEQ ID NO: 2348237 - protein, 4 aa, Cryptosporidium parvum
IETD

SEQ ID NO: 2348238 - protein, 4 aa, Cryptosporidium parvum
IETM

SEQ ID NO: 2348239 - protein, 6 aa, Cryptosporidium parvum
IETNDK

SEQ ID NO: 2348240 - protein, 13 aa, Cryptosporidium parvum
IETNKGERVSPCP

SEQ ID NO: 2348241 - protein, 10 aa, Cryptosporidium parvum
IETNPEATLP

SEQ ID NO: 2348242 - protein, 6 aa, Cryptosporidium parvum
IEVDGQ

SEQ ID NO: 2348243 - protein, 24 aa, Cryptosporidium parvum
IEYNGGTPNASTTYEFNSNIYSSL

SEQ ID NO: 2348244 - protein, 13 aa, Cryptosporidium parvum
IGAEDNNNRQKQK

SEQ ID NO: 2348245 - protein, 6 aa, Cryptosporidium parvum
IGEPTY

SEQ ID NO: 2348246 - protein, 6 aa, Cryptosporidium parvum
IGERKE

SEQ ID NO: 2348247 - protein, 16 aa, Cryptosporidium parvum
IGGARGDESAHGDHEV

SEQ ID NO: 2348248 - protein, 4 aa, Cryptosporidium parvum
IGGG

SEQ ID NO: 2348249 - protein, 50 aa, Cryptosporidium parvum
IGGMGGTGGMGGTGGIGGTGGIGGTGGIGGTGGIGGTGGIGGIAGTGLGG

SEQ ID NO: 2348250 - protein, 9 aa, Cryptosporidium parvum
IGHDSSSEF

SEQ ID NO: 2348251 - protein, 6 aa, Cryptosporidium parvum
IGIDSN

SEQ ID NO: 2348252 - protein, 28 aa, Cryptosporidium parvum
IGNSNNNNNNNNNNNINNTTNTSSINGL

SEQ ID NO: 2348253 - protein, 4 aa, Cryptosporidium parvum
IGPG

SEQ ID NO: 2348254 - protein, 7 aa, Cryptosporidium parvum
IGPGTGN

SEQ ID NO: 2348255 - protein, 6 aa, Cryptosporidium parvum
IGREVN

SEQ ID NO: 2348256 - protein, 6 aa, Cryptosporidium parvum
IGRNVT

SEQ ID NO: 2348257 - protein, 6 aa, Cryptosporidium parvum
IGSAPT

SEQ ID NO: 2348258 - protein, 6 aa, Cryptosporidium parvum
IGSDET

SEQ ID NO: 2348259 - protein, 50 aa, Cryptosporidium parvum; identical to SEQ ID NO: 2262253

SEQ ID NO: 2348260 - protein, 4 aa, Cryptosporidium parvum
IGSK

SEQ ID NO: 2348261 - protein, 5 aa, Cryptosporidium parvum
IGSPG

SEQ ID NO: 2348262 - protein, 5 aa, Cryptosporidium parvum
IGSQR

SEQ ID NO: 2348263 - protein, 16 aa, Cryptosporidium parvum
IGSQRTEGESGDSEVQ

SEQ ID NO: 2348264 - protein, 10 aa, Cryptosporidium parvum
IGSSDQKIVS

SEQ ID NO: 2348265 - protein, 37 aa, Cryptosporidium parvum
IGSSQYNRRNNIKENTEVDEKEPITLSKEDDSKKENF

SEQ ID NO: 2348266 - protein, 12 aa, Cryptosporidium parvum
IGSTSPKIVGSG

SEQ ID NO: 2348267 - protein, 9 aa, Cryptosporidium parvum
IGTNNTPVE

SEQ ID NO: 2348268 - protein, 11 aa, Cryptosporidium parvum
IHDNGKNEEPV

SEQ ID NO: 2348269 - protein, 10 aa, Cryptosporidium parvum
IHEKEEPNIP

SEQ ID NO: 2348270 - protein, 4 aa, Cryptosporidium parvum
IHET

SEQ ID NO: 2348271 - protein, 20 aa, Cryptosporidium parvum
IHGQGKASFSSGNTYEGQWE

SEQ ID NO: 2348272 - protein, 7 aa, Cryptosporidium parvum
IHNEESH

SEQ ID NO: 2348273 - protein, 4 aa, Cryptosporidium parvum
IHNN

SEQ ID NO: 2348274 - protein, 9 aa, Cryptosporidium parvum
IISSSDTQG

SEQ ID NO: 2348275 - protein, 7 aa, Cryptosporidium parvum
IKASESI

SEQ ID NO: 2348276 - protein, 14 aa, Cryptosporidium parvum
IKESVGDEKGTKSR

SEQ ID NO: 2348277 - protein, 27 aa, Cryptosporidium parvum
IKKDSNKKTSICKSSAKSLSTGSKCKK

SEQ ID NO: 2348278 - protein, 9 aa, Cryptosporidium parvum
IKKEEDKFG

SEQ ID NO: 2348279 - protein, 12 aa, Cryptosporidium parvum
IKNANSKLSQTV

SEQ ID NO: 2348280 - protein, 26 aa, Cryptosporidium parvum
IKNGSGIQKQTSNSQNSSHNKGGGSS

SEQ ID NO: 2348281 - protein, 10 aa, Cryptosporidium parvum
IKNNSDRFKP

SEQ ID NO: 2348282 - protein, 4 aa, Cryptosporidium parvum
IKNS

SEQ ID NO: 2348283 - protein, 8 aa, Cryptosporidium parvum
IKNSSDQT

SEQ ID NO: 2348284 - protein, 6 aa, Cryptosporidium parvum
IKPTDT

SEQ ID NO: 2348285 - protein, 4 aa, Cryptosporidium parvum
IKQK

SEQ ID NO: 2348286 - protein, 25 aa, Cryptosporidium parvum
IKSKSSSDLTATSSIDSSSITPETL

SEQ ID NO: 2348287 - protein, 11 aa, Cryptosporidium parvum
IKSVGSSGESE

SEQ ID NO: 2348288 - protein, 10 aa, Cryptosporidium parvum
IKTDESGVSR

SEQ ID NO: 2348289 - protein, 10 aa, Cryptosporidium parvum
IKTTSRNARD

SEQ ID NO: 2348290 - protein, 9 aa, Cryptosporidium parvum
IMSESSDSN

SEQ ID NO: 2348291 - protein, 23 aa, Cryptosporidium parvum
INDENDNDEIDCTETDKDIKEGY

SEQ ID NO: 2348292 - protein, 4 aa, Cryptosporidium parvum
INDN

SEQ ID NO: 2348293 - protein, 6 aa, Cryptosporidium parvum
INDTNK

SEQ ID NO: 2348294 - protein, 6 aa, Cryptosporidium parvum
INEEER

SEQ ID NO: 2348295 - protein, 10 aa, Cryptosporidium parvum
INESNTSIPN

SEQ ID NO: 2348296 - protein, 22 aa, Cryptosporidium parvum
INGEKSDGTYLSSSNHETEGKN

SEQ ID NO: 2348297 - protein, 12 aa, Cryptosporidium parvum
INGLSRSSQDLR

SEQ ID NO: 2348298 - protein, 5 aa, Cryptosporidium parvum
INGSI

SEQ ID NO: 2348299 - protein, 7 aa, Cryptosporidium parvum
INKKSEK

SEQ ID NO: 2348300 - protein, 7 aa, Cryptosporidium parvum
INKTSTA

SEQ ID NO: 2348301 - protein, 6 aa, Cryptosporidium parvum
INNEPI

SEQ ID NO: 2348302 - protein, 6 aa, Cryptosporidium parvum
INNGNK

SEQ ID NO: 2348303 - protein, 16 aa, Cryptosporidium parvum
INNSNSATNTNANPIS

SEQ ID NO: 2348304 - protein, 11 aa, Cryptosporidium parvum
INNSSTTNTNR

SEQ ID NO: 2348305 - protein, 9 aa, Cryptosporidium parvum
INNTESEKR

SEQ ID NO: 2348306 - protein, 9 aa, Cryptosporidium parvum
INPDNSKDF

SEQ ID NO: 2348307 - protein, 23 aa, Cryptosporidium parvum
INPEGSHNTKKPSECRLTRGKFI

SEQ ID NO: 2348308 - protein, 5 aa, Cryptosporidium parvum
INPRT

SEQ ID NO: 2348309 - protein, 4 aa, Cryptosporidium parvum
INPS

SEQ ID NO: 2348310 - protein, 15 aa, Cryptosporidium parvum
INQTPEGSKHSEPNI

SEQ ID NO: 2348311 - protein, 9 aa, Cryptosporidium parvum
INSASTSPM

SEQ ID NO: 2348312 - protein, 42 aa, Cryptosporidium parvum; identical to SEQ ID NO: 2262681

SEQ ID NO: 2348313 - protein, 4 aa, Cryptosporidium parvum
INSH

SEQ ID NO: 2348314 - protein, 6 aa, Cryptosporidium parvum
INSKSL

SEQ ID NO: 2348315 - protein, 11 aa, Cryptosporidium parvum
INSNGITGIGS

SEQ ID NO: 2348316 - protein, 20 aa, Cryptosporidium parvum
INSQDSDGSSKTKSGGNMNT

SEQ ID NO: 2348317 - protein, 12 aa, Cryptosporidium parvum
INSVKNDSSVKI

SEQ ID NO: 2348318 - protein, 15 aa, Cryptosporidium parvum
INSYEKGKLTPHPGL

SEQ ID NO: 2348319 - protein, 7 aa, Cryptosporidium parvum
INTDSNY

SEQ ID NO: 2348320 - protein, 5 aa, Cryptosporidium parvum
INTPE

SEQ ID NO: 2348321 - protein, 8 aa, Cryptosporidium parvum
INTSDESI

SEQ ID NO: 2348322 - protein, 8 aa, Cryptosporidium parvum
INTSDGGC

SEQ ID NO: 2348323 - protein, 5 aa, Cryptosporidium parvum
IPDVG

SEQ ID NO: 2348324 - protein, 17 aa, Cryptosporidium parvum
IPGGGTSGSPTSPGSPI

SEQ ID NO: 2348325 - protein, 9 aa, Cryptosporidium parvum
IPGNSTGNQ

SEQ ID NO: 2348326 - protein, 14 aa, Cryptosporidium parvum
IPGQVDTSTPQANP

SEQ ID NO: 2348327 - protein, 9 aa, Cryptosporidium parvum
IPGRDDCSE

SEQ ID NO: 2348328 - protein, 9 aa, Cryptosporidium parvum
IPGSEKTTL

SEQ ID NO: 2348329 - protein, 4 aa, Cryptosporidium parvum
IPPK

SEQ ID NO: 2348330 - protein, 9 aa, Cryptosporidium parvum
IPPKDTDSL

SEQ ID NO: 2348331 - protein, 5 aa, Cryptosporidium parvum
IPPKG

SEQ ID NO: 2348332 - protein, 5 aa, Cryptosporidium parvum
IPPRK

SEQ ID NO: 2348333 - protein, 4 aa, Cryptosporidium parvum
IPRG

SEQ ID NO: 2348334 - protein, 4 aa, Cryptosporidium parvum
IPRS

SEQ ID NO: 2348335 - protein, 11 aa, Cryptosporidium parvum
IPRSNQRETIG

SEQ ID NO: 2348336 - protein, 4 aa, Cryptosporidium parvum
IPSH

SEQ ID NO: 2348337 - protein, 6 aa, Cryptosporidium parvum
IPSQNE

SEQ ID NO: 2348338 - protein, 9 aa, Cryptosporidium parvum
IPSSSSGRQ

SEQ ID NO: 2348339 - protein, 13 aa, Cryptosporidium parvum
IQAEKFGKSTGRC

SEQ ID NO: 2348340 - protein, 8 aa, Cryptosporidium parvum
IQANQGSY

SEQ ID NO: 2348341 - protein, 6 aa, Cryptosporidium parvum
IQEGRI

SEQ ID NO: 2348342 - protein, 8 aa, Cryptosporidium parvum
IQENSSFR

SEQ ID NO: 2348343 - protein, 12 aa, Cryptosporidium parvum
IQGGGGKSSLVK

SEQ ID NO: 2348344 - protein, 22 aa, Cryptosporidium parvum
IQISNKEAKDLDNSERHDTKNE

SEQ ID NO: 2348345 - protein, 5 aa, Cryptosporidium parvum
IQNND

SEQ ID NO: 2348346 - protein, 14 aa, Cryptosporidium parvum
IQPAGMTAASGSQC

SEQ ID NO: 2348347 - protein, 6 aa, Cryptosporidium parvum
IQQEES

SEQ ID NO: 2348348 - protein, 10 aa, Cryptosporidium parvum
IQSGCSEGDG

SEQ ID NO: 2348349 - protein, 6 aa, Cryptosporidium parvum
IQSSGL

SEQ ID NO: 2348350 - protein, 11 aa, Cryptosporidium parvum
IQSSSKKRMGG

SEQ ID NO: 2348351 - protein, 8 aa, Cryptosporidium parvum
IRENSETK

SEQ ID NO: 2348352 - protein, 12 aa, Cryptosporidium parvum
IRENSPENIESR

SEQ ID NO: 2348353 - protein, 8 aa, Cryptosporidium parvum
IRESSTYS

SEQ ID NO: 2348354 - protein, 17 aa, Cryptosporidium parvum
IRGTGSYIRGTNGRSNG

SEQ ID NO: 2348355 - protein, 10 aa, Cryptosporidium parvum
IRNRSNKAIK

SEQ ID NO: 2348356 - protein, 8 aa, Cryptosporidium parvum
IRQESENY

SEQ ID NO: 2348357 - protein, 19 aa, Cryptosporidium parvum
IRQKKLSKNLDDNEDINSN

SEQ ID NO: 2348358 - protein, 13 aa, Cryptosporidium parvum
IRRQNSRKSINEK

SEQ ID NO: 2348359 - protein, 5 aa, Cryptosporidium parvum
IRSCS

SEQ ID NO: 2348360 - protein, 6 aa, Cryptosporidium parvum
IRYSGD

SEQ ID NO: 2348361 - protein, 12 aa, Cryptosporidium parvum
ISATKEDVENGM

SEQ ID NO: 2348362 - protein, 6 aa, Cryptosporidium parvum
ISDASN

SEQ ID NO: 2348363 - protein, 7 aa, Cryptosporidium parvum
ISDEKAR

SEQ ID NO: 2348364 - protein, 9 aa, Cryptosporidium parvum
ISDPPSSNL

SEQ ID NO: 2348365 - protein, 10 aa, Cryptosporidium parvum
ISEAQGDLGP

SEQ ID NO: 2348366 - protein, 7 aa, Cryptosporidium parvum
ISEGETH

SEQ ID NO: 2348367 - protein, 6 aa, Cryptosporidium parvum
ISENKN

SEQ ID NO: 2348368 - protein, 37 aa, Cryptosporidium parvum; identical to SEQ ID NO: 2263090

SEQ ID NO: 2348369 - protein, 11 aa, Cryptosporidium parvum
ISETSENLNRS

SEQ ID NO: 2348370 - protein, 9 aa, Cryptosporidium parvum
ISGEKSSEI

SEQ ID NO: 2348371 - protein, 34 aa, Cryptosporidium parvum; identical to SEQ ID NO: 2263116

SEQ ID NO: 2348372 - protein, 4 aa, Cryptosporidium parvum
ISGM

SEQ ID NO: 2348373 - protein, 6 aa, Cryptosporidium parvum
ISGQNF

SEQ ID NO: 2348374 - protein, 6 aa, Cryptosporidium parvum
ISIPKQ

SEQ ID NO: 2348375 - protein, 24 aa, Cryptosporidium parvum
ISITDKQNSSEVNNNNNNNCNDSD

SEQ ID NO: 2348376 - protein, 28 aa, Cryptosporidium parvum
ISKDSKASSLPSSSTGASSTATTINGES

SEQ ID NO: 2348377 - protein, 13 aa, Cryptosporidium parvum
ISKGGFSDRPGNV

SEQ ID NO: 2348378 - protein, 16 aa, Cryptosporidium parvum
ISKGNPEFSSSHQQDT

SEQ ID NO: 2348379 - protein, 8 aa, Cryptosporidium parvum
ISKNGFSN

SEQ ID NO: 2348380 - protein, 7 aa, Cryptosporidium parvum
ISKSDQA

SEQ ID NO: 2348381 - protein, 39 aa, Cryptosporidium parvum; identical to SEQ ID NO: 2146176

SEQ ID NO: 2348382 - protein, 8 aa, Cryptosporidium parvum
ISKTAGGL

SEQ ID NO: 2348383 - protein, 20 aa, Cryptosporidium parvum
ISNDIPKQIKKDRSKSNSYI

SEQ ID NO: 2348384 - protein, 14 aa, Cryptosporidium parvum
ISNGSETVKTGGTY

SEQ ID NO: 2348385 - protein, 6 aa, Cryptosporidium parvum
ISPDSN

SEQ ID NO: 2348386 - protein, 10 aa, Cryptosporidium parvum
ISPFKNSESH

SEQ ID NO: 2348387 - protein, 4 aa, Cryptosporidium parvum
ISPG

SEQ ID NO: 2348388 - protein, 5 aa, Cryptosporidium parvum
ISPRE

SEQ ID NO: 2348389 - protein, 7 aa, Cryptosporidium parvum
ISPTENE

SEQ ID NO: 2348390 - protein, 9 aa, Cryptosporidium parvum
ISQAMQTNK

SEQ ID NO: 2348391 - protein, 4 aa, Cryptosporidium parvum
ISRT

SEQ ID NO: 2348392 - protein, 12 aa, Cryptosporidium parvum
ISSDEESEKFGS

SEQ ID NO: 2348393 - protein, 12 aa, Cryptosporidium parvum
ISSDEETPKNIV

SEQ ID NO: 2348394 - protein, 13 aa, Cryptosporidium parvum
ISSEKHKKHIKED

SEQ ID NO: 2348395 - protein, 14 aa, Cryptosporidium parvum
ISSENQRKKTNARI

SEQ ID NO: 2348396 - protein, 6 aa, Cryptosporidium parvum
ISSKKV

SEQ ID NO: 2348397 - protein, 4 aa, Cryptosporidium parvum
ISSN

SEQ ID NO: 2348398 - protein, 7 aa, Cryptosporidium parvum
ISSPEND

SEQ ID NO: 2348399 - protein, 14 aa, Cryptosporidium parvum
ISSTSVSTNNDVSR

SEQ ID NO: 2348400 - protein, 13 aa, Cryptosporidium parvum
ISTAGTEASGTSN

SEQ ID NO: 2348401 - protein, 11 aa, Cryptosporidium parvum
ISTEEKTNQEK

SEQ ID NO: 2348402 - protein, 6 aa, Cryptosporidium parvum
ISTLSR

SEQ ID NO: 2348403 - protein, 9 aa, Cryptosporidium parvum
ISVSKDETI

SEQ ID NO: 2348404 - protein, 9 aa, Cryptosporidium parvum
ITDTSENKS

SEQ ID NO: 2348405 - protein, 7 aa, Cryptosporidium parvum
ITEERRH

SEQ ID NO: 2348406 - protein, 31 aa, Cryptosporidium parvum
ITEESTTKNEPEVSISSTNSNHIKKSSSNNF

SEQ ID NO: 2348407 - protein, 5 aa, Cryptosporidium parvum
ITETE

SEQ ID NO: 2348408 - protein, 5 aa, Cryptosporidium parvum
ITETS

SEQ ID NO: 2348409 - protein, 19 aa, Cryptosporidium parvum
ITGGRTRSLSRSVSPFHSN

SEQ ID NO: 2348410 - protein, 6 aa, Cryptosporidium parvum
ITGKER

SEQ ID NO: 2348411 - protein, 7 aa, Cryptosporidium parvum
ITGKKYA

SEQ ID NO: 2348412 - protein, 24 aa, Cryptosporidium parvum
ITGSSIGTGNTSGNSVSNNSTYQD

SEQ ID NO: 2348413 - protein, 4 aa, Cryptosporidium parvum
ITHR

SEQ ID NO: 2348414 - protein, 7 aa, Cryptosporidium parvum
ITKEGKC

SEQ ID NO: 2348415 - protein, 5 aa, Cryptosporidium parvum
ITKKE

SEQ ID NO: 2348416 - protein, 5 aa, Cryptosporidium parvum
ITNEN

SEQ ID NO: 2348417 - protein, 69 aa, Cryptosporidium parvum
ITNNTNTTSTGVSGGSNSNVVGSTNNNYPNQPTITTTATTTTATTTTSSSSSSSSSSSSSSSSSSNMKR

SEQ ID NO: 2348418 - protein, 9 aa, Cryptosporidium parvum
ITNPSTGSS

SEQ ID NO: 2348419 - protein, 7 aa, Cryptosporidium parvum
ITPTPYK

SEQ ID NO: 2348420 - protein, 14 aa, Cryptosporidium parvum
ITQGQGSPKDVKDT

SEQ ID NO: 2348421 - protein, 6 aa, Cryptosporidium parvum
ITRETY

SEQ ID NO: 2348422 - protein, 9 aa, Cryptosporidium parvum
ITRTSDVRP

SEQ ID NO: 2348423 - protein, 8 aa, Cryptosporidium parvum
ITSGPIGH

SEQ ID NO: 2348424 - protein, 4 aa, Cryptosporidium parvum
ITSY

SEQ ID NO: 2348425 - protein, 19 aa, Cryptosporidium parvum
ITVPSDDKETKVNTETEED

SEQ ID NO: 2348426 - protein, 29 aa, Cryptosporidium parvum
IVPESRSNISNPTTNINKSSSNLRTSTSV

SEQ ID NO: 2348427 - protein, 10 aa, Cryptosporidium parvum
KAAAKEKERQ

SEQ ID NO: 2348428 - protein, 10 aa, Cryptosporidium parvum
KAAPGYATAK

SEQ ID NO: 2348429 - protein, 7 aa, Cryptosporidium parvum
KADDTPL

SEQ ID NO: 2348430 - protein, 9 aa, Cryptosporidium parvum
KADGSTVTT

SEQ ID NO: 2348431 - protein, 5 aa, Cryptosporidium parvum
KADRW

SEQ ID NO: 2348432 - protein, 11 aa, Cryptosporidium parvum
KAELNDKIGQL

SEQ ID NO: 2348433 - protein, 26 aa, Cryptosporidium parvum
KAENISGTENSISRSSLESRTITTDA

SEQ ID NO: 2348434 - protein, 7 aa, Cryptosporidium parvum
KAERERG

SEQ ID NO: 2348435 - protein, 10 aa, Cryptosporidium parvum
KAIKENNNSE

SEQ ID NO: 2348436 - protein, 8 aa, Cryptosporidium parvum
KANLNKDK

SEQ ID NO: 2348437 - protein, 23 aa, Cryptosporidium parvum
KANQGANNPLTSFQSSARSNSVF

SEQ ID NO: 2348438 - protein, 23 aa, Cryptosporidium parvum
KAPGKSNLKKKEGRNARISQRED

SEQ ID NO: 2348439 - protein, 8 aa, Cryptosporidium parvum
KAPHAPPL

SEQ ID NO: 2348440 - protein, 12 aa, Cryptosporidium parvum
KAPTFKSRTNEY

SEQ ID NO: 2348441 - protein, 5 aa, Cryptosporidium parvum
KAPTN

SEQ ID NO: 2348442 - protein, 7 aa, Cryptosporidium parvum
KAPTPQL

SEQ ID NO: 2348443 - protein, 4 aa, Cryptosporidium parvum
KARA

SEQ ID NO: 2348444 - protein, 7 aa, Cryptosporidium parvum
KAREEKL

SEQ ID NO: 2348445 - protein, 12 aa, Cryptosporidium parvum
KARKGEPEPTII

SEQ ID NO: 2348446 - protein, 7 aa, Cryptosporidium parvum
KARYSEK

SEQ ID NO: 2348447 - protein, 26 aa, Cryptosporidium parvum
KATEVSGREVTQDEASNSNTDNDCSF

SEQ ID NO: 2348448 - protein, 5 aa, Cryptosporidium parvum
KATQL

SEQ ID NO: 2348449 - protein, 11 aa, Cryptosporidium parvum
KATSEKKLYDR

SEQ ID NO: 2348450 - protein, 6 aa, Cryptosporidium parvum
KCGSYP

SEQ ID NO: 2348451 - protein, 6 aa, Cryptosporidium parvum
KCKPGD

SEQ ID NO: 2348452 - protein, 14 aa, Cryptosporidium parvum
KCQTKNDKERDRER

SEQ ID NO: 2348453 - protein, 7 aa, Cryptosporidium parvum
KCSAEAS

SEQ ID NO: 2348454 - protein, 10 aa, Cryptosporidium parvum
KDANKLHQET

SEQ ID NO: 2348455 - protein, 7 aa, Cryptosporidium parvum
KDASNHY

SEQ ID NO: 2348456 - protein, 8 aa, Cryptosporidium parvum
KDDHDNRR

SEQ ID NO: 2348457 - protein, 6 aa, Cryptosporidium parvum
KDEIAR

SEQ ID NO: 2348458 - protein, 6 aa, Cryptosporidium parvum
KDEISR

SEQ ID NO: 2348459 - protein, 14 aa, Cryptosporidium parvum
KDENKEKTSQINSS

SEQ ID NO: 2348460 - protein, 6 aa, Cryptosporidium parvum
KDGIDG

SEQ ID NO: 2348461 - protein, 14 aa, Cryptosporidium parvum
KDGRLPQKKEFKGS

SEQ ID NO: 2348462 - protein, 7 aa, Cryptosporidium parvum
KDGSDLP

SEQ ID NO: 2348463 - protein, 6 aa, Cryptosporidium parvum
KDGVDD

SEQ ID NO: 2348464 - protein, 10 aa, Cryptosporidium parvum
KDHSKGCETQ

SEQ ID NO: 2348465 - protein, 9 aa, Cryptosporidium parvum
KDIKSESSR

SEQ ID NO: 2348466 - protein, 6 aa, Cryptosporidium parvum
KDIRQR

SEQ ID NO: 2348467 - protein, 9 aa, Cryptosporidium parvum
KDKNQNDEN

SEQ ID NO: 2348468 - protein, 4 aa, Cryptosporidium parvum
KDLG

SEQ ID NO: 2348469 - protein, 11 aa, Cryptosporidium parvum
KDLNSRPENNY

SEQ ID NO: 2348470 - protein, 22 aa, Cryptosporidium parvum
KDNEKNPSSLKNDQNKKNRFRN

SEQ ID NO: 2348471 - protein, 5 aa, Cryptosporidium parvum
KDNNF

SEQ ID NO: 2348472 - protein, 13 aa, Cryptosporidium parvum
KDNSNMSESNNNL

SEQ ID NO: 2348473 - protein, 9 aa, Cryptosporidium parvum
KDPAEIPWG

SEQ ID NO: 2348474 - protein, 7 aa, Cryptosporidium parvum
KDPEIQE

SEQ ID NO: 2348475 - protein, 7 aa, Cryptosporidium parvum
KDPETGR

SEQ ID NO: 2348476 - protein, 10 aa, Cryptosporidium parvum
KDPNPKKDIE

SEQ ID NO: 2348477 - protein, 13 aa, Cryptosporidium parvum
KDPPEKESEVGNQ

SEQ ID NO: 2348478 - protein, 4 aa, Cryptosporidium parvum
KDPY

SEQ ID NO: 2348479 - protein, 4 aa, Cryptosporidium parvum
KDRE

SEQ ID NO: 2348480 - protein, 10 aa, Cryptosporidium parvum
KDRTSERSKL

SEQ ID NO: 2348481 - protein, 6 aa, Cryptosporidium parvum
KDSGRL

SEQ ID NO: 2348482 - protein, 7 aa, Cryptosporidium parvum
KDSNAQC

SEQ ID NO: 2348483 - protein, 8 aa, Cryptosporidium parvum
KDSPSHSL

SEQ ID NO: 2348484 - protein, 8 aa, Cryptosporidium parvum
KDSSKTKN

SEQ ID NO: 2348485 - protein, 7 aa, Cryptosporidium parvum
KDTNGEP

SEQ ID NO: 2348486 - protein, 20 aa, Cryptosporidium parvum
KDYSPTSSKAIREAPPEECS

SEQ ID NO: 2348487 - protein, 13 aa, Cryptosporidium parvum
KDYSSKHATKDIE

SEQ ID NO: 2348488 - protein, 6 aa, Cryptosporidium parvum
KEAEEK

SEQ ID NO: 2348489 - protein, 7 aa, Cryptosporidium parvum
KEAEKRH

SEQ ID NO: 2348490 - protein, 4 aa, Cryptosporidium parvum
KEAH

SEQ ID NO: 2348491 - protein, 8 aa, Cryptosporidium parvum
KEASNGPM

SEQ ID NO: 2348492 - protein, 7 aa, Cryptosporidium parvum
KEDPEVK

SEQ ID NO: 2348493 - protein, 11 aa, Cryptosporidium parvum
KEDSECDDHEI

SEQ ID NO: 2348494 - protein, 12 aa, Cryptosporidium parvum
KEEAEKRISNPD

SEQ ID NO: 2348495 - protein, 48 aa, Cryptosporidium parvum; identical to SEQ ID NO: 2264137

SEQ ID NO: 2348496 - protein, 6 aa, Cryptosporidium parvum
KEEDVG

SEQ ID NO: 2348497 - protein, 16 aa, Cryptosporidium parvum
KEEEEDKEENLGKEEQ

SEQ ID NO: 2348498 - protein, 7 aa, Cryptosporidium parvum
KEEEREG

SEQ ID NO: 2348499 - protein, 6 aa, Cryptosporidium parvum
KEEERW

SEQ ID NO: 2348500 - protein, 6 aa, Cryptosporidium parvum
KEEIDG

SEQ ID NO: 2348501 - protein, 5 aa, Cryptosporidium parvum
KEEIN

SEQ ID NO: 2348502 - protein, 7 aa, Cryptosporidium parvum
KEEKNEF

SEQ ID NO: 2348503 - protein, 11 aa, Cryptosporidium parvum
KEEKTATKKNS

SEQ ID NO: 2348504 - protein, 7 aa, Cryptosporidium parvum
KEENEDE

SEQ ID NO: 2348505 - protein, 10 aa, Cryptosporidium parvum
KEENFNERNN

SEQ ID NO: 2348506 - protein, 6 aa, Cryptosporidium parvum
KEENGR

SEQ ID NO: 2348507 - protein, 7 aa, Cryptosporidium parvum
KEENTAR

SEQ ID NO: 2348508 - protein, 8 aa, Cryptosporidium parvum
KEETDNLV

SEQ ID NO: 2348509 - protein, 5 aa, Cryptosporidium parvum
KEETF

SEQ ID NO: 2348510 - protein, 7 aa, Cryptosporidium parvum
KEEYGGD

SEQ ID NO: 2348511 - protein, 15 aa, Cryptosporidium parvum
KEEYKNKEMSDSKEI

SEQ ID NO: 2348512 - protein, 10 aa, Cryptosporidium parvum
KEEYKQSKDI

SEQ ID NO: 2348513 - protein, 10 aa, Cryptosporidium parvum
KEFEESTNTV

SEQ ID NO: 2348514 - protein, 6 aa, Cryptosporidium parvum
KEFKGG

SEQ ID NO: 2348515 - protein, 13 aa, Cryptosporidium parvum
KEGESTFNDEEYR

SEQ ID NO: 2348516 - protein, 16 aa, Cryptosporidium parvum
KEGPIDSTPIVTNDGA

SEQ ID NO: 2348517 - protein, 6 aa, Cryptosporidium parvum
KEGYDG

SEQ ID NO: 2348518 - protein, 4 aa, Cryptosporidium parvum
KEIA

SEQ ID NO: 2348519 - protein, 6 aa, Cryptosporidium parvum
KEIQEN

SEQ ID NO: 2348520 - protein, 16 aa, Cryptosporidium parvum
KEKDSEVTEAKKDEPV

SEQ ID NO: 2348521 - protein, 5 aa, Cryptosporidium parvum
KEKEV

SEQ ID NO: 2348522 - protein, 11 aa, Cryptosporidium parvum
KEKGSDKSRNF

SEQ ID NO: 2348523 - protein, 27 aa, Cryptosporidium parvum
KEKQSSQGSVLGSRKSKESELRKKEDY

SEQ ID NO: 2348524 - protein, 5 aa, Cryptosporidium parvum
KEKRI

SEQ ID NO: 2348525 - protein, 7 aa, Cryptosporidium parvum
KEKTEQL

SEQ ID NO: 2348526 - protein, 7 aa, Cryptosporidium parvum
KEKTSQE

SEQ ID NO: 2348527 - protein, 6 aa, Cryptosporidium parvum
KELEDN

SEQ ID NO: 2348528 - protein, 5 aa, Cryptosporidium parvum
KELNT

SEQ ID NO: 2348529 - protein, 7 aa, Cryptosporidium parvum
KELRATS

SEQ ID NO: 2348530 - protein, 13 aa, Cryptosporidium parvum
KELSFGGKARKEM

SEQ ID NO: 2348531 - protein, 17 aa, Cryptosporidium parvum
KENDEKLADRVKRNKRK

SEQ ID NO: 2348532 - protein, 12 aa, Cryptosporidium parvum
KENELSKREGAV

SEQ ID NO: 2348533 - protein, 8 aa, Cryptosporidium parvum
KENGYSAD

SEQ ID NO: 2348534 - protein, 4 aa, Cryptosporidium parvum
KENL

SEQ ID NO: 2348535 - protein, 8 aa, Cryptosporidium parvum
KENPNSYA

SEQ ID NO: 2348536 - protein, 8 aa, Cryptosporidium parvum
KENQKQRM

SEQ ID NO: 2348537 - protein, 5 aa, Cryptosporidium parvum
KENSE

SEQ ID NO: 2348538 - protein, 6 aa, Cryptosporidium parvum
KENTEF

SEQ ID NO: 2348539 - protein, 8 aa, Cryptosporidium parvum
KEPRKGKI

SEQ ID NO: 2348540 - protein, 12 aa, Cryptosporidium parvum
KEQKAKGNQFET

SEQ ID NO: 2348541 - protein, 5 aa, Cryptosporidium parvum
KERGI

SEQ ID NO: 2348542 - protein, 11 aa, Cryptosporidium parvum
KERKISKQELQ

SEQ ID NO: 2348543 - protein, 12 aa, Cryptosporidium parvum
KERNKSEKMEIE

SEQ ID NO: 2348544 - protein, 5 aa, Cryptosporidium parvum
KESAN

SEQ ID NO: 2348545 - protein, 10 aa, Cryptosporidium parvum
KESDPPPPLP

SEQ ID NO: 2348546 - protein, 18 aa, Cryptosporidium parvum
KESDSNNSNSKKLFKQNS

SEQ ID NO: 2348547 - protein, 8 aa, Cryptosporidium parvum
KESEAERF

SEQ ID NO: 2348548 - protein, 6 aa, Cryptosporidium parvum
KESEKY

SEQ ID NO: 2348549 - protein, 9 aa, Cryptosporidium parvum
KESELNTTT

SEQ ID NO: 2348550 - protein, 19 aa, Cryptosporidium parvum
KESGHISSDNLKDSNSHHS

SEQ ID NO: 2348551 - protein, 7 aa, Cryptosporidium parvum
KESIDSE

SEQ ID NO: 2348552 - protein, 10 aa, Cryptosporidium parvum
KESNIKAKAP

SEQ ID NO: 2348553 - protein, 20 aa, Cryptosporidium parvum
KESNKGAKKLDINDQDTKSM

SEQ ID NO: 2348554 - protein, 9 aa, Cryptosporidium parvum
KESNNDNEK

SEQ ID NO: 2348555 - protein, 22 aa, Cryptosporidium parvum
KESNSHKSQSCLSEDESTEIDE

SEQ ID NO: 2348556 - protein, 44 aa, Cryptosporidium parvum
KESTSVPPPAPPAPPAPPAPPAPPAPPSPPTLSKSEAQESPSVL

SEQ ID NO: 2348557 - protein, 13 aa, Cryptosporidium parvum
KETGDGETHSRQN

SEQ ID NO: 2348558 - protein, 10 aa, Cryptosporidium parvum
KETKPPPILS

SEQ ID NO: 2348559 - protein, 8 aa, Cryptosporidium parvum
KETNIDGE

SEQ ID NO: 2348560 - protein, 12 aa, Cryptosporidium parvum
KETNKDGITKSE

SEQ ID NO: 2348561 - protein, 7 aa, Cryptosporidium parvum
KETNSDI

SEQ ID NO: 2348562 - protein, 38 aa, Cryptosporidium parvum; identical to SEQ ID NO: 2114971

SEQ ID NO: 2348563 - protein, 9 aa, Cryptosporidium parvum
KEVNDRQKS

SEQ ID NO: 2348564 - protein, 24 aa, Cryptosporidium parvum
KEVQSQTEKQDEEEISTKQNESHY

SEQ ID NO: 2348565 - protein, 9 aa, Cryptosporidium parvum
KEVTPSEAK

SEQ ID NO: 2348566 - protein, 6 aa, Cryptosporidium parvum
KEWGGS

SEQ ID NO: 2348567 - protein, 6 aa, Cryptosporidium parvum
KEYKQI

SEQ ID NO: 2348568 - protein, 7 aa, Cryptosporidium parvum
KFPDNND

SEQ ID NO: 2348569 - protein, 5 aa, Cryptosporidium parvum
KFPGR

SEQ ID NO: 2348570 - protein, 16 aa, Cryptosporidium parvum
KFPNKKSDNTNSSCSN

SEQ ID NO: 2348571 - protein, 4 aa, Cryptosporidium parvum
KFQE

SEQ ID NO: 2348572 - protein, 12 aa, Cryptosporidium parvum
KFSNSKKTDKSN

SEQ ID NO: 2348573 - protein, 6 aa, Cryptosporidium parvum
KFSPAN

SEQ ID NO: 2348574 - protein, 13 aa, Cryptosporidium parvum
KFSSTRFQSEKSG

SEQ ID NO: 2348575 - protein, 4 aa, Cryptosporidium parvum
KFTR

SEQ ID NO: 2348576 - protein, 14 aa, Cryptosporidium parvum
KGADSSSQNDGYFK

SEQ ID NO: 2348577 - protein, 14 aa, Cryptosporidium parvum
KGAKPDVEESGNER

SEQ ID NO: 2348578 - protein, 7 aa, Cryptosporidium parvum
KGDPETC

SEQ ID NO: 2348579 - protein, 8 aa, Cryptosporidium parvum
KGEANDPL

SEQ ID NO: 2348580 - protein, 4 aa, Cryptosporidium parvum
KGEM

SEQ ID NO: 2348581 - protein, 5 aa, Cryptosporidium parvum
KGGTR

SEQ ID NO: 2348582 - protein, 39 aa, Cryptosporidium parvum
KGGVDNNGQDNISSSSFSSSSSSSSSSSSSSSSSTPGFE

SEQ ID NO: 2348583 - protein, 17 aa, Cryptosporidium parvum
KGKEGRFRGNLSGKRVD

SEQ ID NO: 2348584 - protein, 6 aa, Cryptosporidium parvum
KGKEKY

SEQ ID NO: 2348585 - protein, 8 aa, Cryptosporidium parvum
KGKESPDV

SEQ ID NO: 2348586 - protein, 12 aa, Cryptosporidium parvum
KGKHNKSLKGER

SEQ ID NO: 2348587 - protein, 6 aa, Cryptosporidium parvum
KGLEEE

SEQ ID NO: 2348588 - protein, 7 aa, Cryptosporidium parvum
KGLKDQP

SEQ ID NO: 2348589 - protein, 6 aa, Cryptosporidium parvum
KGLKSF

SEQ ID NO: 2348590 - protein, 6 aa, Cryptosporidium parvum
KGPEEL

SEQ ID NO: 2348591 - protein, 12 aa, Cryptosporidium parvum
KGPMSAPDKSFE

SEQ ID NO: 2348592 - protein, 7 aa, Cryptosporidium parvum
KGQNIES

SEQ ID NO: 2348593 - protein, 6 aa, Cryptosporidium parvum
KGRMSK

SEQ ID NO: 2348594 - protein, 6 aa, Cryptosporidium parvum
KGSEEI

SEQ ID NO: 2348595 - protein, 37 aa, Cryptosporidium parvum; identical to SEQ ID NO: 2147543

SEQ ID NO: 2348596 - protein, 7 aa, Cryptosporidium parvum
KGSPHSI

SEQ ID NO: 2348597 - protein, 25 aa, Cryptosporidium parvum
KGSQKPKNLSDNSLDHDSNVDNSQV

SEQ ID NO: 2348598 - protein, 7 aa, Cryptosporidium parvum
KGSSTYG

SEQ ID NO: 2348599 - protein, 5 aa, Cryptosporidium parvum
KGTDD

SEQ ID NO: 2348600 - protein, 16 aa, Cryptosporidium parvum
KGTKSENEKFPGGDIT

SEQ ID NO: 2348601 - protein, 6 aa, Cryptosporidium parvum
KGTRAY

SEQ ID NO: 2348602 - protein, 7 aa, Cryptosporidium parvum
KGWQSPS

SEQ ID NO: 2348603 - protein, 11 aa, Cryptosporidium parvum
KGYDNTAINNS

SEQ ID NO: 2348604 - protein, 7 aa, Cryptosporidium parvum
KHEQTTQ

SEQ ID NO: 2348605 - protein, 7 aa, Cryptosporidium parvum
KHGEEID

SEQ ID NO: 2348606 - protein, 7 aa, Cryptosporidium parvum
KHNEHPD

SEQ ID NO: 2348607 - protein, 13 aa, Cryptosporidium parvum
KHNSESSNHLKNN

SEQ ID NO: 2348608 - protein, 10 aa, Cryptosporidium parvum
KHNSNEKEVT

SEQ ID NO: 2348609 - protein, 6 aa, Cryptosporidium parvum
KHPNGN

SEQ ID NO: 2348610 - protein, 13 aa, Cryptosporidium parvum
KHPTISKTNHNDL

SEQ ID NO: 2348611 - protein, 9 aa, Cryptosporidium parvum
KHRKNDTVA

SEQ ID NO: 2348612 - protein, 4 aa, Cryptosporidium parvum
KHSA

SEQ ID NO: 2348613 - protein, 14 aa, Cryptosporidium parvum
KHSDKKKDNKLSCE

SEQ ID NO: 2348614 - protein, 4 aa, Cryptosporidium parvum
KHSL

SEQ ID NO: 2348615 - protein, 7 aa, Cryptosporidium parvum
KHSSKLQ

SEQ ID NO: 2348616 - protein, 8 aa, Cryptosporidium parvum
KHTDSIPA

SEQ ID NO: 2348617 - protein, 4 aa, Cryptosporidium parvum
KHTG

SEQ ID NO: 2348618 - protein, 6 aa, Cryptosporidium parvum
KHVTQE

SEQ ID NO: 2348619 - protein, 87 aa, Cryptosporidium parvum; identical to SEQ ID NO: 2264930

SEQ ID NO: 2348620 - protein, 6 aa, Cryptosporidium parvum
KIEADT

SEQ ID NO: 2348621 - protein, 8 aa, Cryptosporidium parvum
KIEKTQDK

SEQ ID NO: 2348622 - protein, 6 aa, Cryptosporidium parvum
KIEPKE

SEQ ID NO: 2348623 - protein, 5 aa, Cryptosporidium parvum
KIESF

SEQ ID NO: 2348624 - protein, 16 aa, Cryptosporidium parvum
KIESPKEKLEIKSGEY

SEQ ID NO: 2348625 - protein, 5 aa, Cryptosporidium parvum
KIGTG

SEQ ID NO: 2348626 - protein, 10 aa, Cryptosporidium parvum
KIKETDSITY

SEQ ID NO: 2348627 - protein, 7 aa, Cryptosporidium parvum
KIKSKRK

SEQ ID NO: 2348628 - protein, 7 aa, Cryptosporidium parvum
KIKSKSQ

SEQ ID NO: 2348629 - protein, 7 aa, Cryptosporidium parvum
KIKTDST

SEQ ID NO: 2348630 - protein, 100 aa, Cryptosporidium parvum; identical to SEQ ID NO: 2264997

SEQ ID NO: 2348631 - protein, 30 aa, Cryptosporidium parvum; identical to SEQ ID NO: 2265027

SEQ ID NO: 2348632 - protein, 6 aa, Cryptosporidium parvum
KIQPQV

SEQ ID NO: 2348633 - protein, 4 aa, Cryptosporidium parvum
KIQQ

SEQ ID NO: 2348634 - protein, 5 aa, Cryptosporidium parvum
KIQST

SEQ ID NO: 2348635 - protein, 42 aa, Cryptosporidium parvum; identical to SEQ ID NO: 2265044

SEQ ID NO: 2348636 - protein, 22 aa, Cryptosporidium parvum
KISEKDIQEYKERYRGSDDEWE

SEQ ID NO: 2348637 - protein, 5 aa, Cryptosporidium parvum
KISNR

SEQ ID NO: 2348638 - protein, 6 aa, Cryptosporidium parvum
KISNSN

SEQ ID NO: 2348639 - protein, 9 aa, Cryptosporidium parvum
KISPSGVNE

SEQ ID NO: 2348640 - protein, 5 aa, Cryptosporidium parvum
KISQI

SEQ ID NO: 2348641 - protein, 12 aa, Cryptosporidium parvum
KISSRSKDIQKA

SEQ ID NO: 2348642 - protein, 5 aa, Cryptosporidium parvum
KITGP

SEQ ID NO: 2348643 - protein, 12 aa, Cryptosporidium parvum
KITTPSPARAKT

SEQ ID NO: 2348644 - protein, 19 aa, Cryptosporidium parvum
KIYSPNSSSIEPQETSQEV

SEQ ID NO: 2348645 - protein, 14 aa, Cryptosporidium parvum
KKAERFSEKDKTFT

SEQ ID NO: 2348646 - protein, 11 aa, Cryptosporidium parvum
KKAISNNDFGN

SEQ ID NO: 2348647 - protein, 7 aa, Cryptosporidium parvum
KKCRETN

SEQ ID NO: 2348648 - protein, 14 aa, Cryptosporidium parvum
KKDETKKELGSSGI

SEQ ID NO: 2348649 - protein, 23 aa, Cryptosporidium parvum
KKDLPSIEEEELDSEKARDLKQL

SEQ ID NO: 2348650 - protein, 18 aa, Cryptosporidium parvum
KKDTHKQKKNLSKTKNEM

SEQ ID NO: 2348651 - protein, 8 aa, Cryptosporidium parvum
KKEDGSEV

SEQ ID NO: 2348652 - protein, 8 aa, Cryptosporidium parvum
KKEENNRI

SEQ ID NO: 2348653 - protein, 7 aa, Cryptosporidium parvum
KKEGMSV

SEQ ID NO: 2348654 - protein, 7 aa, Cryptosporidium parvum
KKEITAD

SEQ ID NO: 2348655 - protein, 6 aa, Cryptosporidium parvum
KKENFE

SEQ ID NO: 2348656 - protein, 12 aa, Cryptosporidium parvum
KKFSATAKYMVY

SEQ ID NO: 2348657 - protein, 10 aa, Cryptosporidium parvum
KKGDDDTIGP

SEQ ID NO: 2348658 - protein, 5 aa, Cryptosporidium parvum
KKGKN

SEQ ID NO: 2348659 - protein, 12 aa, Cryptosporidium parvum
KKGPPPSPFSEE

SEQ ID NO: 2348660 - protein, 6 aa, Cryptosporidium parvum
KKGQHL

SEQ ID NO: 2348661 - protein, 15 aa, Cryptosporidium parvum
KKGSSNTDESSLSEI

SEQ ID NO: 2348662 - protein, 6 aa, Cryptosporidium parvum
KKGTEI

SEQ ID NO: 2348663 - protein, 8 aa, Cryptosporidium parvum
KKGYKSEK

SEQ ID NO: 2348664 - protein, 7 aa, Cryptosporidium parvum
KKHGEGE

SEQ ID NO: 2348665 - protein, 10 aa, Cryptosporidium parvum
KKHGRGGQSA

SEQ ID NO: 2348666 - protein, 7 aa, Cryptosporidium parvum
KKHNNKY

SEQ ID NO: 2348667 - protein, 24 aa, Cryptosporidium parvum
KKIDGESSSDTSDSRSRASSFQEL

SEQ ID NO: 2348668 - protein, 7 aa, Cryptosporidium parvum
KKIERNR

SEQ ID NO: 2348669 - protein, 7 aa, Cryptosporidium parvum
KKKHKED

SEQ ID NO: 2348670 - protein, 7 aa, Cryptosporidium parvum
KKKNGLD

SEQ ID NO: 2348671 - protein, 9 aa, Cryptosporidium parvum
KKKVSSGLD

SEQ ID NO: 2348672 - protein, 6 aa, Cryptosporidium parvum
KKMTES

SEQ ID NO: 2348673 - protein, 5 aa, Cryptosporidium parvum
KKNKY

SEQ ID NO: 2348674 - protein, 6 aa, Cryptosporidium parvum
KKNNPD

SEQ ID NO: 2348675 - protein, 4 aa, Cryptosporidium parvum
KKNP

SEQ ID NO: 2348676 - protein, 7 aa, Cryptosporidium parvum
KKNPVPE

SEQ ID NO: 2348677 - protein, 8 aa, Cryptosporidium parvum
KKNRPSGL

SEQ ID NO: 2348678 - protein, 7 aa, Cryptosporidium parvum
KKNYSKD

SEQ ID NO: 2348679 - protein, 14 aa, Cryptosporidium parvum
KKPESMSHLRNENS

SEQ ID NO: 2348680 - protein, 20 aa, Cryptosporidium parvum
KKPIENTSSAGVIKSEGGSI

SEQ ID NO: 2348681 - protein, 6 aa, Cryptosporidium parvum
KKPIGS

SEQ ID NO: 2348682 - protein, 6 aa, Cryptosporidium parvum
KKPLSA

SEQ ID NO: 2348683 - protein, 13 aa, Cryptosporidium parvum
KKPVNEGKKGQEV

SEQ ID NO: 2348684 - protein, 7 aa, Cryptosporidium parvum
KKQFSSD

SEQ ID NO: 2348685 - protein, 8 aa, Cryptosporidium parvum
KKQSTSEA

SEQ ID NO: 2348686 - protein, 7 aa, Cryptosporidium parvum
KKREDQL

SEQ ID NO: 2348687 - protein, 30 aa, Cryptosporidium parvum; identical to SEQ ID NO: 2265483

SEQ ID NO: 2348688 - protein, 14 aa, Cryptosporidium parvum
KKRKEEEQREQQKT

SEQ ID NO: 2348689 - protein, 19 aa, Cryptosporidium parvum
KKRLTASESDEEETIRSSQ

SEQ ID NO: 2348690 - protein, 33 aa, Cryptosporidium parvum; identical to SEQ ID NO: 2265504

SEQ ID NO: 2348691 - protein, 6 aa, Cryptosporidium parvum
KKRSIY

SEQ ID NO: 2348692 - protein, 9 aa, Cryptosporidium parvum
KKRSSQVPN

SEQ ID NO: 2348693 - protein, 14 aa, Cryptosporidium parvum
KKSDHKNSASIEES

SEQ ID NO: 2348694 - protein, 12 aa, Cryptosporidium parvum
KKSFKDRTEKEV

SEQ ID NO: 2348695 - protein, 6 aa, Cryptosporidium parvum
KKSHSM

SEQ ID NO: 2348696 - protein, 29 aa, Cryptosporidium parvum
KKSISAPKTDVKSSTSENTVSKEISAPTP

SEQ ID NO: 2348697 - protein, 14 aa, Cryptosporidium parvum
KKSKPNSRGGGYRK

SEQ ID NO: 2348698 - protein, 7 aa, Cryptosporidium parvum
KKSNLRH

SEQ ID NO: 2348699 - protein, 5 aa, Cryptosporidium parvum
KKSNN

SEQ ID NO: 2348700 - protein, 11 aa, Cryptosporidium parvum
KKSQEKAKEMQ

SEQ ID NO: 2348701 - protein, 14 aa, Cryptosporidium parvum
KKTERREASREHKA

SEQ ID NO: 2348702 - protein, 10 aa, Cryptosporidium parvum
KKTGGNKQNS

SEQ ID NO: 2348703 - protein, 7 aa, Cryptosporidium parvum
KKTIRAN

SEQ ID NO: 2348704 - protein, 4 aa, Cryptosporidium parvum
KKTM

SEQ ID NO: 2348705 - protein, 5 aa, Cryptosporidium parvum
KKTTL

SEQ ID NO: 2348706 - protein, 4 aa, Cryptosporidium parvum
KKTY

SEQ ID NO: 2348707 - protein, 6 aa, Cryptosporidium parvum
KKYEGG

SEQ ID NO: 2348708 - protein, 6 aa, Cryptosporidium parvum
KLDDGG

SEQ ID NO: 2348709 - protein, 25 aa, Cryptosporidium parvum
KLDEERRLKQKQENLAKREKSASTV

SEQ ID NO: 2348710 - protein, 12 aa, Cryptosporidium parvum
KLDTRRGKTPVH

SEQ ID NO: 2348711 - protein, 14 aa, Cryptosporidium parvum
KLEDRSNSELESNG

SEQ ID NO: 2348712 - protein, 6 aa, Cryptosporidium parvum
KLENEK

SEQ ID NO: 2348713 - protein, 4 aa, Cryptosporidium parvum
KLER

SEQ ID NO: 2348714 - protein, 8 aa, Cryptosporidium parvum
KLETEKDH

SEQ ID NO: 2348715 - protein, 7 aa, Cryptosporidium parvum
KLGDKSG

SEQ ID NO: 2348716 - protein, 20 aa, Cryptosporidium parvum
KLKKNTGAGTTSDKSNIDCN

SEQ ID NO: 2348717 - protein, 8 aa, Cryptosporidium parvum
KLKNEINT

SEQ ID NO: 2348718 - protein, 8 aa, Cryptosporidium parvum
KLKPDQKE

SEQ ID NO: 2348719 - protein, 5 aa, Cryptosporidium parvum
KLNDS

SEQ ID NO: 2348720 - protein, 18 aa, Cryptosporidium parvum
KLQKQKQRKERREQLKAE

SEQ ID NO: 2348721 - protein, 7 aa, Cryptosporidium parvum
KLQSQAN

SEQ ID NO: 2348722 - protein, 13 aa, Cryptosporidium parvum
KLRDVQKQANPLG

SEQ ID NO: 2348723 - protein, 9 aa, Cryptosporidium parvum
KLREKKQSV

SEQ ID NO: 2348724 - protein, 13 aa, Cryptosporidium parvum
KLRKQETKKNLRE

SEQ ID NO: 2348725 - protein, 13 aa, Cryptosporidium parvum
KLSNRESNNLSAT

SEQ ID NO: 2348726 - protein, 13 aa, Cryptosporidium parvum
KLSPKTVHTNNEK

SEQ ID NO: 2348727 - protein, 10 aa, Cryptosporidium parvum
KLSTDERQSI

SEQ ID NO: 2348728 - protein, 8 aa, Cryptosporidium parvum
KLTNRDEV

SEQ ID NO: 2348729 - protein, 14 aa, Cryptosporidium parvum
KLTPSSSKRRFSPQ

SEQ ID NO: 2348730 - protein, 8 aa, Cryptosporidium parvum
KMDPETSS

SEQ ID NO: 2348731 - protein, 11 aa, Cryptosporidium parvum
KMKNPTNSNQI

SEQ ID NO: 2348732 - protein, 12 aa, Cryptosporidium parvum
KMKPDNSQKMSS

SEQ ID NO: 2348733 - protein, 10 aa, Cryptosporidium parvum
KNAGTQSTQS

SEQ ID NO: 2348734 - protein, 10 aa, Cryptosporidium parvum
KNAPKVNQQY

SEQ ID NO: 2348735 - protein, 7 aa, Cryptosporidium parvum
KNAQNSA

SEQ ID NO: 2348736 - protein, 8 aa, Cryptosporidium parvum
KNDDVDLK

SEQ ID NO: 2348737 - protein, 6 aa, Cryptosporidium parvum
KNDMQG

SEQ ID NO: 2348738 - protein, 6 aa, Cryptosporidium parvum
KNDPDL

SEQ ID NO: 2348739 - protein, 9 aa, Cryptosporidium parvum
KNDPTHSNL

SEQ ID NO: 2348740 - protein, 18 aa, Cryptosporidium parvum
KNDPVDKSLEEEDIDNKE

SEQ ID NO: 2348741 - protein, 8 aa, Cryptosporidium parvum
KNDSQDQI

SEQ ID NO: 2348742 - protein, 5 aa, Cryptosporidium parvum
KNEEL

SEQ ID NO: 2348743 - protein, 6 aa, Cryptosporidium parvum
KNEIEA

SEQ ID NO: 2348744 - protein, 6 aa, Cryptosporidium parvum
KNEKNR

SEQ ID NO: 2348745 - protein, 6 aa, Cryptosporidium parvum
KNEKRW

SEQ ID NO: 2348746 - protein, 6 aa, Cryptosporidium parvum
KNESDF

SEQ ID NO: 2348747 - protein, 7 aa, Cryptosporidium parvum
KNESESI

SEQ ID NO: 2348748 - protein, 8 aa, Cryptosporidium parvum
KNESSSKM

SEQ ID NO: 2348749 - protein, 6 aa, Cryptosporidium parvum
KNFGDN

SEQ ID NO: 2348750 - protein, 8 aa, Cryptosporidium parvum
KNFPEDDL

SEQ ID NO: 2348751 - protein, 7 aa, Cryptosporidium parvum
KNFSGRS

SEQ ID NO: 2348752 - protein, 6 aa, Cryptosporidium parvum
KNGESL

SEQ ID NO: 2348753 - protein, 20 aa, Cryptosporidium parvum
KNGGPREDSTSIGSAGAVRR

SEQ ID NO: 2348754 - protein, 4 aa, Cryptosporidium parvum
KNGI

SEQ ID NO: 2348755 - protein, 8 aa, Cryptosporidium parvum
KNGKLGHG

SEQ ID NO: 2348756 - protein, 9 aa, Cryptosporidium parvum
KNGRIQDEV

SEQ ID NO: 2348757 - protein, 5 aa, Cryptosporidium parvum
KNGRW

SEQ ID NO: 2348758 - protein, 9 aa, Cryptosporidium parvum
KNGSKPNYD

SEQ ID NO: 2348759 - protein, 7 aa, Cryptosporidium parvum
KNGYDYK

SEQ ID NO: 2348760 - protein, 18 aa, Cryptosporidium parvum
KNHCTRNKNNDNNTPFNK

SEQ ID NO: 2348761 - protein, 10 aa, Cryptosporidium parvum
KNIDQTNKIN

SEQ ID NO: 2348762 - protein, 9 aa, Cryptosporidium parvum
KNIPKAGRG

SEQ ID NO: 2348763 - protein, 16 aa, Cryptosporidium parvum
KNKEEYRTQEERELKN

SEQ ID NO: 2348764 - protein, 17 aa, Cryptosporidium parvum
KNKENKDSKEDLNTSSK

SEQ ID NO: 2348765 - protein, 30 aa, Cryptosporidium parvum; identical to SEQ ID NO: 2266063

SEQ ID NO: 2348766 - protein, 12 aa, Cryptosporidium parvum
KNKRKKGKKVDS

SEQ ID NO: 2348767 - protein, 26 aa, Cryptosporidium parvum
KNKRQAYGVSTKAGHQHSAESWGTGR

SEQ ID NO: 2348768 - protein, 26 aa, Cryptosporidium parvum
KNKSQKGFEQDESELRSNSNSPSMNS

SEQ ID NO: 2348769 - protein, 5 aa, Cryptosporidium parvum
KNLDG

SEQ ID NO: 2348770 - protein, 10 aa, Cryptosporidium parvum
KNLKESRRKR

SEQ ID NO: 2348771 - protein, 11 aa, Cryptosporidium parvum
KNNGDPKEERP

SEQ ID NO: 2348772 - protein, 20 aa, Cryptosporidium parvum
KNNKERKVTESSQKCSERIE

SEQ ID NO: 2348773 - protein, 6 aa, Cryptosporidium parvum
KNNKTF

SEQ ID NO: 2348774 - protein, 11 aa, Cryptosporidium parvum
KNNQSKKQNVT

SEQ ID NO: 2348775 - protein, 10 aa, Cryptosporidium parvum
KNNSNSKKEG

SEQ ID NO: 2348776 - protein, 8 aa, Cryptosporidium parvum
KNNSQDLK

SEQ ID NO: 2348777 - protein, 10 aa, Cryptosporidium parvum
KNNSYESNSY

SEQ ID NO: 2348778 - protein, 11 aa, Cryptosporidium parvum
KNNVSERANNI

SEQ ID NO: 2348779 - protein, 6 aa, Cryptosporidium parvum
KNPGIK

SEQ ID NO: 2348780 - protein, 25 aa, Cryptosporidium parvum
KNPLNGSPTVSNNSNAFQSRNTISN

SEQ ID NO: 2348781 - protein, 46 aa, Cryptosporidium parvum
KNPSIISSKSEQKQGSLDSLKSSNFYQSSPIDENHISSNENTAAQE

SEQ ID NO: 2348782 - protein, 10 aa, Cryptosporidium parvum
KNQKKTRSGI

SEQ ID NO: 2348783 - protein, 15 aa, Cryptosporidium parvum
KNQKNDKTSDVSNNV

SEQ ID NO: 2348784 - protein, 16 aa, Cryptosporidium parvum
KNQNNENDISTNISED

SEQ ID NO: 2348785 - protein, 7 aa, Cryptosporidium parvum
KNQRISE

SEQ ID NO: 2348786 - protein, 13 aa, Cryptosporidium parvum
KNQSDGDNQYEGA

SEQ ID NO: 2348787 - protein, 6 aa, Cryptosporidium parvum
KNRDSA

SEQ ID NO: 2348788 - protein, 11 aa, Cryptosporidium parvum
KNRRDNFNPRS

SEQ ID NO: 2348789 - protein, 5 aa, Cryptosporidium parvum
KNSEN

SEQ ID NO: 2348790 - protein, 6 aa, Cryptosporidium parvum
KNSIDT

SEQ ID NO: 2348791 - protein, 6 aa, Cryptosporidium parvum
KNSLES

SEQ ID NO: 2348792 - protein, 10 aa, Cryptosporidium parvum
KNSQKHDIEE

SEQ ID NO: 2348793 - protein, 17 aa, Cryptosporidium parvum
KNSTSIPHNKKTGEYCT

SEQ ID NO: 2348794 - protein, 15 aa, Cryptosporidium parvum
KNSTVNDSDNMEIEE

SEQ ID NO: 2348795 - protein, 27 aa, Cryptosporidium parvum
KNTGIKQSNNSPNKKSIQSNSNNSHKS

SEQ ID NO: 2348796 - protein, 5 aa, Cryptosporidium parvum
KNTGL

SEQ ID NO: 2348797 - protein, 6 aa, Cryptosporidium parvum
KNTKFE

SEQ ID NO: 2348798 - protein, 12 aa, Cryptosporidium parvum
KNTNGSHDNYPD

SEQ ID NO: 2348799 - protein, 20 aa, Cryptosporidium parvum
KNTNRHEPLNDAQNNKNKVE

SEQ ID NO: 2348800 - protein, 8 aa, Cryptosporidium parvum
KNTWPDNS

SEQ ID NO: 2348801 - protein, 17 aa, Cryptosporidium parvum
KPAITKEQPTNNAPKAV

SEQ ID NO: 2348802 - protein, 5 aa, Cryptosporidium parvum
KPASI

SEQ ID NO: 2348803 - protein, 9 aa, Cryptosporidium parvum
KPDDEDSVS

SEQ ID NO: 2348804 - protein, 8 aa, Cryptosporidium parvum
KPGSPIQI

SEQ ID NO: 2348805 - protein, 5 aa, Cryptosporidium parvum
KPISE

SEQ ID NO: 2348806 - protein, 7 aa, Cryptosporidium parvum
KPKVSEN

SEQ ID NO: 2348807 - protein, 6 aa, Cryptosporidium parvum
KPLNKT

SEQ ID NO: 2348808 - protein, 12 aa, Cryptosporidium parvum
KPLNTDSVPLNG

SEQ ID NO: 2348809 - protein, 4 aa, Cryptosporidium parvum
KPNL

SEQ ID NO: 2348810 - protein, 4 aa, Cryptosporidium parvum
KPNN

SEQ ID NO: 2348811 - protein, 6 aa, Cryptosporidium parvum
KPNVTT

SEQ ID NO: 2348812 - protein, 22 aa, Cryptosporidium parvum
KPQAENPEQAKPRAPRIGQPKY

SEQ ID NO: 2348813 - protein, 4 aa, Cryptosporidium parvum
KPQG

SEQ ID NO: 2348814 - protein, 8 aa, Cryptosporidium parvum
KPSDGGVY

SEQ ID NO: 2348815 - protein, 7 aa, Cryptosporidium parvum
KPSISDT

SEQ ID NO: 2348816 - protein, 6 aa, Cryptosporidium parvum
KPTAIQ

SEQ ID NO: 2348817 - protein, 9 aa, Cryptosporidium parvum
KPTKAGVSN

SEQ ID NO: 2348818 - protein, 7 aa, Cryptosporidium parvum
KQADELR

SEQ ID NO: 2348819 - protein, 7 aa, Cryptosporidium parvum
KQAEEIE

SEQ ID NO: 2348820 - protein, 6 aa, Cryptosporidium parvum
KQAKDL

SEQ ID NO: 2348821 - protein, 9 aa, Cryptosporidium parvum
KQANTSGVA

SEQ ID NO: 2348822 - protein, 20 aa, Cryptosporidium parvum
KQDSEPREAQSQHTDQKPEL

SEQ ID NO: 2348823 - protein, 9 aa, Cryptosporidium parvum
KQEESNNNS

SEQ ID NO: 2348824 - protein, 6 aa, Cryptosporidium parvum
KQEKKM

SEQ ID NO: 2348825 - protein, 24 aa, Cryptosporidium parvum
KQENDNEENNRQWESLSSKSGWNK

SEQ ID NO: 2348826 - protein, 21 aa, Cryptosporidium parvum
KQGKANSEDDFGSRKFGTSHH

SEQ ID NO: 2348827 - protein, 6 aa, Cryptosporidium parvum
KQGKHD

SEQ ID NO: 2348828 - protein, 19 aa, Cryptosporidium parvum
KQHDEESIEKTQEKVRELE

SEQ ID NO: 2348829 - protein, 14 aa, Cryptosporidium parvum
KQIGQELEEEKQRN

SEQ ID NO: 2348830 - protein, 21 aa, Cryptosporidium parvum
KQKEKSSKFPVRGSKIKTDQV

SEQ ID NO: 2348831 - protein, 12 aa, Cryptosporidium parvum
KQKNENEHEEEE

SEQ ID NO: 2348832 - protein, 4 aa, Cryptosporidium parvum
KQNI

SEQ ID NO: 2348833 - protein, 7 aa, Cryptosporidium parvum
KQNNSNE

SEQ ID NO: 2348834 - protein, 13 aa, Cryptosporidium parvum
KQNSKNEKHGNYA

SEQ ID NO: 2348835 - protein, 20 aa, Cryptosporidium parvum
KQQANNTPSNTSNNNEAVSS

SEQ ID NO: 2348836 - protein, 12 aa, Cryptosporidium parvum
KQQDNRCGDGTT

SEQ ID NO: 2348837 - protein, 65 aa, Cryptosporidium parvum; identical to SEQ ID NO: 2266683

SEQ ID NO: 2348838 - protein, 11 aa, Cryptosporidium parvum
KQRELDELEEE

SEQ ID NO: 2348839 - protein, 8 aa, Cryptosporidium parvum
KQRNKELK

SEQ ID NO: 2348840 - protein, 7 aa, Cryptosporidium parvum
KQRQNES

SEQ ID NO: 2348841 - protein, 8 aa, Cryptosporidium parvum
KQSIKQTN

SEQ ID NO: 2348842 - protein, 7 aa, Cryptosporidium parvum
KQTKNMT

SEQ ID NO: 2348843 - protein, 11 aa, Cryptosporidium parvum
KQTKSIQDSER

SEQ ID NO: 2348844 - protein, 4 aa, Cryptosporidium parvum
KQTN

SEQ ID NO: 2348845 - protein, 6 aa, Cryptosporidium parvum
KRAQEA

SEQ ID NO: 2348846 - protein, 5 aa, Cryptosporidium parvum
KRDNT

SEQ ID NO: 2348847 - protein, 9 aa, Cryptosporidium parvum
KRDSSSKWS

SEQ ID NO: 2348848 - protein, 7 aa, Cryptosporidium parvum
KRESNLA

SEQ ID NO: 2348849 - protein, 5 aa, Cryptosporidium parvum
KRIEE

SEQ ID NO: 2348850 - protein, 7 aa, Cryptosporidium parvum
KRISSSG

SEQ ID NO: 2348851 - protein, 7 aa, Cryptosporidium parvum
KRKDHKF

SEQ ID NO: 2348852 - protein, 4 aa, Cryptosporidium parvum
KRKE

SEQ ID NO: 2348853 - protein, 7 aa, Cryptosporidium parvum
KRKNELG

SEQ ID NO: 2348854 - protein, 7 aa, Cryptosporidium parvum
KRNPNNF

SEQ ID NO: 2348855 - protein, 15 aa, Cryptosporidium parvum
KRPARAQSDGSLQSN

SEQ ID NO: 2348856 - protein, 20 aa, Cryptosporidium parvum
KRPISSKYKPKNTSGTNSNP

SEQ ID NO: 2348857 - protein, 7 aa, Cryptosporidium parvum
KRPKSGE

SEQ ID NO: 2348858 - protein, 4 aa, Cryptosporidium parvum
KRRL

SEQ ID NO: 2348859 - protein, 6 aa, Cryptosporidium parvum
KRRQRS

SEQ ID NO: 2348860 - protein, 13 aa, Cryptosporidium parvum
KRSEKNPEVESSR

SEQ ID NO: 2348861 - protein, 9 aa, Cryptosporidium parvum
KRSNEQKRE

SEQ ID NO: 2348862 - protein, 4 aa, Cryptosporidium parvum
KRSS

SEQ ID NO: 2348863 - protein, 8 aa, Cryptosporidium parvum
KRSVNSGF

SEQ ID NO: 2348864 - protein, 65 aa, Cryptosporidium parvum
KRVKETHVTDQEKDTKHNKHLKQKKHGKNAGNLIGNESASPPNKIESASKGFSFSSQSSNQHNSL

SEQ ID NO: 2348865 - protein, 7 aa, Cryptosporidium parvum
KSADAFS

SEQ ID NO: 2348866 - protein, 10 aa, Cryptosporidium parvum
KSANSLEGVP

SEQ ID NO: 2348867 - protein, 6 aa, Cryptosporidium parvum
KSDEKI

SEQ ID NO: 2348868 - protein, 6 aa, Cryptosporidium parvum
KSDKAA

SEQ ID NO: 2348869 - protein, 5 aa, Cryptosporidium parvum
KSDVR

SEQ ID NO: 2348870 - protein, 7 aa, Cryptosporidium parvum
KSEESKK

SEQ ID NO: 2348871 - protein, 17 aa, Cryptosporidium parvum
KSEKSYLNSSKLKKESI

SEQ ID NO: 2348872 - protein, 7 aa, Cryptosporidium parvum
KSESQGY

SEQ ID NO: 2348873 - protein, 22 aa, Cryptosporidium parvum
KSETKEKDSLETNKRQALEPEA

SEQ ID NO: 2348874 - protein, 5 aa, Cryptosporidium parvum
KSEYD

SEQ ID NO: 2348875 - protein, 16 aa, Cryptosporidium parvum
KSEYYDEYSTQNIRDD

SEQ ID NO: 2348876 - protein, 9 aa, Cryptosporidium parvum
KSGESTNAD

SEQ ID NO: 2348877 - protein, 9 aa, Cryptosporidium parvum
KSGKSDLAE

SEQ ID NO: 2348878 - protein, 7 aa, Cryptosporidium parvum
KSGKVDW

SEQ ID NO: 2348879 - protein, 4 aa, Cryptosporidium parvum
KSGL

SEQ ID NO: 2348880 - protein, 7 aa, Cryptosporidium parvum
KSGLRDA

SEQ ID NO: 2348881 - protein, 7 aa, Cryptosporidium parvum
KSGRAEL

SEQ ID NO: 2348882 - protein, 5 aa, Cryptosporidium parvum
KSGVI

SEQ ID NO: 2348883 - protein, 30 aa, Cryptosporidium parvum; identical to SEQ ID NO: 2267112

SEQ ID NO: 2348884 - protein, 9 aa, Cryptosporidium parvum
KSIANETST

SEQ ID NO: 2348885 - protein, 6 aa, Cryptosporidium parvum
KSIDNK

SEQ ID NO: 2348886 - protein, 21 aa, Cryptosporidium parvum
KSIKQKSETALAAKALSGHNQ

SEQ ID NO: 2348887 - protein, 11 aa, Cryptosporidium parvum
KSINSSKTSSI

SEQ ID NO: 2348888 - protein, 10 aa, Cryptosporidium parvum
KSKAECPMGE

SEQ ID NO: 2348889 - protein, 17 aa, Cryptosporidium parvum
KSKKEKDLTRESAKKDL

SEQ ID NO: 2348890 - protein, 6 aa, Cryptosporidium parvum
KSKKEL

SEQ ID NO: 2348891 - protein, 31 aa, Cryptosporidium parvum; identical to SEQ ID NO: 2267171

SEQ ID NO: 2348892 - protein, 4 aa, Cryptosporidium parvum
KSKV

SEQ ID NO: 2348893 - protein, 6 aa, Cryptosporidium parvum
KSLNST

SEQ ID NO: 2348894 - protein, 34 aa, Cryptosporidium parvum; identical to SEQ ID NO: 2267244

SEQ ID NO: 2348895 - protein, 21 aa, Cryptosporidium parvum
KSNKGKQKVNKSVKVAKSIKK

SEQ ID NO: 2348896 - protein, 6 aa, Cryptosporidium parvum
KSNNSF

SEQ ID NO: 2348897 - protein, 10 aa, Cryptosporidium parvum
KSNNSNISTE

SEQ ID NO: 2348898 - protein, 6 aa, Cryptosporidium parvum
KSNRNH

SEQ ID NO: 2348899 - protein, 9 aa, Cryptosporidium parvum
KSNTNSSLS

SEQ ID NO: 2348900 - protein, 101 aa, Cryptosporidium parvum
KSPPPQAKEGAPTEPKAEPAEAKGAPPAKGAPPAKGTPPAKGKGPPGKGKGPPGGKGPPGGKGPPGGKGPPTGKGPPKGKAGKFGGKTGSKPSGPESKTKK

SEQ ID NO: 2348901 - protein, 7 aa, Cryptosporidium parvum
KSPQGVG

SEQ ID NO: 2348902 - protein, 13 aa, Cryptosporidium parvum
KSQGTGDYSNNGD

SEQ ID NO: 2348903 - protein, 11 aa, Cryptosporidium parvum
KSQKINSSKSL

SEQ ID NO: 2348904 - protein, 10 aa, Cryptosporidium parvum
KSQNSQDVSF

SEQ ID NO: 2348905 - protein, 10 aa, Cryptosporidium parvum
KSQSNEYNLP

SEQ ID NO: 2348906 - protein, 5 aa, Cryptosporidium parvum
KSQTN

SEQ ID NO: 2348907 - protein, 16 aa, Cryptosporidium parvum
KSQYSGNKQERVSNDY

SEQ ID NO: 2348908 - protein, 6 aa, Cryptosporidium parvum
KSRQLR

SEQ ID NO: 2348909 - protein, 15 aa, Cryptosporidium parvum
KSRQNDFDYKGKQTY

SEQ ID NO: 2348910 - protein, 6 aa, Cryptosporidium parvum
KSRREC

SEQ ID NO: 2348911 - protein, 17 aa, Cryptosporidium parvum
KSRRVAETAMNERSSRS

SEQ ID NO: 2348912 - protein, 14 aa, Cryptosporidium parvum
KSSCPTGSEQQQQM

SEQ ID NO: 2348913 - protein, 9 aa, Cryptosporidium parvum
KSSDSGGRS

SEQ ID NO: 2348914 - protein, 8 aa, Cryptosporidium parvum
KSSENKTK

SEQ ID NO: 2348915 - protein, 26 aa, Cryptosporidium parvum
KSSETRKPQSLAEDQEPKKADQSIEE

SEQ ID NO: 2348916 - protein, 17 aa, Cryptosporidium parvum
KSSFPHGSYRPSSSNIS

SEQ ID NO: 2348917 - protein, 8 aa, Cryptosporidium parvum
KSSGADVP

SEQ ID NO: 2348918 - protein, 8 aa, Cryptosporidium parvum
KSSGISDG

SEQ ID NO: 2348919 - protein, 8 aa, Cryptosporidium parvum
KSSGSKDS

SEQ ID NO: 2348920 - protein, 6 aa, Cryptosporidium parvum
KSSLES

SEQ ID NO: 2348921 - protein, 8 aa, Cryptosporidium parvum
KSSLSEED

SEQ ID NO: 2348922 - protein, 10 aa, Cryptosporidium parvum
KSSNKNIENL

SEQ ID NO: 2348923 - protein, 18 aa, Cryptosporidium parvum
KSSQKQGKTQANSETFLP

SEQ ID NO: 2348924 - protein, 10 aa, Cryptosporidium parvum
KSSTSNKKLN

SEQ ID NO: 2348925 - protein, 7 aa, Cryptosporidium parvum
KSSTTIE

SEQ ID NO: 2348926 - protein, 9 aa, Cryptosporidium parvum
KSSYQNSED

SEQ ID NO: 2348927 - protein, 6 aa, Cryptosporidium parvum
KSTEKI

SEQ ID NO: 2348928 - protein, 6 aa, Cryptosporidium parvum
KSTHGW

SEQ ID NO: 2348929 - protein, 8 aa, Cryptosporidium parvum
KSTKIGNN

SEQ ID NO: 2348930 - protein, 20 aa, Cryptosporidium parvum
KSTKPPLPPKPNLTYGPQPF

SEQ ID NO: 2348931 - protein, 5 aa, Cryptosporidium parvum
KSTTV

SEQ ID NO: 2348932 - protein, 7 aa, Cryptosporidium parvum
KSTVGKV

SEQ ID NO: 2348933 - protein, 7 aa, Cryptosporidium parvum
KSTYNQS

SEQ ID NO: 2348934 - protein, 20 aa, Cryptosporidium parvum
KSVPKKQASKVQNTHGETHS

SEQ ID NO: 2348935 - protein, 11 aa, Cryptosporidium parvum
KSVSQSESEHE

SEQ ID NO: 2348936 - protein, 6 aa, Cryptosporidium parvum
KSWNNP

SEQ ID NO: 2348937 - protein, 6 aa, Cryptosporidium parvum
KSYGKL

SEQ ID NO: 2348938 - protein, 8 aa, Cryptosporidium parvum
KSYNNRNE

SEQ ID NO: 2348939 - protein, 7 aa, Cryptosporidium parvum
KTAETGY

SEQ ID NO: 2348940 - protein, 11 aa, Cryptosporidium parvum
KTAKDLKDTDK

SEQ ID NO: 2348941 - protein, 13 aa, Cryptosporidium parvum
KTEDGGFNSPQKS

SEQ ID NO: 2348942 - protein, 8 aa, Cryptosporidium parvum
KTEERTVS

SEQ ID NO: 2348943 - protein, 8 aa, Cryptosporidium parvum
KTEKYSDL

SEQ ID NO: 2348944 - protein, 8 aa, Cryptosporidium parvum
KTENEKDT

SEQ ID NO: 2348945 - protein, 6 aa, Cryptosporidium parvum
KTEPVS

SEQ ID NO: 2348946 - protein, 25 aa, Cryptosporidium parvum
KTETRQRSVKYETSNIAEQDEQRES

SEQ ID NO: 2348947 - protein, 10 aa, Cryptosporidium parvum
KTFSDSSERL

SEQ ID NO: 2348948 - protein, 9 aa, Cryptosporidium parvum
KTGEPSAPL

SEQ ID NO: 2348949 - protein, 5 aa, Cryptosporidium parvum
KTGKT

SEQ ID NO: 2348950 - protein, 8 aa, Cryptosporidium parvum
KTGLHDKP

SEQ ID NO: 2348951 - protein, 6 aa, Cryptosporidium parvum
KTGMDS

SEQ ID NO: 2348952 - protein, 8 aa, Cryptosporidium parvum
KTGNIEST

SEQ ID NO: 2348953 - protein, 14 aa, Cryptosporidium parvum
KTIENLKKKSNENR

SEQ ID NO: 2348954 - protein, 11 aa, Cryptosporidium parvum
KTIRNDNSSRF

SEQ ID NO: 2348955 - protein, 15 aa, Cryptosporidium parvum
KTKEDSIDETENQYE

SEQ ID NO: 2348956 - protein, 17 aa, Cryptosporidium parvum
KTKKVSNTGTKKDQPTM

SEQ ID NO: 2348957 - protein, 6 aa, Cryptosporidium parvum
KTKQTG

SEQ ID NO: 2348958 - protein, 65 aa, Cryptosporidium parvum; identical to SEQ ID NO: 2267688

SEQ ID NO: 2348959 - protein, 5 aa, Cryptosporidium parvum
KTNGE

SEQ ID NO: 2348960 - protein, 15 aa, Cryptosporidium parvum
KTNGLDDATSSQYAQ

SEQ ID NO: 2348961 - protein, 7 aa, Cryptosporidium parvum
KTNKAIQ

SEQ ID NO: 2348962 - protein, 8 aa, Cryptosporidium parvum
KTNSGNYP

SEQ ID NO: 2348963 - protein, 6 aa, Cryptosporidium parvum
KTNSKL

SEQ ID NO: 2348964 - protein, 15 aa, Cryptosporidium parvum
KTNVQDNEAGGITQQ

SEQ ID NO: 2348965 - protein, 14 aa, Cryptosporidium parvum
KTPPEIPKKPTFNP

SEQ ID NO: 2348966 - protein, 18 aa, Cryptosporidium parvum
KTPQGPGAKTEKEEKALS

SEQ ID NO: 2348967 - protein, 4 aa, Cryptosporidium parvum
KTQE

SEQ ID NO: 2348968 - protein, 8 aa, Cryptosporidium parvum
KTQKSQEI

SEQ ID NO: 2348969 - protein, 4 aa, Cryptosporidium parvum
KTQR

SEQ ID NO: 2348970 - protein, 11 aa, Cryptosporidium parvum
KTRDEDLSSTL

SEQ ID NO: 2348971 - protein, 12 aa, Cryptosporidium parvum
KTRTQWDQEQRE

SEQ ID NO: 2348972 - protein, 4 aa, Cryptosporidium parvum
KTRY

SEQ ID NO: 2348973 - protein, 9 aa, Cryptosporidium parvum
KTSANSVYG

SEQ ID NO: 2348974 - protein, 8 aa, Cryptosporidium parvum
KTSELDEL

SEQ ID NO: 2348975 - protein, 18 aa, Cryptosporidium parvum
KTSENSAAPEEPKPEEKA

SEQ ID NO: 2348976 - protein, 5 aa, Cryptosporidium parvum
KTSKN

SEQ ID NO: 2348977 - protein, 10 aa, Cryptosporidium parvum
KTSKNNINNR

SEQ ID NO: 2348978 - protein, 4 aa, Cryptosporidium parvum
KTSN

SEQ ID NO: 2348979 - protein, 8 aa, Cryptosporidium parvum
KTSNSTGM

SEQ ID NO: 2348980 - protein, 16 aa, Cryptosporidium parvum
KTSPASGQTPSRRQSY

SEQ ID NO: 2348981 - protein, 9 aa, Cryptosporidium parvum
KTSQNMKDD

SEQ ID NO: 2348982 - protein, 10 aa, Cryptosporidium parvum
KTSSNQDLSV

SEQ ID NO: 2348983 - protein, 16 aa, Cryptosporidium parvum
KTSSPCSESRNSTPWT

SEQ ID NO: 2348984 - protein, 7 aa, Cryptosporidium parvum
KTTEEAL

SEQ ID NO: 2348985 - protein, 6 aa, Cryptosporidium parvum
KTTGRI

SEQ ID NO: 2348986 - protein, 43 aa, Cryptosporidium parvum; identical to SEQ ID NO: 2267815

SEQ ID NO: 2348987 - protein, 8 aa, Cryptosporidium parvum
KTTPKGNY

SEQ ID NO: 2348988 - protein, 11 aa, Cryptosporidium parvum
KTVEEKTTIGE

SEQ ID NO: 2348989 - protein, 9 aa, Cryptosporidium parvum
KTVSSPEDI

SEQ ID NO: 2348990 - protein, 8 aa, Cryptosporidium parvum
KVAPTDIE

SEQ ID NO: 2348991 - protein, 4 aa, Cryptosporidium parvum
KVDE

SEQ ID NO: 2348992 - protein, 11 aa, Cryptosporidium parvum
KVNDEGLRNDL

SEQ ID NO: 2348993 - protein, 7 aa, Cryptosporidium parvum
KVPDSTY

SEQ ID NO: 2348994 - protein, 28 aa, Cryptosporidium parvum
KVSADEASKRKRQSNSFPGARKSSGGDL

SEQ ID NO: 2348995 - protein, 15 aa, Cryptosporidium parvum
KVSPKNQNGSKYSTK

SEQ ID NO: 2348996 - protein, 12 aa, Cryptosporidium parvum
KVSTPGGSTQAG

SEQ ID NO: 2348997 - protein, 6 aa, Cryptosporidium parvum
KVTPNS

SEQ ID NO: 2348998 - protein, 16 aa, Cryptosporidium parvum
KYGPYETYSGSPASKG

SEQ ID NO: 2348999 - protein, 8 aa, Cryptosporidium parvum
KYIPGSVG

SEQ ID NO: 2349000 - protein, 29 aa, Cryptosporidium parvum
KYKTRTQELEKENSALRQELSEKNERISQ

SEQ ID NO: 2349001 - protein, 16 aa, Cryptosporidium parvum
KYNSRVKNNTNPTQLK

SEQ ID NO: 2349002 - protein, 6 aa, Cryptosporidium parvum
KYNVNN

SEQ ID NO: 2349003 - protein, 9 aa, Cryptosporidium parvum
KYPSESSQI

SEQ ID NO: 2349004 - protein, 8 aa, Cryptosporidium parvum
KYRDEPES

SEQ ID NO: 2349005 - protein, 21 aa, Cryptosporidium parvum
KYSESSSNTKALASLKGSLPE

SEQ ID NO: 2349006 - protein, 11 aa, Cryptosporidium parvum
KYSLRENSRSI

SEQ ID NO: 2349007 - protein, 8 aa, Cryptosporidium parvum
KYTSESET

SEQ ID NO: 2349008 - protein, 4 aa, Cryptosporidium parvum
KYVE

SEQ ID NO: 2349009 - protein, 11 aa, Cryptosporidium parvum
LAKSKVNTENI

SEQ ID NO: 2349010 - protein, 9 aa, Cryptosporidium parvum
LAPAGTNDA

SEQ ID NO: 2349011 - protein, 7 aa, Cryptosporidium parvum
LAPGKVK

SEQ ID NO: 2349012 - protein, 11 aa, Cryptosporidium parvum
LAPPKNPPKVS

SEQ ID NO: 2349013 - protein, 7 aa, Cryptosporidium parvum
LASGDAD

SEQ ID NO: 2349014 - protein, 4 aa, Cryptosporidium parvum
LASP

SEQ ID NO: 2349015 - protein, 7 aa, Cryptosporidium parvum
LASPDLN

SEQ ID NO: 2349016 - protein, 5 aa, Cryptosporidium parvum
LDATK

SEQ ID NO: 2349017 - protein, 16 aa, Cryptosporidium parvum
LDDEDKINEKVSQSLR

SEQ ID NO: 2349018 - protein, 7 aa, Cryptosporidium parvum
LDDESPA

SEQ ID NO: 2349019 - protein, 8 aa, Cryptosporidium parvum
LDKNHEPK

SEQ ID NO: 2349020 - protein, 11 aa, Cryptosporidium parvum
LDNEDNQSMTG

SEQ ID NO: 2349021 - protein, 15 aa, Cryptosporidium parvum
LDNGTSEPINLSVQN

SEQ ID NO: 2349022 - protein, 8 aa, Cryptosporidium parvum
LDNNSNLA

SEQ ID NO: 2349023 - protein, 12 aa, Cryptosporidium parvum
LDPQCGNISKDD

SEQ ID NO: 2349024 - protein, 21 aa, Cryptosporidium parvum
LDPSDYNYRPNYDNSNDSEDY

SEQ ID NO: 2349025 - protein, 10 aa, Cryptosporidium parvum
LDQSEKEAER

SEQ ID NO: 2349026 - protein, 7 aa, Cryptosporidium parvum
LDRGGKD

SEQ ID NO: 2349027 - protein, 31 aa, Cryptosporidium parvum; identical to SEQ ID NO: 2268262

SEQ ID NO: 2349028 - protein, 16 aa, Cryptosporidium parvum
LDSPSKLGTPSSRSSV

SEQ ID NO: 2349029 - protein, 6 aa, Cryptosporidium parvum
LDTEAT

SEQ ID NO: 2349030 - protein, 12 aa, Cryptosporidium parvum
LDYTSDKRGTLK

SEQ ID NO: 2349031 - protein, 7 aa, Cryptosporidium parvum
LEANTGG

SEQ ID NO: 2349032 - protein, 14 aa, Cryptosporidium parvum
LEDRPDGSFIWKSV

SEQ ID NO: 2349033 - protein, 8 aa, Cryptosporidium parvum
LEEGEDLN

SEQ ID NO: 2349034 - protein, 7 aa, Cryptosporidium parvum
LEEGTGN

SEQ ID NO: 2349035 - protein, 5 aa, Cryptosporidium parvum
LEEKA

SEQ ID NO: 2349036 - protein, 4 aa, Cryptosporidium parvum
LEEQ

SEQ ID NO: 2349037 - protein, 5 aa, Cryptosporidium parvum
LEEQK

SEQ ID NO: 2349038 - protein, 8 aa, Cryptosporidium parvum
LEESGSQD

SEQ ID NO: 2349039 - protein, 10 aa, Cryptosporidium parvum
LEESNPDPKD

SEQ ID NO: 2349040 - protein, 7 aa, Cryptosporidium parvum
LEEYGNS

SEQ ID NO: 2349041 - protein, 7 aa, Cryptosporidium parvum
LEGDEDS

SEQ ID NO: 2349042 - protein, 4 aa, Cryptosporidium parvum
LEGE

SEQ ID NO: 2349043 - protein, 5 aa, Cryptosporidium parvum
LEGEK

SEQ ID NO: 2349044 - protein, 9 aa, Cryptosporidium parvum
LEGGDSVSQ

SEQ ID NO: 2349045 - protein, 16 aa, Cryptosporidium parvum
LEGTPIDKNREEVGEN

SEQ ID NO: 2349046 - protein, 20 aa, Cryptosporidium parvum
LEHPTKNNNIDHNDPNISRN

SEQ ID NO: 2349047 - protein, 4 aa, Cryptosporidium parvum
LEKG

SEQ ID NO: 2349048 - protein, 8 aa, Cryptosporidium parvum
LEKGDSYD

SEQ ID NO: 2349049 - protein, 19 aa, Cryptosporidium parvum
LEKKTGLNNNNSNNNNSDD

SEQ ID NO: 2349050 - protein, 7 aa, Cryptosporidium parvum
LEKPTNI

SEQ ID NO: 2349051 - protein, 8 aa, Cryptosporidium parvum
LEKSNQRK

SEQ ID NO: 2349052 - protein, 9 aa, Cryptosporidium parvum
LEKTEKSLT

SEQ ID NO: 2349053 - protein, 7 aa, Cryptosporidium parvum
LENAKNI

SEQ ID NO: 2349054 - protein, 14 aa, Cryptosporidium parvum
LENSASKAKGARKD

SEQ ID NO: 2349055 - protein, 42 aa, Cryptosporidium parvum; identical to SEQ ID NO: 2150525

SEQ ID NO: 2349056 - protein, 20 aa, Cryptosporidium parvum
LEPQPNISTIEKNSESNEEL

SEQ ID NO: 2349057 - protein, 19 aa, Cryptosporidium parvum
LEPTENAYKNLNEQETDHS

SEQ ID NO: 2349058 - protein, 10 aa, Cryptosporidium parvum
LEQQAAEKER

SEQ ID NO: 2349059 - protein, 5 aa, Cryptosporidium parvum
LEQSL

SEQ ID NO: 2349060 - protein, 8 aa, Cryptosporidium parvum
LEQTKSQL

SEQ ID NO: 2349061 - protein, 14 aa, Cryptosporidium parvum
LERSEKEKEDYKRL

SEQ ID NO: 2349062 - protein, 10 aa, Cryptosporidium parvum
LESNPSIEKQ

SEQ ID NO: 2349063 - protein, 4 aa, Cryptosporidium parvum
LESS

SEQ ID NO: 2349064 - protein, 6 aa, Cryptosporidium parvum
LETANE

SEQ ID NO: 2349065 - protein, 10 aa, Cryptosporidium parvum
LETKEREAQT

SEQ ID NO: 2349066 - protein, 9 aa, Cryptosporidium parvum
LEYNETDIS

SEQ ID NO: 2349067 - protein, 7 aa, Cryptosporidium parvum
LGADGST

SEQ ID NO: 2349068 - protein, 11 aa, Cryptosporidium parvum
LGANGDIDGSL

SEQ ID NO: 2349069 - protein, 10 aa, Cryptosporidium parvum
LGDDSPEKEA

SEQ ID NO: 2349070 - protein, 11 aa, Cryptosporidium parvum
LGEPPESDNEM

SEQ ID NO: 2349071 - protein, 7 aa, Cryptosporidium parvum
LGGEVGG

SEQ ID NO: 2349072 - protein, 22 aa, Cryptosporidium parvum
LGGGLGKVRGQEKPESKSFFGG

SEQ ID NO: 2349073 - protein, 9 aa, Cryptosporidium parvum
LGGGTGSGM

SEQ ID NO: 2349074 - protein, 7 aa, Cryptosporidium parvum
LGGNKGN

SEQ ID NO: 2349075 - protein, 5 aa, Cryptosporidium parvum
LGGNS

SEQ ID NO: 2349076 - protein, 8 aa, Cryptosporidium parvum
LGHGDTQD

SEQ ID NO: 2349077 - protein, 11 aa, Cryptosporidium parvum
LGKAKTGTGKT

SEQ ID NO: 2349078 - protein, 8 aa, Cryptosporidium parvum
LGNDGIET

SEQ ID NO: 2349079 - protein, 7 aa, Cryptosporidium parvum
LGPDGRP

SEQ ID NO: 2349080 - protein, 6 aa, Cryptosporidium parvum
LGPRGR

SEQ ID NO: 2349081 - protein, 7 aa, Cryptosporidium parvum
LGPRKAK

SEQ ID NO: 2349082 - protein, 15 aa, Cryptosporidium parvum
LGQGKESCKSKERAC

SEQ ID NO: 2349083 - protein, 25 aa, Cryptosporidium parvum
LGREKDKDLLPNSVPNSNQISHNPN

SEQ ID NO: 2349084 - protein, 7 aa, Cryptosporidium parvum
LGSEKYD

SEQ ID NO: 2349085 - protein, 10 aa, Cryptosporidium parvum
LGSQHSAAVT

SEQ ID NO: 2349086 - protein, 4 aa, Cryptosporidium parvum
LGSS

SEQ ID NO: 2349087 - protein, 6 aa, Cryptosporidium parvum
LGSTRG

SEQ ID NO: 2349088 - protein, 16 aa, Cryptosporidium parvum
LGTSDEGMYGETREKG

SEQ ID NO: 2349089 - protein, 8 aa, Cryptosporidium parvum
LGTTETKQ

SEQ ID NO: 2349090 - protein, 26 aa, Cryptosporidium parvum
LHEKENKALRSVSKRGCKKKNNAVTS

SEQ ID NO: 2349091 - protein, 5 aa, Cryptosporidium parvum
LIGDP

SEQ ID NO: 2349092 - protein, 6 aa, Cryptosporidium parvum
LIKSGD

SEQ ID NO: 2349093 - protein, 4 aa, Cryptosporidium parvum
LISG

SEQ ID NO: 2349094 - protein, 9 aa, Cryptosporidium parvum
LKAGGDREK

SEQ ID NO: 2349095 - protein, 11 aa, Cryptosporidium parvum
LKAKNKANEYE

SEQ ID NO: 2349096 - protein, 20 aa, Cryptosporidium parvum
LKDSNNNNNNNNSNNNEYSI

SEQ ID NO: 2349097 - protein, 19 aa, Cryptosporidium parvum
LKDSPTADSEQSDNESSLE

SEQ ID NO: 2349098 - protein, 11 aa, Cryptosporidium parvum
LKEAGDLNNSI

SEQ ID NO: 2349099 - protein, 8 aa, Cryptosporidium parvum
LKEGTSTF

SEQ ID NO: 2349100 - protein, 8 aa, Cryptosporidium parvum
LKEKGINE

SEQ ID NO: 2349101 - protein, 15 aa, Cryptosporidium parvum
LKEKQEEEKRRKEAL

SEQ ID NO: 2349102 - protein, 7 aa, Cryptosporidium parvum
LKENGED

SEQ ID NO: 2349103 - protein, 27 aa, Cryptosporidium parvum
LKEQKIDTTLSGKQKTECKVKSSSKFT

SEQ ID NO: 2349104 - protein, 12 aa, Cryptosporidium parvum
LKEQNKSLENQL

SEQ ID NO: 2349105 - protein, 17 aa, Cryptosporidium parvum
LKESPTSNDNSSNSNNF

SEQ ID NO: 2349106 - protein, 7 aa, Cryptosporidium parvum
LKGAQDV

SEQ ID NO: 2349107 - protein, 12 aa, Cryptosporidium parvum
LKGDGLNSSDSD

SEQ ID NO: 2349108 - protein, 10 aa, Cryptosporidium parvum
LKGDSLKSKC

SEQ ID NO: 2349109 - protein, 5 aa, Cryptosporidium parvum
LKGGA

SEQ ID NO: 2349110 - protein, 28 aa, Cryptosporidium parvum
LKGNSFNKLPSSDEDKLSIRAKSNKRKT

SEQ ID NO: 2349111 - protein, 4 aa, Cryptosporidium parvum
LKKQ

SEQ ID NO: 2349112 - protein, 19 aa, Cryptosporidium parvum
LKKQNNGELSKSSTYLNPN

SEQ ID NO: 2349113 - protein, 14 aa, Cryptosporidium parvum
LKNGETSSKPINSQ

SEQ ID NO: 2349114 - protein, 7 aa, Cryptosporidium parvum
LKPPKKV

SEQ ID NO: 2349115 - protein, 6 aa, Cryptosporidium parvum
LKPVQS

SEQ ID NO: 2349116 - protein, 21 aa, Cryptosporidium parvum
LKQNSDKSSSQPLHKKPNVKV

SEQ ID NO: 2349117 - protein, 13 aa, Cryptosporidium parvum
LKQTDSKDSLSNC

SEQ ID NO: 2349118 - protein, 6 aa, Cryptosporidium parvum
LKRNKT

SEQ ID NO: 2349119 - protein, 108 aa, Cryptosporidium parvum; identical to SEQ ID NO: 2268821

SEQ ID NO: 2349120 - protein, 13 aa, Cryptosporidium parvum
LKRSQAEYESRKK

SEQ ID NO: 2349121 - protein, 7 aa, Cryptosporidium parvum
LKRTKTL

SEQ ID NO: 2349122 - protein, 9 aa, Cryptosporidium parvum
LKSDHSQHK

SEQ ID NO: 2349123 - protein, 18 aa, Cryptosporidium parvum
LKSGKSVTYTNSSHNNAE

SEQ ID NO: 2349124 - protein, 24 aa, Cryptosporidium parvum
LKSNQPNDAKQSIKTENKECKEKK

SEQ ID NO: 2349125 - protein, 9 aa, Cryptosporidium parvum
LKSSNKKLR

SEQ ID NO: 2349126 - protein, 7 aa, Cryptosporidium parvum
LKTQKST

SEQ ID NO: 2349127 - protein, 19 aa, Cryptosporidium parvum
LKTSRGMIDSSGGGTIGSR

SEQ ID NO: 2349128 - protein, 6 aa, Cryptosporidium parvum
LKTSSK

SEQ ID NO: 2349129 - protein, 28 aa, Cryptosporidium parvum
LLAPKSDLIKSDSLKKSTELGKSQLDSK

SEQ ID NO: 2349130 - protein, 13 aa, Cryptosporidium parvum
LNDPSNAITDSES

SEQ ID NO: 2349131 - protein, 9 aa, Cryptosporidium parvum
LNDSNKEYS

SEQ ID NO: 2349132 - protein, 9 aa, Cryptosporidium parvum
LNDSSSEYQ

SEQ ID NO: 2349133 - protein, 4 aa, Cryptosporidium parvum
LNEG

SEQ ID NO: 2349134 - protein, 9 aa, Cryptosporidium parvum
LNEGESSCE

SEQ ID NO: 2349135 - protein, 6 aa, Cryptosporidium parvum
LNGESK

SEQ ID NO: 2349136 - protein, 4 aa, Cryptosporidium parvum
LNGS

SEQ ID NO: 2349137 - protein, 8 aa, Cryptosporidium parvum
LNIPTDPI

SEQ ID NO: 2349138 - protein, 10 aa, Cryptosporidium parvum
LNKDSQKHRL

SEQ ID NO: 2349139 - protein, 10 aa, Cryptosporidium parvum
LNKGRSSNSE

SEQ ID NO: 2349140 - protein, 12 aa, Cryptosporidium parvum
LNKRKESSIDKK

SEQ ID NO: 2349141 - protein, 8 aa, Cryptosporidium parvum
LNNDGEIK

SEQ ID NO: 2349142 - protein, 6 aa, Cryptosporidium parvum
LNNEQS

SEQ ID NO: 2349143 - protein, 10 aa, Cryptosporidium parvum
LNNHKTDTNL

SEQ ID NO: 2349144 - protein, 32 aa, Cryptosporidium parvum
LNNINTNANSNIDANSSTGTNTLNVGDFNKDG

SEQ ID NO: 2349145 - protein, 4 aa, Cryptosporidium parvum
LNNN

SEQ ID NO: 2349146 - protein, 5 aa, Cryptosporidium parvum
LNPDA

SEQ ID NO: 2349147 - protein, 5 aa, Cryptosporidium parvum
LNPTG

SEQ ID NO: 2349148 - protein, 5 aa, Cryptosporidium parvum
LNPTN

SEQ ID NO: 2349149 - protein, 11 aa, Cryptosporidium parvum
LNQEEKERLEK

SEQ ID NO: 2349150 - protein, 5 aa, Cryptosporidium parvum
LNSND

SEQ ID NO: 2349151 - protein, 10 aa, Cryptosporidium parvum
LNSNQSADEL

SEQ ID NO: 2349152 - protein, 20 aa, Cryptosporidium parvum
LNSQDSHNISSNNNNNNNFQ

SEQ ID NO: 2349153 - protein, 9 aa, Cryptosporidium parvum
LNSSQESNT

SEQ ID NO: 2349154 - protein, 32 aa, Cryptosporidium parvum; identical to SEQ ID NO: 2269111

SEQ ID NO: 2349155 - protein, 14 aa, Cryptosporidium parvum
LNTGNVSSQEITPN

SEQ ID NO: 2349156 - protein, 19 aa, Cryptosporidium parvum
LNTKKTAKKVEGKSKIIGS

SEQ ID NO: 2349157 - protein, 10 aa, Cryptosporidium parvum
LNTPSYGNNS

SEQ ID NO: 2349158 - protein, 9 aa, Cryptosporidium parvum
LNYSNDEIN

SEQ ID NO: 2349159 - protein, 8 aa, Cryptosporidium parvum
LPEGDSTS

SEQ ID NO: 2349160 - protein, 5 aa, Cryptosporidium parvum
LPGEL

SEQ ID NO: 2349161 - protein, 6 aa, Cryptosporidium parvum
LPGWGA

SEQ ID NO: 2349162 - protein, 5 aa, Cryptosporidium parvum
LPHPS

SEQ ID NO: 2349163 - protein, 4 aa, Cryptosporidium parvum
LPKT

SEQ ID NO: 2349164 - protein, 7 aa, Cryptosporidium parvum
LPNKQNS

SEQ ID NO: 2349165 - protein, 7 aa, Cryptosporidium parvum
LPPDSTY

SEQ ID NO: 2349166 - protein, 5 aa, Cryptosporidium parvum
LPPIS

SEQ ID NO: 2349167 - protein, 8 aa, Cryptosporidium parvum
LPPKSPGL

SEQ ID NO: 2349168 - protein, 10 aa, Cryptosporidium parvum
LPPNTEPSSN

SEQ ID NO: 2349169 - protein, 5 aa, Cryptosporidium parvum
LPPPK

SEQ ID NO: 2349170 - protein, 36 aa, Cryptosporidium parvum; identical to SEQ ID NO: 2269254

SEQ ID NO: 2349171 - protein, 13 aa, Cryptosporidium parvum
LPQPSSGNKPLTR

SEQ ID NO: 2349172 - protein, 9 aa, Cryptosporidium parvum
LPRKDGLDL

SEQ ID NO: 2349173 - protein, 5 aa, Cryptosporidium parvum
LPSLE

SEQ ID NO: 2349174 - protein, 7 aa, Cryptosporidium parvum
LPSPVTK

SEQ ID NO: 2349175 - protein, 5 aa, Cryptosporidium parvum
LPSSL

SEQ ID NO: 2349176 - protein, 4 aa, Cryptosporidium parvum
LPYG

SEQ ID NO: 2349177 - protein, 13 aa, Cryptosporidium parvum
LPYTSDDKGNTNN

SEQ ID NO: 2349178 - protein, 6 aa, Cryptosporidium parvum
LQASVA

SEQ ID NO: 2349179 - protein, 12 aa, Cryptosporidium parvum
LQEEKIKRRREI

SEQ ID NO: 2349180 - protein, 6 aa, Cryptosporidium parvum
LQEPKK

SEQ ID NO: 2349181 - protein, 6 aa, Cryptosporidium parvum
LQGDRE

SEQ ID NO: 2349182 - protein, 6 aa, Cryptosporidium parvum
LQGTTG

SEQ ID NO: 2349183 - protein, 11 aa, Cryptosporidium parvum
LQKKGTEYQGN

SEQ ID NO: 2349184 - protein, 17 aa, Cryptosporidium parvum
LQNESTEFTNSYQTPLS

SEQ ID NO: 2349185 - protein, 12 aa, Cryptosporidium parvum
LQNPTGAMSPGP

SEQ ID NO: 2349186 - protein, 9 aa, Cryptosporidium parvum
LQSNAPNRG

SEQ ID NO: 2349187 - protein, 9 aa, Cryptosporidium parvum
LQSSTREEL

SEQ ID NO: 2349188 - protein, 12 aa, Cryptosporidium parvum
LRDPGSAPNIGD

SEQ ID NO: 2349189 - protein, 6 aa, Cryptosporidium parvum
LRETTS

SEQ ID NO: 2349190 - protein, 7 aa, Cryptosporidium parvum
LRKGEQY

SEQ ID NO: 2349191 - protein, 14 aa, Cryptosporidium parvum
LRNDTRQKREYEEN

SEQ ID NO: 2349192 - protein, 6 aa, Cryptosporidium parvum
LRNPET

SEQ ID NO: 2349193 - protein, 8 aa, Cryptosporidium parvum
LRPPPIPI

SEQ ID NO: 2349194 - protein, 9 aa, Cryptosporidium parvum
LRSKPQKGE

SEQ ID NO: 2349195 - protein, 7 aa, Cryptosporidium parvum
LRSRGSS

SEQ ID NO: 2349196 - protein, 34 aa, Cryptosporidium parvum
LRTRRRTQKWADKQYKRANLGTRYKSNPFGGASH

SEQ ID NO: 2349197 - protein, 9 aa, Cryptosporidium parvum
LSAKKTKSL

SEQ ID NO: 2349198 - protein, 4 aa, Cryptosporidium parvum
LSDD

SEQ ID NO: 2349199 - protein, 10 aa, Cryptosporidium parvum
LSDDSARGIE

SEQ ID NO: 2349200 - protein, 7 aa, Cryptosporidium parvum
LSDESRE

SEQ ID NO: 2349201 - protein, 5 aa, Cryptosporidium parvum
LSDKK

SEQ ID NO: 2349202 - protein, 9 aa, Cryptosporidium parvum
LSDPNAAYK

SEQ ID NO: 2349203 - protein, 26 aa, Cryptosporidium parvum
LSDSTTKYNLGSNDYDLQRDTQTCRK

SEQ ID NO: 2349204 - protein, 47 aa, Cryptosporidium parvum; identical to SEQ ID NO: 2269496

SEQ ID NO: 2349205 - protein, 8 aa, Cryptosporidium parvum
LSEHDSDI

SEQ ID NO: 2349206 - protein, 11 aa, Cryptosporidium parvum
LSEQDLNSNKI

SEQ ID NO: 2349207 - protein, 11 aa, Cryptosporidium parvum
LSEQDNKSNIT

SEQ ID NO: 2349208 - protein, 7 aa, Cryptosporidium parvum
LSESSRK

SEQ ID NO: 2349209 - protein, 8 aa, Cryptosporidium parvum
LSGGEQTK

SEQ ID NO: 2349210 - protein, 8 aa, Cryptosporidium parvum
LSGSGTPN

SEQ ID NO: 2349211 - protein, 9 aa, Cryptosporidium parvum
LSHSNDRNG

SEQ ID NO: 2349212 - protein, 55 aa, Cryptosporidium parvum; identical to SEQ ID NO: 2151486

SEQ ID NO: 2349213 - protein, 11 aa, Cryptosporidium parvum
LSITPSSPKTF

SEQ ID NO: 2349214 - protein, 7 aa, Cryptosporidium parvum
LSKDSQD

SEQ ID NO: 2349215 - protein, 7 aa, Cryptosporidium parvum
LSKDTDS

SEQ ID NO: 2349216 - protein, 4 aa, Cryptosporidium parvum
LSKE

SEQ ID NO: 2349217 - protein, 9 aa, Cryptosporidium parvum
LSKQSTKNS

SEQ ID NO: 2349218 - protein, 23 aa, Cryptosporidium parvum
LSKSAPELGSQDKKNKKSRSNPM

SEQ ID NO: 2349219 - protein, 9 aa, Cryptosporidium parvum
LSKYQKQNL

SEQ ID NO: 2349220 - protein, 4 aa, Cryptosporidium parvum
LSNE

SEQ ID NO: 2349221 - protein, 16 aa, Cryptosporidium parvum
LSNRPKRKSPKCIKDE

SEQ ID NO: 2349222 - protein, 10 aa, Cryptosporidium parvum
LSNSDPSLDT

SEQ ID NO: 2349223 - protein, 7 aa, Cryptosporidium parvum
LSPDESE

SEQ ID NO: 2349224 - protein, 5 aa, Cryptosporidium parvum
LSPER

SEQ ID NO: 2349225 - protein, 6 aa, Cryptosporidium parvum
LSPGDK

SEQ ID NO: 2349226 - protein, 5 aa, Cryptosporidium parvum
LSPLD

SEQ ID NO: 2349227 - protein, 6 aa, Cryptosporidium parvum
LSPNLS

SEQ ID NO: 2349228 - protein, 122 aa, Cryptosporidium parvum; identical to SEQ ID NO: 2269661

SEQ ID NO: 2349229 - protein, 8 aa, Cryptosporidium parvum
LSPQNRNR

SEQ ID NO: 2349230 - protein, 8 aa, Cryptosporidium parvum
LSQKTALN

SEQ ID NO: 2349231 - protein, 12 aa, Cryptosporidium parvum
LSSLDEKSKGMK

SEQ ID NO: 2349232 - protein, 18 aa, Cryptosporidium parvum
LSSPTKLNNWKSSETPIR

SEQ ID NO: 2349233 - protein, 8 aa, Cryptosporidium parvum
LSSSENPW

SEQ ID NO: 2349234 - protein, 12 aa, Cryptosporidium parvum
LSSSGRHNSPSS

SEQ ID NO: 2349235 - protein, 11 aa, Cryptosporidium parvum
LSSTNNKEKCH

SEQ ID NO: 2349236 - protein, 9 aa, Cryptosporidium parvum
LSTDGNIKK

SEQ ID NO: 2349237 - protein, 4 aa, Cryptosporidium parvum
LSTG

SEQ ID NO: 2349238 - protein, 5 aa, Cryptosporidium parvum
LSTKT

SEQ ID NO: 2349239 - protein, 14 aa, Cryptosporidium parvum
LSTRKKKQNSDSGI

SEQ ID NO: 2349240 - protein, 7 aa, Cryptosporidium parvum
LSTSDSK

SEQ ID NO: 2349241 - protein, 11 aa, Cryptosporidium parvum
LSVKSSNNSFP

SEQ ID NO: 2349242 - protein, 28 aa, Cryptosporidium parvum
LSYSGEESSYSQSRRRTHDYSKTCPSFQ

SEQ ID NO: 2349243 - protein, 6 aa, Cryptosporidium parvum
LTDGGL

SEQ ID NO: 2349244 - protein, 6 aa, Cryptosporidium parvum
LTEAAE

SEQ ID NO: 2349245 - protein, 17 aa, Cryptosporidium parvum
LTEDEDDDGTSDSEVDM

SEQ ID NO: 2349246 - protein, 12 aa, Cryptosporidium parvum
LTGSTLNNSNHL

SEQ ID NO: 2349247 - protein, 7 aa, Cryptosporidium parvum
LTKSGEK

SEQ ID NO: 2349248 - protein, 13 aa, Cryptosporidium parvum
LTNETEDQETRQE

SEQ ID NO: 2349249 - protein, 24 aa, Cryptosporidium parvum
LTNNYGAESYQLNSPENQRGAGRI

SEQ ID NO: 2349250 - protein, 8 aa, Cryptosporidium parvum
LTNTSDLE

SEQ ID NO: 2349251 - protein, 6 aa, Cryptosporidium parvum
LTPSSE

SEQ ID NO: 2349252 - protein, 10 aa, Cryptosporidium parvum
LTSRGSQQYR

SEQ ID NO: 2349253 - protein, 29 aa, Cryptosporidium parvum
LTSSDSSSSSSSSSASNTSKTNNSASHQD

SEQ ID NO: 2349254 - protein, 26 aa, Cryptosporidium parvum
LTSSRGSRRGGNGAYSSGNNTGTGGM

SEQ ID NO: 2349255 - protein, 7 aa, Cryptosporidium parvum
LTTTTKE

SEQ ID NO: 2349256 - protein, 11 aa, Cryptosporidium parvum
LVGNNSNPNPF

SEQ ID NO: 2349257 - protein, 5 aa, Cryptosporidium parvum
LYGES

SEQ ID NO: 2349258 - protein, 6 aa, Cryptosporidium parvum
LYGRDS

SEQ ID NO: 2349259 - protein, 5 aa, Cryptosporidium parvum
LYSPT

SEQ ID NO: 2349260 - protein, 9 aa, Cryptosporidium parvum
MANINSSNQ

SEQ ID NO: 2349261 - protein, 20 aa, Cryptosporidium parvum
MASGEDDDIPDLVENFEDVE

SEQ ID NO: 2349262 - protein, 8 aa, Cryptosporidium parvum
MASSIGSN

SEQ ID NO: 2349263 - protein, 7 aa, Cryptosporidium parvum
MATDSSY

SEQ ID NO: 2349264 - protein, 10 aa, Cryptosporidium parvum
MDESKMDGRQ

SEQ ID NO: 2349265 - protein, 6 aa, Cryptosporidium parvum
MDGPTS

SEQ ID NO: 2349266 - protein, 13 aa, Cryptosporidium parvum
MDKRSGKVLEENP

SEQ ID NO: 2349267 - protein, 11 aa, Cryptosporidium parvum
MDNASNNERAS

SEQ ID NO: 2349268 - protein, 7 aa, Cryptosporidium parvum
MEDSQGN

SEQ ID NO: 2349269 - protein, 4 aa, Cryptosporidium parvum
MENS

SEQ ID NO: 2349270 - protein, 6 aa, Cryptosporidium parvum
MENSKT

SEQ ID NO: 2349271 - protein, 4 aa, Cryptosporidium parvum
MENT

SEQ ID NO: 2349272 - protein, 12 aa, Cryptosporidium parvum
MEPPKRPTDKPL

SEQ ID NO: 2349273 - protein, 20 aa, Cryptosporidium parvum
METETSRISESYESQKSDLN

SEQ ID NO: 2349274 - protein, 10 aa, Cryptosporidium parvum
MGESGSNEDD

SEQ ID NO: 2349275 - protein, 5 aa, Cryptosporidium parvum
MGGDL

SEQ ID NO: 2349276 - protein, 5 aa, Cryptosporidium parvum
MGSGE

SEQ ID NO: 2349277 - protein, 34 aa, Cryptosporidium parvum; identical to SEQ ID NO: 2270080

SEQ ID NO: 2349278 - protein, 4 aa, Cryptosporidium parvum
MIGG

SEQ ID NO: 2349279 - protein, 9 aa, Cryptosporidium parvum
MKEDKRNLA

SEQ ID NO: 2349280 - protein, 8 aa, Cryptosporidium parvum
MKNSKPCD

SEQ ID NO: 2349281 - protein, 4 aa, Cryptosporidium parvum
MKPP

SEQ ID NO: 2349282 - protein, 31 aa, Cryptosporidium parvum; identical to SEQ ID NO: 2219944

SEQ ID NO: 2349283 - protein, 5 aa, Cryptosporidium parvum
MNATG

SEQ ID NO: 2349284 - protein, 49 aa, Cryptosporidium parvum
MNDGPREGAAKASMSDKTNKDEQSIPKISTPVASTKQSVVPTSSTQLTG

SEQ ID NO: 2349285 - protein, 8 aa, Cryptosporidium parvum
MNNSENLT

SEQ ID NO: 2349286 - protein, 6 aa, Cryptosporidium parvum
MNSPEH

SEQ ID NO: 2349287 - protein, 8 aa, Cryptosporidium parvum
MNTTQSME

SEQ ID NO: 2349288 - protein, 4 aa, Cryptosporidium parvum
MPKV

SEQ ID NO: 2349289 - protein, 11 aa, Cryptosporidium parvum
MPPEQISPTVT

SEQ ID NO: 2349290 - protein, 11 aa, Cryptosporidium parvum
MPTASTSQILG

SEQ ID NO: 2349291 - protein, 4 aa, Cryptosporidium parvum
MPTT

SEQ ID NO: 2349292 - protein, 5 aa, Cryptosporidium parvum
MPYSK

SEQ ID NO: 2349293 - protein, 18 aa, Cryptosporidium parvum
MQNNNANHDYNDQVQSSN

SEQ ID NO: 2349294 - protein, 19 aa, Cryptosporidium parvum
MQQQSNSRNKGSEPQINSN

SEQ ID NO: 2349295 - protein, 4 aa, Cryptosporidium parvum
MRPI

SEQ ID NO: 2349296 - protein, 66 aa, Cryptosporidium parvum; identical to SEQ ID NO: 2270203

SEQ ID NO: 2349297 - protein, 7 aa, Cryptosporidium parvum
MRRETEK

SEQ ID NO: 2349298 - protein, 4 aa, Cryptosporidium parvum
MSKS

SEQ ID NO: 2349299 - protein, 8 aa, Cryptosporidium parvum
MSKSNNIS

SEQ ID NO: 2349300 - protein, 4 aa, Cryptosporidium parvum
MSLN

SEQ ID NO: 2349301 - protein, 16 aa, Cryptosporidium parvum
MSQDDEKEEESHEGHK

SEQ ID NO: 2349302 - protein, 25 aa, Cryptosporidium parvum
MSSQSQPRTVSKSRSISHTRTQSQP

SEQ ID NO: 2349303 - protein, 9 aa, Cryptosporidium parvum
MSSRGQQPT

SEQ ID NO: 2349304 - protein, 46 aa, Cryptosporidium parvum; identical to SEQ ID NO: 2270240

SEQ ID NO: 2349305 - protein, 6 aa, Cryptosporidium parvum
MTGGRT

SEQ ID NO: 2349306 - protein, 12 aa, Cryptosporidium parvum
MTNKADNSQDIS

SEQ ID NO: 2349307 - protein, 16 aa, Cryptosporidium parvum
MTPTTSASSSSVSPIS

SEQ ID NO: 2349308 - protein, 97 aa, Cryptosporidium parvum; identical to SEQ ID NO: 2270260

SEQ ID NO: 2349309 - protein, 5 aa, Cryptosporidium parvum
MYPNS

SEQ ID NO: 2349310 - protein, 13 aa, Cryptosporidium parvum
NADDMNTAVSSYS

SEQ ID NO: 2349311 - protein, 12 aa, Cryptosporidium parvum
NADSYEDEVDPI

SEQ ID NO: 2349312 - protein, 7 aa, Cryptosporidium parvum
NAEPNTK

SEQ ID NO: 2349313 - protein, 16 aa, Cryptosporidium parvum
NAESGDTSSASKRCSY

SEQ ID NO: 2349314 - protein, 4 aa, Cryptosporidium parvum
NAFT

SEQ ID NO: 2349315 - protein, 6 aa, Cryptosporidium parvum
NAGFDG

SEQ ID NO: 2349316 - protein, 46 aa, Cryptosporidium parvum; identical to SEQ ID NO: 2270304

SEQ ID NO: 2349317 - protein, 8 aa, Cryptosporidium parvum
NAKKSSEC

SEQ ID NO: 2349318 - protein, 29 aa, Cryptosporidium parvum
NANITTNTTNTTTTTTNNNNNNNNNNNST

SEQ ID NO: 2349319 - protein, 4 aa, Cryptosporidium parvum
NANP

SEQ ID NO: 2349320 - protein, 5 aa, Cryptosporidium parvum
NAQQD

SEQ ID NO: 2349321 - protein, 8 aa, Cryptosporidium parvum
NASEEELS

SEQ ID NO: 2349322 - protein, 10 aa, Cryptosporidium parvum
NASLKESISQ

SEQ ID NO: 2349323 - protein, 14 aa, Cryptosporidium parvum
NASRNLEDNQTSLD

SEQ ID NO: 2349324 - protein, 9 aa, Cryptosporidium parvum
NASSGGECS

SEQ ID NO: 2349325 - protein, 5 aa, Cryptosporidium parvum
NASST

SEQ ID NO: 2349326 - protein, 5 aa, Cryptosporidium parvum
NATDI

SEQ ID NO: 2349327 - protein, 8 aa, Cryptosporidium parvum
NATKDLSP

SEQ ID NO: 2349328 - protein, 14 aa, Cryptosporidium parvum
NCASESTFEGERQN

SEQ ID NO: 2349329 - protein, 11 aa, Cryptosporidium parvum
NCNETSANRTK

SEQ ID NO: 2349330 - protein, 7 aa, Cryptosporidium parvum
NCPNDSI

SEQ ID NO: 2349331 - protein, 13 aa, Cryptosporidium parvum
NDAEITTSKQDSN

SEQ ID NO: 2349332 - protein, 12 aa, Cryptosporidium parvum
NDDSDDSDKSLS

SEQ ID NO: 2349333 - protein, 15 aa, Cryptosporidium parvum
NDDSGLDAQNSNSNT

SEQ ID NO: 2349334 - protein, 14 aa, Cryptosporidium parvum
NDEGVTSATGLTIS

SEQ ID NO: 2349335 - protein, 22 aa, Cryptosporidium parvum
NDELDELEEAKQQLKENSEKIT

SEQ ID NO: 2349336 - protein, 11 aa, Cryptosporidium parvum
NDENKKGDEML

SEQ ID NO: 2349337 - protein, 4 aa, Cryptosporidium parvum
NDES

SEQ ID NO: 2349338 - protein, 7 aa, Cryptosporidium parvum
NDGIDDD

SEQ ID NO: 2349339 - protein, 6 aa, Cryptosporidium parvum
NDGQQH

SEQ ID NO: 2349340 - protein, 8 aa, Cryptosporidium parvum
NDKNNTVT

SEQ ID NO: 2349341 - protein, 18 aa, Cryptosporidium parvum
NDKNTIDSKNLDKIEGKQ

SEQ ID NO: 2349342 - protein, 7 aa, Cryptosporidium parvum
NDKREEL

SEQ ID NO: 2349343 - protein, 11 aa, Cryptosporidium parvum
NDLEDPKKPFS

SEQ ID NO: 2349344 - protein, 7 aa, Cryptosporidium parvum
NDNFGEG

SEQ ID NO: 2349345 - protein, 7 aa, Cryptosporidium parvum
NDPDTKD

SEQ ID NO: 2349346 - protein, 9 aa, Cryptosporidium parvum
NDPNENDYH

SEQ ID NO: 2349347 - protein, 7 aa, Cryptosporidium parvum
NDQVTQQ

SEQ ID NO: 2349348 - protein, 13 aa, Cryptosporidium parvum
NDSEEKHQSSKKY

SEQ ID NO: 2349349 - protein, 8 aa, Cryptosporidium parvum
NDSRAQEC

SEQ ID NO: 2349350 - protein, 7 aa, Cryptosporidium parvum
NDSTDRL

SEQ ID NO: 2349351 - protein, 28 aa, Cryptosporidium parvum
NDTLTGKSGLNLERNSTVQNDEKNIGSK

SEQ ID NO: 2349352 - protein, 8 aa, Cryptosporidium parvum
NDTYPKFS

SEQ ID NO: 2349353 - protein, 11 aa, Cryptosporidium parvum
NDVDEDNKTPL

SEQ ID NO: 2349354 - protein, 4 aa, Cryptosporidium parvum
NECT

SEQ ID NO: 2349355 - protein, 6 aa, Cryptosporidium parvum
NEDDRT

SEQ ID NO: 2349356 - protein, 13 aa, Cryptosporidium parvum
NEDRNYDQSRNNC

SEQ ID NO: 2349357 - protein, 12 aa, Cryptosporidium parvum
NEDSLKEAYKSF

SEQ ID NO: 2349358 - protein, 5 aa, Cryptosporidium parvum
NEEAV

SEQ ID NO: 2349359 - protein, 5 aa, Cryptosporidium parvum
NEEEC

SEQ ID NO: 2349360 - protein, 8 aa, Cryptosporidium parvum
NEEELKEK

SEQ ID NO: 2349361 - protein, 8 aa, Cryptosporidium parvum
NEENNTVK

SEQ ID NO: 2349362 - protein, 12 aa, Cryptosporidium parvum
NEEQSMATNVDH

SEQ ID NO: 2349363 - protein, 8 aa, Cryptosporidium parvum
NEESRKLY

SEQ ID NO: 2349364 - protein, 54 aa, Cryptosporidium parvum; identical to SEQ ID NO: 2270755

SEQ ID NO: 2349365 - protein, 9 aa, Cryptosporidium parvum
NEGESSIPH

SEQ ID NO: 2349366 - protein, 12 aa, Cryptosporidium parvum
NEHDAALGNGGL

SEQ ID NO: 2349367 - protein, 4 aa, Cryptosporidium parvum
NEHP

SEQ ID NO: 2349368 - protein, 6 aa, Cryptosporidium parvum
NEISSP

SEQ ID NO: 2349369 - protein, 8 aa, Cryptosporidium parvum
NEKAPLSK

SEQ ID NO: 2349370 - protein, 5 aa, Cryptosporidium parvum
NEKLE

SEQ ID NO: 2349371 - protein, 5 aa, Cryptosporidium parvum
NEKNL

SEQ ID NO: 2349372 - protein, 7 aa, Cryptosporidium parvum
NEKRGKR

SEQ ID NO: 2349373 - protein, 23 aa, Cryptosporidium parvum
NEKSKKRAKNTKFKGNSKINNED

SEQ ID NO: 2349374 - protein, 11 aa, Cryptosporidium parvum
NEKTKAEVESL

SEQ ID NO: 2349375 - protein, 6 aa, Cryptosporidium parvum
NEKYEG

SEQ ID NO: 2349376 - protein, 11 aa, Cryptosporidium parvum
NELDKPSESVS

SEQ ID NO: 2349377 - protein, 31 aa, Cryptosporidium parvum; identical to SEQ ID NO: 2270854

SEQ ID NO: 2349378 - protein, 8 aa, Cryptosporidium parvum
NELNNSEI

SEQ ID NO: 2349379 - protein, 9 aa, Cryptosporidium parvum
NENEGGESL

SEQ ID NO: 2349380 - protein, 8 aa, Cryptosporidium parvum
NENKRPLT

SEQ ID NO: 2349381 - protein, 11 aa, Cryptosporidium parvum
NENNLEKKTNL

SEQ ID NO: 2349382 - protein, 7 aa, Cryptosporidium parvum
NENNSQY

SEQ ID NO: 2349383 - protein, 5 aa, Cryptosporidium parvum
NENTS

SEQ ID NO: 2349384 - protein, 14 aa, Cryptosporidium parvum
NEPKAEEDSKEEVK

SEQ ID NO: 2349385 - protein, 16 aa, Cryptosporidium parvum
NEQNPFLSGTGAAGTM

SEQ ID NO: 2349386 - protein, 10 aa, Cryptosporidium parvum
NERNISNLNN

SEQ ID NO: 2349387 - protein, 6 aa, Cryptosporidium parvum
NESETI

SEQ ID NO: 2349388 - protein, 11 aa, Cryptosporidium parvum
NESGTFPNQED

SEQ ID NO: 2349389 - protein, 7 aa, Cryptosporidium parvum
NESGYSN

SEQ ID NO: 2349390 - protein, 4 aa, Cryptosporidium parvum
NESI

SEQ ID NO: 2349391 - protein, 5 aa, Cryptosporidium parvum
NESIQ

SEQ ID NO: 2349392 - protein, 11 aa, Cryptosporidium parvum
NESLGNDISTQ

SEQ ID NO: 2349393 - protein, 9 aa, Cryptosporidium parvum
NESPKSLSF

SEQ ID NO: 2349394 - protein, 7 aa, Cryptosporidium parvum
NESSAAD

SEQ ID NO: 2349395 - protein, 10 aa, Cryptosporidium parvum
NETIEENTTN

SEQ ID NO: 2349396 - protein, 8 aa, Cryptosporidium parvum
NFEERDKQ

SEQ ID NO: 2349397 - protein, 10 aa, Cryptosporidium parvum
NFEPKKTMDA

SEQ ID NO: 2349398 - protein, 7 aa, Cryptosporidium parvum
NFEPTSK

SEQ ID NO: 2349399 - protein, 4 aa, Cryptosporidium parvum
NFET

SEQ ID NO: 2349400 - protein, 7 aa, Cryptosporidium parvum
NFPPLKS

SEQ ID NO: 2349401 - protein, 13 aa, Cryptosporidium parvum
NFSNRNNNNNLPD

SEQ ID NO: 2349402 - protein, 11 aa, Cryptosporidium parvum
NFTPKNNNGSG

SEQ ID NO: 2349403 - protein, 25 aa, Cryptosporidium parvum
NGADPRYKNKQGLTPKDAAESQGHS

SEQ ID NO: 2349404 - protein, 12 aa, Cryptosporidium parvum
NGAEEEESNISL

SEQ ID NO: 2349405 - protein, 8 aa, Cryptosporidium parvum
NGDDSGKV

SEQ ID NO: 2349406 - protein, 14 aa, Cryptosporidium parvum
NGDEKSQPKGKESI

SEQ ID NO: 2349407 - protein, 6 aa, Cryptosporidium parvum
NGDPLD

SEQ ID NO: 2349408 - protein, 10 aa, Cryptosporidium parvum
NGDQSVSRPY

SEQ ID NO: 2349409 - protein, 4 aa, Cryptosporidium parvum
NGDY

SEQ ID NO: 2349410 - protein, 7 aa, Cryptosporidium parvum
NGEDSNE

SEQ ID NO: 2349411 - protein, 5 aa, Cryptosporidium parvum
NGELP

SEQ ID NO: 2349412 - protein, 6 aa, Cryptosporidium parvum
NGIGKS

SEQ ID NO: 2349413 - protein, 9 aa, Cryptosporidium parvum
NGKRSQIER

SEQ ID NO: 2349414 - protein, 8 aa, Cryptosporidium parvum
NGKSIENQ

SEQ ID NO: 2349415 - protein, 5 aa, Cryptosporidium parvum
NGLQR

SEQ ID NO: 2349416 - protein, 10 aa, Cryptosporidium parvum
NGMTSSNSNF

SEQ ID NO: 2349417 - protein, 7 aa, Cryptosporidium parvum
NGNANKN

SEQ ID NO: 2349418 - protein, 6 aa, Cryptosporidium parvum
NGNKRL

SEQ ID NO: 2349419 - protein, 12 aa, Cryptosporidium parvum
NGNKSSRSQREH

SEQ ID NO: 2349420 - protein, 9 aa, Cryptosporidium parvum
NGNNNITDS

SEQ ID NO: 2349421 - protein, 7 aa, Cryptosporidium parvum
NGNRYEG

SEQ ID NO: 2349422 - protein, 13 aa, Cryptosporidium parvum
NGNSGGTGNENYT

SEQ ID NO: 2349423 - protein, 9 aa, Cryptosporidium parvum
NGRPEKAPD

SEQ ID NO: 2349424 - protein, 11 aa, Cryptosporidium parvum
NGRPTENENLE

SEQ ID NO: 2349425 - protein, 7 aa, Cryptosporidium parvum
NGRSTQV

SEQ ID NO: 2349426 - protein, 13 aa, Cryptosporidium parvum
NGSLSENGLVSSK

SEQ ID NO: 2349427 - protein, 24 aa, Cryptosporidium parvum
NGSQSGGKGDSEKIINTGSTNTNS

SEQ ID NO: 2349428 - protein, 5 aa, Cryptosporidium parvum
NGSVG

SEQ ID NO: 2349429 - protein, 7 aa, Cryptosporidium parvum
NGTRKTC

SEQ ID NO: 2349430 - protein, 14 aa, Cryptosporidium parvum
NGVATAISSANQHK

SEQ ID NO: 2349431 - protein, 5 aa, Cryptosporidium parvum
NGVEN

SEQ ID NO: 2349432 - protein, 5 aa, Cryptosporidium parvum
NGVSW

SEQ ID NO: 2349433 - protein, 11 aa, Cryptosporidium parvum
NHDESAMQNQH

SEQ ID NO: 2349434 - protein, 5 aa, Cryptosporidium parvum
NHDYE

SEQ ID NO: 2349435 - protein, 20 aa, Cryptosporidium parvum
NHESNSKTTNNLDSTGSSTL

SEQ ID NO: 2349436 - protein, 5 aa, Cryptosporidium parvum
NHFAK

SEQ ID NO: 2349437 - protein, 7 aa, Cryptosporidium parvum
NHFPEEG

SEQ ID NO: 2349438 - protein, 7 aa, Cryptosporidium parvum
NHGKEEM

SEQ ID NO: 2349439 - protein, 10 aa, Cryptosporidium parvum
NHGSSSDENL

SEQ ID NO: 2349440 - protein, 13 aa, Cryptosporidium parvum
NHLTDSNKNAKNF

SEQ ID NO: 2349441 - protein, 5 aa, Cryptosporidium parvum
NHLYG

SEQ ID NO: 2349442 - protein, 7 aa, Cryptosporidium parvum
NHNASSQ

SEQ ID NO: 2349443 - protein, 30 aa, Cryptosporidium parvum; identical to SEQ ID NO: 2152984

SEQ ID NO: 2349444 - protein, 7 aa, Cryptosporidium parvum
NHSSQEI

SEQ ID NO: 2349445 - protein, 22 aa, Cryptosporidium parvum
NHSSTNKKRSKDHTENSEYSEN

SEQ ID NO: 2349446 - protein, 8 aa, Cryptosporidium parvum
NHTKKKPL

SEQ ID NO: 2349447 - protein, 14 aa, Cryptosporidium parvum
NIAGSSNSVPGSNN

SEQ ID NO: 2349448 - protein, 6 aa, Cryptosporidium parvum
NIDDDQ

SEQ ID NO: 2349449 - protein, 23 aa, Cryptosporidium parvum
NIDDTKTYLSNDEKFKPPNLSDN

SEQ ID NO: 2349450 - protein, 15 aa, Cryptosporidium parvum
NIDGSNNNSSSSSSL

SEQ ID NO: 2349451 - protein, 5 aa, Cryptosporidium parvum
NIDQR

SEQ ID NO: 2349452 - protein, 7 aa, Cryptosporidium parvum
NIDSSNN

SEQ ID NO: 2349453 - protein, 12 aa, Cryptosporidium parvum
NIEAGNKSAPIT

SEQ ID NO: 2349454 - protein, 57 aa, Cryptosporidium parvum
NIEEDIKAKNASKNEEIKVQQNSDTNSINNVDSSSAVDERKFKRSRSRESDDNLNGS

SEQ ID NO: 2349455 - protein, 6 aa, Cryptosporidium parvum
NIEGDG

SEQ ID NO: 2349456 - protein, 17 aa, Cryptosporidium parvum
NIENKIKKNDEISNVPE

SEQ ID NO: 2349457 - protein, 10 aa, Cryptosporidium parvum
NIGGGTGQDI

SEQ ID NO: 2349458 - protein, 12 aa, Cryptosporidium parvum
NIGRNSKSSYDG

SEQ ID NO: 2349459 - protein, 37 aa, Cryptosporidium parvum; identical to SEQ ID NO: 2271428

SEQ ID NO: 2349460 - protein, 8 aa, Cryptosporidium parvum
NIGSPLPE

SEQ ID NO: 2349461 - protein, 6 aa, Cryptosporidium parvum
NIGTQT

SEQ ID NO: 2349462 - protein, 10 aa, Cryptosporidium parvum
NIKDSDIKEI

SEQ ID NO: 2349463 - protein, 7 aa, Cryptosporidium parvum
NIKEKGE

SEQ ID NO: 2349464 - protein, 12 aa, Cryptosporidium parvum
NIKGKGRTSGSI

SEQ ID NO: 2349465 - protein, 4 aa, Cryptosporidium parvum
NIKN

SEQ ID NO: 2349466 - protein, 4 aa, Cryptosporidium parvum
NINI

SEQ ID NO: 2349467 - protein, 84 aa, Cryptosporidium parvum; identical to SEQ ID NO: 2271486

SEQ ID NO: 2349468 - protein, 7 aa, Cryptosporidium parvum
NIPKGGK

SEQ ID NO: 2349469 - protein, 6 aa, Cryptosporidium parvum
NIPPNY

SEQ ID NO: 2349470 - protein, 8 aa, Cryptosporidium parvum
NIPPPPYN

SEQ ID NO: 2349471 - protein, 5 aa, Cryptosporidium parvum
NIPQN

SEQ ID NO: 2349472 - protein, 4 aa, Cryptosporidium parvum
NIPS

SEQ ID NO: 2349473 - protein, 10 aa, Cryptosporidium parvum
NIPSENNSAL

SEQ ID NO: 2349474 - protein, 4 aa, Cryptosporidium parvum
NIPT

SEQ ID NO: 2349475 - protein, 10 aa, Cryptosporidium parvum
NIQKDPEKEM

SEQ ID NO: 2349476 - protein, 13 aa, Cryptosporidium parvum
NISKNKEYSEEST

SEQ ID NO: 2349477 - protein, 8 aa, Cryptosporidium parvum
NISPSSEI

SEQ ID NO: 2349478 - protein, 8 aa, Cryptosporidium parvum
NISSGNNV

SEQ ID NO: 2349479 - protein, 10 aa, Cryptosporidium parvum
NISSKKDFGT

SEQ ID NO: 2349480 - protein, 42 aa, Cryptosporidium parvum; identical to SEQ ID NO: 2153140

SEQ ID NO: 2349481 - protein, 5 aa, Cryptosporidium parvum
NISTQ

SEQ ID NO: 2349482 - protein, 5 aa, Cryptosporidium parvum
NITEE

SEQ ID NO: 2349483 - protein, 17 aa, Cryptosporidium parvum
NITNNNSTSNVAGNINN

SEQ ID NO: 2349484 - protein, 4 aa, Cryptosporidium parvum
NIVG

SEQ ID NO: 2349485 - protein, 19 aa, Cryptosporidium parvum
NKAAENKQNLEKQKAANGL

SEQ ID NO: 2349486 - protein, 12 aa, Cryptosporidium parvum
NKAEKSKKKCDN

SEQ ID NO: 2349487 - protein, 35 aa, Cryptosporidium parvum
NKANEKTFTEDKDELVGNTDKNELEDTQDDSTKIL

SEQ ID NO: 2349488 - protein, 8 aa, Cryptosporidium parvum
NKATGAGF

SEQ ID NO: 2349489 - protein, 10 aa, Cryptosporidium parvum
NKDHETQTNQ

SEQ ID NO: 2349490 - protein, 6 aa, Cryptosporidium parvum
NKDLGV

SEQ ID NO: 2349491 - protein, 8 aa, Cryptosporidium parvum
NKDQLSHY

SEQ ID NO: 2349492 - protein, 7 aa, Cryptosporidium parvum
NKDSELN

SEQ ID NO: 2349493 - protein, 28 aa, Cryptosporidium parvum
NKDTQITTGSENGKTVGNIASPATINGS

SEQ ID NO: 2349494 - protein, 9 aa, Cryptosporidium parvum
NKEESRYQV

SEQ ID NO: 2349495 - protein, 4 aa, Cryptosporidium parvum
NKET

SEQ ID NO: 2349496 - protein, 5 aa, Cryptosporidium parvum
NKETV

SEQ ID NO: 2349497 - protein, 9 aa, Cryptosporidium parvum
NKGQESPLE

SEQ ID NO: 2349498 - protein, 27 aa, Cryptosporidium parvum
NKGTETNPSNLEETNHNNSNVSVSRNS

SEQ ID NO: 2349499 - protein, 8 aa, Cryptosporidium parvum
NKHASPTN

SEQ ID NO: 2349500 - protein, 21 aa, Cryptosporidium parvum
NKIASEKAERLESRRKLLSKN

SEQ ID NO: 2349501 - protein, 4 aa, Cryptosporidium parvum
NKIE

SEQ ID NO: 2349502 - protein, 10 aa, Cryptosporidium parvum
NKIKSASNNE

SEQ ID NO: 2349503 - protein, 11 aa, Cryptosporidium parvum
NKINSKTKYNR

SEQ ID NO: 2349504 - protein, 6 aa, Cryptosporidium parvum
NKIQDK

SEQ ID NO: 2349505 - protein, 12 aa, Cryptosporidium parvum
NKITNNTGKRMA

SEQ ID NO: 2349506 - protein, 6 aa, Cryptosporidium parvum
NKKCRN

SEQ ID NO: 2349507 - protein, 11 aa, Cryptosporidium parvum
NKKGGEPNKYS

SEQ ID NO: 2349508 - protein, 9 aa, Cryptosporidium parvum
NKKKTESLT

SEQ ID NO: 2349509 - protein, 9 aa, Cryptosporidium parvum
NKKQTSEVI

SEQ ID NO: 2349510 - protein, 6 aa, Cryptosporidium parvum
NKKSID

SEQ ID NO: 2349511 - protein, 11 aa, Cryptosporidium parvum
NKKSTPTKMPT

SEQ ID NO: 2349512 - protein, 7 aa, Cryptosporidium parvum
NKNAELP

SEQ ID NO: 2349513 - protein, 7 aa, Cryptosporidium parvum
NKNEVSY

SEQ ID NO: 2349514 - protein, 6 aa, Cryptosporidium parvum
NKNGTL

SEQ ID NO: 2349515 - protein, 12 aa, Cryptosporidium parvum
NKNKDRIELETK

SEQ ID NO: 2349516 - protein, 26 aa, Cryptosporidium parvum
NKNKSKGDRDSNKMEFDTDSDDDFDE

SEQ ID NO: 2349517 - protein, 10 aa, Cryptosporidium parvum
NKNKTDSEEF

SEQ ID NO: 2349518 - protein, 7 aa, Cryptosporidium parvum
NKNKVEQ

SEQ ID NO: 2349519 - protein, 18 aa, Cryptosporidium parvum
NKNRTASKNKLRNSRSNR

SEQ ID NO: 2349520 - protein, 7 aa, Cryptosporidium parvum
NKPIYSE

SEQ ID NO: 2349521 - protein, 5 aa, Cryptosporidium parvum
NKQDY

SEQ ID NO: 2349522 - protein, 19 aa, Cryptosporidium parvum
NKQNSKDHINSKDTNSTEF

SEQ ID NO: 2349523 - protein, 7 aa, Cryptosporidium parvum
NKRENEI

SEQ ID NO: 2349524 - protein, 7 aa, Cryptosporidium parvum
NKRERTS

SEQ ID NO: 2349525 - protein, 10 aa, Cryptosporidium parvum
NKRFSEGSLQ

SEQ ID NO: 2349526 - protein, 9 aa, Cryptosporidium parvum
NKRLPRRSN

SEQ ID NO: 2349527 - protein, 7 aa, Cryptosporidium parvum
NKRNSFK

SEQ ID NO: 2349528 - protein, 7 aa, Cryptosporidium parvum
NKSGKIG

SEQ ID NO: 2349529 - protein, 23 aa, Cryptosporidium parvum
NKSKKKSLGNESTSTLNDDIEND

SEQ ID NO: 2349530 - protein, 24 aa, Cryptosporidium parvum
NKSKLNKCQTDQIEAGNRGMGARK

SEQ ID NO: 2349531 - protein, 20 aa, Cryptosporidium parvum
NKSKTNLVPNKESHKGNEMP

SEQ ID NO: 2349532 - protein, 10 aa, Cryptosporidium parvum
NKSLEEQNTV

SEQ ID NO: 2349533 - protein, 15 aa, Cryptosporidium parvum
NKSNSRSSAKDKGSL

SEQ ID NO: 2349534 - protein, 9 aa, Cryptosporidium parvum
NKSQEGNQF

SEQ ID NO: 2349535 - protein, 6 aa, Cryptosporidium parvum
NKSSNP

SEQ ID NO: 2349536 - protein, 7 aa, Cryptosporidium parvum
NKSSSRS

SEQ ID NO: 2349537 - protein, 5 aa, Cryptosporidium parvum
NKTDL

SEQ ID NO: 2349538 - protein, 6 aa, Cryptosporidium parvum
NKTIQN

SEQ ID NO: 2349539 - protein, 7 aa, Cryptosporidium parvum
NKTLQNT

SEQ ID NO: 2349540 - protein, 9 aa, Cryptosporidium parvum
NKTNQDNIE

SEQ ID NO: 2349541 - protein, 7 aa, Cryptosporidium parvum
NKTPKLS

SEQ ID NO: 2349542 - protein, 29 aa, Cryptosporidium parvum
NKTTSLDDDFASTSTPSDSTNSDPEKTPY

SEQ ID NO: 2349543 - protein, 12 aa, Cryptosporidium parvum
NKVNNRSRRSIS

SEQ ID NO: 2349544 - protein, 26 aa, Cryptosporidium parvum
NKVTDTMKSAQKSNERAGPMGEKDPI

SEQ ID NO: 2349545 - protein, 13 aa, Cryptosporidium parvum
NLDEIEDGTKIQE

SEQ ID NO: 2349546 - protein, 7 aa, Cryptosporidium parvum
NLDGFQD

SEQ ID NO: 2349547 - protein, 13 aa, Cryptosporidium parvum
NLEDTSGKAVSSK

SEQ ID NO: 2349548 - protein, 11 aa, Cryptosporidium parvum
NLEEENDEEFE

SEQ ID NO: 2349549 - protein, 13 aa, Cryptosporidium parvum
NLENNKEKLNEDK

SEQ ID NO: 2349550 - protein, 5 aa, Cryptosporidium parvum
NLEPE

SEQ ID NO: 2349551 - protein, 4 aa, Cryptosporidium parvum
NLHP

SEQ ID NO: 2349552 - protein, 5 aa, Cryptosporidium parvum
NLKKG

SEQ ID NO: 2349553 - protein, 15 aa, Cryptosporidium parvum
NLNGNNNSNSNIGSG

SEQ ID NO: 2349554 - protein, 25 aa, Cryptosporidium parvum
NLNSSSNMSFTGGSTASQTTLQTPG

SEQ ID NO: 2349555 - protein, 16 aa, Cryptosporidium parvum
NLPENPVYSSEQGTER

SEQ ID NO: 2349556 - protein, 21 aa, Cryptosporidium parvum
NLSGSGGSTQNVTAVGPSVSC

SEQ ID NO: 2349557 - protein, 40 aa, Cryptosporidium parvum; identical to SEQ ID NO: 2272144

SEQ ID NO: 2349558 - protein, 16 aa, Cryptosporidium parvum
NLSKDGRYSELSNRST

SEQ ID NO: 2349559 - protein, 4 aa, Cryptosporidium parvum
NLTK

SEQ ID NO: 2349560 - protein, 6 aa, Cryptosporidium parvum
NLTSPI

SEQ ID NO: 2349561 - protein, 12 aa, Cryptosporidium parvum
NMGEPIDLFFAI

SEQ ID NO: 2349562 - protein, 9 aa, Cryptosporidium parvum
NMSKGRDQR

SEQ ID NO: 2349563 - protein, 9 aa, Cryptosporidium parvum
NNAGDSSYL

SEQ ID NO: 2349564 - protein, 7 aa, Cryptosporidium parvum
NNAISNP

SEQ ID NO: 2349565 - protein, 7 aa, Cryptosporidium parvum
NNAKENL

SEQ ID NO: 2349566 - protein, 8 aa, Cryptosporidium parvum
NNASPLEV

SEQ ID NO: 2349567 - protein, 27 aa, Cryptosporidium parvum
NNATNNNDSTDLGEKYSDERVPDPTLT

SEQ ID NO: 2349568 - protein, 15 aa, Cryptosporidium parvum
NNATNTLDNKSENEL

SEQ ID NO: 2349569 - protein, 6 aa, Cryptosporidium parvum
NNCENG

SEQ ID NO: 2349570 - protein, 8 aa, Cryptosporidium parvum
NNDHGNDQ

SEQ ID NO: 2349571 - protein, 9 aa, Cryptosporidium parvum
NNDQSNTNF

SEQ ID NO: 2349572 - protein, 5 aa, Cryptosporidium parvum
NNDYL

SEQ ID NO: 2349573 - protein, 4 aa, Cryptosporidium parvum
NNEN

SEQ ID NO: 2349574 - protein, 5 aa, Cryptosporidium parvum
NNENK

SEQ ID NO: 2349575 - protein, 9 aa, Cryptosporidium parvum
NNEPHTTNT

SEQ ID NO: 2349576 - protein, 12 aa, Cryptosporidium parvum
NNFGTSIERNKK

SEQ ID NO: 2349577 - protein, 17 aa, Cryptosporidium parvum
NNGGTDGMRNESSTPRF

SEQ ID NO: 2349578 - protein, 18 aa, Cryptosporidium parvum
NNGINTGAPGSNNNPIII

SEQ ID NO: 2349579 - protein, 8 aa, Cryptosporidium parvum
NNGNQYQE

SEQ ID NO: 2349580 - protein, 33 aa, Cryptosporidium parvum; identical to SEQ ID NO: 2153747

SEQ ID NO: 2349581 - protein, 4 aa, Cryptosporidium parvum
NNHD

SEQ ID NO: 2349582 - protein, 12 aa, Cryptosporidium parvum
NNIDSSANTQNV

SEQ ID NO: 2349583 - protein, 6 aa, Cryptosporidium parvum
NNISDE

SEQ ID NO: 2349584 - protein, 10 aa, Cryptosporidium parvum
NNKDTPKGWK

SEQ ID NO: 2349585 - protein, 9 aa, Cryptosporidium parvum
NNKGPISNT

SEQ ID NO: 2349586 - protein, 28 aa, Cryptosporidium parvum
NNKPNDQTVTQTPGQNLEQSSGSNIFGS

SEQ ID NO: 2349587 - protein, 12 aa, Cryptosporidium parvum
NNKRHHNNEFDG

SEQ ID NO: 2349588 - protein, 10 aa, Cryptosporidium parvum
NNNDSDWSLS

SEQ ID NO: 2349589 - protein, 4 aa, Cryptosporidium parvum
NNNE

SEQ ID NO: 2349590 - protein, 10 aa, Cryptosporidium parvum
NNNELSPDSL

SEQ ID NO: 2349591 - protein, 10 aa, Cryptosporidium parvum
NNNGDHEGIN

SEQ ID NO: 2349592 - protein, 6 aa, Cryptosporidium parvum
NNNLTS

SEQ ID NO: 2349593 - protein, 16 aa, Cryptosporidium parvum
NNNNKTNGISQSSNSR

SEQ ID NO: 2349594 - protein, 8 aa, Cryptosporidium parvum
NNNNLGEG

SEQ ID NO: 2349595 - protein, 54 aa, Cryptosporidium parvum; identical to SEQ ID NO: 2272515

SEQ ID NO: 2349596 - protein, 12 aa, Cryptosporidium parvum
NNNRTQENHDNS

SEQ ID NO: 2349597 - protein, 9 aa, Cryptosporidium parvum
NNNSNSKVQ

SEQ ID NO: 2349598 - protein, 9 aa, Cryptosporidium parvum
NNNSSKLDG

SEQ ID NO: 2349599 - protein, 5 aa, Cryptosporidium parvum
NNPAS

SEQ ID NO: 2349600 - protein, 6 aa, Cryptosporidium parvum
NNPDRA

SEQ ID NO: 2349601 - protein, 6 aa, Cryptosporidium parvum
NNPNSP

SEQ ID NO: 2349602 - protein, 11 aa, Cryptosporidium parvum
NNQMEDTNEHE

SEQ ID NO: 2349603 - protein, 9 aa, Cryptosporidium parvum
NNQSTIPEN

SEQ ID NO: 2349604 - protein, 5 aa, Cryptosporidium parvum
NNRDS

SEQ ID NO: 2349605 - protein, 7 aa, Cryptosporidium parvum
NNRKFSR

SEQ ID NO: 2349606 - protein, 8 aa, Cryptosporidium parvum
NNRKPIPG

SEQ ID NO: 2349607 - protein, 16 aa, Cryptosporidium parvum
NNRRKSSISGGRTASA

SEQ ID NO: 2349608 - protein, 11 aa, Cryptosporidium parvum
NNSANKAKKSI

SEQ ID NO: 2349609 - protein, 8 aa, Cryptosporidium parvum
NNSDKKAL

SEQ ID NO: 2349610 - protein, 8 aa, Cryptosporidium parvum
NNSESFEM

SEQ ID NO: 2349611 - protein, 11 aa, Cryptosporidium parvum
NNSKENDTSTL

SEQ ID NO: 2349612 - protein, 12 aa, Cryptosporidium parvum
NNSKGNLDNGQV

SEQ ID NO: 2349613 - protein, 12 aa, Cryptosporidium parvum
NNSKLIEVEKWK

SEQ ID NO: 2349614 - protein, 11 aa, Cryptosporidium parvum
NNSKSGGYDSL

SEQ ID NO: 2349615 - protein, 5 aa, Cryptosporidium parvum
NNSLS

SEQ ID NO: 2349616 - protein, 9 aa, Cryptosporidium parvum
NNSNNNQRV

SEQ ID NO: 2349617 - protein, 22 aa, Cryptosporidium parvum
NNSNNNTTNNLNSGSNTSISAG

SEQ ID NO: 2349618 - protein, 29 aa, Cryptosporidium parvum
NNSSISGGIQYQSPKNTIPTQPPNNLQPV

SEQ ID NO: 2349619 - protein, 13 aa, Cryptosporidium parvum
NNSSPRNQTSSFQ

SEQ ID NO: 2349620 - protein, 23 aa, Cryptosporidium parvum
NNSSYTNLNSPSPSPSPSPSPSI

SEQ ID NO: 2349621 - protein, 17 aa, Cryptosporidium parvum
NNSTTIGNENYKGELEN

SEQ ID NO: 2349622 - protein, 7 aa, Cryptosporidium parvum
NNTDIGT

SEQ ID NO: 2349623 - protein, 9 aa, Cryptosporidium parvum
NNTERNMNE

SEQ ID NO: 2349624 - protein, 11 aa, Cryptosporidium parvum
NNTNNIKNDEV

SEQ ID NO: 2349625 - protein, 5 aa, Cryptosporidium parvum
NNVKS

SEQ ID NO: 2349626 - protein, 5 aa, Cryptosporidium parvum
NNYKN

SEQ ID NO: 2349627 - protein, 23 aa, Cryptosporidium parvum
NNYKTNNAIEPSTCETNQDNEYI

SEQ ID NO: 2349628 - protein, 4 aa, Cryptosporidium parvum
NNYN

SEQ ID NO: 2349629 - protein, 21 aa, Cryptosporidium parvum
NNYSSDPRQNPQYPNFAPSTF

SEQ ID NO: 2349630 - protein, 4 aa, Cryptosporidium parvum
NPAV

SEQ ID NO: 2349631 - protein, 5 aa, Cryptosporidium parvum
NPDKG

SEQ ID NO: 2349632 - protein, 5 aa, Cryptosporidium parvum
NPDLA

SEQ ID NO: 2349633 - protein, 17 aa, Cryptosporidium parvum
NPELDNSNTQKKLQSEE

SEQ ID NO: 2349634 - protein, 16 aa, Cryptosporidium parvum
NPENSSKELKNDEDSI

SEQ ID NO: 2349635 - protein, 24 aa, Cryptosporidium parvum
NPGNLNVNGTTNQIQTSSAPMSTP

SEQ ID NO: 2349636 - protein, 5 aa, Cryptosporidium parvum
NPIPG

SEQ ID NO: 2349637 - protein, 10 aa, Cryptosporidium parvum
NPKPKKYDTT

SEQ ID NO: 2349638 - protein, 6 aa, Cryptosporidium parvum
NPLGYP

SEQ ID NO: 2349639 - protein, 6 aa, Cryptosporidium parvum
NPLSRS

SEQ ID NO: 2349640 - protein, 6 aa, Cryptosporidium parvum
NPMFSS

SEQ ID NO: 2349641 - protein, 4 aa, Cryptosporidium parvum
NPNS

SEQ ID NO: 2349642 - protein, 6 aa, Cryptosporidium parvum
NPNVAA

SEQ ID NO: 2349643 - protein, 8 aa, Cryptosporidium parvum
NPPSNDTE

SEQ ID NO: 2349644 - protein, 18 aa, Cryptosporidium parvum
NPRNVGSLPSDDKNVGTA

SEQ ID NO: 2349645 - protein, 8 aa, Cryptosporidium parvum
NPSDITSK

SEQ ID NO: 2349646 - protein, 44 aa, Cryptosporidium parvum
NPSNAKKTNKTGKKNKKKSKPNKKPNLNESNNDNLNSGLNENNN

SEQ ID NO: 2349647 - protein, 16 aa, Cryptosporidium parvum
NPSQGTPPLPKDGLSS

SEQ ID NO: 2349648 - protein, 7 aa, Cryptosporidium parvum
NPSTGEE

SEQ ID NO: 2349649 - protein, 6 aa, Cryptosporidium parvum
NPTKGM

SEQ ID NO: 2349650 - protein, 8 aa, Cryptosporidium parvum
NPTTNSYK

SEQ ID NO: 2349651 - protein, 7 aa, Cryptosporidium parvum
NPVASRQ

SEQ ID NO: 2349652 - protein, 4 aa, Cryptosporidium parvum
NPVR

SEQ ID NO: 2349653 - protein, 11 aa, Cryptosporidium parvum
NPWRPNPTRMP

SEQ ID NO: 2349654 - protein, 4 aa, Cryptosporidium parvum
NPYT

SEQ ID NO: 2349655 - protein, 6 aa, Cryptosporidium parvum
NQDNED

SEQ ID NO: 2349656 - protein, 6 aa, Cryptosporidium parvum
NQDRPR

SEQ ID NO: 2349657 - protein, 8 aa, Cryptosporidium parvum
NQEDDESF

SEQ ID NO: 2349658 - protein, 5 aa, Cryptosporidium parvum
NQEPA

SEQ ID NO: 2349659 - protein, 6 aa, Cryptosporidium parvum
NQFNSG

SEQ ID NO: 2349660 - protein, 13 aa, Cryptosporidium parvum
NQGAGVSSEYSDC

SEQ ID NO: 2349661 - protein, 6 aa, Cryptosporidium parvum
NQGDEN

SEQ ID NO: 2349662 - protein, 8 aa, Cryptosporidium parvum
NQIDPDRQ

SEQ ID NO: 2349663 - protein, 8 aa, Cryptosporidium parvum
NQKDPCGN

SEQ ID NO: 2349664 - protein, 10 aa, Cryptosporidium parvum
NQKSGSPISV

SEQ ID NO: 2349665 - protein, 12 aa, Cryptosporidium parvum
NQKTKSSEIGTT

SEQ ID NO: 2349666 - protein, 7 aa, Cryptosporidium parvum
NQKTPDY

SEQ ID NO: 2349667 - protein, 13 aa, Cryptosporidium parvum
NQKTQQEWNSGYS

SEQ ID NO: 2349668 - protein, 7 aa, Cryptosporidium parvum
NQKYPEY

SEQ ID NO: 2349669 - protein, 5 aa, Cryptosporidium parvum
NQLTD

SEQ ID NO: 2349670 - protein, 4 aa, Cryptosporidium parvum
NQNE

SEQ ID NO: 2349671 - protein, 4 aa, Cryptosporidium parvum
NQNL

SEQ ID NO: 2349672 - protein, 7 aa, Cryptosporidium parvum
NQNLESN

SEQ ID NO: 2349673 - protein, 13 aa, Cryptosporidium parvum
NQNSKLNIDNENG

SEQ ID NO: 2349674 - protein, 8 aa, Cryptosporidium parvum
NQQDKELS

SEQ ID NO: 2349675 - protein, 39 aa, Cryptosporidium parvum; identical to SEQ ID NO: 2273163

SEQ ID NO: 2349676 - protein, 8 aa, Cryptosporidium parvum
NQQSVTSK

SEQ ID NO: 2349677 - protein, 13 aa, Cryptosporidium parvum
NQRHPSPNKLYTG

SEQ ID NO: 2349678 - protein, 5 aa, Cryptosporidium parvum
NQSAH

SEQ ID NO: 2349679 - protein, 13 aa, Cryptosporidium parvum
NQSDIKRKPNYMR

SEQ ID NO: 2349680 - protein, 9 aa, Cryptosporidium parvum
NQSIGTNSK

SEQ ID NO: 2349681 - protein, 13 aa, Cryptosporidium parvum
NQSNKYGDDGYCS

SEQ ID NO: 2349682 - protein, 12 aa, Cryptosporidium parvum
NQSNYNSNWKQT

SEQ ID NO: 2349683 - protein, 4 aa, Cryptosporidium parvum
NQTR

SEQ ID NO: 2349684 - protein, 7 aa, Cryptosporidium parvum
NQVNSQV

SEQ ID NO: 2349685 - protein, 10 aa, Cryptosporidium parvum
NRAREGNYPI

SEQ ID NO: 2349686 - protein, 8 aa, Cryptosporidium parvum
NRCNSQGK

SEQ ID NO: 2349687 - protein, 4 aa, Cryptosporidium parvum
NRDE

SEQ ID NO: 2349688 - protein, 4 aa, Cryptosporidium parvum
NRDR

SEQ ID NO: 2349689 - protein, 14 aa, Cryptosporidium parvum
NRIANTGSSPNISL

SEQ ID NO: 2349690 - protein, 5 aa, Cryptosporidium parvum
NRISN

SEQ ID NO: 2349691 - protein, 4 aa, Cryptosporidium parvum
NRLS

SEQ ID NO: 2349692 - protein, 14 aa, Cryptosporidium parvum
NRLTKDRLKGNEEL

SEQ ID NO: 2349693 - protein, 4 aa, Cryptosporidium parvum
NRNK

SEQ ID NO: 2349694 - protein, 9 aa, Cryptosporidium parvum
NRNNSGTPK

SEQ ID NO: 2349695 - protein, 5 aa, Cryptosporidium parvum
NRNSP

SEQ ID NO: 2349696 - protein, 7 aa, Cryptosporidium parvum
NRPDTLD

SEQ ID NO: 2349697 - protein, 8 aa, Cryptosporidium parvum
NRPKYYNS

SEQ ID NO: 2349698 - protein, 6 aa, Cryptosporidium parvum
NRPNKL

SEQ ID NO: 2349699 - protein, 7 aa, Cryptosporidium parvum
NRQGVPI

SEQ ID NO: 2349700 - protein, 9 aa, Cryptosporidium parvum
NRQNTTSSV

SEQ ID NO: 2349701 - protein, 9 aa, Cryptosporidium parvum
NRQSTTKVS

SEQ ID NO: 2349702 - protein, 9 aa, Cryptosporidium parvum
NRRGGPDDA

SEQ ID NO: 2349703 - protein, 9 aa, Cryptosporidium parvum
NRRKELTKK

SEQ ID NO: 2349704 - protein, 7 aa, Cryptosporidium parvum
NRSEDEA

SEQ ID NO: 2349705 - protein, 6 aa, Cryptosporidium parvum
NRSKKI

SEQ ID NO: 2349706 - protein, 6 aa, Cryptosporidium parvum
NRTPQN

SEQ ID NO: 2349707 - protein, 38 aa, Cryptosporidium parvum
NRTRDEIYESSKRSSCDSSSKKKLIKPSRKSISKENAA

SEQ ID NO: 2349708 - protein, 14 aa, Cryptosporidium parvum
NRYSTSASSNISSQ

SEQ ID NO: 2349709 - protein, 15 aa, Cryptosporidium parvum
NSANKSGNKSKKRNV

SEQ ID NO: 2349710 - protein, 7 aa, Cryptosporidium parvum
NSCNDTE

SEQ ID NO: 2349711 - protein, 9 aa, Cryptosporidium parvum
NSDGSKRLN

SEQ ID NO: 2349712 - protein, 10 aa, Cryptosporidium parvum
NSDKDSKITS

SEQ ID NO: 2349713 - protein, 10 aa, Cryptosporidium parvum
NSDLDGDLTS

SEQ ID NO: 2349714 - protein, 12 aa, Cryptosporidium parvum
NSDQNRNDSNGL

SEQ ID NO: 2349715 - protein, 33 aa, Cryptosporidium parvum; identical to SEQ ID NO: 2273418

SEQ ID NO: 2349716 - protein, 12 aa, Cryptosporidium parvum
NSDSQNKNDQAV

SEQ ID NO: 2349717 - protein, 12 aa, Cryptosporidium parvum
NSDYSSGNDGYG

SEQ ID NO: 2349718 - protein, 4 aa, Cryptosporidium parvum
NSEI

SEQ ID NO: 2349719 - protein, 11 aa, Cryptosporidium parvum
NSEKLSNHDLP

SEQ ID NO: 2349720 - protein, 57 aa, Cryptosporidium parvum
NSEKPIKNKNTIKKITKAKDSVKQSVTKKETKNTQIKNTPAKKTTALSKSKVSSIPS

SEQ ID NO: 2349721 - protein, 8 aa, Cryptosporidium parvum
NSESKIPI

SEQ ID NO: 2349722 - protein, 5 aa, Cryptosporidium parvum
NSETV

SEQ ID NO: 2349723 - protein, 18 aa, Cryptosporidium parvum
NSFDISPSSEQNHVESPS

SEQ ID NO: 2349724 - protein, 11 aa, Cryptosporidium parvum
NSFKSGKDIQK

SEQ ID NO: 2349725 - protein, 7 aa, Cryptosporidium parvum
NSFNESN

SEQ ID NO: 2349726 - protein, 6 aa, Cryptosporidium parvum
NSGYSD

SEQ ID NO: 2349727 - protein, 4 aa, Cryptosporidium parvum
NSHI

SEQ ID NO: 2349728 - protein, 15 aa, Cryptosporidium parvum
NSIEEAVKSNSRDAS

SEQ ID NO: 2349729 - protein, 6 aa, Cryptosporidium parvum
NSIEYG

SEQ ID NO: 2349730 - protein, 4 aa, Cryptosporidium parvum
NSIK

SEQ ID NO: 2349731 - protein, 8 aa, Cryptosporidium parvum
NSIRGQSN

SEQ ID NO: 2349732 - protein, 8 aa, Cryptosporidium parvum
NSITPETS

SEQ ID NO: 2349733 - protein, 8 aa, Cryptosporidium parvum
NSKDDAQR

SEQ ID NO: 2349734 - protein, 12 aa, Cryptosporidium parvum
NSKIKDKKTNFD

SEQ ID NO: 2349735 - protein, 16 aa, Cryptosporidium parvum
NSKKENSQANVPREDI

SEQ ID NO: 2349736 - protein, 5 aa, Cryptosporidium parvum
NSKLN

SEQ ID NO: 2349737 - protein, 15 aa, Cryptosporidium parvum
NSKLTKNPTGSNDER

SEQ ID NO: 2349738 - protein, 10 aa, Cryptosporidium parvum
NSKQSSSDIN

SEQ ID NO: 2349739 - protein, 8 aa, Cryptosporidium parvum
NSKRASKV

SEQ ID NO: 2349740 - protein, 9 aa, Cryptosporidium parvum
NSKTRSNLQ

SEQ ID NO: 2349741 - protein, 13 aa, Cryptosporidium parvum
NSKVSNSHDTKKL

SEQ ID NO: 2349742 - protein, 5 aa, Cryptosporidium parvum
NSKYF

SEQ ID NO: 2349743 - protein, 20 aa, Cryptosporidium parvum
NSLAKGESAPSNSEEHSGSI

SEQ ID NO: 2349744 - protein, 5 aa, Cryptosporidium parvum
NSLIP

SEQ ID NO: 2349745 - protein, 19 aa, Cryptosporidium parvum
NSLQGSNTVQNDFTNNENI

SEQ ID NO: 2349746 - protein, 7 aa, Cryptosporidium parvum
NSLQGTV

SEQ ID NO: 2349747 - protein, 20 aa, Cryptosporidium parvum
NSMNSSQKSDENKSDQYSGL

SEQ ID NO: 2349748 - protein, 21 aa, Cryptosporidium parvum
NSNATTSSLPSSLSDNNNINN

SEQ ID NO: 2349749 - protein, 9 aa, Cryptosporidium parvum
NSNERASPI

SEQ ID NO: 2349750 - protein, 12 aa, Cryptosporidium parvum
NSNIPSNVEQKV

SEQ ID NO: 2349751 - protein, 6 aa, Cryptosporidium parvum
NSNISD

SEQ ID NO: 2349752 - protein, 14 aa, Cryptosporidium parvum
NSNLRSQISQQSNN

SEQ ID NO: 2349753 - protein, 60 aa, Cryptosporidium parvum; identical to SEQ ID NO: 2273684

SEQ ID NO: 2349754 - protein, 16 aa, Cryptosporidium parvum
NSNNNNTNNNTNNNNY

SEQ ID NO: 2349755 - protein, 10 aa, Cryptosporidium parvum
NSNNQKAQDL

SEQ ID NO: 2349756 - protein, 12 aa, Cryptosporidium parvum
NSNPIPSTSHQD

SEQ ID NO: 2349757 - protein, 5 aa, Cryptosporidium parvum
NSNSI

SEQ ID NO: 2349758 - protein, 5 aa, Cryptosporidium parvum
NSPIT

SEQ ID NO: 2349759 - protein, 4 aa, Cryptosporidium parvum
NSQE

SEQ ID NO: 2349760 - protein, 6 aa, Cryptosporidium parvum
NSQENL

SEQ ID NO: 2349761 - protein, 29 aa, Cryptosporidium parvum
NSQGYKPNETLQSTNYSDNTTVSESQLSS

SEQ ID NO: 2349762 - protein, 4 aa, Cryptosporidium parvum
NSQH

SEQ ID NO: 2349763 - protein, 13 aa, Cryptosporidium parvum
NSQTLRNNNSSRF

SEQ ID NO: 2349764 - protein, 8 aa, Cryptosporidium parvum
NSQTTPEW

SEQ ID NO: 2349765 - protein, 5 aa, Cryptosporidium parvum
NSRDE

SEQ ID NO: 2349766 - protein, 5 aa, Cryptosporidium parvum
NSRTV

SEQ ID NO: 2349767 - protein, 13 aa, Cryptosporidium parvum
NSSDSNLDNASIS

SEQ ID NO: 2349768 - protein, 9 aa, Cryptosporidium parvum
NSSELSSNV

SEQ ID NO: 2349769 - protein, 7 aa, Cryptosporidium parvum
NSSGQPY

SEQ ID NO: 2349770 - protein, 7 aa, Cryptosporidium parvum
NSSKRRI

SEQ ID NO: 2349771 - protein, 6 aa, Cryptosporidium parvum
NSSNKG

SEQ ID NO: 2349772 - protein, 10 aa, Cryptosporidium parvum
NSSRTEQKLN

SEQ ID NO: 2349773 - protein, 12 aa, Cryptosporidium parvum
NSSSPVNKSKGL

SEQ ID NO: 2349774 - protein, 9 aa, Cryptosporidium parvum
NSSSSYYGT

SEQ ID NO: 2349775 - protein, 6 aa, Cryptosporidium parvum
NSSWLD

SEQ ID NO: 2349776 - protein, 7 aa, Cryptosporidium parvum
NSSYSEL

SEQ ID NO: 2349777 - protein, 6 aa, Cryptosporidium parvum
NSTEEY

SEQ ID NO: 2349778 - protein, 5 aa, Cryptosporidium parvum
NSTGF

SEQ ID NO: 2349779 - protein, 10 aa, Cryptosporidium parvum
NSTNKAETSI

SEQ ID NO: 2349780 - protein, 22 aa, Cryptosporidium parvum
NSTPKTVRQDISSPKVQNSTTF

SEQ ID NO: 2349781 - protein, 9 aa, Cryptosporidium parvum
NSTSNQYSS

SEQ ID NO: 2349782 - protein, 6 aa, Cryptosporidium parvum
NSTSPS

SEQ ID NO: 2349783 - protein, 11 aa, Cryptosporidium parvum
NSTSSPPSSFP

SEQ ID NO: 2349784 - protein, 24 aa, Cryptosporidium parvum
NSVNSSEMRTPSNGINLSEKGSPE

SEQ ID NO: 2349785 - protein, 9 aa, Cryptosporidium parvum
NTASNNVGG

SEQ ID NO: 2349786 - protein, 5 aa, Cryptosporidium parvum
NTDIT

SEQ ID NO: 2349787 - protein, 9 aa, Cryptosporidium parvum
NTDNATNTI

SEQ ID NO: 2349788 - protein, 10 aa, Cryptosporidium parvum
NTEKGEAKGF

SEQ ID NO: 2349789 - protein, 11 aa, Cryptosporidium parvum
NTESSKVGQHL

SEQ ID NO: 2349790 - protein, 7 aa, Cryptosporidium parvum
NTEYDPS

SEQ ID NO: 2349791 - protein, 9 aa, Cryptosporidium parvum
NTFDKTKND

SEQ ID NO: 2349792 - protein, 6 aa, Cryptosporidium parvum
NTGENV

SEQ ID NO: 2349793 - protein, 6 aa, Cryptosporidium parvum
NTINEI

SEQ ID NO: 2349794 - protein, 10 aa, Cryptosporidium parvum
NTKDEVSEIN

SEQ ID NO: 2349795 - protein, 9 aa, Cryptosporidium parvum
NTKKKPPKY

SEQ ID NO: 2349796 - protein, 19 aa, Cryptosporidium parvum
NTKLSSKSGSQSSLNQTNY

SEQ ID NO: 2349797 - protein, 6 aa, Cryptosporidium parvum
NTKNPY

SEQ ID NO: 2349798 - protein, 5 aa, Cryptosporidium parvum
NTLEN

SEQ ID NO: 2349799 - protein, 7 aa, Cryptosporidium parvum
NTMQQKQ

SEQ ID NO: 2349800 - protein, 21 aa, Cryptosporidium parvum
NTNLNTNHSISQNVNQTTYGQ

SEQ ID NO: 2349801 - protein, 7 aa, Cryptosporidium parvum
NTNPRAK

SEQ ID NO: 2349802 - protein, 10 aa, Cryptosporidium parvum
NTNSIASKEA

SEQ ID NO: 2349803 - protein, 9 aa, Cryptosporidium parvum
NTPKTPTLG

SEQ ID NO: 2349804 - protein, 6 aa, Cryptosporidium parvum
NTPNNV

SEQ ID NO: 2349805 - protein, 8 aa, Cryptosporidium parvum
NTPPEPYI

SEQ ID NO: 2349806 - protein, 7 aa, Cryptosporidium parvum
NTPSGTV

SEQ ID NO: 2349807 - protein, 14 aa, Cryptosporidium parvum
NTQQNRDSSACNSP

SEQ ID NO: 2349808 - protein, 5 aa, Cryptosporidium parvum
NTQSG

SEQ ID NO: 2349809 - protein, 6 aa, Cryptosporidium parvum
NTRNPG

SEQ ID NO: 2349810 - protein, 11 aa, Cryptosporidium parvum
NTRYNDEQEIK

SEQ ID NO: 2349811 - protein, 14 aa, Cryptosporidium parvum
NTTDNFDKNTHSEL

SEQ ID NO: 2349812 - protein, 44 aa, Cryptosporidium parvum; identical to SEQ ID NO: 2274166

SEQ ID NO: 2349813 - protein, 7 aa, Cryptosporidium parvum
NTTEKRH

SEQ ID NO: 2349814 - protein, 36 aa, Cryptosporidium parvum; identical to SEQ ID NO: 2274178

SEQ ID NO: 2349815 - protein, 14 aa, Cryptosporidium parvum
NVEGGSGSNNLNDV

SEQ ID NO: 2349816 - protein, 13 aa, Cryptosporidium parvum
NVENSRLEESSDR

SEQ ID NO: 2349817 - protein, 7 aa, Cryptosporidium parvum
NVERSKD

SEQ ID NO: 2349818 - protein, 13 aa, Cryptosporidium parvum
NVGEPKKSRDINY

SEQ ID NO: 2349819 - protein, 5 aa, Cryptosporidium parvum
NVIPN

SEQ ID NO: 2349820 - protein, 5 aa, Cryptosporidium parvum
NVISP

SEQ ID NO: 2349821 - protein, 8 aa, Cryptosporidium parvum
NVKPSKNL

SEQ ID NO: 2349822 - protein, 8 aa, Cryptosporidium parvum
NVQPKDVK

SEQ ID NO: 2349823 - protein, 18 aa, Cryptosporidium parvum
NVSGTSGTTGNEHGSGSG

SEQ ID NO: 2349824 - protein, 8 aa, Cryptosporidium parvum
NVSSNTDI

SEQ ID NO: 2349825 - protein, 33 aa, Cryptosporidium parvum; identical to SEQ ID NO: 2274282

SEQ ID NO: 2349826 - protein, 16 aa, Cryptosporidium parvum
NVTQDEVSNGDSLENE

SEQ ID NO: 2349827 - protein, 15 aa, Cryptosporidium parvum
NVTTGTKTGETTRTA

SEQ ID NO: 2349828 - protein, 5 aa, Cryptosporidium parvum
NVYEG

SEQ ID NO: 2349829 - protein, 10 aa, Cryptosporidium parvum
NVYKPDSVSY

SEQ ID NO: 2349830 - protein, 8 aa, Cryptosporidium parvum
NWEKTDPV

SEQ ID NO: 2349831 - protein, 4 aa, Cryptosporidium parvum
NYDE

SEQ ID NO: 2349832 - protein, 12 aa, Cryptosporidium parvum
NYGSSSESDNYV

SEQ ID NO: 2349833 - protein, 8 aa, Cryptosporidium parvum
NYNSQNPK

SEQ ID NO: 2349834 - protein, 49 aa, Cryptosporidium parvum
NYPQRDSARSYSRGRSRSRSGSIGRSRSRSRSRDRIRSRSRSMSEFGSR

SEQ ID NO: 2349835 - protein, 10 aa, Cryptosporidium parvum
NYRDRRNREH

SEQ ID NO: 2349836 - protein, 4 aa, Cryptosporidium parvum
NYRE

SEQ ID NO: 2349837 - protein, 12 aa, Cryptosporidium parvum
NYRKAQGEKEGL

SEQ ID NO: 2349838 - protein, 7 aa, Cryptosporidium parvum
NYSMGGQ

SEQ ID NO: 2349839 - protein, 7 aa, Cryptosporidium parvum
NYSNPTE

SEQ ID NO: 2349840 - protein, 9 aa, Cryptosporidium parvum
NYSPETSLQ

SEQ ID NO: 2349841 - protein, 15 aa, Cryptosporidium parvum
NYYQESGRAGRDGLE

SEQ ID NO: 2349842 - protein, 7 aa, Cryptosporidium parvum
NYYTRNG

SEQ ID NO: 2349843 - protein, 21 aa, Cryptosporidium parvum
PAAPMSARSTSSIGAESRVST

SEQ ID NO: 2349844 - protein, 26 aa, Cryptosporidium parvum
PAASKSDSEKFKNRSLGNSTISSAVT

SEQ ID NO: 2349845 - protein, 13 aa, Cryptosporidium parvum
PAEEFNSNNLSSD

SEQ ID NO: 2349846 - protein, 6 aa, Cryptosporidium parvum
PAERQN

SEQ ID NO: 2349847 - protein, 11 aa, Cryptosporidium parvum
PAIPQPPVPFQ

SEQ ID NO: 2349848 - protein, 9 aa, Cryptosporidium parvum
PAKETKKTK

SEQ ID NO: 2349849 - protein, 15 aa, Cryptosporidium parvum
PAPKYHSRSKTQNTS

SEQ ID NO: 2349850 - protein, 8 aa, Cryptosporidium parvum
PAPSDPLS

SEQ ID NO: 2349851 - protein, 13 aa, Cryptosporidium parvum
PAPWRGSDGEARI

SEQ ID NO: 2349852 - protein, 4 aa, Cryptosporidium parvum
PASN

SEQ ID NO: 2349853 - protein, 10 aa, Cryptosporidium parvum
PASRRNNDGN

SEQ ID NO: 2349854 - protein, 10 aa, Cryptosporidium parvum
PASTGAAKAV

SEQ ID NO: 2349855 - protein, 8 aa, Cryptosporidium parvum
PATTENTA

SEQ ID NO: 2349856 - protein, 6 aa, Cryptosporidium parvum
PATYTT

SEQ ID NO: 2349857 - protein, 5 aa, Cryptosporidium parvum
PAVTI

SEQ ID NO: 2349858 - protein, 8 aa, Cryptosporidium parvum
PDEATKAI

SEQ ID NO: 2349859 - protein, 16 aa, Cryptosporidium parvum
PDEKPILASSSAGGMN

SEQ ID NO: 2349860 - protein, 5 aa, Cryptosporidium parvum
PDEYQ

SEQ ID NO: 2349861 - protein, 6 aa, Cryptosporidium parvum
PDKGGK

SEQ ID NO: 2349862 - protein, 13 aa, Cryptosporidium parvum
PDKNPDNREEAEE

SEQ ID NO: 2349863 - protein, 15 aa, Cryptosporidium parvum
PDKNQNDEKSKERFQ

SEQ ID NO: 2349864 - protein, 4 aa, Cryptosporidium parvum
PDLA

SEQ ID NO: 2349865 - protein, 10 aa, Cryptosporidium parvum
PDLARKNENP

SEQ ID NO: 2349866 - protein, 16 aa, Cryptosporidium parvum
PDLDGNQFKRNDTAVS

SEQ ID NO: 2349867 - protein, 4 aa, Cryptosporidium parvum
PDPI

SEQ ID NO: 2349868 - protein, 9 aa, Cryptosporidium parvum
PDPNEVDSR

SEQ ID NO: 2349869 - protein, 9 aa, Cryptosporidium parvum
PDPNKSNKL

SEQ ID NO: 2349870 - protein, 8 aa, Cryptosporidium parvum
PDPPRFPT

SEQ ID NO: 2349871 - protein, 11 aa, Cryptosporidium parvum
PDQNKISSDSI

SEQ ID NO: 2349872 - protein, 6 aa, Cryptosporidium parvum
PDTEKL

SEQ ID NO: 2349873 - protein, 5 aa, Cryptosporidium parvum
PDTGK

SEQ ID NO: 2349874 - protein, 18 aa, Cryptosporidium parvum
PDTPSTQAPPVLSSNSVG

SEQ ID NO: 2349875 - protein, 5 aa, Cryptosporidium parvum
PDYKK

SEQ ID NO: 2349876 - protein, 7 aa, Cryptosporidium parvum
PDYRTPN

SEQ ID NO: 2349877 - protein, 12 aa, Cryptosporidium parvum
PEDLDKELDLIW

SEQ ID NO: 2349878 - protein, 8 aa, Cryptosporidium parvum
PEDPNKLE

SEQ ID NO: 2349879 - protein, 6 aa, Cryptosporidium parvum
PEDPVI

SEQ ID NO: 2349880 - protein, 4 aa, Cryptosporidium parvum
PEDV

SEQ ID NO: 2349881 - protein, 8 aa, Cryptosporidium parvum
PEGGWTKE

SEQ ID NO: 2349882 - protein, 14 aa, Cryptosporidium parvum
PEGSLNKAAELASN

SEQ ID NO: 2349883 - protein, 5 aa, Cryptosporidium parvum
PEIGE

SEQ ID NO: 2349884 - protein, 4 aa, Cryptosporidium parvum
PEKL

SEQ ID NO: 2349885 - protein, 8 aa, Cryptosporidium parvum
PEKNENFR

SEQ ID NO: 2349886 - protein, 10 aa, Cryptosporidium parvum
PELTNDNGSF

SEQ ID NO: 2349887 - protein, 5 aa, Cryptosporidium parvum
PEMQS

SEQ ID NO: 2349888 - protein, 5 aa, Cryptosporidium parvum
PENAD

SEQ ID NO: 2349889 - protein, 5 aa, Cryptosporidium parvum
PENPN

SEQ ID NO: 2349890 - protein, 9 aa, Cryptosporidium parvum
PEPSSISSI

SEQ ID NO: 2349891 - protein, 17 aa, Cryptosporidium parvum
PEQTQIHDQESKSHNSS

SEQ ID NO: 2349892 - protein, 10 aa, Cryptosporidium parvum
PESDGSESFN

SEQ ID NO: 2349893 - protein, 4 aa, Cryptosporidium parvum
PESF

SEQ ID NO: 2349894 - protein, 10 aa, Cryptosporidium parvum
PESNRNQSSE

SEQ ID NO: 2349895 - protein, 16 aa, Cryptosporidium parvum
PFHKTDDRIHQNSNNY

SEQ ID NO: 2349896 - protein, 12 aa, Cryptosporidium parvum
PFSGKDTAGYIQ

SEQ ID NO: 2349897 - protein, 9 aa, Cryptosporidium parvum
PFSKTERKK

SEQ ID NO: 2349898 - protein, 9 aa, Cryptosporidium parvum
PGEFDPSEP

SEQ ID NO: 2349899 - protein, 8 aa, Cryptosporidium parvum
PGEIPSSV

SEQ ID NO: 2349900 - protein, 6 aa, Cryptosporidium parvum
PGFGDH

SEQ ID NO: 2349901 - protein, 5 aa, Cryptosporidium parvum
PGGTF

SEQ ID NO: 2349902 - protein, 5 aa, Cryptosporidium parvum
PGHES

SEQ ID NO: 2349903 - protein, 7 aa, Cryptosporidium parvum
PGHPMKP

SEQ ID NO: 2349904 - protein, 62 aa, Cryptosporidium parvum; identical to SEQ ID NO: 2274773

SEQ ID NO: 2349905 - protein, 8 aa, Cryptosporidium parvum
PGNLRGEA

SEQ ID NO: 2349906 - protein, 5 aa, Cryptosporidium parvum
PGNTA

SEQ ID NO: 2349907 - protein, 7 aa, Cryptosporidium parvum
PGRTTHA

SEQ ID NO: 2349908 - protein, 10 aa, Cryptosporidium parvum
PGSFNPPPKV

SEQ ID NO: 2349909 - protein, 4 aa, Cryptosporidium parvum
PGSS

SEQ ID NO: 2349910 - protein, 5 aa, Cryptosporidium parvum
PGTMD

SEQ ID NO: 2349911 - protein, 7 aa, Cryptosporidium parvum
PHKSPQS

SEQ ID NO: 2349912 - protein, 4 aa, Cryptosporidium parvum
PHLN

SEQ ID NO: 2349913 - protein, 5 aa, Cryptosporidium parvum
PHPRP

SEQ ID NO: 2349914 - protein, 4 aa, Cryptosporidium parvum
PHSL

SEQ ID NO: 2349915 - protein, 5 aa, Cryptosporidium parvum
PHSPS

SEQ ID NO: 2349916 - protein, 5 aa, Cryptosporidium parvum
PHYKR

SEQ ID NO: 2349917 - protein, 8 aa, Cryptosporidium parvum
PIDSNYQG

SEQ ID NO: 2349918 - protein, 10 aa, Cryptosporidium parvum
PIEDNDESLS

SEQ ID NO: 2349919 - protein, 14 aa, Cryptosporidium parvum
PIHSPESTSGPKKD

SEQ ID NO: 2349920 - protein, 14 aa, Cryptosporidium parvum
PIKKSKNKPGKRDR

SEQ ID NO: 2349921 - protein, 11 aa, Cryptosporidium parvum
PINSSKDCPNV

SEQ ID NO: 2349922 - protein, 11 aa, Cryptosporidium parvum
PINSSSTSVNK

SEQ ID NO: 2349923 - protein, 6 aa, Cryptosporidium parvum
PIQTRT

SEQ ID NO: 2349924 - protein, 4 aa, Cryptosporidium parvum
PIRN

SEQ ID NO: 2349925 - protein, 7 aa, Cryptosporidium parvum
PISENKS

SEQ ID NO: 2349926 - protein, 21 aa, Cryptosporidium parvum
PISQASAKQRSGRAGRTGPGK

SEQ ID NO: 2349927 - protein, 13 aa, Cryptosporidium parvum
PITTNSQVSAGRS

SEQ ID NO: 2349928 - protein, 12 aa, Cryptosporidium parvum
PKANAVKTSKLD

SEQ ID NO: 2349929 - protein, 13 aa, Cryptosporidium parvum
PKCKRRHEPKARH

SEQ ID NO: 2349930 - protein, 10 aa, Cryptosporidium parvum
PKDIDHDQKV

SEQ ID NO: 2349931 - protein, 19 aa, Cryptosporidium parvum
PKDKQAQADRKKSKFYHPQ

SEQ ID NO: 2349932 - protein, 13 aa, Cryptosporidium parvum
PKDTSRLTATNNI

SEQ ID NO: 2349933 - protein, 5 aa, Cryptosporidium parvum
PKEAG

SEQ ID NO: 2349934 - protein, 5 aa, Cryptosporidium parvum
PKETK

SEQ ID NO: 2349935 - protein, 9 aa, Cryptosporidium parvum
PKFASTVGS

SEQ ID NO: 2349936 - protein, 13 aa, Cryptosporidium parvum
PKFNANATNEKGF

SEQ ID NO: 2349937 - protein, 19 aa, Cryptosporidium parvum
PKKIEKEPNDNKKDESNKL

SEQ ID NO: 2349938 - protein, 9 aa, Cryptosporidium parvum
PKKLEESKK

SEQ ID NO: 2349939 - protein, 10 aa, Cryptosporidium parvum
PKKSDGTNKG

SEQ ID NO: 2349940 - protein, 10 aa, Cryptosporidium parvum
PKNDQSDFNS

SEQ ID NO: 2349941 - protein, 8 aa, Cryptosporidium parvum
PKNSGKTT

SEQ ID NO: 2349942 - protein, 7 aa, Cryptosporidium parvum
PKPGNSM

SEQ ID NO: 2349943 - protein, 10 aa, Cryptosporidium parvum
PKPKNEPENI

SEQ ID NO: 2349944 - protein, 8 aa, Cryptosporidium parvum
PKRISGKE

SEQ ID NO: 2349945 - protein, 16 aa, Cryptosporidium parvum
PKSKAALTAARTNANS

SEQ ID NO: 2349946 - protein, 9 aa, Cryptosporidium parvum
PKSKEPHSK

SEQ ID NO: 2349947 - protein, 7 aa, Cryptosporidium parvum
PKSSQGT

SEQ ID NO: 2349948 - protein, 6 aa, Cryptosporidium parvum
PKSTLG

SEQ ID NO: 2349949 - protein, 12 aa, Cryptosporidium parvum
PKSTPPNPEKIK

SEQ ID NO: 2349950 - protein, 5 aa, Cryptosporidium parvum
PKSVA

SEQ ID NO: 2349951 - protein, 9 aa, Cryptosporidium parvum
PKTEPEQDY

SEQ ID NO: 2349952 - protein, 4 aa, Cryptosporidium parvum
PKTL

SEQ ID NO: 2349953 - protein, 10 aa, Cryptosporidium parvum
PKVPGISSNN

SEQ ID NO: 2349954 - protein, 6 aa, Cryptosporidium parvum
PKVTSS

SEQ ID NO: 2349955 - protein, 5 aa, Cryptosporidium parvum
PLANK

SEQ ID NO: 2349956 - protein, 8 aa, Cryptosporidium parvum
PLEKKNSW

SEQ ID NO: 2349957 - protein, 6 aa, Cryptosporidium parvum
PLGGPR

SEQ ID NO: 2349958 - protein, 10 aa, Cryptosporidium parvum
PLGNDNGSGM

SEQ ID NO: 2349959 - protein, 10 aa, Cryptosporidium parvum
PLKSTKSNIS

SEQ ID NO: 2349960 - protein, 9 aa, Cryptosporidium parvum
PLNGEDAER

SEQ ID NO: 2349961 - protein, 25 aa, Cryptosporidium parvum
PLPPKRNGPGWNSHSTGNKLEDSNN

SEQ ID NO: 2349962 - protein, 31 aa, Cryptosporidium parvum; identical to SEQ ID NO: 2275140

SEQ ID NO: 2349963 - protein, 4 aa, Cryptosporidium parvum
PLQP

SEQ ID NO: 2349964 - protein, 11 aa, Cryptosporidium parvum
PLSTLRTKKNE

SEQ ID NO: 2349965 - protein, 5 aa, Cryptosporidium parvum
PLTEK

SEQ ID NO: 2349966 - protein, 6 aa, Cryptosporidium parvum
PNDGPD

SEQ ID NO: 2349967 - protein, 11 aa, Cryptosporidium parvum
PNDNTEQGKEL

SEQ ID NO: 2349968 - protein, 13 aa, Cryptosporidium parvum
PNFEGNNNNLDSS

SEQ ID NO: 2349969 - protein, 14 aa, Cryptosporidium parvum
PNFQNKRKEYGLNN

SEQ ID NO: 2349970 - protein, 9 aa, Cryptosporidium parvum
PNFSQSQKE

SEQ ID NO: 2349971 - protein, 4 aa, Cryptosporidium parvum
PNGP

SEQ ID NO: 2349972 - protein, 14 aa, Cryptosporidium parvum
PNGSYSTIKDSESS

SEQ ID NO: 2349973 - protein, 7 aa, Cryptosporidium parvum
PNIDDET

SEQ ID NO: 2349974 - protein, 6 aa, Cryptosporidium parvum
PNINRD

SEQ ID NO: 2349975 - protein, 23 aa, Cryptosporidium parvum
PNITSSTDFNNESENGINNNSRL

SEQ ID NO: 2349976 - protein, 4 aa, Cryptosporidium parvum
PNIV

SEQ ID NO: 2349977 - protein, 5 aa, Cryptosporidium parvum
PNKKS

SEQ ID NO: 2349978 - protein, 22 aa, Cryptosporidium parvum
PNKSIKKEANNTLNTGTQNNSV

SEQ ID NO: 2349979 - protein, 9 aa, Cryptosporidium parvum
PNKSSNSDK

SEQ ID NO: 2349980 - protein, 4 aa, Cryptosporidium parvum
PNKT

SEQ ID NO: 2349981 - protein, 23 aa, Cryptosporidium parvum
PNKTPDDYKDGNNIKHEQHQDFD

SEQ ID NO: 2349982 - protein, 4 aa, Cryptosporidium parvum
PNLA

SEQ ID NO: 2349983 - protein, 4 aa, Cryptosporidium parvum
PNLP

SEQ ID NO: 2349984 - protein, 4 aa, Cryptosporidium parvum
PNMP

SEQ ID NO: 2349985 - protein, 5 aa, Cryptosporidium parvum
PNNKT

SEQ ID NO: 2349986 - protein, 6 aa, Cryptosporidium parvum
PNNKYG

SEQ ID NO: 2349987 - protein, 23 aa, Cryptosporidium parvum
PNNNNSNNINNNNNNNSNTTLTT

SEQ ID NO: 2349988 - protein, 16 aa, Cryptosporidium parvum
PNNSIQPQYVNGTSTH

SEQ ID NO: 2349989 - protein, 24 aa, Cryptosporidium parvum
PNNSSGGGGRGGREGECDGNTNSQ

SEQ ID NO: 2349990 - protein, 4 aa, Cryptosporidium parvum
PNNV

SEQ ID NO: 2349991 - protein, 16 aa, Cryptosporidium parvum
PNPNTSTSNNIPSTTA

SEQ ID NO: 2349992 - protein, 5 aa, Cryptosporidium parvum
PNPSP

SEQ ID NO: 2349993 - protein, 13 aa, Cryptosporidium parvum
PNPVSTQNEAIGG

SEQ ID NO: 2349994 - protein, 9 aa, Cryptosporidium parvum
PNQDEATSI

SEQ ID NO: 2349995 - protein, 8 aa, Cryptosporidium parvum
PNQTRKGT

SEQ ID NO: 2349996 - protein, 7 aa, Cryptosporidium parvum
PNQYGER

SEQ ID NO: 2349997 - protein, 10 aa, Cryptosporidium parvum
PNRRPHKPYQ

SEQ ID NO: 2349998 - protein, 9 aa, Cryptosporidium parvum
PNSGGDVNC

SEQ ID NO: 2349999 - protein, 4 aa, Cryptosporidium parvum
PNSI

SEQ ID NO: 2350000 - protein, 8 aa, Cryptosporidium parvum
PNSMQSGQ

SEQ ID NO: 2350001 - protein, 4 aa, Cryptosporidium parvum
PNSN

SEQ ID NO: 2350002 - protein, 9 aa, Cryptosporidium parvum
PNSNEKERI

SEQ ID NO: 2350003 - protein, 10 aa, Cryptosporidium parvum
PNSNNSPDEF

SEQ ID NO: 2350004 - protein, 6 aa, Cryptosporidium parvum
PNSRKA

SEQ ID NO: 2350005 - protein, 25 aa, Cryptosporidium parvum
PNSRRNHQNTKNCSNSSSSSNTNNH

SEQ ID NO: 2350006 - protein, 9 aa, Cryptosporidium parvum
PNSSPTNIS

SEQ ID NO: 2350007 - protein, 5 aa, Cryptosporidium parvum
PNSWP

SEQ ID NO: 2350008 - protein, 7 aa, Cryptosporidium parvum
PNYKDRR

SEQ ID NO: 2350009 - protein, 8 aa, Cryptosporidium parvum
PNYPIERS

SEQ ID NO: 2350010 - protein, 7 aa, Cryptosporidium parvum
PNYPRKQ

SEQ ID NO: 2350011 - protein, 5 aa, Cryptosporidium parvum
PPDED

SEQ ID NO: 2350012 - protein, 5 aa, Cryptosporidium parvum
PPFFG

SEQ ID NO: 2350013 - protein, 16 aa, Cryptosporidium parvum
PPFKSHNDLSASQDSF

SEQ ID NO: 2350014 - protein, 11 aa, Cryptosporidium parvum
PPGGPVLENSK

SEQ ID NO: 2350015 - protein, 5 aa, Cryptosporidium parvum
PPGNN

SEQ ID NO: 2350016 - protein, 10 aa, Cryptosporidium parvum
PPHSTRPKET

SEQ ID NO: 2350017 - protein, 4 aa, Cryptosporidium parvum
PPIL

SEQ ID NO: 2350018 - protein, 55 aa, Cryptosporidium parvum; identical to SEQ ID NO: 2275430

SEQ ID NO: 2350019 - protein, 5 aa, Cryptosporidium parvum
PPKID

SEQ ID NO: 2350020 - protein, 10 aa, Cryptosporidium parvum
PPKKVDGIAD

SEQ ID NO: 2350021 - protein, 4 aa, Cryptosporidium parvum
PPLS

SEQ ID NO: 2350022 - protein, 5 aa, Cryptosporidium parvum
PPNHT

SEQ ID NO: 2350023 - protein, 11 aa, Cryptosporidium parvum
PPNSRVGSSGA

SEQ ID NO: 2350024 - protein, 11 aa, Cryptosporidium parvum
PPPIQPPEKIP

SEQ ID NO: 2350025 - protein, 13 aa, Cryptosporidium parvum
PPPPPPPSKTSGA

SEQ ID NO: 2350026 - protein, 5 aa, Cryptosporidium parvum
PPRDI

SEQ ID NO: 2350027 - protein, 10 aa, Cryptosporidium parvum
PPSEDQPQGM

SEQ ID NO: 2350028 - protein, 5 aa, Cryptosporidium parvum
PPSGA

SEQ ID NO: 2350029 - protein, 5 aa, Cryptosporidium parvum
PPSNE

SEQ ID NO: 2350030 - protein, 4 aa, Cryptosporidium parvum
PPSY

SEQ ID NO: 2350031 - protein, 6 aa, Cryptosporidium parvum
PPTRAF

SEQ ID NO: 2350032 - protein, 4 aa, Cryptosporidium parvum
PPWN

SEQ ID NO: 2350033 - protein, 30 aa, Cryptosporidium parvum; identical to SEQ ID NO: 2275542

SEQ ID NO: 2350034 - protein, 8 aa, Cryptosporidium parvum
PQGSDSSF

SEQ ID NO: 2350035 - protein, 5 aa, Cryptosporidium parvum
PQINE

SEQ ID NO: 2350036 - protein, 4 aa, Cryptosporidium parvum
PQKL

SEQ ID NO: 2350037 - protein, 7 aa, Cryptosporidium parvum
PQLPREG

SEQ ID NO: 2350038 - protein, 18 aa, Cryptosporidium parvum
PQNISKPINRSVEASTSQ

SEQ ID NO: 2350039 - protein, 7 aa, Cryptosporidium parvum
PQNPKEK

SEQ ID NO: 2350040 - protein, 5 aa, Cryptosporidium parvum
PQPDV

SEQ ID NO: 2350041 - protein, 6 aa, Cryptosporidium parvum
PQPGEK

SEQ ID NO: 2350042 - protein, 4 aa, Cryptosporidium parvum
PQRT

SEQ ID NO: 2350043 - protein, 9 aa, Cryptosporidium parvum
PQSGNSVSV

SEQ ID NO: 2350044 - protein, 6 aa, Cryptosporidium parvum
PRDIEK

SEQ ID NO: 2350045 - protein, 10 aa, Cryptosporidium parvum
PRINKTDSEN

SEQ ID NO: 2350046 - protein, 25 aa, Cryptosporidium parvum
PRKEDREPNDPQTPNAHTRCPQKQF

SEQ ID NO: 2350047 - protein, 21 aa, Cryptosporidium parvum
PRKKTQRSHSQKLKQDKKQTS

SEQ ID NO: 2350048 - protein, 7 aa, Cryptosporidium parvum
PRLENQN

SEQ ID NO: 2350049 - protein, 4 aa, Cryptosporidium parvum
PRNL

SEQ ID NO: 2350050 - protein, 21 aa, Cryptosporidium parvum
PRPWKGGDNSSNGPKDSTGDD

SEQ ID NO: 2350051 - protein, 8 aa, Cryptosporidium parvum
PSAKKKKE

SEQ ID NO: 2350052 - protein, 7 aa, Cryptosporidium parvum
PSDTEHS

SEQ ID NO: 2350053 - protein, 33 aa, Cryptosporidium parvum; identical to SEQ ID NO: 2156690

SEQ ID NO: 2350054 - protein, 5 aa, Cryptosporidium parvum
PSHGQ

SEQ ID NO: 2350055 - protein, 4 aa, Cryptosporidium parvum
PSIS

SEQ ID NO: 2350056 - protein, 10 aa, Cryptosporidium parvum
PSKFQDESTT

SEQ ID NO: 2350057 - protein, 8 aa, Cryptosporidium parvum
PSKKPDYY

SEQ ID NO: 2350058 - protein, 5 aa, Cryptosporidium parvum
PSLDS

SEQ ID NO: 2350059 - protein, 13 aa, Cryptosporidium parvum
PSNDSTKATSSIP

SEQ ID NO: 2350060 - protein, 14 aa, Cryptosporidium parvum
PSNEASKSNLTGYA

SEQ ID NO: 2350061 - protein, 8 aa, Cryptosporidium parvum
PSNITNDS

SEQ ID NO: 2350062 - protein, 25 aa, Cryptosporidium parvum
PSNLSPKKSRAKRKVADAIKRVEIT

SEQ ID NO: 2350063 - protein, 22 aa, Cryptosporidium parvum
PSNPVATQFDPKPQVSGQPPIN

SEQ ID NO: 2350064 - protein, 4 aa, Cryptosporidium parvum
PSNQ

SEQ ID NO: 2350065 - protein, 13 aa, Cryptosporidium parvum
PSNSDQSRKSWTT

SEQ ID NO: 2350066 - protein, 7 aa, Cryptosporidium parvum
PSNSEIE

SEQ ID NO: 2350067 - protein, 6 aa, Cryptosporidium parvum
PSNSMN

SEQ ID NO: 2350068 - protein, 7 aa, Cryptosporidium parvum
PSQGDLD

SEQ ID NO: 2350069 - protein, 4 aa, Cryptosporidium parvum
PSQI

SEQ ID NO: 2350070 - protein, 4 aa, Cryptosporidium parvum
PSQR

SEQ ID NO: 2350071 - protein, 9 aa, Cryptosporidium parvum
PSSLNNNQN

SEQ ID NO: 2350072 - protein, 7 aa, Cryptosporidium parvum
PSSNGRF

SEQ ID NO: 2350073 - protein, 12 aa, Cryptosporidium parvum
PSTEGSSDKNIA

SEQ ID NO: 2350074 - protein, 7 aa, Cryptosporidium parvum
PSTSFKE

SEQ ID NO: 2350075 - protein, 10 aa, Cryptosporidium parvum
PSYPSSREAL

SEQ ID NO: 2350076 - protein, 4 aa, Cryptosporidium parvum
PTEP

SEQ ID NO: 2350077 - protein, 8 aa, Cryptosporidium parvum
PTESAANA

SEQ ID NO: 2350078 - protein, 11 aa, Cryptosporidium parvum
PTFPDQQPSGC

SEQ ID NO: 2350079 - protein, 7 aa, Cryptosporidium parvum
PTHTQVR

SEQ ID NO: 2350080 - protein, 9 aa, Cryptosporidium parvum
PTKGCGNRT

SEQ ID NO: 2350081 - protein, 13 aa, Cryptosporidium parvum
PTKTETTTTMTET

SEQ ID NO: 2350082 - protein, 4 aa, Cryptosporidium parvum
PTNE

SEQ ID NO: 2350083 - protein, 14 aa, Cryptosporidium parvum
PTNMKDDEECMMCS

SEQ ID NO: 2350084 - protein, 5 aa, Cryptosporidium parvum
PTNNF

SEQ ID NO: 2350085 - protein, 4 aa, Cryptosporidium parvum
PTPD

SEQ ID NO: 2350086 - protein, 7 aa, Cryptosporidium parvum
PTPGTVE

SEQ ID NO: 2350087 - protein, 17 aa, Cryptosporidium parvum
PTPRKASEKEKLRPETQ

SEQ ID NO: 2350088 - protein, 17 aa, Cryptosporidium parvum
PTRARGERVYKPGGKKE

SEQ ID NO: 2350089 - protein, 14 aa, Cryptosporidium parvum
PTRPYGPGEKLPPH

SEQ ID NO: 2350090 - protein, 4 aa, Cryptosporidium parvum
PTRR

SEQ ID NO: 2350091 - protein, 11 aa, Cryptosporidium parvum
PTSARLNPTVG

SEQ ID NO: 2350092 - protein, 12 aa, Cryptosporidium parvum
PTSKRNHKAWMI

SEQ ID NO: 2350093 - protein, 6 aa, Cryptosporidium parvum
PTSRDP

SEQ ID NO: 2350094 - protein, 12 aa, Cryptosporidium parvum
PTSTNDQNSKGN

SEQ ID NO: 2350095 - protein, 5 aa, Cryptosporidium parvum
PTVEE

SEQ ID NO: 2350096 - protein, 15 aa, Cryptosporidium parvum
PVGGRYNPSKTLSQN

SEQ ID NO: 2350097 - protein, 4 aa, Cryptosporidium parvum
PVNP

SEQ ID NO: 2350098 - protein, 17 aa, Cryptosporidium parvum
PVSGSGGNTISSSSTNN

SEQ ID NO: 2350099 - protein, 8 aa, Cryptosporidium parvum
PWGKGRPG

SEQ ID NO: 2350100 - protein, 16 aa, Cryptosporidium parvum
PWSSSKPAQPESETNE

SEQ ID NO: 2350101 - protein, 63 aa, Cryptosporidium parvum; identical to SEQ ID NO: 2276015

SEQ ID NO: 2350102 - protein, 15 aa, Cryptosporidium parvum
PYPNGVQDLPKETKD

SEQ ID NO: 2350103 - protein, 31 aa, Cryptosporidium parvum; identical to SEQ ID NO: 2276034

SEQ ID NO: 2350104 - protein, 15 aa, Cryptosporidium parvum
PYQTTPEVQTNNPNL

SEQ ID NO: 2350105 - protein, 6 aa, Cryptosporidium parvum
PYSIGS

SEQ ID NO: 2350106 - protein, 8 aa, Cryptosporidium parvum
PYSPTDSR

SEQ ID NO: 2350107 - protein, 15 aa, Cryptosporidium parvum
PYSQSKISSRSTGID

SEQ ID NO: 2350108 - protein, 8 aa, Cryptosporidium parvum
QAAKTDSK

SEQ ID NO: 2350109 - protein, 9 aa, Cryptosporidium parvum
QAEKHNTDF

SEQ ID NO: 2350110 - protein, 5 aa, Cryptosporidium parvum
QAEKT

SEQ ID NO: 2350111 - protein, 8 aa, Cryptosporidium parvum
QAISYNRT

SEQ ID NO: 2350112 - protein, 13 aa, Cryptosporidium parvum
QAITDSKEKIQKS

SEQ ID NO: 2350113 - protein, 33 aa, Cryptosporidium parvum
QAKSHALATEDVGSEAITKPKPISAAAKAAAER

SEQ ID NO: 2350114 - protein, 8 aa, Cryptosporidium parvum
QAQQISTA

SEQ ID NO: 2350115 - protein, 30 aa, Cryptosporidium parvum
QAQSEMGQQPTSNPREFREQKQRHQRNSVH

SEQ ID NO: 2350116 - protein, 13 aa, Cryptosporidium parvum
QAQTERKKTGNTL

SEQ ID NO: 2350117 - protein, 19 aa, Cryptosporidium parvum
QAQTQSQAQVQSSQALPEL

SEQ ID NO: 2350118 - protein, 4 aa, Cryptosporidium parvum
QAQV

SEQ ID NO: 2350119 - protein, 11 aa, Cryptosporidium parvum
QARTGSGKTLA

SEQ ID NO: 2350120 - protein, 8 aa, Cryptosporidium parvum
QASKDHQS

SEQ ID NO: 2350121 - protein, 13 aa, Cryptosporidium parvum
QASKKSESSIADP

SEQ ID NO: 2350122 - protein, 9 aa, Cryptosporidium parvum
QASSQGYSS

SEQ ID NO: 2350123 - protein, 4 aa, Cryptosporidium parvum
QATK

SEQ ID NO: 2350124 - protein, 7 aa, Cryptosporidium parvum
QCNREKN

SEQ ID NO: 2350125 - protein, 6 aa, Cryptosporidium parvum
QDAHSL

SEQ ID NO: 2350126 - protein, 6 aa, Cryptosporidium parvum
QDALGG

SEQ ID NO: 2350127 - protein, 9 aa, Cryptosporidium parvum
QDCDTKQAI

SEQ ID NO: 2350128 - protein, 6 aa, Cryptosporidium parvum
QDGFNT

SEQ ID NO: 2350129 - protein, 8 aa, Cryptosporidium parvum
QDGKVDGT

SEQ ID NO: 2350130 - protein, 9 aa, Cryptosporidium parvum
QDGNPETRK

SEQ ID NO: 2350131 - protein, 15 aa, Cryptosporidium parvum
QDKETTDTNTSSEES

SEQ ID NO: 2350132 - protein, 7 aa, Cryptosporidium parvum
QDNEEDS

SEQ ID NO: 2350133 - protein, 15 aa, Cryptosporidium parvum
QDNSKDQKLETTNKS

SEQ ID NO: 2350134 - protein, 12 aa, Cryptosporidium parvum
QDPDAPIPDTSE

SEQ ID NO: 2350135 - protein, 7 aa, Cryptosporidium parvum
QDSAENN

SEQ ID NO: 2350136 - protein, 8 aa, Cryptosporidium parvum
QDSDSEVV

SEQ ID NO: 2350137 - protein, 17 aa, Cryptosporidium parvum
QDTKEEATETDLNSSRM

SEQ ID NO: 2350138 - protein, 20 aa, Cryptosporidium parvum
QDTSLSANNNNTCIGNSSQR

SEQ ID NO: 2350139 - protein, 11 aa, Cryptosporidium parvum
QEAETTKDAVS

SEQ ID NO: 2350140 - protein, 18 aa, Cryptosporidium parvum
QEEAKRLSEKLGDKKLSE

SEQ ID NO: 2350141 - protein, 13 aa, Cryptosporidium parvum
QEEENENNENYSE

SEQ ID NO: 2350142 - protein, 7 aa, Cryptosporidium parvum
QEENKRR

SEQ ID NO: 2350143 - protein, 5 aa, Cryptosporidium parvum
QEEPF

SEQ ID NO: 2350144 - protein, 12 aa, Cryptosporidium parvum
QEERRRKEEEFK

SEQ ID NO: 2350145 - protein, 26 aa, Cryptosporidium parvum
QEFNSQSEEYGGWDGSYTSPKKGQIK

SEQ ID NO: 2350146 - protein, 11 aa, Cryptosporidium parvum
QEGRKSPESMR

SEQ ID NO: 2350147 - protein, 9 aa, Cryptosporidium parvum
QEISEKENN

SEQ ID NO: 2350148 - protein, 8 aa, Cryptosporidium parvum
QEKKNNEY

SEQ ID NO: 2350149 - protein, 9 aa, Cryptosporidium parvum
QEKRPENKM

SEQ ID NO: 2350150 - protein, 11 aa, Cryptosporidium parvum
QELRSKASGNI

SEQ ID NO: 2350151 - protein, 8 aa, Cryptosporidium parvum
QENAEASR

SEQ ID NO: 2350152 - protein, 8 aa, Cryptosporidium parvum
QENDEQPC

SEQ ID NO: 2350153 - protein, 27 aa, Cryptosporidium parvum
QENEQELKRREEEEKKKEEERRRLEEE

SEQ ID NO: 2350154 - protein, 9 aa, Cryptosporidium parvum
QENNEDDEF

SEQ ID NO: 2350155 - protein, 14 aa, Cryptosporidium parvum
QEPNSNKNTSRSNL

SEQ ID NO: 2350156 - protein, 7 aa, Cryptosporidium parvum
QEPPRSG

SEQ ID NO: 2350157 - protein, 9 aa, Cryptosporidium parvum
QEREDQKSM

SEQ ID NO: 2350158 - protein, 5 aa, Cryptosporidium parvum
QEREK

SEQ ID NO: 2350159 - protein, 8 aa, Cryptosporidium parvum
QESDSAIQ

SEQ ID NO: 2350160 - protein, 9 aa, Cryptosporidium parvum
QESSDVIGE

SEQ ID NO: 2350161 - protein, 9 aa, Cryptosporidium parvum
QESSNTTKQ

SEQ ID NO: 2350162 - protein, 4 aa, Cryptosporidium parvum
QETL

SEQ ID NO: 2350163 - protein, 7 aa, Cryptosporidium parvum
QETRPEN

SEQ ID NO: 2350164 - protein, 10 aa, Cryptosporidium parvum
QFEDSSSSYA

SEQ ID NO: 2350165 - protein, 10 aa, Cryptosporidium parvum
QFPDDEDIST

SEQ ID NO: 2350166 - protein, 6 aa, Cryptosporidium parvum
QFSSSN

SEQ ID NO: 2350167 - protein, 11 aa, Cryptosporidium parvum
QGDANKASENC

SEQ ID NO: 2350168 - protein, 9 aa, Cryptosporidium parvum
QGEQHQDGC

SEQ ID NO: 2350169 - protein, 6 aa, Cryptosporidium parvum
QGESRG

SEQ ID NO: 2350170 - protein, 14 aa, Cryptosporidium parvum
QGGVSKSVSTSTSV

SEQ ID NO: 2350171 - protein, 8 aa, Cryptosporidium parvum
QGKDKSKE

SEQ ID NO: 2350172 - protein, 8 aa, Cryptosporidium parvum
QGKDSSLK

SEQ ID NO: 2350173 - protein, 10 aa, Cryptosporidium parvum
QGKDTNFDDA

SEQ ID NO: 2350174 - protein, 6 aa, Cryptosporidium parvum
QGKTKL

SEQ ID NO: 2350175 - protein, 4 aa, Cryptosporidium parvum
QGPE

SEQ ID NO: 2350176 - protein, 7 aa, Cryptosporidium parvum
QGPGMGA

SEQ ID NO: 2350177 - protein, 4 aa, Cryptosporidium parvum
QGQD

SEQ ID NO: 2350178 - protein, 9 aa, Cryptosporidium parvum
QGSSETYLE

SEQ ID NO: 2350179 - protein, 9 aa, Cryptosporidium parvum
QGSSQEFND

SEQ ID NO: 2350180 - protein, 19 aa, Cryptosporidium parvum
QGVSEYSQSGNEEHTSKSS

SEQ ID NO: 2350181 - protein, 4 aa, Cryptosporidium parvum
QHDV

SEQ ID NO: 2350182 - protein, 12 aa, Cryptosporidium parvum
QHNEDTTPKPVF

SEQ ID NO: 2350183 - protein, 6 aa, Cryptosporidium parvum
QHNQGV

SEQ ID NO: 2350184 - protein, 11 aa, Cryptosporidium parvum
QHSNPVTPQQA

SEQ ID NO: 2350185 - protein, 10 aa, Cryptosporidium parvum
QHTDYPPKYY

SEQ ID NO: 2350186 - protein, 17 aa, Cryptosporidium parvum
QIEENQKLTDYDKEKLR

SEQ ID NO: 2350187 - protein, 16 aa, Cryptosporidium parvum
QIESEEDNKVKSNVTV

SEQ ID NO: 2350188 - protein, 25 aa, Cryptosporidium parvum
QIKHNSAESAKPKMEASSPPQNVTK

SEQ ID NO: 2350189 - protein, 5 aa, Cryptosporidium parvum
QIKQP

SEQ ID NO: 2350190 - protein, 5 aa, Cryptosporidium parvum
QINAN

SEQ ID NO: 2350191 - protein, 8 aa, Cryptosporidium parvum
QINEQKKK

SEQ ID NO: 2350192 - protein, 8 aa, Cryptosporidium parvum
QIPGDQSS

SEQ ID NO: 2350193 - protein, 7 aa, Cryptosporidium parvum
QIQKNKE

SEQ ID NO: 2350194 - protein, 14 aa, Cryptosporidium parvum
QIQSQREEKEVANG

SEQ ID NO: 2350195 - protein, 11 aa, Cryptosporidium parvum
QIQTGNQAKPI

SEQ ID NO: 2350196 - protein, 15 aa, Cryptosporidium parvum
QISESLEGKIGKPEI

SEQ ID NO: 2350197 - protein, 5 aa, Cryptosporidium parvum
QISNT

SEQ ID NO: 2350198 - protein, 9 aa, Cryptosporidium parvum
QISTTSKDN

SEQ ID NO: 2350199 - protein, 5 aa, Cryptosporidium parvum
QITPP

SEQ ID NO: 2350200 - protein, 16 aa, Cryptosporidium parvum
QITVKEPSKASEGDTN

SEQ ID NO: 2350201 - protein, 20 aa, Cryptosporidium parvum
QKAELKSELNRNKVKSSDFE

SEQ ID NO: 2350202 - protein, 9 aa, Cryptosporidium parvum
QKDDSEPID

SEQ ID NO: 2350203 - protein, 12 aa, Cryptosporidium parvum
QKDECTKLEQSE

SEQ ID NO: 2350204 - protein, 11 aa, Cryptosporidium parvum
QKEFNNDEQKL

SEQ ID NO: 2350205 - protein, 9 aa, Cryptosporidium parvum
QKEKDSGAE

SEQ ID NO: 2350206 - protein, 5 aa, Cryptosporidium parvum
QKGSS

SEQ ID NO: 2350207 - protein, 8 aa, Cryptosporidium parvum
QKKENNEL

SEQ ID NO: 2350208 - protein, 5 aa, Cryptosporidium parvum
QKKSQ

SEQ ID NO: 2350209 - protein, 51 aa, Cryptosporidium parvum; identical to SEQ ID NO: 2157600

SEQ ID NO: 2350210 - protein, 23 aa, Cryptosporidium parvum
QKLDTSEMEEINPGRRNQENHSS

SEQ ID NO: 2350211 - protein, 4 aa, Cryptosporidium parvum
QKNI

SEQ ID NO: 2350212 - protein, 5 aa, Cryptosporidium parvum
QKNKK

SEQ ID NO: 2350213 - protein, 9 aa, Cryptosporidium parvum
QKNRQLEVE

SEQ ID NO: 2350214 - protein, 6 aa, Cryptosporidium parvum
QKNTEN

SEQ ID NO: 2350215 - protein, 8 aa, Cryptosporidium parvum
QKPDGTDL

SEQ ID NO: 2350216 - protein, 4 aa, Cryptosporidium parvum
QKPV

SEQ ID NO: 2350217 - protein, 6 aa, Cryptosporidium parvum
QKSEIE

SEQ ID NO: 2350218 - protein, 8 aa, Cryptosporidium parvum
QKSEQKRI

SEQ ID NO: 2350219 - protein, 8 aa, Cryptosporidium parvum
QKSGKKSV

SEQ ID NO: 2350220 - protein, 7 aa, Cryptosporidium parvum
QKSNSRI

SEQ ID NO: 2350221 - protein, 8 aa, Cryptosporidium parvum
QKSTQVDA

SEQ ID NO: 2350222 - protein, 20 aa, Cryptosporidium parvum
QKSTSSFDFTGGRPNSALSP

SEQ ID NO: 2350223 - protein, 13 aa, Cryptosporidium parvum
QLCGTGKKDETDL

SEQ ID NO: 2350224 - protein, 10 aa, Cryptosporidium parvum
QLGKAGKSNF

SEQ ID NO: 2350225 - protein, 7 aa, Cryptosporidium parvum
QLKDGSE

SEQ ID NO: 2350226 - protein, 6 aa, Cryptosporidium parvum
QLNDSE

SEQ ID NO: 2350227 - protein, 10 aa, Cryptosporidium parvum
QLNKLSSNKD

SEQ ID NO: 2350228 - protein, 7 aa, Cryptosporidium parvum
QLPNSSN

SEQ ID NO: 2350229 - protein, 6 aa, Cryptosporidium parvum
QLPPDD

SEQ ID NO: 2350230 - protein, 6 aa, Cryptosporidium parvum
QLPPGI

SEQ ID NO: 2350231 - protein, 5 aa, Cryptosporidium parvum
QLSEH

SEQ ID NO: 2350232 - protein, 24 aa, Cryptosporidium parvum
QMDSNSVKTSPSLVPNSGGNQLTT

SEQ ID NO: 2350233 - protein, 8 aa, Cryptosporidium parvum
QMDSSNGA

SEQ ID NO: 2350234 - protein, 20 aa, Cryptosporidium parvum
QMESNSNKSEFDLNSSSQRF

SEQ ID NO: 2350235 - protein, 12 aa, Cryptosporidium parvum
QMRSESKKAQLR

SEQ ID NO: 2350236 - protein, 5 aa, Cryptosporidium parvum
QNDSK

SEQ ID NO: 2350237 - protein, 10 aa, Cryptosporidium parvum
QNDVEDIQSS

SEQ ID NO: 2350238 - protein, 9 aa, Cryptosporidium parvum
QNEEKQTAE

SEQ ID NO: 2350239 - protein, 10 aa, Cryptosporidium parvum
QNEKTSESKL

SEQ ID NO: 2350240 - protein, 5 aa, Cryptosporidium parvum
QNEVQ

SEQ ID NO: 2350241 - protein, 9 aa, Cryptosporidium parvum
QNGEKYEGY

SEQ ID NO: 2350242 - protein, 6 aa, Cryptosporidium parvum
QNGNDD

SEQ ID NO: 2350243 - protein, 8 aa, Cryptosporidium parvum
QNGQNNPL

SEQ ID NO: 2350244 - protein, 43 aa, Cryptosporidium parvum; identical to SEQ ID NO: 2276991

SEQ ID NO: 2350245 - protein, 10 aa, Cryptosporidium parvum
QNHGGKEEQI

SEQ ID NO: 2350246 - protein, 7 aa, Cryptosporidium parvum
QNKDGSF

SEQ ID NO: 2350247 - protein, 5 aa, Cryptosporidium parvum
QNKEK

SEQ ID NO: 2350248 - protein, 6 aa, Cryptosporidium parvum
QNKGLN

SEQ ID NO: 2350249 - protein, 18 aa, Cryptosporidium parvum
QNKSKQEKEENLTKETKI

SEQ ID NO: 2350250 - protein, 17 aa, Cryptosporidium parvum
QNLTETPRLGNNMHDSS

SEQ ID NO: 2350251 - protein, 13 aa, Cryptosporidium parvum
QNNSYSQLKPHPD

SEQ ID NO: 2350252 - protein, 7 aa, Cryptosporidium parvum
QNPIEDG

SEQ ID NO: 2350253 - protein, 6 aa, Cryptosporidium parvum
QNPNYG

SEQ ID NO: 2350254 - protein, 7 aa, Cryptosporidium parvum
QNPPYTS

SEQ ID NO: 2350255 - protein, 5 aa, Cryptosporidium parvum
QNQCT

SEQ ID NO: 2350256 - protein, 13 aa, Cryptosporidium parvum
QNSNLKSQSQLNE

SEQ ID NO: 2350257 - protein, 9 aa, Cryptosporidium parvum
QNSQYSTEI

SEQ ID NO: 2350258 - protein, 9 aa, Cryptosporidium parvum
QNSSLKQMG

SEQ ID NO: 2350259 - protein, 9 aa, Cryptosporidium parvum
QNTNTNPNF

SEQ ID NO: 2350260 - protein, 9 aa, Cryptosporidium parvum
QNTPPNRYV

SEQ ID NO: 2350261 - protein, 8 aa, Cryptosporidium parvum
QNVAGQRI

SEQ ID NO: 2350262 - protein, 9 aa, Cryptosporidium parvum
QNVKGSEMQ

SEQ ID NO: 2350263 - protein, 4 aa, Cryptosporidium parvum
QPFK

SEQ ID NO: 2350264 - protein, 4 aa, Cryptosporidium parvum
QPGA

SEQ ID NO: 2350265 - protein, 41 aa, Cryptosporidium parvum; identical to SEQ ID NO: 2277171

SEQ ID NO: 2350266 - protein, 19 aa, Cryptosporidium parvum
QPIEDDNCSESSIISFLSE

SEQ ID NO: 2350267 - protein, 5 aa, Cryptosporidium parvum
QPLKN

SEQ ID NO: 2350268 - protein, 19 aa, Cryptosporidium parvum
QPPPPQKVDQKDSDNSRLQ

SEQ ID NO: 2350269 - protein, 5 aa, Cryptosporidium parvum
QPRRV

SEQ ID NO: 2350270 - protein, 5 aa, Cryptosporidium parvum
QPSEL

SEQ ID NO: 2350271 - protein, 15 aa, Cryptosporidium parvum
QPSQVRRNHYISQNH

SEQ ID NO: 2350272 - protein, 11 aa, Cryptosporidium parvum
QPSSAKVPWGG

SEQ ID NO: 2350273 - protein, 5 aa, Cryptosporidium parvum
QPSSF

SEQ ID NO: 2350274 - protein, 4 aa, Cryptosporidium parvum
QPTI

SEQ ID NO: 2350275 - protein, 4 aa, Cryptosporidium parvum
QPVD

SEQ ID NO: 2350276 - protein, 6 aa, Cryptosporidium parvum
QPVKSH

SEQ ID NO: 2350277 - protein, 5 aa, Cryptosporidium parvum
QPYPT

SEQ ID NO: 2350278 - protein, 5 aa, Cryptosporidium parvum
QQASN

SEQ ID NO: 2350279 - protein, 5 aa, Cryptosporidium parvum
QQGIQ

SEQ ID NO: 2350280 - protein, 9 aa, Cryptosporidium parvum
QQGNSLSKV

SEQ ID NO: 2350281 - protein, 4 aa, Cryptosporidium parvum
QQIN

SEQ ID NO: 2350282 - protein, 6 aa, Cryptosporidium parvum
QQKGER

SEQ ID NO: 2350283 - protein, 9 aa, Cryptosporidium parvum
QQKNSFKQK

SEQ ID NO: 2350284 - protein, 14 aa, Cryptosporidium parvum
QQMQGASGAESKAV

SEQ ID NO: 2350285 - protein, 5 aa, Cryptosporidium parvum
QQNQR

SEQ ID NO: 2350286 - protein, 31 aa, Cryptosporidium parvum; identical to SEQ ID NO: 2277285

SEQ ID NO: 2350287 - protein, 18 aa, Cryptosporidium parvum
QQPNGIDRSEKRKERENI

SEQ ID NO: 2350288 - protein, 8 aa, Cryptosporidium parvum
QQQQQQRM

SEQ ID NO: 2350289 - protein, 6 aa, Cryptosporidium parvum
QQSSSM

SEQ ID NO: 2350290 - protein, 6 aa, Cryptosporidium parvum
QQSWNK

SEQ ID NO: 2350291 - protein, 6 aa, Cryptosporidium parvum
QQTAGR

SEQ ID NO: 2350292 - protein, 8 aa, Cryptosporidium parvum
QQTEGIPF

SEQ ID NO: 2350293 - protein, 12 aa, Cryptosporidium parvum
QQYPIDQNPRIN

SEQ ID NO: 2350294 - protein, 8 aa, Cryptosporidium parvum
QRDYNNNT

SEQ ID NO: 2350295 - protein, 11 aa, Cryptosporidium parvum
QRELSNTEDQI

SEQ ID NO: 2350296 - protein, 8 aa, Cryptosporidium parvum
QRKLAERN

SEQ ID NO: 2350297 - protein, 14 aa, Cryptosporidium parvum
QRNQSENDQEEESE

SEQ ID NO: 2350298 - protein, 10 aa, Cryptosporidium parvum
QRQKAANRAL

SEQ ID NO: 2350299 - protein, 7 aa, Cryptosporidium parvum
QSATRPI

SEQ ID NO: 2350300 - protein, 8 aa, Cryptosporidium parvum
QSDKDLSA

SEQ ID NO: 2350301 - protein, 12 aa, Cryptosporidium parvum
QSDTKNESKSIG

SEQ ID NO: 2350302 - protein, 8 aa, Cryptosporidium parvum
QSEDRNQI

SEQ ID NO: 2350303 - protein, 4 aa, Cryptosporidium parvum
QSFP

SEQ ID NO: 2350304 - protein, 24 aa, Cryptosporidium parvum
QSFSSSNINQRQIGDNLKNPNHGI

SEQ ID NO: 2350305 - protein, 11 aa, Cryptosporidium parvum
QSGGTNPMGVP

SEQ ID NO: 2350306 - protein, 9 aa, Cryptosporidium parvum
QSIGEPGTQ

SEQ ID NO: 2350307 - protein, 7 aa, Cryptosporidium parvum
QSIGMGK

SEQ ID NO: 2350308 - protein, 8 aa, Cryptosporidium parvum
QSITPAGR

SEQ ID NO: 2350309 - protein, 22 aa, Cryptosporidium parvum
QSITPNKPVPGENSISVSPQTG

SEQ ID NO: 2350310 - protein, 7 aa, Cryptosporidium parvum
QSKSDCS

SEQ ID NO: 2350311 - protein, 5 aa, Cryptosporidium parvum
QSLQK

SEQ ID NO: 2350312 - protein, 8 aa, Cryptosporidium parvum
QSLSSTEE

SEQ ID NO: 2350313 - protein, 9 aa, Cryptosporidium parvum
QSNKDSEIS

SEQ ID NO: 2350314 - protein, 14 aa, Cryptosporidium parvum
QSNLNNSSNDFNSK

SEQ ID NO: 2350315 - protein, 11 aa, Cryptosporidium parvum
QSNLQESHSRN

SEQ ID NO: 2350316 - protein, 6 aa, Cryptosporidium parvum
QSPPGV

SEQ ID NO: 2350317 - protein, 8 aa, Cryptosporidium parvum
QSPTGSGK

SEQ ID NO: 2350318 - protein, 19 aa, Cryptosporidium parvum
QSQDQYKRKINSPIKNIHK

SEQ ID NO: 2350319 - protein, 6 aa, Cryptosporidium parvum
QSQNPI

SEQ ID NO: 2350320 - protein, 11 aa, Cryptosporidium parvum
QSQNSEKQQAI

SEQ ID NO: 2350321 - protein, 8 aa, Cryptosporidium parvum
QSQQQAQH

SEQ ID NO: 2350322 - protein, 11 aa, Cryptosporidium parvum
QSQTKLEKTTF

SEQ ID NO: 2350323 - protein, 15 aa, Cryptosporidium parvum
QSQYTSGIGSNSQIY

SEQ ID NO: 2350324 - protein, 13 aa, Cryptosporidium parvum
QSSKDDQKKRDEL

SEQ ID NO: 2350325 - protein, 6 aa, Cryptosporidium parvum
QSSNSR

SEQ ID NO: 2350326 - protein, 6 aa, Cryptosporidium parvum
QSSQNT

SEQ ID NO: 2350327 - protein, 5 aa, Cryptosporidium parvum
QSSSC

SEQ ID NO: 2350328 - protein, 6 aa, Cryptosporidium parvum
QSSTFS

SEQ ID NO: 2350329 - protein, 6 aa, Cryptosporidium parvum
QSSTLE

SEQ ID NO: 2350330 - protein, 4 aa, Cryptosporidium parvum
QSSV

SEQ ID NO: 2350331 - protein, 5 aa, Cryptosporidium parvum
QSSVE

SEQ ID NO: 2350332 - protein, 17 aa, Cryptosporidium parvum
QSTVQNPQKKVANSQIG

SEQ ID NO: 2350333 - protein, 11 aa, Cryptosporidium parvum
QSVGGKRIRAE

SEQ ID NO: 2350334 - protein, 8 aa, Cryptosporidium parvum
QSVSNKEN

SEQ ID NO: 2350335 - protein, 6 aa, Cryptosporidium parvum
QTCDNE

SEQ ID NO: 2350336 - protein, 10 aa, Cryptosporidium parvum
QTDGGHQSDL

SEQ ID NO: 2350337 - protein, 13 aa, Cryptosporidium parvum
QTDKNSSISNIEN

SEQ ID NO: 2350338 - protein, 5 aa, Cryptosporidium parvum
QTDPI

SEQ ID NO: 2350339 - protein, 15 aa, Cryptosporidium parvum
QTDSSGEISNTKEYD

SEQ ID NO: 2350340 - protein, 8 aa, Cryptosporidium parvum
QTGEEEQS

SEQ ID NO: 2350341 - protein, 7 aa, Cryptosporidium parvum
QTGNEAK

SEQ ID NO: 2350342 - protein, 11 aa, Cryptosporidium parvum
QTGTGKTYTME

SEQ ID NO: 2350343 - protein, 6 aa, Cryptosporidium parvum
QTHNKK

SEQ ID NO: 2350344 - protein, 49 aa, Cryptosporidium parvum
QTKSQNSKYSLRNKSQTSASSTNNSPKKGGRGSSFNHNKANSNNQNRQF

SEQ ID NO: 2350345 - protein, 13 aa, Cryptosporidium parvum
QTKYQQQDQAETV

SEQ ID NO: 2350346 - protein, 9 aa, Cryptosporidium parvum
QTLSTEKSK

SEQ ID NO: 2350347 - protein, 4 aa, Cryptosporidium parvum
QTNF

SEQ ID NO: 2350348 - protein, 28 aa, Cryptosporidium parvum
QTNSDKTRQDLEQNKEVVERKDEEIANS

SEQ ID NO: 2350349 - protein, 5 aa, Cryptosporidium parvum
QTPMG

SEQ ID NO: 2350350 - protein, 10 aa, Cryptosporidium parvum
QTPSQTTYGK

SEQ ID NO: 2350351 - protein, 10 aa, Cryptosporidium parvum
QTQGESEESF

SEQ ID NO: 2350352 - protein, 8 aa, Cryptosporidium parvum
QTQSPTMS

SEQ ID NO: 2350353 - protein, 5 aa, Cryptosporidium parvum
QTRDS

SEQ ID NO: 2350354 - protein, 12 aa, Cryptosporidium parvum
QTRKDQNSAQRS

SEQ ID NO: 2350355 - protein, 12 aa, Cryptosporidium parvum
QTRNSSKDHSIT

SEQ ID NO: 2350356 - protein, 9 aa, Cryptosporidium parvum
QTSEETLQS

SEQ ID NO: 2350357 - protein, 15 aa, Cryptosporidium parvum
QTSISEVSRNKRPLT

SEQ ID NO: 2350358 - protein, 9 aa, Cryptosporidium parvum
QTSSGKTHT

SEQ ID NO: 2350359 - protein, 4 aa, Cryptosporidium parvum
QTST

SEQ ID NO: 2350360 - protein, 5 aa, Cryptosporidium parvum
QTTST

SEQ ID NO: 2350361 - protein, 13 aa, Cryptosporidium parvum
QTVDSQRAKIEDE

SEQ ID NO: 2350362 - protein, 6 aa, Cryptosporidium parvum
QVDSPE

SEQ ID NO: 2350363 - protein, 5 aa, Cryptosporidium parvum
QVETE

SEQ ID NO: 2350364 - protein, 11 aa, Cryptosporidium parvum
QVNEKDQDWER

SEQ ID NO: 2350365 - protein, 29 aa, Cryptosporidium parvum
QVNSQNTRGSAQQGPKLAGAQPIRQGGCC

SEQ ID NO: 2350366 - protein, 6 aa, Cryptosporidium parvum
QVYEGE

SEQ ID NO: 2350367 - protein, 13 aa, Cryptosporidium parvum
QYAPYSRLGTPDD

SEQ ID NO: 2350368 - protein, 7 aa, Cryptosporidium parvum
QYDGIDS

SEQ ID NO: 2350369 - protein, 16 aa, Cryptosporidium parvum
QYEDTSHKDYSQNNPR

SEQ ID NO: 2350370 - protein, 20 aa, Cryptosporidium parvum
QYNYRRDEDFRREDYPRSHN

SEQ ID NO: 2350371 - protein, 8 aa, Cryptosporidium parvum
RAGKDTKI

SEQ ID NO: 2350372 - protein, 4 aa, Cryptosporidium parvum
RAGP

SEQ ID NO: 2350373 - protein, 4 aa, Cryptosporidium parvum
RAGV

SEQ ID NO: 2350374 - protein, 9 aa, Cryptosporidium parvum
RAKSGSKKK

SEQ ID NO: 2350375 - protein, 10 aa, Cryptosporidium parvum
RANNKSNNLE

SEQ ID NO: 2350376 - protein, 12 aa, Cryptosporidium parvum
RAPPSEVESLPQ

SEQ ID NO: 2350377 - protein, 6 aa, Cryptosporidium parvum
RATGGR

SEQ ID NO: 2350378 - protein, 7 aa, Cryptosporidium parvum
RCGGEQS

SEQ ID NO: 2350379 - protein, 8 aa, Cryptosporidium parvum
RDELSGEV

SEQ ID NO: 2350380 - protein, 7 aa, Cryptosporidium parvum
RDEYERR

SEQ ID NO: 2350381 - protein, 4 aa, Cryptosporidium parvum
RDID

SEQ ID NO: 2350382 - protein, 8 aa, Cryptosporidium parvum
RDKESGTL

SEQ ID NO: 2350383 - protein, 6 aa, Cryptosporidium parvum
RDKTGS

SEQ ID NO: 2350384 - protein, 4 aa, Cryptosporidium parvum
RDPA

SEQ ID NO: 2350385 - protein, 6 aa, Cryptosporidium parvum
RDQLHS

SEQ ID NO: 2350386 - protein, 17 aa, Cryptosporidium parvum
RDSEELKPGEKPFPEGV

SEQ ID NO: 2350387 - protein, 6 aa, Cryptosporidium parvum
RDSSEL

SEQ ID NO: 2350388 - protein, 10 aa, Cryptosporidium parvum
RDTEKPEYNP

SEQ ID NO: 2350389 - protein, 9 aa, Cryptosporidium parvum
REAEELTET

SEQ ID NO: 2350390 - protein, 5 aa, Cryptosporidium parvum
REAEG

SEQ ID NO: 2350391 - protein, 4 aa, Cryptosporidium parvum
REDD

SEQ ID NO: 2350392 - protein, 4 aa, Cryptosporidium parvum
REGC

SEQ ID NO: 2350393 - protein, 9 aa, Cryptosporidium parvum
REGDALRSS

SEQ ID NO: 2350394 - protein, 4 aa, Cryptosporidium parvum
REGE

SEQ ID NO: 2350395 - protein, 4 aa, Cryptosporidium parvum
REGL

SEQ ID NO: 2350396 - protein, 9 aa, Cryptosporidium parvum
REGSPGSTI

SEQ ID NO: 2350397 - protein, 7 aa, Cryptosporidium parvum
REKDQAI

SEQ ID NO: 2350398 - protein, 13 aa, Cryptosporidium parvum
REKQRKEENERKR

SEQ ID NO: 2350399 - protein, 7 aa, Cryptosporidium parvum
RENGKRK

SEQ ID NO: 2350400 - protein, 36 aa, Cryptosporidium parvum
REQSLSTSNEIDSIDNEHKDSSNFTTESELTNTRDK

SEQ ID NO: 2350401 - protein, 11 aa, Cryptosporidium parvum
RESLESRAERS

SEQ ID NO: 2350402 - protein, 11 aa, Cryptosporidium parvum
RESRGDNKYRG

SEQ ID NO: 2350403 - protein, 10 aa, Cryptosporidium parvum
RESSDGSKSV

SEQ ID NO: 2350404 - protein, 7 aa, Cryptosporidium parvum
RETNGRI

SEQ ID NO: 2350405 - protein, 9 aa, Cryptosporidium parvum
REVNARKNK

SEQ ID NO: 2350406 - protein, 5 aa, Cryptosporidium parvum
RFDQD

SEQ ID NO: 2350407 - protein, 11 aa, Cryptosporidium parvum
RGANVDPTGEW

SEQ ID NO: 2350408 - protein, 11 aa, Cryptosporidium parvum
RGDKESKGLDK

SEQ ID NO: 2350409 - protein, 5 aa, Cryptosporidium parvum
RGEEL

SEQ ID NO: 2350410 - protein, 5 aa, Cryptosporidium parvum
RGEKL

SEQ ID NO: 2350411 - protein, 15 aa, Cryptosporidium parvum
RGGFSTVNKTNNDVE

SEQ ID NO: 2350412 - protein, 7 aa, Cryptosporidium parvum
RGGPISS

SEQ ID NO: 2350413 - protein, 7 aa, Cryptosporidium parvum
RGGSNTV

SEQ ID NO: 2350414 - protein, 14 aa, Cryptosporidium parvum
RGLNRSTPFSNNQT

SEQ ID NO: 2350415 - protein, 8 aa, Cryptosporidium parvum
RGLPSRKN

SEQ ID NO: 2350416 - protein, 8 aa, Cryptosporidium parvum
RGNGKISR

SEQ ID NO: 2350417 - protein, 8 aa, Cryptosporidium parvum
RGNSPPGK

SEQ ID NO: 2350418 - protein, 4 aa, Cryptosporidium parvum
RGNV

SEQ ID NO: 2350419 - protein, 8 aa, Cryptosporidium parvum
RGPYSPYS

SEQ ID NO: 2350420 - protein, 16 aa, Cryptosporidium parvum
RGRSYSNGNEGGNYRS

SEQ ID NO: 2350421 - protein, 4 aa, Cryptosporidium parvum
RGRT

SEQ ID NO: 2350422 - protein, 12 aa, Cryptosporidium parvum
RGSKSITRSRRK

SEQ ID NO: 2350423 - protein, 5 aa, Cryptosporidium parvum
RGVGG

SEQ ID NO: 2350424 - protein, 17 aa, Cryptosporidium parvum
RGYPNQINPKTLNSPTR

SEQ ID NO: 2350425 - protein, 16 aa, Cryptosporidium parvum
RHAQHKDDMTGTGSFN

SEQ ID NO: 2350426 - protein, 14 aa, Cryptosporidium parvum
RHESPSEEKKENFS

SEQ ID NO: 2350427 - protein, 18 aa, Cryptosporidium parvum
RHGKPGVGSTSSSRFIPL

SEQ ID NO: 2350428 - protein, 6 aa, Cryptosporidium parvum
RHRGLP

SEQ ID NO: 2350429 - protein, 13 aa, Cryptosporidium parvum
RHTSRHISRKTTE

SEQ ID NO: 2350430 - protein, 6 aa, Cryptosporidium parvum
RIEKQR

SEQ ID NO: 2350431 - protein, 4 aa, Cryptosporidium parvum
RIGQ

SEQ ID NO: 2350432 - protein, 13 aa, Cryptosporidium parvum
RIHDQEKSSKFDN

SEQ ID NO: 2350433 - protein, 9 aa, Cryptosporidium parvum
RINSGGTTV

SEQ ID NO: 2350434 - protein, 19 aa, Cryptosporidium parvum
RIRYDEDDDEENIDLGRNE

SEQ ID NO: 2350435 - protein, 18 aa, Cryptosporidium parvum
RISTSNLHKNTSSDIGDV

SEQ ID NO: 2350436 - protein, 18 aa, Cryptosporidium parvum
RKALSSNSFNNRENRSAF

SEQ ID NO: 2350437 - protein, 6 aa, Cryptosporidium parvum
RKCSSS

SEQ ID NO: 2350438 - protein, 9 aa, Cryptosporidium parvum
RKCSTKDEK

SEQ ID NO: 2350439 - protein, 12 aa, Cryptosporidium parvum
RKDEVERVAKAN

SEQ ID NO: 2350440 - protein, 17 aa, Cryptosporidium parvum
RKDVNSIGEQIKRLDLN

SEQ ID NO: 2350441 - protein, 6 aa, Cryptosporidium parvum
RKEQRA

SEQ ID NO: 2350442 - protein, 8 aa, Cryptosporidium parvum
RKEREQLK

SEQ ID NO: 2350443 - protein, 9 aa, Cryptosporidium parvum
RKETDTGPV

SEQ ID NO: 2350444 - protein, 17 aa, Cryptosporidium parvum
RKEVDRARGASPNTRSA

SEQ ID NO: 2350445 - protein, 12 aa, Cryptosporidium parvum
RKGANEATKALN

SEQ ID NO: 2350446 - protein, 9 aa, Cryptosporidium parvum
RKGHSVGDI

SEQ ID NO: 2350447 - protein, 34 aa, Cryptosporidium parvum
RKGIQGGTGGLNKVNNGEEEDEDDEEEDEDSREF

SEQ ID NO: 2350448 - protein, 7 aa, Cryptosporidium parvum
RKGLPTQ

SEQ ID NO: 2350449 - protein, 7 aa, Cryptosporidium parvum
RKKAECD

SEQ ID NO: 2350450 - protein, 15 aa, Cryptosporidium parvum
RKKAKKEMEEATDPT

SEQ ID NO: 2350451 - protein, 11 aa, Cryptosporidium parvum
RKKEEENNQKI

SEQ ID NO: 2350452 - protein, 4 aa, Cryptosporidium parvum
RKKS

SEQ ID NO: 2350453 - protein, 5 aa, Cryptosporidium parvum
RKKYG

SEQ ID NO: 2350454 - protein, 10 aa, Cryptosporidium parvum
RKMEDNGTNH

SEQ ID NO: 2350455 - protein, 7 aa, Cryptosporidium parvum
RKNDHDK

SEQ ID NO: 2350456 - protein, 13 aa, Cryptosporidium parvum
RKNKGQSETISTG

SEQ ID NO: 2350457 - protein, 19 aa, Cryptosporidium parvum
RKNRSTKKGKYTNADAADL

SEQ ID NO: 2350458 - protein, 29 aa, Cryptosporidium parvum
RKNSYENSNIENSNISSDFTDSKVNKNNS

SEQ ID NO: 2350459 - protein, 9 aa, Cryptosporidium parvum
RKNSYKNIE

SEQ ID NO: 2350460 - protein, 5 aa, Cryptosporidium parvum
RKQDL

SEQ ID NO: 2350461 - protein, 5 aa, Cryptosporidium parvum
RKRRK

SEQ ID NO: 2350462 - protein, 8 aa, Cryptosporidium parvum
RKRRTAET

SEQ ID NO: 2350463 - protein, 13 aa, Cryptosporidium parvum
RKSERQRIDQSGV

SEQ ID NO: 2350464 - protein, 7 aa, Cryptosporidium parvum
RKSISEK

SEQ ID NO: 2350465 - protein, 9 aa, Cryptosporidium parvum
RKSKTSDIS

SEQ ID NO: 2350466 - protein, 6 aa, Cryptosporidium parvum
RKVSRH

SEQ ID NO: 2350467 - protein, 9 aa, Cryptosporidium parvum
RLEKQEDTL

SEQ ID NO: 2350468 - protein, 20 aa, Cryptosporidium parvum
RLKGQSSAQSSGLENSALSK

SEQ ID NO: 2350469 - protein, 21 aa, Cryptosporidium parvum
RLRKKEEDGNVFENKQDSHIY

SEQ ID NO: 2350470 - protein, 9 aa, Cryptosporidium parvum
RLSKDKNNM

SEQ ID NO: 2350471 - protein, 27 aa, Cryptosporidium parvum
RMKKGGKHQKDEEKREKTKHGKKKKAP

SEQ ID NO: 2350472 - protein, 16 aa, Cryptosporidium parvum
RNAPGQMGTKSFGGSR

SEQ ID NO: 2350473 - protein, 6 aa, Cryptosporidium parvum
RNDAGH

SEQ ID NO: 2350474 - protein, 17 aa, Cryptosporidium parvum
RNEAGKASHISLPPSNK

SEQ ID NO: 2350475 - protein, 7 aa, Cryptosporidium parvum
RNEESKN

SEQ ID NO: 2350476 - protein, 12 aa, Cryptosporidium parvum
RNELNSKVKELK

SEQ ID NO: 2350477 - protein, 7 aa, Cryptosporidium parvum
RNESNAY

SEQ ID NO: 2350478 - protein, 20 aa, Cryptosporidium parvum
RNGGFQQKPGENPGLTNSGH

SEQ ID NO: 2350479 - protein, 5 aa, Cryptosporidium parvum
RNGLE

SEQ ID NO: 2350480 - protein, 6 aa, Cryptosporidium parvum
RNGRHS

SEQ ID NO: 2350481 - protein, 14 aa, Cryptosporidium parvum
RNKDKEEAKQVKVT

SEQ ID NO: 2350482 - protein, 7 aa, Cryptosporidium parvum
RNKKELA

SEQ ID NO: 2350483 - protein, 6 aa, Cryptosporidium parvum
RNKYNS

SEQ ID NO: 2350484 - protein, 9 aa, Cryptosporidium parvum
RNNGKKNQA

SEQ ID NO: 2350485 - protein, 20 aa, Cryptosporidium parvum
RNNLSKNTLNKDYDPGLEPN

SEQ ID NO: 2350486 - protein, 9 aa, Cryptosporidium parvum
RNNNPLDRP

SEQ ID NO: 2350487 - protein, 4 aa, Cryptosporidium parvum
RNQE

SEQ ID NO: 2350488 - protein, 20 aa, Cryptosporidium parvum
RNQQQVNTSSAATLSYTNNG

SEQ ID NO: 2350489 - protein, 21 aa, Cryptosporidium parvum
RNQRENMTGEANIPNQGNDPH

SEQ ID NO: 2350490 - protein, 5 aa, Cryptosporidium parvum
RNRSK

SEQ ID NO: 2350491 - protein, 13 aa, Cryptosporidium parvum
RNSDNSSGSSRNR

SEQ ID NO: 2350492 - protein, 60 aa, Cryptosporidium parvum; identical to SEQ ID NO: 2278721

SEQ ID NO: 2350493 - protein, 5 aa, Cryptosporidium parvum
RNSTV

SEQ ID NO: 2350494 - protein, 10 aa, Cryptosporidium parvum
RNTAENSLNE

SEQ ID NO: 2350495 - protein, 5 aa, Cryptosporidium parvum
RPAMT

SEQ ID NO: 2350496 - protein, 9 aa, Cryptosporidium parvum
RPGHSKEQC

SEQ ID NO: 2350497 - protein, 6 aa, Cryptosporidium parvum
RPGNRV

SEQ ID NO: 2350498 - protein, 5 aa, Cryptosporidium parvum
RPIAN

SEQ ID NO: 2350499 - protein, 8 aa, Cryptosporidium parvum
RPISTSRE

SEQ ID NO: 2350500 - protein, 10 aa, Cryptosporidium parvum
RPNLASRRPL

SEQ ID NO: 2350501 - protein, 12 aa, Cryptosporidium parvum
RPPNEAEKTHGN

SEQ ID NO: 2350502 - protein, 6 aa, Cryptosporidium parvum
RPRRRC

SEQ ID NO: 2350503 - protein, 6 aa, Cryptosporidium parvum
RPSENS

SEQ ID NO: 2350504 - protein, 32 aa, Cryptosporidium parvum; identical to SEQ ID NO: 2278807

SEQ ID NO: 2350505 - protein, 7 aa, Cryptosporidium parvum
RPSIYKS

SEQ ID NO: 2350506 - protein, 18 aa, Cryptosporidium parvum
RPSPVDEEKKQAENSEKK

SEQ ID NO: 2350507 - protein, 5 aa, Cryptosporidium parvum
RPSVE

SEQ ID NO: 2350508 - protein, 4 aa, Cryptosporidium parvum
RPTI

SEQ ID NO: 2350509 - protein, 5 aa, Cryptosporidium parvum
RPTSE

SEQ ID NO: 2350510 - protein, 15 aa, Cryptosporidium parvum
RPWEDPNPEAGERTI

SEQ ID NO: 2350511 - protein, 25 aa, Cryptosporidium parvum
RQAGQRRQSGAGLTSTASGRNLGSN

SEQ ID NO: 2350512 - protein, 14 aa, Cryptosporidium parvum
RQDDKEDPITGEKR

SEQ ID NO: 2350513 - protein, 8 aa, Cryptosporidium parvum
RQDPNINS

SEQ ID NO: 2350514 - protein, 10 aa, Cryptosporidium parvum
RQEDPTTKKL

SEQ ID NO: 2350515 - protein, 8 aa, Cryptosporidium parvum
RQEDSRKA

SEQ ID NO: 2350516 - protein, 30 aa, Cryptosporidium parvum
RQGKDESETKNNGLSQINNEGSQRVTPSYY

SEQ ID NO: 2350517 - protein, 4 aa, Cryptosporidium parvum
RQNM

SEQ ID NO: 2350518 - protein, 8 aa, Cryptosporidium parvum
RQNSARGI

SEQ ID NO: 2350519 - protein, 38 aa, Cryptosporidium parvum
RQSNENLAKRSSISRSGTGIKLSEDQSSNANSNTINRP

SEQ ID NO: 2350520 - protein, 5 aa, Cryptosporidium parvum
RQTEI

SEQ ID NO: 2350521 - protein, 18 aa, Cryptosporidium parvum
RRAKIKNKDEETSKEDDW

SEQ ID NO: 2350522 - protein, 6 aa, Cryptosporidium parvum
RRDGDN

SEQ ID NO: 2350523 - protein, 5 aa, Cryptosporidium parvum
RRDHK

SEQ ID NO: 2350524 - protein, 13 aa, Cryptosporidium parvum
RREKQQKAFRGRK

SEQ ID NO: 2350525 - protein, 6 aa, Cryptosporidium parvum
RRESIS

SEQ ID NO: 2350526 - protein, 5 aa, Cryptosporidium parvum
RRETI

SEQ ID NO: 2350527 - protein, 9 aa, Cryptosporidium parvum
RRGITEKGG

SEQ ID NO: 2350528 - protein, 14 aa, Cryptosporidium parvum
RRHPGGRGRNSRGT

SEQ ID NO: 2350529 - protein, 6 aa, Cryptosporidium parvum
RRHSNE

SEQ ID NO: 2350530 - protein, 13 aa, Cryptosporidium parvum
RRKGKAVDNSTQA

SEQ ID NO: 2350531 - protein, 19 aa, Cryptosporidium parvum
RRKNADEKSDEKDAQKASG

SEQ ID NO: 2350532 - protein, 5 aa, Cryptosporidium parvum
RRKTI

SEQ ID NO: 2350533 - protein, 17 aa, Cryptosporidium parvum
RRNRYIPSDEEYQEEES

SEQ ID NO: 2350534 - protein, 5 aa, Cryptosporidium parvum
RRRDL

SEQ ID NO: 2350535 - protein, 12 aa, Cryptosporidium parvum
RRRGRRRRPGKL

SEQ ID NO: 2350536 - protein, 6 aa, Cryptosporidium parvum
RRSENQ

SEQ ID NO: 2350537 - protein, 21 aa, Cryptosporidium parvum
RRSGSDQKTSGSQKPKGLQSE

SEQ ID NO: 2350538 - protein, 7 aa, Cryptosporidium parvum
RRSSDGC

SEQ ID NO: 2350539 - protein, 4 aa, Cryptosporidium parvum
RRTG

SEQ ID NO: 2350540 - protein, 7 aa, Cryptosporidium parvum
RRTGTGM

SEQ ID NO: 2350541 - protein, 5 aa, Cryptosporidium parvum
RRTVE

SEQ ID NO: 2350542 - protein, 5 aa, Cryptosporidium parvum
RRVHS

SEQ ID NO: 2350543 - protein, 7 aa, Cryptosporidium parvum
RSDITGR

SEQ ID NO: 2350544 - protein, 12 aa, Cryptosporidium parvum
RSDKPRNLNYDL

SEQ ID NO: 2350545 - protein, 12 aa, Cryptosporidium parvum
RSEGTSEPKDIS

SEQ ID NO: 2350546 - protein, 7 aa, Cryptosporidium parvum
RSENIDN

SEQ ID NO: 2350547 - protein, 13 aa, Cryptosporidium parvum
RSFKNSSGINLEK

SEQ ID NO: 2350548 - protein, 25 aa, Cryptosporidium parvum
RSFQDNIEKGQKTNKKQLSIKSSQK

SEQ ID NO: 2350549 - protein, 7 aa, Cryptosporidium parvum
RSGRPGI

SEQ ID NO: 2350550 - protein, 4 aa, Cryptosporidium parvum
RSKF

SEQ ID NO: 2350551 - protein, 6 aa, Cryptosporidium parvum
RSKSDG

SEQ ID NO: 2350552 - protein, 5 aa, Cryptosporidium parvum
RSKSV

SEQ ID NO: 2350553 - protein, 13 aa, Cryptosporidium parvum
RSKVGKHGRVTKD

SEQ ID NO: 2350554 - protein, 4 aa, Cryptosporidium parvum
RSKY

SEQ ID NO: 2350555 - protein, 14 aa, Cryptosporidium parvum
RSKYNSGNQGVQRK

SEQ ID NO: 2350556 - protein, 6 aa, Cryptosporidium parvum
RSLTPD

SEQ ID NO: 2350557 - protein, 11 aa, Cryptosporidium parvum
RSNGTSKEDIE

SEQ ID NO: 2350558 - protein, 10 aa, Cryptosporidium parvum
RSPESGVSKG

SEQ ID NO: 2350559 - protein, 33 aa, Cryptosporidium parvum; identical to SEQ ID NO: 2159755

SEQ ID NO: 2350560 - protein, 10 aa, Cryptosporidium parvum
RSPVNRKKSN

SEQ ID NO: 2350561 - protein, 5 aa, Cryptosporidium parvum
RSRRK

SEQ ID NO: 2350562 - protein, 7 aa, Cryptosporidium parvum
RSRTTGF

SEQ ID NO: 2350563 - protein, 6 aa, Cryptosporidium parvum
RSSKLE

SEQ ID NO: 2350564 - protein, 7 aa, Cryptosporidium parvum
RSSLNAD

SEQ ID NO: 2350565 - protein, 6 aa, Cryptosporidium parvum
RSSNDI

SEQ ID NO: 2350566 - protein, 14 aa, Cryptosporidium parvum
RSSSSSECNDSAAE

SEQ ID NO: 2350567 - protein, 6 aa, Cryptosporidium parvum
RSSTHF

SEQ ID NO: 2350568 - protein, 7 aa, Cryptosporidium parvum
RSSTKPI

SEQ ID NO: 2350569 - protein, 7 aa, Cryptosporidium parvum
RSSTLSH

SEQ ID NO: 2350570 - protein, 5 aa, Cryptosporidium parvum
RSTPD

SEQ ID NO: 2350571 - protein, 6 aa, Cryptosporidium parvum
RTHSQL

SEQ ID NO: 2350572 - protein, 7 aa, Cryptosporidium parvum
RTISETP

SEQ ID NO: 2350573 - protein, 16 aa, Cryptosporidium parvum
RTKTTERLADGTVRET

SEQ ID NO: 2350574 - protein, 4 aa, Cryptosporidium parvum
RTQA

SEQ ID NO: 2350575 - protein, 5 aa, Cryptosporidium parvum
RTRNS

SEQ ID NO: 2350576 - protein, 4 aa, Cryptosporidium parvum
RVEY

SEQ ID NO: 2350577 - protein, 8 aa, Cryptosporidium parvum
RVKPSKKV

SEQ ID NO: 2350578 - protein, 6 aa, Cryptosporidium parvum
RVNDEG

SEQ ID NO: 2350579 - protein, 26 aa, Cryptosporidium parvum
RVNGNGNSQGVYRSRNNKHLRSNPFE

SEQ ID NO: 2350580 - protein, 7 aa, Cryptosporidium parvum
RVPDDGK

SEQ ID NO: 2350581 - protein, 16 aa, Cryptosporidium parvum
RVSNGTEKSGHEPLPI

SEQ ID NO: 2350582 - protein, 6 aa, Cryptosporidium parvum
RVSTDG

SEQ ID NO: 2350583 - protein, 25 aa, Cryptosporidium parvum
RYDSNSGGSSQSQGGQTNNTDSSSI

SEQ ID NO: 2350584 - protein, 28 aa, Cryptosporidium parvum
RYEQKEGGEVSEAERETEFGSSEVTSSV

SEQ ID NO: 2350585 - protein, 7 aa, Cryptosporidium parvum
RYGPHNH

SEQ ID NO: 2350586 - protein, 6 aa, Cryptosporidium parvum
RYTTDS

SEQ ID NO: 2350587 - protein, 6 aa, Cryptosporidium parvum
SAFKNK

SEQ ID NO: 2350588 - protein, 8 aa, Cryptosporidium parvum
SAKNAYNV

SEQ ID NO: 2350589 - protein, 15 aa, Cryptosporidium parvum
SAKPKKATEATKKPK

SEQ ID NO: 2350590 - protein, 7 aa, Cryptosporidium parvum
SALSELG

SEQ ID NO: 2350591 - protein, 5 aa, Cryptosporidium parvum
SANDI

SEQ ID NO: 2350592 - protein, 7 aa, Cryptosporidium parvum
SANGDSI

SEQ ID NO: 2350593 - protein, 15 aa, Cryptosporidium parvum
SANNTDKLSDQPTYF

SEQ ID NO: 2350594 - protein, 14 aa, Cryptosporidium parvum
SANRIKNSRNSINE

SEQ ID NO: 2350595 - protein, 8 aa, Cryptosporidium parvum
SAPPKDNV

SEQ ID NO: 2350596 - protein, 7 aa, Cryptosporidium parvum
SAPTDAT

SEQ ID NO: 2350597 - protein, 18 aa, Cryptosporidium parvum
SAQPASSVISKERADTLR

SEQ ID NO: 2350598 - protein, 14 aa, Cryptosporidium parvum
SARNNTSFKSISNE

SEQ ID NO: 2350599 - protein, 18 aa, Cryptosporidium parvum
SASESSENGKIQGIDSPA

SEQ ID NO: 2350600 - protein, 13 aa, Cryptosporidium parvum
SASNSGESYGTEA

SEQ ID NO: 2350601 - protein, 9 aa, Cryptosporidium parvum
SASQGEGDL

SEQ ID NO: 2350602 - protein, 5 aa, Cryptosporidium parvum
SASSI

SEQ ID NO: 2350603 - protein, 9 aa, Cryptosporidium parvum
SATESYSPL

SEQ ID NO: 2350604 - protein, 14 aa, Cryptosporidium parvum
SAVKTGMDELGGEA

SEQ ID NO: 2350605 - protein, 8 aa, Cryptosporidium parvum
SAYNQRSI

SEQ ID NO: 2350606 - protein, 25 aa, Cryptosporidium parvum
SAYSSALKKRASGKTAVNSNSSRSH

SEQ ID NO: 2350607 - protein, 5 aa, Cryptosporidium parvum
SCDDT

SEQ ID NO: 2350608 - protein, 7 aa, Cryptosporidium parvum
SCGSNYS

SEQ ID NO: 2350609 - protein, 8 aa, Cryptosporidium parvum
SCNDENKI

SEQ ID NO: 2350610 - protein, 13 aa, Cryptosporidium parvum
SDAKNDPAKGCED

SEQ ID NO: 2350611 - protein, 5 aa, Cryptosporidium parvum
SDAQE

SEQ ID NO: 2350612 - protein, 13 aa, Cryptosporidium parvum
SDEPESRKVLSSQ

SEQ ID NO: 2350613 - protein, 17 aa, Cryptosporidium parvum
SDESRNGSFGASKDQID

SEQ ID NO: 2350614 - protein, 4 aa, Cryptosporidium parvum
SDFN

SEQ ID NO: 2350615 - protein, 24 aa, Cryptosporidium parvum
SDFSTVKTKSRKNTTKKSSSNEKK

SEQ ID NO: 2350616 - protein, 12 aa, Cryptosporidium parvum
SDGEDPDEHEGM

SEQ ID NO: 2350617 - protein, 7 aa, Cryptosporidium parvum
SDGSNNF

SEQ ID NO: 2350618 - protein, 8 aa, Cryptosporidium parvum
SDHETQNR

SEQ ID NO: 2350619 - protein, 10 aa, Cryptosporidium parvum
SDKNSPNDIN

SEQ ID NO: 2350620 - protein, 10 aa, Cryptosporidium parvum
SDLDDEEPEC

SEQ ID NO: 2350621 - protein, 7 aa, Cryptosporidium parvum
SDLKSGD

SEQ ID NO: 2350622 - protein, 6 aa, Cryptosporidium parvum
SDLKSP

SEQ ID NO: 2350623 - protein, 7 aa, Cryptosporidium parvum
SDLSSTH

SEQ ID NO: 2350624 - protein, 26 aa, Cryptosporidium parvum
SDMKKQKNKELDYQSDYSNLSSPLKS

SEQ ID NO: 2350625 - protein, 25 aa, Cryptosporidium parvum
SDNIETELGEKKQEEESLGGRKRSM

SEQ ID NO: 2350626 - protein, 13 aa, Cryptosporidium parvum
SDNNGSIKNNFGQ

SEQ ID NO: 2350627 - protein, 7 aa, Cryptosporidium parvum
SDNPIQN

SEQ ID NO: 2350628 - protein, 6 aa, Cryptosporidium parvum
SDNSNN

SEQ ID NO: 2350629 - protein, 21 aa, Cryptosporidium parvum
SDPEKRNRYDTYGADGVSADF

SEQ ID NO: 2350630 - protein, 10 aa, Cryptosporidium parvum
SDPGSDLENV

SEQ ID NO: 2350631 - protein, 7 aa, Cryptosporidium parvum
SDPKLTS

SEQ ID NO: 2350632 - protein, 6 aa, Cryptosporidium parvum
SDPNAL

SEQ ID NO: 2350633 - protein, 12 aa, Cryptosporidium parvum
SDPNPNSPANTI

SEQ ID NO: 2350634 - protein, 7 aa, Cryptosporidium parvum
SDPNQVN

SEQ ID NO: 2350635 - protein, 5 aa, Cryptosporidium parvum
SDPNS

SEQ ID NO: 2350636 - protein, 6 aa, Cryptosporidium parvum
SDPSNA

SEQ ID NO: 2350637 - protein, 4 aa, Cryptosporidium parvum
SDQV

SEQ ID NO: 2350638 - protein, 27 aa, Cryptosporidium parvum
SDRALKKEKKKLAMDSQKISSALSNEI

SEQ ID NO: 2350639 - protein, 4 aa, Cryptosporidium parvum
SDRH

SEQ ID NO: 2350640 - protein, 7 aa, Cryptosporidium parvum
SDSDEKT

SEQ ID NO: 2350641 - protein, 5 aa, Cryptosporidium parvum
SDSEM

SEQ ID NO: 2350642 - protein, 7 aa, Cryptosporidium parvum
SDSFQKN

SEQ ID NO: 2350643 - protein, 5 aa, Cryptosporidium parvum
SDSGD

SEQ ID NO: 2350644 - protein, 8 aa, Cryptosporidium parvum
SDSHQSVT

SEQ ID NO: 2350645 - protein, 8 aa, Cryptosporidium parvum
SDSKGRPF

SEQ ID NO: 2350646 - protein, 5 aa, Cryptosporidium parvum
SDSNI

SEQ ID NO: 2350647 - protein, 8 aa, Cryptosporidium parvum
SDSNNLQL

SEQ ID NO: 2350648 - protein, 6 aa, Cryptosporidium parvum
SDSPEK

SEQ ID NO: 2350649 - protein, 27 aa, Cryptosporidium parvum
SDSSNMSKSGTMDKERSEKSSAEIKKE

SEQ ID NO: 2350650 - protein, 9 aa, Cryptosporidium parvum
SDSTGGPGV

SEQ ID NO: 2350651 - protein, 10 aa, Cryptosporidium parvum
SDSTHPNDVS

SEQ ID NO: 2350652 - protein, 7 aa, Cryptosporidium parvum
SDVRDRY

SEQ ID NO: 2350653 - protein, 10 aa, Cryptosporidium parvum
SDYSGKIRGH

SEQ ID NO: 2350654 - protein, 5 aa, Cryptosporidium parvum
SEAET

SEQ ID NO: 2350655 - protein, 11 aa, Cryptosporidium parvum
SEALDSPNKTL

SEQ ID NO: 2350656 - protein, 7 aa, Cryptosporidium parvum
SEARRTI

SEQ ID NO: 2350657 - protein, 6 aa, Cryptosporidium parvum
SECLNQ

SEQ ID NO: 2350658 - protein, 6 aa, Cryptosporidium parvum
SECQET

SEQ ID NO: 2350659 - protein, 5 aa, Cryptosporidium parvum
SEDDH

SEQ ID NO: 2350660 - protein, 6 aa, Cryptosporidium parvum
SEEQEV

SEQ ID NO: 2350661 - protein, 5 aa, Cryptosporidium parvum
SEFDK

SEQ ID NO: 2350662 - protein, 5 aa, Cryptosporidium parvum
SEGGL

SEQ ID NO: 2350663 - protein, 6 aa, Cryptosporidium parvum
SEGKNI

SEQ ID NO: 2350664 - protein, 5 aa, Cryptosporidium parvum
SEIEN

SEQ ID NO: 2350665 - protein, 9 aa, Cryptosporidium parvum
SEIGENGGI

SEQ ID NO: 2350666 - protein, 6 aa, Cryptosporidium parvum
SEIPSD

SEQ ID NO: 2350667 - protein, 58 aa, Cryptosporidium parvum; identical to SEQ ID NO: 2280050

SEQ ID NO: 2350668 - protein, 8 aa, Cryptosporidium parvum
SEITANES

SEQ ID NO: 2350669 - protein, 22 aa, Cryptosporidium parvum
SEKKSVSQPKRGTTESRPTLQK

SEQ ID NO: 2350670 - protein, 9 aa, Cryptosporidium parvum
SEKKSYSSY

SEQ ID NO: 2350671 - protein, 4 aa, Cryptosporidium parvum
SEKS

SEQ ID NO: 2350672 - protein, 8 aa, Cryptosporidium parvum
SEKTTDKE

SEQ ID NO: 2350673 - protein, 12 aa, Cryptosporidium parvum
SELEDYKKTNCE

SEQ ID NO: 2350674 - protein, 5 aa, Cryptosporidium parvum
SELKD

SEQ ID NO: 2350675 - protein, 10 aa, Cryptosporidium parvum
SELSDTDFGN

SEQ ID NO: 2350676 - protein, 12 aa, Cryptosporidium parvum
SENDDNNHNNRN

SEQ ID NO: 2350677 - protein, 8 aa, Cryptosporidium parvum
SENEASQL

SEQ ID NO: 2350678 - protein, 5 aa, Cryptosporidium parvum
SENGE

SEQ ID NO: 2350679 - protein, 13 aa, Cryptosporidium parvum
SENKANERNQEIS

SEQ ID NO: 2350680 - protein, 12 aa, Cryptosporidium parvum
SENLNKKSNQET

SEQ ID NO: 2350681 - protein, 5 aa, Cryptosporidium parvum
SENNI

SEQ ID NO: 2350682 - protein, 5 aa, Cryptosporidium parvum
SENPR

SEQ ID NO: 2350683 - protein, 4 aa, Cryptosporidium parvum
SENS

SEQ ID NO: 2350684 - protein, 24 aa, Cryptosporidium parvum
SENSKKSDLNKNKKVSKHISKTNN

SEQ ID NO: 2350685 - protein, 5 aa, Cryptosporidium parvum
SENTL

SEQ ID NO: 2350686 - protein, 25 aa, Cryptosporidium parvum
SENYNNTKFPKVSEELDSEKTIVGG

SEQ ID NO: 2350687 - protein, 6 aa, Cryptosporidium parvum
SEPAQL

SEQ ID NO: 2350688 - protein, 17 aa, Cryptosporidium parvum
SEPKGDDSTNNISNPEE

SEQ ID NO: 2350689 - protein, 17 aa, Cryptosporidium parvum
SEPRNYTPVSSKNISDI

SEQ ID NO: 2350690 - protein, 7 aa, Cryptosporidium parvum
SEQDKKL

SEQ ID NO: 2350691 - protein, 42 aa, Cryptosporidium parvum; identical to SEQ ID NO: 2160682

SEQ ID NO: 2350692 - protein, 4 aa, Cryptosporidium parvum
SERD

SEQ ID NO: 2350693 - protein, 9 aa, Cryptosporidium parvum
SERDSGSGE

SEQ ID NO: 2350694 - protein, 14 aa, Cryptosporidium parvum
SERESKGNTRIKYE

SEQ ID NO: 2350695 - protein, 14 aa, Cryptosporidium parvum
SERNSLKDEREQLN

SEQ ID NO: 2350696 - protein, 6 aa, Cryptosporidium parvum
SERSQL

SEQ ID NO: 2350697 - protein, 12 aa, Cryptosporidium parvum
SESEESDYDESD

SEQ ID NO: 2350698 - protein, 26 aa, Cryptosporidium parvum
SESESEPESDSDPDPDQNSDQDSELK

SEQ ID NO: 2350699 - protein, 8 aa, Cryptosporidium parvum
SESLSGVV

SEQ ID NO: 2350700 - protein, 5 aa, Cryptosporidium parvum
SESNE

SEQ ID NO: 2350701 - protein, 12 aa, Cryptosporidium parvum
SESNTDLCTSDS

SEQ ID NO: 2350702 - protein, 17 aa, Cryptosporidium parvum
SESNTKLKRQQTLGSSF

SEQ ID NO: 2350703 - protein, 9 aa, Cryptosporidium parvum
SESSNKYGI

SEQ ID NO: 2350704 - protein, 4 aa, Cryptosporidium parvum
SESY

SEQ ID NO: 2350705 - protein, 6 aa, Cryptosporidium parvum
SESYDS

SEQ ID NO: 2350706 - protein, 4 aa, Cryptosporidium parvum
SETP

SEQ ID NO: 2350707 - protein, 7 aa, Cryptosporidium parvum
SETSPIS

SEQ ID NO: 2350708 - protein, 7 aa, Cryptosporidium parvum
SEVETDK

SEQ ID NO: 2350709 - protein, 7 aa, Cryptosporidium parvum
SEVKSES

SEQ ID NO: 2350710 - protein, 10 aa, Cryptosporidium parvum
SEWSRSGLND

SEQ ID NO: 2350711 - protein, 4 aa, Cryptosporidium parvum
SEYK

SEQ ID NO: 2350712 - protein, 11 aa, Cryptosporidium parvum
SFDNSKATCET

SEQ ID NO: 2350713 - protein, 14 aa, Cryptosporidium parvum
SFEDKISKGENKER

SEQ ID NO: 2350714 - protein, 37 aa, Cryptosporidium parvum; identical to SEQ ID NO: 2280349

SEQ ID NO: 2350715 - protein, 6 aa, Cryptosporidium parvum
SFKNHP

SEQ ID NO: 2350716 - protein, 9 aa, Cryptosporidium parvum
SFQSKPKEK

SEQ ID NO: 2350717 - protein, 5 aa, Cryptosporidium parvum
SFSEG

SEQ ID NO: 2350718 - protein, 6 aa, Cryptosporidium parvum
SFTGKE

SEQ ID NO: 2350719 - protein, 5 aa, Cryptosporidium parvum
SGALD

SEQ ID NO: 2350720 - protein, 8 aa, Cryptosporidium parvum
SGARTTKF

SEQ ID NO: 2350721 - protein, 9 aa, Cryptosporidium parvum
SGDKNNELK

SEQ ID NO: 2350722 - protein, 11 aa, Cryptosporidium parvum
SGDSNKTHNSN

SEQ ID NO: 2350723 - protein, 18 aa, Cryptosporidium parvum
SGEDISGSRRYGRGNSGF

SEQ ID NO: 2350724 - protein, 10 aa, Cryptosporidium parvum
SGEGKTLYSD

SEQ ID NO: 2350725 - protein, 4 aa, Cryptosporidium parvum
SGEI

SEQ ID NO: 2350726 - protein, 6 aa, Cryptosporidium parvum
SGEKIE

SEQ ID NO: 2350727 - protein, 15 aa, Cryptosporidium parvum
SGEWRDDKRHGKGTV

SEQ ID NO: 2350728 - protein, 6 aa, Cryptosporidium parvum
SGFDST

SEQ ID NO: 2350729 - protein, 28 aa, Cryptosporidium parvum
SGFNQDSYQPRSPTPSPSPPLSDTKVPL

SEQ ID NO: 2350730 - protein, 6 aa, Cryptosporidium parvum
SGGDDG

SEQ ID NO: 2350731 - protein, 10 aa, Cryptosporidium parvum
SGGEKKTESL

SEQ ID NO: 2350732 - protein, 10 aa, Cryptosporidium parvum
SGGNNNNNKK

SEQ ID NO: 2350733 - protein, 6 aa, Cryptosporidium parvum
SGGNTQ

SEQ ID NO: 2350734 - protein, 39 aa, Cryptosporidium parvum; identical to SEQ ID NO: 2160972

SEQ ID NO: 2350735 - protein, 4 aa, Cryptosporidium parvum
SGIN

SEQ ID NO: 2350736 - protein, 15 aa, Cryptosporidium parvum
SGKVNKSLKKDEQLH

SEQ ID NO: 2350737 - protein, 5 aa, Cryptosporidium parvum
SGLRE

SEQ ID NO: 2350738 - protein, 9 aa, Cryptosporidium parvum
SGLSSKRGF

SEQ ID NO: 2350739 - protein, 20 aa, Cryptosporidium parvum
SGNDNNGVNTEGSNNHTIPG

SEQ ID NO: 2350740 - protein, 8 aa, Cryptosporidium parvum
SGNKLKKD

SEQ ID NO: 2350741 - protein, 9 aa, Cryptosporidium parvum
SGNNQGSVN

SEQ ID NO: 2350742 - protein, 10 aa, Cryptosporidium parvum
SGNRPRYNAR

SEQ ID NO: 2350743 - protein, 13 aa, Cryptosporidium parvum
SGNYSWGSQGISR

SEQ ID NO: 2350744 - protein, 8 aa, Cryptosporidium parvum
SGPSSEDN

SEQ ID NO: 2350745 - protein, 15 aa, Cryptosporidium parvum
SGPVKSDSINDDTRI

SEQ ID NO: 2350746 - protein, 19 aa, Cryptosporidium parvum
SGQKSLESQITDSASVNGT

SEQ ID NO: 2350747 - protein, 4 aa, Cryptosporidium parvum
SGQN

SEQ ID NO: 2350748 - protein, 8 aa, Cryptosporidium parvum
SGQTPESL

SEQ ID NO: 2350749 - protein, 5 aa, Cryptosporidium parvum
SGRAF

SEQ ID NO: 2350750 - protein, 6 aa, Cryptosporidium parvum
SGRGVP

SEQ ID NO: 2350751 - protein, 39 aa, Cryptosporidium parvum
SGRHNEERGSGSEKTTSLSSGGKPCISNNSPSKGGNEVG

SEQ ID NO: 2350752 - protein, 4 aa, Cryptosporidium parvum
SGRN

SEQ ID NO: 2350753 - protein, 10 aa, Cryptosporidium parvum
SGRTGRAGKF

SEQ ID NO: 2350754 - protein, 6 aa, Cryptosporidium parvum
SGSGFG

SEQ ID NO: 2350755 - protein, 7 aa, Cryptosporidium parvum
SGSHTRS

SEQ ID NO: 2350756 - protein, 5 aa, Cryptosporidium parvum
SGSNN

SEQ ID NO: 2350757 - protein, 8 aa, Cryptosporidium parvum
SGSNNDQN

SEQ ID NO: 2350758 - protein, 13 aa, Cryptosporidium parvum
SGSNPIKGRNDSI

SEQ ID NO: 2350759 - protein, 11 aa, Cryptosporidium parvum
SGSSDNNSVYN

SEQ ID NO: 2350760 - protein, 13 aa, Cryptosporidium parvum
SGSTITGKSDDTY

SEQ ID NO: 2350761 - protein, 8 aa, Cryptosporidium parvum
SGTDTSFQ

SEQ ID NO: 2350762 - protein, 7 aa, Cryptosporidium parvum
SGTGSKF

SEQ ID NO: 2350763 - protein, 5 aa, Cryptosporidium parvum
SGTNE

SEQ ID NO: 2350764 - protein, 8 aa, Cryptosporidium parvum
SGTPRPQM

SEQ ID NO: 2350765 - protein, 16 aa, Cryptosporidium parvum
SGYNGGLSEELNPTDF

SEQ ID NO: 2350766 - protein, 6 aa, Cryptosporidium parvum
SHDDGK

SEQ ID NO: 2350767 - protein, 9 aa, Cryptosporidium parvum
SHENSSSEI

SEQ ID NO: 2350768 - protein, 9 aa, Cryptosporidium parvum
SHKKGLDSD

SEQ ID NO: 2350769 - protein, 21 aa, Cryptosporidium parvum
SHNDSNISRDGLVDDNGESLI

SEQ ID NO: 2350770 - protein, 5 aa, Cryptosporidium parvum
SHNTE

SEQ ID NO: 2350771 - protein, 14 aa, Cryptosporidium parvum
SHRIPSTKSSHASN

SEQ ID NO: 2350772 - protein, 6 aa, Cryptosporidium parvum
SHSKSG

SEQ ID NO: 2350773 - protein, 4 aa, Cryptosporidium parvum
SHTG

SEQ ID NO: 2350774 - protein, 11 aa, Cryptosporidium parvum
SHTQGRKHQTN

SEQ ID NO: 2350775 - protein, 4 aa, Cryptosporidium parvum
SHVG

SEQ ID NO: 2350776 - protein, 65 aa, Cryptosporidium parvum
SIDANSGKEDKDLGNKSSEQHDSSLSGGKPKRLSDGSARITKTTNKNKSSTSNSKSGIGSNNPDD

SEQ ID NO: 2350777 - protein, 10 aa, Cryptosporidium parvum
SIDKPNEQNN

SEQ ID NO: 2350778 - protein, 10 aa, Cryptosporidium parvum
SIENNDNNHH

SEQ ID NO: 2350779 - protein, 6 aa, Cryptosporidium parvum
SIETPR

SEQ ID NO: 2350780 - protein, 12 aa, Cryptosporidium parvum
SIFGSSNSSNPF

SEQ ID NO: 2350781 - protein, 6 aa, Cryptosporidium parvum
SIGGKG

SEQ ID NO: 2350782 - protein, 17 aa, Cryptosporidium parvum
SIKGRSENEIMANDKPL

SEQ ID NO: 2350783 - protein, 9 aa, Cryptosporidium parvum
SIKQDDEGI

SEQ ID NO: 2350784 - protein, 11 aa, Cryptosporidium parvum
SINKEKTSIDQ

SEQ ID NO: 2350785 - protein, 33 aa, Cryptosporidium parvum; identical to SEQ ID NO: 2280947

SEQ ID NO: 2350786 - protein, 13 aa, Cryptosporidium parvum
SINSSRPNTFTNN

SEQ ID NO: 2350787 - protein, 4 aa, Cryptosporidium parvum
SINT

SEQ ID NO: 2350788 - protein, 22 aa, Cryptosporidium parvum
SINTEQNGQFTNEDSEDQNQNL

SEQ ID NO: 2350789 - protein, 16 aa, Cryptosporidium parvum
SINTKQKNSNETGKFT

SEQ ID NO: 2350790 - protein, 8 aa, Cryptosporidium parvum
SINYNSYD

SEQ ID NO: 2350791 - protein, 5 aa, Cryptosporidium parvum
SIPDE

SEQ ID NO: 2350792 - protein, 5 aa, Cryptosporidium parvum
SIPTP

SEQ ID NO: 2350793 - protein, 12 aa, Cryptosporidium parvum
SIQNQGQQITTQ

SEQ ID NO: 2350794 - protein, 4 aa, Cryptosporidium parvum
SIQP

SEQ ID NO: 2350795 - protein, 5 aa, Cryptosporidium parvum
SIREN

SEQ ID NO: 2350796 - protein, 15 aa, Cryptosporidium parvum
SIRESDTGLAPPSQW

SEQ ID NO: 2350797 - protein, 8 aa, Cryptosporidium parvum
SISDEREN

SEQ ID NO: 2350798 - protein, 27 aa, Cryptosporidium parvum
SISKDKSSIGDGNLSSNSTNNNKLPKK

SEQ ID NO: 2350799 - protein, 30 aa, Cryptosporidium parvum; identical to SEQ ID NO: 2281021

SEQ ID NO: 2350800 - protein, 4 aa, Cryptosporidium parvum
SISP

SEQ ID NO: 2350801 - protein, 6 aa, Cryptosporidium parvum
SITGSS

SEQ ID NO: 2350802 - protein, 17 aa, Cryptosporidium parvum
SITSQARKSYYKPKNED

SEQ ID NO: 2350803 - protein, 8 aa, Cryptosporidium parvum
SKADGNRS

SEQ ID NO: 2350804 - protein, 8 aa, Cryptosporidium parvum
SKAKRNSY

SEQ ID NO: 2350805 - protein, 11 aa, Cryptosporidium parvum
SKDARPSRFPP

SEQ ID NO: 2350806 - protein, 6 aa, Cryptosporidium parvum
SKDDNI

SEQ ID NO: 2350807 - protein, 8 aa, Cryptosporidium parvum
SKDGEFGG

SEQ ID NO: 2350808 - protein, 7 aa, Cryptosporidium parvum
SKDGQNE

SEQ ID NO: 2350809 - protein, 4 aa, Cryptosporidium parvum
SKDM

SEQ ID NO: 2350810 - protein, 11 aa, Cryptosporidium parvum
SKDPSSPFNPN

SEQ ID NO: 2350811 - protein, 5 aa, Cryptosporidium parvum
SKDQD

SEQ ID NO: 2350812 - protein, 10 aa, Cryptosporidium parvum
SKDSSKDMSN

SEQ ID NO: 2350813 - protein, 11 aa, Cryptosporidium parvum
SKDSSSNNSCN

SEQ ID NO: 2350814 - protein, 5 aa, Cryptosporidium parvum
SKEEI

SEQ ID NO: 2350815 - protein, 7 aa, Cryptosporidium parvum
SKEEKYE

SEQ ID NO: 2350816 - protein, 6 aa, Cryptosporidium parvum
SKELRQ

SEQ ID NO: 2350817 - protein, 27 aa, Cryptosporidium parvum
SKESFQDSDESISYSRSSGSSINPSIN

SEQ ID NO: 2350818 - protein, 11 aa, Cryptosporidium parvum
SKESRDGFSKT

SEQ ID NO: 2350819 - protein, 66 aa, Cryptosporidium parvum; identical to SEQ ID NO: 2281173

SEQ ID NO: 2350820 - protein, 4 aa, Cryptosporidium parvum
SKFD

SEQ ID NO: 2350821 - protein, 5 aa, Cryptosporidium parvum
SKGDY

SEQ ID NO: 2350822 - protein, 5 aa, Cryptosporidium parvum
SKGFR

SEQ ID NO: 2350823 - protein, 13 aa, Cryptosporidium parvum
SKGKQKGNTQLKQ

SEQ ID NO: 2350824 - protein, 5 aa, Cryptosporidium parvum
SKGNE

SEQ ID NO: 2350825 - protein, 5 aa, Cryptosporidium parvum
SKGPI

SEQ ID NO: 2350826 - protein, 17 aa, Cryptosporidium parvum
SKIPTKINYDGTETQIS

SEQ ID NO: 2350827 - protein, 7 aa, Cryptosporidium parvum
SKISKES

SEQ ID NO: 2350828 - protein, 6 aa, Cryptosporidium parvum
SKISQS

SEQ ID NO: 2350829 - protein, 11 aa, Cryptosporidium parvum
SKKEKPSQKDK

SEQ ID NO: 2350830 - protein, 10 aa, Cryptosporidium parvum
SKKENIDDIS

SEQ ID NO: 2350831 - protein, 7 aa, Cryptosporidium parvum
SKKPFDF

SEQ ID NO: 2350832 - protein, 9 aa, Cryptosporidium parvum
SKKSISRHG

SEQ ID NO: 2350833 - protein, 19 aa, Cryptosporidium parvum
SKKSKTSQVDEKTSLPYGS

SEQ ID NO: 2350834 - protein, 10 aa, Cryptosporidium parvum
SKKSNTEEDW

SEQ ID NO: 2350835 - protein, 6 aa, Cryptosporidium parvum
SKLEES

SEQ ID NO: 2350836 - protein, 9 aa, Cryptosporidium parvum
SKLPDEDNN

SEQ ID NO: 2350837 - protein, 20 aa, Cryptosporidium parvum
SKMGNSSQSILDPKQEREYN

SEQ ID NO: 2350838 - protein, 7 aa, Cryptosporidium parvum
SKMSNSS

SEQ ID NO: 2350839 - protein, 6 aa, Cryptosporidium parvum
SKNKLE

SEQ ID NO: 2350840 - protein, 8 aa, Cryptosporidium parvum
SKNNHHGN

SEQ ID NO: 2350841 - protein, 10 aa, Cryptosporidium parvum
SKNSTPEEIE

SEQ ID NO: 2350842 - protein, 6 aa, Cryptosporidium parvum
SKNVPK

SEQ ID NO: 2350843 - protein, 7 aa, Cryptosporidium parvum
SKPDDEI

SEQ ID NO: 2350844 - protein, 6 aa, Cryptosporidium parvum
SKPPKI

SEQ ID NO: 2350845 - protein, 5 aa, Cryptosporidium parvum
SKQDI

SEQ ID NO: 2350846 - protein, 6 aa, Cryptosporidium parvum
SKQENM

SEQ ID NO: 2350847 - protein, 7 aa, Cryptosporidium parvum
SKQGSIN

SEQ ID NO: 2350848 - protein, 6 aa, Cryptosporidium parvum
SKQLSI

SEQ ID NO: 2350849 - protein, 6 aa, Cryptosporidium parvum
SKQNKG

SEQ ID NO: 2350850 - protein, 9 aa, Cryptosporidium parvum
SKQYHESTK

SEQ ID NO: 2350851 - protein, 5 aa, Cryptosporidium parvum
SKRAY

SEQ ID NO: 2350852 - protein, 7 aa, Cryptosporidium parvum
SKRDSQN

SEQ ID NO: 2350853 - protein, 7 aa, Cryptosporidium parvum
SKRSGNI

SEQ ID NO: 2350854 - protein, 9 aa, Cryptosporidium parvum
SKRVEGKKS

SEQ ID NO: 2350855 - protein, 8 aa, Cryptosporidium parvum
SKRYSKDC

SEQ ID NO: 2350856 - protein, 11 aa, Cryptosporidium parvum
SKSKDVLEGGP

SEQ ID NO: 2350857 - protein, 7 aa, Cryptosporidium parvum
SKSLENK

SEQ ID NO: 2350858 - protein, 12 aa, Cryptosporidium parvum
SKSNIDSEENRR

SEQ ID NO: 2350859 - protein, 7 aa, Cryptosporidium parvum
SKSNLKP

SEQ ID NO: 2350860 - protein, 7 aa, Cryptosporidium parvum
SKSNTEV

SEQ ID NO: 2350861 - protein, 7 aa, Cryptosporidium parvum
SKSNYLE

SEQ ID NO: 2350862 - protein, 16 aa, Cryptosporidium parvum
SKSPLEIAGKPNLEVT

SEQ ID NO: 2350863 - protein, 8 aa, Cryptosporidium parvum
SKSRDEYG

SEQ ID NO: 2350864 - protein, 8 aa, Cryptosporidium parvum
SKSRNKEF

SEQ ID NO: 2350865 - protein, 10 aa, Cryptosporidium parvum
SKSSIQSNNN

SEQ ID NO: 2350866 - protein, 10 aa, Cryptosporidium parvum
SKVEKVQSES

SEQ ID NO: 2350867 - protein, 7 aa, Cryptosporidium parvum
SKVMPTT

SEQ ID NO: 2350868 - protein, 28 aa, Cryptosporidium parvum
SKVSKTDEDSQVCNRQGTEEDDQASRDH

SEQ ID NO: 2350869 - protein, 9 aa, Cryptosporidium parvum
SKYDSNGQV

SEQ ID NO: 2350870 - protein, 12 aa, Cryptosporidium parvum
SLDEDEEDEDEL

SEQ ID NO: 2350871 - protein, 6 aa, Cryptosporidium parvum
SLENSS

SEQ ID NO: 2350872 - protein, 7 aa, Cryptosporidium parvum
SLETERD

SEQ ID NO: 2350873 - protein, 7 aa, Cryptosporidium parvum
SLGGNSR

SEQ ID NO: 2350874 - protein, 7 aa, Cryptosporidium parvum
SLGGRTK

SEQ ID NO: 2350875 - protein, 9 aa, Cryptosporidium parvum
SLGKDDYTA

SEQ ID NO: 2350876 - protein, 19 aa, Cryptosporidium parvum
SLGRDYEGGGSSGGGSVED

SEQ ID NO: 2350877 - protein, 10 aa, Cryptosporidium parvum
SLGRSKELSE

SEQ ID NO: 2350878 - protein, 8 aa, Cryptosporidium parvum
SLNNNDGI

SEQ ID NO: 2350879 - protein, 9 aa, Cryptosporidium parvum
SLNQEGKDG

SEQ ID NO: 2350880 - protein, 5 aa, Cryptosporidium parvum
SLNSI

SEQ ID NO: 2350881 - protein, 10 aa, Cryptosporidium parvum
SLNSSANNLK

SEQ ID NO: 2350882 - protein, 11 aa, Cryptosporidium parvum
SLPGKCNNEEK

SEQ ID NO: 2350883 - protein, 13 aa, Cryptosporidium parvum
SLPLSTKQKLGQI

SEQ ID NO: 2350884 - protein, 20 aa, Cryptosporidium parvum
SLPSRKDSTISKQPTRSGTV

SEQ ID NO: 2350885 - protein, 4 aa, Cryptosporidium parvum
SLRK

SEQ ID NO: 2350886 - protein, 12 aa, Cryptosporidium parvum
SLRRSEKNSEPL

SEQ ID NO: 2350887 - protein, 10 aa, Cryptosporidium parvum
SLSDDDENKT

SEQ ID NO: 2350888 - protein, 12 aa, Cryptosporidium parvum
SLSKSPGSFERE

SEQ ID NO: 2350889 - protein, 23 aa, Cryptosporidium parvum
SLSQDSKKEDSIKNFSGSELGNT

SEQ ID NO: 2350890 - protein, 6 aa, Cryptosporidium parvum
SLTIST

SEQ ID NO: 2350891 - protein, 8 aa, Cryptosporidium parvum
SLYDSKNN

SEQ ID NO: 2350892 - protein, 20 aa, Cryptosporidium parvum
SMRRTTGFRDNSENGDLNSQ

SEQ ID NO: 2350893 - protein, 16 aa, Cryptosporidium parvum
SNDENSSNSEEETNLV

SEQ ID NO: 2350894 - protein, 11 aa, Cryptosporidium parvum
SNDKGKTGRKI

SEQ ID NO: 2350895 - protein, 14 aa, Cryptosporidium parvum
SNDLDNDKELESDK

SEQ ID NO: 2350896 - protein, 7 aa, Cryptosporidium parvum
SNDPIST

SEQ ID NO: 2350897 - protein, 8 aa, Cryptosporidium parvum
SNDTENKM

SEQ ID NO: 2350898 - protein, 20 aa, Cryptosporidium parvum
SNEGGNDTFSYKSSQGNDQF

SEQ ID NO: 2350899 - protein, 4 aa, Cryptosporidium parvum
SNEK

SEQ ID NO: 2350900 - protein, 7 aa, Cryptosporidium parvum
SNEKDPV

SEQ ID NO: 2350901 - protein, 7 aa, Cryptosporidium parvum
SNEKRSF

SEQ ID NO: 2350902 - protein, 9 aa, Cryptosporidium parvum
SNENAGSYN

SEQ ID NO: 2350903 - protein, 5 aa, Cryptosporidium parvum
SNENF

SEQ ID NO: 2350904 - protein, 6 aa, Cryptosporidium parvum
SNENFN

SEQ ID NO: 2350905 - protein, 5 aa, Cryptosporidium parvum
SNERQ

SEQ ID NO: 2350906 - protein, 4 aa, Cryptosporidium parvum
SNES

SEQ ID NO: 2350907 - protein, 4 aa, Cryptosporidium parvum
SNEY

SEQ ID NO: 2350908 - protein, 6 aa, Cryptosporidium parvum
SNFAKD

SEQ ID NO: 2350909 - protein, 16 aa, Cryptosporidium parvum
SNGDRKKNAVARATGE

SEQ ID NO: 2350910 - protein, 7 aa, Cryptosporidium parvum
SNGEGQI

SEQ ID NO: 2350911 - protein, 25 aa, Cryptosporidium parvum
SNGEKITRRDPYARYTDYDTDSSYI

SEQ ID NO: 2350912 - protein, 20 aa, Cryptosporidium parvum
SNGMPEAGNESSEDDDDDEI

SEQ ID NO: 2350913 - protein, 8 aa, Cryptosporidium parvum
SNGSITSR

SEQ ID NO: 2350914 - protein, 9 aa, Cryptosporidium parvum
SNGSKSFDN

SEQ ID NO: 2350915 - protein, 10 aa, Cryptosporidium parvum
SNGSKSSLRY

SEQ ID NO: 2350916 - protein, 10 aa, Cryptosporidium parvum
SNHNSPNESR

SEQ ID NO: 2350917 - protein, 15 aa, Cryptosporidium parvum
SNIDKADSNAITGPV

SEQ ID NO: 2350918 - protein, 4 aa, Cryptosporidium parvum
SNIE

SEQ ID NO: 2350919 - protein, 10 aa, Cryptosporidium parvum
SNIESETNTV

SEQ ID NO: 2350920 - protein, 6 aa, Cryptosporidium parvum
SNIHTS

SEQ ID NO: 2350921 - protein, 21 aa, Cryptosporidium parvum
SNINSKSKEIGIDSNATPGMT

SEQ ID NO: 2350922 - protein, 19 aa, Cryptosporidium parvum
SNIPRNKNIRSEACSSDEA

SEQ ID NO: 2350923 - protein, 7 aa, Cryptosporidium parvum
SNKDEYI

SEQ ID NO: 2350924 - protein, 9 aa, Cryptosporidium parvum
SNKDQFNDP

SEQ ID NO: 2350925 - protein, 5 aa, Cryptosporidium parvum
SNKER

SEQ ID NO: 2350926 - protein, 6 aa, Cryptosporidium parvum
SNKFSG

SEQ ID NO: 2350927 - protein, 5 aa, Cryptosporidium parvum
SNKKP

SEQ ID NO: 2350928 - protein, 15 aa, Cryptosporidium parvum
SNKKYPNNSSTPFDN

SEQ ID NO: 2350929 - protein, 7 aa, Cryptosporidium parvum
SNKNKKL

SEQ ID NO: 2350930 - protein, 8 aa, Cryptosporidium parvum
SNKPDSQW

SEQ ID NO: 2350931 - protein, 7 aa, Cryptosporidium parvum
SNKRNNQ

SEQ ID NO: 2350932 - protein, 8 aa, Cryptosporidium parvum
SNKSAGTI

SEQ ID NO: 2350933 - protein, 19 aa, Cryptosporidium parvum
SNKYCNKSDSKNKLEKTNK

SEQ ID NO: 2350934 - protein, 6 aa, Cryptosporidium parvum
SNLDQN

SEQ ID NO: 2350935 - protein, 9 aa, Cryptosporidium parvum
SNLETNSNL

SEQ ID NO: 2350936 - protein, 17 aa, Cryptosporidium parvum
SNLNSTNNTSIATTSLS

SEQ ID NO: 2350937 - protein, 6 aa, Cryptosporidium parvum
SNLPKE

SEQ ID NO: 2350938 - protein, 12 aa, Cryptosporidium parvum
SNMENLNSRQDC

SEQ ID NO: 2350939 - protein, 5 aa, Cryptosporidium parvum
SNNEL

SEQ ID NO: 2350940 - protein, 23 aa, Cryptosporidium parvum
SNNENIQANSTRSSISGDKQELL

SEQ ID NO: 2350941 - protein, 4 aa, Cryptosporidium parvum
SNNN

SEQ ID NO: 2350942 - protein, 19 aa, Cryptosporidium parvum
SNNNSIKELQDQNSNNKKY

SEQ ID NO: 2350943 - protein, 8 aa, Cryptosporidium parvum
SNNPDEVI

SEQ ID NO: 2350944 - protein, 5 aa, Cryptosporidium parvum
SNNTD

SEQ ID NO: 2350945 - protein, 4 aa, Cryptosporidium parvum
SNNY

SEQ ID NO: 2350946 - protein, 7 aa, Cryptosporidium parvum
SNPIDSQ

SEQ ID NO: 2350947 - protein, 4 aa, Cryptosporidium parvum
SNPQ

SEQ ID NO: 2350948 - protein, 9 aa, Cryptosporidium parvum
SNQADDTNV

SEQ ID NO: 2350949 - protein, 7 aa, Cryptosporidium parvum
SNQGRGV

SEQ ID NO: 2350950 - protein, 6 aa, Cryptosporidium parvum
SNQNTN

SEQ ID NO: 2350951 - protein, 20 aa, Cryptosporidium parvum
SNRISEDPDKISERNKRIKN

SEQ ID NO: 2350952 - protein, 9 aa, Cryptosporidium parvum
SNRNKDLSY

SEQ ID NO: 2350953 - protein, 10 aa, Cryptosporidium parvum
SNRSELSQGA

SEQ ID NO: 2350954 - protein, 7 aa, Cryptosporidium parvum
SNRTNSS

SEQ ID NO: 2350955 - protein, 5 aa, Cryptosporidium parvum
SNSDI

SEQ ID NO: 2350956 - protein, 13 aa, Cryptosporidium parvum
SNSDRPKSEIETN

SEQ ID NO: 2350957 - protein, 8 aa, Cryptosporidium parvum
SNSEDNIS

SEQ ID NO: 2350958 - protein, 10 aa, Cryptosporidium parvum
SNSEKQVKDA

SEQ ID NO: 2350959 - protein, 6 aa, Cryptosporidium parvum
SNSKDL

SEQ ID NO: 2350960 - protein, 13 aa, Cryptosporidium parvum
SNSKEKESSNYKP

SEQ ID NO: 2350961 - protein, 5 aa, Cryptosporidium parvum
SNSLR

SEQ ID NO: 2350962 - protein, 9 aa, Cryptosporidium parvum
SNSNNIENL

SEQ ID NO: 2350963 - protein, 13 aa, Cryptosporidium parvum
SNSQIAQMISFNF

SEQ ID NO: 2350964 - protein, 17 aa, Cryptosporidium parvum
SNSTSMVGANSTGVLPS

SEQ ID NO: 2350965 - protein, 14 aa, Cryptosporidium parvum
SNTDPKEDAAWSSE

SEQ ID NO: 2350966 - protein, 18 aa, Cryptosporidium parvum
SNTGDQNSKDSSIRENSN

SEQ ID NO: 2350967 - protein, 4 aa, Cryptosporidium parvum
SNTL

SEQ ID NO: 2350968 - protein, 13 aa, Cryptosporidium parvum
SNTNLSQKTTLTN

SEQ ID NO: 2350969 - protein, 6 aa, Cryptosporidium parvum
SNVANG

SEQ ID NO: 2350970 - protein, 29 aa, Cryptosporidium parvum
SNYGCSTSSITNSTSIQNQAINSTNTGSG

SEQ ID NO: 2350971 - protein, 17 aa, Cryptosporidium parvum
SNYNQQLGDSNEYSAES

SEQ ID NO: 2350972 - protein, 10 aa, Cryptosporidium parvum
SNYSSSTSSV

SEQ ID NO: 2350973 - protein, 5 aa, Cryptosporidium parvum
SNYST

SEQ ID NO: 2350974 - protein, 9 aa, Cryptosporidium parvum
SNYYSNNGN

SEQ ID NO: 2350975 - protein, 8 aa, Cryptosporidium parvum
SPASIRGP

SEQ ID NO: 2350976 - protein, 16 aa, Cryptosporidium parvum
SPDANDKSVNKNIKKN

SEQ ID NO: 2350977 - protein, 7 aa, Cryptosporidium parvum
SPDPNIE

SEQ ID NO: 2350978 - protein, 6 aa, Cryptosporidium parvum
SPEERK

SEQ ID NO: 2350979 - protein, 4 aa, Cryptosporidium parvum
SPEG

SEQ ID NO: 2350980 - protein, 4 aa, Cryptosporidium parvum
SPEI

SEQ ID NO: 2350981 - protein, 5 aa, Cryptosporidium parvum
SPELR

SEQ ID NO: 2350982 - protein, 8 aa, Cryptosporidium parvum
SPESRLTA

SEQ ID NO: 2350983 - protein, 5 aa, Cryptosporidium parvum
SPGLQ

SEQ ID NO: 2350984 - protein, 7 aa, Cryptosporidium parvum
SPGSSSI

SEQ ID NO: 2350985 - protein, 46 aa, Cryptosporidium parvum; identical to SEQ ID NO: 2282512

SEQ ID NO: 2350986 - protein, 18 aa, Cryptosporidium parvum
SPIEDHDPDQDQDRDQDY

SEQ ID NO: 2350987 - protein, 8 aa, Cryptosporidium parvum
SPIGSSNQ

SEQ ID NO: 2350988 - protein, 12 aa, Cryptosporidium parvum
SPKENSSPEEIQ

SEQ ID NO: 2350989 - protein, 8 aa, Cryptosporidium parvum
SPKQISPK

SEQ ID NO: 2350990 - protein, 9 aa, Cryptosporidium parvum
SPKTDDSSI

SEQ ID NO: 2350991 - protein, 7 aa, Cryptosporidium parvum
SPKVSDT

SEQ ID NO: 2350992 - protein, 9 aa, Cryptosporidium parvum
SPMDEAKKE

SEQ ID NO: 2350993 - protein, 5 aa, Cryptosporidium parvum
SPMET

SEQ ID NO: 2350994 - protein, 9 aa, Cryptosporidium parvum
SPNAGAAEI

SEQ ID NO: 2350995 - protein, 13 aa, Cryptosporidium parvum
SPNSDITQKDDSL

SEQ ID NO: 2350996 - protein, 7 aa, Cryptosporidium parvum
SPPGTPT

SEQ ID NO: 2350997 - protein, 12 aa, Cryptosporidium parvum
SPRLSSTPNPRK

SEQ ID NO: 2350998 - protein, 7 aa, Cryptosporidium parvum
SPSEWPG

SEQ ID NO: 2350999 - protein, 6 aa, Cryptosporidium parvum
SPSNAA

SEQ ID NO: 2351000 - protein, 7 aa, Cryptosporidium parvum
SPSNIQK

SEQ ID NO: 2351001 - protein, 7 aa, Cryptosporidium parvum
SPSTSPY

SEQ ID NO: 2351002 - protein, 6 aa, Cryptosporidium parvum
SPTAFK

SEQ ID NO: 2351003 - protein, 19 aa, Cryptosporidium parvum
SPTEQHDESKFKDPETGAE

SEQ ID NO: 2351004 - protein, 8 aa, Cryptosporidium parvum
SPTHQEKT

SEQ ID NO: 2351005 - protein, 5 aa, Cryptosporidium parvum
SPTLD

SEQ ID NO: 2351006 - protein, 14 aa, Cryptosporidium parvum
SPVSEYSSEIESKS

SEQ ID NO: 2351007 - protein, 5 aa, Cryptosporidium parvum
SQALG

SEQ ID NO: 2351008 - protein, 12 aa, Cryptosporidium parvum
SQCVSNNNSNSP

SEQ ID NO: 2351009 - protein, 9 aa, Cryptosporidium parvum
SQDCNEGYQ

SEQ ID NO: 2351010 - protein, 8 aa, Cryptosporidium parvum
SQDKSMQE

SEQ ID NO: 2351011 - protein, 10 aa, Cryptosporidium parvum
SQFNQNSSYI

SEQ ID NO: 2351012 - protein, 10 aa, Cryptosporidium parvum
SQGGCKENQD

SEQ ID NO: 2351013 - protein, 12 aa, Cryptosporidium parvum
SQGKQGDRAARA

SEQ ID NO: 2351014 - protein, 8 aa, Cryptosporidium parvum
SQGSSHEE

SEQ ID NO: 2351015 - protein, 24 aa, Cryptosporidium parvum
SQIGSSSNNINGTGNVNTLNTGIG

SEQ ID NO: 2351016 - protein, 13 aa, Cryptosporidium parvum
SQKDSSSSKMRQE

SEQ ID NO: 2351017 - protein, 6 aa, Cryptosporidium parvum
SQKEAI

SEQ ID NO: 2351018 - protein, 10 aa, Cryptosporidium parvum
SQKNSNKSWL

SEQ ID NO: 2351019 - protein, 9 aa, Cryptosporidium parvum
SQKSSANSL

SEQ ID NO: 2351020 - protein, 8 aa, Cryptosporidium parvum
SQNEKNEY

SEQ ID NO: 2351021 - protein, 6 aa, Cryptosporidium parvum
SQNGEY

SEQ ID NO: 2351022 - protein, 6 aa, Cryptosporidium parvum
SQNGGM

SEQ ID NO: 2351023 - protein, 9 aa, Cryptosporidium parvum
SQNSSLDAN

SEQ ID NO: 2351024 - protein, 8 aa, Cryptosporidium parvum
SQPAQNNQ

SEQ ID NO: 2351025 - protein, 10 aa, Cryptosporidium parvum
SQPENPEDAL

SEQ ID NO: 2351026 - protein, 4 aa, Cryptosporidium parvum
SQPN

SEQ ID NO: 2351027 - protein, 6 aa, Cryptosporidium parvum
SQPSEI

SEQ ID NO: 2351028 - protein, 19 aa, Cryptosporidium parvum
SQQEGGDSFSLSPNSKINK

SEQ ID NO: 2351029 - protein, 4 aa, Cryptosporidium parvum
SQQL

SEQ ID NO: 2351030 - protein, 6 aa, Cryptosporidium parvum
SQQTNN

SEQ ID NO: 2351031 - protein, 10 aa, Cryptosporidium parvum
SQQYNKPGSC

SEQ ID NO: 2351032 - protein, 9 aa, Cryptosporidium parvum
SQRATGGTS

SEQ ID NO: 2351033 - protein, 5 aa, Cryptosporidium parvum
SQSDG

SEQ ID NO: 2351034 - protein, 8 aa, Cryptosporidium parvum
SQSHSKSV

SEQ ID NO: 2351035 - protein, 20 aa, Cryptosporidium parvum
SQSPLVSPAVSSKKNRKEVE

SEQ ID NO: 2351036 - protein, 24 aa, Cryptosporidium parvum
SQSPPPGKTLTPSQSSSNESNPIR

SEQ ID NO: 2351037 - protein, 23 aa, Cryptosporidium parvum
SQSQPQSRSHLQSQSLPGPQSQT

SEQ ID NO: 2351038 - protein, 41 aa, Cryptosporidium parvum; identical to SEQ ID NO: 2282879

SEQ ID NO: 2351039 - protein, 5 aa, Cryptosporidium parvum
SQTNN

SEQ ID NO: 2351040 - protein, 27 aa, Cryptosporidium parvum
SQTNNDETSSVEAQSYSSDFSNDEDFD

SEQ ID NO: 2351041 - protein, 49 aa, Cryptosporidium parvum; identical to SEQ ID NO: 2282908

SEQ ID NO: 2351042 - protein, 11 aa, Cryptosporidium parvum
SQVTQNAENSN

SEQ ID NO: 2351043 - protein, 12 aa, Cryptosporidium parvum
SQYQDGYTKDST

SEQ ID NO: 2351044 - protein, 19 aa, Cryptosporidium parvum
SRARENETNDAHQEKDKKD

SEQ ID NO: 2351045 - protein, 6 aa, Cryptosporidium parvum
SRDEKV

SEQ ID NO: 2351046 - protein, 6 aa, Cryptosporidium parvum
SREDEQ

SEQ ID NO: 2351047 - protein, 9 aa, Cryptosporidium parvum
SREEEESRI

SEQ ID NO: 2351048 - protein, 5 aa, Cryptosporidium parvum
SREEI

SEQ ID NO: 2351049 - protein, 15 aa, Cryptosporidium parvum
SREEKIKYKNEELDT

SEQ ID NO: 2351050 - protein, 8 aa, Cryptosporidium parvum
SREKNETV

SEQ ID NO: 2351051 - protein, 7 aa, Cryptosporidium parvum
SRIRPPA

SEQ ID NO: 2351052 - protein, 20 aa, Cryptosporidium parvum
SRISQSHNTETLSGVNNSEK

SEQ ID NO: 2351053 - protein, 26 aa, Cryptosporidium parvum
SRKALQKKNKPKNSGNSNNKNISEPS

SEQ ID NO: 2351054 - protein, 15 aa, Cryptosporidium parvum
SRKNNWKSKNAKEGP

SEQ ID NO: 2351055 - protein, 9 aa, Cryptosporidium parvum
SRKRANNYI

SEQ ID NO: 2351056 - protein, 4 aa, Cryptosporidium parvum
SRLE

SEQ ID NO: 2351057 - protein, 22 aa, Cryptosporidium parvum
SRNIKQNQTNLKNSLGRKNGSL

SEQ ID NO: 2351058 - protein, 10 aa, Cryptosporidium parvum
SRNKNGEIIS

SEQ ID NO: 2351059 - protein, 5 aa, Cryptosporidium parvum
SRNNW

SEQ ID NO: 2351060 - protein, 21 aa, Cryptosporidium parvum
SRNRETVCSSDSESSDDEDFD

SEQ ID NO: 2351061 - protein, 7 aa, Cryptosporidium parvum
SRPGQCG

SEQ ID NO: 2351062 - protein, 17 aa, Cryptosporidium parvum
SRRDETANQRSHPYSPT

SEQ ID NO: 2351063 - protein, 6 aa, Cryptosporidium parvum
SRRPRG

SEQ ID NO: 2351064 - protein, 18 aa, Cryptosporidium parvum
SRRSRNSRWRGASEDNFN

SEQ ID NO: 2351065 - protein, 6 aa, Cryptosporidium parvum
SRSKKI

SEQ ID NO: 2351066 - protein, 8 aa, Cryptosporidium parvum
SRSNSFGP

SEQ ID NO: 2351067 - protein, 24 aa, Cryptosporidium parvum
SRTDTAKSLQEKQKNQCKRHKNKE

SEQ ID NO: 2351068 - protein, 15 aa, Cryptosporidium parvum
SRTFDTELGNPSSIP

SEQ ID NO: 2351069 - protein, 5 aa, Cryptosporidium parvum
SRTGY

SEQ ID NO: 2351070 - protein, 10 aa, Cryptosporidium parvum
SRTKNRKRNI

SEQ ID NO: 2351071 - protein, 9 aa, Cryptosporidium parvum
SSAKNSTNV

SEQ ID NO: 2351072 - protein, 5 aa, Cryptosporidium parvum
SSCSR

SEQ ID NO: 2351073 - protein, 5 aa, Cryptosporidium parvum
SSCTD

SEQ ID NO: 2351074 - protein, 5 aa, Cryptosporidium parvum
SSDIK

SEQ ID NO: 2351075 - protein, 14 aa, Cryptosporidium parvum
SSDMESKNPASDVS

SEQ ID NO: 2351076 - protein, 38 aa, Cryptosporidium parvum; identical to SEQ ID NO: 2283207

SEQ ID NO: 2351077 - protein, 37 aa, Cryptosporidium parvum; identical to SEQ ID NO: 2283208

SEQ ID NO: 2351078 - protein, 20 aa, Cryptosporidium parvum
SSDYSNVRKTHANSAIGAGF

SEQ ID NO: 2351079 - protein, 7 aa, Cryptosporidium parvum
SSEADEN

SEQ ID NO: 2351080 - protein, 4 aa, Cryptosporidium parvum
SSEE

SEQ ID NO: 2351081 - protein, 31 aa, Cryptosporidium parvum; identical to SEQ ID NO: 2283223

SEQ ID NO: 2351082 - protein, 10 aa, Cryptosporidium parvum
SSEISSKRNT

SEQ ID NO: 2351083 - protein, 6 aa, Cryptosporidium parvum
SSEQAI

SEQ ID NO: 2351084 - protein, 6 aa, Cryptosporidium parvum
SSEQGY

SEQ ID NO: 2351085 - protein, 4 aa, Cryptosporidium parvum
SSER

SEQ ID NO: 2351086 - protein, 9 aa, Cryptosporidium parvum
SSGDSSKDF

SEQ ID NO: 2351087 - protein, 4 aa, Cryptosporidium parvum
SSGL

SEQ ID NO: 2351088 - protein, 7 aa, Cryptosporidium parvum
SSGTGKT

SEQ ID NO: 2351089 - protein, 15 aa, Cryptosporidium parvum
SSGTSFQSTEFGSPL

SEQ ID NO: 2351090 - protein, 5 aa, Cryptosporidium parvum
SSHQK

SEQ ID NO: 2351091 - protein, 10 aa, Cryptosporidium parvum
SSHSKSSNQS

SEQ ID NO: 2351092 - protein, 10 aa, Cryptosporidium parvum
SSIEHNSDKG

SEQ ID NO: 2351093 - protein, 10 aa, Cryptosporidium parvum
SSIIESNDSY

SEQ ID NO: 2351094 - protein, 15 aa, Cryptosporidium parvum
SSINASNSASESSFT

SEQ ID NO: 2351095 - protein, 46 aa, Cryptosporidium parvum; identical to SEQ ID NO: 2283365

SEQ ID NO: 2351096 - protein, 5 aa, Cryptosporidium parvum
SSISK

SEQ ID NO: 2351097 - protein, 8 aa, Cryptosporidium parvum
SSKFDKDS

SEQ ID NO: 2351098 - protein, 10 aa, Cryptosporidium parvum
SSKINSSEHG

SEQ ID NO: 2351099 - protein, 5 aa, Cryptosporidium parvum
SSKLE

SEQ ID NO: 2351100 - protein, 5 aa, Cryptosporidium parvum
SSKSK

SEQ ID NO: 2351101 - protein, 22 aa, Cryptosporidium parvum
SSKSRNSLKNINQTQEENNREP

SEQ ID NO: 2351102 - protein, 7 aa, Cryptosporidium parvum
SSLDGNI

SEQ ID NO: 2351103 - protein, 9 aa, Cryptosporidium parvum
SSLDPNNYI

SEQ ID NO: 2351104 - protein, 6 aa, Cryptosporidium parvum
SSLKRK

SEQ ID NO: 2351105 - protein, 4 aa, Cryptosporidium parvum
SSLP

SEQ ID NO: 2351106 - protein, 4 aa, Cryptosporidium parvum
SSME

SEQ ID NO: 2351107 - protein, 8 aa, Cryptosporidium parvum
SSMSGTET

SEQ ID NO: 2351108 - protein, 23 aa, Cryptosporidium parvum
SSNESQGTHQSSNYLNKDSSIPT

SEQ ID NO: 2351109 - protein, 7 aa, Cryptosporidium parvum
SSNFEGN

SEQ ID NO: 2351110 - protein, 8 aa, Cryptosporidium parvum
SSNGVTKS

SEQ ID NO: 2351111 - protein, 8 aa, Cryptosporidium parvum
SSNIDSDE

SEQ ID NO: 2351112 - protein, 7 aa, Cryptosporidium parvum
SSNKKTF

SEQ ID NO: 2351113 - protein, 16 aa, Cryptosporidium parvum
SSNKNESSIHENQKRT

SEQ ID NO: 2351114 - protein, 7 aa, Cryptosporidium parvum
SSNKNTL

SEQ ID NO: 2351115 - protein, 5 aa, Cryptosporidium parvum
SSNLA

SEQ ID NO: 2351116 - protein, 14 aa, Cryptosporidium parvum
SSNNENGDNENVQM

SEQ ID NO: 2351117 - protein, 8 aa, Cryptosporidium parvum
SSNNLNDQ

SEQ ID NO: 2351118 - protein, 21 aa, Cryptosporidium parvum
SSNNSVSSGIGDSGTGNEKRY

SEQ ID NO: 2351119 - protein, 20 aa, Cryptosporidium parvum
SSNPAGGTSHRRRIARAKRS

SEQ ID NO: 2351120 - protein, 5 aa, Cryptosporidium parvum
SSNSR

SEQ ID NO: 2351121 - protein, 12 aa, Cryptosporidium parvum
SSNVTEDSQGYP

SEQ ID NO: 2351122 - protein, 5 aa, Cryptosporidium parvum
SSQES

SEQ ID NO: 2351123 - protein, 7 aa, Cryptosporidium parvum
SSQPKSA

SEQ ID NO: 2351124 - protein, 6 aa, Cryptosporidium parvum
SSRQSN

SEQ ID NO: 2351125 - protein, 13 aa, Cryptosporidium parvum
SSRQSQTIGRHDA

SEQ ID NO: 2351126 - protein, 6 aa, Cryptosporidium parvum
SSRTRQ

SEQ ID NO: 2351127 - protein, 35 aa, Cryptosporidium parvum; identical to SEQ ID NO: 2163678

SEQ ID NO: 2351128 - protein, 15 aa, Cryptosporidium parvum
SSSESKSDSETKERT

SEQ ID NO: 2351129 - protein, 42 aa, Cryptosporidium parvum; identical to SEQ ID NO: 2283689

SEQ ID NO: 2351130 - protein, 8 aa, Cryptosporidium parvum
SSSGREDV

SEQ ID NO: 2351131 - protein, 19 aa, Cryptosporidium parvum
SSSGVSTKINDTEKREVSA

SEQ ID NO: 2351132 - protein, 6 aa, Cryptosporidium parvum
SSSIKS

SEQ ID NO: 2351133 - protein, 11 aa, Cryptosporidium parvum
SSSINKGNDDV

SEQ ID NO: 2351134 - protein, 10 aa, Cryptosporidium parvum
SSSRNYESRT

SEQ ID NO: 2351135 - protein, 8 aa, Cryptosporidium parvum
SSSSFSSG

SEQ ID NO: 2351136 - protein, 11 aa, Cryptosporidium parvum
SSSSNESQIKE

SEQ ID NO: 2351137 - protein, 13 aa, Cryptosporidium parvum
SSSSQPNESNHNI

SEQ ID NO: 2351138 - protein, 20 aa, Cryptosporidium parvum
SSSSRYNRDYPNGSRSSLSQ

SEQ ID NO: 2351139 - protein, 10 aa, Cryptosporidium parvum
SSSSSSKENL

SEQ ID NO: 2351140 - protein, 15 aa, Cryptosporidium parvum
SSSSSSSSPSQEQKL

SEQ ID NO: 2351141 - protein, 21 aa, Cryptosporidium parvum
SSSSTGIPRPGRPKRTVTAKK

SEQ ID NO: 2351142 - protein, 8 aa, Cryptosporidium parvum
SSSTTFSD

SEQ ID NO: 2351143 - protein, 4 aa, Cryptosporidium parvum
SSSV

SEQ ID NO: 2351144 - protein, 10 aa, Cryptosporidium parvum
SSSVSSYKDH

SEQ ID NO: 2351145 - protein, 13 aa, Cryptosporidium parvum
SSTGNSNGTQGNI

SEQ ID NO: 2351146 - protein, 23 aa, Cryptosporidium parvum
SSTISKGGMSSNISNSSRFSNAS

SEQ ID NO: 2351147 - protein, 4 aa, Cryptosporidium parvum
SSTL

SEQ ID NO: 2351148 - protein, 7 aa, Cryptosporidium parvum
SSTSGNS

SEQ ID NO: 2351149 - protein, 10 aa, Cryptosporidium parvum
SSTSIGNSNG

SEQ ID NO: 2351150 - protein, 9 aa, Cryptosporidium parvum
SSVDQDSGF

SEQ ID NO: 2351151 - protein, 19 aa, Cryptosporidium parvum
SSVKANNKGIPSSPRDGAD

SEQ ID NO: 2351152 - protein, 6 aa, Cryptosporidium parvum
SSVRTE

SEQ ID NO: 2351153 - protein, 4 aa, Cryptosporidium parvum
SSWD

SEQ ID NO: 2351154 - protein, 85 aa, Cryptosporidium parvum; identical to SEQ ID NO: 2283867

SEQ ID NO: 2351155 - protein, 7 aa, Cryptosporidium parvum
STAPIGG

SEQ ID NO: 2351156 - protein, 17 aa, Cryptosporidium parvum
STDNGTLNNIENTNSLN

SEQ ID NO: 2351157 - protein, 14 aa, Cryptosporidium parvum
STDNPGSLFSSTNN

SEQ ID NO: 2351158 - protein, 5 aa, Cryptosporidium parvum
STETR

SEQ ID NO: 2351159 - protein, 9 aa, Cryptosporidium parvum
STFGGKNSH

SEQ ID NO: 2351160 - protein, 10 aa, Cryptosporidium parvum
STFYGDSGPL

SEQ ID NO: 2351161 - protein, 14 aa, Cryptosporidium parvum
STGDDGRCLLWDVR

SEQ ID NO: 2351162 - protein, 7 aa, Cryptosporidium parvum
STGESIT

SEQ ID NO: 2351163 - protein, 14 aa, Cryptosporidium parvum
STGKFPSQNPSPEF

SEQ ID NO: 2351164 - protein, 7 aa, Cryptosporidium parvum
STGQKKK

SEQ ID NO: 2351165 - protein, 7 aa, Cryptosporidium parvum
STHNPAS

SEQ ID NO: 2351166 - protein, 11 aa, Cryptosporidium parvum
STIGTTTSGTI

SEQ ID NO: 2351167 - protein, 4 aa, Cryptosporidium parvum
STIS

SEQ ID NO: 2351168 - protein, 9 aa, Cryptosporidium parvum
STKEKYRWG

SEQ ID NO: 2351169 - protein, 9 aa, Cryptosporidium parvum
STKPSRRQC

SEQ ID NO: 2351170 - protein, 4 aa, Cryptosporidium parvum
STKY

SEQ ID NO: 2351171 - protein, 5 aa, Cryptosporidium parvum
STLDI

SEQ ID NO: 2351172 - protein, 12 aa, Cryptosporidium parvum
STLDPEKNDQNE

SEQ ID NO: 2351173 - protein, 20 aa, Cryptosporidium parvum
STLDSGNIRSNLNGSQNNTL

SEQ ID NO: 2351174 - protein, 14 aa, Cryptosporidium parvum
STNEEAGDGTTTAT

SEQ ID NO: 2351175 - protein, 25 aa, Cryptosporidium parvum
STNIEKGNSEDDESEKQENSIYDVI

SEQ ID NO: 2351176 - protein, 8 aa, Cryptosporidium parvum
STNSSSMI

SEQ ID NO: 2351177 - protein, 5 aa, Cryptosporidium parvum
STPIS

SEQ ID NO: 2351178 - protein, 10 aa, Cryptosporidium parvum
STPSGTIPGL

SEQ ID NO: 2351179 - protein, 10 aa, Cryptosporidium parvum
STPTNNNSMA

SEQ ID NO: 2351180 - protein, 18 aa, Cryptosporidium parvum
STQIGKDNMGYSNRKQRR

SEQ ID NO: 2351181 - protein, 5 aa, Cryptosporidium parvum
STQLT

SEQ ID NO: 2351182 - protein, 13 aa, Cryptosporidium parvum
STRKKFGYNRSEK

SEQ ID NO: 2351183 - protein, 4 aa, Cryptosporidium parvum
STRN

SEQ ID NO: 2351184 - protein, 6 aa, Cryptosporidium parvum
STSDNK

SEQ ID NO: 2351185 - protein, 8 aa, Cryptosporidium parvum
STSFTSKP

SEQ ID NO: 2351186 - protein, 10 aa, Cryptosporidium parvum
STSIKAESLE

SEQ ID NO: 2351187 - protein, 5 aa, Cryptosporidium parvum
STSQN

SEQ ID NO: 2351188 - protein, 21 aa, Cryptosporidium parvum
STSSGLNLNSGLGKNGIGSGD

SEQ ID NO: 2351189 - protein, 6 aa, Cryptosporidium parvum
STSSPS

SEQ ID NO: 2351190 - protein, 10 aa, Cryptosporidium parvum
STSSSNTNYT

SEQ ID NO: 2351191 - protein, 15 aa, Cryptosporidium parvum
STSSSRCQTEENELE

SEQ ID NO: 2351192 - protein, 5 aa, Cryptosporidium parvum
STSTG

SEQ ID NO: 2351193 - protein, 14 aa, Cryptosporidium parvum
STSTGNNVQGISKT

SEQ ID NO: 2351194 - protein, 6 aa, Cryptosporidium parvum
STTEED

SEQ ID NO: 2351195 - protein, 12 aa, Cryptosporidium parvum
STTKSSNCSNNI

SEQ ID NO: 2351196 - protein, 6 aa, Cryptosporidium parvum
STVNSL

SEQ ID NO: 2351197 - protein, 6 aa, Cryptosporidium parvum
STVSDS

SEQ ID NO: 2351198 - protein, 31 aa, Cryptosporidium parvum; identical to SEQ ID NO: 2284196

SEQ ID NO: 2351199 - protein, 8 aa, Cryptosporidium parvum
SVDKPIGD

SEQ ID NO: 2351200 - protein, 11 aa, Cryptosporidium parvum
SVDPKSKWKQI

SEQ ID NO: 2351201 - protein, 9 aa, Cryptosporidium parvum
SVDSNAERN

SEQ ID NO: 2351202 - protein, 6 aa, Cryptosporidium parvum
SVEDSE

SEQ ID NO: 2351203 - protein, 7 aa, Cryptosporidium parvum
SVGGNKM

SEQ ID NO: 2351204 - protein, 7 aa, Cryptosporidium parvum
SVGPDLS

SEQ ID NO: 2351205 - protein, 10 aa, Cryptosporidium parvum
SVGTEKDNEM

SEQ ID NO: 2351206 - protein, 5 aa, Cryptosporidium parvum
SVKGE

SEQ ID NO: 2351207 - protein, 6 aa, Cryptosporidium parvum
SVNNEN

SEQ ID NO: 2351208 - protein, 9 aa, Cryptosporidium parvum
SVNPPPQIA

SEQ ID NO: 2351209 - protein, 15 aa, Cryptosporidium parvum
SVNSSEETNCTTSSE

SEQ ID NO: 2351210 - protein, 12 aa, Cryptosporidium parvum
SVPKKSDISEIS

SEQ ID NO: 2351211 - protein, 6 aa, Cryptosporidium parvum
SVPKSG

SEQ ID NO: 2351212 - protein, 23 aa, Cryptosporidium parvum
SVPNTIEQQPNEASSASNSNAGA

SEQ ID NO: 2351213 - protein, 10 aa, Cryptosporidium parvum
SVPTQSKLNS

SEQ ID NO: 2351214 - protein, 12 aa, Cryptosporidium parvum
SVSDSENNNPHY

SEQ ID NO: 2351215 - protein, 14 aa, Cryptosporidium parvum
SVSNDNLSKNPTII

SEQ ID NO: 2351216 - protein, 8 aa, Cryptosporidium parvum
SVTPEAED

SEQ ID NO: 2351217 - protein, 12 aa, Cryptosporidium parvum
SVTRYDPNVRGR

SEQ ID NO: 2351218 - protein, 5 aa, Cryptosporidium parvum
SWKPI

SEQ ID NO: 2351219 - protein, 5 aa, Cryptosporidium parvum
SYDDQ

SEQ ID NO: 2351220 - protein, 12 aa, Cryptosporidium parvum
SYEFQQQPSSRR

SEQ ID NO: 2351221 - protein, 16 aa, Cryptosporidium parvum
SYKAEFERNKDEALKR

SEQ ID NO: 2351222 - protein, 5 aa, Cryptosporidium parvum
SYPAP

SEQ ID NO: 2351223 - protein, 4 aa, Cryptosporidium parvum
SYPG

SEQ ID NO: 2351224 - protein, 6 aa, Cryptosporidium parvum
SYPTPF

SEQ ID NO: 2351225 - protein, 8 aa, Cryptosporidium parvum
SYSKAAQD

SEQ ID NO: 2351226 - protein, 4 aa, Cryptosporidium parvum
SYYN

SEQ ID NO: 2351227 - protein, 7 aa, Cryptosporidium parvum
TADSIGK

SEQ ID NO: 2351228 - protein, 9 aa, Cryptosporidium parvum
TAENGKGFS

SEQ ID NO: 2351229 - protein, 32 aa, Cryptosporidium parvum; identical to SEQ ID NO: 2284405

SEQ ID NO: 2351230 - protein, 11 aa, Cryptosporidium parvum
TAGKNSNSNTI

SEQ ID NO: 2351231 - protein, 9 aa, Cryptosporidium parvum
TAHSTRKEA

SEQ ID NO: 2351232 - protein, 8 aa, Cryptosporidium parvum
TAIEESEE

SEQ ID NO: 2351233 - protein, 4 aa, Cryptosporidium parvum
TAIT

SEQ ID NO: 2351234 - protein, 11 aa, Cryptosporidium parvum
TANTNSNTTNI

SEQ ID NO: 2351235 - protein, 139 aa, Cryptosporidium parvum
TAPETTTTGAAGVTGSTNTTGTTTRTTTGATGATGATGATNTTGTTTRTTTGATGATGTTGTTTTTTTTTTGATGTTTDTNTTTTTTTTGTTGTTGTTDTSGFTTGATTTTTFKKTATTGTQKQGENNTVTNTSTVNTE

SEQ ID NO: 2351236 - protein, 8 aa, Cryptosporidium parvum
TARIGSKG

SEQ ID NO: 2351237 - protein, 6 aa, Cryptosporidium parvum
TASDDG

SEQ ID NO: 2351238 - protein, 5 aa, Cryptosporidium parvum
TCGGP

SEQ ID NO: 2351239 - protein, 6 aa, Cryptosporidium parvum
TCIEGG

SEQ ID NO: 2351240 - protein, 12 aa, Cryptosporidium parvum
TCNNNPEMQNQI

SEQ ID NO: 2351241 - protein, 22 aa, Cryptosporidium parvum
TDAENKAKIEKSTSKKRPVIKG

SEQ ID NO: 2351242 - protein, 4 aa, Cryptosporidium parvum
TDCL

SEQ ID NO: 2351243 - protein, 38 aa, Cryptosporidium parvum
TDDEVEGQKDDQKETNQSTLEGGLENVGGGGVGDSEEF

SEQ ID NO: 2351244 - protein, 4 aa, Cryptosporidium parvum
TDDS

SEQ ID NO: 2351245 - protein, 10 aa, Cryptosporidium parvum
TDEEENPSSK

SEQ ID NO: 2351246 - protein, 4 aa, Cryptosporidium parvum
TDEN

SEQ ID NO: 2351247 - protein, 10 aa, Cryptosporidium parvum
TDEVNTEDPK

SEQ ID NO: 2351248 - protein, 4 aa, Cryptosporidium parvum
TDID

SEQ ID NO: 2351249 - protein, 5 aa, Cryptosporidium parvum
TDNMH

SEQ ID NO: 2351250 - protein, 12 aa, Cryptosporidium parvum
TDNNADFGHNGR

SEQ ID NO: 2351251 - protein, 9 aa, Cryptosporidium parvum
TDNPAKIGN

SEQ ID NO: 2351252 - protein, 5 aa, Cryptosporidium parvum
TDNSF

SEQ ID NO: 2351253 - protein, 4 aa, Cryptosporidium parvum
TDNT

SEQ ID NO: 2351254 - protein, 8 aa, Cryptosporidium parvum
TDPKSGDY

SEQ ID NO: 2351255 - protein, 7 aa, Cryptosporidium parvum
TDQLNEK

SEQ ID NO: 2351256 - protein, 7 aa, Cryptosporidium parvum
TDSSRGL

SEQ ID NO: 2351257 - protein, 8 aa, Cryptosporidium parvum
TDVEGKSL

SEQ ID NO: 2351258 - protein, 9 aa, Cryptosporidium parvum
TEAERKRRM

SEQ ID NO: 2351259 - protein, 9 aa, Cryptosporidium parvum
TEDGKEKKV

SEQ ID NO: 2351260 - protein, 15 aa, Cryptosporidium parvum
TEDLGSQKPKMADQS

SEQ ID NO: 2351261 - protein, 5 aa, Cryptosporidium parvum
TEEAT

SEQ ID NO: 2351262 - protein, 6 aa, Cryptosporidium parvum
TEEDDR

SEQ ID NO: 2351263 - protein, 14 aa, Cryptosporidium parvum
TEEERSKRRSDAKR

SEQ ID NO: 2351264 - protein, 17 aa, Cryptosporidium parvum
TEEINNSNSYSQSCNTI

SEQ ID NO: 2351265 - protein, 9 aa, Cryptosporidium parvum
TEIPPGSMP

SEQ ID NO: 2351266 - protein, 7 aa, Cryptosporidium parvum
TEKKTRE

SEQ ID NO: 2351267 - protein, 12 aa, Cryptosporidium parvum
TEKYNSKEDSDF

SEQ ID NO: 2351268 - protein, 14 aa, Cryptosporidium parvum
TELKKDEANSSTYI

SEQ ID NO: 2351269 - protein, 5 aa, Cryptosporidium parvum
TENFK

SEQ ID NO: 2351270 - protein, 9 aa, Cryptosporidium parvum
TENKNEENL

SEQ ID NO: 2351271 - protein, 4 aa, Cryptosporidium parvum
TENN

SEQ ID NO: 2351272 - protein, 7 aa, Cryptosporidium parvum
TEPGEAV

SEQ ID NO: 2351273 - protein, 5 aa, Cryptosporidium parvum
TEPGS

SEQ ID NO: 2351274 - protein, 12 aa, Cryptosporidium parvum
TEQEKKDPSNSN

SEQ ID NO: 2351275 - protein, 10 aa, Cryptosporidium parvum
TERENTEKEN

SEQ ID NO: 2351276 - protein, 4 aa, Cryptosporidium parvum
TERP

SEQ ID NO: 2351277 - protein, 5 aa, Cryptosporidium parvum
TESEV

SEQ ID NO: 2351278 - protein, 11 aa, Cryptosporidium parvum
TESGAKAEIDN

SEQ ID NO: 2351279 - protein, 38 aa, Cryptosporidium parvum; identical to SEQ ID NO: 2164675

SEQ ID NO: 2351280 - protein, 24 aa, Cryptosporidium parvum
TESPSYGKKAKRTDSDSSDNESVI

SEQ ID NO: 2351281 - protein, 6 aa, Cryptosporidium parvum
TESTAV

SEQ ID NO: 2351282 - protein, 6 aa, Cryptosporidium parvum
TFGPKG

SEQ ID NO: 2351283 - protein, 4 aa, Cryptosporidium parvum
TFNS

SEQ ID NO: 2351284 - protein, 11 aa, Cryptosporidium parvum
TFPGSQPVSLN

SEQ ID NO: 2351285 - protein, 28 aa, Cryptosporidium parvum
TFSQAGNNQTINSNNYSNFRSSNRHNSS

SEQ ID NO: 2351286 - protein, 5 aa, Cryptosporidium parvum
TFTGG

SEQ ID NO: 2351287 - protein, 5 aa, Cryptosporidium parvum
TGADD

SEQ ID NO: 2351288 - protein, 9 aa, Cryptosporidium parvum
TGDGSSSAA

SEQ ID NO: 2351289 - protein, 6 aa, Cryptosporidium parvum
TGGCDG

SEQ ID NO: 2351290 - protein, 5 aa, Cryptosporidium parvum
TGGGK

SEQ ID NO: 2351291 - protein, 4 aa, Cryptosporidium parvum
TGIR

SEQ ID NO: 2351292 - protein, 6 aa, Cryptosporidium parvum
TGISSV

SEQ ID NO: 2351293 - protein, 36 aa, Cryptosporidium parvum; identical to SEQ ID NO: 2164785

SEQ ID NO: 2351294 - protein, 5 aa, Cryptosporidium parvum
TGKTK

SEQ ID NO: 2351295 - protein, 6 aa, Cryptosporidium parvum
TGPSSY

SEQ ID NO: 2351296 - protein, 9 aa, Cryptosporidium parvum
TGQKKAQEL

SEQ ID NO: 2351297 - protein, 16 aa, Cryptosporidium parvum
TGSRDKYDQENIGNSI

SEQ ID NO: 2351298 - protein, 24 aa, Cryptosporidium parvum
TGSSIAPVDSPSTCGEESITPSKE

SEQ ID NO: 2351299 - protein, 27 aa, Cryptosporidium parvum
TGSTNSSTAAASSSLFGGSNPSNNTLG

SEQ ID NO: 2351300 - protein, 6 aa, Cryptosporidium parvum
TGTSQA

SEQ ID NO: 2351301 - protein, 20 aa, Cryptosporidium parvum
TGYETPTKLSYGAGDRSSSI

SEQ ID NO: 2351302 - protein, 4 aa, Cryptosporidium parvum
TGYI

SEQ ID NO: 2351303 - protein, 8 aa, Cryptosporidium parvum
THKDGGLG

SEQ ID NO: 2351304 - protein, 6 aa, Cryptosporidium parvum
THPSQT

SEQ ID NO: 2351305 - protein, 9 aa, Cryptosporidium parvum
THSDSDGNI

SEQ ID NO: 2351306 - protein, 9 aa, Cryptosporidium parvum
TIESSSNNN

SEQ ID NO: 2351307 - protein, 12 aa, Cryptosporidium parvum
TIKENKEKMPNR

SEQ ID NO: 2351308 - protein, 9 aa, Cryptosporidium parvum
TIKSSVTTN

SEQ ID NO: 2351309 - protein, 8 aa, Cryptosporidium parvum
TINESYKS

SEQ ID NO: 2351310 - protein, 13 aa, Cryptosporidium parvum
TIQATNELKENFG

SEQ ID NO: 2351311 - protein, 26 aa, Cryptosporidium parvum
TIQESYYSNYDKNGMNKNNDEYELND

SEQ ID NO: 2351312 - protein, 5 aa, Cryptosporidium parvum
TIQTE

SEQ ID NO: 2351313 - protein, 51 aa, Cryptosporidium parvum; identical to SEQ ID NO: 2164937

SEQ ID NO: 2351314 - protein, 5 aa, Cryptosporidium parvum
TISSP

SEQ ID NO: 2351315 - protein, 5 aa, Cryptosporidium parvum
TKAQK

SEQ ID NO: 2351316 - protein, 15 aa, Cryptosporidium parvum
TKDKEEEEEEEEEEE

SEQ ID NO: 2351317 - protein, 5 aa, Cryptosporidium parvum
TKDTI

SEQ ID NO: 2351318 - protein, 9 aa, Cryptosporidium parvum
TKEALRQEK

SEQ ID NO: 2351319 - protein, 9 aa, Cryptosporidium parvum
TKENANKEI

SEQ ID NO: 2351320 - protein, 5 aa, Cryptosporidium parvum
TKEVD

SEQ ID NO: 2351321 - protein, 10 aa, Cryptosporidium parvum
TKFKPGTTNL

SEQ ID NO: 2351322 - protein, 4 aa, Cryptosporidium parvum
TKGT

SEQ ID NO: 2351323 - protein, 19 aa, Cryptosporidium parvum
TKIDSYRSSLQQSKKELVS

SEQ ID NO: 2351324 - protein, 9 aa, Cryptosporidium parvum
TKIEIKDKK

SEQ ID NO: 2351325 - protein, 12 aa, Cryptosporidium parvum
TKITSKDTRFSS

SEQ ID NO: 2351326 - protein, 27 aa, Cryptosporidium parvum
TKIYPPSDGEISPESDSSRSLSRSISP

SEQ ID NO: 2351327 - protein, 8 aa, Cryptosporidium parvum
TKKMGKKE

SEQ ID NO: 2351328 - protein, 17 aa, Cryptosporidium parvum
TKKQDESKDNSSNKTQE

SEQ ID NO: 2351329 - protein, 16 aa, Cryptosporidium parvum
TKKSRGRGRPKSKPKQ

SEQ ID NO: 2351330 - protein, 4 aa, Cryptosporidium parvum
TKKV

SEQ ID NO: 2351331 - protein, 8 aa, Cryptosporidium parvum
TKMPATST

SEQ ID NO: 2351332 - protein, 9 aa, Cryptosporidium parvum
TKNQRHDNH

SEQ ID NO: 2351333 - protein, 21 aa, Cryptosporidium parvum
TKNTNKPSKQGGGKGRKGGKR

SEQ ID NO: 2351334 - protein, 5 aa, Cryptosporidium parvum
TKNYA

SEQ ID NO: 2351335 - protein, 7 aa, Cryptosporidium parvum
TKQTANE

SEQ ID NO: 2351336 - protein, 9 aa, Cryptosporidium parvum
TKSDNESAA

SEQ ID NO: 2351337 - protein, 8 aa, Cryptosporidium parvum
TKSKGPEI

SEQ ID NO: 2351338 - protein, 5 aa, Cryptosporidium parvum
TKSMG

SEQ ID NO: 2351339 - protein, 15 aa, Cryptosporidium parvum
TKVSEDIDRAKEGNI

SEQ ID NO: 2351340 - protein, 64 aa, Cryptosporidium parvum; identical to SEQ ID NO: 2285339

SEQ ID NO: 2351341 - protein, 5 aa, Cryptosporidium parvum
TLATN

SEQ ID NO: 2351342 - protein, 8 aa, Cryptosporidium parvum
TLGKSSKL

SEQ ID NO: 2351343 - protein, 14 aa, Cryptosporidium parvum
TLKDKDREKPINET

SEQ ID NO: 2351344 - protein, 9 aa, Cryptosporidium parvum
TLPEPHRTR

SEQ ID NO: 2351345 - protein, 5 aa, Cryptosporidium parvum
TLPNN

SEQ ID NO: 2351346 - protein, 24 aa, Cryptosporidium parvum
TLQNDLKSSNKTVTNKNKKRKLSQ

SEQ ID NO: 2351347 - protein, 19 aa, Cryptosporidium parvum
TLQNDNKPSCDGEIESKRT

SEQ ID NO: 2351348 - protein, 16 aa, Cryptosporidium parvum
TLSSMKDSSKKEKSTW

SEQ ID NO: 2351349 - protein, 13 aa, Cryptosporidium parvum
TMGNTTNSNDPHV

SEQ ID NO: 2351350 - protein, 6 aa, Cryptosporidium parvum
TMKEDE

SEQ ID NO: 2351351 - protein, 7 aa, Cryptosporidium parvum
TMNPASQ

SEQ ID NO: 2351352 - protein, 18 aa, Cryptosporidium parvum
TNAEATIYEEDASSKTNF

SEQ ID NO: 2351353 - protein, 9 aa, Cryptosporidium parvum
TNDDRNYKY

SEQ ID NO: 2351354 - protein, 8 aa, Cryptosporidium parvum
TNDEKNKK

SEQ ID NO: 2351355 - protein, 5 aa, Cryptosporidium parvum
TNDRD

SEQ ID NO: 2351356 - protein, 5 aa, Cryptosporidium parvum
TNEGK

SEQ ID NO: 2351357 - protein, 6 aa, Cryptosporidium parvum
TNEGSY

SEQ ID NO: 2351358 - protein, 5 aa, Cryptosporidium parvum
TNEPK

SEQ ID NO: 2351359 - protein, 8 aa, Cryptosporidium parvum
TNEVSEQE

SEQ ID NO: 2351360 - protein, 12 aa, Cryptosporidium parvum
TNFRPSNPQPSV

SEQ ID NO: 2351361 - protein, 12 aa, Cryptosporidium parvum
TNHSPTKNPQVF

SEQ ID NO: 2351362 - protein, 9 aa, Cryptosporidium parvum
TNKDHSRVN

SEQ ID NO: 2351363 - protein, 5 aa, Cryptosporidium parvum
TNKEV

SEQ ID NO: 2351364 - protein, 12 aa, Cryptosporidium parvum
TNKGFDNEGKFE

SEQ ID NO: 2351365 - protein, 9 aa, Cryptosporidium parvum
TNKKRKKDL

SEQ ID NO: 2351366 - protein, 19 aa, Cryptosporidium parvum
TNKRQISEEFTEKRDHEYD

SEQ ID NO: 2351367 - protein, 8 aa, Cryptosporidium parvum
TNNDEKSF

SEQ ID NO: 2351368 - protein, 7 aa, Cryptosporidium parvum
TNNETKS

SEQ ID NO: 2351369 - protein, 19 aa, Cryptosporidium parvum
TNNHSKSYKFSHGSNSSFH

SEQ ID NO: 2351370 - protein, 7 aa, Cryptosporidium parvum
TNPSYGD

SEQ ID NO: 2351371 - protein, 17 aa, Cryptosporidium parvum
TNQPYAPISQAPRPLPQ

SEQ ID NO: 2351372 - protein, 9 aa, Cryptosporidium parvum
TNQQEGERN

SEQ ID NO: 2351373 - protein, 6 aa, Cryptosporidium parvum
TNQRQD

SEQ ID NO: 2351374 - protein, 30 aa, Cryptosporidium parvum
TNSGGNSSGNNGEVGGAGVGGVGAGEGIEN

SEQ ID NO: 2351375 - protein, 13 aa, Cryptosporidium parvum
TNSHESNQIDSNI

SEQ ID NO: 2351376 - protein, 5 aa, Cryptosporidium parvum
TNSLQ

SEQ ID NO: 2351377 - protein, 13 aa, Cryptosporidium parvum
TNSPSSPRSPVIE

SEQ ID NO: 2351378 - protein, 4 aa, Cryptosporidium parvum
TNSQ

SEQ ID NO: 2351379 - protein, 4 aa, Cryptosporidium parvum
TNSS

SEQ ID NO: 2351380 - protein, 29 aa, Cryptosporidium parvum
TNTNINTINNNNNNNTNSNNAVNTNTNNA

SEQ ID NO: 2351381 - protein, 12 aa, Cryptosporidium parvum
TNYQKGSSDKHS

SEQ ID NO: 2351382 - protein, 41 aa, Cryptosporidium parvum
TPAKSTSKMQTTPKKGDSPGKSMIKGETPKSGIKKEPSLGK

SEQ ID NO: 2351383 - protein, 5 aa, Cryptosporidium parvum
TPDSG

SEQ ID NO: 2351384 - protein, 5 aa, Cryptosporidium parvum
TPEAV

SEQ ID NO: 2351385 - protein, 21 aa, Cryptosporidium parvum
TPINNTNESPVTPSTGCETPL

SEQ ID NO: 2351386 - protein, 8 aa, Cryptosporidium parvum
TPIPESNN

SEQ ID NO: 2351387 - protein, 4 aa, Cryptosporidium parvum
TPKH

SEQ ID NO: 2351388 - protein, 5 aa, Cryptosporidium parvum
TPLQN

SEQ ID NO: 2351389 - protein, 5 aa, Cryptosporidium parvum
TPMDT

SEQ ID NO: 2351390 - protein, 4 aa, Cryptosporidium parvum
TPNF

SEQ ID NO: 2351391 - protein, 10 aa, Cryptosporidium parvum
TPNKELNSQL

SEQ ID NO: 2351392 - protein, 7 aa, Cryptosporidium parvum
TPNSLNN

SEQ ID NO: 2351393 - protein, 12 aa, Cryptosporidium parvum
TPPDNKSSKHNK

SEQ ID NO: 2351394 - protein, 14 aa, Cryptosporidium parvum
TPQNTKISEESSDR

SEQ ID NO: 2351395 - protein, 4 aa, Cryptosporidium parvum
TPRL

SEQ ID NO: 2351396 - protein, 8 aa, Cryptosporidium parvum
TPRNGEPL

SEQ ID NO: 2351397 - protein, 9 aa, Cryptosporidium parvum
TPSPNPLAN

SEQ ID NO: 2351398 - protein, 5 aa, Cryptosporidium parvum
TPSRE

SEQ ID NO: 2351399 - protein, 5 aa, Cryptosporidium parvum
TPSTI

SEQ ID NO: 2351400 - protein, 5 aa, Cryptosporidium parvum
TPTDN

SEQ ID NO: 2351401 - protein, 10 aa, Cryptosporidium parvum
TPTDQENEQV

SEQ ID NO: 2351402 - protein, 6 aa, Cryptosporidium parvum
TPTSKD

SEQ ID NO: 2351403 - protein, 4 aa, Cryptosporidium parvum
TQAE

SEQ ID NO: 2351404 - protein, 4 aa, Cryptosporidium parvum
TQAK

SEQ ID NO: 2351405 - protein, 8 aa, Cryptosporidium parvum
TQDEITTR

SEQ ID NO: 2351406 - protein, 14 aa, Cryptosporidium parvum
TQIESGLGATEGKN

SEQ ID NO: 2351407 - protein, 27 aa, Cryptosporidium parvum
TQISHETSKIRRKDPNEYSSSLESLSE

SEQ ID NO: 2351408 - protein, 9 aa, Cryptosporidium parvum
TQKAGSMLQ

SEQ ID NO: 2351409 - protein, 4 aa, Cryptosporidium parvum
TQLQ

SEQ ID NO: 2351410 - protein, 4 aa, Cryptosporidium parvum
TQNS

SEQ ID NO: 2351411 - protein, 9 aa, Cryptosporidium parvum
TQNSLGRPE

SEQ ID NO: 2351412 - protein, 7 aa, Cryptosporidium parvum
TQPDHHE

SEQ ID NO: 2351413 - protein, 10 aa, Cryptosporidium parvum
TQQENGPDCA

SEQ ID NO: 2351414 - protein, 5 aa, Cryptosporidium parvum
TQQSL

SEQ ID NO: 2351415 - protein, 7 aa, Cryptosporidium parvum
TQSKINS

SEQ ID NO: 2351416 - protein, 5 aa, Cryptosporidium parvum
TQSYE

SEQ ID NO: 2351417 - protein, 5 aa, Cryptosporidium parvum
TQTYW

SEQ ID NO: 2351418 - protein, 10 aa, Cryptosporidium parvum
TQVEKQGGIG

SEQ ID NO: 2351419 - protein, 18 aa, Cryptosporidium parvum
TRGSGLSLSDNYDSLGGG

SEQ ID NO: 2351420 - protein, 16 aa, Cryptosporidium parvum
TRGSTDQDSFSYNKNS

SEQ ID NO: 2351421 - protein, 4 aa, Cryptosporidium parvum
TRGY

SEQ ID NO: 2351422 - protein, 6 aa, Cryptosporidium parvum
TRHANG

SEQ ID NO: 2351423 - protein, 7 aa, Cryptosporidium parvum
TRKEPSI

SEQ ID NO: 2351424 - protein, 10 aa, Cryptosporidium parvum
TRKKTNGESV

SEQ ID NO: 2351425 - protein, 25 aa, Cryptosporidium parvum
TRKYHPENIDNPTNLSIGKEGGYFP

SEQ ID NO: 2351426 - protein, 7 aa, Cryptosporidium parvum
TRNPSPL

SEQ ID NO: 2351427 - protein, 5 aa, Cryptosporidium parvum
TRPRE

SEQ ID NO: 2351428 - protein, 12 aa, Cryptosporidium parvum
TRQFTQKSKREL

SEQ ID NO: 2351429 - protein, 7 aa, Cryptosporidium parvum
TRQRGNP

SEQ ID NO: 2351430 - protein, 10 aa, Cryptosporidium parvum
TRSEENNPTN

SEQ ID NO: 2351431 - protein, 27 aa, Cryptosporidium parvum
TRSPKSSKGSRSSKPSSILPGSRHRSS

SEQ ID NO: 2351432 - protein, 9 aa, Cryptosporidium parvum
TRYNSSENC

SEQ ID NO: 2351433 - protein, 7 aa, Cryptosporidium parvum
TSADKSQ

SEQ ID NO: 2351434 - protein, 9 aa, Cryptosporidium parvum
TSAVTGEGV

SEQ ID NO: 2351435 - protein, 8 aa, Cryptosporidium parvum
TSDEGMNT

SEQ ID NO: 2351436 - protein, 7 aa, Cryptosporidium parvum
TSDGKNF

SEQ ID NO: 2351437 - protein, 4 aa, Cryptosporidium parvum
TSDL

SEQ ID NO: 2351438 - protein, 18 aa, Cryptosporidium parvum
TSEHAEKHSVHKSSLSGI

SEQ ID NO: 2351439 - protein, 13 aa, Cryptosporidium parvum
TSEISQTKSYSDY

SEQ ID NO: 2351440 - protein, 7 aa, Cryptosporidium parvum
TSENAKE

SEQ ID NO: 2351441 - protein, 21 aa, Cryptosporidium parvum
TSERAEQRLKHNRSSSSGSNI

SEQ ID NO: 2351442 - protein, 4 aa, Cryptosporidium parvum
TSES

SEQ ID NO: 2351443 - protein, 5 aa, Cryptosporidium parvum
TSFSN

SEQ ID NO: 2351444 - protein, 7 aa, Cryptosporidium parvum
TSFSPPE

SEQ ID NO: 2351445 - protein, 8 aa, Cryptosporidium parvum
TSHNVPSE

SEQ ID NO: 2351446 - protein, 5 aa, Cryptosporidium parvum
TSIDS

SEQ ID NO: 2351447 - protein, 5 aa, Cryptosporidium parvum
TSINP

SEQ ID NO: 2351448 - protein, 11 aa, Cryptosporidium parvum
TSKDGSSLSSQ

SEQ ID NO: 2351449 - protein, 8 aa, Cryptosporidium parvum
TSKNSRRI

SEQ ID NO: 2351450 - protein, 6 aa, Cryptosporidium parvum
TSLTST

SEQ ID NO: 2351451 - protein, 8 aa, Cryptosporidium parvum
TSNDIRTN

SEQ ID NO: 2351452 - protein, 5 aa, Cryptosporidium parvum
TSNEK

SEQ ID NO: 2351453 - protein, 5 aa, Cryptosporidium parvum
TSNLP

SEQ ID NO: 2351454 - protein, 9 aa, Cryptosporidium parvum
TSNNLGISS

SEQ ID NO: 2351455 - protein, 18 aa, Cryptosporidium parvum
TSNNSDTEKQKSNINIEE

SEQ ID NO: 2351456 - protein, 12 aa, Cryptosporidium parvum
TSNSTLESDSSS

SEQ ID NO: 2351457 - protein, 4 aa, Cryptosporidium parvum
TSPV

SEQ ID NO: 2351458 - protein, 6 aa, Cryptosporidium parvum
TSSDLS

SEQ ID NO: 2351459 - protein, 8 aa, Cryptosporidium parvum
TSSGDSIA

SEQ ID NO: 2351460 - protein, 6 aa, Cryptosporidium parvum
TSSKDI

SEQ ID NO: 2351461 - protein, 9 aa, Cryptosporidium parvum
TSSNTNVEL

SEQ ID NO: 2351462 - protein, 8 aa, Cryptosporidium parvum
TSSPDPNL

SEQ ID NO: 2351463 - protein, 8 aa, Cryptosporidium parvum
TSSSPDIA

SEQ ID NO: 2351464 - protein, 15 aa, Cryptosporidium parvum
TSSTSTNSGNSGDIV

SEQ ID NO: 2351465 - protein, 4 aa, Cryptosporidium parvum
TSTD

SEQ ID NO: 2351466 - protein, 5 aa, Cryptosporidium parvum
TSTQQ

SEQ ID NO: 2351467 - protein, 5 aa, Cryptosporidium parvum
TSVPE

SEQ ID NO: 2351468 - protein, 11 aa, Cryptosporidium parvum
TTDKDSKVTYK

SEQ ID NO: 2351469 - protein, 7 aa, Cryptosporidium parvum
TTEHPTG

SEQ ID NO: 2351470 - protein, 10 aa, Cryptosporidium parvum
TTENNSTKNM

SEQ ID NO: 2351471 - protein, 6 aa, Cryptosporidium parvum
TTGDTI

SEQ ID NO: 2351472 - protein, 4 aa, Cryptosporidium parvum
TTGN

SEQ ID NO: 2351473 - protein, 8 aa, Cryptosporidium parvum
TTKARPQI

SEQ ID NO: 2351474 - protein, 6 aa, Cryptosporidium parvum
TTKGEM

SEQ ID NO: 2351475 - protein, 6 aa, Cryptosporidium parvum
TTKTRY

SEQ ID NO: 2351476 - protein, 24 aa, Cryptosporidium parvum
TTNLEAGKSDVNKSIKPPNSQGSV

SEQ ID NO: 2351477 - protein, 6 aa, Cryptosporidium parvum
TTPETK

SEQ ID NO: 2351478 - protein, 42 aa, Cryptosporidium parvum; identical to SEQ ID NO: 2286417

SEQ ID NO: 2351479 - protein, 6 aa, Cryptosporidium parvum
TTSEKN

SEQ ID NO: 2351480 - protein, 15 aa, Cryptosporidium parvum
TTSPISPSNSPLHSN

SEQ ID NO: 2351481 - protein, 7 aa, Cryptosporidium parvum
TTSTSSF

SEQ ID NO: 2351482 - protein, 5 aa, Cryptosporidium parvum
TTVGS

SEQ ID NO: 2351483 - protein, 16 aa, Cryptosporidium parvum
TVDGPSKGGKDWRAGR

SEQ ID NO: 2351484 - protein, 14 aa, Cryptosporidium parvum
TVEKRDDIKETKEV

SEQ ID NO: 2351485 - protein, 9 aa, Cryptosporidium parvum
TVENKRREF

SEQ ID NO: 2351486 - protein, 9 aa, Cryptosporidium parvum
TVESGGRHF

SEQ ID NO: 2351487 - protein, 5 aa, Cryptosporidium parvum
TVEVS

SEQ ID NO: 2351488 - protein, 8 aa, Cryptosporidium parvum
TVGDSGKR

SEQ ID NO: 2351489 - protein, 14 aa, Cryptosporidium parvum
TVNKTSTEDVTSTT

SEQ ID NO: 2351490 - protein, 26 aa, Cryptosporidium parvum
TVPTQGNSGNNPSKFKSQLRADAQEF

SEQ ID NO: 2351491 - protein, 14 aa, Cryptosporidium parvum
TVRPPTAPTSFPSN

SEQ ID NO: 2351492 - protein, 7 aa, Cryptosporidium parvum
TVRTSDG

SEQ ID NO: 2351493 - protein, 9 aa, Cryptosporidium parvum
TVTQNISSQ

SEQ ID NO: 2351494 - protein, 4 aa, Cryptosporidium parvum
TWSE

SEQ ID NO: 2351495 - protein, 25 aa, Cryptosporidium parvum
TYGNELTEAAAKEATDCCENQDEAA

SEQ ID NO: 2351496 - protein, 6 aa, Cryptosporidium parvum
TYNENY

SEQ ID NO: 2351497 - protein, 11 aa, Cryptosporidium parvum
TYNSDNNQLVS

SEQ ID NO: 2351498 - protein, 5 aa, Cryptosporidium parvum
TYNSH

SEQ ID NO: 2351499 - protein, 5 aa, Cryptosporidium parvum
TYPER

SEQ ID NO: 2351500 - protein, 13 aa, Cryptosporidium parvum
TYPRTETSRYPKN

SEQ ID NO: 2351501 - protein, 8 aa, Cryptosporidium parvum
TYSDSIKT

SEQ ID NO: 2351502 - protein, 7 aa, Cryptosporidium parvum
VADAERA

SEQ ID NO: 2351503 - protein, 20 aa, Cryptosporidium parvum
VADSDYSKQEQIKNTSGDSK

SEQ ID NO: 2351504 - protein, 4 aa, Cryptosporidium parvum
VAGG

SEQ ID NO: 2351505 - protein, 5 aa, Cryptosporidium parvum
VANRT

SEQ ID NO: 2351506 - protein, 14 aa, Cryptosporidium parvum
VANTKRADEPQRRD

SEQ ID NO: 2351507 - protein, 22 aa, Cryptosporidium parvum
VAPRAKMNQQRSRRFRSARDSE

SEQ ID NO: 2351508 - protein, 10 aa, Cryptosporidium parvum
VAQSKGMAHT

SEQ ID NO: 2351509 - protein, 12 aa, Cryptosporidium parvum
VASTNMNSYSSR

SEQ ID NO: 2351510 - protein, 5 aa, Cryptosporidium parvum
VATDK

SEQ ID NO: 2351511 - protein, 4 aa, Cryptosporidium parvum
VDGS

SEQ ID NO: 2351512 - protein, 10 aa, Cryptosporidium parvum
VDPPSQLTNM

SEQ ID NO: 2351513 - protein, 8 aa, Cryptosporidium parvum
VDRNGKRS

SEQ ID NO: 2351514 - protein, 7 aa, Cryptosporidium parvum
VDRTGNG

SEQ ID NO: 2351515 - protein, 7 aa, Cryptosporidium parvum
VDTSGHL

SEQ ID NO: 2351516 - protein, 9 aa, Cryptosporidium parvum
VEAAKQYTR

SEQ ID NO: 2351517 - protein, 14 aa, Cryptosporidium parvum
VEEDEYPDDEHHIE

SEQ ID NO: 2351518 - protein, 7 aa, Cryptosporidium parvum
VEEDGID

SEQ ID NO: 2351519 - protein, 4 aa, Cryptosporidium parvum
VEGF

SEQ ID NO: 2351520 - protein, 8 aa, Cryptosporidium parvum
VEKPNPKY

SEQ ID NO: 2351521 - protein, 16 aa, Cryptosporidium parvum
VENFEKEDKESKGETI

SEQ ID NO: 2351522 - protein, 5 aa, Cryptosporidium parvum
VENNA

SEQ ID NO: 2351523 - protein, 7 aa, Cryptosporidium parvum
VENSGGL

SEQ ID NO: 2351524 - protein, 7 aa, Cryptosporidium parvum
VEPNNKK

SEQ ID NO: 2351525 - protein, 5 aa, Cryptosporidium parvum
VESLG

SEQ ID NO: 2351526 - protein, 8 aa, Cryptosporidium parvum
VESPDKKK

SEQ ID NO: 2351527 - protein, 8 aa, Cryptosporidium parvum
VESVSEEA

SEQ ID NO: 2351528 - protein, 9 aa, Cryptosporidium parvum
VEVDPETEF

SEQ ID NO: 2351529 - protein, 40 aa, Cryptosporidium parvum; identical to SEQ ID NO: 2286791

SEQ ID NO: 2351530 - protein, 10 aa, Cryptosporidium parvum
VGETSAGTEI

SEQ ID NO: 2351531 - protein, 23 aa, Cryptosporidium parvum
VGGGLQQQEDNISSTVKDSGDVS

SEQ ID NO: 2351532 - protein, 8 aa, Cryptosporidium parvum
VGGSDPMN

SEQ ID NO: 2351533 - protein, 17 aa, Cryptosporidium parvum
VGNEEKIDYKDNTKRES

SEQ ID NO: 2351534 - protein, 10 aa, Cryptosporidium parvum
VGPGGNVSSQ

SEQ ID NO: 2351535 - protein, 10 aa, Cryptosporidium parvum
VGPPGSGFLP

SEQ ID NO: 2351536 - protein, 9 aa, Cryptosporidium parvum
VGQPHSPHP

SEQ ID NO: 2351537 - protein, 5 aa, Cryptosporidium parvum
VGRHG

SEQ ID NO: 2351538 - protein, 4 aa, Cryptosporidium parvum
VHDE

SEQ ID NO: 2351539 - protein, 26 aa, Cryptosporidium parvum
VHKEEASSQEKGKKNKLSRKKIQNIK

SEQ ID NO: 2351540 - protein, 8 aa, Cryptosporidium parvum
VINPGQAF

SEQ ID NO: 2351541 - protein, 9 aa, Cryptosporidium parvum
VISPKPPNA

SEQ ID NO: 2351542 - protein, 7 aa, Cryptosporidium parvum
VKEKNSK

SEQ ID NO: 2351543 - protein, 10 aa, Cryptosporidium parvum
VKKKSEDDFE

SEQ ID NO: 2351544 - protein, 8 aa, Cryptosporidium parvum
VKNESVEL

SEQ ID NO: 2351545 - protein, 7 aa, Cryptosporidium parvum
VKPDSKE

SEQ ID NO: 2351546 - protein, 11 aa, Cryptosporidium parvum
VKSTKKTSENL

SEQ ID NO: 2351547 - protein, 8 aa, Cryptosporidium parvum
VLGGGSKE

SEQ ID NO: 2351548 - protein, 11 aa, Cryptosporidium parvum
VLPNKDKNEIK

SEQ ID NO: 2351549 - protein, 11 aa, Cryptosporidium parvum
VLQNENTFENG

SEQ ID NO: 2351550 - protein, 8 aa, Cryptosporidium parvum
VNEEENKQ

SEQ ID NO: 2351551 - protein, 8 aa, Cryptosporidium parvum
VNEGESGL

SEQ ID NO: 2351552 - protein, 9 aa, Cryptosporidium parvum
VNESSKAEV

SEQ ID NO: 2351553 - protein, 19 aa, Cryptosporidium parvum
VNFRDNSNPVATSTSAGFN

SEQ ID NO: 2351554 - protein, 24 aa, Cryptosporidium parvum
VNKSFNTEKNLSSTLSSGKDSVKV

SEQ ID NO: 2351555 - protein, 11 aa, Cryptosporidium parvum
VNKSLKEEVQV

SEQ ID NO: 2351556 - protein, 21 aa, Cryptosporidium parvum
VNKTNKLNASIGDDVATGNHS

SEQ ID NO: 2351557 - protein, 7 aa, Cryptosporidium parvum
VNLNNPD

SEQ ID NO: 2351558 - protein, 5 aa, Cryptosporidium parvum
VNNPT

SEQ ID NO: 2351559 - protein, 21 aa, Cryptosporidium parvum
VNPNSASSLQISTSQPSSQKL

SEQ ID NO: 2351560 - protein, 8 aa, Cryptosporidium parvum
VNSNNTVQ

SEQ ID NO: 2351561 - protein, 7 aa, Cryptosporidium parvum
VNSNSLR

SEQ ID NO: 2351562 - protein, 12 aa, Cryptosporidium parvum
VNSRNSIQNSNI

SEQ ID NO: 2351563 - protein, 15 aa, Cryptosporidium parvum
VPDKKSLPNNLEASN

SEQ ID NO: 2351564 - protein, 13 aa, Cryptosporidium parvum
VPEDLRKTSPTGH

SEQ ID NO: 2351565 - protein, 9 aa, Cryptosporidium parvum
VPEGESNDL

SEQ ID NO: 2351566 - protein, 6 aa, Cryptosporidium parvum
VPGGGS

SEQ ID NO: 2351567 - protein, 74 aa, Cryptosporidium parvum; identical to SEQ ID NO: 2287170

SEQ ID NO: 2351568 - protein, 8 aa, Cryptosporidium parvum
VPIGATPE

SEQ ID NO: 2351569 - protein, 10 aa, Cryptosporidium parvum
VPNDSESQFS

SEQ ID NO: 2351570 - protein, 4 aa, Cryptosporidium parvum
VPNG

SEQ ID NO: 2351571 - protein, 5 aa, Cryptosporidium parvum
VPNHD

SEQ ID NO: 2351572 - protein, 7 aa, Cryptosporidium parvum
VPNNTRE

SEQ ID NO: 2351573 - protein, 6 aa, Cryptosporidium parvum
VPPTGV

SEQ ID NO: 2351574 - protein, 9 aa, Cryptosporidium parvum
VPPTPQGVA

SEQ ID NO: 2351575 - protein, 11 aa, Cryptosporidium parvum
VPTNNNGSKFK

SEQ ID NO: 2351576 - protein, 4 aa, Cryptosporidium parvum
VPYC

SEQ ID NO: 2351577 - protein, 4 aa, Cryptosporidium parvum
VPYR

SEQ ID NO: 2351578 - protein, 14 aa, Cryptosporidium parvum
VQDEEAEGSGAEEI

SEQ ID NO: 2351579 - protein, 6 aa, Cryptosporidium parvum
VQEAEE

SEQ ID NO: 2351580 - protein, 4 aa, Cryptosporidium parvum
VQET

SEQ ID NO: 2351581 - protein, 16 aa, Cryptosporidium parvum
VQGNGQGGRPGSHGHQ

SEQ ID NO: 2351582 - protein, 9 aa, Cryptosporidium parvum
VQGTTYPGS

SEQ ID NO: 2351583 - protein, 8 aa, Cryptosporidium parvum
VQQAREDA

SEQ ID NO: 2351584 - protein, 13 aa, Cryptosporidium parvum
VQTSTNTSMAEDN

SEQ ID NO: 2351585 - protein, 11 aa, Cryptosporidium parvum
VRERKVTRGDQ

SEQ ID NO: 2351586 - protein, 6 aa, Cryptosporidium parvum
VRGPSR

SEQ ID NO: 2351587 - protein, 12 aa, Cryptosporidium parvum
VRGSSGDKYRQQ

SEQ ID NO: 2351588 - protein, 6 aa, Cryptosporidium parvum
VRIEPE

SEQ ID NO: 2351589 - protein, 7 aa, Cryptosporidium parvum
VRKSGVP

SEQ ID NO: 2351590 - protein, 8 aa, Cryptosporidium parvum
VRNSSSNI

SEQ ID NO: 2351591 - protein, 6 aa, Cryptosporidium parvum
VRNTEK

SEQ ID NO: 2351592 - protein, 7 aa, Cryptosporidium parvum
VRRKQSN

SEQ ID NO: 2351593 - protein, 17 aa, Cryptosporidium parvum
VRTRDHQEQQKKCSAIQ

SEQ ID NO: 2351594 - protein, 14 aa, Cryptosporidium parvum
VSASGTSRSGQGAF

SEQ ID NO: 2351595 - protein, 25 aa, Cryptosporidium parvum
VSDSEITSSRSRSKSLRSTRSENQI

SEQ ID NO: 2351596 - protein, 6 aa, Cryptosporidium parvum
VSEGIN

SEQ ID NO: 2351597 - protein, 32 aa, Cryptosporidium parvum; identical to SEQ ID NO: 2287375

SEQ ID NO: 2351598 - protein, 6 aa, Cryptosporidium parvum
VSEQAK

SEQ ID NO: 2351599 - protein, 6 aa, Cryptosporidium parvum
VSEYRT

SEQ ID NO: 2351600 - protein, 26 aa, Cryptosporidium parvum
VSFSRSGSNIMSNSNGIGNGIKSEFD

SEQ ID NO: 2351601 - protein, 12 aa, Cryptosporidium parvum
VSGEGQPTSSSS

SEQ ID NO: 2351602 - protein, 8 aa, Cryptosporidium parvum
VSHTNGNP

SEQ ID NO: 2351603 - protein, 4 aa, Cryptosporidium parvum
VSKG

SEQ ID NO: 2351604 - protein, 12 aa, Cryptosporidium parvum
VSKHREGSTGTN

SEQ ID NO: 2351605 - protein, 6 aa, Cryptosporidium parvum
VSKPGW

SEQ ID NO: 2351606 - protein, 8 aa, Cryptosporidium parvum
VSNNSNRS

SEQ ID NO: 2351607 - protein, 9 aa, Cryptosporidium parvum
VSPKDIYQR

SEQ ID NO: 2351608 - protein, 6 aa, Cryptosporidium parvum
VSQKEK

SEQ ID NO: 2351609 - protein, 35 aa, Cryptosporidium parvum; identical to SEQ ID NO: 2287479

SEQ ID NO: 2351610 - protein, 11 aa, Cryptosporidium parvum
VSSLGRVGGAV

SEQ ID NO: 2351611 - protein, 24 aa, Cryptosporidium parvum
VSSNSNGIKGGASNASNSHDPNNL

SEQ ID NO: 2351612 - protein, 4 aa, Cryptosporidium parvum
VSSP

SEQ ID NO: 2351613 - protein, 10 aa, Cryptosporidium parvum
VSSPNKPGKI

SEQ ID NO: 2351614 - protein, 8 aa, Cryptosporidium parvum
VSSTGDQI

SEQ ID NO: 2351615 - protein, 47 aa, Cryptosporidium parvum; identical to SEQ ID NO: 2287515

SEQ ID NO: 2351616 - protein, 24 aa, Cryptosporidium parvum
VSTSSSSTSASSPTPSSSNPIDTS

SEQ ID NO: 2351617 - protein, 9 aa, Cryptosporidium parvum
VSTTSSLGS

SEQ ID NO: 2351618 - protein, 4 aa, Cryptosporidium parvum
VTED

SEQ ID NO: 2351619 - protein, 9 aa, Cryptosporidium parvum
VTEDPEYQE

SEQ ID NO: 2351620 - protein, 5 aa, Cryptosporidium parvum
VTEDQ

SEQ ID NO: 2351621 - protein, 4 aa, Cryptosporidium parvum
VTGG

SEQ ID NO: 2351622 - protein, 5 aa, Cryptosporidium parvum
VTGHH

SEQ ID NO: 2351623 - protein, 7 aa, Cryptosporidium parvum
VTHPGSG

SEQ ID NO: 2351624 - protein, 13 aa, Cryptosporidium parvum
VTINADKKSISNK

SEQ ID NO: 2351625 - protein, 5 aa, Cryptosporidium parvum
VTNET

SEQ ID NO: 2351626 - protein, 18 aa, Cryptosporidium parvum
VTNNDQVGINKEEQSSYL

SEQ ID NO: 2351627 - protein, 4 aa, Cryptosporidium parvum
VTPE

SEQ ID NO: 2351628 - protein, 5 aa, Cryptosporidium parvum
VTPGH

SEQ ID NO: 2351629 - protein, 5 aa, Cryptosporidium parvum
VTPNA

SEQ ID NO: 2351630 - protein, 5 aa, Cryptosporidium parvum
VTPNE

SEQ ID NO: 2351631 - protein, 11 aa, Cryptosporidium parvum
VTSDEGRELAD

SEQ ID NO: 2351632 - protein, 8 aa, Cryptosporidium parvum
VTSISGDK

SEQ ID NO: 2351633 - protein, 13 aa, Cryptosporidium parvum
VTTTKGEKTLSPN

SEQ ID NO: 2351634 - protein, 13 aa, Cryptosporidium parvum
VVGNNNTKSSGRL

SEQ ID NO: 2351635 - protein, 7 aa, Cryptosporidium parvum
VVNGKGS

SEQ ID NO: 2351636 - protein, 4 aa, Cryptosporidium parvum
VVPG

SEQ ID NO: 2351637 - protein, 13 aa, Cryptosporidium parvum
VYTSGKSSTAAGL

SEQ ID NO: 2351638 - protein, 6 aa, Cryptosporidium parvum
WDRTSQ

SEQ ID NO: 2351639 - protein, 10 aa, Cryptosporidium parvum
WGLPSPDSQG

SEQ ID NO: 2351640 - protein, 7 aa, Cryptosporidium parvum
WKSDSNP

SEQ ID NO: 2351641 - protein, 6 aa, Cryptosporidium parvum
WNPQAD

SEQ ID NO: 2351642 - protein, 42 aa, Cryptosporidium parvum; identical to SEQ ID NO: 2287701

SEQ ID NO: 2351643 - protein, 7 aa, Cryptosporidium parvum
WPSEDGH

SEQ ID NO: 2351644 - protein, 5 aa, Cryptosporidium parvum
WRKPK

SEQ ID NO: 2351645 - protein, 6 aa, Cryptosporidium parvum
WSDEET

SEQ ID NO: 2351646 - protein, 33 aa, Cryptosporidium parvum; identical to SEQ ID NO: 2287723

SEQ ID NO: 2351647 - protein, 20 aa, Cryptosporidium parvum
WSSSRSTLSIQNESTRDEFD

SEQ ID NO: 2351648 - protein, 4 aa, Cryptosporidium parvum
YAIR

SEQ ID NO: 2351649 - protein, 7 aa, Cryptosporidium parvum
YAKPPFS

SEQ ID NO: 2351650 - protein, 14 aa, Cryptosporidium parvum
YDDDQSLAEARREG

SEQ ID NO: 2351651 - protein, 18 aa, Cryptosporidium parvum
YDGNKVGGGYRGGGSDPL

SEQ ID NO: 2351652 - protein, 7 aa, Cryptosporidium parvum
YDNDSEI

SEQ ID NO: 2351653 - protein, 7 aa, Cryptosporidium parvum
YDPQEDD

SEQ ID NO: 2351654 - protein, 7 aa, Cryptosporidium parvum
YDPSTGI

SEQ ID NO: 2351655 - protein, 12 aa, Cryptosporidium parvum
YDQNRSTISIDP

SEQ ID NO: 2351656 - protein, 4 aa, Cryptosporidium parvum
YDTF

SEQ ID NO: 2351657 - protein, 10 aa, Cryptosporidium parvum
YDVSENTEDV

SEQ ID NO: 2351658 - protein, 13 aa, Cryptosporidium parvum
YEDPNSWRLSKRR

SEQ ID NO: 2351659 - protein, 11 aa, Cryptosporidium parvum
YEEKGKSDKEN

SEQ ID NO: 2351660 - protein, 8 aa, Cryptosporidium parvum
YEENPKFQ

SEQ ID NO: 2351661 - protein, 8 aa, Cryptosporidium parvum
YEKGDTDF

SEQ ID NO: 2351662 - protein, 6 aa, Cryptosporidium parvum
YEKNRD

SEQ ID NO: 2351663 - protein, 11 aa, Cryptosporidium parvum
YEKTISTEKAT

SEQ ID NO: 2351664 - protein, 17 aa, Cryptosporidium parvum
YEMGRPASNTKLGASPR

SEQ ID NO: 2351665 - protein, 5 aa, Cryptosporidium parvum
YENGT

SEQ ID NO: 2351666 - protein, 8 aa, Cryptosporidium parvum
YEQISSEA

SEQ ID NO: 2351667 - protein, 5 aa, Cryptosporidium parvum
YESEG

SEQ ID NO: 2351668 - protein, 5 aa, Cryptosporidium parvum
YESYK

SEQ ID NO: 2351669 - protein, 5 aa, Cryptosporidium parvum
YETEL

SEQ ID NO: 2351670 - protein, 7 aa, Cryptosporidium parvum
YETSEPV

SEQ ID NO: 2351671 - protein, 11 aa, Cryptosporidium parvum
YETTQSGKTQI

SEQ ID NO: 2351672 - protein, 28 aa, Cryptosporidium parvum
YGARKHKDLKSLNEELDESSIENQNKQT

SEQ ID NO: 2351673 - protein, 4 aa, Cryptosporidium parvum
YGDT

SEQ ID NO: 2351674 - protein, 8 aa, Cryptosporidium parvum
YGGDNGFN

SEQ ID NO: 2351675 - protein, 17 aa, Cryptosporidium parvum
YGIPRRNTTVPKTPKFA

SEQ ID NO: 2351676 - protein, 4 aa, Cryptosporidium parvum
YGSD

SEQ ID NO: 2351677 - protein, 10 aa, Cryptosporidium parvum
YGSDAKTRKM

SEQ ID NO: 2351678 - protein, 12 aa, Cryptosporidium parvum
YGSKNGHSNTHI

SEQ ID NO: 2351679 - protein, 5 aa, Cryptosporidium parvum
YGVEK

SEQ ID NO: 2351680 - protein, 8 aa, Cryptosporidium parvum
YGYHPEEN

SEQ ID NO: 2351681 - protein, 11 aa, Cryptosporidium parvum
YHESPLSDGKS

SEQ ID NO: 2351682 - protein, 8 aa, Cryptosporidium parvum
YIERNGKG

SEQ ID NO: 2351683 - protein, 14 aa, Cryptosporidium parvum
YKALKTENKDLKGR

SEQ ID NO: 2351684 - protein, 4 aa, Cryptosporidium parvum
YKDK

SEQ ID NO: 2351685 - protein, 16 aa, Cryptosporidium parvum
YKDRSRSQNEYYNSGI

SEQ ID NO: 2351686 - protein, 20 aa, Cryptosporidium parvum
YKEENKIESIERKKNENNSY

SEQ ID NO: 2351687 - protein, 22 aa, Cryptosporidium parvum
YKELNNSVNTISSVSSSSTGSI

SEQ ID NO: 2351688 - protein, 7 aa, Cryptosporidium parvum
YKENQKS

SEQ ID NO: 2351689 - protein, 17 aa, Cryptosporidium parvum
YKGTGFNGHKKSYPNYL

SEQ ID NO: 2351690 - protein, 8 aa, Cryptosporidium parvum
YKNDTNRI

SEQ ID NO: 2351691 - protein, 7 aa, Cryptosporidium parvum
YKNSNEI

SEQ ID NO: 2351692 - protein, 6 aa, Cryptosporidium parvum
YKPENT

SEQ ID NO: 2351693 - protein, 6 aa, Cryptosporidium parvum
YKPNCD

SEQ ID NO: 2351694 - protein, 46 aa, Cryptosporidium parvum; identical to SEQ ID NO: 2288075

SEQ ID NO: 2351695 - protein, 10 aa, Cryptosporidium parvum
YKSKHRPPWR

SEQ ID NO: 2351696 - protein, 10 aa, Cryptosporidium parvum
YKSNKREKIN

SEQ ID NO: 2351697 - protein, 9 aa, Cryptosporidium parvum
YKSSPPDSR

SEQ ID NO: 2351698 - protein, 9 aa, Cryptosporidium parvum
YKSTQQPPV

SEQ ID NO: 2351699 - protein, 5 aa, Cryptosporidium parvum
YLTEE

SEQ ID NO: 2351700 - protein, 7 aa, Cryptosporidium parvum
YLTEPST

SEQ ID NO: 2351701 - protein, 8 aa, Cryptosporidium parvum
YNGEQERI

SEQ ID NO: 2351702 - protein, 21 aa, Cryptosporidium parvum
YNGKSDHSNPTTLNASKSRNE

SEQ ID NO: 2351703 - protein, 26 aa, Cryptosporidium parvum
YNHGSKQGNSNYGNSGFGQTYRQREH

SEQ ID NO: 2351704 - protein, 11 aa, Cryptosporidium parvum
YNKSSGQTTSN

SEQ ID NO: 2351705 - protein, 17 aa, Cryptosporidium parvum
YNNEAQNNHDEGSKSQT

SEQ ID NO: 2351706 - protein, 8 aa, Cryptosporidium parvum
YNNGKSCE

SEQ ID NO: 2351707 - protein, 7 aa, Cryptosporidium parvum
YNNSPNH

SEQ ID NO: 2351708 - protein, 5 aa, Cryptosporidium parvum
YNQEK

SEQ ID NO: 2351709 - protein, 11 aa, Cryptosporidium parvum
YNSERSSGLHA

SEQ ID NO: 2351710 - protein, 62 aa, Cryptosporidium parvum; identical to SEQ ID NO: 2288212

SEQ ID NO: 2351711 - protein, 7 aa, Cryptosporidium parvum
YNSSSYN

SEQ ID NO: 2351712 - protein, 10 aa, Cryptosporidium parvum
YNTNTNNKTK

SEQ ID NO: 2351713 - protein, 4 aa, Cryptosporidium parvum
YPAA

SEQ ID NO: 2351714 - protein, 13 aa, Cryptosporidium parvum
YPAKDSSHYSGLS

SEQ ID NO: 2351715 - protein, 11 aa, Cryptosporidium parvum
YPDGTTTPQNS

SEQ ID NO: 2351716 - protein, 6 aa, Cryptosporidium parvum
YPESDQ

SEQ ID NO: 2351717 - protein, 5 aa, Cryptosporidium parvum
YPESI

SEQ ID NO: 2351718 - protein, 5 aa, Cryptosporidium parvum
YPNSS

SEQ ID NO: 2351719 - protein, 5 aa, Cryptosporidium parvum
YPPTI

SEQ ID NO: 2351720 - protein, 13 aa, Cryptosporidium parvum
YPREPKKKLSGLD

SEQ ID NO: 2351721 - protein, 8 aa, Cryptosporidium parvum
YPTSPDVV

SEQ ID NO: 2351722 - protein, 6 aa, Cryptosporidium parvum
YPVEEA

SEQ ID NO: 2351723 - protein, 4 aa, Cryptosporidium parvum
YQNE

SEQ ID NO: 2351724 - protein, 17 aa, Cryptosporidium parvum
YQQEKDTKTNTNKQTKE

SEQ ID NO: 2351725 - protein, 8 aa, Cryptosporidium parvum
YQQQQQQQ

SEQ ID NO: 2351726 - protein, 10 aa, Cryptosporidium parvum
YQSDSDVAAE

SEQ ID NO: 2351727 - protein, 5 aa, Cryptosporidium parvum
YQSEK

SEQ ID NO: 2351728 - protein, 9 aa, Cryptosporidium parvum
YRASKEKNL

SEQ ID NO: 2351729 - protein, 18 aa, Cryptosporidium parvum
YREGGIKREELKQNKFGR

SEQ ID NO: 2351730 - protein, 10 aa, Cryptosporidium parvum
YRGKKSNGQF

SEQ ID NO: 2351731 - protein, 9 aa, Cryptosporidium parvum
YRISPNNTI

SEQ ID NO: 2351732 - protein, 10 aa, Cryptosporidium parvum
YRNRKEGGLG

SEQ ID NO: 2351733 - protein, 15 aa, Cryptosporidium parvum
YRSGNSSSSIGSQGV

SEQ ID NO: 2351734 - protein, 9 aa, Cryptosporidium parvum
YSAASQAAA

SEQ ID NO: 2351735 - protein, 30 aa, Cryptosporidium parvum; identical to SEQ ID NO: 2167780

SEQ ID NO: 2351736 - protein, 7 aa, Cryptosporidium parvum
YSGGEGT

SEQ ID NO: 2351737 - protein, 21 aa, Cryptosporidium parvum
YSGGQSPVSEDLAESQRSYYK

SEQ ID NO: 2351738 - protein, 10 aa, Cryptosporidium parvum
YSGSETLSQD

SEQ ID NO: 2351739 - protein, 12 aa, Cryptosporidium parvum
YSGSNDKSQGVD

SEQ ID NO: 2351740 - protein, 14 aa, Cryptosporidium parvum
YSGSQYSSKNTSQL

SEQ ID NO: 2351741 - protein, 7 aa, Cryptosporidium parvum
YSKATST

SEQ ID NO: 2351742 - protein, 11 aa, Cryptosporidium parvum
YSKPTKSEDGN

SEQ ID NO: 2351743 - protein, 22 aa, Cryptosporidium parvum
YSNNKSDNDKDFQYQDENINDE

SEQ ID NO: 2351744 - protein, 5 aa, Cryptosporidium parvum
YSNSR

SEQ ID NO: 2351745 - protein, 18 aa, Cryptosporidium parvum
YSPRESKEVCGGKKRSEI

SEQ ID NO: 2351746 - protein, 7 aa, Cryptosporidium parvum
YSPTNGT

SEQ ID NO: 2351747 - protein, 9 aa, Cryptosporidium parvum
YSQEYEVPP

SEQ ID NO: 2351748 - protein, 25 aa, Cryptosporidium parvum
YSQSYSQGSSSNLGGLTETDSKTMS

SEQ ID NO: 2351749 - protein, 4 aa, Cryptosporidium parvum
YSRK

SEQ ID NO: 2351750 - protein, 16 aa, Cryptosporidium parvum
YSSSKTSLNNQKQKKY

SEQ ID NO: 2351751 - protein, 46 aa, Cryptosporidium parvum
YSSSRGGNSQRGANAVGTSSMTGNMSSAAASSSKGRSISDSRREGL

SEQ ID NO: 2351752 - protein, 9 aa, Cryptosporidium parvum
YSSSTESES

SEQ ID NO: 2351753 - protein, 9 aa, Cryptosporidium parvum
YSSTKGVEK

SEQ ID NO: 2351754 - protein, 5 aa, Cryptosporidium parvum
YSTAA

SEQ ID NO: 2351755 - protein, 7 aa, Cryptosporidium parvum
YSTDGKY

SEQ ID NO: 2351756 - protein, 6 aa, Cryptosporidium parvum
YSYSKT

SEQ ID NO: 2351757 - protein, 6 aa, Cryptosporidium parvum
YTAENR

SEQ ID NO: 2351758 - protein, 15 aa, Cryptosporidium parvum
YTEANDNSYSPNKSS

SEQ ID NO: 2351759 - protein, 13 aa, Cryptosporidium parvum
YTGGSTGELIVCS

SEQ ID NO: 2351760 - protein, 11 aa, Cryptosporidium parvum
YTGKDDPESIY

SEQ ID NO: 2351761 - protein, 21 aa, Cryptosporidium parvum
YTGNSHSHQLEPPNEDLVEDQ

SEQ ID NO: 2351762 - protein, 12 aa, Cryptosporidium parvum
YTHGSSSKVGYT

SEQ ID NO: 2351763 - protein, 20 aa, Cryptosporidium parvum
YTPSTASSIRDKMNLHNLEV

SEQ ID NO: 2351764 - protein, 15 aa, Cryptosporidium parvum
YTQNLDQADSQRNDD

SEQ ID NO: 2351765 - protein, 9 aa, Cryptosporidium parvum
YTQSERKDL

SEQ ID NO: 2351766 - protein, 11 aa, Cryptosporidium parvum
YTRKKNQKGKW

SEQ ID NO: 2351767 - protein, 5 aa, Cryptosporidium parvum
YVPGE

SEQ ID NO: 2351768 - protein, 9 aa, Cryptosporidium parvum
YYGENNGLT

SEQ ID NO: 2351769 - protein, 15 aa, Cryptosporidium parvum
YYNTSNNNYTNTNSW

SEQ ID NO: 2351770 - protein, 5 aa, Cryptosporidium parvum
YYQNN

SEQ ID NO: 2351771 - protein, 23 aa, Cryptosporidium parvum
YYRTRSSSYCTSTCSSSSPPTTG

SEQ ID NO: 2351772 - protein, 26 aa, Cryptosporidium parvum
AAANSWKPIEDGFEISNVIKGNTIDS

SEQ ID NO: 2351773 - protein, 18 aa, Cryptosporidium parvum
AAILSNGELYTWGCSKNG

SEQ ID NO: 2351774 - protein, 26 aa, Cryptosporidium parvum
AAQTGPKLQEWLGLRDWKNNQSKKQN

SEQ ID NO: 2351775 - protein, 20 aa, Cryptosporidium parvum
ACKLNVFKFNCDVSQIRPTI

SEQ ID NO: 2351776 - protein, 19 aa, Cryptosporidium parvum
ADKACGFGVYTYANGNRYE

SEQ ID NO: 2351777 - protein, 24 aa, Cryptosporidium parvum
ADPPWNSGWIDIWFSEEDALTHDI

SEQ ID NO: 2351778 - protein, 29 aa, Cryptosporidium parvum
ADPPYSPYCLRCIMVCTISPSVTFFQQTY

SEQ ID NO: 2351779 - protein, 23 aa, Cryptosporidium parvum
ADQDFNGAQVYYGAVQTPSQTTY

SEQ ID NO: 2351780 - protein, 26 aa, Cryptosporidium parvum
ADRWQCGKCLKQFKGEEYVHKHLAKK

SEQ ID NO: 2351781 - protein, 18 aa, Cryptosporidium parvum
AEALRLATEQSIRVNDEG

SEQ ID NO: 2351782 - protein, 18 aa, Cryptosporidium parvum
AEEMFKKIAEAYEVLSDP

SEQ ID NO: 2351783 - protein, 20 aa, Cryptosporidium parvum
AELCSLNLQKRLRVLPPKHP

SEQ ID NO: 2351784 - protein, 23 aa, Cryptosporidium parvum
AENLCYLAKLFLDHKTLQYDVEP

SEQ ID NO: 2351785 - protein, 18 aa, Cryptosporidium parvum
AENWKNILKSVQFENYKE

SEQ ID NO: 2351786 - protein, 23 aa, Cryptosporidium parvum
AEPLEILLHLPLVCEDKNTPYVF

SEQ ID NO: 2351787 - protein, 26 aa, Cryptosporidium parvum
AEYPTDIRLLSSIAVLTQRITDRAFD

SEQ ID NO: 2351788 - protein, 19 aa, Cryptosporidium parvum
AFERNLLFSGFIKVKKLKG

SEQ ID NO: 2351789 - protein, 20 aa, Cryptosporidium parvum
AFYLEKYLSLVNEVYGSGDL

SEQ ID NO: 2351790 - protein, 18 aa, Cryptosporidium parvum
AGIRSCSEEKLIHGCDSH

SEQ ID NO: 2351791 - protein, 27 aa, Cryptosporidium parvum
AGLPHFSTGFMRSWGRDTFIAFNGILI

SEQ ID NO: 2351792 - protein, 28 aa, Cryptosporidium parvum
AGRNLPLNRFKYSPIVAALKHNHKLLPV

SEQ ID NO: 2351793 - protein, 25 aa, Cryptosporidium parvum
AIAGLCKISSLAPLFSSLNICDDIL

SEQ ID NO: 2351794 - protein, 24 aa, Cryptosporidium parvum
AIESGCKVVLFGSLYRVIHESAKI

SEQ ID NO: 2351795 - protein, 23 aa, Cryptosporidium parvum
AIGKGTRAYQNFLKLKPRKEDRE

SEQ ID NO: 2351796 - protein, 18 aa, Cryptosporidium parvum
AIISCLNSLEIIHPKEPI

SEQ ID NO: 2351797 - protein, 30 aa, Cryptosporidium parvum; identical to SEQ ID NO: 2288880

SEQ ID NO: 2351798 - protein, 20 aa, Cryptosporidium parvum
AKALLQYELRQWFLSNPPSN

SEQ ID NO: 2351799 - protein, 17 aa, Cryptosporidium parvum
AKEGPMMLDDLKSKINA

SEQ ID NO: 2351800 - protein, 24 aa, Cryptosporidium parvum
AKETKKTKALRFWNSVKGTWIFRI

SEQ ID NO: 2351801 - protein, 21 aa, Cryptosporidium parvum
AKGKHNKSLKGERVGVVDIGG

SEQ ID NO: 2351802 - protein, 28 aa, Cryptosporidium parvum
AKKSSECMGRISRFVSRYLANKGMTIGI

SEQ ID NO: 2351803 - protein, 22 aa, Cryptosporidium parvum
AKRRLREKLLRKEISDMKKQKN

SEQ ID NO: 2351804 - protein, 18 aa, Cryptosporidium parvum
AKWDLGWMNDTLSYLYTP

SEQ ID NO: 2351805 - protein, 22 aa, Cryptosporidium parvum
ALCNCLKDDIQWTIDNLYTDIP

SEQ ID NO: 2351806 - protein, 24 aa, Cryptosporidium parvum
ALELTWKYPIENSSNFPNDKNMIG

SEQ ID NO: 2351807 - protein, 23 aa, Cryptosporidium parvum
ALHPEPFGVLGYQKFGDDGQYEY

SEQ ID NO: 2351808 - protein, 19 aa, Cryptosporidium parvum
ALLKDLVFLLGNREFDVFR

SEQ ID NO: 2351809 - protein, 17 aa, Cryptosporidium parvum
ALQPYPTGIKWINETHS

SEQ ID NO: 2351810 - protein, 18 aa, Cryptosporidium parvum
ALTALILNKLQLNLKVCA

SEQ ID NO: 2351811 - protein, 18 aa, Cryptosporidium parvum
ALVEKAAKCDLGAIEGEI

SEQ ID NO: 2351812 - protein, 22 aa, Cryptosporidium parvum
ALYLEVLQFIISQYDPRIKISK

SEQ ID NO: 2351813 - protein, 17 aa, Cryptosporidium parvum
ANALIQILSNCKFLEII

SEQ ID NO: 2351814 - protein, 24 aa, Cryptosporidium parvum
ANDLRKDRCTGLIANLHRMGINNS

SEQ ID NO: 2351815 - protein, 17 aa, Cryptosporidium parvum
ANEWGERLLSYFQFERN

SEQ ID NO: 2351816 - protein, 27 aa, Cryptosporidium parvum
ANGFMFSMVVSYTWNNVYLLGRYIKFS

SEQ ID NO: 2351817 - protein, 18 aa, Cryptosporidium parvum
ANIIYHLCDMFTKYYSDV

SEQ ID NO: 2351818 - protein, 23 aa, Cryptosporidium parvum
ANNEAFFPLPNNFSLKPCDTKTL

SEQ ID NO: 2351819 - protein, 17 aa, Cryptosporidium parvum
ANNLKILVIDEVDRMLD

SEQ ID NO: 2351820 - protein, 18 aa, Cryptosporidium parvum
ANQIRFISNDGSFKSQQL

SEQ ID NO: 2351821 - protein, 23 aa, Cryptosporidium parvum
ANSYRLAGYETSEPVKVEIPLIK

SEQ ID NO: 2351822 - protein, 26 aa, Cryptosporidium parvum
ANTLLRLNNLLSFKGNLLRIGKPKVS

SEQ ID NO: 2351823 - protein, 27 aa, Cryptosporidium parvum
ANVILRLVPRLDVPALIRKSQNSQDVS

SEQ ID NO: 2351824 - protein, 29 aa, Cryptosporidium parvum
APHNLRILRWTIFKSNRLPIGKYVCAIFD

SEQ ID NO: 2351825 - protein, 19 aa, Cryptosporidium parvum
APLENCKMQSYIVDDNGMN

SEQ ID NO: 2351826 - protein, 22 aa, Cryptosporidium parvum
APNRGSIWMVFEYLPYDLSGYI

SEQ ID NO: 2351827 - protein, 22 aa, Cryptosporidium parvum
AQDWTFASSIIKNSSINASNSA

SEQ ID NO: 2351828 - protein, 21 aa, Cryptosporidium parvum
AQGLVGPIFGSFIMTNFRIIL

SEQ ID NO: 2351829 - protein, 18 aa, Cryptosporidium parvum
AQLQALELTWKYPIENSS

SEQ ID NO: 2351830 - protein, 17 aa, Cryptosporidium parvum
AQMIKGKVPLNVGEPKK

SEQ ID NO: 2351831 - protein, 25 aa, Cryptosporidium parvum
AQQHVCEGWAFPMVPDYCSISGQNV

SEQ ID NO: 2351832 - protein, 22 aa, Cryptosporidium parvum
ARAYCRLLYSLSCISFGIPMVF

SEQ ID NO: 2351833 - protein, 23 aa, Cryptosporidium parvum
ARFCPSIKAVKFLGNGQERSDLI

SEQ ID NO: 2351834 - protein, 18 aa, Cryptosporidium parvum
ARIKERFLHEIGLLDSGI

SEQ ID NO: 2351835 - protein, 19 aa, Cryptosporidium parvum
ARISSYSNFGLKELTLDDS

SEQ ID NO: 2351836 - protein, 19 aa, Cryptosporidium parvum
ARPPLPYVPYPNRRPHKPY

SEQ ID NO: 2351837 - protein, 25 aa, Cryptosporidium parvum
ASDIPAELSLKVVYDMLKRREAEGL

SEQ ID NO: 2351838 - protein, 17 aa, Cryptosporidium parvum
ASGFCYINDIVLGILEL

SEQ ID NO: 2351839 - protein, 19 aa, Cryptosporidium parvum
ASGHLLATRKARLMNNVID

SEQ ID NO: 2351840 - protein, 19 aa, Cryptosporidium parvum
ASMKYVFEQYFAKFDYIQE

SEQ ID NO: 2351841 - protein, 18 aa, Cryptosporidium parvum
ASQVKQPNWTGGKELSQQ

SEQ ID NO: 2351842 - protein, 18 aa, Cryptosporidium parvum
ASTMVILQRHGCCTMLLY

SEQ ID NO: 2351843 - protein, 18 aa, Cryptosporidium parvum
ASVAEAFVFWFESEKDML

SEQ ID NO: 2351844 - protein, 24 aa, Cryptosporidium parvum
ATDIGSMLPWFVNLSLKLNAHVLA

SEQ ID NO: 2351845 - protein, 23 aa, Cryptosporidium parvum
ATGCPSLVMARGHRINNVPELPL

SEQ ID NO: 2351846 - protein, 25 aa, Cryptosporidium parvum
ATLCCLSALGLRGKVVSSFSFFPPK

SEQ ID NO: 2351847 - protein, 23 aa, Cryptosporidium parvum
ATLQKRILELFVERRALMDENKS

SEQ ID NO: 2351848 - protein, 23 aa, Cryptosporidium parvum
ATLSRSVTDLALLALNNPCKVST

SEQ ID NO: 2351849 - protein, 26 aa, Cryptosporidium parvum
ATNEKGFSSLHWASLKGHSQVVEELL

SEQ ID NO: 2351850 - protein, 19 aa, Cryptosporidium parvum
ATSTPLIFQNRCQEHHLPS

SEQ ID NO: 2351851 - protein, 20 aa, Cryptosporidium parvum
ATSVKLTFNYFLVKQNELFE

SEQ ID NO: 2351852 - protein, 17 aa, Cryptosporidium parvum
AVKTLATSFSWKSLYQA

SEQ ID NO: 2351853 - protein, 19 aa, Cryptosporidium parvum
AVLGDRPIYVGKFQKKAER

SEQ ID NO: 2351854 - protein, 17 aa, Cryptosporidium parvum
AVSVCREFPDLLRPKAR

SEQ ID NO: 2351855 - protein, 19 aa, Cryptosporidium parvum
AYFKESIWIPNALIPLVRQ

SEQ ID NO: 2351856 - protein, 20 aa, Cryptosporidium parvum
AYFMNCNIFTIPGRTFPVEI

SEQ ID NO: 2351857 - protein, 21 aa, Cryptosporidium parvum
CAQYFLGFCKYGPKCKRRHEP

SEQ ID NO: 2351858 - protein, 26 aa, Cryptosporidium parvum
CCDYYRYIRRKSWLILNVLLLMVDSS

SEQ ID NO: 2351859 - protein, 25 aa, Cryptosporidium parvum
CDGYIRYSLKNCYFFNVPLTRMTMD

SEQ ID NO: 2351860 - protein, 25 aa, Cryptosporidium parvum
CDICSKSIHKSCLKKCNQFIASSSF

SEQ ID NO: 2351861 - protein, 27 aa, Cryptosporidium parvum
CDPLYYSKRVKALMCKSLLNYTDAVRD

SEQ ID NO: 2351862 - protein, 22 aa, Cryptosporidium parvum
CDSSVLCSLVLTVSDLCSMYRD

SEQ ID NO: 2351863 - protein, 24 aa, Cryptosporidium parvum
CEGRVKLGDFGWCGDLCRRCNSMA

SEQ ID NO: 2351864 - protein, 17 aa, Cryptosporidium parvum
CEIGLPNCGAVNFSSLC

SEQ ID NO: 2351865 - protein, 22 aa, Cryptosporidium parvum
CELDERCPFSHCLSWHRRNPYE

SEQ ID NO: 2351866 - protein, 17 aa, Cryptosporidium parvum
CFFGLLDGHGHYGKTAS

SEQ ID NO: 2351867 - protein, 17 aa, Cryptosporidium parvum
CFMMLRMPYESEGAKKL

SEQ ID NO: 2351868 - protein, 28 aa, Cryptosporidium parvum
CGISMGGAIALRLAEYIGQICQEDNLDG

SEQ ID NO: 2351869 - protein, 28 aa, Cryptosporidium parvum
CGIYDSKFKYLILNFSSLYMKKLVQPYY

SEQ ID NO: 2351870 - protein, 18 aa, Cryptosporidium parvum
CGKKVKWFSMDNLEEQKP

SEQ ID NO: 2351871 - protein, 19 aa, Cryptosporidium parvum
CGLTGELRKGEQYLKELRF

SEQ ID NO: 2351872 - protein, 22 aa, Cryptosporidium parvum
CGNMPFKTFIFKILEDSGLSSK

SEQ ID NO: 2351873 - protein, 25 aa, Cryptosporidium parvum
CGRAGRTGYAITFFTLRDIPKIKSI

SEQ ID NO: 2351874 - protein, 18 aa, Cryptosporidium parvum
CIMEFFLYSKKELILELF

SEQ ID NO: 2351875 - protein, 23 aa, Cryptosporidium parvum
CINGLRPALFEADFDNWNEVNAA

SEQ ID NO: 2351876 - protein, 17 aa, Cryptosporidium parvum
CINPNISSMNWYVYQSP

SEQ ID NO: 2351877 - protein, 21 aa, Cryptosporidium parvum
CIRERRGYCDFELDELREDDG

SEQ ID NO: 2351878 - protein, 22 aa, Cryptosporidium parvum
CKEGRIYVLVNIAAKSSSRTST

SEQ ID NO: 2351879 - protein, 19 aa, Cryptosporidium parvum
CKFCPHQTCNFSLKSTFFM

SEQ ID NO: 2351880 - protein, 19 aa, Cryptosporidium parvum
CKLREEFPNVPIIALTATA

SEQ ID NO: 2351881 - protein, 17 aa, Cryptosporidium parvum
CKRHKNKELTYCCTSYG

SEQ ID NO: 2351882 - protein, 30 aa, Cryptosporidium parvum; identical to SEQ ID NO: 2289513

SEQ ID NO: 2351883 - protein, 24 aa, Cryptosporidium parvum
CLIKEIRKSKDFFLNLLQDKNLIY

SEQ ID NO: 2351884 - protein, 23 aa, Cryptosporidium parvum
CLISQCVFIKNSLKYYLNTEYLE

SEQ ID NO: 2351885 - protein, 22 aa, Cryptosporidium parvum
CNAKIEIIGLFSATNIIAVNSN

SEQ ID NO: 2351886 - protein, 32 aa, Cryptosporidium parvum; identical to SEQ ID NO: 2289550

SEQ ID NO: 2351887 - protein, 19 aa, Cryptosporidium parvum
CNILNYLIDGVWRQQQYRL

SEQ ID NO: 2351888 - protein, 18 aa, Cryptosporidium parvum
CNRMYKNELDSFSGIGIV

SEQ ID NO: 2351889 - protein, 19 aa, Cryptosporidium parvum
CNSLDRVKRIFPESNRNQS

SEQ ID NO: 2351890 - protein, 38 aa, Cryptosporidium parvum; identical to SEQ ID NO: 2289570

SEQ ID NO: 2351891 - protein, 21 aa, Cryptosporidium parvum
CNSPLRIVEEGQIDDEEHISR

SEQ ID NO: 2351892 - protein, 25 aa, Cryptosporidium parvum
CPLLHRSAFRLALLVVGISHSVLGK

SEQ ID NO: 2351893 - protein, 17 aa, Cryptosporidium parvum
CPNCTGADIRSVCTEAG

SEQ ID NO: 2351894 - protein, 22 aa, Cryptosporidium parvum
CRDALTRRSLGYAYVNYNSVAD

SEQ ID NO: 2351895 - protein, 18 aa, Cryptosporidium parvum
CRLYLSIKGTRKYHPENI

SEQ ID NO: 2351896 - protein, 24 aa, Cryptosporidium parvum
CSESHAAYTYCCVVSLALLNSLDI

SEQ ID NO: 2351897 - protein, 22 aa, Cryptosporidium parvum
CSIDRLPCFSVENSLINNYLMN

SEQ ID NO: 2351898 - protein, 24 aa, Cryptosporidium parvum
CSISKGSILWVRNFRVITKEFGDR

SEQ ID NO: 2351899 - protein, 21 aa, Cryptosporidium parvum
CSLSLWDLRTSCIDEPIMKNK

SEQ ID NO: 2351900 - protein, 21 aa, Cryptosporidium parvum
CSPQLLKTFCETFDFTDLFND

SEQ ID NO: 2351901 - protein, 27 aa, Cryptosporidium parvum
CTDACLLRYLRGYNLKVIKSFEALAKT

SEQ ID NO: 2351902 - protein, 17 aa, Cryptosporidium parvum
CTEAGMFALRERRKHVT

SEQ ID NO: 2351903 - protein, 22 aa, Cryptosporidium parvum
CTKHYCPFAHGLDELRNPETIE

SEQ ID NO: 2351904 - protein, 24 aa, Cryptosporidium parvum
CTSISGCGPGYFSNIAHHFIQSGI

SEQ ID NO: 2351905 - protein, 20 aa, Cryptosporidium parvum
CTTQCRVIHPNLVHSVNQRW

SEQ ID NO: 2351906 - protein, 25 aa, Cryptosporidium parvum
CTTTTRSGRFVSLKYGYDDILMSDD

SEQ ID NO: 2351907 - protein, 20 aa, Cryptosporidium parvum
CVAHIEMGRLVTKVENPIVL

SEQ ID NO: 2351908 - protein, 19 aa, Cryptosporidium parvum
CVIMGKPIKIGTGSFDILY

SEQ ID NO: 2351909 - protein, 28 aa, Cryptosporidium parvum
CWDSPWGKGRPGWHIECSVMASNTLGFP

SEQ ID NO: 2351910 - protein, 24 aa, Cryptosporidium parvum
CYKEKKFDEALGFYLKALGILELE

SEQ ID NO: 2351911 - protein, 17 aa, Cryptosporidium parvum
CYMAPEILKGERQTAKV

SEQ ID NO: 2351912 - protein, 17 aa, Cryptosporidium parvum
CYSNLGLVYRLLGDCRQ

SEQ ID NO: 2351913 - protein, 20 aa, Cryptosporidium parvum
DALKAVVHIIDLYRSRRGIT

SEQ ID NO: 2351914 - protein, 20 aa, Cryptosporidium parvum
DALLRPGRIDRKIEFPNPNE

SEQ ID NO: 2351915 - protein, 19 aa, Cryptosporidium parvum
DAVSPFIPSVHDPETQINS

SEQ ID NO: 2351916 - protein, 22 aa, Cryptosporidium parvum
DCNRSGLPLGGIIIQSGIASGL

SEQ ID NO: 2351917 - protein, 24 aa, Cryptosporidium parvum
DDEIPRFFKDIGYPITINKTTIIA

SEQ ID NO: 2351918 - protein, 20 aa, Cryptosporidium parvum
DDHKGIRGLYSFFQKENNWQ

SEQ ID NO: 2351919 - protein, 17 aa, Cryptosporidium parvum
DDIRLKVSHNIRFSDFP

SEQ ID NO: 2351920 - protein, 25 aa, Cryptosporidium parvum
DDIVRLLTCRKIQLREGEIMKHLSV

SEQ ID NO: 2351921 - protein, 21 aa, Cryptosporidium parvum
DDLRHAHVLLHIIDISGNTNE

SEQ ID NO: 2351922 - protein, 17 aa, Cryptosporidium parvum
DDLSCYSKENFAHREEQ

SEQ ID NO: 2351923 - protein, 17 aa, Cryptosporidium parvum
DDYCSRLSMKTLMRNSS

SEQ ID NO: 2351924 - protein, 23 aa, Cryptosporidium parvum
DDYKPDPTPAYNFSDEKLRDVQK

SEQ ID NO: 2351925 - protein, 24 aa, Cryptosporidium parvum
DEADRLLDMGFRQECLEILKYSSR

SEQ ID NO: 2351926 - protein, 24 aa, Cryptosporidium parvum
DEEPECSDVIIGHFEKVIRPYTRK

SEQ ID NO: 2351927 - protein, 21 aa, Cryptosporidium parvum
DEINKIILCKNAPNSNVGSLE

SEQ ID NO: 2351928 - protein, 25 aa, Cryptosporidium parvum
DEKARNFFGRFGITGSLALEPLYVL

SEQ ID NO: 2351929 - protein, 22 aa, Cryptosporidium parvum
DEKELFRVFATFDINHLMSVLQ

SEQ ID NO: 2351930 - protein, 18 aa, Cryptosporidium parvum
DELEEEYSNWVIRLQGEN

SEQ ID NO: 2351931 - protein, 20 aa, Cryptosporidium parvum
DEQLHGGLLDGKKYIPGSVG

SEQ ID NO: 2351932 - protein, 20 aa, Cryptosporidium parvum
DEQRESLAFEFSNKKKTESL

SEQ ID NO: 2351933 - protein, 35 aa, Cryptosporidium parvum; identical to SEQ ID NO: 2289902

SEQ ID NO: 2351934 - protein, 17 aa, Cryptosporidium parvum
DEYGRWCRSILNSGQVQ

SEQ ID NO: 2351935 - protein, 25 aa, Cryptosporidium parvum
DFEYIIPIFVIYRIFEVHSENCKSI

SEQ ID NO: 2351936 - protein, 18 aa, Cryptosporidium parvum
DFLSHGGNDFGSRISNSI

SEQ ID NO: 2351937 - protein, 24 aa, Cryptosporidium parvum
DFSCFKALQLESIYSTPIPESNNV

SEQ ID NO: 2351938 - protein, 22 aa, Cryptosporidium parvum
DFTSRIFLKGNFVKFKELIPGN

SEQ ID NO: 2351939 - protein, 29 aa, Cryptosporidium parvum
DGINSLLYEFWIKKFYSITNVEISRSLEP

SEQ ID NO: 2351940 - protein, 24 aa, Cryptosporidium parvum
DGQEFRVPFLVNYETKCELNKFER

SEQ ID NO: 2351941 - protein, 19 aa, Cryptosporidium parvum
DGVLPVKIESVPKKSDISE

SEQ ID NO: 2351942 - protein, 23 aa, Cryptosporidium parvum
DGVYKSIFIRIAEYKVKQRSALF

SEQ ID NO: 2351943 - protein, 18 aa, Cryptosporidium parvum
DHEWLRIEIEMWIFNNIN

SEQ ID NO: 2351944 - protein, 18 aa, Cryptosporidium parvum
DHVEGFSPEVAWVTKSGK

SEQ ID NO: 2351945 - protein, 36 aa, Cryptosporidium parvum; identical to SEQ ID NO: 2169168

SEQ ID NO: 2351946 - protein, 24 aa, Cryptosporidium parvum
DIDKIIRFSICSSSLQMDLINKTL

SEQ ID NO: 2351947 - protein, 26 aa, Cryptosporidium parvum
DIFIAPYRLAELFVIGLPRCSFYMQK

SEQ ID NO: 2351948 - protein, 23 aa, Cryptosporidium parvum
DIFTAKLKFEGVKNVERSKDTII

SEQ ID NO: 2351949 - protein, 18 aa, Cryptosporidium parvum
DIIKSCLDNGANVLHTDK

SEQ ID NO: 2351950 - protein, 17 aa, Cryptosporidium parvum
DIIPFEYHWEKPLFHSK

SEQ ID NO: 2351951 - protein, 24 aa, Cryptosporidium parvum
DIKEGYGKCRFQVINTIEVDDIVE

SEQ ID NO: 2351952 - protein, 18 aa, Cryptosporidium parvum
DILQESYHNFKFISSSNK

SEQ ID NO: 2351953 - protein, 24 aa, Cryptosporidium parvum
DISKSDQAVKCLIQDANLNMPKVF

SEQ ID NO: 2351954 - protein, 18 aa, Cryptosporidium parvum
DKACCKSIRCENVMETVS

SEQ ID NO: 2351955 - protein, 25 aa, Cryptosporidium parvum
DKDIWLESICMVVNAVTRVETLKDA

SEQ ID NO: 2351956 - protein, 20 aa, Cryptosporidium parvum
DKEWGGSCEDVFDPNEYWQK

SEQ ID NO: 2351957 - protein, 23 aa, Cryptosporidium parvum
DKIEGKQRCELMLSINTRKEPSI

SEQ ID NO: 2351958 - protein, 18 aa, Cryptosporidium parvum
DKILRLLLPLFDTGSRDK

SEQ ID NO: 2351959 - protein, 19 aa, Cryptosporidium parvum
DKKALTWGLGLQGRLGHGD

SEQ ID NO: 2351960 - protein, 22 aa, Cryptosporidium parvum
DKKGSFAIFYGIGFRIIQSEER

SEQ ID NO: 2351961 - protein, 29 aa, Cryptosporidium parvum
DKKLGISKGYCFLCYEDQKSTILAVDNAN

SEQ ID NO: 2351962 - protein, 22 aa, Cryptosporidium parvum
DKRILIKKCVPICQRLFYSDTV

SEQ ID NO: 2351963 - protein, 19 aa, Cryptosporidium parvum
DKSITEFIEDIIISLPEGF

SEQ ID NO: 2351964 - protein, 17 aa, Cryptosporidium parvum
DLGRTSPSLGDLIQESL

SEQ ID NO: 2351965 - protein, 20 aa, Cryptosporidium parvum
DLHLKILLVCLIQKSITVEI

SEQ ID NO: 2351966 - protein, 24 aa, Cryptosporidium parvum
DLKGSKCRLYLFGEVFEQFQNELI

SEQ ID NO: 2351967 - protein, 25 aa, Cryptosporidium parvum
DLLHKGGNCNSFIEKFGRNHLNDSS

SEQ ID NO: 2351968 - protein, 18 aa, Cryptosporidium parvum
DLSSIQWFSIEDVAKIIY

SEQ ID NO: 2351969 - protein, 19 aa, Cryptosporidium parvum
DLVFLLGNREFDVFRRLYS

SEQ ID NO: 2351970 - protein, 21 aa, Cryptosporidium parvum
DLYRIPIYIFEKVRNSKLNAS

SEQ ID NO: 2351971 - protein, 37 aa, Cryptosporidium parvum; identical to SEQ ID NO: 2169382

SEQ ID NO: 2351972 - protein, 28 aa, Cryptosporidium parvum
DNFNPRSGIRWLCFILGEYGKLISSKVS

SEQ ID NO: 2351973 - protein, 23 aa, Cryptosporidium parvum
DNGGRFLSLHAYNLSKLNSNIPS

SEQ ID NO: 2351974 - protein, 25 aa, Cryptosporidium parvum
DNIRSQKLPSFGFENRFQDNIKGKG

SEQ ID NO: 2351975 - protein, 25 aa, Cryptosporidium parvum
DNKGRLRVGAAIGVNEIERAKLLVE

SEQ ID NO: 2351976 - protein, 23 aa, Cryptosporidium parvum
DNKSELLAAAAAFAASNTMNISN

SEQ ID NO: 2351977 - protein, 17 aa, Cryptosporidium parvum
DNSWNLFHPSLLGSSTR

SEQ ID NO: 2351978 - protein, 20 aa, Cryptosporidium parvum
DNTRCILGMMSMENTAILSV

SEQ ID NO: 2351979 - protein, 18 aa, Cryptosporidium parvum
DNTRLMLENLRLRDSGGI

SEQ ID NO: 2351980 - protein, 28 aa, Cryptosporidium parvum
DPRHGRYLTASVMFRGRMSTKEVDEQML

SEQ ID NO: 2351981 - protein, 23 aa, Cryptosporidium parvum
DPYTLLPEQPWDVMKEDGDKPLA

SEQ ID NO: 2351982 - protein, 22 aa, Cryptosporidium parvum
DQYSGLPPHIFKMAQNAYDSLF

SEQ ID NO: 2351983 - protein, 18 aa, Cryptosporidium parvum
DRFIDALNATKCAIEQGI

SEQ ID NO: 2351984 - protein, 22 aa, Cryptosporidium parvum
DRIRTLKTLFGYQVGMPGRPLL

SEQ ID NO: 2351985 - protein, 18 aa, Cryptosporidium parvum
DRNTRFVHRSRLLAHKEV

SEQ ID NO: 2351986 - protein, 18 aa, Cryptosporidium parvum
DRRNVIVVLFLIREYPLA

SEQ ID NO: 2351987 - protein, 18 aa, Cryptosporidium parvum
DRSKSNSYIKTWGKEKWT

SEQ ID NO: 2351988 - protein, 32 aa, Cryptosporidium parvum
DRWKYITTLIPPEFKKSCTIALHSQYIECYNK

SEQ ID NO: 2351989 - protein, 23 aa, Cryptosporidium parvum
DSEISITDLITWHISEYDHPESE

SEQ ID NO: 2351990 - protein, 21 aa, Cryptosporidium parvum
DSFEWQLKYKNKMKGNMIFMA

SEQ ID NO: 2351991 - protein, 19 aa, Cryptosporidium parvum
DSGKRIDFSLLMNNNKCSI

SEQ ID NO: 2351992 - protein, 28 aa, Cryptosporidium parvum
DSKLRISIQRLLAGMTFELDSEQEQTST

SEQ ID NO: 2351993 - protein, 22 aa, Cryptosporidium parvum
DSLELSLLLNFRSLSTKLQTEI

SEQ ID NO: 2351994 - protein, 17 aa, Cryptosporidium parvum
DSLILEYFELDGFDINY

SEQ ID NO: 2351995 - protein, 18 aa, Cryptosporidium parvum
DSLMDFIFFIWAADDEFW

SEQ ID NO: 2351996 - protein, 25 aa, Cryptosporidium parvum
DSLSGDRLGCFNLSLKGHGHAVSFL

SEQ ID NO: 2351997 - protein, 18 aa, Cryptosporidium parvum
DSNPVVTLCNHYFCEKCA

SEQ ID NO: 2351998 - protein, 22 aa, Cryptosporidium parvum
DSQDINLIWSRSRVFELQVANC

SEQ ID NO: 2351999 - protein, 22 aa, Cryptosporidium parvum
DSSLKPQLSIFGRPSPVDEEKK

SEQ ID NO: 2352000 - protein, 24 aa, Cryptosporidium parvum
DTISEVVDVFSFFDTVKRIYYSWQ

SEQ ID NO: 2352001 - protein, 26 aa, Cryptosporidium parvum
DTQGCMEICITPPLSSELITSNNFYF

SEQ ID NO: 2352002 - protein, 24 aa, Cryptosporidium parvum
DVEKCIFLSDGRFHLESAMIQNPS

SEQ ID NO: 2352003 - protein, 18 aa, Cryptosporidium parvum
DVGSSAFIGNSLRYEFIN

SEQ ID NO: 2352004 - protein, 22 aa, Cryptosporidium parvum
DVKELPSILLFTCQSLKPYKVI

SEQ ID NO: 2352005 - protein, 33 aa, Cryptosporidium parvum; identical to SEQ ID NO: 2169601

SEQ ID NO: 2352006 - protein, 23 aa, Cryptosporidium parvum
DVPCLACPVFETCSWSFESQILP

SEQ ID NO: 2352007 - protein, 18 aa, Cryptosporidium parvum
DVRRASIMHERGFPEMAV

SEQ ID NO: 2352008 - protein, 18 aa, Cryptosporidium parvum
DWEGGWWSKEFLSRRDVR

SEQ ID NO: 2352009 - protein, 20 aa, Cryptosporidium parvum
DYNLRHFNEYGGLEGLTKLK

SEQ ID NO: 2352010 - protein, 27 aa, Cryptosporidium parvum
EADLWSLGVLFYVMLGGAFPFDERKGN

SEQ ID NO: 2352011 - protein, 29 aa, Cryptosporidium parvum
EAEEKLYIRRVCLIQSTFRMYLQRRYFIR

SEQ ID NO: 2352012 - protein, 21 aa, Cryptosporidium parvum
EAFLPTIDLLMALKATYGNEL

SEQ ID NO: 2352013 - protein, 19 aa, Cryptosporidium parvum
EAIFKLKEYIIQNLSNSLN

SEQ ID NO: 2352014 - protein, 21 aa, Cryptosporidium parvum
EATKIILCYLANIQKSTSSFD

SEQ ID NO: 2352015 - protein, 23 aa, Cryptosporidium parvum
EAVAKLRFSYLVTPEHVEEACQI

SEQ ID NO: 2352016 - protein, 17 aa, Cryptosporidium parvum
ECASVAEAFVFWFESEK

SEQ ID NO: 2352017 - protein, 21 aa, Cryptosporidium parvum
ECGNLPDWVLDNIMNILKYQK

SEQ ID NO: 2352018 - protein, 21 aa, Cryptosporidium parvum
ECQNRLNGCFLECLFNNENNN

SEQ ID NO: 2352019 - protein, 22 aa, Cryptosporidium parvum
ECVRKLYYELLVEYNGDDSGKV

SEQ ID NO: 2352020 - protein, 17 aa, Cryptosporidium parvum
EDCYYSADEDFQLENEE

SEQ ID NO: 2352021 - protein, 18 aa, Cryptosporidium parvum
EDEFIRFSGCAKNQACTI

SEQ ID NO: 2352022 - protein, 19 aa, Cryptosporidium parvum
EDGNILWNKPFTTVQGGWI

SEQ ID NO: 2352023 - protein, 20 aa, Cryptosporidium parvum
EDHIDYMVSYFRKYDLRGNG

SEQ ID NO: 2352024 - protein, 17 aa, Cryptosporidium parvum
EDLKFSFTICNPPYYDS

SEQ ID NO: 2352025 - protein, 17 aa, Cryptosporidium parvum
EDPIEFIDSYSYIRDLP

SEQ ID NO: 2352026 - protein, 18 aa, Cryptosporidium parvum
EDSLLCKIDNTKIDSYRS

SEQ ID NO: 2352027 - protein, 17 aa, Cryptosporidium parvum
EDSRCLASWMLNGLAEY

SEQ ID NO: 2352028 - protein, 22 aa, Cryptosporidium parvum
EDVFQRPWYISTIARDNRIKSW

SEQ ID NO: 2352029 - protein, 21 aa, Cryptosporidium parvum
EDVNGLHILLKFPSEAETTVM

SEQ ID NO: 2352030 - protein, 19 aa, Cryptosporidium parvum
EDYFGYDVYLVMNITDIDD

SEQ ID NO: 2352031 - protein, 20 aa, Cryptosporidium parvum
EEATRECLIILADLHDILTS

SEQ ID NO: 2352032 - protein, 26 aa, Cryptosporidium parvum
EEDFKTSFSYFYEAFEAFNIANDERA

SEQ ID NO: 2352033 - protein, 19 aa, Cryptosporidium parvum
EEEREGALFYILNKIFTKR

SEQ ID NO: 2352034 - protein, 24 aa, Cryptosporidium parvum
EEERRKWDYSWQIGKTQVFVKDSL

SEQ ID NO: 2352035 - protein, 22 aa, Cryptosporidium parvum
EEFPDRILQTFSVFPSPKVSDT

SEQ ID NO: 2352036 - protein, 23 aa, Cryptosporidium parvum
EEFSPYLKIIESIGLKINEKMKP

SEQ ID NO: 2352037 - protein, 17 aa, Cryptosporidium parvum
EEGFCKDGGIIGCTQPR

SEQ ID NO: 2352038 - protein, 19 aa, Cryptosporidium parvum
EEIKFSSSRNYESRTVCTK

SEQ ID NO: 2352039 - protein, 27 aa, Cryptosporidium parvum
EELCACVSIIPSVRSIYKFKGQVHDEN

SEQ ID NO: 2352040 - protein, 23 aa, Cryptosporidium parvum
EELNLCFGYKFGLKNDSQDQISI

SEQ ID NO: 2352041 - protein, 24 aa, Cryptosporidium parvum
EELRRQNDRCCCNSRGEKLYQRNC

SEQ ID NO: 2352042 - protein, 24 aa, Cryptosporidium parvum
EEMKRIESSIAIRCGKGKMRNRRR

SEQ ID NO: 2352043 - protein, 22 aa, Cryptosporidium parvum
EENRKLNIFAYIGRLEDEIANL

SEQ ID NO: 2352044 - protein, 26 aa, Cryptosporidium parvum
EERKKFVPRCCFFGGKAAPGYATAKT

SEQ ID NO: 2352045 - protein, 22 aa, Cryptosporidium parvum
EEYLELPIAYISRLTDCHHLLA

SEQ ID NO: 2352046 - protein, 26 aa, Cryptosporidium parvum
EFALKKDFPLPFGSLLVTFERLDLIN

SEQ ID NO: 2352047 - protein, 26 aa, Cryptosporidium parvum
EFDQRLPGELGRRLRIDDSDFNDIDQ

SEQ ID NO: 2352048 - protein, 27 aa, Cryptosporidium parvum
EFDVFRRLYSLLIKFAPLDLKDLISIE

SEQ ID NO: 2352049 - protein, 26 aa, Cryptosporidium parvum
EFEKLNKLKSALSELGDFNKKLLEEN

SEQ ID NO: 2352050 - protein, 17 aa, Cryptosporidium parvum
EFFQLLVQEIFNIDFGM

SEQ ID NO: 2352051 - protein, 25 aa, Cryptosporidium parvum
EFHKICCTLCGRVKCSNCNISNTVE

SEQ ID NO: 2352052 - protein, 24 aa, Cryptosporidium parvum
EFKSIRYNPEYAITIRQLYEFIKA

SEQ ID NO: 2352053 - protein, 26 aa, Cryptosporidium parvum
EFNGPSYFCSYSFASVFSRMGPNSWP

SEQ ID NO: 2352054 - protein, 19 aa, Cryptosporidium parvum
EFSRYIRRFYSVIIPNSDN

SEQ ID NO: 2352055 - protein, 18 aa, Cryptosporidium parvum
EFVGIGLNTGENVPFEMK

SEQ ID NO: 2352056 - protein, 25 aa, Cryptosporidium parvum
EGFESCLRISQPFFVGQGNGLELWI

SEQ ID NO: 2352057 - protein, 21 aa, Cryptosporidium parvum
EGFLTRLGRKMAELPMEPKLS

SEQ ID NO: 2352058 - protein, 17 aa, Cryptosporidium parvum
EGKKLLVSAKFPNDKLN

SEQ ID NO: 2352059 - protein, 21 aa, Cryptosporidium parvum
EGKQMLARVVGWKLYGTQVTH

SEQ ID NO: 2352060 - protein, 18 aa, Cryptosporidium parvum
EGLDRMATDSSYSMIGGG

SEQ ID NO: 2352061 - protein, 17 aa, Cryptosporidium parvum
EGLQWVSYYYFRGVPSW

SEQ ID NO: 2352062 - protein, 17 aa, Cryptosporidium parvum
EGMSINRSLLALSQVIS

SEQ ID NO: 2352063 - protein, 17 aa, Cryptosporidium parvum
EGPLEKKNSWSWGHKLR

SEQ ID NO: 2352064 - protein, 22 aa, Cryptosporidium parvum
EGRNNLFLKRDEIIIRKISHMI

SEQ ID NO: 2352065 - protein, 17 aa, Cryptosporidium parvum
EGVPDLIYLIAQLTQNY

SEQ ID NO: 2352066 - protein, 22 aa, Cryptosporidium parvum
EHFKEVFPISFRSNIPLICESF

SEQ ID NO: 2352067 - protein, 19 aa, Cryptosporidium parvum
EHIEFQLKVSICEVYMERI

SEQ ID NO: 2352068 - protein, 20 aa, Cryptosporidium parvum
EHKQWGTAVFNFRRNEVRSF

SEQ ID NO: 2352069 - protein, 27 aa, Cryptosporidium parvum
EHYQRSPTCWRLVMRHIGILDFDSNQN

SEQ ID NO: 2352070 - protein, 24 aa, Cryptosporidium parvum
EIACHVCSSMIKKAREEKLKITNS

SEQ ID NO: 2352071 - protein, 24 aa, Cryptosporidium parvum
EIAEVCIQLGIPCKVESKRYSKDC

SEQ ID NO: 2352072 - protein, 22 aa, Cryptosporidium parvum
EIDEKFLFYLFSNFGKILSLKI

SEQ ID NO: 2352073 - protein, 22 aa, Cryptosporidium parvum
EIDNGVIKVCLAFLQRTKVLLE

SEQ ID NO: 2352074 - protein, 23 aa, Cryptosporidium parvum
EIEAEKILKYCTFVMQNNLDLNG

SEQ ID NO: 2352075 - protein, 22 aa, Cryptosporidium parvum
EIIRGGLSLDLFSRIRDALSSL

SEQ ID NO: 2352076 - protein, 17 aa, Cryptosporidium parvum
EIIRRGRKGIQGGTGGL

SEQ ID NO: 2352077 - protein, 19 aa, Cryptosporidium parvum
EIISEILEVAKRFRSQVTA

SEQ ID NO: 2352078 - protein, 24 aa, Cryptosporidium parvum
EIKKEYRLRALALHPDKNQNDEKS

SEQ ID NO: 2352079 - protein, 21 aa, Cryptosporidium parvum
EILRSRGIERLFPIQAQSFES

SEQ ID NO: 2352080 - protein, 24 aa, Cryptosporidium parvum
EIPNCKGENIVNCHHSFGDGIDKS

SEQ ID NO: 2352081 - protein, 18 aa, Cryptosporidium parvum
EISGKFRSNIMLKCCETE

SEQ ID NO: 2352082 - protein, 26 aa, Cryptosporidium parvum
EIWREALIASCRARHAAKENRLRTLH

SEQ ID NO: 2352083 - protein, 25 aa, Cryptosporidium parvum
EKCSVCSCHGTLLSCDICSKSIHKS

SEQ ID NO: 2352084 - protein, 25 aa, Cryptosporidium parvum
EKDEKLDELVTIFSHKNNRKFSRDN

SEQ ID NO: 2352085 - protein, 23 aa, Cryptosporidium parvum
EKDPRIVEPYAKIDKSKKKYRTN

SEQ ID NO: 2352086 - protein, 23 aa, Cryptosporidium parvum
EKEAISSFLLGRTSLYSPTSVLS

SEQ ID NO: 2352087 - protein, 24 aa, Cryptosporidium parvum
EKELFPSFRIEVINYLKMRSQEYI

SEQ ID NO: 2352088 - protein, 18 aa, Cryptosporidium parvum
EKFQEIYRQFAPLIDQRS

SEQ ID NO: 2352089 - protein, 22 aa, Cryptosporidium parvum
EKFRFDLRVENLHIFLHEQCEI

SEQ ID NO: 2352090 - protein, 18 aa, Cryptosporidium parvum
EKHDILCEENQQLINEIN

SEQ ID NO: 2352091 - protein, 24 aa, Cryptosporidium parvum
EKIAELENALAIGEANKIESLKTY

SEQ ID NO: 2352092 - protein, 17 aa, Cryptosporidium parvum
EKICVNCEIGLPNCGAV

SEQ ID NO: 2352093 - protein, 25 aa, Cryptosporidium parvum
EKIIWRLAYISVMGYEIDFGWLEIL

SEQ ID NO: 2352094 - protein, 37 aa, Cryptosporidium parvum; identical to SEQ ID NO: 2291102

SEQ ID NO: 2352095 - protein, 20 aa, Cryptosporidium parvum
EKLFEVITHLIIRYKEDYKE

SEQ ID NO: 2352096 - protein, 27 aa, Cryptosporidium parvum
EKMDISNDLTFRYLLDILQESYHNFKF

SEQ ID NO: 2352097 - protein, 24 aa, Cryptosporidium parvum
EKNTLLQMCRLISTLLEYFPNSFF

SEQ ID NO: 2352098 - protein, 18 aa, Cryptosporidium parvum
EKRLKDHISSIGCNITDV

SEQ ID NO: 2352099 - protein, 25 aa, Cryptosporidium parvum
EKSRQLRESFEISKEDLFIGCEITC

SEQ ID NO: 2352100 - protein, 17 aa, Cryptosporidium parvum
EKSWRKKEVNIIINVGG

SEQ ID NO: 2352101 - protein, 23 aa, Cryptosporidium parvum
EKTHGNGLLCVNVRSEQCIEISS

SEQ ID NO: 2352102 - protein, 22 aa, Cryptosporidium parvum
EKTKRFDFVVLMLNENFQILNK

SEQ ID NO: 2352103 - protein, 21 aa, Cryptosporidium parvum
EKVSMRIISIFGPDAEIWREA

SEQ ID NO: 2352104 - protein, 17 aa, Cryptosporidium parvum
EKYKISIYVNRKLLESN

SEQ ID NO: 2352105 - protein, 25 aa, Cryptosporidium parvum
ELALIWCILKTFAISTKYHHRQEFI

SEQ ID NO: 2352106 - protein, 25 aa, Cryptosporidium parvum
ELDLKEFYTCIGLVSDLLVSILKDP

SEQ ID NO: 2352107 - protein, 20 aa, Cryptosporidium parvum
ELILFRLRFNSGNNQGSVNF

SEQ ID NO: 2352108 - protein, 21 aa, Cryptosporidium parvum
ELLVKLKQFWSEYPEKLNKKI

SEQ ID NO: 2352109 - protein, 28 aa, Cryptosporidium parvum
ELNLPECCLRCIEFTSRMFVFIQKVPII

SEQ ID NO: 2352110 - protein, 24 aa, Cryptosporidium parvum
ELQHLSVPYWNLFPDVIDDVLNDT

SEQ ID NO: 2352111 - protein, 27 aa, Cryptosporidium parvum
ELRLKQQYFFVCATIQDILRRFKKSGK

SEQ ID NO: 2352112 - protein, 19 aa, Cryptosporidium parvum
ELTERKSLALELLKLLSNK

SEQ ID NO: 2352113 - protein, 25 aa, Cryptosporidium parvum
ELTQINIKYCFPFIVIYDASNTGDQ

SEQ ID NO: 2352114 - protein, 28 aa, Cryptosporidium parvum
ELWKNPFYWTEIFSINSLYFKSSFLDHS

SEQ ID NO: 2352115 - protein, 26 aa, Cryptosporidium parvum
EMGKGSFKYAWVLDKLKAERERGITI

SEQ ID NO: 2352116 - protein, 23 aa, Cryptosporidium parvum
EMIQKFWINLSIIIDNEKWEKRD

SEQ ID NO: 2352117 - protein, 37 aa, Cryptosporidium parvum
ENGKRKFRFSSLCPKLLNCLFPWIRSEQYFEDHDQPI

SEQ ID NO: 2352118 - protein, 17 aa, Cryptosporidium parvum
ENGLVLMTKRFIQYLYE

SEQ ID NO: 2352119 - protein, 23 aa, Cryptosporidium parvum
ENIQCVIRWSFGGDEVFVTGSFN

SEQ ID NO: 2352120 - protein, 19 aa, Cryptosporidium parvum
ENRASVILVGLGFTQEMLK

SEQ ID NO: 2352121 - protein, 20 aa, Cryptosporidium parvum
ENSGKMVLMDRLIKKLVSGG

SEQ ID NO: 2352122 - protein, 34 aa, Cryptosporidium parvum; identical to SEQ ID NO: 2291383

SEQ ID NO: 2352123 - protein, 26 aa, Cryptosporidium parvum
ENTEFFSMGFSPKFTWSAPTDATWIN

SEQ ID NO: 2352124 - protein, 27 aa, Cryptosporidium parvum
ENTKRSFPRFEFEDHFQVSLLDSQQYN

SEQ ID NO: 2352125 - protein, 23 aa, Cryptosporidium parvum
EPGAFSFSFFEVYCEQIQDLLTG

SEQ ID NO: 2352126 - protein, 19 aa, Cryptosporidium parvum
EQEKHYNSHFGQYEGNNFS

SEQ ID NO: 2352127 - protein, 26 aa, Cryptosporidium parvum
EQGIVPGGGSALLWASRNLGKLYSQS

SEQ ID NO: 2352128 - protein, 24 aa, Cryptosporidium parvum
EQIKKHILSVFGFEELYRMNILER

SEQ ID NO: 2352129 - protein, 19 aa, Cryptosporidium parvum
EQLNISRTMLASMGSPSSD

SEQ ID NO: 2352130 - protein, 20 aa, Cryptosporidium parvum
EQLSRLLIVLFSVYHNFEKN

SEQ ID NO: 2352131 - protein, 18 aa, Cryptosporidium parvum
EQMKLFLKELENHVEEEI

SEQ ID NO: 2352132 - protein, 25 aa, Cryptosporidium parvum
EQNHKFCLVLIYGHLVIMRIENICV

SEQ ID NO: 2352133 - protein, 25 aa, Cryptosporidium parvum
EQPCASVFYPCMQCADIFQLKADIC

SEQ ID NO: 2352134 - protein, 23 aa, Cryptosporidium parvum
EQQISPLFQFRAKLYFEGNTWKV

SEQ ID NO: 2352135 - protein, 24 aa, Cryptosporidium parvum
EQTKKRPSDVAKEEQSKKVCTETS

SEQ ID NO: 2352136 - protein, 18 aa, Cryptosporidium parvum
ERACNNCNCGRADLEKEI

SEQ ID NO: 2352137 - protein, 18 aa, Cryptosporidium parvum
ERAKESSLRRLDRTLLLI

SEQ ID NO: 2352138 - protein, 24 aa, Cryptosporidium parvum
ERANLKLQLDFAIIQQGRLKGQSS

SEQ ID NO: 2352139 - protein, 25 aa, Cryptosporidium parvum
EREYYKWDYIILLTTRYISPDSNTI

SEQ ID NO: 2352140 - protein, 24 aa, Cryptosporidium parvum
ERFQRCLRLTFNETVMKNPQWFKL

SEQ ID NO: 2352141 - protein, 20 aa, Cryptosporidium parvum
ERHKLPLSIYPNGSYSTIKD

SEQ ID NO: 2352142 - protein, 19 aa, Cryptosporidium parvum
ERICKSIINGLELVIIPDL

SEQ ID NO: 2352143 - protein, 21 aa, Cryptosporidium parvum
ERKEREKLERQCYWMQEENKT

SEQ ID NO: 2352144 - protein, 22 aa, Cryptosporidium parvum
ERKGEMRAPIIGIPSKKPDYYV

SEQ ID NO: 2352145 - protein, 20 aa, Cryptosporidium parvum
ERLEKLGFSQGVWNFDPIQP

SEQ ID NO: 2352146 - protein, 23 aa, Cryptosporidium parvum
ERLKRSDFLNLSFYIQVIEGGAC

SEQ ID NO: 2352147 - protein, 19 aa, Cryptosporidium parvum
ERLRRLALESIDLSKDPYY

SEQ ID NO: 2352148 - protein, 17 aa, Cryptosporidium parvum
ERMPPCFIYQKYGVCVD

SEQ ID NO: 2352149 - protein, 22 aa, Cryptosporidium parvum
ERPGFICLKPEPSSISSISKEM

SEQ ID NO: 2352150 - protein, 28 aa, Cryptosporidium parvum
ERSVELLKSLGICRNFRPSVLTKTMIHT

SEQ ID NO: 2352151 - protein, 21 aa, Cryptosporidium parvum
ERTWFLRRNFHSVIIDEAHRI

SEQ ID NO: 2352152 - protein, 17 aa, Cryptosporidium parvum
ERYPCFVDALRDLDDAL

SEQ ID NO: 2352153 - protein, 22 aa, Cryptosporidium parvum
ESCSKMRRKEIINLEDTLKELE

SEQ ID NO: 2352154 - protein, 18 aa, Cryptosporidium parvum
ESFPVYIGSFGHFLAEVI

SEQ ID NO: 2352155 - protein, 25 aa, Cryptosporidium parvum
ESGKYASCFSKNHFSIFSLFNKHKL

SEQ ID NO: 2352156 - protein, 22 aa, Cryptosporidium parvum
ESICIPAKHILLSLQVHSSGTS

SEQ ID NO: 2352157 - protein, 19 aa, Cryptosporidium parvum
ESIKNLKVYRAIAKQKEKS

SEQ ID NO: 2352158 - protein, 23 aa, Cryptosporidium parvum
ESLKRDVENLSIMKKSYDDQSFI

SEQ ID NO: 2352159 - protein, 20 aa, Cryptosporidium parvum
ESLLKPCIEHHNMLQSYKSS

SEQ ID NO: 2352160 - protein, 24 aa, Cryptosporidium parvum
ESLYLKACKFVSVSQTNNKVIKML

SEQ ID NO: 2352161 - protein, 33 aa, Cryptosporidium parvum; identical to SEQ ID NO: 2291595

SEQ ID NO: 2352162 - protein, 23 aa, Cryptosporidium parvum
ESPDVLKAIGYCHTSSFYTVKSL

SEQ ID NO: 2352163 - protein, 25 aa, Cryptosporidium parvum
ESRDGFSKTAIREIVLLTNLKHENI

SEQ ID NO: 2352164 - protein, 22 aa, Cryptosporidium parvum
ESSCSSSIWVRFNDTKVYLSKE

SEQ ID NO: 2352165 - protein, 32 aa, Cryptosporidium parvum; identical to SEQ ID NO: 2291616

SEQ ID NO: 2352166 - protein, 21 aa, Cryptosporidium parvum
ETGIIRPGMNVTFAPAGVTTE

SEQ ID NO: 2352167 - protein, 28 aa, Cryptosporidium parvum
ETIVLDGCIKDIVFAGSLFVPNYTSVYK

SEQ ID NO: 2352168 - protein, 19 aa, Cryptosporidium parvum
ETKADILFHIHKILEESSE

SEQ ID NO: 2352169 - protein, 19 aa, Cryptosporidium parvum
ETLKSWKYVNYDFDEELEM

SEQ ID NO: 2352170 - protein, 20 aa, Cryptosporidium parvum
ETLPRPNIDFNQTHKMLDPF

SEQ ID NO: 2352171 - protein, 29 aa, Cryptosporidium parvum
ETVTKTTTRFASGNVDGVTTRTETFVTKA

SEQ ID NO: 2352172 - protein, 17 aa, Cryptosporidium parvum
EVECILKKAGVRVKIDD

SEQ ID NO: 2352173 - protein, 18 aa, Cryptosporidium parvum
EVENTDLLVRLNDYKENQ

SEQ ID NO: 2352174 - protein, 21 aa, Cryptosporidium parvum
EVIAGSSGFGCNFDGDPEIIE

SEQ ID NO: 2352175 - protein, 30 aa, Cryptosporidium parvum; identical to SEQ ID NO: 2170683

SEQ ID NO: 2352176 - protein, 24 aa, Cryptosporidium parvum
EVIPICKTINFFGKTVIDNEMIQK

SEQ ID NO: 2352177 - protein, 20 aa, Cryptosporidium parvum
EVKPVIKREITIVNVTLLEV

SEQ ID NO: 2352178 - protein, 20 aa, Cryptosporidium parvum
EVLESRSLVWVKHPKLAWAP

SEQ ID NO: 2352179 - protein, 24 aa, Cryptosporidium parvum
EVLLGFNCTIFAYGQTGTGKTYTM

SEQ ID NO: 2352180 - protein, 20 aa, Cryptosporidium parvum
EVPDIPRNIAIADYVEQILF

SEQ ID NO: 2352181 - protein, 25 aa, Cryptosporidium parvum
EVRNPHYWRYIGIIKLYKKVQGLLS

SEQ ID NO: 2352182 - protein, 25 aa, Cryptosporidium parvum
EVTDICFDLNMTLFLAWSPKEAGHI

SEQ ID NO: 2352183 - protein, 18 aa, Cryptosporidium parvum
EYEMRYTIHSSLQSICAS

SEQ ID NO: 2352184 - protein, 19 aa, Cryptosporidium parvum
EYFNGTFIDTCRINVQYAF

SEQ ID NO: 2352185 - protein, 25 aa, Cryptosporidium parvum
EYKNFSIYTLLALRTISSEFKNLDT

SEQ ID NO: 2352186 - protein, 25 aa, Cryptosporidium parvum
EYLGTWWRTEFNYSPLPYLPPHSTR

SEQ ID NO: 2352187 - protein, 23 aa, Cryptosporidium parvum
EYSDCSPLSFLTGGGATNFGMDF

SEQ ID NO: 2352188 - protein, 26 aa, Cryptosporidium parvum
EYSRKQKYCYLHFFCKKTKKQDESKD

SEQ ID NO: 2352189 - protein, 27 aa, Cryptosporidium parvum
FAIDEAHCVCQWGFDFRPDYIQLCKLR

SEQ ID NO: 2352190 - protein, 25 aa, Cryptosporidium parvum
FAKLSSMHFYGWKKGLKTGIYYLRT

SEQ ID NO: 2352191 - protein, 27 aa, Cryptosporidium parvum
FASIVGTRCVVVWIGIRDCLSQESLFS

SEQ ID NO: 2352192 - protein, 26 aa, Cryptosporidium parvum
FDCVKRIPDGILLFFGSYSLMDQAVK

SEQ ID NO: 2352193 - protein, 22 aa, Cryptosporidium parvum
FDDELFNIISELDKINFKNQNN

SEQ ID NO: 2352194 - protein, 23 aa, Cryptosporidium parvum
FDDLCLSGFLAVREHADLLLSLT

SEQ ID NO: 2352195 - protein, 21 aa, Cryptosporidium parvum
FDERYPINNGIMLFKNSLFSL

SEQ ID NO: 2352196 - protein, 17 aa, Cryptosporidium parvum
FDILKEYNRQGVPISSG

SEQ ID NO: 2352197 - protein, 17 aa, Cryptosporidium parvum
FDLKYNGFYILYAKSNK

SEQ ID NO: 2352198 - protein, 17 aa, Cryptosporidium parvum
FDMFGGMDGMMGGMGGM

SEQ ID NO: 2352199 - protein, 19 aa, Cryptosporidium parvum
FDMNYLLERAKLFQLNDFF

SEQ ID NO: 2352200 - protein, 24 aa, Cryptosporidium parvum
FDSVHNMPNWLLKNITFRLKEEFP

SEQ ID NO: 2352201 - protein, 17 aa, Cryptosporidium parvum
FEEIFFDLVIKKAHSKG

SEQ ID NO: 2352202 - protein, 18 aa, Cryptosporidium parvum
FEHPADCIYMNGVDNRHF

SEQ ID NO: 2352203 - protein, 23 aa, Cryptosporidium parvum
FEKNCNRLPILHSNCKLRTMNDS

SEQ ID NO: 2352204 - protein, 18 aa, Cryptosporidium parvum
FEKVWIDPFFDRKTLHVA

SEQ ID NO: 2352205 - protein, 23 aa, Cryptosporidium parvum
FELCSSYPRIIVVPENISDSQLI

SEQ ID NO: 2352206 - protein, 17 aa, Cryptosporidium parvum
FEPKFNKWISVDIHRGG

SEQ ID NO: 2352207 - protein, 24 aa, Cryptosporidium parvum
FESLPWKGQTMFSNFRELQISLQS

SEQ ID NO: 2352208 - protein, 18 aa, Cryptosporidium parvum
FESNAWISNVYFIKTPSL

SEQ ID NO: 2352209 - protein, 17 aa, Cryptosporidium parvum
FEVEGSDIFTAKLKFEG

SEQ ID NO: 2352210 - protein, 19 aa, Cryptosporidium parvum
FEYHWEKPLFHSKLFEIDH

SEQ ID NO: 2352211 - protein, 17 aa, Cryptosporidium parvum
FEYLPYDLSGYIEGLKL

SEQ ID NO: 2352212 - protein, 18 aa, Cryptosporidium parvum
FFCVHGGLSPELRSVDQI

SEQ ID NO: 2352213 - protein, 28 aa, Cryptosporidium parvum
FFEELNRSFPIICLLLFERRVRSKSDGI

SEQ ID NO: 2352214 - protein, 17 aa, Cryptosporidium parvum
FFLEAGRNLPLNRFKYS

SEQ ID NO: 2352215 - protein, 24 aa, Cryptosporidium parvum
FFMPHCDRCVFGMIINYFNSGEGK

SEQ ID NO: 2352216 - protein, 24 aa, Cryptosporidium parvum
FGDTCKFLHDRSDFKSGWKLDKEW

SEQ ID NO: 2352217 - protein, 24 aa, Cryptosporidium parvum
FGEDFKGKCKVKCDNCMRSELEKP

SEQ ID NO: 2352218 - protein, 26 aa, Cryptosporidium parvum
FGEIESLTLVLACKLNVFKFNCDVSQ

SEQ ID NO: 2352219 - protein, 20 aa, Cryptosporidium parvum
FGEKCKIAALLSNILDTNAE

SEQ ID NO: 2352220 - protein, 24 aa, Cryptosporidium parvum
FGGFSSCFQFNFDGRLFDKFETGD

SEQ ID NO: 2352221 - protein, 22 aa, Cryptosporidium parvum
FGLGKWRIILATSKLTNRDEVG

SEQ ID NO: 2352222 - protein, 17 aa, Cryptosporidium parvum
FGNPKIFSLNTCPVPVA

SEQ ID NO: 2352223 - protein, 26 aa, Cryptosporidium parvum
FGTAIMFCNMSDYPFLSSIEKASKIS

SEQ ID NO: 2352224 - protein, 17 aa, Cryptosporidium parvum
FHDQICFNQYSIFQRIQ

SEQ ID NO: 2352225 - protein, 17 aa, Cryptosporidium parvum
FHHNFSMFGEVIQDNGQ

SEQ ID NO: 2352226 - protein, 19 aa, Cryptosporidium parvum
FIDTCRINVQYAFPPGSDL

SEQ ID NO: 2352227 - protein, 19 aa, Cryptosporidium parvum
FIEDIIISLPEGFTILGSI

SEQ ID NO: 2352228 - protein, 24 aa, Cryptosporidium parvum
FIFNTCKYGFVRVIHSSISMDLER

SEQ ID NO: 2352229 - protein, 22 aa, Cryptosporidium parvum
FIGCKYSSIFDKNACIALNDSF

SEQ ID NO: 2352230 - protein, 24 aa, Cryptosporidium parvum
FIMTNFRIILAPLFQKNINNKALT

SEQ ID NO: 2352231 - protein, 21 aa, Cryptosporidium parvum
FIPKERIVIDIKRDSSELCRT

SEQ ID NO: 2352232 - protein, 18 aa, Cryptosporidium parvum
FISIKGFYFQAKILGETI

SEQ ID NO: 2352233 - protein, 17 aa, Cryptosporidium parvum
FKATRFIFEISGNDDDT

SEQ ID NO: 2352234 - protein, 27 aa, Cryptosporidium parvum
FKCEICGNCSYWGRRAFERHFSETRHA

SEQ ID NO: 2352235 - protein, 22 aa, Cryptosporidium parvum
FKDTIMYYIIFLKYVIIVTKLQ

SEQ ID NO: 2352236 - protein, 17 aa, Cryptosporidium parvum
FKISNKIFETLKLPTSA

SEQ ID NO: 2352237 - protein, 20 aa, Cryptosporidium parvum
FKKGDLLTALVGLENSGNSC

SEQ ID NO: 2352238 - protein, 27 aa, Cryptosporidium parvum
FKLNLTDNALLYWREEPTFPDQQPSGC

SEQ ID NO: 2352239 - protein, 23 aa, Cryptosporidium parvum
FKQCGYIAASLIYRGNLELLRLL

SEQ ID NO: 2352240 - protein, 17 aa, Cryptosporidium parvum
FKSLMVFMKGIKEEPYC

SEQ ID NO: 2352241 - protein, 19 aa, Cryptosporidium parvum
FKSSSLIINKEEITLGLRS

SEQ ID NO: 2352242 - protein, 17 aa, Cryptosporidium parvum
FKTFGCGSAIASTSYAT

SEQ ID NO: 2352243 - protein, 26 aa, Cryptosporidium parvum
FLDKNLKIVFSIIIHSNRWLQDNSKD

SEQ ID NO: 2352244 - protein, 17 aa, Cryptosporidium parvum
FLGEGSYFRAYRGLLSC

SEQ ID NO: 2352245 - protein, 22 aa, Cryptosporidium parvum
FLIDASKFYSLICPSLSSRLIC

SEQ ID NO: 2352246 - protein, 17 aa, Cryptosporidium parvum
FLKIEAFRDLEQLRVRV

SEQ ID NO: 2352247 - protein, 18 aa, Cryptosporidium parvum
FLLGKIVFLDSIYYKLKL

SEQ ID NO: 2352248 - protein, 17 aa, Cryptosporidium parvum
FLLHKWDAPMNYSPETS

SEQ ID NO: 2352249 - protein, 18 aa, Cryptosporidium parvum
FLLRAVLVLLSLNKTQFA

SEQ ID NO: 2352250 - protein, 24 aa, Cryptosporidium parvum
FLLSTRAGGLGINLATADIVILYD

SEQ ID NO: 2352251 - protein, 19 aa, Cryptosporidium parvum
FLNNLFLPSINTRNPGIRI

SEQ ID NO: 2352252 - protein, 25 aa, Cryptosporidium parvum
FLPEMLQQLLMDFEYIIPIFVIYRI

SEQ ID NO: 2352253 - protein, 22 aa, Cryptosporidium parvum
FLPEMLSLLLMLHVKIPGVLVN

SEQ ID NO: 2352254 - protein, 19 aa, Cryptosporidium parvum
FLQKLGNSMIDYINDQNKQ

SEQ ID NO: 2352255 - protein, 22 aa, Cryptosporidium parvum
FLRNCELNREVGWREVENTDLL

SEQ ID NO: 2352256 - protein, 18 aa, Cryptosporidium parvum
FLRNGGKLKIVLDGKSRD

SEQ ID NO: 2352257 - protein, 18 aa, Cryptosporidium parvum
FLSNPFMNPFGLQVPPIL

SEQ ID NO: 2352258 - protein, 24 aa, Cryptosporidium parvum
FLVDLRLSYESCGIYDSKFKYLIL

SEQ ID NO: 2352259 - protein, 25 aa, Cryptosporidium parvum
FMCSASVPEVLVERDAVLSSFGTVD

SEQ ID NO: 2352260 - protein, 18 aa, Cryptosporidium parvum
FNDGFSLSTGNLHRTRSH

SEQ ID NO: 2352261 - protein, 19 aa, Cryptosporidium parvum
FNGILLKASFLGKTDIIKS

SEQ ID NO: 2352262 - protein, 19 aa, Cryptosporidium parvum
FNGMVPGIIGSGIGGGCLL

SEQ ID NO: 2352263 - protein, 20 aa, Cryptosporidium parvum
FNIEVNWDPSNGLIFGGNIH

SEQ ID NO: 2352264 - protein, 23 aa, Cryptosporidium parvum
FNIQLDCLYLFSPDYDGSPPLYV

SEQ ID NO: 2352265 - protein, 19 aa, Cryptosporidium parvum
FNITRIKRCCQIMGRQEND

SEQ ID NO: 2352266 - protein, 23 aa, Cryptosporidium parvum
FNKRCEYCKVLSTSLSKMNFSTI

SEQ ID NO: 2352267 - protein, 23 aa, Cryptosporidium parvum
FNLKLEIVTMIIFYSEDDLQVQK

SEQ ID NO: 2352268 - protein, 17 aa, Cryptosporidium parvum
FNLRPVIQNRNNSGTPK

SEQ ID NO: 2352269 - protein, 18 aa, Cryptosporidium parvum
FNNIELENTFSFLLYHYH

SEQ ID NO: 2352270 - protein, 25 aa, Cryptosporidium parvum
FNNNFNFRINVQWHSVYVDGWPHII

SEQ ID NO: 2352271 - protein, 18 aa, Cryptosporidium parvum
FNPYEIYSICAVSFSPFK

SEQ ID NO: 2352272 - protein, 25 aa, Cryptosporidium parvum
FNSREFKIAIALAENCQLPVFITLR

SEQ ID NO: 2352273 - protein, 21 aa, Cryptosporidium parvum
FNYKALSVTLEHLFEQQSSTL

SEQ ID NO: 2352274 - protein, 17 aa, Cryptosporidium parvum
FPAGFTPSLSCKGFHDL

SEQ ID NO: 2352275 - protein, 19 aa, Cryptosporidium parvum
FPCENCAISQIVLYDHNIR

SEQ ID NO: 2352276 - protein, 21 aa, Cryptosporidium parvum
FPDLLSPNCNGIFGPDLNNFL

SEQ ID NO: 2352277 - protein, 22 aa, Cryptosporidium parvum
FPESLLPINGVPIINYIIEMLL

SEQ ID NO: 2352278 - protein, 21 aa, Cryptosporidium parvum
FPEVVELLLSSGADLSLGLPH

SEQ ID NO: 2352279 - protein, 20 aa, Cryptosporidium parvum
FPKLQSVSFDNLFKLNTPLQ

SEQ ID NO: 2352280 - protein, 20 aa, Cryptosporidium parvum
FPVMGEQSVTMMINEEAQTV

SEQ ID NO: 2352281 - protein, 41 aa, Cryptosporidium parvum; identical to SEQ ID NO: 2292531

SEQ ID NO: 2352282 - protein, 25 aa, Cryptosporidium parvum
FQEPPRSGLYCDILWADPIDEKDET

SEQ ID NO: 2352283 - protein, 24 aa, Cryptosporidium parvum
FQFIQCLLSNFSVRGGIFEKSFAL

SEQ ID NO: 2352284 - protein, 21 aa, Cryptosporidium parvum
FQGTISFLILHWDDLFFELFE

SEQ ID NO: 2352285 - protein, 22 aa, Cryptosporidium parvum
FQHTHLYGRHLIIEVAENDDDS

SEQ ID NO: 2352286 - protein, 17 aa, Cryptosporidium parvum
FQIRFILVLLQGNILEH

SEQ ID NO: 2352287 - protein, 19 aa, Cryptosporidium parvum
FQLKVSICEVYMERIRDLL

SEQ ID NO: 2352288 - protein, 24 aa, Cryptosporidium parvum
FREWDGLMRICFSRKKKTIRANFN

SEQ ID NO: 2352289 - protein, 20 aa, Cryptosporidium parvum
FRLIDEFYPILICKKNDYNL

SEQ ID NO: 2352290 - protein, 18 aa, Cryptosporidium parvum
FRLPIKKESGHISSDNLK

SEQ ID NO: 2352291 - protein, 19 aa, Cryptosporidium parvum
FRLQVPMGSILASLRSQDC

SEQ ID NO: 2352292 - protein, 17 aa, Cryptosporidium parvum
FRQECLEILKYSSRTRQ

SEQ ID NO: 2352293 - protein, 25 aa, Cryptosporidium parvum
FRSKIPQLIRHLGWDESIPLRNSLI

SEQ ID NO: 2352294 - protein, 18 aa, Cryptosporidium parvum
FRSLSLKGIYYDRRNHGW

SEQ ID NO: 2352295 - protein, 20 aa, Cryptosporidium parvum
FRSNIMLKCCETEFSFVSCW

SEQ ID NO: 2352296 - protein, 21 aa, Cryptosporidium parvum
FRWHWINILKCTTIEEFSPYQ

SEQ ID NO: 2352297 - protein, 17 aa, Cryptosporidium parvum
FSAAAALSSLVSAGVRS

SEQ ID NO: 2352298 - protein, 24 aa, Cryptosporidium parvum
FSADFKASIVYRVSGYAGKVLFGW

SEQ ID NO: 2352299 - protein, 21 aa, Cryptosporidium parvum
FSANPFIPLKGEAIALDSTTA

SEQ ID NO: 2352300 - protein, 22 aa, Cryptosporidium parvum
FSDIPYLLKLVNVLSDSYGFSI

SEQ ID NO: 2352301 - protein, 25 aa, Cryptosporidium parvum
FSEALNVLKSVGFVIVKLKPSQIHK

SEQ ID NO: 2352302 - protein, 19 aa, Cryptosporidium parvum
FSEKDRWFSLSSVTSPVDI

SEQ ID NO: 2352303 - protein, 18 aa, Cryptosporidium parvum
FSEYFPLQSEAKFSKNPS

SEQ ID NO: 2352304 - protein, 25 aa, Cryptosporidium parvum
FSFFPPKLSGLVLRDRDGSEIEFKK

SEQ ID NO: 2352305 - protein, 27 aa, Cryptosporidium parvum
FSGDFLLNLLIKFGILRSDASDLHSLI

SEQ ID NO: 2352306 - protein, 17 aa, Cryptosporidium parvum
FSGRMGKFPSLSEDILT

SEQ ID NO: 2352307 - protein, 29 aa, Cryptosporidium parvum
FSGRSIGLLDIYGFEVFDCNSFEQFCINF

SEQ ID NO: 2352308 - protein, 26 aa, Cryptosporidium parvum
FSIQSRWRSFQIRKSFLAILGSRIQA

SEQ ID NO: 2352309 - protein, 18 aa, Cryptosporidium parvum
FSKRVIWYTSQVSKLKNL

SEQ ID NO: 2352310 - protein, 19 aa, Cryptosporidium parvum
FSNDTNLYGNISMIDENIG

SEQ ID NO: 2352311 - protein, 23 aa, Cryptosporidium parvum
FSNLKSYLNFISIYNQISKQGSI

SEQ ID NO: 2352312 - protein, 19 aa, Cryptosporidium parvum
FSSLYMKKLVQPYYSKIFK

SEQ ID NO: 2352313 - protein, 20 aa, Cryptosporidium parvum
FSTKDIFSLSSSGVSTKIND

SEQ ID NO: 2352314 - protein, 22 aa, Cryptosporidium parvum
FTDYPPLGRFAVRDMKQTVAVG

SEQ ID NO: 2352315 - protein, 25 aa, Cryptosporidium parvum
FTISEGIPALIPRIEELASSKINSS

SEQ ID NO: 2352316 - protein, 25 aa, Cryptosporidium parvum
FTMTSKHVWGPINLFYPDVKSTFTY

SEQ ID NO: 2352317 - protein, 29 aa, Cryptosporidium parvum
FTSKEYIRDCCTIKPHWLVDFAPNLFQFA

SEQ ID NO: 2352318 - protein, 17 aa, Cryptosporidium parvum
FTYEVISSLRISDGALL

SEQ ID NO: 2352319 - protein, 20 aa, Cryptosporidium parvum
FTYNEIMVVILFNPELDLNT

SEQ ID NO: 2352320 - protein, 20 aa, Cryptosporidium parvum
FVELMTCLSSAYLQVKDENK

SEQ ID NO: 2352321 - protein, 19 aa, Cryptosporidium parvum
FVGAEPYNTIGIRIPNIEL

SEQ ID NO: 2352322 - protein, 18 aa, Cryptosporidium parvum
FVKLISWYDNESGYSNRL

SEQ ID NO: 2352323 - protein, 17 aa, Cryptosporidium parvum
FVLEDIKEMLSIKNIEI

SEQ ID NO: 2352324 - protein, 21 aa, Cryptosporidium parvum
FVPAHFCKDAWGLVYYDGTPT

SEQ ID NO: 2352325 - protein, 20 aa, Cryptosporidium parvum
FVPSCGHCQNYFLYKRIRSI

SEQ ID NO: 2352326 - protein, 27 aa, Cryptosporidium parvum
FVTIPIPRILQGLEVFNLTGRDLLQAS

SEQ ID NO: 2352327 - protein, 19 aa, Cryptosporidium parvum
FWFAAIRFFFLEAGRNLPL

SEQ ID NO: 2352328 - protein, 18 aa, Cryptosporidium parvum
FWKFYLDGKFTMVSKKYI

SEQ ID NO: 2352329 - protein, 30 aa, Cryptosporidium parvum
FWNSVKGTWIFRIATFGLFSFIGYVDKGYT

SEQ ID NO: 2352330 - protein, 18 aa, Cryptosporidium parvum
FYFSSMFDHIVFKQAQEM

SEQ ID NO: 2352331 - protein, 37 aa, Cryptosporidium parvum; identical to SEQ ID NO: 2292832

SEQ ID NO: 2352332 - protein, 18 aa, Cryptosporidium parvum
FYLQRYGVELGRRKNADE

SEQ ID NO: 2352333 - protein, 19 aa, Cryptosporidium parvum
FYQPMVLIATLFQKSSQKQ

SEQ ID NO: 2352334 - protein, 18 aa, Cryptosporidium parvum
FYSQLIIRMIYLCTWMIV

SEQ ID NO: 2352335 - protein, 18 aa, Cryptosporidium parvum
FYTSPRCMCVSFHKYGDY

SEQ ID NO: 2352336 - protein, 17 aa, Cryptosporidium parvum
FYWDLKITEPGSVQISI

SEQ ID NO: 2352337 - protein, 24 aa, Cryptosporidium parvum
GAKFARQGTNPGLIHISHKEKQSS

SEQ ID NO: 2352338 - protein, 26 aa, Cryptosporidium parvum
GAKPLKRLSCPAIFFDCTHDNETPCE

SEQ ID NO: 2352339 - protein, 25 aa, Cryptosporidium parvum
GALVARMLSMLWSKPLIGVNHCVAH

SEQ ID NO: 2352340 - protein, 17 aa, Cryptosporidium parvum
GANGINNGYSWRKNKPI

SEQ ID NO: 2352341 - protein, 23 aa, Cryptosporidium parvum
GAQPIRCPTNFLKKVSQDVVVTS

SEQ ID NO: 2352342 - protein, 20 aa, Cryptosporidium parvum
GASISNYLLEKCRLTNQQEG

SEQ ID NO: 2352343 - protein, 24 aa, Cryptosporidium parvum
GAVRKSGVPGVYWSQKPQGWRVVY

SEQ ID NO: 2352344 - protein, 28 aa, Cryptosporidium parvum
GCCFKDTFGEKIIICGISMGGAIALRLA

SEQ ID NO: 2352345 - protein, 20 aa, Cryptosporidium parvum
GCGQLGFGNLEDCLVPRVNL

SEQ ID NO: 2352346 - protein, 26 aa, Cryptosporidium parvum
GCLDGTIRLWDFRTGENVKILKGHKS

SEQ ID NO: 2352347 - protein, 25 aa, Cryptosporidium parvum
GCTLGSTVGFAIRFEDITTPETKIK

SEQ ID NO: 2352348 - protein, 32 aa, Cryptosporidium parvum
GDELAADFGENWFSRIRRISENNIKNELILFR

SEQ ID NO: 2352349 - protein, 26 aa, Cryptosporidium parvum
GDGSKFFPFFISKYIRSLQKSNYFGE

SEQ ID NO: 2352350 - protein, 18 aa, Cryptosporidium parvum
GDQTRKVLQHAFKERLKI

SEQ ID NO: 2352351 - protein, 22 aa, Cryptosporidium parvum
GDSWRLYDLITRHFFATISNDI

SEQ ID NO: 2352352 - protein, 17 aa, Cryptosporidium parvum
GDVLLNLIEESFGIIDD

SEQ ID NO: 2352353 - protein, 21 aa, Cryptosporidium parvum
GEASLEWSLNFLTRNCDFLNE

SEQ ID NO: 2352354 - protein, 24 aa, Cryptosporidium parvum
GEEIDEVGCLLIFDETYKSVIDSF

SEQ ID NO: 2352355 - protein, 24 aa, Cryptosporidium parvum
GEELPNLSCFNWGNVKCDEMRSLN

SEQ ID NO: 2352356 - protein, 19 aa, Cryptosporidium parvum
GEGLSYLIILGISDGSWME

SEQ ID NO: 2352357 - protein, 27 aa, Cryptosporidium parvum
GEIKKAYHKLAIKWHPDKNMGNDRQMC

SEQ ID NO: 2352358 - protein, 20 aa, Cryptosporidium parvum
GEKKFGFSLKNSICKAQNNI

SEQ ID NO: 2352359 - protein, 22 aa, Cryptosporidium parvum
GEKLRSLLFNSFNLKSESQGYG

SEQ ID NO: 2352360 - protein, 19 aa, Cryptosporidium parvum
GELIIECIGEILTDSDVRD

SEQ ID NO: 2352361 - protein, 23 aa, Cryptosporidium parvum
GELILAEKPLCWITTKIGNHFKD

SEQ ID NO: 2352362 - protein, 19 aa, Cryptosporidium parvum
GELRGIINCERINIDEEHL

SEQ ID NO: 2352363 - protein, 20 aa, Cryptosporidium parvum
GERVSPCPEDFDVVLENDSR

SEQ ID NO: 2352364 - protein, 28 aa, Cryptosporidium parvum
GERVYKPGGKKEWRVVFWTHESTKPSRR

SEQ ID NO: 2352365 - protein, 19 aa, Cryptosporidium parvum
GEVPLELSSFANSYRLAGY

SEQ ID NO: 2352366 - protein, 26 aa, Cryptosporidium parvum
GFGRIGRLVLRACMERNDITVVAIND

SEQ ID NO: 2352367 - protein, 18 aa, Cryptosporidium parvum
GFIFPSPVQYHILSQGAI

SEQ ID NO: 2352368 - protein, 21 aa, Cryptosporidium parvum
GFLTKSFISIKGFYFQAKILG

SEQ ID NO: 2352369 - protein, 22 aa, Cryptosporidium parvum
GFTNRTLPHFKMNCVDGRSRGF

SEQ ID NO: 2352370 - protein, 18 aa, Cryptosporidium parvum
GFVGNSFFSGLQPDEFFF

SEQ ID NO: 2352371 - protein, 29 aa, Cryptosporidium parvum
GGAIRFFMLCKQIKHSFVNISLNDENINI

SEQ ID NO: 2352372 - protein, 23 aa, Cryptosporidium parvum
GGEYIGGLLPGALAAAGLNIGGG

SEQ ID NO: 2352373 - protein, 22 aa, Cryptosporidium parvum
GGGKRKGAIAIYLEPWHVDVVE

SEQ ID NO: 2352374 - protein, 22 aa, Cryptosporidium parvum
GGILRYKVDFQDYAVVEDDLDE

SEQ ID NO: 2352375 - protein, 18 aa, Cryptosporidium parvum
GGIPFLLNLRHFYQFNFI

SEQ ID NO: 2352376 - protein, 30 aa, Cryptosporidium parvum; identical to SEQ ID NO: 2171899

SEQ ID NO: 2352377 - protein, 27 aa, Cryptosporidium parvum
GHCQNYFLYKRIRSIIGKGEKINLTNL

SEQ ID NO: 2352378 - protein, 23 aa, Cryptosporidium parvum
GHDIWPGACYVYKSNGSKSSLRY

SEQ ID NO: 2352379 - protein, 17 aa, Cryptosporidium parvum
GHEPLPIENSTFNFIVI

SEQ ID NO: 2352380 - protein, 18 aa, Cryptosporidium parvum
GHHTAILLVTGKLYMFGG

SEQ ID NO: 2352381 - protein, 23 aa, Cryptosporidium parvum
GHTHFKNLFLIVWFEYNASIGKV

SEQ ID NO: 2352382 - protein, 20 aa, Cryptosporidium parvum
GIEGFHQFFPGLNMGGEYIG

SEQ ID NO: 2352383 - protein, 24 aa, Cryptosporidium parvum
GIIPRAVQLIFERLESQYTEYGVR

SEQ ID NO: 2352384 - protein, 23 aa, Cryptosporidium parvum
GIKEEPYCRFAKGLVSLLDSIKV

SEQ ID NO: 2352385 - protein, 24 aa, Cryptosporidium parvum
GINNGYSWRKNKPITDNNVNQESK

SEQ ID NO: 2352386 - protein, 30 aa, Cryptosporidium parvum; identical to SEQ ID NO: 2293213

SEQ ID NO: 2352387 - protein, 19 aa, Cryptosporidium parvum
GIRAFGLRIPKFPVPKITL

SEQ ID NO: 2352388 - protein, 26 aa, Cryptosporidium parvum
GISIEPSSDWGLERHSKFALEKVTAL

SEQ ID NO: 2352389 - protein, 20 aa, Cryptosporidium parvum
GISQRHICYYYKELSENFKL

SEQ ID NO: 2352390 - protein, 18 aa, Cryptosporidium parvum
GKALSGLLDGIGKMDNII

SEQ ID NO: 2352391 - protein, 20 aa, Cryptosporidium parvum
GKARARKLVILYGNLSFPSK

SEQ ID NO: 2352392 - protein, 19 aa, Cryptosporidium parvum
GKGILRFAMGHSIQGVWKD

SEQ ID NO: 2352393 - protein, 23 aa, Cryptosporidium parvum
GKHDKWVIAWSFFEKEERTSILK

SEQ ID NO: 2352394 - protein, 18 aa, Cryptosporidium parvum
GKHKALLGSIRGFKGNNV

SEQ ID NO: 2352395 - protein, 18 aa, Cryptosporidium parvum
GKKITAFVPRDGCLNYID

SEQ ID NO: 2352396 - protein, 19 aa, Cryptosporidium parvum
GKKYRCRYISGKIDKAQES

SEQ ID NO: 2352397 - protein, 19 aa, Cryptosporidium parvum
GKLKFIFDTHIYSINTNKI

SEQ ID NO: 2352398 - protein, 22 aa, Cryptosporidium parvum
GKNSLSDSFVWKDYHRGYISTE

SEQ ID NO: 2352399 - protein, 17 aa, Cryptosporidium parvum
GKPAVTITPKFAASPPK

SEQ ID NO: 2352400 - protein, 17 aa, Cryptosporidium parvum
GKPWKDSYIVIMSDGVS

SEQ ID NO: 2352401 - protein, 27 aa, Cryptosporidium parvum
GKSTGRCNCGYPIFIINGEVIAGSSGF

SEQ ID NO: 2352402 - protein, 19 aa, Cryptosporidium parvum
GKTLCYILPILGRLKNDKV

SEQ ID NO: 2352403 - protein, 27 aa, Cryptosporidium parvum
GKVEHIWKSTCFIKLPSKLDDGGYFTC

SEQ ID NO: 2352404 - protein, 20 aa, Cryptosporidium parvum
GKYELIGVICHLGKSVHSGH

SEQ ID NO: 2352405 - protein, 22 aa, Cryptosporidium parvum
GLARQVFHSVRMSLQEQARATK

SEQ ID NO: 2352406 - protein, 18 aa, Cryptosporidium parvum
GLCGPIKAIYLGLNHQTM

SEQ ID NO: 2352407 - protein, 20 aa, Cryptosporidium parvum
GLDDIFFKNMLEIATENKRL

SEQ ID NO: 2352408 - protein, 18 aa, Cryptosporidium parvum
GLLDGKKYIPGSVGGGLI

SEQ ID NO: 2352409 - protein, 23 aa, Cryptosporidium parvum
GLLSNFDWRSSYLPHIYSATLGL

SEQ ID NO: 2352410 - protein, 26 aa, Cryptosporidium parvum
GLPHTCAPCRGGPISSKAIHFAAIRG

SEQ ID NO: 2352411 - protein, 27 aa, Cryptosporidium parvum
GLPSLESRLYISEGIFCKTKLFIVGPP

SEQ ID NO: 2352412 - protein, 22 aa, Cryptosporidium parvum
GLRAEGYYQMTLIQRDTLPHSL

SEQ ID NO: 2352413 - protein, 17 aa, Cryptosporidium parvum
GLRDAASIASLMTTTQV

SEQ ID NO: 2352414 - protein, 21 aa, Cryptosporidium parvum
GMGARKRARFTVYDDNQELNQ

SEQ ID NO: 2352415 - protein, 21 aa, Cryptosporidium parvum
GMNLLLFLTGRFICRQKGLDV

SEQ ID NO: 2352416 - protein, 18 aa, Cryptosporidium parvum
GMSVYRTRGSGLSLSDNY

SEQ ID NO: 2352417 - protein, 18 aa, Cryptosporidium parvum
GNGKISRQQFIWLTSIGG

SEQ ID NO: 2352418 - protein, 26 aa, Cryptosporidium parvum
GNGMIPVLCIKLGSTILNKEFSANDI

SEQ ID NO: 2352419 - protein, 22 aa, Cryptosporidium parvum
GNIRVEIWFSDFSNQSAHQALL

SEQ ID NO: 2352420 - protein, 20 aa, Cryptosporidium parvum
GNLHGFGGLMAQDPDAPIPD

SEQ ID NO: 2352421 - protein, 19 aa, Cryptosporidium parvum
GNLIFSPKVFLPCNPDKGY

SEQ ID NO: 2352422 - protein, 18 aa, Cryptosporidium parvum
GNQAIWRNLIPRIWSIFI

SEQ ID NO: 2352423 - protein, 21 aa, Cryptosporidium parvum
GNRMITEILLKYGADINDVDE

SEQ ID NO: 2352424 - protein, 33 aa, Cryptosporidium parvum
GPDGRPMPYWLYKLNGLGIEFKCEICGNCSYWG

SEQ ID NO: 2352425 - protein, 24 aa, Cryptosporidium parvum
GPEWVWPMGHFLMAKYQLLKEKYE

SEQ ID NO: 2352426 - protein, 21 aa, Cryptosporidium parvum
GPGKCYRLYTEAAFNTEMLPT

SEQ ID NO: 2352427 - protein, 25 aa, Cryptosporidium parvum
GPKRISGKEAVSCVNGSIIHPFYQP

SEQ ID NO: 2352428 - protein, 25 aa, Cryptosporidium parvum
GPNSWPEFSKLLAHLVESPHYSVRL

SEQ ID NO: 2352429 - protein, 23 aa, Cryptosporidium parvum
GRADLKIRIPKSLWEYWEAFAND

SEQ ID NO: 2352430 - protein, 18 aa, Cryptosporidium parvum
GRELDSFNIGNNITNNNS

SEQ ID NO: 2352431 - protein, 26 aa, Cryptosporidium parvum
GRGGQSALRFARLRMEKRHNYLRKVA

SEQ ID NO: 2352432 - protein, 30 aa, Cryptosporidium parvum
GRHQSSMYRKCLRALWDMFQYDDEINLKIA

SEQ ID NO: 2352433 - protein, 18 aa, Cryptosporidium parvum
GRHSVVCRHWIRNMCMKG

SEQ ID NO: 2352434 - protein, 23 aa, Cryptosporidium parvum
GRITTEIQSFVPVILGENQKLDT

SEQ ID NO: 2352435 - protein, 19 aa, Cryptosporidium parvum
GRMSKDRLFEIMDTFLRQY

SEQ ID NO: 2352436 - protein, 26 aa, Cryptosporidium parvum
GRPEKAPDVCYSWWIFSLLYFLGRAN

SEQ ID NO: 2352437 - protein, 23 aa, Cryptosporidium parvum
GRQFEHPDYWLVQSNPWEIERQD

SEQ ID NO: 2352438 - protein, 17 aa, Cryptosporidium parvum
GRSELVVGWYHSHPGFG

SEQ ID NO: 2352439 - protein, 18 aa, Cryptosporidium parvum
GRSRGFVGNSFFSGLQPD

SEQ ID NO: 2352440 - protein, 19 aa, Cryptosporidium parvum
GRTKTCIIATITASSIYLE

SEQ ID NO: 2352441 - protein, 18 aa, Cryptosporidium parvum
GRVLDFIERGILNVSKIS

SEQ ID NO: 2352442 - protein, 20 aa, Cryptosporidium parvum
GRYDFIWIQWALQYLSDDEF

SEQ ID NO: 2352443 - protein, 25 aa, Cryptosporidium parvum
GSDLLPRPWSKYSIGSSQYNRRNNI

SEQ ID NO: 2352444 - protein, 20 aa, Cryptosporidium parvum
GSETVRKGWNAFSTLNNAID

SEQ ID NO: 2352445 - protein, 24 aa, Cryptosporidium parvum
GSFNKECRTIFVGDLYINRSKSNY

SEQ ID NO: 2352446 - protein, 32 aa, Cryptosporidium parvum; identical to SEQ ID NO: 2293604

SEQ ID NO: 2352447 - protein, 24 aa, Cryptosporidium parvum
GSITSRQIDIEVSKETTDTSVANN

SEQ ID NO: 2352448 - protein, 20 aa, Cryptosporidium parvum
GSKEGLFFYILLENNAKKSS

SEQ ID NO: 2352449 - protein, 17 aa, Cryptosporidium parvum
GSLGMIIRRPVTRSQTK

SEQ ID NO: 2352450 - protein, 22 aa, Cryptosporidium parvum
GSLPAPIMNRFDQEFRMYVNSD

SEQ ID NO: 2352451 - protein, 31 aa, Cryptosporidium parvum; identical to SEQ ID NO: 2172344

SEQ ID NO: 2352452 - protein, 23 aa, Cryptosporidium parvum
GSPEIWAAIFRYINKLVYIAKPR

SEQ ID NO: 2352453 - protein, 24 aa, Cryptosporidium parvum
GSPLPERHEIVLFKSMEDANNTTF

SEQ ID NO: 2352454 - protein, 18 aa, Cryptosporidium parvum
GSSKLMFVHTMYSEEIEL

SEQ ID NO: 2352455 - protein, 18 aa, Cryptosporidium parvum
GSSQEFNDGFSLSTGNLH

SEQ ID NO: 2352456 - protein, 24 aa, Cryptosporidium parvum
GSSREVLLRFNVDLPKKHGRGGQS

SEQ ID NO: 2352457 - protein, 19 aa, Cryptosporidium parvum
GSWMEGFESCLRISQPFFV

SEQ ID NO: 2352458 - protein, 19 aa, Cryptosporidium parvum
GTEHFKKYASLMLLLSDIL

SEQ ID NO: 2352459 - protein, 23 aa, Cryptosporidium parvum
GTLKTCGGHWGYIDLQQPVFHVG

SEQ ID NO: 2352460 - protein, 24 aa, Cryptosporidium parvum
GTNCVYCKFYFQEILEDHIPGYRI

SEQ ID NO: 2352461 - protein, 32 aa, Cryptosporidium parvum
GTNKGYCFIEFLGKLEAISALEQFQHTHLYGR

SEQ ID NO: 2352462 - protein, 21 aa, Cryptosporidium parvum
GTPSFETSIHFGINLYVLTVG

SEQ ID NO: 2352463 - protein, 21 aa, Cryptosporidium parvum
GTSKCIIRYDLLDIGLAICSP

SEQ ID NO: 2352464 - protein, 22 aa, Cryptosporidium parvum
GVCKFLFKPDHYALFSKLKSLL

SEQ ID NO: 2352465 - protein, 19 aa, Cryptosporidium parvum
GVGKSCLLLRFADDTYTDS

SEQ ID NO: 2352466 - protein, 24 aa, Cryptosporidium parvum
GVGKSCLLLRFAQDDSFTDSYITT

SEQ ID NO: 2352467 - protein, 17 aa, Cryptosporidium parvum
GVLGRGAYSSVFKIRSK

SEQ ID NO: 2352468 - protein, 17 aa, Cryptosporidium parvum
GVLPGITSICWGGDRNN

SEQ ID NO: 2352469 - protein, 27 aa, Cryptosporidium parvum
GVLYLLYKACRIFKQLGVEYVTIFEPN

SEQ ID NO: 2352470 - protein, 22 aa, Cryptosporidium parvum
GVSRGFGFVSFLSPDEATKAIT

SEQ ID NO: 2352471 - protein, 25 aa, Cryptosporidium parvum
GVSVLEHLIRCFKENNSLSNILKPF

SEQ ID NO: 2352472 - protein, 25 aa, Cryptosporidium parvum
GVTPGHRIPMGLLLGGRDALENELE

SEQ ID NO: 2352473 - protein, 20 aa, Cryptosporidium parvum
GVVKLADFGLARVFNTRNRM

SEQ ID NO: 2352474 - protein, 26 aa, Cryptosporidium parvum
GWKRIPKERSCIFLDSIDEQDSSVND

SEQ ID NO: 2352475 - protein, 22 aa, Cryptosporidium parvum
GWNFTGCSTVPFVTYPEKNISS

SEQ ID NO: 2352476 - protein, 20 aa, Cryptosporidium parvum
GWTCETCGASTNLWLNLSDG

SEQ ID NO: 2352477 - protein, 18 aa, Cryptosporidium parvum
GWVYYSLENSAVIEKSWR

SEQ ID NO: 2352478 - protein, 24 aa, Cryptosporidium parvum
GYDSLKEALNYVWGPSVELTPSMQ

SEQ ID NO: 2352479 - protein, 21 aa, Cryptosporidium parvum
GYFTCEGRQLLTLKTAESSRM

SEQ ID NO: 2352480 - protein, 17 aa, Cryptosporidium parvum
GYLRLSFNFKEKKVSYI

SEQ ID NO: 2352481 - protein, 23 aa, Cryptosporidium parvum
GYSQLKKGILLLLVGGVEKRTKD

SEQ ID NO: 2352482 - protein, 19 aa, Cryptosporidium parvum
GYSSFSLEFPYICCSIDAE

SEQ ID NO: 2352483 - protein, 20 aa, Cryptosporidium parvum
GYTVEKCLYIPKARKGEPEP

SEQ ID NO: 2352484 - protein, 32 aa, Cryptosporidium parvum
GYVCSSCLSIFCSRFKAPICSTCGARLKRIPI

SEQ ID NO: 2352485 - protein, 17 aa, Cryptosporidium parvum
HAPSLIFMDEIDSIGSQ

SEQ ID NO: 2352486 - protein, 19 aa, Cryptosporidium parvum
HELMFSTDELDNWKNLLPK

SEQ ID NO: 2352487 - protein, 24 aa, Cryptosporidium parvum
HFAKEGLSIFYSYDLCSSSCSVPT

SEQ ID NO: 2352488 - protein, 18 aa, Cryptosporidium parvum
HFIPGITCEFILEDQIIS

SEQ ID NO: 2352489 - protein, 23 aa, Cryptosporidium parvum
HFIPMYVELCDKLRDHLKDVTTI

SEQ ID NO: 2352490 - protein, 24 aa, Cryptosporidium parvum
HGGRVGWDYCLWIDIPEFSCMYLK

SEQ ID NO: 2352491 - protein, 21 aa, Cryptosporidium parvum
HGRAGVPMEVMGLLLGEFIDD

SEQ ID NO: 2352492 - protein, 23 aa, Cryptosporidium parvum
HHGASKLNSLWNFDGYNHQGGIY

SEQ ID NO: 2352493 - protein, 17 aa, Cryptosporidium parvum
HHLPSSPLVYGPRNQSV

SEQ ID NO: 2352494 - protein, 19 aa, Cryptosporidium parvum
HHSGFGFIEFEFVSDVEYA

SEQ ID NO: 2352495 - protein, 18 aa, Cryptosporidium parvum
HINLGSDILMDFFDGGFL

SEQ ID NO: 2352496 - protein, 24 aa, Cryptosporidium parvum
HIPGYRIMSCWEQKVEKPNPKYQY

SEQ ID NO: 2352497 - protein, 23 aa, Cryptosporidium parvum
HISDNVFRIFIYSNIKTFSNQMD

SEQ ID NO: 2352498 - protein, 24 aa, Cryptosporidium parvum
HKDGGLGFDAKWDLGWMNDTLSYL

SEQ ID NO: 2352499 - protein, 20 aa, Cryptosporidium parvum
HKVRDSWNKLVSVIQKTSSN

SEQ ID NO: 2352500 - protein, 20 aa, Cryptosporidium parvum
HLERCISDLQFVFAQIPLSV

SEQ ID NO: 2352501 - protein, 22 aa, Cryptosporidium parvum
HLKMFTDWIELMSREYFELTIL

SEQ ID NO: 2352502 - protein, 20 aa, Cryptosporidium parvum
HLLDYLSLICIQWKSQYKIC

SEQ ID NO: 2352503 - protein, 23 aa, Cryptosporidium parvum
HLMAVGMARLGGIGIIHKNMDME

SEQ ID NO: 2352504 - protein, 18 aa, Cryptosporidium parvum
HLPNMTRNFYVDGFKPSP

SEQ ID NO: 2352505 - protein, 30 aa, Cryptosporidium parvum
HLYGVLCCICKSCGAFLLKGEEKRQHLARL

SEQ ID NO: 2352506 - protein, 18 aa, Cryptosporidium parvum
HMMKTSSTWIVPFLMDHL

SEQ ID NO: 2352507 - protein, 20 aa, Cryptosporidium parvum
HPARFRSCQNYEIITHGGES

SEQ ID NO: 2352508 - protein, 26 aa, Cryptosporidium parvum
HPYYLPNFLDIFSWSLPFVSEKVTEM

SEQ ID NO: 2352509 - protein, 24 aa, Cryptosporidium parvum
HQTMQPCGFCFVQYYSHADALTAV

SEQ ID NO: 2352510 - protein, 17 aa, Cryptosporidium parvum
HRCLIDALFSNGFIFPS

SEQ ID NO: 2352511 - protein, 22 aa, Cryptosporidium parvum
HSGGFRKSFHGYPPPQMEGGSA

SEQ ID NO: 2352512 - protein, 23 aa, Cryptosporidium parvum
HSHLRFFGNMVLSLWDCGGQDIF

SEQ ID NO: 2352513 - protein, 21 aa, Cryptosporidium parvum
HSHPGFGCWFSGTDVSTQQSF

SEQ ID NO: 2352514 - protein, 25 aa, Cryptosporidium parvum
HSIDELRPSVDLTRTKLCEIQLKEG

SEQ ID NO: 2352515 - protein, 21 aa, Cryptosporidium parvum
HSYELPEIIATKVVYGNENYI

SEQ ID NO: 2352516 - protein, 19 aa, Cryptosporidium parvum
HVCNVPYDFQNIVPDFLVG

SEQ ID NO: 2352517 - protein, 25 aa, Cryptosporidium parvum
HVEEACQIFKSSLSKIRYNDIDLGD

SEQ ID NO: 2352518 - protein, 26 aa, Cryptosporidium parvum
HVEIFKRKIFLGQWQSAYIILTKDKF

SEQ ID NO: 2352519 - protein, 24 aa, Cryptosporidium parvum
HYCKEKKFSSTRFQSEKSGLMQCY

SEQ ID NO: 2352520 - protein, 21 aa, Cryptosporidium parvum
HYIGHSLPFPVKFMSNSHHFH

SEQ ID NO: 2352521 - protein, 19 aa, Cryptosporidium parvum
HYKDWESISFLVLSKDFIM

SEQ ID NO: 2352522 - protein, 19 aa, Cryptosporidium parvum
HYLFYPKNIQVMDLKENSK

SEQ ID NO: 2352523 - protein, 17 aa, Cryptosporidium parvum
HYTKFVELMTCLSSAYL

SEQ ID NO: 2352524 - protein, 21 aa, Cryptosporidium parvum
HYTNCKLEFLNIENIHKVRDS

SEQ ID NO: 2352525 - protein, 18 aa, Cryptosporidium parvum
IADGGIRYSGDIGKALAV

SEQ ID NO: 2352526 - protein, 20 aa, Cryptosporidium parvum
IADKCFIGPEIEFFVFESVS

SEQ ID NO: 2352527 - protein, 23 aa, Cryptosporidium parvum
IAFFDSVCGIWRNMKEKNINNLL

SEQ ID NO: 2352528 - protein, 20 aa, Cryptosporidium parvum
IAIGNCIDRFARVMKLDNYP

SEQ ID NO: 2352529 - protein, 17 aa, Cryptosporidium parvum
IANILYIFVEINLLSDH

SEQ ID NO: 2352530 - protein, 20 aa, Cryptosporidium parvum
IANIPIEYIISYIDMMFSSI

SEQ ID NO: 2352531 - protein, 17 aa, Cryptosporidium parvum
IAQKLALPVDEVTEDPE

SEQ ID NO: 2352532 - protein, 23 aa, Cryptosporidium parvum
IARFHRILRPFMLRRVKSEVEID

SEQ ID NO: 2352533 - protein, 21 aa, Cryptosporidium parvum
IARGCLNRRTAAFIAKLRKSK

SEQ ID NO: 2352534 - protein, 18 aa, Cryptosporidium parvum
ICIIPNLDRNGGFQQKPG

SEQ ID NO: 2352535 - protein, 20 aa, Cryptosporidium parvum
ICKDEHPESIIFNQNAIKES

SEQ ID NO: 2352536 - protein, 22 aa, Cryptosporidium parvum
ICNSIRGLVVWERVECSKGPIG

SEQ ID NO: 2352537 - protein, 19 aa, Cryptosporidium parvum
ICREEELYTLFSHINGFKE

SEQ ID NO: 2352538 - protein, 17 aa, Cryptosporidium parvum
ICTTRIVAGVGVPQITA

SEQ ID NO: 2352539 - protein, 24 aa, Cryptosporidium parvum
IDDYSVRVVDVFSMPQSGNSVSVE

SEQ ID NO: 2352540 - protein, 23 aa, Cryptosporidium parvum
IDGNPSWMFEKAFKTLKEKIPTC

SEQ ID NO: 2352541 - protein, 17 aa, Cryptosporidium parvum
IDHGFSVIQGRAACHES

SEQ ID NO: 2352542 - protein, 29 aa, Cryptosporidium parvum
IDIELGKGWKIFLSRSVDLGRWTIIQKLS

SEQ ID NO: 2352543 - protein, 18 aa, Cryptosporidium parvum
IDIHSGGIDLRFPHHDNE

SEQ ID NO: 2352544 - protein, 17 aa, Cryptosporidium parvum
IDIPIILGKIEKPRNSL

SEQ ID NO: 2352545 - protein, 17 aa, Cryptosporidium parvum
IDLLIALPRPKVFEKVL

SEQ ID NO: 2352546 - protein, 18 aa, Cryptosporidium parvum
IDMKSIYLTPDFMDKKNR

SEQ ID NO: 2352547 - protein, 25 aa, Cryptosporidium parvum
IDMLNIPIWLYKESGSLTVNGPFST

SEQ ID NO: 2352548 - protein, 24 aa, Cryptosporidium parvum
IDNRRKRGSISFHVKPKVNLSYPR

SEQ ID NO: 2352549 - protein, 17 aa, Cryptosporidium parvum
IDQDELFVNVNASKQLS

SEQ ID NO: 2352550 - protein, 19 aa, Cryptosporidium parvum
IDQFEIWVTWMEKLSLIND

SEQ ID NO: 2352551 - protein, 23 aa, Cryptosporidium parvum
IDQRLHDVFNFIRTGGIMLGDGK

SEQ ID NO: 2352552 - protein, 23 aa, Cryptosporidium parvum
IDRFKNCIGNWIAMNTINDKDLE

SEQ ID NO: 2352553 - protein, 21 aa, Cryptosporidium parvum
IDSICELLRASIKMPPEQISP

SEQ ID NO: 2352554 - protein, 27 aa, Cryptosporidium parvum
IDSNKSFKLSICNANELIIECKHSDSG

SEQ ID NO: 2352555 - protein, 23 aa, Cryptosporidium parvum
IDSTGWYDLISMILASSNKIVDH

SEQ ID NO: 2352556 - protein, 23 aa, Cryptosporidium parvum
IDSYNPHVSFCMQRIKRYLESND

SEQ ID NO: 2352557 - protein, 25 aa, Cryptosporidium parvum
IDYSLRFFLENDLIYLLNPIQSSVR

SEQ ID NO: 2352558 - protein, 18 aa, Cryptosporidium parvum
IEAWAEKFWNSGHAETHV

SEQ ID NO: 2352559 - protein, 23 aa, Cryptosporidium parvum
IECNEMKNFIGPIIQGKVAKDIC

SEQ ID NO: 2352560 - protein, 24 aa, Cryptosporidium parvum
IEFRSLFCQCIIYIILKRTKTKFY

SEQ ID NO: 2352561 - protein, 21 aa, Cryptosporidium parvum
IEGDCVLKATKVINTSDESID

SEQ ID NO: 2352562 - protein, 28 aa, Cryptosporidium parvum
IEGNPDWRILKSHLLREGRVRKDHLLEI

SEQ ID NO: 2352563 - protein, 20 aa, Cryptosporidium parvum
IEGRILWDILETIRREHKLK

SEQ ID NO: 2352564 - protein, 17 aa, Cryptosporidium parvum
IEISVLTSSLGFESNFD

SEQ ID NO: 2352565 - protein, 18 aa, Cryptosporidium parvum
IELEFKSMELDWERRALE

SEQ ID NO: 2352566 - protein, 24 aa, Cryptosporidium parvum
IELLKGSGVGALISSMIQYKPSDG

SEQ ID NO: 2352567 - protein, 25 aa, Cryptosporidium parvum
IELSDDFFIKIPRNVFIGLNSIDFA

SEQ ID NO: 2352568 - protein, 17 aa, Cryptosporidium parvum
IELTRNIHFFKFIVDGE

SEQ ID NO: 2352569 - protein, 17 aa, Cryptosporidium parvum
IEYIISYIDMMFSSIYR

SEQ ID NO: 2352570 - protein, 25 aa, Cryptosporidium parvum
IFEMITNRCGVVFSECKSYPVEEAR

SEQ ID NO: 2352571 - protein, 18 aa, Cryptosporidium parvum
IFFGKPIRDFSSFSNVIR

SEQ ID NO: 2352572 - protein, 23 aa, Cryptosporidium parvum
IFIKSHILSLYLYYNQEYDTQKS

SEQ ID NO: 2352573 - protein, 24 aa, Cryptosporidium parvum
IFSKLELLRNYLLKVKKNESDFLE

SEQ ID NO: 2352574 - protein, 22 aa, Cryptosporidium parvum
IGDPPRKRKLPTDEDGLVKQIL

SEQ ID NO: 2352575 - protein, 21 aa, Cryptosporidium parvum
IGIATICRIHRLHIAPDYDEF

SEQ ID NO: 2352576 - protein, 23 aa, Cryptosporidium parvum
IGLLRSRKCPFIIALNKIDRLYG

SEQ ID NO: 2352577 - protein, 25 aa, Cryptosporidium parvum
IGNALFPMFWSSFLASQQFNNTHSF

SEQ ID NO: 2352578 - protein, 19 aa, Cryptosporidium parvum
IGPEGGWTKEELTDLITMG

SEQ ID NO: 2352579 - protein, 17 aa, Cryptosporidium parvum
IGPFGLRVTGEDLETIK

SEQ ID NO: 2352580 - protein, 21 aa, Cryptosporidium parvum
IGQLMIEYIAVWGIINEDDHL

SEQ ID NO: 2352581 - protein, 23 aa, Cryptosporidium parvum
IGSCGYNIYHFLKSGSIKVFVNI

SEQ ID NO: 2352582 - protein, 23 aa, Cryptosporidium parvum
IGSKTLNFAHNWTKSDNESAALI

SEQ ID NO: 2352583 - protein, 18 aa, Cryptosporidium parvum
IHCFFPYLYCEVPKSTPP

SEQ ID NO: 2352584 - protein, 19 aa, Cryptosporidium parvum
IHEAIEFSEFLIPATNKKR

SEQ ID NO: 2352585 - protein, 17 aa, Cryptosporidium parvum
IHHPNFRSWTHEQIIEH

SEQ ID NO: 2352586 - protein, 18 aa, Cryptosporidium parvum
IHISLPILSTNSHESNQI

SEQ ID NO: 2352587 - protein, 24 aa, Cryptosporidium parvum
IHKWRILQQRSYIAIGKFKQTCES

SEQ ID NO: 2352588 - protein, 20 aa, Cryptosporidium parvum
IHLWDLRKSAILDSLELSTL

SEQ ID NO: 2352589 - protein, 23 aa, Cryptosporidium parvum
IHRDIKCANLLISGDGVVKLADF

SEQ ID NO: 2352590 - protein, 25 aa, Cryptosporidium parvum
IHTDPLWKHLEVVLSGADVPGEGEH

SEQ ID NO: 2352591 - protein, 19 aa, Cryptosporidium parvum
IIAKCCGLTGELRKGEQYL

SEQ ID NO: 2352592 - protein, 18 aa, Cryptosporidium parvum
IIEFKGIKIQRAINSANR

SEQ ID NO: 2352593 - protein, 20 aa, Cryptosporidium parvum
IIHMQRFYLSEDWRPKKINL

SEQ ID NO: 2352594 - protein, 17 aa, Cryptosporidium parvum
IIKRSNIDYARAFIGHD

SEQ ID NO: 2352595 - protein, 27 aa, Cryptosporidium parvum
IILDVHFPLAVYKKLLGYKVDIGDLYE

SEQ ID NO: 2352596 - protein, 25 aa, Cryptosporidium parvum
IILNTFRYIPVAGVLLESQKRPMLI

SEQ ID NO: 2352597 - protein, 26 aa, Cryptosporidium parvum
IIPKPFPGLISKVSVPWKRVKTSSPC

SEQ ID NO: 2352598 - protein, 29 aa, Cryptosporidium parvum
IIQRFRTGKIWILICTDLMARGVDFKNVS

SEQ ID NO: 2352599 - protein, 17 aa, Cryptosporidium parvum
IISKCIEVYRPGAIVLQ

SEQ ID NO: 2352600 - protein, 29 aa, Cryptosporidium parvum
IKAKAPLGVINFKIAEWSLQISDSDEKTF

SEQ ID NO: 2352601 - protein, 17 aa, Cryptosporidium parvum
IKAKRIHGISTQMMGSG

SEQ ID NO: 2352602 - protein, 25 aa, Cryptosporidium parvum
IKDAYEYAKQLWLKARNKSKLNKCQ

SEQ ID NO: 2352603 - protein, 17 aa, Cryptosporidium parvum
IKDFFTLNINEIIQNSK

SEQ ID NO: 2352604 - protein, 22 aa, Cryptosporidium parvum
IKDKKISSVIIFDSSVKSEYYD

SEQ ID NO: 2352605 - protein, 17 aa, Cryptosporidium parvum
IKDSIGGLMDSYVASYD

SEQ ID NO: 2352606 - protein, 20 aa, Cryptosporidium parvum
IKECCEILNLKISNLNNDGE

SEQ ID NO: 2352607 - protein, 21 aa, Cryptosporidium parvum
IKEMWKSLISKKGMNLEDIIR

SEQ ID NO: 2352608 - protein, 22 aa, Cryptosporidium parvum
IKEPRKGKIRRIKMKNPKFAST

SEQ ID NO: 2352609 - protein, 21 aa, Cryptosporidium parvum
IKFAPLDLKDLISIEKNHGSM

SEQ ID NO: 2352610 - protein, 25 aa, Cryptosporidium parvum
IKFFMKRYWLDIKLFGKMLYENKRE

SEQ ID NO: 2352611 - protein, 17 aa, Cryptosporidium parvum
IKGIQFHEFVDLICNQG

SEQ ID NO: 2352612 - protein, 17 aa, Cryptosporidium parvum
IKHNSCLVVFVGGVTLG

SEQ ID NO: 2352613 - protein, 23 aa, Cryptosporidium parvum
IKHWTEYLFEWQVLSRRSSIIYR

SEQ ID NO: 2352614 - protein, 17 aa, Cryptosporidium parvum
IKIEDIMSPDLFSDLPI

SEQ ID NO: 2352615 - protein, 20 aa, Cryptosporidium parvum
IKIIKAVMFLGNITFIENEG

SEQ ID NO: 2352616 - protein, 17 aa, Cryptosporidium parvum
IKIRNSHIFNNSDELFA

SEQ ID NO: 2352617 - protein, 19 aa, Cryptosporidium parvum
IKIRSLFQFIQCLLSNFSV

SEQ ID NO: 2352618 - protein, 19 aa, Cryptosporidium parvum
IKIVPKIIPKPAITKEQPT

SEQ ID NO: 2352619 - protein, 24 aa, Cryptosporidium parvum
IKKFKRFLRLQGFQSQDQYKRKIN

SEQ ID NO: 2352620 - protein, 17 aa, Cryptosporidium parvum
IKLGQCLNSTRNIEKIQ

SEQ ID NO: 2352621 - protein, 25 aa, Cryptosporidium parvum
IKLLSSFIELCKFNKNNIVGTENLI

SEQ ID NO: 2352622 - protein, 23 aa, Cryptosporidium parvum
IKNLFTIHVYELNARVALENHDL

SEQ ID NO: 2352623 - protein, 28 aa, Cryptosporidium parvum
IKNWRFHKIPMFWLQVKLIEILELFPEV

SEQ ID NO: 2352624 - protein, 20 aa, Cryptosporidium parvum
IKQLKMRSPAIFSLSFDRPN

SEQ ID NO: 2352625 - protein, 19 aa, Cryptosporidium parvum
IKRKETLSICYIESEYIQD

SEQ ID NO: 2352626 - protein, 21 aa, Cryptosporidium parvum
IKSAGKRAAKKLKDKSKSLKR

SEQ ID NO: 2352627 - protein, 18 aa, Cryptosporidium parvum
IKSKMNIDVIVGNVVTEE

SEQ ID NO: 2352628 - protein, 18 aa, Cryptosporidium parvum
IKTLRYILRPKLLTKPII

SEQ ID NO: 2352629 - protein, 20 aa, Cryptosporidium parvum
IKTNFERCFYIPSCDSNEYY

SEQ ID NO: 2352630 - protein, 24 aa, Cryptosporidium parvum
IKTVFKVLFSLEFRESPQSINWFW

SEQ ID NO: 2352631 - protein, 20 aa, Cryptosporidium parvum
IKYLWETKRDFNIHEVFDDE

SEQ ID NO: 2352632 - protein, 21 aa, Cryptosporidium parvum
IKYRLLRMNNENFFKSFGDKK

SEQ ID NO: 2352633 - protein, 27 aa, Cryptosporidium parvum
ILEDYCHMRGFPYCRIDGNTSGDDRDR

SEQ ID NO: 2352634 - protein, 17 aa, Cryptosporidium parvum
ILELCLGSTAAQFIACS

SEQ ID NO: 2352635 - protein, 20 aa, Cryptosporidium parvum
ILELLKYHARVMYIDIDVHH

SEQ ID NO: 2352636 - protein, 18 aa, Cryptosporidium parvum
ILFKFPRVSPIINDEKNK

SEQ ID NO: 2352637 - protein, 18 aa, Cryptosporidium parvum
ILFRNLFVLLTWASDYIG

SEQ ID NO: 2352638 - protein, 26 aa, Cryptosporidium parvum
ILGVQARLLPLFSFVSRYSTINESYK

SEQ ID NO: 2352639 - protein, 26 aa, Cryptosporidium parvum
ILISCKLCKFSFKKPYWEKKIKNTNR

SEQ ID NO: 2352640 - protein, 22 aa, Cryptosporidium parvum
ILLPGEKLLLFSKECGISAQGL

SEQ ID NO: 2352641 - protein, 17 aa, Cryptosporidium parvum
ILLRTSIINHRRDLARK

SEQ ID NO: 2352642 - protein, 24 aa, Cryptosporidium parvum
ILNLGGIPPRKECINSIRRQTVDS

SEQ ID NO: 2352643 - protein, 25 aa, Cryptosporidium parvum
ILSSSECLFGYGFIPKTEPVSGLFD

SEQ ID NO: 2352644 - protein, 17 aa, Cryptosporidium parvum
ILTNFKSLMVFMKGIKE

SEQ ID NO: 2352645 - protein, 17 aa, Cryptosporidium parvum
IMKKSYDDQSFIIKQMK

SEQ ID NO: 2352646 - protein, 17 aa, Cryptosporidium parvum
IMLFKNSLFSLQLVFQV

SEQ ID NO: 2352647 - protein, 17 aa, Cryptosporidium parvum
IMVVILFNPELDLNTTD

SEQ ID NO: 2352648 - protein, 24 aa, Cryptosporidium parvum
INEAFPPVFPLFTLPPLPPKRNGP

SEQ ID NO: 2352649 - protein, 24 aa, Cryptosporidium parvum
INELLKHRGGDCTIETILNELSTS

SEQ ID NO: 2352650 - protein, 25 aa, Cryptosporidium parvum
INEYFRLLFEFNKNGVHFVNIIQGN

SEQ ID NO: 2352651 - protein, 19 aa, Cryptosporidium parvum
INIEICYDVELPISEFTYK

SEQ ID NO: 2352652 - protein, 19 aa, Cryptosporidium parvum
INIKRVIMKNVNMNERYHF

SEQ ID NO: 2352653 - protein, 26 aa, Cryptosporidium parvum
ININNGNKWKGWGIKSGESTNADLFE

SEQ ID NO: 2352654 - protein, 18 aa, Cryptosporidium parvum
INLTESHFKEIVSELENA

SEQ ID NO: 2352655 - protein, 24 aa, Cryptosporidium parvum
INQNSKVYGCFQWLDQPEIGESIV

SEQ ID NO: 2352656 - protein, 24 aa, Cryptosporidium parvum
INRFVLEWRNIYRFENVIAGSVSI

SEQ ID NO: 2352657 - protein, 21 aa, Cryptosporidium parvum
INSLRFSDCFMQPEKKCGSYP

SEQ ID NO: 2352658 - protein, 25 aa, Cryptosporidium parvum
INSMLRPALNIGKRTKSTGNLDDKD

SEQ ID NO: 2352659 - protein, 23 aa, Cryptosporidium parvum
INTCLKILYTFQIRSELGYINPM

SEQ ID NO: 2352660 - protein, 27 aa, Cryptosporidium parvum
IPDCAVRALSHCLLELTGINNDLKKIP

SEQ ID NO: 2352661 - protein, 18 aa, Cryptosporidium parvum
IPDPPRFPTAALKIKQHT

SEQ ID NO: 2352662 - protein, 17 aa, Cryptosporidium parvum
IPEHIKDSIGGLMDSYV

SEQ ID NO: 2352663 - protein, 24 aa, Cryptosporidium parvum
IPEVGELFSIHFQDLLEIYSKYFI

SEQ ID NO: 2352664 - protein, 18 aa, Cryptosporidium parvum
IPHALMGAIAIHLSLLDH

SEQ ID NO: 2352665 - protein, 29 aa, Cryptosporidium parvum
IPLDPRIVMRILFNFRKLYPVSYKTRIIK

SEQ ID NO: 2352666 - protein, 17 aa, Cryptosporidium parvum
IPNLDRNGGFQQKPGEN

SEQ ID NO: 2352667 - protein, 32 aa, Cryptosporidium parvum
IPNNWKFQATVARKQLRQFTGLEETDFNLKEL

SEQ ID NO: 2352668 - protein, 24 aa, Cryptosporidium parvum
IPRKECQIPHEFVGIGLNTGENVP

SEQ ID NO: 2352669 - protein, 18 aa, Cryptosporidium parvum
IPVKEMTRVFSVDMQEKE

SEQ ID NO: 2352670 - protein, 25 aa, Cryptosporidium parvum
IQFFKSLRISVGINDVTCARMLLSK

SEQ ID NO: 2352671 - protein, 22 aa, Cryptosporidium parvum
IQGLRMLESIRLFGVFHDSFRN

SEQ ID NO: 2352672 - protein, 22 aa, Cryptosporidium parvum
IQINARIGALERFQRCLRLTFN

SEQ ID NO: 2352673 - protein, 26 aa, Cryptosporidium parvum
IQKLSFFFNKFRVVDEDLSWPIIDQG

SEQ ID NO: 2352674 - protein, 25 aa, Cryptosporidium parvum
IQLACPRLSTDWGAYYKKPILNSYE

SEQ ID NO: 2352675 - protein, 17 aa, Cryptosporidium parvum
IQMAFFIISACELSDKK

SEQ ID NO: 2352676 - protein, 23 aa, Cryptosporidium parvum
IQNWKRRLEITSKLNYNMVHFTP

SEQ ID NO: 2352677 - protein, 18 aa, Cryptosporidium parvum
IQSSIPINEMNGFNVKVD

SEQ ID NO: 2352678 - protein, 23 aa, Cryptosporidium parvum
IRCIKPNSRKAVHEFDSLDVLRQ

SEQ ID NO: 2352679 - protein, 17 aa, Cryptosporidium parvum
IRKASFSIQSRWRSFQI

SEQ ID NO: 2352680 - protein, 18 aa, Cryptosporidium parvum
IRKHCIYPVIGHQDRILL

SEQ ID NO: 2352681 - protein, 22 aa, Cryptosporidium parvum
IRKLTISISKLKKMVMGKDNFA

SEQ ID NO: 2352682 - protein, 22 aa, Cryptosporidium parvum
IRNLERYERFIGSTKLLEEVSI

SEQ ID NO: 2352683 - protein, 20 aa, Cryptosporidium parvum
IRPPAKLFDRDKVESLGGVV

SEQ ID NO: 2352684 - protein, 25 aa, Cryptosporidium parvum
IRSFKPNPMCFHRTVTPIQRRRKIT

SEQ ID NO: 2352685 - protein, 28 aa, Cryptosporidium parvum
IRSKAICCLTKLFQCCPDRLRANEWGER

SEQ ID NO: 2352686 - protein, 18 aa, Cryptosporidium parvum
IRSKRSGNIYALKVMSVE

SEQ ID NO: 2352687 - protein, 17 aa, Cryptosporidium parvum
IRSLRFDTPTSLVRREF

SEQ ID NO: 2352688 - protein, 23 aa, Cryptosporidium parvum
IRSVCTEAGMFAIRARRKSISEK

SEQ ID NO: 2352689 - protein, 27 aa, Cryptosporidium parvum
IRWHPRGPCIFGGGVDGTGWLWMAPDG

SEQ ID NO: 2352690 - protein, 22 aa, Cryptosporidium parvum
ISAFCIQIAILANHQTGRDTHV

SEQ ID NO: 2352691 - protein, 19 aa, Cryptosporidium parvum
ISAPTPIKIVPKIIPKPAI

SEQ ID NO: 2352692 - protein, 17 aa, Cryptosporidium parvum
ISDELRNSIIRLVPKEQ

SEQ ID NO: 2352693 - protein, 19 aa, Cryptosporidium parvum
ISGGQLLVKYQHGIDKEIA

SEQ ID NO: 2352694 - protein, 24 aa, Cryptosporidium parvum
ISIKEAACHVGITLCSHLRHSDRV

SEQ ID NO: 2352695 - protein, 27 aa, Cryptosporidium parvum
ISKEMRRLCSILTFLFDSKNSGCLEFT

SEQ ID NO: 2352696 - protein, 18 aa, Cryptosporidium parvum
ISKLKPIFAKLAPPNIVK

SEQ ID NO: 2352697 - protein, 38 aa, Cryptosporidium parvum
ISKNGFSNQEWVMHYWKEIPLPFSFTSIINRIRNNYYR

SEQ ID NO: 2352698 - protein, 32 aa, Cryptosporidium parvum
ISKSTLYCSTCMCFYCASCAHMNHVSAGSYHD

SEQ ID NO: 2352699 - protein, 22 aa, Cryptosporidium parvum
ISLEELKRGYELNNVLQDHLML

SEQ ID NO: 2352700 - protein, 25 aa, Cryptosporidium parvum
ISLFSEAFSSLNSMVNLFTSLRFYH

SEQ ID NO: 2352701 - protein, 21 aa, Cryptosporidium parvum
ISLPEGFTILGSIQSKSDCSE

SEQ ID NO: 2352702 - protein, 25 aa, Cryptosporidium parvum
ISLSWFCLNCLQTIVGDSVCLCGVD

SEQ ID NO: 2352703 - protein, 20 aa, Cryptosporidium parvum
ISLYHALSFYNAIYSEDFGY

SEQ ID NO: 2352704 - protein, 18 aa, Cryptosporidium parvum
ISNDGSFKSQQLFNNNIV

SEQ ID NO: 2352705 - protein, 17 aa, Cryptosporidium parvum
ISNYGCSTSSITNSTSI

SEQ ID NO: 2352706 - protein, 19 aa, Cryptosporidium parvum
ISPKGWTCETCGASTNLWL

SEQ ID NO: 2352707 - protein, 24 aa, Cryptosporidium parvum
ISQIPRQTPSVVRPPTAPNSISKS

SEQ ID NO: 2352708 - protein, 25 aa, Cryptosporidium parvum
ISRCGQCKRYLTYISNILPQRLYCS

SEQ ID NO: 2352709 - protein, 17 aa, Cryptosporidium parvum
ISRRSRNSRWRGASEDN

SEQ ID NO: 2352710 - protein, 17 aa, Cryptosporidium parvum
ISRTMLASMGSPSSDSR

SEQ ID NO: 2352711 - protein, 21 aa, Cryptosporidium parvum
ISRTRACTVVLSLKEGSLEDC

SEQ ID NO: 2352712 - protein, 17 aa, Cryptosporidium parvum
ISSEVICGLLNGMEYCI

SEQ ID NO: 2352713 - protein, 21 aa, Cryptosporidium parvum
ISSGLLKDIFGYMEIKESKMT

SEQ ID NO: 2352714 - protein, 26 aa, Cryptosporidium parvum
ISSLLRISSPFLWHFFQNGGNVHDLP

SEQ ID NO: 2352715 - protein, 24 aa, Cryptosporidium parvum
ISTNCVRIMFGISEFMKESQDAEL

SEQ ID NO: 2352716 - protein, 26 aa, Cryptosporidium parvum
ITADKQIPCRFHLISVPPNSRVGSSG

SEQ ID NO: 2352717 - protein, 19 aa, Cryptosporidium parvum
ITEKSKLILSSYITSNNSD

SEQ ID NO: 2352718 - protein, 23 aa, Cryptosporidium parvum
ITHLFYKTLVYISAISGINSNGI

SEQ ID NO: 2352719 - protein, 25 aa, Cryptosporidium parvum
ITHPLRYIKGLKQCFEYIKSIEEDN

SEQ ID NO: 2352720 - protein, 20 aa, Cryptosporidium parvum
ITSIPGLRPPPIPISNEANF

SEQ ID NO: 2352721 - protein, 24 aa, Cryptosporidium parvum
ITSKICIGNVFLIKTIPITIYNEF

SEQ ID NO: 2352722 - protein, 20 aa, Cryptosporidium parvum
IVDGEWRYSPEYPIESDSEG

SEQ ID NO: 2352723 - protein, 25 aa, Cryptosporidium parvum
IVFDLTCGAGAFTLPLIKIKDCTLF

SEQ ID NO: 2352724 - protein, 23 aa, Cryptosporidium parvum
IVGNDFLPHIPFHTVDQGLARII

SEQ ID NO: 2352725 - protein, 17 aa, Cryptosporidium parvum
IVHPLCIDDPAPWRGSD

SEQ ID NO: 2352726 - protein, 24 aa, Cryptosporidium parvum
IVPFLMDHLIHYSILVKNNYIGIS

SEQ ID NO: 2352727 - protein, 19 aa, Cryptosporidium parvum
IVYNLRDGYFSGCSVALEL

SEQ ID NO: 2352728 - protein, 24 aa, Cryptosporidium parvum
IYNDLKILRFHDGISGKTYKALPS

SEQ ID NO: 2352729 - protein, 17 aa, Cryptosporidium parvum
IYYKLKLSIESFQQKLL

SEQ ID NO: 2352730 - protein, 20 aa, Cryptosporidium parvum
KAELGLNLHQLYNGRIPAAP

SEQ ID NO: 2352731 - protein, 23 aa, Cryptosporidium parvum
KAKLDLFKMRFLGRNMKISYYCE

SEQ ID NO: 2352732 - protein, 22 aa, Cryptosporidium parvum
KAKSGLSDFVLKSKRISSSGSL

SEQ ID NO: 2352733 - protein, 34 aa, Cryptosporidium parvum; identical to SEQ ID NO: 2174284

SEQ ID NO: 2352734 - protein, 22 aa, Cryptosporidium parvum
KAQKKIPLWARSMNWIPKMKEQ

SEQ ID NO: 2352735 - protein, 20 aa, Cryptosporidium parvum
KARVAKIIRNLMDMMSKIPD

SEQ ID NO: 2352736 - protein, 21 aa, Cryptosporidium parvum
KAWENPRIVLANFLKSMFLTS

SEQ ID NO: 2352737 - protein, 19 aa, Cryptosporidium parvum
KCPWFAVGRCRMDKECNWA

SEQ ID NO: 2352738 - protein, 28 aa, Cryptosporidium parvum
KCYQSWWHMRVIRELLGFDIEELNFISK

SEQ ID NO: 2352739 - protein, 20 aa, Cryptosporidium parvum
KDETVLWTWISKRSSKLETL

SEQ ID NO: 2352740 - protein, 20 aa, Cryptosporidium parvum
KDFRNQLLLLRRNLAAEFGI

SEQ ID NO: 2352741 - protein, 17 aa, Cryptosporidium parvum
KDGGIIGCTQPRRVAAT

SEQ ID NO: 2352742 - protein, 21 aa, Cryptosporidium parvum
KDGGKRPIVKTIPGGGTSGSP

SEQ ID NO: 2352743 - protein, 30 aa, Cryptosporidium parvum; identical to SEQ ID NO: 2295974

SEQ ID NO: 2352744 - protein, 25 aa, Cryptosporidium parvum
KDIIVSICCLILRIISCTWSNNFSS

SEQ ID NO: 2352745 - protein, 20 aa, Cryptosporidium parvum
KDILSIFWKFYLDGKFTMVS

SEQ ID NO: 2352746 - protein, 25 aa, Cryptosporidium parvum
KDLNSFPIQIPVFFSQNIQHIESNS

SEQ ID NO: 2352747 - protein, 22 aa, Cryptosporidium parvum
KDNLYHWNKQMNVIKNVSSSIV

SEQ ID NO: 2352748 - protein, 25 aa, Cryptosporidium parvum
KDPVYKAQCQLSFKDSFSEGGLYVN

SEQ ID NO: 2352749 - protein, 22 aa, Cryptosporidium parvum
KDSEIVVCFIMQLPYYIKVQAG

SEQ ID NO: 2352750 - protein, 17 aa, Cryptosporidium parvum
KDWNLSSKLSISVQDSC

SEQ ID NO: 2352751 - protein, 21 aa, Cryptosporidium parvum
KDWQLGYMVIEDFSIYIYDSG

SEQ ID NO: 2352752 - protein, 20 aa, Cryptosporidium parvum
KEELTDLITMGFKVVNMGDR

SEQ ID NO: 2352753 - protein, 23 aa, Cryptosporidium parvum
KEGGELYNIWYGKYQFDYDKRGK

SEQ ID NO: 2352754 - protein, 17 aa, Cryptosporidium parvum
KEGRFRGNLSGKRVDFS

SEQ ID NO: 2352755 - protein, 21 aa, Cryptosporidium parvum
KEIKEFAWIQICDKYNNGKSC

SEQ ID NO: 2352756 - protein, 21 aa, Cryptosporidium parvum
KEISCGGHHTAILLVTGKLYM

SEQ ID NO: 2352757 - protein, 24 aa, Cryptosporidium parvum
KEKIPTCRTHFCGYDENLENSNIE

SEQ ID NO: 2352758 - protein, 18 aa, Cryptosporidium parvum
KEKLRMKRFEEKNKKFEK

SEQ ID NO: 2352759 - protein, 20 aa, Cryptosporidium parvum
KEKYRWGEATSLLSVTESLI

SEQ ID NO: 2352760 - protein, 18 aa, Cryptosporidium parvum
KELMASPLSKELRQKYNV

SEQ ID NO: 2352761 - protein, 17 aa, Cryptosporidium parvum
KELPILSAYVASSYRGY

SEQ ID NO: 2352762 - protein, 18 aa, Cryptosporidium parvum
KELYHRFERVLNNNENLK

SEQ ID NO: 2352763 - protein, 34 aa, Cryptosporidium parvum
KEMEQLLALDDFKKVIGLLERAKESSLRRLDRTL

SEQ ID NO: 2352764 - protein, 20 aa, Cryptosporidium parvum
KENFYSYCIKNIPRYINLAE

SEQ ID NO: 2352765 - protein, 21 aa, Cryptosporidium parvum
KENKFHPPVTTWWIEGANHNL

SEQ ID NO: 2352766 - protein, 18 aa, Cryptosporidium parvum
KENLEKMALYLGEPQNTI

SEQ ID NO: 2352767 - protein, 21 aa, Cryptosporidium parvum
KENNWQCVVEIVPNCPKVIRK

SEQ ID NO: 2352768 - protein, 18 aa, Cryptosporidium parvum
KERQVRFATGDVPISLLQ

SEQ ID NO: 2352769 - protein, 24 aa, Cryptosporidium parvum
KERTFYLDHIFPMDTNQSYVYKTA

SEQ ID NO: 2352770 - protein, 21 aa, Cryptosporidium parvum
KESCLSCPKDIIVSICCLILR

SEQ ID NO: 2352771 - protein, 24 aa, Cryptosporidium parvum
KESKGCSYLVLWLDCDREGENICF

SEQ ID NO: 2352772 - protein, 22 aa, Cryptosporidium parvum
KESWLCKSCNERIYSINGYLNP

SEQ ID NO: 2352773 - protein, 34 aa, Cryptosporidium parvum; identical to SEQ ID NO: 2296172

SEQ ID NO: 2352774 - protein, 18 aa, Cryptosporidium parvum
KEYLNNFSQTSICSTNTI

SEQ ID NO: 2352775 - protein, 25 aa, Cryptosporidium parvum
KEYLVSNIFLYRSCISDSHRVELEF

SEQ ID NO: 2352776 - protein, 17 aa, Cryptosporidium parvum
KFFQARPPLPYVPYPNR

SEQ ID NO: 2352777 - protein, 18 aa, Cryptosporidium parvum
KFLEIKVWEETRIEKYQH

SEQ ID NO: 2352778 - protein, 19 aa, Cryptosporidium parvum
KFTSLPSCQVYSYQDKETT

SEQ ID NO: 2352779 - protein, 30 aa, Cryptosporidium parvum; identical to SEQ ID NO: 2296227

SEQ ID NO: 2352780 - protein, 17 aa, Cryptosporidium parvum
KGFWEMCNSDSLHKSYM

SEQ ID NO: 2352781 - protein, 20 aa, Cryptosporidium parvum
KGGTRLKQFLSEISNVTNGI

SEQ ID NO: 2352782 - protein, 23 aa, Cryptosporidium parvum
KGGWNLKAYKCIDLIEKLFEVIT

SEQ ID NO: 2352783 - protein, 22 aa, Cryptosporidium parvum
KGHGHAVSFLKKFNVPLLILGG

SEQ ID NO: 2352784 - protein, 17 aa, Cryptosporidium parvum
KGKDIKLSFDVEELNDP

SEQ ID NO: 2352785 - protein, 26 aa, Cryptosporidium parvum
KGKVVIDCFRLISPHSVIAGQEPRQT

SEQ ID NO: 2352786 - protein, 18 aa, Cryptosporidium parvum
KGLGELGFVIGRHGPDSD

SEQ ID NO: 2352787 - protein, 24 aa, Cryptosporidium parvum
KGRKCSSSRCILRGRCICYNNVFF

SEQ ID NO: 2352788 - protein, 18 aa, Cryptosporidium parvum
KGSLPEDCYYSADEDFQL

SEQ ID NO: 2352789 - protein, 22 aa, Cryptosporidium parvum
KHDRLNCPICRGMHLEDAPLLY

SEQ ID NO: 2352790 - protein, 27 aa, Cryptosporidium parvum
KHGKKKKAPILRRIFGKKGSSNTDESS

SEQ ID NO: 2352791 - protein, 22 aa, Cryptosporidium parvum
KHSMRIPGLVLDSCPFQSSQGA

SEQ ID NO: 2352792 - protein, 20 aa, Cryptosporidium parvum
KHSSIIFLPAIEDLESAYIT

SEQ ID NO: 2352793 - protein, 20 aa, Cryptosporidium parvum
KHYLLPLILLYSDLKESEAE

SEQ ID NO: 2352794 - protein, 24 aa, Cryptosporidium parvum
KIDESRVPSFLLIETAHQIIHICE

SEQ ID NO: 2352795 - protein, 19 aa, Cryptosporidium parvum
KIGEYGIDAYRDYALDIFS

SEQ ID NO: 2352796 - protein, 23 aa, Cryptosporidium parvum
KILKHGCNVFINRQLIYNYPDQL

SEQ ID NO: 2352797 - protein, 18 aa, Cryptosporidium parvum
KINPRTNVMFNISSVQFL

SEQ ID NO: 2352798 - protein, 26 aa, Cryptosporidium parvum
KINQWTSIVRWEFKHPTPFIRTREFL

SEQ ID NO: 2352799 - protein, 18 aa, Cryptosporidium parvum
KIPFVAISGFVGDNMVER

SEQ ID NO: 2352800 - protein, 26 aa, Cryptosporidium parvum
KIQKSSFPHGSYRPSSSNISINNGIN

SEQ ID NO: 2352801 - protein, 25 aa, Cryptosporidium parvum
KIVQDACKVPCHLISSNAGFDGSVI

SEQ ID NO: 2352802 - protein, 19 aa, Cryptosporidium parvum
KKCIQSIKSIYLLKNGYSS

SEQ ID NO: 2352803 - protein, 22 aa, Cryptosporidium parvum
KKDEPVPWWLANVDKPNLVEVD

SEQ ID NO: 2352804 - protein, 23 aa, Cryptosporidium parvum
KKDVRLVIHLSMPKSLENYYQES

SEQ ID NO: 2352805 - protein, 21 aa, Cryptosporidium parvum
KKEGLFNFLFLFQKLNGRPTE

SEQ ID NO: 2352806 - protein, 27 aa, Cryptosporidium parvum
KKEKSTWSRIFSPLSFGFDKRELSYSG

SEQ ID NO: 2352807 - protein, 26 aa, Cryptosporidium parvum
KKESKLSRLSFRGDKESKGLDKINSM

SEQ ID NO: 2352808 - protein, 23 aa, Cryptosporidium parvum
KKGDPETCPAFLFVTPEKLKHSK

SEQ ID NO: 2352809 - protein, 18 aa, Cryptosporidium parvum
KKGVDIVVGCPGRVLDFI

SEQ ID NO: 2352810 - protein, 18 aa, Cryptosporidium parvum
KKLIEGFSDFSKIRNEQF

SEQ ID NO: 2352811 - protein, 17 aa, Cryptosporidium parvum
KKMGEGVIRSKLKRMVD

SEQ ID NO: 2352812 - protein, 36 aa, Cryptosporidium parvum; identical to SEQ ID NO: 2174902

SEQ ID NO: 2352813 - protein, 19 aa, Cryptosporidium parvum
KKNGVSWKNASFFKSISKD

SEQ ID NO: 2352814 - protein, 20 aa, Cryptosporidium parvum
KKNRLEVLKLRAAESNQRKI

SEQ ID NO: 2352815 - protein, 25 aa, Cryptosporidium parvum
KKPYDCSFVSREFRGIEKSRQLRES

SEQ ID NO: 2352816 - protein, 18 aa, Cryptosporidium parvum
KKRLIPIDQDELFVNVNA

SEQ ID NO: 2352817 - protein, 19 aa, Cryptosporidium parvum
KKSHSMGVTCIQKSNRNHQ

SEQ ID NO: 2352818 - protein, 26 aa, Cryptosporidium parvum
KKSNSLVGLYAEWVDKNTIWDVRKGP

SEQ ID NO: 2352819 - protein, 20 aa, Cryptosporidium parvum
KKSQRLSLDVNYSMKNSKPC

SEQ ID NO: 2352820 - protein, 18 aa, Cryptosporidium parvum
KKTNLSISLLDILFDHFK

SEQ ID NO: 2352821 - protein, 22 aa, Cryptosporidium parvum
KKYGKNCILNYWANAYKTNINN

SEQ ID NO: 2352822 - protein, 18 aa, Cryptosporidium parvum
KLDDGGYFTCEGRQLLTL

SEQ ID NO: 2352823 - protein, 27 aa, Cryptosporidium parvum
KLEASLLDIYSFISWYIYDYNNEITQK

SEQ ID NO: 2352824 - protein, 17 aa, Cryptosporidium parvum
KLFCLVENFIYLDMTQT

SEQ ID NO: 2352825 - protein, 18 aa, Cryptosporidium parvum
KLFNELALIWCILKTFAI

SEQ ID NO: 2352826 - protein, 17 aa, Cryptosporidium parvum
KLIESLAGLPIKEISCG

SEQ ID NO: 2352827 - protein, 22 aa, Cryptosporidium parvum
KLKLRRRGRRRRPGKLNISKQL

SEQ ID NO: 2352828 - protein, 17 aa, Cryptosporidium parvum
KLLGYKVDIGDLYEIQP

SEQ ID NO: 2352829 - protein, 19 aa, Cryptosporidium parvum
KLNKLSNEEYLVFCSIEDA

SEQ ID NO: 2352830 - protein, 22 aa, Cryptosporidium parvum
KLNLWWELMVYILRWSFELGPS

SEQ ID NO: 2352831 - protein, 23 aa, Cryptosporidium parvum
KLPLWHLFSSLCWQGYHNQQECC

SEQ ID NO: 2352832 - protein, 20 aa, Cryptosporidium parvum
KLQLLIGVSIRRIHEALEDL

SEQ ID NO: 2352833 - protein, 23 aa, Cryptosporidium parvum
KLRKEVYQGIRVMPFSQNMMYCQ

SEQ ID NO: 2352834 - protein, 20 aa, Cryptosporidium parvum
KLSESCLIIELFNSRQSNEN

SEQ ID NO: 2352835 - protein, 21 aa, Cryptosporidium parvum
KLSLKEGKWGHPERPLSDLGR

SEQ ID NO: 2352836 - protein, 24 aa, Cryptosporidium parvum
KLTECGCVFVFYVADWFALLNNKM

SEQ ID NO: 2352837 - protein, 38 aa, Cryptosporidium parvum
KLVCQDFINFILLWLRFGEIPLEGKISFCNLTQNDSKI

SEQ ID NO: 2352838 - protein, 24 aa, Cryptosporidium parvum
KLYQRNCMDYQYSKREGCIRERRG

SEQ ID NO: 2352839 - protein, 20 aa, Cryptosporidium parvum
KMFRLESSAESWVVKQKEQK

SEQ ID NO: 2352840 - protein, 21 aa, Cryptosporidium parvum
KMGVIPRMVHDVFETISNAEE

SEQ ID NO: 2352841 - protein, 25 aa, Cryptosporidium parvum
KMKEQRNVDPFSIFGDSCMFMDLED

SEQ ID NO: 2352842 - protein, 26 aa, Cryptosporidium parvum
KMKGNMIFMASLVRKKVIASTVVLMC

SEQ ID NO: 2352843 - protein, 22 aa, Cryptosporidium parvum
KMSGLFWGIGSMKLLFNNLQSE

SEQ ID NO: 2352844 - protein, 19 aa, Cryptosporidium parvum
KNCDVFFHKICYGISNHNA

SEQ ID NO: 2352845 - protein, 24 aa, Cryptosporidium parvum
KNCTHFRISCKLFEGKSDSNLVKK

SEQ ID NO: 2352846 - protein, 19 aa, Cryptosporidium parvum
KNDDFRGNVSIVPTSAVTG

SEQ ID NO: 2352847 - protein, 20 aa, Cryptosporidium parvum
KNDHIFSFDWFIKTRSSNDI

SEQ ID NO: 2352848 - protein, 20 aa, Cryptosporidium parvum
KNDPWMKIKCENEPNMADIQ

SEQ ID NO: 2352849 - protein, 23 aa, Cryptosporidium parvum
KNDRNIHRFKLLPPSNEVVNHLI

SEQ ID NO: 2352850 - protein, 22 aa, Cryptosporidium parvum
KNEMGFFSSLFFESDLLQYLFE

SEQ ID NO: 2352851 - protein, 17 aa, Cryptosporidium parvum
KNFPFRCHRVTSSSPDI

SEQ ID NO: 2352852 - protein, 17 aa, Cryptosporidium parvum
KNHFSIFSLFNKHKLQL

SEQ ID NO: 2352853 - protein, 18 aa, Cryptosporidium parvum
KNICERLSLGERCEKCGS

SEQ ID NO: 2352854 - protein, 25 aa, Cryptosporidium parvum
KNKESFCRYVSLVLEDDFFEKSILF

SEQ ID NO: 2352855 - protein, 17 aa, Cryptosporidium parvum
KNKLSRKKIQNIKKSSI

SEQ ID NO: 2352856 - protein, 23 aa, Cryptosporidium parvum
KNPQWFKLYIHYEPDSYKEINGF

SEQ ID NO: 2352857 - protein, 21 aa, Cryptosporidium parvum
KNRFRNLSTKHLIDSKENNEM

SEQ ID NO: 2352858 - protein, 19 aa, Cryptosporidium parvum
KNTLKRVEFLSVKDITEII

SEQ ID NO: 2352859 - protein, 21 aa, Cryptosporidium parvum
KNVSCVVNYDFPHSPSNYIHR

SEQ ID NO: 2352860 - protein, 19 aa, Cryptosporidium parvum
KNYSLICRKILEKFQSDLQ

SEQ ID NO: 2352861 - protein, 19 aa, Cryptosporidium parvum
KPEEPCWDSPWGKGRPGWH

SEQ ID NO: 2352862 - protein, 22 aa, Cryptosporidium parvum
KPGNLQRFLHLFIINQLFSENL

SEQ ID NO: 2352863 - protein, 22 aa, Cryptosporidium parvum
KPGNSMLPAGRFIVAKESKNKQ

SEQ ID NO: 2352864 - protein, 18 aa, Cryptosporidium parvum
KPPFKSHNDLSASQDSFF

SEQ ID NO: 2352865 - protein, 21 aa, Cryptosporidium parvum
KPQRIRMAHNLILSYDLYKHM

SEQ ID NO: 2352866 - protein, 21 aa, Cryptosporidium parvum
KQAKDLKEWIKAHSPNRDSNY

SEQ ID NO: 2352867 - protein, 29 aa, Cryptosporidium parvum
KQFIIALEEIISFQGLWKSICEIEGTENI

SEQ ID NO: 2352868 - protein, 20 aa, Cryptosporidium parvum
KQFKLTCAKSQTNFVGINLE

SEQ ID NO: 2352869 - protein, 23 aa, Cryptosporidium parvum
KQKVKKPESSICEHIESETLNSD

SEQ ID NO: 2352870 - protein, 22 aa, Cryptosporidium parvum
KQLNNCLSCLLRGFKCQDVLIR

SEQ ID NO: 2352871 - protein, 29 aa, Cryptosporidium parvum
KQMFYRDNVFFNFLLVKHFSFGENDKILK

SEQ ID NO: 2352872 - protein, 19 aa, Cryptosporidium parvum
KQVKDYIVKFNNRRETIER

SEQ ID NO: 2352873 - protein, 17 aa, Cryptosporidium parvum
KQWKVRRLIATLEAARG

SEQ ID NO: 2352874 - protein, 22 aa, Cryptosporidium parvum
KREVSAPIFGSSDMESKNPASD

SEQ ID NO: 2352875 - protein, 20 aa, Cryptosporidium parvum
KRGKRCLSIRFKKQKFFTKK

SEQ ID NO: 2352876 - protein, 17 aa, Cryptosporidium parvum
KRIEYEHEIDLIRNNFT

SEQ ID NO: 2352877 - protein, 23 aa, Cryptosporidium parvum
KRKDHKFTPGFLFVSMDVSRALV

SEQ ID NO: 2352878 - protein, 19 aa, Cryptosporidium parvum
KRKLGVWADNIEVQALSDL

SEQ ID NO: 2352879 - protein, 25 aa, Cryptosporidium parvum
KRKRQSNSFPGARKSSGGDLYKSLF

SEQ ID NO: 2352880 - protein, 18 aa, Cryptosporidium parvum
KRLFMHRSPLPSLEESAI

SEQ ID NO: 2352881 - protein, 20 aa, Cryptosporidium parvum
KRLLKLCSYSRVYSTQVPVV

SEQ ID NO: 2352882 - protein, 19 aa, Cryptosporidium parvum
KRNKRKCNIEHSGIKETHF

SEQ ID NO: 2352883 - protein, 23 aa, Cryptosporidium parvum
KRYILRYLIYDCICIERDDTVKS

SEQ ID NO: 2352884 - protein, 30 aa, Cryptosporidium parvum; identical to SEQ ID NO: 2297139

SEQ ID NO: 2352885 - protein, 23 aa, Cryptosporidium parvum
KSGHFLHVDFGYIFGEDPKPFPP

SEQ ID NO: 2352886 - protein, 18 aa, Cryptosporidium parvum
KSGILSMKIVEFGFQGTN

SEQ ID NO: 2352887 - protein, 18 aa, Cryptosporidium parvum
KSGKDIQKGIAFDSSSVR

SEQ ID NO: 2352888 - protein, 21 aa, Cryptosporidium parvum
KSHLDPYDWYYSSSNNENGDN

SEQ ID NO: 2352889 - protein, 17 aa, Cryptosporidium parvum
KSICGLSDHLHDVYCNN

SEQ ID NO: 2352890 - protein, 18 aa, Cryptosporidium parvum
KSIFDDFGLMRALSDGDI

SEQ ID NO: 2352891 - protein, 28 aa, Cryptosporidium parvum
KSILEYLDLFPCFVLAIFKSLVLLDQGE

SEQ ID NO: 2352892 - protein, 20 aa, Cryptosporidium parvum
KSLCIKFNLINSKKENIDDI

SEQ ID NO: 2352893 - protein, 27 aa, Cryptosporidium parvum
KSLEYMRFSTLFLKKLIIGPIQVKCND

SEQ ID NO: 2352894 - protein, 17 aa, Cryptosporidium parvum
KSLIDIYLLRSVANEKT

SEQ ID NO: 2352895 - protein, 18 aa, Cryptosporidium parvum
KSLRSALRGHIEYDKAEK

SEQ ID NO: 2352896 - protein, 18 aa, Cryptosporidium parvum
KSLRVRAGDFANIHVSKH

SEQ ID NO: 2352897 - protein, 18 aa, Cryptosporidium parvum
KSMGYGFLEFKTSENAKE

SEQ ID NO: 2352898 - protein, 25 aa, Cryptosporidium parvum
KSMLEKRIGPVFSRNINGEKSDGTY

SEQ ID NO: 2352899 - protein, 18 aa, Cryptosporidium parvum
KSNLRGCEGLIERIQCMT

SEQ ID NO: 2352900 - protein, 21 aa, Cryptosporidium parvum
KSNSYIKTWGKEKWTNDLIHK

SEQ ID NO: 2352901 - protein, 23 aa, Cryptosporidium parvum
KSQILRFVNEFSTRTVYTSGKSS

SEQ ID NO: 2352902 - protein, 18 aa, Cryptosporidium parvum
KSRRECLTERKVINQRHK

SEQ ID NO: 2352903 - protein, 18 aa, Cryptosporidium parvum
KSSAFKFTGAVVSGSHQQ

SEQ ID NO: 2352904 - protein, 26 aa, Cryptosporidium parvum
KSSELKTNLWLERSWIIHFSGSNRLE

SEQ ID NO: 2352905 - protein, 20 aa, Cryptosporidium parvum
KSSNLLAFICRNIMTNWLPL

SEQ ID NO: 2352906 - protein, 18 aa, Cryptosporidium parvum
KSVHFEGFGTFYMPPPTR

SEQ ID NO: 2352907 - protein, 20 aa, Cryptosporidium parvum
KSYFCLYFAKGACVNGSKCK

SEQ ID NO: 2352908 - protein, 21 aa, Cryptosporidium parvum
KSYRCICYISTPIYIHEYHEI

SEQ ID NO: 2352909 - protein, 25 aa, Cryptosporidium parvum
KSYRFAISGQGAWKYLDVLPDKGGK

SEQ ID NO: 2352910 - protein, 17 aa, Cryptosporidium parvum
KTAMHFFDIIKNKYALL

SEQ ID NO: 2352911 - protein, 24 aa, Cryptosporidium parvum
KTDSKLLSLCWMNEHTIYTGGSTG

SEQ ID NO: 2352912 - protein, 18 aa, Cryptosporidium parvum
KTIWKLKLTIHKLNSTWI

SEQ ID NO: 2352913 - protein, 20 aa, Cryptosporidium parvum
KTKLLYLAIYEYLVVYSTLE

SEQ ID NO: 2352914 - protein, 24 aa, Cryptosporidium parvum
KTKNWLKCDWNRWIDTDEEENPSS

SEQ ID NO: 2352915 - protein, 21 aa, Cryptosporidium parvum
KTLATSFSWKSLYQADTTFTY

SEQ ID NO: 2352916 - protein, 29 aa, Cryptosporidium parvum
KTLSPNGVFWLARRLFRKPVNTLLPGTYL

SEQ ID NO: 2352917 - protein, 24 aa, Cryptosporidium parvum
KTNGEIVFSLVFPKSKSFYDRRVV

SEQ ID NO: 2352918 - protein, 20 aa, Cryptosporidium parvum
KTNHTCFIAFNRAYCIDTEI

SEQ ID NO: 2352919 - protein, 19 aa, Cryptosporidium parvum
KTRECLEILYNDLNQDLLV

SEQ ID NO: 2352920 - protein, 27 aa, Cryptosporidium parvum
KTVVSKPGWGAVRWADLSISDASNSWI

SEQ ID NO: 2352921 - protein, 26 aa, Cryptosporidium parvum
KVALGRACGVSRPVIAAAITSKDGSS

SEQ ID NO: 2352922 - protein, 22 aa, Cryptosporidium parvum
KVDSSLLAFGIRSDKPRNLNYD

SEQ ID NO: 2352923 - protein, 21 aa, Cryptosporidium parvum
KVDSWSVGILIYELYMGNVPF

SEQ ID NO: 2352924 - protein, 21 aa, Cryptosporidium parvum
KVKEGRNLICTEGNSEEEKVI

SEQ ID NO: 2352925 - protein, 29 aa, Cryptosporidium parvum
KVKQRSALFKALILYSLKNKEYMNGESAK

SEQ ID NO: 2352926 - protein, 24 aa, Cryptosporidium parvum
KVLCGIYGPNLCKQNPIEDGLSVS

SEQ ID NO: 2352927 - protein, 18 aa, Cryptosporidium parvum
KVLECKRKLLKSEFWGTI

SEQ ID NO: 2352928 - protein, 28 aa, Cryptosporidium parvum
KVLQHAFKERLKIILVLNKMDRLILELG

SEQ ID NO: 2352929 - protein, 20 aa, Cryptosporidium parvum
KVMFTSRCYSTWKTENIVDI

SEQ ID NO: 2352930 - protein, 18 aa, Cryptosporidium parvum
KVNLGGFTEADWYKKIPN

SEQ ID NO: 2352931 - protein, 18 aa, Cryptosporidium parvum
KVPFPILILHGTNDQVIH

SEQ ID NO: 2352932 - protein, 32 aa, Cryptosporidium parvum; identical to SEQ ID NO: 2297436

SEQ ID NO: 2352933 - protein, 17 aa, Cryptosporidium parvum
KWGHPERPLSDLGRAIY

SEQ ID NO: 2352934 - protein, 26 aa, Cryptosporidium parvum
KYADIPERLYLLYGSRWKSLKERKIS

SEQ ID NO: 2352935 - protein, 17 aa, Cryptosporidium parvum
KYDWKYLEEQFRSIRQD

SEQ ID NO: 2352936 - protein, 24 aa, Cryptosporidium parvum
KYLECSGALEMLYRSFLSLYISIE

SEQ ID NO: 2352937 - protein, 19 aa, Cryptosporidium parvum
KYQHRVCYVDIDIHHGDGV

SEQ ID NO: 2352938 - protein, 23 aa, Cryptosporidium parvum
KYSLNILRHVFRALRRIVSDDFV

SEQ ID NO: 2352939 - protein, 23 aa, Cryptosporidium parvum
KYVKTPYPHVYKPDSYLKNEISI

SEQ ID NO: 2352940 - protein, 21 aa, Cryptosporidium parvum
KYVVECFRLPIKKESGHISSD

SEQ ID NO: 2352941 - protein, 17 aa, Cryptosporidium parvum
KYYRGMGSVGAMKSGSG

SEQ ID NO: 2352942 - protein, 17 aa, Cryptosporidium parvum
LADCFMMLRMPYESEGA

SEQ ID NO: 2352943 - protein, 17 aa, Cryptosporidium parvum
LADTILVQKALLKDLVF

SEQ ID NO: 2352944 - protein, 18 aa, Cryptosporidium parvum
LAEDCLRVSSISPASIRG

SEQ ID NO: 2352945 - protein, 20 aa, Cryptosporidium parvum
LAENIPPNYSELVKETMKVL

SEQ ID NO: 2352946 - protein, 26 aa, Cryptosporidium parvum
LAFSAILCAGIDGILHKIHPAAYLNT

SEQ ID NO: 2352947 - protein, 17 aa, Cryptosporidium parvum
LALELLKLLSNKYREEF

SEQ ID NO: 2352948 - protein, 19 aa, Cryptosporidium parvum
LAQCANIVAACKLMSQSEF

SEQ ID NO: 2352949 - protein, 24 aa, Cryptosporidium parvum
LAVEGYGLLKLMGINGIIGTTTVS

SEQ ID NO: 2352950 - protein, 18 aa, Cryptosporidium parvum
LCDSKYSIGKKIFPENSD

SEQ ID NO: 2352951 - protein, 19 aa, Cryptosporidium parvum
LCELLDYEQAVFPHLNYSK

SEQ ID NO: 2352952 - protein, 32 aa, Cryptosporidium parvum; identical to SEQ ID NO: 2297581

SEQ ID NO: 2352953 - protein, 22 aa, Cryptosporidium parvum
LCFELKSLFIAPTREICIQINK

SEQ ID NO: 2352954 - protein, 19 aa, Cryptosporidium parvum
LCGEFDFDITHWNVEPYPN

SEQ ID NO: 2352955 - protein, 17 aa, Cryptosporidium parvum
LCLDLLFESSFFLCKIN

SEQ ID NO: 2352956 - protein, 23 aa, Cryptosporidium parvum
LCNHYFCEKCAFSHYTNTSKCFQ

SEQ ID NO: 2352957 - protein, 24 aa, Cryptosporidium parvum
LCQIQFRATLLWIHRISVEDCKRE

SEQ ID NO: 2352958 - protein, 19 aa, Cryptosporidium parvum
LCSLTELGHEKQNFFFYDD

SEQ ID NO: 2352959 - protein, 20 aa, Cryptosporidium parvum
LCTPLHFSASNGFDEIVNKL

SEQ ID NO: 2352960 - protein, 23 aa, Cryptosporidium parvum
LCVKSLNKRNSFKMSNSKLTKNP

SEQ ID NO: 2352961 - protein, 20 aa, Cryptosporidium parvum
LDAPCTGLGIIARDPSVKVK

SEQ ID NO: 2352962 - protein, 17 aa, Cryptosporidium parvum
LDDFTSRIFLKGNFVKF

SEQ ID NO: 2352963 - protein, 18 aa, Cryptosporidium parvum
LDDLDIVFISKFSACDLT

SEQ ID NO: 2352964 - protein, 34 aa, Cryptosporidium parvum; identical to SEQ ID NO: 2175814

SEQ ID NO: 2352965 - protein, 17 aa, Cryptosporidium parvum
LDEFPKLQSVSFDNLFK

SEQ ID NO: 2352966 - protein, 21 aa, Cryptosporidium parvum
LDERLLRIEQLEMNYQNVNLE

SEQ ID NO: 2352967 - protein, 23 aa, Cryptosporidium parvum
LDFSYLNIRWRRKMGEKLIDIQG

SEQ ID NO: 2352968 - protein, 19 aa, Cryptosporidium parvum
LDHDLGRIVKVMAKGKHNK

SEQ ID NO: 2352969 - protein, 19 aa, Cryptosporidium parvum
LDINYGYIKPIRYLNDGLP

SEQ ID NO: 2352970 - protein, 18 aa, Cryptosporidium parvum
LDIPLVWRDKSFGHKNNH

SEQ ID NO: 2352971 - protein, 28 aa, Cryptosporidium parvum
LDKDLLSSCFAFHFSLMKTRKIFYDLLQ

SEQ ID NO: 2352972 - protein, 19 aa, Cryptosporidium parvum
LDKIYTFTGPILIAVNPYR

SEQ ID NO: 2352973 - protein, 29 aa, Cryptosporidium parvum
LDKYFRFTLGNLYAHKLFWGNNIPISCMI

SEQ ID NO: 2352974 - protein, 29 aa, Cryptosporidium parvum
LDLLFESSFFLCKINHTILNNLLIYENDH

SEQ ID NO: 2352975 - protein, 17 aa, Cryptosporidium parvum
LDLNRLVGFNQIIINVV

SEQ ID NO: 2352976 - protein, 17 aa, Cryptosporidium parvum
LDLRGCKNILNIELEHF

SEQ ID NO: 2352977 - protein, 17 aa, Cryptosporidium parvum
LDPALLRPGRLDRKVEF

SEQ ID NO: 2352978 - protein, 24 aa, Cryptosporidium parvum
LDPHLVKHLSVFGINVGQLEKTEK

SEQ ID NO: 2352979 - protein, 20 aa, Cryptosporidium parvum
LDPNELLNVFQWKKLKDPET

SEQ ID NO: 2352980 - protein, 17 aa, Cryptosporidium parvum
LDSKMAFFQSIINPLLH

SEQ ID NO: 2352981 - protein, 23 aa, Cryptosporidium parvum
LDSLATKNYAGWGYGIRYTYGIF

SEQ ID NO: 2352982 - protein, 22 aa, Cryptosporidium parvum
LDSTTAASCLGKFYESKYLGSS

SEQ ID NO: 2352983 - protein, 17 aa, Cryptosporidium parvum
LDVGFLTDASKFVAGSV

SEQ ID NO: 2352984 - protein, 21 aa, Cryptosporidium parvum
LDVIEILPLTEWLVNTYQNYG

SEQ ID NO: 2352985 - protein, 26 aa, Cryptosporidium parvum
LDVLRMLKCEFEVFGKVQGVSFRKYT

SEQ ID NO: 2352986 - protein, 17 aa, Cryptosporidium parvum
LEAKLQLLIGVSIRRIH

SEQ ID NO: 2352987 - protein, 17 aa, Cryptosporidium parvum
LEASRYIHRVGRTARIG

SEQ ID NO: 2352988 - protein, 18 aa, Cryptosporidium parvum
LEDIQVLDLWKLSILIGG

SEQ ID NO: 2352989 - protein, 24 aa, Cryptosporidium parvum
LEDLKWDINQGLQVDHVRANSQSI

SEQ ID NO: 2352990 - protein, 18 aa, Cryptosporidium parvum
LEEISAYSYDPVKNITII

SEQ ID NO: 2352991 - protein, 24 aa, Cryptosporidium parvum
LEEKAKNYFIMFSKERKEREKLER

SEQ ID NO: 2352992 - protein, 32 aa, Cryptosporidium parvum
LEGKIGKPEIEWKPANLSGELVLPLVYQTYVT

SEQ ID NO: 2352993 - protein, 26 aa, Cryptosporidium parvum
LEGLTKLKPCYLCYSSSTISNQMIGI

SEQ ID NO: 2352994 - protein, 17 aa, Cryptosporidium parvum
LEHANGFMFSMVVSYTW

SEQ ID NO: 2352995 - protein, 17 aa, Cryptosporidium parvum
LEIDYGILSACDVVLNH

SEQ ID NO: 2352996 - protein, 17 aa, Cryptosporidium parvum
LEIGSKIWIGTVEASYL

SEQ ID NO: 2352997 - protein, 20 aa, Cryptosporidium parvum
LEIIDLILCQIQFRATLLWI

SEQ ID NO: 2352998 - protein, 20 aa, Cryptosporidium parvum
LEIPIFLQLLNFCVYSVMDS

SEQ ID NO: 2352999 - protein, 39 aa, Cryptosporidium parvum
LELDYELICIDFFLRYISNLYPLWGEYGDNLMFHIAQIY

SEQ ID NO: 2353000 - protein, 17 aa, Cryptosporidium parvum
LELELGMEFEQASSQGY

SEQ ID NO: 2353001 - protein, 24 aa, Cryptosporidium parvum
LELFPEVINDYFVNYKMNKIMEDV

SEQ ID NO: 2353002 - protein, 22 aa, Cryptosporidium parvum
LELLKCELDDFGFKNNLLAQIF

SEQ ID NO: 2353003 - protein, 17 aa, Cryptosporidium parvum
LELLRLLINTIKNDLNN

SEQ ID NO: 2353004 - protein, 18 aa, Cryptosporidium parvum
LELMPIVEYCGEWGYNPR

SEQ ID NO: 2353005 - protein, 18 aa, Cryptosporidium parvum
LELSTSITSYGRAMIDIT

SEQ ID NO: 2353006 - protein, 22 aa, Cryptosporidium parvum
LEMGAIELLIVWENLETKRMVV

SEQ ID NO: 2353007 - protein, 24 aa, Cryptosporidium parvum
LENCDFGDWQKLRIQEHATEIPPG

SEQ ID NO: 2353008 - protein, 19 aa, Cryptosporidium parvum
LENDGLRVRCFRLEQRVKE

SEQ ID NO: 2353009 - protein, 20 aa, Cryptosporidium parvum
LENMKPPPLIILPVYSSQPS

SEQ ID NO: 2353010 - protein, 18 aa, Cryptosporidium parvum
LERAKLFQLNDFFFFTRL

SEQ ID NO: 2353011 - protein, 19 aa, Cryptosporidium parvum
LERHSKFALEKVTALKKTI

SEQ ID NO: 2353012 - protein, 23 aa, Cryptosporidium parvum
LESRAERSLKEIITDTLGKSSKL

SEQ ID NO: 2353013 - protein, 25 aa, Cryptosporidium parvum
LETDCRFSYCALSSLTILNRINEID

SEQ ID NO: 2353014 - protein, 33 aa, Cryptosporidium parvum; identical to SEQ ID NO: 2176034

SEQ ID NO: 2353015 - protein, 18 aa, Cryptosporidium parvum
LFCRRGVEVTVISQGEFF

SEQ ID NO: 2353016 - protein, 20 aa, Cryptosporidium parvum
LFEEKCLWEDAPIFESTSGA

SEQ ID NO: 2353017 - protein, 18 aa, Cryptosporidium parvum
LFETIALNSVNNFSTNQI

SEQ ID NO: 2353018 - protein, 24 aa, Cryptosporidium parvum
LFIEWSIGCEIFRKIWGPDEKPIL

SEQ ID NO: 2353019 - protein, 18 aa, Cryptosporidium parvum
LFIVTSLGTWGEIPPLLA

SEQ ID NO: 2353020 - protein, 23 aa, Cryptosporidium parvum
LFKNSLFSLQLVFQVLIKQAYRN

SEQ ID NO: 2353021 - protein, 27 aa, Cryptosporidium parvum
LFKTSLCVYWIKGSCVVGDSCRYAHGI

SEQ ID NO: 2353022 - protein, 19 aa, Cryptosporidium parvum
LFQSGSCWHVDNILGSHII

SEQ ID NO: 2353023 - protein, 18 aa, Cryptosporidium parvum
LFSFPLLSSACIRHIKDN

SEQ ID NO: 2353024 - protein, 42 aa, Cryptosporidium parvum; identical to SEQ ID NO: 2176114

SEQ ID NO: 2353025 - protein, 17 aa, Cryptosporidium parvum
LFTHNPLSLAISNLLKS

SEQ ID NO: 2353026 - protein, 22 aa, Cryptosporidium parvum
LFTKQIRCCKASNDRKPLDIGA

SEQ ID NO: 2353027 - protein, 24 aa, Cryptosporidium parvum
LFTVFKRLLLYDSKAVRKCAVKVI

SEQ ID NO: 2353028 - protein, 25 aa, Cryptosporidium parvum
LGGNSRTIIICNCSPDRVNYYETLS

SEQ ID NO: 2353029 - protein, 23 aa, Cryptosporidium parvum
LGHPLEGIMVVELIIIAKCCGLT

SEQ ID NO: 2353030 - protein, 19 aa, Cryptosporidium parvum
LGNCLSAILILSGKEEIDG

SEQ ID NO: 2353031 - protein, 17 aa, Cryptosporidium parvum
LGRYIKFSRRISQSKWG

SEQ ID NO: 2353032 - protein, 18 aa, Cryptosporidium parvum
LGSLWCLDNVPGSSLHAF

SEQ ID NO: 2353033 - protein, 17 aa, Cryptosporidium parvum
LGVRDLAYRLCFLACHI

SEQ ID NO: 2353034 - protein, 20 aa, Cryptosporidium parvum
LGYQYAINWAGGLHHGKKHE

SEQ ID NO: 2353035 - protein, 20 aa, Cryptosporidium parvum
LHIMSHPWLLAINNLTNIDI

SEQ ID NO: 2353036 - protein, 22 aa, Cryptosporidium parvum
LHLEYKKVFKLFVIGDLGKEES

SEQ ID NO: 2353037 - protein, 25 aa, Cryptosporidium parvum
LHVKIPGVLVNMWCTLRDLVNEGII

SEQ ID NO: 2353038 - protein, 24 aa, Cryptosporidium parvum
LIAILRSSQLVEILENMLRDYFQL

SEQ ID NO: 2353039 - protein, 20 aa, Cryptosporidium parvum
LICQYISFLSKYALDLVPGI

SEQ ID NO: 2353040 - protein, 24 aa, Cryptosporidium parvum
LIDYRNKYKIAICEGDLNTDITDK

SEQ ID NO: 2353041 - protein, 18 aa, Cryptosporidium parvum
LIEEYIRCNNSCPITKSE

SEQ ID NO: 2353042 - protein, 20 aa, Cryptosporidium parvum
LIEGYSVPFPYDAYKCQINY

SEQ ID NO: 2353043 - protein, 24 aa, Cryptosporidium parvum
LIEILKRDIDIFLKSGDVLLNLIE

SEQ ID NO: 2353044 - protein, 17 aa, Cryptosporidium parvum
LIEYYSALHESRKALQK

SEQ ID NO: 2353045 - protein, 18 aa, Cryptosporidium parvum
LIKCSDPNSYIEIYISCS

SEQ ID NO: 2353046 - protein, 30 aa, Cryptosporidium parvum; identical to SEQ ID NO: 2298151

SEQ ID NO: 2353047 - protein, 22 aa, Cryptosporidium parvum
LINSGIPCFRGETIKKLKERLL

SEQ ID NO: 2353048 - protein, 21 aa, Cryptosporidium parvum
LIPFEMLKWMEFLIRMTRELV

SEQ ID NO: 2353049 - protein, 21 aa, Cryptosporidium parvum
LIPPRMSPLLRSQRQRLKQIL

SEQ ID NO: 2353050 - protein, 23 aa, Cryptosporidium parvum
LIQAFAGICSYITFNEPTDRREI

SEQ ID NO: 2353051 - protein, 23 aa, Cryptosporidium parvum
LIQGGLLPGLGIPMTQPGVPGVP

SEQ ID NO: 2353052 - protein, 28 aa, Cryptosporidium parvum
LIRFTKMYYPHYICVGISDRKSLELAGL

SEQ ID NO: 2353053 - protein, 19 aa, Cryptosporidium parvum
LIRMTRELVPSSLLVHQKI

SEQ ID NO: 2353054 - protein, 24 aa, Cryptosporidium parvum
LIRNIKQNFIWESIEVTWKQEESN

SEQ ID NO: 2353055 - protein, 28 aa, Cryptosporidium parvum
LISKSQCVFFLSASYTGMFPRFEHSTEL

SEQ ID NO: 2353056 - protein, 27 aa, Cryptosporidium parvum
LISRLKIIRDYFICFNGDFSDLLIKNM

SEQ ID NO: 2353057 - protein, 23 aa, Cryptosporidium parvum
LISRPLPLSHEWIVWEQLNVETR

SEQ ID NO: 2353058 - protein, 26 aa, Cryptosporidium parvum
LITMKSSAVSLKFKYEEEIKLEVEDG

SEQ ID NO: 2353059 - protein, 17 aa, Cryptosporidium parvum
LIVSQCPGVVRLHKIVV

SEQ ID NO: 2353060 - protein, 23 aa, Cryptosporidium parvum
LKAVANMCLYTPNIAVFASSHIE

SEQ ID NO: 2353061 - protein, 23 aa, Cryptosporidium parvum
LKDERLQDILDLYSPGNLRGEAK

SEQ ID NO: 2353062 - protein, 19 aa, Cryptosporidium parvum
LKEKVGMKINCDRNLSNVI

SEQ ID NO: 2353063 - protein, 25 aa, Cryptosporidium parvum
LKETCIKRPKFRLIVTSATLEADKF

SEQ ID NO: 2353064 - protein, 24 aa, Cryptosporidium parvum
LKHARSKSVASFIGIDMTGPSSYI

SEQ ID NO: 2353065 - protein, 21 aa, Cryptosporidium parvum
LKHDEKPIWSFFIGSQDISIE

SEQ ID NO: 2353066 - protein, 17 aa, Cryptosporidium parvum
LKILDIRSPNLPLQAAK

SEQ ID NO: 2353067 - protein, 32 aa, Cryptosporidium parvum; identical to SEQ ID NO: 2176381

SEQ ID NO: 2353068 - protein, 17 aa, Cryptosporidium parvum
LKKHVFLLLKLKIDKKN

SEQ ID NO: 2353069 - protein, 20 aa, Cryptosporidium parvum
LKKKETILITGINKKFVLED

SEQ ID NO: 2353070 - protein, 21 aa, Cryptosporidium parvum
LKKVRSFCGWRQDTFPGSQPV

SEQ ID NO: 2353071 - protein, 17 aa, Cryptosporidium parvum
LKLDHCVLNGPENHSSI

SEQ ID NO: 2353072 - protein, 17 aa, Cryptosporidium parvum
LKLELLDDFELEKIIHE

SEQ ID NO: 2353073 - protein, 24 aa, Cryptosporidium parvum
LKLLSPKSHLFCLVHKMDKLSAIE

SEQ ID NO: 2353074 - protein, 20 aa, Cryptosporidium parvum
LKLQKKLLFFVTGSDRVPMK

SEQ ID NO: 2353075 - protein, 23 aa, Cryptosporidium parvum
LKMYRKDMVVNHNHIWNERNVLE

SEQ ID NO: 2353076 - protein, 18 aa, Cryptosporidium parvum
LKNDLKLIQIFERETKSM

SEQ ID NO: 2353077 - protein, 20 aa, Cryptosporidium parvum
LKNRIVIELPCRGKSWNNPN

SEQ ID NO: 2353078 - protein, 22 aa, Cryptosporidium parvum
LKPHPDGLILGGIVPNGNIVDI

SEQ ID NO: 2353079 - protein, 17 aa, Cryptosporidium parvum
LKPKPKFLAPPKNPPKV

SEQ ID NO: 2353080 - protein, 20 aa, Cryptosporidium parvum
LKRKEHPICYDGFEPSGRMH

SEQ ID NO: 2353081 - protein, 20 aa, Cryptosporidium parvum
LKSKCRQVDLAVSRQVEIEI

SEQ ID NO: 2353082 - protein, 21 aa, Cryptosporidium parvum
LKTGLIRFPVEIIKDEFESLI

SEQ ID NO: 2353083 - protein, 17 aa, Cryptosporidium parvum
LKTSSKNWFCFQCLSLT

SEQ ID NO: 2353084 - protein, 17 aa, Cryptosporidium parvum
LKVVCLQTYGLLGLYST

SEQ ID NO: 2353085 - protein, 20 aa, Cryptosporidium parvum
LKYNGFYILYAKSNKPDSQW

SEQ ID NO: 2353086 - protein, 24 aa, Cryptosporidium parvum
LKYWRQILDGIIVRHRRITRSPKS

SEQ ID NO: 2353087 - protein, 30 aa, Cryptosporidium parvum; identical to SEQ ID NO: 2176511

SEQ ID NO: 2353088 - protein, 19 aa, Cryptosporidium parvum
LLCPLCMTPQCFGRGNSPP

SEQ ID NO: 2353089 - protein, 24 aa, Cryptosporidium parvum
LLDKCGFTGAPYMDRIRTLKTLFG

SEQ ID NO: 2353090 - protein, 18 aa, Cryptosporidium parvum
LLEEAMILHKLRHPNIVS

SEQ ID NO: 2353091 - protein, 19 aa, Cryptosporidium parvum
LLEEFPKLHDLFQAVMSYP

SEQ ID NO: 2353092 - protein, 24 aa, Cryptosporidium parvum
LLEISYKLLNEWNANSSIITYKVT

SEQ ID NO: 2353093 - protein, 20 aa, Cryptosporidium parvum
LLEYRICGVKLYQNPPYTSH

SEQ ID NO: 2353094 - protein, 39 aa, Cryptosporidium parvum; identical to SEQ ID NO: 2298494

SEQ ID NO: 2353095 - protein, 18 aa, Cryptosporidium parvum
LLLFDLAINMYQKYTHLS

SEQ ID NO: 2353096 - protein, 24 aa, Cryptosporidium parvum
LLMRVSCGIHCGDIEAALETYELL

SEQ ID NO: 2353097 - protein, 18 aa, Cryptosporidium parvum
LLNDEIWELNRIIKSNNN

SEQ ID NO: 2353098 - protein, 25 aa, Cryptosporidium parvum
LLQNTSTCFQEYLSDLLSITEKSKL

SEQ ID NO: 2353099 - protein, 22 aa, Cryptosporidium parvum
LLSECSCINIFAFGSSGTGKTF

SEQ ID NO: 2353100 - protein, 18 aa, Cryptosporidium parvum
LLSILDKFIETFTLLHGE

SEQ ID NO: 2353101 - protein, 17 aa, Cryptosporidium parvum
LLVAYREKSVRIFGDGL

SEQ ID NO: 2353102 - protein, 24 aa, Cryptosporidium parvum
LLVHYAHSCLIPFEELAMSKDINI

SEQ ID NO: 2353103 - protein, 17 aa, Cryptosporidium parvum
LLYSCINHLITLQNLNR

SEQ ID NO: 2353104 - protein, 22 aa, Cryptosporidium parvum
LMVYILRWSFELGPSKSRSLLI

SEQ ID NO: 2353105 - protein, 18 aa, Cryptosporidium parvum
LNAAPNCCGSNYNYFIDR

SEQ ID NO: 2353106 - protein, 18 aa, Cryptosporidium parvum
LNATKCAIEQGIVPGGGS

SEQ ID NO: 2353107 - protein, 17 aa, Cryptosporidium parvum
LNDSFVKLISWYDNESG

SEQ ID NO: 2353108 - protein, 21 aa, Cryptosporidium parvum
LNEGKNYVCGSTRSVFEPINE

SEQ ID NO: 2353109 - protein, 30 aa, Cryptosporidium parvum; identical to SEQ ID NO: 2176696

SEQ ID NO: 2353110 - protein, 17 aa, Cryptosporidium parvum
LNFPTDRIFLLGQSIGS

SEQ ID NO: 2353111 - protein, 19 aa, Cryptosporidium parvum
LNGVTGCTILQDFMEREEK

SEQ ID NO: 2353112 - protein, 20 aa, Cryptosporidium parvum
LNILELLSMDIEEQVKYKDK

SEQ ID NO: 2353113 - protein, 17 aa, Cryptosporidium parvum
LNNSMANLAGRMKKGGK

SEQ ID NO: 2353114 - protein, 17 aa, Cryptosporidium parvum
LNPAYTSLRKSARLAQI

SEQ ID NO: 2353115 - protein, 26 aa, Cryptosporidium parvum
LNPVKIPVCDPLAWGETLGCTSAIID

SEQ ID NO: 2353116 - protein, 20 aa, Cryptosporidium parvum
LNSDQEMCFSLKNCLRNLLL

SEQ ID NO: 2353117 - protein, 19 aa, Cryptosporidium parvum
LNSRLHAMQILKFEHPADC

SEQ ID NO: 2353118 - protein, 26 aa, Cryptosporidium parvum
LNSSECLYLNFDSPWSSSKPAQPESE

SEQ ID NO: 2353119 - protein, 30 aa, Cryptosporidium parvum; identical to SEQ ID NO: 2298776

SEQ ID NO: 2353120 - protein, 26 aa, Cryptosporidium parvum
LNTSIRLWWKRIFKGSIETDISKFNR

SEQ ID NO: 2353121 - protein, 30 aa, Cryptosporidium parvum; identical to SEQ ID NO: 2298794

SEQ ID NO: 2353122 - protein, 17 aa, Cryptosporidium parvum
LPDACLAISQVKNGYDY

SEQ ID NO: 2353123 - protein, 18 aa, Cryptosporidium parvum
LPDVMSIRLDRKLSAKKT

SEQ ID NO: 2353124 - protein, 17 aa, Cryptosporidium parvum
LPFPNYGTFLGKETAEY

SEQ ID NO: 2353125 - protein, 19 aa, Cryptosporidium parvum
LPGITSICWGGDRNNTLIA

SEQ ID NO: 2353126 - protein, 17 aa, Cryptosporidium parvum
LPGLLKYNNPASVTVVI

SEQ ID NO: 2353127 - protein, 17 aa, Cryptosporidium parvum
LPIGMALFEDHTESLAT

SEQ ID NO: 2353128 - protein, 21 aa, Cryptosporidium parvum
LPIRKGDEVMVIRGSNHDYEG

SEQ ID NO: 2353129 - protein, 25 aa, Cryptosporidium parvum
LPKHHVLKSLPLFDLDPNIFGIACG

SEQ ID NO: 2353130 - protein, 18 aa, Cryptosporidium parvum
LPLKTVVIIWDYLLANGL

SEQ ID NO: 2353131 - protein, 21 aa, Cryptosporidium parvum
LPNCGAVNFSSLCNYTNVYIF

SEQ ID NO: 2353132 - protein, 26 aa, Cryptosporidium parvum
LPPKSPGLIPRFTIDMWDSSITSGPI

SEQ ID NO: 2353133 - protein, 17 aa, Cryptosporidium parvum
LPPRAIPPINLSQSLMT

SEQ ID NO: 2353134 - protein, 21 aa, Cryptosporidium parvum
LPQKPCRCILLSNILTVEELL

SEQ ID NO: 2353135 - protein, 18 aa, Cryptosporidium parvum
LPSAIPGQVDTSTPQANP

SEQ ID NO: 2353136 - protein, 17 aa, Cryptosporidium parvum
LPSRKNSFFGINRTAER

SEQ ID NO: 2353137 - protein, 21 aa, Cryptosporidium parvum
LPYLQHSMIAFANRIPYQTTP

SEQ ID NO: 2353138 - protein, 17 aa, Cryptosporidium parvum
LQACQQLGFNDIVDQYT

SEQ ID NO: 2353139 - protein, 23 aa, Cryptosporidium parvum
LQFDGAYIYNCLKFFREKWSSSI

SEQ ID NO: 2353140 - protein, 25 aa, Cryptosporidium parvum
LQGKGLIPVCVFDGATLPMKRVTEE

SEQ ID NO: 2353141 - protein, 19 aa, Cryptosporidium parvum
LQIPGLLFIDTPGHESFNN

SEQ ID NO: 2353142 - protein, 24 aa, Cryptosporidium parvum
LQKICSPFGRINRLCLSPSKTIAI

SEQ ID NO: 2353143 - protein, 27 aa, Cryptosporidium parvum
LQLAKDLKHIFGFGNPKIFSLNTCPVP

SEQ ID NO: 2353144 - protein, 19 aa, Cryptosporidium parvum
LQLNLKVCAVKAPGFGDHR

SEQ ID NO: 2353145 - protein, 19 aa, Cryptosporidium parvum
LQLPNLVPTCRSMIENGNL

SEQ ID NO: 2353146 - protein, 19 aa, Cryptosporidium parvum
LQLVFQVLIKQAYRNSLLY

SEQ ID NO: 2353147 - protein, 27 aa, Cryptosporidium parvum
LQNSLRELWSLLNFLYPEIFSSSEEFE

SEQ ID NO: 2353148 - protein, 27 aa, Cryptosporidium parvum
LQQRIRGGAVPPVLRPGAIPPGPPGVH

SEQ ID NO: 2353149 - protein, 25 aa, Cryptosporidium parvum
LQRSCKRLMTHINIRETEFGNKLLD

SEQ ID NO: 2353150 - protein, 17 aa, Cryptosporidium parvum
LQSGIILADEEDFKTSF

SEQ ID NO: 2353151 - protein, 18 aa, Cryptosporidium parvum
LQSLKYMLLSKIMSQQTN

SEQ ID NO: 2353152 - protein, 17 aa, Cryptosporidium parvum
LQVPPILGQNANLIAQM

SEQ ID NO: 2353153 - protein, 25 aa, Cryptosporidium parvum
LQVYRFGETVSIPFFDGSWQPSSFY

SEQ ID NO: 2353154 - protein, 33 aa, Cryptosporidium parvum
LQYLFELSIICLQNCKFYKLLKSHQKYFHYHKF

SEQ ID NO: 2353155 - protein, 19 aa, Cryptosporidium parvum
LRALSPGDKDIWLESICMV

SEQ ID NO: 2353156 - protein, 26 aa, Cryptosporidium parvum
LRCPHPRPKLGMEIGNWDTPEYEPHP

SEQ ID NO: 2353157 - protein, 20 aa, Cryptosporidium parvum
LRFAMGHSIQGVWKDGVLSQ

SEQ ID NO: 2353158 - protein, 17 aa, Cryptosporidium parvum
LRFLIWHIISEKEEAEK

SEQ ID NO: 2353159 - protein, 22 aa, Cryptosporidium parvum
LRFNGNCKLLLEYIPFSEPEDI

SEQ ID NO: 2353160 - protein, 22 aa, Cryptosporidium parvum
LRGKVVSSFSFFPPKLSGLVLR

SEQ ID NO: 2353161 - protein, 19 aa, Cryptosporidium parvum
LRGVLDSMLLSEKKEGNSN

SEQ ID NO: 2353162 - protein, 20 aa, Cryptosporidium parvum
LRKYKEWYNDVVVVCNFSSR

SEQ ID NO: 2353163 - protein, 20 aa, Cryptosporidium parvum
LRLAPGGTFGRLTIFTKGAI

SEQ ID NO: 2353164 - protein, 27 aa, Cryptosporidium parvum
LRLNSLYGSIYYFKLGIIKDLPPPIQP

SEQ ID NO: 2353165 - protein, 31 aa, Cryptosporidium parvum; identical to SEQ ID NO: 2299067

SEQ ID NO: 2353166 - protein, 21 aa, Cryptosporidium parvum
LRNVPKCWTYETSLIVDTYID

SEQ ID NO: 2353167 - protein, 33 aa, Cryptosporidium parvum; identical to SEQ ID NO: 2177058

SEQ ID NO: 2353168 - protein, 25 aa, Cryptosporidium parvum
LRPQLRVLKISLKKSLFNEVSKLVL

SEQ ID NO: 2353169 - protein, 25 aa, Cryptosporidium parvum
LRQLRCAGMLESIRIRRSGYSILYP

SEQ ID NO: 2353170 - protein, 23 aa, Cryptosporidium parvum
LRQYKMRMNLYIDKSNEVYVTEP

SEQ ID NO: 2353171 - protein, 19 aa, Cryptosporidium parvum
LRRQLEFFIYHQIHTDPLW

SEQ ID NO: 2353172 - protein, 21 aa, Cryptosporidium parvum
LRRRLARGVPQDFRWKIWNSL

SEQ ID NO: 2353173 - protein, 23 aa, Cryptosporidium parvum
LRSAAIRFGMRYISSGKELSFGG

SEQ ID NO: 2353174 - protein, 21 aa, Cryptosporidium parvum
LRSDFVVKYIEWLKEDEEDDE

SEQ ID NO: 2353175 - protein, 20 aa, Cryptosporidium parvum
LRSIANILFPSYIMDEKELT

SEQ ID NO: 2353176 - protein, 21 aa, Cryptosporidium parvum
LRSLRRTGSRFLPPNSSIYSF

SEQ ID NO: 2353177 - protein, 26 aa, Cryptosporidium parvum
LRSTRLMISHLFIWRQRNSMFRVSKD

SEQ ID NO: 2353178 - protein, 20 aa, Cryptosporidium parvum
LRTDILPFLHDIIGKLLDDS

SEQ ID NO: 2353179 - protein, 17 aa, Cryptosporidium parvum
LRTKICIHCSDTGCCFK

SEQ ID NO: 2353180 - protein, 21 aa, Cryptosporidium parvum
LRTRHVKLVPLGVEIGSNGIS

SEQ ID NO: 2353181 - protein, 27 aa, Cryptosporidium parvum
LRTVELFYLKYCLPKLGDILKKYNVEI

SEQ ID NO: 2353182 - protein, 18 aa, Cryptosporidium parvum
LRVKLRRDTEKPEYNPFK

SEQ ID NO: 2353183 - protein, 28 aa, Cryptosporidium parvum
LRVKPNWRKPKGIDCRVRRKFKGNYLMP

SEQ ID NO: 2353184 - protein, 19 aa, Cryptosporidium parvum
LRVRCFRLEQRVKELTNNY

SEQ ID NO: 2353185 - protein, 17 aa, Cryptosporidium parvum
LSALGIPNTCHFKEITK

SEQ ID NO: 2353186 - protein, 17 aa, Cryptosporidium parvum
LSCDSSLNLEFMNSNQQ

SEQ ID NO: 2353187 - protein, 21 aa, Cryptosporidium parvum
LSEEGLNCDIYWKNDDFRGNV

SEQ ID NO: 2353188 - protein, 17 aa, Cryptosporidium parvum
LSFDPRRLNEWILNNME

SEQ ID NO: 2353189 - protein, 18 aa, Cryptosporidium parvum
LSICQGTWLYYENPVAHF

SEQ ID NO: 2353190 - protein, 18 aa, Cryptosporidium parvum
LSISKSRDEYGRWCRSIL

SEQ ID NO: 2353191 - protein, 28 aa, Cryptosporidium parvum
LSISLNVKECLALFPIKKFKRFLRLQGF

SEQ ID NO: 2353192 - protein, 27 aa, Cryptosporidium parvum
LSKFKEAFEWLKIKFDYTQSERKDLKN

SEQ ID NO: 2353193 - protein, 25 aa, Cryptosporidium parvum
LSLDALKTLPGWGARQKLERFGLRF

SEQ ID NO: 2353194 - protein, 17 aa, Cryptosporidium parvum
LSLEQWGTLIQTMNQMN

SEQ ID NO: 2353195 - protein, 17 aa, Cryptosporidium parvum
LSLFRSKIPQLIRHLGW

SEQ ID NO: 2353196 - protein, 23 aa, Cryptosporidium parvum
LSLQNKYRCAVLMFQEEFALRLL

SEQ ID NO: 2353197 - protein, 28 aa, Cryptosporidium parvum
LSLRYHPFENICGFTNPYYGENNGLTEL

SEQ ID NO: 2353198 - protein, 22 aa, Cryptosporidium parvum
LSNGELYTWGCSKNGKLGHGQF

SEQ ID NO: 2353199 - protein, 17 aa, Cryptosporidium parvum
LSNNFLVAISQINDNLK

SEQ ID NO: 2353200 - protein, 23 aa, Cryptosporidium parvum
LSNRYSILIKRIIKLLKLSRTRQ

SEQ ID NO: 2353201 - protein, 18 aa, Cryptosporidium parvum
LSPSEWPGTLEINPPEVL

SEQ ID NO: 2353202 - protein, 27 aa, Cryptosporidium parvum
LSPTAFKGFQKRFFKLNLTDNALLYWR

SEQ ID NO: 2353203 - protein, 26 aa, Cryptosporidium parvum
LSRCQLRHPPVFEIDGALTRGYAENL

SEQ ID NO: 2353204 - protein, 17 aa, Cryptosporidium parvum
LSSFGLCEFDSPEGVIN

SEQ ID NO: 2353205 - protein, 21 aa, Cryptosporidium parvum
LSSRLICKVANLTSEISQTKS

SEQ ID NO: 2353206 - protein, 18 aa, Cryptosporidium parvum
LSTFGFQISPNIQSGCSE

SEQ ID NO: 2353207 - protein, 29 aa, Cryptosporidium parvum
LSVQLPSCRSLRTSIRINRSSTLSHLGKN

SEQ ID NO: 2353208 - protein, 24 aa, Cryptosporidium parvum
LSVVEFFKYPIPFFSKKNISKNGF

SEQ ID NO: 2353209 - protein, 31 aa, Cryptosporidium parvum; identical to SEQ ID NO: 2177249

SEQ ID NO: 2353210 - protein, 21 aa, Cryptosporidium parvum
LTEPSTINWNFGKIKSNNSNI

SEQ ID NO: 2353211 - protein, 26 aa, Cryptosporidium parvum
LTIVKRFSVSWMYKSGFLHIPIHSIT

SEQ ID NO: 2353212 - protein, 20 aa, Cryptosporidium parvum
LTLKHKYGLIGRNGIGKSTL

SEQ ID NO: 2353213 - protein, 18 aa, Cryptosporidium parvum
LTLSGNVSSVKPIMITSL

SEQ ID NO: 2353214 - protein, 18 aa, Cryptosporidium parvum
LTRGFPVMGEQSVTMMIN

SEQ ID NO: 2353215 - protein, 17 aa, Cryptosporidium parvum
LTRTRVAIFVYDVANIE

SEQ ID NO: 2353216 - protein, 18 aa, Cryptosporidium parvum
LTSEGIVQIFTRIYANYE

SEQ ID NO: 2353217 - protein, 18 aa, Cryptosporidium parvum
LTSYCNWDEQIADVSCRL

SEQ ID NO: 2353218 - protein, 17 aa, Cryptosporidium parvum
LVCKMLNRYCDGYIRYS

SEQ ID NO: 2353219 - protein, 22 aa, Cryptosporidium parvum
LVDGWCFGCVGSTVLVTLSDHY

SEQ ID NO: 2353220 - protein, 18 aa, Cryptosporidium parvum
LVDYPRMKVAELVSIKTL

SEQ ID NO: 2353221 - protein, 24 aa, Cryptosporidium parvum
LVERCKKVKTCPRCMSQQGQLRRT

SEQ ID NO: 2353222 - protein, 17 aa, Cryptosporidium parvum
LVGEASLEWSLNFLTRN

SEQ ID NO: 2353223 - protein, 18 aa, Cryptosporidium parvum
LVGLISAARLLVHLYESN

SEQ ID NO: 2353224 - protein, 18 aa, Cryptosporidium parvum
LVKGLPSLESRLYISEGI

SEQ ID NO: 2353225 - protein, 24 aa, Cryptosporidium parvum
LVKIWEFIVPNLIFTLSRIRLYKE

SEQ ID NO: 2353226 - protein, 25 aa, Cryptosporidium parvum
LVKSCQICLNYYFPSKAIKQMESNS

SEQ ID NO: 2353227 - protein, 22 aa, Cryptosporidium parvum
LVLMTKRFIQYLYEQGESRIID

SEQ ID NO: 2353228 - protein, 17 aa, Cryptosporidium parvum
LVNPFLMMQRMSAANPM

SEQ ID NO: 2353229 - protein, 20 aa, Cryptosporidium parvum
LVRREFERFGAIRDVYLPLD

SEQ ID NO: 2353230 - protein, 19 aa, Cryptosporidium parvum
LWEKIKLSNNFLVAISQIN

SEQ ID NO: 2353231 - protein, 26 aa, Cryptosporidium parvum
LWIDAKSRDWILEWQTKNGRWSVRKF

SEQ ID NO: 2353232 - protein, 26 aa, Cryptosporidium parvum
LWKRYPARIYRHMMKTSSTWIVPFLM

SEQ ID NO: 2353233 - protein, 22 aa, Cryptosporidium parvum
LWYRPPELLLGAQFYDTPVDMW

SEQ ID NO: 2353234 - protein, 21 aa, Cryptosporidium parvum
LYCGILDIFGFECFPNNSFEQ

SEQ ID NO: 2353235 - protein, 17 aa, Cryptosporidium parvum
LYKYPAIIKTIPDFLES

SEQ ID NO: 2353236 - protein, 21 aa, Cryptosporidium parvum
LYLSFWCFSAAAALSSLVSAG

SEQ ID NO: 2353237 - protein, 27 aa, Cryptosporidium parvum
LYLSNRKRIPCMFKIIPCNEHSESFRE

SEQ ID NO: 2353238 - protein, 21 aa, Cryptosporidium parvum
LYMFGGGAFGKLGFGSTDDVL

SEQ ID NO: 2353239 - protein, 19 aa, Cryptosporidium parvum
LYMGPCKNIHSEVLREKYL

SEQ ID NO: 2353240 - protein, 18 aa, Cryptosporidium parvum
LYNFISAFHFNQADFPDS

SEQ ID NO: 2353241 - protein, 17 aa, Cryptosporidium parvum
LYNQRISFFVKISDIVC

SEQ ID NO: 2353242 - protein, 30 aa, Cryptosporidium parvum
LYSTLTNLNRSGCYRGCKFQNKDAIIENLD

SEQ ID NO: 2353243 - protein, 17 aa, Cryptosporidium parvum
LYTEAAFNTEMLPTTVP

SEQ ID NO: 2353244 - protein, 17 aa, Cryptosporidium parvum
MADWIPPTRCFSNAESG

SEQ ID NO: 2353245 - protein, 18 aa, Cryptosporidium parvum
MAERAFSAYIKSLFILTP

SEQ ID NO: 2353246 - protein, 23 aa, Cryptosporidium parvum
MASSIPYLLPLLMGSGSNNDQNI

SEQ ID NO: 2353247 - protein, 25 aa, Cryptosporidium parvum
MCFSLKNCLRNLLLSQITSDEGMNT

SEQ ID NO: 2353248 - protein, 17 aa, Cryptosporidium parvum
MCKKAVRCLRQQQTAGR

SEQ ID NO: 2353249 - protein, 27 aa, Cryptosporidium parvum
MCSNSDFRRISPLLGVLNDSYHNNNFH

SEQ ID NO: 2353250 - protein, 21 aa, Cryptosporidium parvum
MDLLRGIKLGVEHVVNELDLL

SEQ ID NO: 2353251 - protein, 22 aa, Cryptosporidium parvum
MDNELLKVWCMEMCPEEYLDAG

SEQ ID NO: 2353252 - protein, 26 aa, Cryptosporidium parvum
MDSVRAGPFGSLFRPDNFIFGQSGAG

SEQ ID NO: 2353253 - protein, 21 aa, Cryptosporidium parvum
MDTRASIPLYLYGDLEPFIES

SEQ ID NO: 2353254 - protein, 18 aa, Cryptosporidium parvum
MECLNSWKNILLIDYQKS

SEQ ID NO: 2353255 - protein, 17 aa, Cryptosporidium parvum
MEKTLIQRKEQLLQACQ

SEQ ID NO: 2353256 - protein, 19 aa, Cryptosporidium parvum
MELDWERRALEHTKEALRQ

SEQ ID NO: 2353257 - protein, 26 aa, Cryptosporidium parvum
METDFKLSIPILIELIKKDNLDEIED

SEQ ID NO: 2353258 - protein, 20 aa, Cryptosporidium parvum
MGRNAFMCSASVPEVLVERD

SEQ ID NO: 2353259 - protein, 23 aa, Cryptosporidium parvum
MGSGEGRMCWLYLKNDWKEIKEF

SEQ ID NO: 2353260 - protein, 18 aa, Cryptosporidium parvum
MHELRRQLEFFIYHQIHT

SEQ ID NO: 2353261 - protein, 25 aa, Cryptosporidium parvum
MHGKGTYIFPCGNVYEGEWVNDVKE

SEQ ID NO: 2353262 - protein, 17 aa, Cryptosporidium parvum
MHNNWWVKFKEISENKN

SEQ ID NO: 2353263 - protein, 21 aa, Cryptosporidium parvum
MIESILGRCVAFWGNMNIMIE

SEQ ID NO: 2353264 - protein, 19 aa, Cryptosporidium parvum
MIGSGWHYYHQILNQYKPC

SEQ ID NO: 2353265 - protein, 19 aa, Cryptosporidium parvum
MIKALLVLKSIIKDEISQV

SEQ ID NO: 2353266 - protein, 17 aa, Cryptosporidium parvum
MIKFCGKDNFHLRIRVH

SEQ ID NO: 2353267 - protein, 26 aa, Cryptosporidium parvum
MIKRDPKIRIGYFAQHHIESLDLTLN

SEQ ID NO: 2353268 - protein, 22 aa, Cryptosporidium parvum
MILCTQNIYFWIISLERITNYQ

SEQ ID NO: 2353269 - protein, 19 aa, Cryptosporidium parvum
MILHKLRHPNIVSLVDFSD

SEQ ID NO: 2353270 - protein, 25 aa, Cryptosporidium parvum
MISGLKLSYCLNFKANALIQILSNC

SEQ ID NO: 2353271 - protein, 18 aa, Cryptosporidium parvum
MIVICFKSLKGGTRLKQF

SEQ ID NO: 2353272 - protein, 25 aa, Cryptosporidium parvum
MKEVLECLKCIGLCESEIFEILRIC

SEQ ID NO: 2353273 - protein, 21 aa, Cryptosporidium parvum
MKFLKRKATCDLEFCVELFWL

SEQ ID NO: 2353274 - protein, 19 aa, Cryptosporidium parvum
MKINCDRNLSNVIKKNEEL

SEQ ID NO: 2353275 - protein, 24 aa, Cryptosporidium parvum
MKSLEHRESILLSALEDSSYRMTD

SEQ ID NO: 2353276 - protein, 18 aa, Cryptosporidium parvum
MKVAELVSIKTLRYILRP

SEQ ID NO: 2353277 - protein, 20 aa, Cryptosporidium parvum
MKVKTTKTVTTQEVKPSSES

SEQ ID NO: 2353278 - protein, 24 aa, Cryptosporidium parvum
MLADKGICCIDEFDKMDDKDVVAI

SEQ ID NO: 2353279 - protein, 23 aa, Cryptosporidium parvum
MLEMLKRVGRSELVVGWYHSHPG

SEQ ID NO: 2353280 - protein, 20 aa, Cryptosporidium parvum
MLENLRLRDSGGIQISQRQN

SEQ ID NO: 2353281 - protein, 19 aa, Cryptosporidium parvum
MLFKLLIHPVHELVNNLKT

SEQ ID NO: 2353282 - protein, 32 aa, Cryptosporidium parvum; identical to SEQ ID NO: 2177650

SEQ ID NO: 2353283 - protein, 19 aa, Cryptosporidium parvum
MLRELKKPYDCSFVSREFR

SEQ ID NO: 2353284 - protein, 22 aa, Cryptosporidium parvum
MNCNNSIEFLRIWQNIYQNNQF

SEQ ID NO: 2353285 - protein, 22 aa, Cryptosporidium parvum
MNLINLKWLLVRSSESIRNKLN

SEQ ID NO: 2353286 - protein, 26 aa, Cryptosporidium parvum
MNMIAAKLLEDWDVIGHFFQDCMSEE

SEQ ID NO: 2353287 - protein, 20 aa, Cryptosporidium parvum
MNVYHPKLLLSIVSNVMIVS

SEQ ID NO: 2353288 - protein, 18 aa, Cryptosporidium parvum
MPHGRAMVTGGFPNQNAM

SEQ ID NO: 2353289 - protein, 18 aa, Cryptosporidium parvum
MQCADIFQLKADICQLGM

SEQ ID NO: 2353290 - protein, 23 aa, Cryptosporidium parvum
MRFRHGVGIWELFIPHLGPGEKY

SEQ ID NO: 2353291 - protein, 20 aa, Cryptosporidium parvum
MRIIKDKIEFARIQTDSSGE

SEQ ID NO: 2353292 - protein, 29 aa, Cryptosporidium parvum
MRNVNELNIEYDFCKMVSKKSKLDDSDSK

SEQ ID NO: 2353293 - protein, 20 aa, Cryptosporidium parvum
MSADLAKNGIVFGGENSIGN

SEQ ID NO: 2353294 - protein, 25 aa, Cryptosporidium parvum
MSGVTCCLRFPGQLNSDLRKMCVNL

SEQ ID NO: 2353295 - protein, 23 aa, Cryptosporidium parvum
MSNWNVIKLLAYVDKIGDQEIES

SEQ ID NO: 2353296 - protein, 23 aa, Cryptosporidium parvum
MSRRKTIGGVFCYLLKQLVAEDQ

SEQ ID NO: 2353297 - protein, 24 aa, Cryptosporidium parvum
MTELSRFRTRICERKALHGVCELD

SEQ ID NO: 2353298 - protein, 18 aa, Cryptosporidium parvum
MTVRRFLTATGHAISLFS

SEQ ID NO: 2353299 - protein, 23 aa, Cryptosporidium parvum
MYAKMFKDCYGFISPTKFINTCL

SEQ ID NO: 2353300 - protein, 18 aa, Cryptosporidium parvum
MYDQCSKGDYSLVEKIMN

SEQ ID NO: 2353301 - protein, 31 aa, Cryptosporidium parvum; identical to SEQ ID NO: 2177838

SEQ ID NO: 2353302 - protein, 21 aa, Cryptosporidium parvum
NAYICSGLDDIFFKNMLEIAT

SEQ ID NO: 2353303 - protein, 29 aa, Cryptosporidium parvum
NCLPDQYKDLFSRFIRVMNTLQFIGLLYL

SEQ ID NO: 2353304 - protein, 24 aa, Cryptosporidium parvum
NDHIWKYSKIRNIKGVNNFEERDK

SEQ ID NO: 2353305 - protein, 17 aa, Cryptosporidium parvum
NDLRNCDSEYAIDKTAE

SEQ ID NO: 2353306 - protein, 17 aa, Cryptosporidium parvum
NDRNGIFSYNFYNNNAD

SEQ ID NO: 2353307 - protein, 20 aa, Cryptosporidium parvum
NDVSSRFSIISSNLKESPTS

SEQ ID NO: 2353308 - protein, 24 aa, Cryptosporidium parvum
NEDIELRFTLNLEEDLSKFKEAFE

SEQ ID NO: 2353309 - protein, 24 aa, Cryptosporidium parvum
NEEEMIGLLKLVFDKATTQHHFIP

SEQ ID NO: 2353310 - protein, 24 aa, Cryptosporidium parvum
NEELEEYKHLVLRFMHQQNGNDDY

SEQ ID NO: 2353311 - protein, 26 aa, Cryptosporidium parvum
NEESCLPLRILIKFERKTLKDKDREK

SEQ ID NO: 2353312 - protein, 19 aa, Cryptosporidium parvum
NEFMEIIGGFRSCAKEESK

SEQ ID NO: 2353313 - protein, 22 aa, Cryptosporidium parvum
NEGGESLNGFLISGNHESNSKT

SEQ ID NO: 2353314 - protein, 24 aa, Cryptosporidium parvum
NEIHCIRVMPNLTLSICQGTWLYY

SEQ ID NO: 2353315 - protein, 20 aa, Cryptosporidium parvum
NEIQKILSIPVFVNPDLCEV

SEQ ID NO: 2353316 - protein, 21 aa, Cryptosporidium parvum
NEISELRLKLSNSKEKESSNY

SEQ ID NO: 2353317 - protein, 24 aa, Cryptosporidium parvum
NEKDPVGCIVFLRFSDTLIEATNS

SEQ ID NO: 2353318 - protein, 18 aa, Cryptosporidium parvum
NEKFEIMTDSLLLLQRLE

SEQ ID NO: 2353319 - protein, 18 aa, Cryptosporidium parvum
NEKRWKTIGGVFDSENSI

SEQ ID NO: 2353320 - protein, 18 aa, Cryptosporidium parvum
NELGELVHSISHLGEKKL

SEQ ID NO: 2353321 - protein, 17 aa, Cryptosporidium parvum
NELGYQYAINWAGGLHH

SEQ ID NO: 2353322 - protein, 23 aa, Cryptosporidium parvum
NELKLDCKASFTVFSSSPLLLNR

SEQ ID NO: 2353323 - protein, 21 aa, Cryptosporidium parvum
NENPIRFLGLLECNCDFENCR

SEQ ID NO: 2353324 - protein, 24 aa, Cryptosporidium parvum
NENTSRFPLRFTNVNQNFELCSSY

SEQ ID NO: 2353325 - protein, 24 aa, Cryptosporidium parvum
NEQLSRITIYITLQVVFILENLKN

SEQ ID NO: 2353326 - protein, 25 aa, Cryptosporidium parvum
NEVCSFNLLQPLSLNISYSGSNDKS

SEQ ID NO: 2353327 - protein, 34 aa, Cryptosporidium parvum; identical to SEQ ID NO: 2300122

SEQ ID NO: 2353328 - protein, 17 aa, Cryptosporidium parvum
NFEIIKLSQKVDLLQKD

SEQ ID NO: 2353329 - protein, 32 aa, Cryptosporidium parvum; identical to SEQ ID NO: 2178013

SEQ ID NO: 2353330 - protein, 20 aa, Cryptosporidium parvum
NFGGLMCSNSDFRRISPLLG

SEQ ID NO: 2353331 - protein, 23 aa, Cryptosporidium parvum
NFITEIDPLLSLTKLKSLNISKN

SEQ ID NO: 2353332 - protein, 24 aa, Cryptosporidium parvum
NFKAKREVVNFQDILREEEITSKE

SEQ ID NO: 2353333 - protein, 22 aa, Cryptosporidium parvum
NGEFVLGYSILPLVSAYYTEKL

SEQ ID NO: 2353334 - protein, 17 aa, Cryptosporidium parvum
NGGMLPSAIPGQVDTST

SEQ ID NO: 2353335 - protein, 17 aa, Cryptosporidium parvum
NGIEHTNHLIIFNNEEL

SEQ ID NO: 2353336 - protein, 24 aa, Cryptosporidium parvum
NGIKSEFDPSIFIGYNSARDRVIR

SEQ ID NO: 2353337 - protein, 18 aa, Cryptosporidium parvum
NGMLSDWRVPTCEMLYYS

SEQ ID NO: 2353338 - protein, 26 aa, Cryptosporidium parvum
NGNFIAKLFIRFGMKPEQTQIHDQES

SEQ ID NO: 2353339 - protein, 24 aa, Cryptosporidium parvum
NGNKRLSWQQILALGKSTEKIVGL

SEQ ID NO: 2353340 - protein, 19 aa, Cryptosporidium parvum
NGNNCIYCNASLERTSNTR

SEQ ID NO: 2353341 - protein, 33 aa, Cryptosporidium parvum; identical to SEQ ID NO: 2178071

SEQ ID NO: 2353342 - protein, 17 aa, Cryptosporidium parvum
NGSIECNSLDRVKRIFP

SEQ ID NO: 2353343 - protein, 18 aa, Cryptosporidium parvum
NGVEVWFREGHIGSNQVS

SEQ ID NO: 2353344 - protein, 18 aa, Cryptosporidium parvum
NHEYNLFFNNFYKDYELG

SEQ ID NO: 2353345 - protein, 17 aa, Cryptosporidium parvum
NHVPNANQIRFISNDGS

SEQ ID NO: 2353346 - protein, 18 aa, Cryptosporidium parvum
NHYECVFNNNFNFRINVQ

SEQ ID NO: 2353347 - protein, 22 aa, Cryptosporidium parvum
NIAFVRYFLRSSAEFAKAAMEN

SEQ ID NO: 2353348 - protein, 28 aa, Cryptosporidium parvum
NIDIGVVPQCCWIWSTYVFLKIIKSFTF

SEQ ID NO: 2353349 - protein, 19 aa, Cryptosporidium parvum
NIHFFKFIVDGEWRYSPEY

SEQ ID NO: 2353350 - protein, 23 aa, Cryptosporidium parvum
NIKGKGRTSGSIYRLDKTENEKD

SEQ ID NO: 2353351 - protein, 23 aa, Cryptosporidium parvum
NIKHKINESIGWWIISVNEYGYL

SEQ ID NO: 2353352 - protein, 18 aa, Cryptosporidium parvum
NILIPKVRLKKLIENGSL

SEQ ID NO: 2353353 - protein, 24 aa, Cryptosporidium parvum
NILRRCATYVYKILSILGLCGEDN

SEQ ID NO: 2353354 - protein, 22 aa, Cryptosporidium parvum
NISYFCSKGFCIRKIGKARARK

SEQ ID NO: 2353355 - protein, 20 aa, Cryptosporidium parvum
NIVELYGVVFSRPHNDLNEH

SEQ ID NO: 2353356 - protein, 17 aa, Cryptosporidium parvum
NKARMLNSELLKKQREL

SEQ ID NO: 2353357 - protein, 19 aa, Cryptosporidium parvum
NKEKMLFFFNDIAFLKDNC

SEQ ID NO: 2353358 - protein, 18 aa, Cryptosporidium parvum
NKESCVISSVSSPNKPGK

SEQ ID NO: 2353359 - protein, 21 aa, Cryptosporidium parvum
NKIFTKRVIVFFQTKKEAHRC

SEQ ID NO: 2353360 - protein, 26 aa, Cryptosporidium parvum
NKIKCSCTSFLWKGVNMDLGTSDEGM

SEQ ID NO: 2353361 - protein, 25 aa, Cryptosporidium parvum
NKILELKGLRFAFFKDDLDILDTCI

SEQ ID NO: 2353362 - protein, 19 aa, Cryptosporidium parvum
NKKIIVFVSCCKQVRFLST

SEQ ID NO: 2353363 - protein, 25 aa, Cryptosporidium parvum
NKLESVSFLKYCWNLTDINLSNNNL

SEQ ID NO: 2353364 - protein, 19 aa, Cryptosporidium parvum
NKLGNIFREISLRNESNAY

SEQ ID NO: 2353365 - protein, 21 aa, Cryptosporidium parvum
NKLLVGNKCDLVSKRVVTSDE

SEQ ID NO: 2353366 - protein, 17 aa, Cryptosporidium parvum
NKLYLPLYSKFVDENSF

SEQ ID NO: 2353367 - protein, 24 aa, Cryptosporidium parvum
NKMDRLILELGFDVKEAYIHITKL

SEQ ID NO: 2353368 - protein, 23 aa, Cryptosporidium parvum
NKPDSQWKQFYSARMRTNAFNSR

SEQ ID NO: 2353369 - protein, 25 aa, Cryptosporidium parvum
NKQTKEFNIEFGLEKNTGIKQSNNS

SEQ ID NO: 2353370 - protein, 18 aa, Cryptosporidium parvum
NKSADAFSIKDQSQLDSW

SEQ ID NO: 2353371 - protein, 19 aa, Cryptosporidium parvum
NKSRLTIMKTMPAPVTDIK

SEQ ID NO: 2353372 - protein, 17 aa, Cryptosporidium parvum
NKTALLCPLCMTPQCFG

SEQ ID NO: 2353373 - protein, 31 aa, Cryptosporidium parvum
NKTQECAFPHYWRYLAIWKLFTNQELVTYNK

SEQ ID NO: 2353374 - protein, 25 aa, Cryptosporidium parvum
NKTRYRLSVSLYNLFGCGDVFSDEI

SEQ ID NO: 2353375 - protein, 20 aa, Cryptosporidium parvum
NLEMEVCLRCVQSSNKNTLS

SEQ ID NO: 2353376 - protein, 17 aa, Cryptosporidium parvum
NLFRPNQLESFSLDNIG

SEQ ID NO: 2353377 - protein, 19 aa, Cryptosporidium parvum
NLFTSLRFYHYSVEVRNVL

SEQ ID NO: 2353378 - protein, 22 aa, Cryptosporidium parvum
NLIPELVKKVSYIVEDTYRRQI

SEQ ID NO: 2353379 - protein, 17 aa, Cryptosporidium parvum
NLKSIALGLCIINTILS

SEQ ID NO: 2353380 - protein, 21 aa, Cryptosporidium parvum
NLKTKIKHYFSNNIQEEINVC

SEQ ID NO: 2353381 - protein, 17 aa, Cryptosporidium parvum
NLLSLKFVSSHNIESLK

SEQ ID NO: 2353382 - protein, 23 aa, Cryptosporidium parvum
NLLVCKLCKKSSTTIEFNSHNIR

SEQ ID NO: 2353383 - protein, 25 aa, Cryptosporidium parvum
NLLWHWRSGDWIAHLSELKLLNPSN

SEQ ID NO: 2353384 - protein, 23 aa, Cryptosporidium parvum
NLPYQISSPFVFKLLSLQNKYRC

SEQ ID NO: 2353385 - protein, 19 aa, Cryptosporidium parvum
NLQIGSRINNPVCEYITSF

SEQ ID NO: 2353386 - protein, 20 aa, Cryptosporidium parvum
NLQKRLRVLPPKHPGKDETM

SEQ ID NO: 2353387 - protein, 19 aa, Cryptosporidium parvum
NLTGRDLLQASIRMISNPR

SEQ ID NO: 2353388 - protein, 24 aa, Cryptosporidium parvum
NMKHSCKRCIVEVEMWKRKLKTQE

SEQ ID NO: 2353389 - protein, 18 aa, Cryptosporidium parvum
NNCNCGRADLEKEIGVEA

SEQ ID NO: 2353390 - protein, 19 aa, Cryptosporidium parvum
NNHFKLCTRLATLGNASFV

SEQ ID NO: 2353391 - protein, 17 aa, Cryptosporidium parvum
NNIKLCLNIEDIPSYNN

SEQ ID NO: 2353392 - protein, 21 aa, Cryptosporidium parvum
NNKYGRWSIIRVTTDLSTKFK

SEQ ID NO: 2353393 - protein, 18 aa, Cryptosporidium parvum
NNLVKPPFKSHNDLSASQ

SEQ ID NO: 2353394 - protein, 30 aa, Cryptosporidium parvum
NNNESILWPECLKSPFSYKFETNIQANQGS

SEQ ID NO: 2353395 - protein, 18 aa, Cryptosporidium parvum
NNNLLEWYNSLKQKIKNT

SEQ ID NO: 2353396 - protein, 24 aa, Cryptosporidium parvum
NNPLDRPKQCFIQVKRLLLGENNF

SEQ ID NO: 2353397 - protein, 22 aa, Cryptosporidium parvum
NNSLPIGKIRNIWKGLQSTVLK

SEQ ID NO: 2353398 - protein, 21 aa, Cryptosporidium parvum
NPLHSLVICHPDLHLIEQRFF

SEQ ID NO: 2353399 - protein, 25 aa, Cryptosporidium parvum
NPPLSSLQKFFALLISSRPIANNEA

SEQ ID NO: 2353400 - protein, 23 aa, Cryptosporidium parvum
NPQKLMECLVVIKSPNSDITQKD

SEQ ID NO: 2353401 - protein, 24 aa, Cryptosporidium parvum
NQDRPRLLPYLNRMLRELKKPYDC

SEQ ID NO: 2353402 - protein, 26 aa, Cryptosporidium parvum
NQEFLKGIVKRSGRPGITLIDKNFNW

SEQ ID NO: 2353403 - protein, 18 aa, Cryptosporidium parvum
NQIEELYKPLEYPKLCNR

SEQ ID NO: 2353404 - protein, 24 aa, Cryptosporidium parvum
NQKGKWRVKLRNGIAQIANQEIPF

SEQ ID NO: 2353405 - protein, 23 aa, Cryptosporidium parvum
NQNSELYINFVFSTKIPTHLEHA

SEQ ID NO: 2353406 - protein, 19 aa, Cryptosporidium parvum
NQSFIPNWYDSVIGGSGTE

SEQ ID NO: 2353407 - protein, 21 aa, Cryptosporidium parvum
NQYKTNCETNMTSEQTKKRPS

SEQ ID NO: 2353408 - protein, 22 aa, Cryptosporidium parvum
NRIELDFGGLGKGYLWDMEITS

SEQ ID NO: 2353409 - protein, 27 aa, Cryptosporidium parvum
NRKFEFIKCKLINISYAFPSDTEHSIK

SEQ ID NO: 2353410 - protein, 26 aa, Cryptosporidium parvum
NRKKLLEEWGLPGTYVTLWLKEELGE

SEQ ID NO: 2353411 - protein, 18 aa, Cryptosporidium parvum
NRLAPQIFIETSISSFLS

SEQ ID NO: 2353412 - protein, 24 aa, Cryptosporidium parvum
NRLNLRGLNEFDLKESRLSMSFDA

SEQ ID NO: 2353413 - protein, 30 aa, Cryptosporidium parvum; identical to SEQ ID NO: 2300828

SEQ ID NO: 2353414 - protein, 26 aa, Cryptosporidium parvum
NRRIMVYSEKISIIILYQLLVCVDYL

SEQ ID NO: 2353415 - protein, 21 aa, Cryptosporidium parvum
NRRLSESYKLFLNGQNDGGLL

SEQ ID NO: 2353416 - protein, 23 aa, Cryptosporidium parvum
NRRRVCAVGPLVVYAEDNGIVKA

SEQ ID NO: 2353417 - protein, 23 aa, Cryptosporidium parvum
NRSSELRLIIAPLALALVPVGEV

SEQ ID NO: 2353418 - protein, 37 aa, Cryptosporidium parvum
NRTNSSCRILSAAEMKKVFCKSKKPIGSLKDFVHTIE

SEQ ID NO: 2353419 - protein, 26 aa, Cryptosporidium parvum
NSCISVPTGSFLIRAFYSNNGVNNNN

SEQ ID NO: 2353420 - protein, 23 aa, Cryptosporidium parvum
NSDDWKYGGAMFGPGNNSTVHAS

SEQ ID NO: 2353421 - protein, 19 aa, Cryptosporidium parvum
NSELIFICVKPHILSQILS

SEQ ID NO: 2353422 - protein, 26 aa, Cryptosporidium parvum
NSLGFKLFVDKCCDYYRYIRRKSWLI

SEQ ID NO: 2353423 - protein, 19 aa, Cryptosporidium parvum
NSLILLLTSYCNWDEQIAD

SEQ ID NO: 2353424 - protein, 19 aa, Cryptosporidium parvum
NSNKFGLIFEKLYLTGIQQ

SEQ ID NO: 2353425 - protein, 23 aa, Cryptosporidium parvum
NSNPDLWLSWLLMGRNNSKENDT

SEQ ID NO: 2353426 - protein, 27 aa, Cryptosporidium parvum
NSPLILEKFHPIWIRKIIDERRNLVLK

SEQ ID NO: 2353427 - protein, 19 aa, Cryptosporidium parvum
NSSHPAFGFEQEKHYNSHF

SEQ ID NO: 2353428 - protein, 20 aa, Cryptosporidium parvum
NSSRFGKFIEIYFDATGKLR

SEQ ID NO: 2353429 - protein, 17 aa, Cryptosporidium parvum
NSTLVSCIECCISYFSR

SEQ ID NO: 2353430 - protein, 22 aa, Cryptosporidium parvum
NSYSSRSHLIFMLQLQQKNVFD

SEQ ID NO: 2353431 - protein, 20 aa, Cryptosporidium parvum
NTDKVILLWTGCTPTSKDME

SEQ ID NO: 2353432 - protein, 19 aa, Cryptosporidium parvum
NTFYGRYISDLGCYLQPAT

SEQ ID NO: 2353433 - protein, 18 aa, Cryptosporidium parvum
NTGYKVSTSMLFDIQVKR

SEQ ID NO: 2353434 - protein, 30 aa, Cryptosporidium parvum; identical to SEQ ID NO: 2178735

SEQ ID NO: 2353435 - protein, 25 aa, Cryptosporidium parvum
NTIFWSIKDVESFDKVQNKRIINKM

SEQ ID NO: 2353436 - protein, 24 aa, Cryptosporidium parvum
NTILRECAIIELMQNVMMVHNDNP

SEQ ID NO: 2353437 - protein, 18 aa, Cryptosporidium parvum
NTMNHFFFYCFSKDPNPK

SEQ ID NO: 2353438 - protein, 24 aa, Cryptosporidium parvum
NTSKCFQCGLPTKGTFNIASIPQE

SEQ ID NO: 2353439 - protein, 35 aa, Cryptosporidium parvum; identical to SEQ ID NO: 2178764

SEQ ID NO: 2353440 - protein, 23 aa, Cryptosporidium parvum
NVEKAMWSAFVSVRHTLAKYCDR

SEQ ID NO: 2353441 - protein, 19 aa, Cryptosporidium parvum
NVPELPLVISNEIQNINKT

SEQ ID NO: 2353442 - protein, 17 aa, Cryptosporidium parvum
NWPKADCILILRNMPFD

SEQ ID NO: 2353443 - protein, 24 aa, Cryptosporidium parvum
NYLKECGFDSCWIHSSYYDIISQF

SEQ ID NO: 2353444 - protein, 18 aa, Cryptosporidium parvum
NYVAKSPFFLSVKNKYRD

SEQ ID NO: 2353445 - protein, 22 aa, Cryptosporidium parvum
NYVKTRQYEIVFKKIKDSEIVV

SEQ ID NO: 2353446 - protein, 26 aa, Cryptosporidium parvum
PAFLNDLRISSNLLRILFDANKERGI

SEQ ID NO: 2353447 - protein, 20 aa, Cryptosporidium parvum
PAVRFEIFILIYELIENIKI

SEQ ID NO: 2353448 - protein, 26 aa, Cryptosporidium parvum
PCRRYHKRLKLLPPVNPDECYVLTDS

SEQ ID NO: 2353449 - protein, 19 aa, Cryptosporidium parvum
PCSESRNSTPWTFSSNKNE

SEQ ID NO: 2353450 - protein, 19 aa, Cryptosporidium parvum
PDIFYGNGIQILLQPFSDL

SEQ ID NO: 2353451 - protein, 20 aa, Cryptosporidium parvum
PDSLKSLGWDNSVIVRVLNI

SEQ ID NO: 2353452 - protein, 23 aa, Cryptosporidium parvum
PDVGYCQGMNFIAALLLITSNFD

SEQ ID NO: 2353453 - protein, 23 aa, Cryptosporidium parvum
PDYFRVLWNFISSVDLVRKTKLD

SEQ ID NO: 2353454 - protein, 21 aa, Cryptosporidium parvum
PDYIQLCKLREEFPNVPIIAL

SEQ ID NO: 2353455 - protein, 26 aa, Cryptosporidium parvum
PEIQKLILEFLFSFKTSQKLSLVNKE

SEQ ID NO: 2353456 - protein, 22 aa, Cryptosporidium parvum
PELSLPYKLWIDAKSRDWILEW

SEQ ID NO: 2353457 - protein, 22 aa, Cryptosporidium parvum
PEMFASEIPQNFPIETNPEATL

SEQ ID NO: 2353458 - protein, 42 aa, Cryptosporidium parvum; identical to SEQ ID NO: 2301269

SEQ ID NO: 2353459 - protein, 22 aa, Cryptosporidium parvum
PEVESSRKFGFVGFYSEEDAKK

SEQ ID NO: 2353460 - protein, 24 aa, Cryptosporidium parvum
PFACDIAIILSCWLQNKSISTLSR

SEQ ID NO: 2353461 - protein, 18 aa, Cryptosporidium parvum
PFAIEIGNILTHHYLFYP

SEQ ID NO: 2353462 - protein, 21 aa, Cryptosporidium parvum
PFLLNLRHFYQFNFITQRHRR

SEQ ID NO: 2353463 - protein, 22 aa, Cryptosporidium parvum
PFVCASTRIALTASAKWGLPSP

SEQ ID NO: 2353464 - protein, 20 aa, Cryptosporidium parvum
PGCRKCVIATNIAEASLTID

SEQ ID NO: 2353465 - protein, 19 aa, Cryptosporidium parvum
PGIGAGAAGLGGRTYKSDP

SEQ ID NO: 2353466 - protein, 17 aa, Cryptosporidium parvum
PHAPPLVNRTRNIYIVT

SEQ ID NO: 2353467 - protein, 27 aa, Cryptosporidium parvum
PHPMGLQPFPMHSILLPTLLQAQIQAQ

SEQ ID NO: 2353468 - protein, 18 aa, Cryptosporidium parvum
PIAEKFPYLIYPMNADEL

SEQ ID NO: 2353469 - protein, 26 aa, Cryptosporidium parvum
PIASNSYVWRCLKSNLRGCEGLIERI

SEQ ID NO: 2353470 - protein, 25 aa, Cryptosporidium parvum
PIFIQWLDCVYQCYNQFPTEFQFHP

SEQ ID NO: 2353471 - protein, 23 aa, Cryptosporidium parvum
PIHSEVYIRYGILSSSECLFGYG

SEQ ID NO: 2353472 - protein, 18 aa, Cryptosporidium parvum
PIILAIGPEGGWTKEELT

SEQ ID NO: 2353473 - protein, 19 aa, Cryptosporidium parvum
PKDIFPIMIVGTRVTNETV

SEQ ID NO: 2353474 - protein, 20 aa, Cryptosporidium parvum
PKEDLKILVTKGAANISPKI

SEQ ID NO: 2353475 - protein, 18 aa, Cryptosporidium parvum
PKEVRDFLSHGGNDFGSR

SEQ ID NO: 2353476 - protein, 25 aa, Cryptosporidium parvum
PKISKFRGNALIKNCRKITKEGKCK

SEQ ID NO: 2353477 - protein, 17 aa, Cryptosporidium parvum
PKKEILLYVPLTNMQRR

SEQ ID NO: 2353478 - protein, 35 aa, Cryptosporidium parvum; identical to SEQ ID NO: 2179128

SEQ ID NO: 2353479 - protein, 18 aa, Cryptosporidium parvum
PKLLLSIVSNVMIVSEGM

SEQ ID NO: 2353480 - protein, 22 aa, Cryptosporidium parvum
PKMLQFHLLLAIRSVVANLGVQ

SEQ ID NO: 2353481 - protein, 19 aa, Cryptosporidium parvum
PKNHCPKLKKMSLSNNCLK

SEQ ID NO: 2353482 - protein, 19 aa, Cryptosporidium parvum
PKPEEKALPLLNSQSSTFS

SEQ ID NO: 2353483 - protein, 17 aa, Cryptosporidium parvum
PKPKFLAPPKNPPKVSH

SEQ ID NO: 2353484 - protein, 17 aa, Cryptosporidium parvum
PKYLIIHMQRFYLSEDW

SEQ ID NO: 2353485 - protein, 22 aa, Cryptosporidium parvum
PLAVELKSLLSININKKKNGLD

SEQ ID NO: 2353486 - protein, 22 aa, Cryptosporidium parvum
PLDYRSRRPRGFGFVEYVEEED

SEQ ID NO: 2353487 - protein, 29 aa, Cryptosporidium parvum
PLHVAKHMLRVCRETRPNIWVYAELFTGD

SEQ ID NO: 2353488 - protein, 25 aa, Cryptosporidium parvum
PLLERLKLAYLKVVIPKCKYDQNRS

SEQ ID NO: 2353489 - protein, 19 aa, Cryptosporidium parvum
PLLNCLNTKCGLDATKSLE

SEQ ID NO: 2353490 - protein, 23 aa, Cryptosporidium parvum
PLLRQSSCLIRSLIITLNTIQNL

SEQ ID NO: 2353491 - protein, 18 aa, Cryptosporidium parvum
PLRLPLQDVYKIGGVGTV

SEQ ID NO: 2353492 - protein, 17 aa, Cryptosporidium parvum
PLYKMKMLVLKHSNIPT

SEQ ID NO: 2353493 - protein, 26 aa, Cryptosporidium parvum
PMFPRWCKSRLFAWPVDKWLEIIRKT

SEQ ID NO: 2353494 - protein, 23 aa, Cryptosporidium parvum
PNAQEFIPRGWVNPTNEPFINHL

SEQ ID NO: 2353495 - protein, 17 aa, Cryptosporidium parvum
PNCNGIFGPDLNNFLSQ

SEQ ID NO: 2353496 - protein, 20 aa, Cryptosporidium parvum
PNFMTGSLIHNFPLFQNQDT

SEQ ID NO: 2353497 - protein, 23 aa, Cryptosporidium parvum
PNIPCSIAKQLFRKLVSDISQRA

SEQ ID NO: 2353498 - protein, 19 aa, Cryptosporidium parvum
PNIQSFTRMRSHLDNVLFG

SEQ ID NO: 2353499 - protein, 23 aa, Cryptosporidium parvum
PNPNTRWSIKKALFHPDCIQQLL

SEQ ID NO: 2353500 - protein, 25 aa, Cryptosporidium parvum
PPDSRPFWFQDWGERAISYYSSQID

SEQ ID NO: 2353501 - protein, 22 aa, Cryptosporidium parvum
PPEKIPGYDVWQPPPPQKVDQK

SEQ ID NO: 2353502 - protein, 17 aa, Cryptosporidium parvum
PPGDILVFLTGQEEIDN

SEQ ID NO: 2353503 - protein, 19 aa, Cryptosporidium parvum
PPKIRLMSVKAIFSENFLS

SEQ ID NO: 2353504 - protein, 19 aa, Cryptosporidium parvum
PPLNDFLLGKIVFLDSIYY

SEQ ID NO: 2353505 - protein, 23 aa, Cryptosporidium parvum
PPLPPKRNGPGWNSHSTGNKLED

SEQ ID NO: 2353506 - protein, 18 aa, Cryptosporidium parvum
PPMHDWQFYDKKRIMELH

SEQ ID NO: 2353507 - protein, 17 aa, Cryptosporidium parvum
PPPSYPAPVLKTNIHHF

SEQ ID NO: 2353508 - protein, 24 aa, Cryptosporidium parvum
PPRFTRGILNRHCYVLFDNMKNRD

SEQ ID NO: 2353509 - protein, 19 aa, Cryptosporidium parvum
PPTTGYCLKNDEGVTSATG

SEQ ID NO: 2353510 - protein, 17 aa, Cryptosporidium parvum
PQIIPICNPNKSSNSDK

SEQ ID NO: 2353511 - protein, 23 aa, Cryptosporidium parvum
PQRLYCSFCEIYLDIPQRGTIKI

SEQ ID NO: 2353512 - protein, 21 aa, Cryptosporidium parvum
PRHIRMLFLLHKWDAPMNYSP

SEQ ID NO: 2353513 - protein, 28 aa, Cryptosporidium parvum
PRPLPQLGSYFTPRPWKGGDNSSNGPKD

SEQ ID NO: 2353514 - protein, 21 aa, Cryptosporidium parvum
PRVDILRFVHDKYVIPILMVI

SEQ ID NO: 2353515 - protein, 27 aa, Cryptosporidium parvum
PSCDIISFLDIFLLSLFRSKIPQLIRH

SEQ ID NO: 2353516 - protein, 26 aa, Cryptosporidium parvum
PSFLSFKPKFMYSIPFKCNENKYSRS

SEQ ID NO: 2353517 - protein, 34 aa, Cryptosporidium parvum; identical to SEQ ID NO: 2301684

SEQ ID NO: 2353518 - protein, 29 aa, Cryptosporidium parvum
PSQTTYGKCGVKYETTQSGKTQIKITETY

SEQ ID NO: 2353519 - protein, 21 aa, Cryptosporidium parvum
PSRLEFISNIGRRFQGKSLNV

SEQ ID NO: 2353520 - protein, 17 aa, Cryptosporidium parvum
PSRRQSYSIPILRERCL

SEQ ID NO: 2353521 - protein, 24 aa, Cryptosporidium parvum
PSSFSLKTSRGMIDSSGGGTIGSR

SEQ ID NO: 2353522 - protein, 22 aa, Cryptosporidium parvum
PTIEEIKRFFGVSDLSEVNIDS

SEQ ID NO: 2353523 - protein, 19 aa, Cryptosporidium parvum
PTISAAGLFSLPSTEGSSD

SEQ ID NO: 2353524 - protein, 22 aa, Cryptosporidium parvum
PTNWIMQTWRNIQCEMGNEGDS

SEQ ID NO: 2353525 - protein, 22 aa, Cryptosporidium parvum
PTTADFPLEGILSPKENSSPEE

SEQ ID NO: 2353526 - protein, 27 aa, Cryptosporidium parvum
PVAKDGGLPCIVWLLLAIVHCSVNGNK

SEQ ID NO: 2353527 - protein, 20 aa, Cryptosporidium parvum
PVEIIKDEFESLINPENSSK

SEQ ID NO: 2353528 - protein, 18 aa, Cryptosporidium parvum
PVGTCSSTSIGNSNGVAF

SEQ ID NO: 2353529 - protein, 21 aa, Cryptosporidium parvum
PVKEYYRFLDMESIAKESPYW

SEQ ID NO: 2353530 - protein, 26 aa, Cryptosporidium parvum
PVLRLLKYWLHIRRLPVAKDGGLPCI

SEQ ID NO: 2353531 - protein, 17 aa, Cryptosporidium parvum
PVNEIKTNLDITTNLDE

SEQ ID NO: 2353532 - protein, 31 aa, Cryptosporidium parvum; identical to SEQ ID NO: 2179444

SEQ ID NO: 2353533 - protein, 24 aa, Cryptosporidium parvum
PVPPNCIRPSVTMGESGSNEDDLT

SEQ ID NO: 2353534 - protein, 20 aa, Cryptosporidium parvum
PVSLSLKFAKAMVDHYPERL

SEQ ID NO: 2353535 - protein, 19 aa, Cryptosporidium parvum
PWGGVTLIPFIDEFLLLDS

SEQ ID NO: 2353536 - protein, 20 aa, Cryptosporidium parvum
PYDLSGYIEGLKLEGRVIKV

SEQ ID NO: 2353537 - protein, 18 aa, Cryptosporidium parvum
PYKSSVILREPRVLVDGW

SEQ ID NO: 2353538 - protein, 18 aa, Cryptosporidium parvum
PYNTIGIRIPNIELIKQR

SEQ ID NO: 2353539 - protein, 19 aa, Cryptosporidium parvum
QADINSCIKLFPMIENNIK

SEQ ID NO: 2353540 - protein, 23 aa, Cryptosporidium parvum
QAFKEGRYRCLVATDVAARGLHI

SEQ ID NO: 2353541 - protein, 35 aa, Cryptosporidium parvum; identical to SEQ ID NO: 2179500

SEQ ID NO: 2353542 - protein, 34 aa, Cryptosporidium parvum
QAVKTIHKLASFYVRDILKFILNEESISNDKLNG

SEQ ID NO: 2353543 - protein, 23 aa, Cryptosporidium parvum
QAVMSYPLITQWYKEMEQSADTE

SEQ ID NO: 2353544 - protein, 26 aa, Cryptosporidium parvum
QCQARLKELYSLGIVEFEGSNREEFL

SEQ ID NO: 2353545 - protein, 21 aa, Cryptosporidium parvum
QDDLSALIWTDIRHFAFILFK

SEQ ID NO: 2353546 - protein, 24 aa, Cryptosporidium parvum
QDEAAKCLQEFYSEWAQNKGMVSR

SEQ ID NO: 2353547 - protein, 17 aa, Cryptosporidium parvum
QDFKFNVMIKIIKATML

SEQ ID NO: 2353548 - protein, 17 aa, Cryptosporidium parvum
QDISALAEDCLRVSSIS

SEQ ID NO: 2353549 - protein, 21 aa, Cryptosporidium parvum
QDLLEIYSKYFIQKTRPRESI

SEQ ID NO: 2353550 - protein, 17 aa, Cryptosporidium parvum
QDLPLMLRGLELLSRSD

SEQ ID NO: 2353551 - protein, 28 aa, Cryptosporidium parvum
QDLTRTGFIIFWGGRELDSFNIGNNITN

SEQ ID NO: 2353552 - protein, 31 aa, Cryptosporidium parvum; identical to SEQ ID NO: 2301891

SEQ ID NO: 2353553 - protein, 21 aa, Cryptosporidium parvum
QDYSYEFLNLLLSKEETDNLV

SEQ ID NO: 2353554 - protein, 18 aa, Cryptosporidium parvum
QECLEILKYSSRTRQTML

SEQ ID NO: 2353555 - protein, 20 aa, Cryptosporidium parvum
QEFTLCSGYDIHKQKISIKT

SEQ ID NO: 2353556 - protein, 19 aa, Cryptosporidium parvum
QEIDLPDVMSIRLDRKLSA

SEQ ID NO: 2353557 - protein, 39 aa, Cryptosporidium parvum; identical to SEQ ID NO: 2301919

SEQ ID NO: 2353558 - protein, 24 aa, Cryptosporidium parvum
QELDLKIGVAFSRLQTKYLKSKFG

SEQ ID NO: 2353559 - protein, 18 aa, Cryptosporidium parvum
QELESIKLGQCLNSTRNI

SEQ ID NO: 2353560 - protein, 36 aa, Cryptosporidium parvum
QEPAKCLLIGSPFKLPCSKGCHLRTDILPFLHDIIG

SEQ ID NO: 2353561 - protein, 32 aa, Cryptosporidium parvum; identical to SEQ ID NO: 2301942

SEQ ID NO: 2353562 - protein, 26 aa, Cryptosporidium parvum
QFIASSSFCLPNWFSSSKISKESYFK

SEQ ID NO: 2353563 - protein, 25 aa, Cryptosporidium parvum
QFPTEFQFHPNLLIIIADHLNNSLF

SEQ ID NO: 2353564 - protein, 19 aa, Cryptosporidium parvum
QFYSCEIHISLPILSTNSH

SEQ ID NO: 2353565 - protein, 21 aa, Cryptosporidium parvum
QGDIPYCDTILYLDNPKPKKY

SEQ ID NO: 2353566 - protein, 27 aa, Cryptosporidium parvum
QGIQDLFGSISICNSPEIFKITYKIPF

SEQ ID NO: 2353567 - protein, 27 aa, Cryptosporidium parvum
QGNMFCSCCTCPMQQQFPSCQCGTNYF

SEQ ID NO: 2353568 - protein, 17 aa, Cryptosporidium parvum
QGSFAIVERLEKLINKY

SEQ ID NO: 2353569 - protein, 20 aa, Cryptosporidium parvum
QHDICKDFKETGYCGFGDTC

SEQ ID NO: 2353570 - protein, 24 aa, Cryptosporidium parvum
QHKKFKRMLLFSLRSLSDLCVPPT

SEQ ID NO: 2353571 - protein, 19 aa, Cryptosporidium parvum
QIEQVWKLLWSLTTFGSQN

SEQ ID NO: 2353572 - protein, 18 aa, Cryptosporidium parvum
QIINNGVLRSGYQTLSSI

SEQ ID NO: 2353573 - protein, 26 aa, Cryptosporidium parvum
QILKFILNYCKKCFENIMNGESVNKR

SEQ ID NO: 2353574 - protein, 18 aa, Cryptosporidium parvum
QIRAACRVLNSIGNYVDI

SEQ ID NO: 2353575 - protein, 25 aa, Cryptosporidium parvum
QKELKRLKLVVIDPITSLLGSHNFI

SEQ ID NO: 2353576 - protein, 25 aa, Cryptosporidium parvum
QKLKLPIIYQCYGDFYYYHYNHDNF

SEQ ID NO: 2353577 - protein, 18 aa, Cryptosporidium parvum
QKSMRWQPISVIHNQLAL

SEQ ID NO: 2353578 - protein, 20 aa, Cryptosporidium parvum
QKSRVAIAIMAYLNPHLLIL

SEQ ID NO: 2353579 - protein, 22 aa, Cryptosporidium parvum
QLCLECIEWCLEEKRTFLRHRI

SEQ ID NO: 2353580 - protein, 24 aa, Cryptosporidium parvum
QLLGERLFPIIAQFQPELAGKITG

SEQ ID NO: 2353581 - protein, 20 aa, Cryptosporidium parvum
QLMPSIPGVYFDRRQIGYRV

SEQ ID NO: 2353582 - protein, 24 aa, Cryptosporidium parvum
QLVAYSLYWLLKFTNSTNVPIYSI

SEQ ID NO: 2353583 - protein, 27 aa, Cryptosporidium parvum
QMCDRFIRDIPRGFFYAYFLNPLILLA

SEQ ID NO: 2353584 - protein, 25 aa, Cryptosporidium parvum
QMGTKSFGGSRMGVAQSKGMAHTQQ

SEQ ID NO: 2353585 - protein, 21 aa, Cryptosporidium parvum
QMTDLGFNIEVNWDPSNGLIF

SEQ ID NO: 2353586 - protein, 29 aa, Cryptosporidium parvum
QNEEVQYRIPLLNCHVGDWQPVDSDRVVF

SEQ ID NO: 2353587 - protein, 23 aa, Cryptosporidium parvum
QNFCPHIPFPPWSGSTTNQNKEE

SEQ ID NO: 2353588 - protein, 22 aa, Cryptosporidium parvum
QNFRSLETFKSLISDNNGSIKN

SEQ ID NO: 2353589 - protein, 20 aa, Cryptosporidium parvum
QNISEYKKSVGVMEGSYVDR

SEQ ID NO: 2353590 - protein, 17 aa, Cryptosporidium parvum
QNLKIDLNNTVLILDEA

SEQ ID NO: 2353591 - protein, 25 aa, Cryptosporidium parvum
QNLPKREVIQNFKLKASDQSEDSNS

SEQ ID NO: 2353592 - protein, 20 aa, Cryptosporidium parvum
QNSTLDWTRDERKMFRLESS

SEQ ID NO: 2353593 - protein, 30 aa, Cryptosporidium parvum; identical to SEQ ID NO: 2302181

SEQ ID NO: 2353594 - protein, 17 aa, Cryptosporidium parvum
QNYLVWIKDLEQIDLGI

SEQ ID NO: 2353595 - protein, 24 aa, Cryptosporidium parvum
QPEIGESIVDAWGVGNTFDSFIKG

SEQ ID NO: 2353596 - protein, 27 aa, Cryptosporidium parvum
QPQKLPKLRGFLSMNSLAHLGRQSFGT

SEQ ID NO: 2353597 - protein, 23 aa, Cryptosporidium parvum
QRFIDRFRCNASRASLVQSRIKY

SEQ ID NO: 2353598 - protein, 23 aa, Cryptosporidium parvum
QRGNPILAHVCNVPYDFQNIVPD

SEQ ID NO: 2353599 - protein, 24 aa, Cryptosporidium parvum
QRKGLPTQHKIVMAAEKQRTLNKK

SEQ ID NO: 2353600 - protein, 19 aa, Cryptosporidium parvum
QRKNLPIYPMRDSLVDAIR

SEQ ID NO: 2353601 - protein, 23 aa, Cryptosporidium parvum
QRKSSILLECIQGFVKMMKGLPN

SEQ ID NO: 2353602 - protein, 24 aa, Cryptosporidium parvum
QRMIHRDMILYISFQEEIMSQRNQ

SEQ ID NO: 2353603 - protein, 25 aa, Cryptosporidium parvum
QRVTPSYYPNPMIKMPGQSMENFKA

SEQ ID NO: 2353604 - protein, 25 aa, Cryptosporidium parvum
QSELEIVEGLKLDKGYISPYFITNQ

SEQ ID NO: 2353605 - protein, 22 aa, Cryptosporidium parvum
QSLLLCDIAWIFQSMKNISSNL

SEQ ID NO: 2353606 - protein, 23 aa, Cryptosporidium parvum
QSLQKRLEVVHNFYTHESLVTSN

SEQ ID NO: 2353607 - protein, 31 aa, Cryptosporidium parvum; identical to SEQ ID NO: 2179898

SEQ ID NO: 2353608 - protein, 24 aa, Cryptosporidium parvum
QSQKEWNHIYALQNYIIERKGEMR

SEQ ID NO: 2353609 - protein, 21 aa, Cryptosporidium parvum
QSQYFMWEIFIGFTDPNPNTR

SEQ ID NO: 2353610 - protein, 19 aa, Cryptosporidium parvum
QSRKSWTTRIEKILKAAAF

SEQ ID NO: 2353611 - protein, 25 aa, Cryptosporidium parvum
QSVLRPLRGFRCMGSMGRSKTKKNN

SEQ ID NO: 2353612 - protein, 25 aa, Cryptosporidium parvum
QSYLKALRIARKEFETFINNAQQSW

SEQ ID NO: 2353613 - protein, 21 aa, Cryptosporidium parvum
QTCHLAHRMGLAPSKSDLEQL

SEQ ID NO: 2353614 - protein, 27 aa, Cryptosporidium parvum
QTTQWAVGLTRVFLKIEAFRDLEQLRV

SEQ ID NO: 2353615 - protein, 20 aa, Cryptosporidium parvum
QTYPGLVSFGNQILKQVNKD

SEQ ID NO: 2353616 - protein, 19 aa, Cryptosporidium parvum
QVDDDCCLCLDALNRDLVK

SEQ ID NO: 2353617 - protein, 25 aa, Cryptosporidium parvum
QVFQDCSRMTTTTTVPSTFTTQTTA

SEQ ID NO: 2353618 - protein, 24 aa, Cryptosporidium parvum
QVIEHPWFKSYHLMNFHEDNKVSF

SEQ ID NO: 2353619 - protein, 24 aa, Cryptosporidium parvum
QVILPPKLLFKLPKHHVLKSLPLF

SEQ ID NO: 2353620 - protein, 26 aa, Cryptosporidium parvum
QVLDLWKLSILIGGGISQIGSSSNNI

SEQ ID NO: 2353621 - protein, 20 aa, Cryptosporidium parvum
QYTEACLQSLVAAAAEYPTD

SEQ ID NO: 2353622 - protein, 18 aa, Cryptosporidium parvum
QYTISWLKMGIFALNDIK

SEQ ID NO: 2353623 - protein, 19 aa, Cryptosporidium parvum
RAAIVVKKCKNAIQKYLEC

SEQ ID NO: 2353624 - protein, 26 aa, Cryptosporidium parvum
RADAQEFKPTFGITGSNVIPNSGIYY

SEQ ID NO: 2353625 - protein, 24 aa, Cryptosporidium parvum
RAFSTEIDYNWFLSPHNRILIENI

SEQ ID NO: 2353626 - protein, 31 aa, Cryptosporidium parvum; identical to SEQ ID NO: 2180000

SEQ ID NO: 2353627 - protein, 21 aa, Cryptosporidium parvum
RAHTPRYLWEKIKLSNNFLVA

SEQ ID NO: 2353628 - protein, 18 aa, Cryptosporidium parvum
RAKDWLNQIEELYKPLEY

SEQ ID NO: 2353629 - protein, 17 aa, Cryptosporidium parvum
RAKLYFEGNTWKVDEIY

SEQ ID NO: 2353630 - protein, 18 aa, Cryptosporidium parvum
RAKYKFPGRQKVVVSDKW

SEQ ID NO: 2353631 - protein, 23 aa, Cryptosporidium parvum
RANNIKVSASMFVEDLATGLKGM

SEQ ID NO: 2353632 - protein, 19 aa, Cryptosporidium parvum
RARMAERKAAAAAAAAAAA

SEQ ID NO: 2353633 - protein, 17 aa, Cryptosporidium parvum
RAYNISIALSKFSAYTF

SEQ ID NO: 2353634 - protein, 18 aa, Cryptosporidium parvum
RCALLPTPDYRILNLGGI

SEQ ID NO: 2353635 - protein, 19 aa, Cryptosporidium parvum
RCQTFPAIGEVTMMKKDGT

SEQ ID NO: 2353636 - protein, 19 aa, Cryptosporidium parvum
RCVAFWGNMNIMIEKILQL

SEQ ID NO: 2353637 - protein, 23 aa, Cryptosporidium parvum
RDCKRCYYLSLEFLLGRAMQNAL

SEQ ID NO: 2353638 - protein, 20 aa, Cryptosporidium parvum
RDEFTWRASQDLYKLEWKVG

SEQ ID NO: 2353639 - protein, 19 aa, Cryptosporidium parvum
RDELRRLRESDRFKYEKYI

SEQ ID NO: 2353640 - protein, 20 aa, Cryptosporidium parvum
RDEYKIECIVAPYEADAQLS

SEQ ID NO: 2353641 - protein, 19 aa, Cryptosporidium parvum
RDHCPEIFSQFLTPSMYAK

SEQ ID NO: 2353642 - protein, 19 aa, Cryptosporidium parvum
RDHKNWTALHIGVSKKFPE

SEQ ID NO: 2353643 - protein, 26 aa, Cryptosporidium parvum
RDIWSIGCVMYCILNGSPPFFGQDTR

SEQ ID NO: 2353644 - protein, 27 aa, Cryptosporidium parvum
RDLAYRLCFLACHIEVVNAIASADDGR

SEQ ID NO: 2353645 - protein, 18 aa, Cryptosporidium parvum
RDLFPALWVPDLFMERVE

SEQ ID NO: 2353646 - protein, 21 aa, Cryptosporidium parvum
RDPRRSLLIRSLRFDTPTSLV

SEQ ID NO: 2353647 - protein, 18 aa, Cryptosporidium parvum
RDSSSKWSKIDFSEISDF

SEQ ID NO: 2353648 - protein, 24 aa, Cryptosporidium parvum
REEKWWESIYNYYSQIYIPGYLFG

SEQ ID NO: 2353649 - protein, 17 aa, Cryptosporidium parvum
REGEIMKHLSVQEAETT

SEQ ID NO: 2353650 - protein, 17 aa, Cryptosporidium parvum
REIESVCNVVLLPYNYL

SEQ ID NO: 2353651 - protein, 23 aa, Cryptosporidium parvum
REIKIILDIHGKKYRCRYISGKI

SEQ ID NO: 2353652 - protein, 17 aa, Cryptosporidium parvum
REIKRMEHILNMRILEE

SEQ ID NO: 2353653 - protein, 21 aa, Cryptosporidium parvum
RELFKQYVVPIVDEVLLGFNC

SEQ ID NO: 2353654 - protein, 20 aa, Cryptosporidium parvum
RELKSSGISDGFTIELFDTD

SEQ ID NO: 2353655 - protein, 22 aa, Cryptosporidium parvum
RENLKKCLNILELLSMDIEEQV

SEQ ID NO: 2353656 - protein, 21 aa, Cryptosporidium parvum
RERLARLTGRVALIKIGGYSD

SEQ ID NO: 2353657 - protein, 19 aa, Cryptosporidium parvum
REVGWREVENTDLLVRLND

SEQ ID NO: 2353658 - protein, 27 aa, Cryptosporidium parvum
REVVEMPLLHPERFVQLGIDPPKGVLL

SEQ ID NO: 2353659 - protein, 28 aa, Cryptosporidium parvum
RFFKDLDYKAIFTWKRFNQIKYVLDTRS

SEQ ID NO: 2353660 - protein, 20 aa, Cryptosporidium parvum
RFVHRSRLLAHKEVVPQAVW

SEQ ID NO: 2353661 - protein, 19 aa, Cryptosporidium parvum
RFWDFRMINSPIYEHKTNG

SEQ ID NO: 2353662 - protein, 44 aa, Cryptosporidium parvum; identical to SEQ ID NO: 2302636

SEQ ID NO: 2353663 - protein, 24 aa, Cryptosporidium parvum
RGFPEMAVILAFDIKVDAEAEVEA

SEQ ID NO: 2353664 - protein, 23 aa, Cryptosporidium parvum
RGGKDICNSCVDLKELLVSVCGE

SEQ ID NO: 2353665 - protein, 20 aa, Cryptosporidium parvum
RGIAEIVLLAADAEPLEILL

SEQ ID NO: 2353666 - protein, 20 aa, Cryptosporidium parvum
RGIDKLPPMHDWQFYDKKRI

SEQ ID NO: 2353667 - protein, 26 aa, Cryptosporidium parvum
RGIHIPLSLAGKYFGLLKNERTKGDK

SEQ ID NO: 2353668 - protein, 17 aa, Cryptosporidium parvum
RGKSSKYGSGAVGGGSS

SEQ ID NO: 2353669 - protein, 19 aa, Cryptosporidium parvum
RGLIELIVHPLCIDDPAPW

SEQ ID NO: 2353670 - protein, 23 aa, Cryptosporidium parvum
RGPSRCPITLWFDQYNMKVVLED

SEQ ID NO: 2353671 - protein, 23 aa, Cryptosporidium parvum
RGRKTMKAQKLWFLILQAQIETG

SEQ ID NO: 2353672 - protein, 18 aa, Cryptosporidium parvum
RGTVKFANQLFEQEKGYL

SEQ ID NO: 2353673 - protein, 18 aa, Cryptosporidium parvum
RHGCCTMLLYEIIRRLSI

SEQ ID NO: 2353674 - protein, 24 aa, Cryptosporidium parvum
RIIIGSLRVLARVASNPSNVDNLI

SEQ ID NO: 2353675 - protein, 30 aa, Cryptosporidium parvum; identical to SEQ ID NO: 2302741

SEQ ID NO: 2353676 - protein, 17 aa, Cryptosporidium parvum
RINNPVCEYITSFSKCD

SEQ ID NO: 2353677 - protein, 28 aa, Cryptosporidium parvum
RIPNPHSLMPLRSCFSSRNGLWVASAAE

SEQ ID NO: 2353678 - protein, 30 aa, Cryptosporidium parvum
RIREDEAISRFFSWFSELICSRNHIIDPIL

SEQ ID NO: 2353679 - protein, 18 aa, Cryptosporidium parvum
RITCGTWLVYLYELKRCH

SEQ ID NO: 2353680 - protein, 21 aa, Cryptosporidium parvum
RIVELIPRKSIVFDLTCGAGA

SEQ ID NO: 2353681 - protein, 22 aa, Cryptosporidium parvum
RIYEIYLNLVIYCEQSVLGKVY

SEQ ID NO: 2353682 - protein, 21 aa, Cryptosporidium parvum
RIYPHLNNMDGFFVAKLKKIS

SEQ ID NO: 2353683 - protein, 17 aa, Cryptosporidium parvum
RKDYSFNSVAEMNIAAS

SEQ ID NO: 2353684 - protein, 20 aa, Cryptosporidium parvum
RKEEEFKRKVQQGIQETYLE

SEQ ID NO: 2353685 - protein, 20 aa, Cryptosporidium parvum
RKLLKSEFWGTIVEHLETEI

SEQ ID NO: 2353686 - protein, 26 aa, Cryptosporidium parvum
RKLLSECGTILRWSRQEDPTTKKLSS

SEQ ID NO: 2353687 - protein, 21 aa, Cryptosporidium parvum
RKMGVFRLSFDPRRLNEWILN

SEQ ID NO: 2353688 - protein, 19 aa, Cryptosporidium parvum
RKPIPGHFYGTYRSQNLKI

SEQ ID NO: 2353689 - protein, 23 aa, Cryptosporidium parvum
RKSRELWEKISYEKARLEEYGNS

SEQ ID NO: 2353690 - protein, 17 aa, Cryptosporidium parvum
RKTLLSFLELVSEKDNE

SEQ ID NO: 2353691 - protein, 24 aa, Cryptosporidium parvum
RKYKLDILCEITFPISEYSDNLPI

SEQ ID NO: 2353692 - protein, 17 aa, Cryptosporidium parvum
RLEGFSGTMSENIFYEN

SEQ ID NO: 2353693 - protein, 23 aa, Cryptosporidium parvum
RLENFSKFKSGQVDILFASELAA

SEQ ID NO: 2353694 - protein, 19 aa, Cryptosporidium parvum
RLEVKISNMIRNMKTPKHI

SEQ ID NO: 2353695 - protein, 20 aa, Cryptosporidium parvum
RLHLKAFPLFSTQLNISKRN

SEQ ID NO: 2353696 - protein, 17 aa, Cryptosporidium parvum
RLIDDFIILGFIVGNDF

SEQ ID NO: 2353697 - protein, 23 aa, Cryptosporidium parvum
RLKGNEELNGFVGISRVFNGNIK

SEQ ID NO: 2353698 - protein, 20 aa, Cryptosporidium parvum
RLKLNQLKHELNFKFISSSN

SEQ ID NO: 2353699 - protein, 18 aa, Cryptosporidium parvum
RLLRLSSYPFSKLGLLES

SEQ ID NO: 2353700 - protein, 20 aa, Cryptosporidium parvum
RLSSCPTFSSIATSWGTPVP

SEQ ID NO: 2353701 - protein, 22 aa, Cryptosporidium parvum
RLTDCHHLLAIFCEKNRIEYPK

SEQ ID NO: 2353702 - protein, 18 aa, Cryptosporidium parvum
RLTETLVNKEHELMIKEN

SEQ ID NO: 2353703 - protein, 25 aa, Cryptosporidium parvum
RLWENKTPKLSSIWRRNEESKNLIV

SEQ ID NO: 2353704 - protein, 32 aa, Cryptosporidium parvum; identical to SEQ ID NO: 2180490

SEQ ID NO: 2353705 - protein, 27 aa, Cryptosporidium parvum
RLYYKSDFTRFMLNLIINKSDPKLTSP

SEQ ID NO: 2353706 - protein, 24 aa, Cryptosporidium parvum
RMLTNRVVTLWYRPPELLLGAQFY

SEQ ID NO: 2353707 - protein, 17 aa, Cryptosporidium parvum
RMRSHLDNVLFGTIYAE

SEQ ID NO: 2353708 - protein, 37 aa, Cryptosporidium parvum; identical to SEQ ID NO: 2302980

SEQ ID NO: 2353709 - protein, 18 aa, Cryptosporidium parvum
RNAPGQMGTKSFGGSRMG

SEQ ID NO: 2353710 - protein, 25 aa, Cryptosporidium parvum
RNFGSKELDRDGGHRGRGWSGNLSH

SEQ ID NO: 2353711 - protein, 17 aa, Cryptosporidium parvum
RNGIFSYNFYNNNADDM

SEQ ID NO: 2353712 - protein, 28 aa, Cryptosporidium parvum
RNINSVKICNAVRCKKCGIWTEGNANLI

SEQ ID NO: 2353713 - protein, 23 aa, Cryptosporidium parvum
RNKSGKIGKRWFKDGVLNGAEEE

SEQ ID NO: 2353714 - protein, 30 aa, Cryptosporidium parvum; identical to SEQ ID NO: 2180545

SEQ ID NO: 2353715 - protein, 24 aa, Cryptosporidium parvum
RNNSAWCYRHFIFTNLKKMNALKE

SEQ ID NO: 2353716 - protein, 25 aa, Cryptosporidium parvum
RNSIRFCDQIIFFLKKNWGIFYKKV

SEQ ID NO: 2353717 - protein, 17 aa, Cryptosporidium parvum
RNSRWRGASEDNFNTIK

SEQ ID NO: 2353718 - protein, 21 aa, Cryptosporidium parvum
RNSWMHIFSFDSAIPRSNQRE

SEQ ID NO: 2353719 - protein, 23 aa, Cryptosporidium parvum
RNTLHPRSDLVMMSTLTESNSKL

SEQ ID NO: 2353720 - protein, 36 aa, Cryptosporidium parvum
RNYGERFLDVVLPGVCSRIACLIPHPVSPGIVLSLT

SEQ ID NO: 2353721 - protein, 26 aa, Cryptosporidium parvum
RNYHIFYCLAAGVSKGIFPESISEEL

SEQ ID NO: 2353722 - protein, 19 aa, Cryptosporidium parvum
RNYLNENIHLFYNKRDEVE

SEQ ID NO: 2353723 - protein, 25 aa, Cryptosporidium parvum
RPCEACSSLKGVVLYPLTENVGIEE

SEQ ID NO: 2353724 - protein, 24 aa, Cryptosporidium parvum
RPEHILKKSLDFVYNNYIKYSSSK

SEQ ID NO: 2353725 - protein, 26 aa, Cryptosporidium parvum
RPFFQRLTDSIYRRLIIGSSNQIKLV

SEQ ID NO: 2353726 - protein, 17 aa, Cryptosporidium parvum
RPIRLLYYNDLHYDSLF

SEQ ID NO: 2353727 - protein, 18 aa, Cryptosporidium parvum
RPIYVGKFQKKAERFSEK

SEQ ID NO: 2353728 - protein, 17 aa, Cryptosporidium parvum
RPLGIGIQGLADCFMML

SEQ ID NO: 2353729 - protein, 19 aa, Cryptosporidium parvum
RPNIGRFSVNPGNLNVNGT

SEQ ID NO: 2353730 - protein, 19 aa, Cryptosporidium parvum
RPNQLESFSLDNIGALPKN

SEQ ID NO: 2353731 - protein, 24 aa, Cryptosporidium parvum
RQKLERFGLRFISKVRDFVDSKST

SEQ ID NO: 2353732 - protein, 19 aa, Cryptosporidium parvum
RQTEISRYFSAKRYGVEKS

SEQ ID NO: 2353733 - protein, 18 aa, Cryptosporidium parvum
RQTMLFSATLSRSVTDLA

SEQ ID NO: 2353734 - protein, 24 aa, Cryptosporidium parvum
RQVYILGWLIHLRILNRIVDNIFI

SEQ ID NO: 2353735 - protein, 18 aa, Cryptosporidium parvum
RREDIVLVGATIGSGQAS

SEQ ID NO: 2353736 - protein, 18 aa, Cryptosporidium parvum
RRGGSPGRHHTMDGTGMP

SEQ ID NO: 2353737 - protein, 17 aa, Cryptosporidium parvum
RRLWCKRCNTHFIPGIT

SEQ ID NO: 2353738 - protein, 30 aa, Cryptosporidium parvum; identical to SEQ ID NO: 2180697

SEQ ID NO: 2353739 - protein, 31 aa, Cryptosporidium parvum; identical to SEQ ID NO: 2303175

SEQ ID NO: 2353740 - protein, 20 aa, Cryptosporidium parvum
RRPIYTIPRSVIVDRNKRMY

SEQ ID NO: 2353741 - protein, 19 aa, Cryptosporidium parvum
RRPTFPFVSILATSHLCKG

SEQ ID NO: 2353742 - protein, 18 aa, Cryptosporidium parvum
RRQCSFSEAKYGKEAASL

SEQ ID NO: 2353743 - protein, 29 aa, Cryptosporidium parvum
RRQSYSIPILRERCLSPMKYVDYYIETLP

SEQ ID NO: 2353744 - protein, 18 aa, Cryptosporidium parvum
RRRIKIRNSHIFNNSDEL

SEQ ID NO: 2353745 - protein, 20 aa, Cryptosporidium parvum
RRSSEYEYKISHADNKGSIE

SEQ ID NO: 2353746 - protein, 30 aa, Cryptosporidium parvum; identical to SEQ ID NO: 2180718

SEQ ID NO: 2353747 - protein, 27 aa, Cryptosporidium parvum
RSDFKSGWKLDKEWEIEQKKKRLKIES

SEQ ID NO: 2353748 - protein, 25 aa, Cryptosporidium parvum
RSHNLEFKTSFPYVSNGGVMQVVSN

SEQ ID NO: 2353749 - protein, 17 aa, Cryptosporidium parvum
RSLPIGISIEPSSDWGL

SEQ ID NO: 2353750 - protein, 29 aa, Cryptosporidium parvum
RSMISTSYFLSCRILPYLWSFYESYPTYK

SEQ ID NO: 2353751 - protein, 21 aa, Cryptosporidium parvum
RSNIDYARAFIGHDFKNGSKP

SEQ ID NO: 2353752 - protein, 17 aa, Cryptosporidium parvum
RSNIPLICESFVDNQEN

SEQ ID NO: 2353753 - protein, 18 aa, Cryptosporidium parvum
RSNKFSGDGFIFGPTSTN

SEQ ID NO: 2353754 - protein, 20 aa, Cryptosporidium parvum
RSQKICGLILFDSIRMLVSV

SEQ ID NO: 2353755 - protein, 24 aa, Cryptosporidium parvum
RSSQPKSAFKRCIEDEMMITTISS

SEQ ID NO: 2353756 - protein, 29 aa, Cryptosporidium parvum
RSSRSHAILRIKIESHINSNDVCVGILNF

SEQ ID NO: 2353757 - protein, 17 aa, Cryptosporidium parvum
RSTRSENQINLKIKNEI

SEQ ID NO: 2353758 - protein, 20 aa, Cryptosporidium parvum
RTDACFICVIGSELVQKYVG

SEQ ID NO: 2353759 - protein, 21 aa, Cryptosporidium parvum
RTDIKSCIMEFFLYSKKELIL

SEQ ID NO: 2353760 - protein, 26 aa, Cryptosporidium parvum
RTDINILSFLSFRFELEDEFDSCNKH

SEQ ID NO: 2353761 - protein, 19 aa, Cryptosporidium parvum
RTIGRVRIGKFILDTWYFS

SEQ ID NO: 2353762 - protein, 18 aa, Cryptosporidium parvum
RTKCVTTTSTTPVQTGTT

SEQ ID NO: 2353763 - protein, 19 aa, Cryptosporidium parvum
RTKDNIKLRGDINVCIVGD

SEQ ID NO: 2353764 - protein, 18 aa, Cryptosporidium parvum
RTLCRVCGKHILKQKFAT

SEQ ID NO: 2353765 - protein, 23 aa, Cryptosporidium parvum
RTLEGFYSMEMIQKFRLKSNSDI

SEQ ID NO: 2353766 - protein, 17 aa, Cryptosporidium parvum
RTSESKASLRKFLESTI

SEQ ID NO: 2353767 - protein, 17 aa, Cryptosporidium parvum
RTTYCYVSFRKDLVETL

SEQ ID NO: 2353768 - protein, 21 aa, Cryptosporidium parvum
RTVCTKERFQFLHISILRDYI

SEQ ID NO: 2353769 - protein, 19 aa, Cryptosporidium parvum
RVADCYSNLGLVYRLLGDC

SEQ ID NO: 2353770 - protein, 25 aa, Cryptosporidium parvum
RVIYWKDLYKSGVISQLMFSYETFV

SEQ ID NO: 2353771 - protein, 25 aa, Cryptosporidium parvum
RVRHKLCNSKGYWPRIKIEIPEKNE

SEQ ID NO: 2353772 - protein, 24 aa, Cryptosporidium parvum
RWKHYEDFNTLFLQFEEFSTNKEV

SEQ ID NO: 2353773 - protein, 18 aa, Cryptosporidium parvum
RYAGVLFKNPQFHERIDC

SEQ ID NO: 2353774 - protein, 22 aa, Cryptosporidium parvum
RYESTFLKKLCQSIETDVVNGH

SEQ ID NO: 2353775 - protein, 17 aa, Cryptosporidium parvum
RYGRGNSGFQWRDELRN

SEQ ID NO: 2353776 - protein, 26 aa, Cryptosporidium parvum
RYGVEKSYEMALRFYQVNIIGNFGND

SEQ ID NO: 2353777 - protein, 18 aa, Cryptosporidium parvum
RYSKFKTECDVSCVLYSY

SEQ ID NO: 2353778 - protein, 35 aa, Cryptosporidium parvum; identical to SEQ ID NO: 2180915

SEQ ID NO: 2353779 - protein, 28 aa, Cryptosporidium parvum
SAKSCSCSCPLVTFSSSNSFLIQLKSGE

SEQ ID NO: 2353780 - protein, 21 aa, Cryptosporidium parvum
SAMLDCVRDPAKHIIQGLWRK

SEQ ID NO: 2353781 - protein, 21 aa, Cryptosporidium parvum
SATTCKAGTAQSEAVTSQVCY

SEQ ID NO: 2353782 - protein, 17 aa, Cryptosporidium parvum
SCRYCKKTSNSTGMEKI

SEQ ID NO: 2353783 - protein, 18 aa, Cryptosporidium parvum
SDIIKCLPHKEHVEPLIK

SEQ ID NO: 2353784 - protein, 24 aa, Cryptosporidium parvum
SDILRCMKRQKSLHCDTMDFHVLV

SEQ ID NO: 2353785 - protein, 22 aa, Cryptosporidium parvum
SDLEVAELICEMYDQCSKGDYS

SEQ ID NO: 2353786 - protein, 25 aa, Cryptosporidium parvum
SDLFIHGSLYHLALMKRREFPEVLL

SEQ ID NO: 2353787 - protein, 32 aa, Cryptosporidium parvum; identical to SEQ ID NO: 2303540

SEQ ID NO: 2353788 - protein, 21 aa, Cryptosporidium parvum
SDLWSTGMAYKIVIITNAGLR

SEQ ID NO: 2353789 - protein, 20 aa, Cryptosporidium parvum
SDMLFELKKLPLWNDHDNNP

SEQ ID NO: 2353790 - protein, 20 aa, Cryptosporidium parvum
SDNACRGVIIAGLPFPSIAD

SEQ ID NO: 2353791 - protein, 23 aa, Cryptosporidium parvum
SDRKSLELAGLWNNILKKVKRKD

SEQ ID NO: 2353792 - protein, 19 aa, Cryptosporidium parvum
SDTALKFISKFQVKLSDFN

SEQ ID NO: 2353793 - protein, 24 aa, Cryptosporidium parvum
SDTLLCIIQRVSLLWENKDFEFFE

SEQ ID NO: 2353794 - protein, 18 aa, Cryptosporidium parvum
SDVKSCLNTKKTAKKVEG

SEQ ID NO: 2353795 - protein, 24 aa, Cryptosporidium parvum
SEAIARLLPYHTFYVDEIKSNRIS

SEQ ID NO: 2353796 - protein, 22 aa, Cryptosporidium parvum
SECLPSKCIQPICIFNEEPSIY

SEQ ID NO: 2353797 - protein, 18 aa, Cryptosporidium parvum
SEFWGTIVEHLETEIFEN

SEQ ID NO: 2353798 - protein, 24 aa, Cryptosporidium parvum
SEIKKSYRKLALKWHPDKNPDNRE

SEQ ID NO: 2353799 - protein, 25 aa, Cryptosporidium parvum
SELIPRGKQVLGFDIGIGANCIFSL

SEQ ID NO: 2353800 - protein, 24 aa, Cryptosporidium parvum
SELRRRHSNELQRFETIIDDLKKK

SEQ ID NO: 2353801 - protein, 18 aa, Cryptosporidium parvum
SELRWYKENFEQIKNDLL

SEQ ID NO: 2353802 - protein, 25 aa, Cryptosporidium parvum
SENQLKISYILVRVLAQLRMIESIL

SEQ ID NO: 2353803 - protein, 18 aa, Cryptosporidium parvum
SERLIPPRMSPLLRSQRQ

SEQ ID NO: 2353804 - protein, 25 aa, Cryptosporidium parvum
SESSARFILKQVVEALIYMHQKEII

SEQ ID NO: 2353805 - protein, 30 aa, Cryptosporidium parvum
SETFLPKDSRLVIYGKFKDNPLVSLIGEVP

SEQ ID NO: 2353806 - protein, 27 aa, Cryptosporidium parvum
SETIMYPYFAKWIRSHRDLPLKINQWT

SEQ ID NO: 2353807 - protein, 28 aa, Cryptosporidium parvum
SETLSEWRNELLLAILEKISESKMFQDT

SEQ ID NO: 2353808 - protein, 17 aa, Cryptosporidium parvum
SEVFKMDYELTQINIKY

SEQ ID NO: 2353809 - protein, 17 aa, Cryptosporidium parvum
SEYEVMEKTLIQRKEQL

SEQ ID NO: 2353810 - protein, 17 aa, Cryptosporidium parvum
SEYPMYVSLAVSVGRLV

SEQ ID NO: 2353811 - protein, 25 aa, Cryptosporidium parvum
SFALFKIRGMRGIISEEDFEVLQQK

SEQ ID NO: 2353812 - protein, 20 aa, Cryptosporidium parvum
SFCKDSCFAQAWSVGTILYF

SEQ ID NO: 2353813 - protein, 29 aa, Cryptosporidium parvum
SFDAAMPIWMIKRFVDLFNASRTTYCYVS

SEQ ID NO: 2353814 - protein, 26 aa, Cryptosporidium parvum
SFDPIFMKKCFQRLCGELEMTQNSQY

SEQ ID NO: 2353815 - protein, 19 aa, Cryptosporidium parvum
SFESLKLPQFEDSSSSYAE

SEQ ID NO: 2353816 - protein, 19 aa, Cryptosporidium parvum
SFGGDEVFVTGSFNFWRKQ

SEQ ID NO: 2353817 - protein, 26 aa, Cryptosporidium parvum
SFIIKSSQCPIIFSCRMAIVNNSKKE

SEQ ID NO: 2353818 - protein, 24 aa, Cryptosporidium parvum
SFNKSWNLFFSKFLNGFRLEMSDG

SEQ ID NO: 2353819 - protein, 23 aa, Cryptosporidium parvum
SFRSNLDYAKWVIEKGADVNAKD

SEQ ID NO: 2353820 - protein, 17 aa, Cryptosporidium parvum
SFSEGGLYVNLKNFEAY

SEQ ID NO: 2353821 - protein, 19 aa, Cryptosporidium parvum
SFSIKWWPLNEKFYKHEKL

SEQ ID NO: 2353822 - protein, 18 aa, Cryptosporidium parvum
SFTHLFSIINYERIINNC

SEQ ID NO: 2353823 - protein, 25 aa, Cryptosporidium parvum
SFTHVLGLCKPCVFVNKTNKKCRNG

SEQ ID NO: 2353824 - protein, 24 aa, Cryptosporidium parvum
SFYDRRVVSSKSKRLLKLCSYSRV

SEQ ID NO: 2353825 - protein, 22 aa, Cryptosporidium parvum
SGELPPPLPPSFGELPLPPPPP

SEQ ID NO: 2353826 - protein, 19 aa, Cryptosporidium parvum
SGGIQVYFDECLKDKKVFV

SEQ ID NO: 2353827 - protein, 19 aa, Cryptosporidium parvum
SGIPNLLVLGDYCEGALLH

SEQ ID NO: 2353828 - protein, 17 aa, Cryptosporidium parvum
SGISDGFTIELFDTDAE

SEQ ID NO: 2353829 - protein, 24 aa, Cryptosporidium parvum
SGLDEKIRVIKYLWETKRDFNIHE

SEQ ID NO: 2353830 - protein, 23 aa, Cryptosporidium parvum
SGLGPRKAKSLAFYLDSHPGPIS

SEQ ID NO: 2353831 - protein, 23 aa, Cryptosporidium parvum
SGLKELNPYYVLQGDSFSSSKIC

SEQ ID NO: 2353832 - protein, 19 aa, Cryptosporidium parvum
SGSDGPHMFGTSIKNNSDR

SEQ ID NO: 2353833 - protein, 23 aa, Cryptosporidium parvum
SGSSISTSIVNWAEKNNVSERAN

SEQ ID NO: 2353834 - protein, 31 aa, Cryptosporidium parvum; identical to SEQ ID NO: 2181345

SEQ ID NO: 2353835 - protein, 25 aa, Cryptosporidium parvum
SHVGLKKKRRAIWLGSEVENNAIKE

SEQ ID NO: 2353836 - protein, 24 aa, Cryptosporidium parvum
SIAKYSYHILICIINIIEDKSFQL

SEQ ID NO: 2353837 - protein, 20 aa, Cryptosporidium parvum
SIALGLCIINTILSDMLNIF

SEQ ID NO: 2353838 - protein, 21 aa, Cryptosporidium parvum
SIDVPRTFPELNIFRDQASQE

SEQ ID NO: 2353839 - protein, 17 aa, Cryptosporidium parvum
SIFCPRCYNDPPFLDAK

SEQ ID NO: 2353840 - protein, 21 aa, Cryptosporidium parvum
SIGAYGFEGSRQLAIEYRESM

SEQ ID NO: 2353841 - protein, 24 aa, Cryptosporidium parvum
SIGTRGRRGYGSGSCTTTTRSGRF

SEQ ID NO: 2353842 - protein, 32 aa, Cryptosporidium parvum; identical to SEQ ID NO: 2181384

SEQ ID NO: 2353843 - protein, 32 aa, Cryptosporidium parvum; identical to SEQ ID NO: 2303934

SEQ ID NO: 2353844 - protein, 19 aa, Cryptosporidium parvum
SILQWLKEYLNNFSQTSIC

SEQ ID NO: 2353845 - protein, 23 aa, Cryptosporidium parvum
SINFRDFHVRLIAILRSSQLVEI

SEQ ID NO: 2353846 - protein, 17 aa, Cryptosporidium parvum
SIPHESCFQDLEIVSSL

SEQ ID NO: 2353847 - protein, 37 aa, Cryptosporidium parvum
SIPSHGSHLPLLPPSRFPFQSEARRTINRLSDSTTKY

SEQ ID NO: 2353848 - protein, 18 aa, Cryptosporidium parvum
SIRLFGVFHDSFRNLLKK

SEQ ID NO: 2353849 - protein, 20 aa, Cryptosporidium parvum
SISLFPDRTGFAIGSIEGRC

SEQ ID NO: 2353850 - protein, 17 aa, Cryptosporidium parvum
SISRHGGHYNMHAKEDI

SEQ ID NO: 2353851 - protein, 19 aa, Cryptosporidium parvum
SIWELSHKSIYDVSKKTNY

SEQ ID NO: 2353852 - protein, 25 aa, Cryptosporidium parvum
SKASLRKFLESTIMDSGEDSINNGT

SEQ ID NO: 2353853 - protein, 19 aa, Cryptosporidium parvum
SKCGFYDSDFRNFEIKIKT

SEQ ID NO: 2353854 - protein, 24 aa, Cryptosporidium parvum
SKCIEVYRPGAIVLQCGADSVRGD

SEQ ID NO: 2353855 - protein, 18 aa, Cryptosporidium parvum
SKDKAFLCVVNMDKTEWL

SEQ ID NO: 2353856 - protein, 30 aa, Cryptosporidium parvum; identical to SEQ ID NO: 2181477

SEQ ID NO: 2353857 - protein, 17 aa, Cryptosporidium parvum
SKFLGAAANSWKPIEDG

SEQ ID NO: 2353858 - protein, 18 aa, Cryptosporidium parvum
SKGDYSLVEKIMNIQKAP

SEQ ID NO: 2353859 - protein, 24 aa, Cryptosporidium parvum
SKGGKDWRAGRCAGNNIIPASTGA

SEQ ID NO: 2353860 - protein, 23 aa, Cryptosporidium parvum
SKGLQNWIYRLFSTYRSNGTSKE

SEQ ID NO: 2353861 - protein, 26 aa, Cryptosporidium parvum
SKGMKNQFCKLVDNFVEETSKALIDE

SEQ ID NO: 2353862 - protein, 21 aa, Cryptosporidium parvum
SKGRPFGFVNFENPDSAKAAV

SEQ ID NO: 2353863 - protein, 20 aa, Cryptosporidium parvum
SKHRPPWRTSIDNIINAMQE

SEQ ID NO: 2353864 - protein, 27 aa, Cryptosporidium parvum
SKIIASIEYPLVISWGETYKIYLGNVF

SEQ ID NO: 2353865 - protein, 19 aa, Cryptosporidium parvum
SKILTYRSGSFIQANSQGY

SEQ ID NO: 2353866 - protein, 23 aa, Cryptosporidium parvum
SKILYNRIIELADIIWNHMEGLN

SEQ ID NO: 2353867 - protein, 28 aa, Cryptosporidium parvum
SKKVGFFEVWLLLSLWKRYPARIYRHMM

SEQ ID NO: 2353868 - protein, 17 aa, Cryptosporidium parvum
SKLKMISGLKLSYCLNF

SEQ ID NO: 2353869 - protein, 17 aa, Cryptosporidium parvum
SKLRFSNDTNLYGNISM

SEQ ID NO: 2353870 - protein, 22 aa, Cryptosporidium parvum
SKLVNCKEVLDLKDFDAELKDI

SEQ ID NO: 2353871 - protein, 32 aa, Cryptosporidium parvum
SKNIYPIEVLLKLYKPLNVPRSIFKLETAIQR

SEQ ID NO: 2353872 - protein, 27 aa, Cryptosporidium parvum
SKQTKCQETMRGAGYETSIQGQDQARK

SEQ ID NO: 2353873 - protein, 20 aa, Cryptosporidium parvum
SKTCPSFQRKGSLRPSPNTQ

SEQ ID NO: 2353874 - protein, 23 aa, Cryptosporidium parvum
SKVFSSKLIFHWLTHHILTNFLY

SEQ ID NO: 2353875 - protein, 18 aa, Cryptosporidium parvum
SKWGEVKSVNIIRSPESG

SEQ ID NO: 2353876 - protein, 23 aa, Cryptosporidium parvum
SLCVDCMNCSISQFSMALNKEIS

SEQ ID NO: 2353877 - protein, 18 aa, Cryptosporidium parvum
SLDQTCHLAHRMGLAPSK

SEQ ID NO: 2353878 - protein, 20 aa, Cryptosporidium parvum
SLEAIIGGGVSWIPKNSTVN

SEQ ID NO: 2353879 - protein, 25 aa, Cryptosporidium parvum
SLEILYRPGIPRSYSKFICPSGTDT

SEQ ID NO: 2353880 - protein, 22 aa, Cryptosporidium parvum
SLGEAVCGWNIKFPTFSLSTQN

SEQ ID NO: 2353881 - protein, 24 aa, Cryptosporidium parvum
SLIENKCRVVVCSDLLARGIDIRM

SEQ ID NO: 2353882 - protein, 17 aa, Cryptosporidium parvum
SLIYRGNLELLRLLINT

SEQ ID NO: 2353883 - protein, 22 aa, Cryptosporidium parvum
SLLEGYSTIFILGELPEVKNRC

SEQ ID NO: 2353884 - protein, 19 aa, Cryptosporidium parvum
SLLSKIFHDQICFNQYSIF

SEQ ID NO: 2353885 - protein, 17 aa, Cryptosporidium parvum
SLLSLNSSIIFHKELVN

SEQ ID NO: 2353886 - protein, 19 aa, Cryptosporidium parvum
SLPAERQNSLILKASKIGN

SEQ ID NO: 2353887 - protein, 30 aa, Cryptosporidium parvum; identical to SEQ ID NO: 2304256

SEQ ID NO: 2353888 - protein, 20 aa, Cryptosporidium parvum
SLSCSWKRYCEQHTLRKKAD

SEQ ID NO: 2353889 - protein, 25 aa, Cryptosporidium parvum
SLSDLRITSIFQKYGQIVSIKRQDP

SEQ ID NO: 2353890 - protein, 21 aa, Cryptosporidium parvum
SLSTSHPVQFISFSPSNQQIL

SEQ ID NO: 2353891 - protein, 21 aa, Cryptosporidium parvum
SLSVFKLKFLYFAENISLFES

SEQ ID NO: 2353892 - protein, 17 aa, Cryptosporidium parvum
SMIKHNSCLVVFVGGVT

SEQ ID NO: 2353893 - protein, 18 aa, Cryptosporidium parvum
SMILSLFSKAFGVFMTGI

SEQ ID NO: 2353894 - protein, 25 aa, Cryptosporidium parvum
SMKKAIQIFSCLSVSTETRVRVACV

SEQ ID NO: 2353895 - protein, 24 aa, Cryptosporidium parvum
SMTFKDTYLALAYSRDEYISKFNS

SEQ ID NO: 2353896 - protein, 21 aa, Cryptosporidium parvum
SNAGALWGSIMGGTNRTSTVP

SEQ ID NO: 2353897 - protein, 17 aa, Cryptosporidium parvum
SNFSANPFIPLKGEAIA

SEQ ID NO: 2353898 - protein, 27 aa, Cryptosporidium parvum
SNISIRTDICGRIRIVGANSSEFKTWD

SEQ ID NO: 2353899 - protein, 30 aa, Cryptosporidium parvum; identical to SEQ ID NO: 2304368

SEQ ID NO: 2353900 - protein, 26 aa, Cryptosporidium parvum
SNKDLKCLICFNTGILKRVLIPQKFD

SEQ ID NO: 2353901 - protein, 23 aa, Cryptosporidium parvum
SNKLRFPSIYTELISSKVEYEKL

SEQ ID NO: 2353902 - protein, 19 aa, Cryptosporidium parvum
SNLKPRLIKNTSIPGILDS

SEQ ID NO: 2353903 - protein, 18 aa, Cryptosporidium parvum
SNLPDIFYGNGIQILLQP

SEQ ID NO: 2353904 - protein, 28 aa, Cryptosporidium parvum
SNNFKSILYFEFYWMPEWTRNNDRYLFN

SEQ ID NO: 2353905 - protein, 26 aa, Cryptosporidium parvum
SNNLSATEFDVCHSLLQKIKTRDEDL

SEQ ID NO: 2353906 - protein, 17 aa, Cryptosporidium parvum
SNPLSRSEAFKMINPLE

SEQ ID NO: 2353907 - protein, 18 aa, Cryptosporidium parvum
SNPMNRLLAKFHKKRPSS

SEQ ID NO: 2353908 - protein, 25 aa, Cryptosporidium parvum
SNQKIDVCFYIGFVPFYSKVILRLL

SEQ ID NO: 2353909 - protein, 21 aa, Cryptosporidium parvum
SNREEFLCYYIIYVTLQNMKA

SEQ ID NO: 2353910 - protein, 24 aa, Cryptosporidium parvum
SNRKPVENYSRFEGFEQRQENVIK

SEQ ID NO: 2353911 - protein, 24 aa, Cryptosporidium parvum
SNSLYCFLDSMKLWLSEYDSDALI

SEQ ID NO: 2353912 - protein, 26 aa, Cryptosporidium parvum
SNSVGRLSSFFGNRELSGIASSSSLT

SEQ ID NO: 2353913 - protein, 18 aa, Cryptosporidium parvum
SNVPYCPKRENMINNTGH

SEQ ID NO: 2353914 - protein, 18 aa, Cryptosporidium parvum
SPESMRHREYESFHGNGG

SEQ ID NO: 2353915 - protein, 26 aa, Cryptosporidium parvum
SPGPYEWLYNPLLMNLYGNYSAASQA

SEQ ID NO: 2353916 - protein, 20 aa, Cryptosporidium parvum
SPHWKLPLFGDPLFAILKDL

SEQ ID NO: 2353917 - protein, 17 aa, Cryptosporidium parvum
SPIELRNWSDGSNNFKS

SEQ ID NO: 2353918 - protein, 26 aa, Cryptosporidium parvum
SPKSLSFPEPVIFMGDFIQGRKNREE

SEQ ID NO: 2353919 - protein, 18 aa, Cryptosporidium parvum
SPLLHFDEKLVFNVFSSA

SEQ ID NO: 2353920 - protein, 18 aa, Cryptosporidium parvum
SPNNTIRRKFIVGITETA

SEQ ID NO: 2353921 - protein, 25 aa, Cryptosporidium parvum
SPNVKTRFPSVITIFSAPNYCDVYN

SEQ ID NO: 2353922 - protein, 24 aa, Cryptosporidium parvum
SPRNFRRACLEFQQSPPGVLLASD

SEQ ID NO: 2353923 - protein, 18 aa, Cryptosporidium parvum
SQAPRPLPQLGSYFTPRP

SEQ ID NO: 2353924 - protein, 24 aa, Cryptosporidium parvum
SQCCSYPTLAFFEGYNRLNSWSKE

SEQ ID NO: 2353925 - protein, 17 aa, Cryptosporidium parvum
SQGGLVNPFLMMQRMSA

SEQ ID NO: 2353926 - protein, 19 aa, Cryptosporidium parvum
SQIGFKSSSLIINKEEITL

SEQ ID NO: 2353927 - protein, 23 aa, Cryptosporidium parvum
SQIRRVKFQPTLSPIAQSPLSEN

SEQ ID NO: 2353928 - protein, 27 aa, Cryptosporidium parvum
SQKPQGWRVVYYTGKDREFEYFKVPAN

SEQ ID NO: 2353929 - protein, 28 aa, Cryptosporidium parvum
SQKVVFPCILKIIPQYIFNARDPIICGV

SEQ ID NO: 2353930 - protein, 18 aa, Cryptosporidium parvum
SQLHCIYELVNAFSNFSE

SEQ ID NO: 2353931 - protein, 17 aa, Cryptosporidium parvum
SQMHKSGVLIGFPQNPK

SEQ ID NO: 2353932 - protein, 22 aa, Cryptosporidium parvum
SQNLKISKSMMGAELSSLKRTK

SEQ ID NO: 2353933 - protein, 26 aa, Cryptosporidium parvum
SQNNPRRVCICIKWNSSHHLEDNERT

SEQ ID NO: 2353934 - protein, 19 aa, Cryptosporidium parvum
SQPDSAMWFNQLNSAQQLM

SEQ ID NO: 2353935 - protein, 22 aa, Cryptosporidium parvum
SQSKLKLGIPKLGIKSKSSSDL

SEQ ID NO: 2353936 - protein, 19 aa, Cryptosporidium parvum
SRCYSTWKTENIVDIIKRS

SEQ ID NO: 2353937 - protein, 19 aa, Cryptosporidium parvum
SRFGYPLGTRVVYINTNDG

SEQ ID NO: 2353938 - protein, 26 aa, Cryptosporidium parvum
SRFPPDAWHLCCWLLRKNSNERASPI

SEQ ID NO: 2353939 - protein, 22 aa, Cryptosporidium parvum
SRGLDFPKIDWVIQLDIPENAD

SEQ ID NO: 2353940 - protein, 30 aa, Cryptosporidium parvum; identical to SEQ ID NO: 2304615

SEQ ID NO: 2353941 - protein, 22 aa, Cryptosporidium parvum
SRKLFENCLDRWRRNKVSLDPQ

SEQ ID NO: 2353942 - protein, 25 aa, Cryptosporidium parvum
SRLDKLDIVDGFLFKDDDTEKKDGV

SEQ ID NO: 2353943 - protein, 18 aa, Cryptosporidium parvum
SRLKTKRVNSKKEIEIVT

SEQ ID NO: 2353944 - protein, 19 aa, Cryptosporidium parvum
SRLLRFAIDEAHCVCQWGF

SEQ ID NO: 2353945 - protein, 19 aa, Cryptosporidium parvum
SRLSMKTLMRNSSSSYYGT

SEQ ID NO: 2353946 - protein, 18 aa, Cryptosporidium parvum
SRLSMSFDARNGRHSFNR

SEQ ID NO: 2353947 - protein, 23 aa, Cryptosporidium parvum
SRNAMKVRFSRAYQANFYFSNKR

SEQ ID NO: 2353948 - protein, 25 aa, Cryptosporidium parvum
SRNNWGVGFLESFERKKVCQYIRVD

SEQ ID NO: 2353949 - protein, 20 aa, Cryptosporidium parvum
SRPYAAISVSAMPQNQNRPL

SEQ ID NO: 2353950 - protein, 31 aa, Cryptosporidium parvum
SRQLTRYRLAMYFYEFLKSIKMLTEKGNGVF

SEQ ID NO: 2353951 - protein, 25 aa, Cryptosporidium parvum
SRREGLKTILTFLSKRGYPNQINPK

SEQ ID NO: 2353952 - protein, 22 aa, Cryptosporidium parvum
SRSLEPFFMWQISILGNCHTPT

SEQ ID NO: 2353953 - protein, 18 aa, Cryptosporidium parvum
SRVNRLSVLSAITSTQQR

SEQ ID NO: 2353954 - protein, 19 aa, Cryptosporidium parvum
SSACPHLAFSAILCAGIDG

SEQ ID NO: 2353955 - protein, 17 aa, Cryptosporidium parvum
SSAFKNKESCVISSVSS

SEQ ID NO: 2353956 - protein, 34 aa, Cryptosporidium parvum
SSCGNCYLGDAFRCSGCPYKGMPAFKPGEKVSLA

SEQ ID NO: 2353957 - protein, 18 aa, Cryptosporidium parvum
SSDFEWNDSLSVINKEQF

SEQ ID NO: 2353958 - protein, 26 aa, Cryptosporidium parvum
SSDLKIAAFRLLRRCMSDPSNALDFL

SEQ ID NO: 2353959 - protein, 21 aa, Cryptosporidium parvum
SSINLPILINFSGVFEEKLIF

SEQ ID NO: 2353960 - protein, 17 aa, Cryptosporidium parvum
SSKEMRNVNELNIEYDF

SEQ ID NO: 2353961 - protein, 18 aa, Cryptosporidium parvum
SSKGRRWSNNSTTSTISS

SEQ ID NO: 2353962 - protein, 27 aa, Cryptosporidium parvum
SSKIREVQTGFQFRLQVPMGSILASLR

SEQ ID NO: 2353963 - protein, 24 aa, Cryptosporidium parvum
SSKNWFCFQCLSLTLRILPSLIYR

SEQ ID NO: 2353964 - protein, 19 aa, Cryptosporidium parvum
SSLGSVVFDCVKRIPDGIL

SEQ ID NO: 2353965 - protein, 30 aa, Cryptosporidium parvum; identical to SEQ ID NO: 2182169

SEQ ID NO: 2353966 - protein, 23 aa, Cryptosporidium parvum
SSLKTIFIIFQLHFTDNHFDFLF

SEQ ID NO: 2353967 - protein, 18 aa, Cryptosporidium parvum
SSLLIGRKELINYVKTRQ

SEQ ID NO: 2353968 - protein, 23 aa, Cryptosporidium parvum
SSLPDIHKVAAMTFQLPNLRDES

SEQ ID NO: 2353969 - protein, 19 aa, Cryptosporidium parvum
SSLRRLDRTLLLIEENFEQ

SEQ ID NO: 2353970 - protein, 23 aa, Cryptosporidium parvum
SSNMKRSFSLEFLSQALGDDSPE

SEQ ID NO: 2353971 - protein, 24 aa, Cryptosporidium parvum
SSNSRLAMNLTILIRNLFSPEDQQ

SEQ ID NO: 2353972 - protein, 25 aa, Cryptosporidium parvum
SSQKVWPNLLVNFGRYESTFLKKLC

SEQ ID NO: 2353973 - protein, 20 aa, Cryptosporidium parvum
SSSCLTESTFQLIIDSVSQK

SEQ ID NO: 2353974 - protein, 23 aa, Cryptosporidium parvum
SSSDSGYFCPFYATREIESVCNV

SEQ ID NO: 2353975 - protein, 22 aa, Cryptosporidium parvum
SSSFSSGMGFQGGVSKSVSTST

SEQ ID NO: 2353976 - protein, 24 aa, Cryptosporidium parvum
SSSNPCPSCSSSAKSCSCSCPLVT

SEQ ID NO: 2353977 - protein, 21 aa, Cryptosporidium parvum
SSSSYAECYLEVDGVSHYETH

SEQ ID NO: 2353978 - protein, 17 aa, Cryptosporidium parvum
SSTHFRKDNLLWHWRSG

SEQ ID NO: 2353979 - protein, 17 aa, Cryptosporidium parvum
SSVASKFGIPIIADGGI

SEQ ID NO: 2353980 - protein, 25 aa, Cryptosporidium parvum
SSVLRRQLHDQSHFLPSNSLVNSNN

SEQ ID NO: 2353981 - protein, 18 aa, Cryptosporidium parvum
SSYLPHIYSATLGLKNGF

SEQ ID NO: 2353982 - protein, 19 aa, Cryptosporidium parvum
STDIDICINWILTNIDSIN

SEQ ID NO: 2353983 - protein, 23 aa, Cryptosporidium parvum
STEDARHSVRFENGLVLMTKRFI

SEQ ID NO: 2353984 - protein, 19 aa, Cryptosporidium parvum
STELHGFLPQEKRLENFSK

SEQ ID NO: 2353985 - protein, 19 aa, Cryptosporidium parvum
STGLPFYLPLVDYAGKEEM

SEQ ID NO: 2353986 - protein, 18 aa, Cryptosporidium parvum
STIMSRSDISTCEDVISL

SEQ ID NO: 2353987 - protein, 18 aa, Cryptosporidium parvum
STLPRILDFLSESITKVL

SEQ ID NO: 2353988 - protein, 18 aa, Cryptosporidium parvum
STPLCILNSYLNHLSLYV

SEQ ID NO: 2353989 - protein, 20 aa, Cryptosporidium parvum
STPSILGILLKYFDVSWPSH

SEQ ID NO: 2353990 - protein, 27 aa, Cryptosporidium parvum
STVEYLSNFILELCIDDILTSLDTSIH

SEQ ID NO: 2353991 - protein, 25 aa, Cryptosporidium parvum
STVVLMCMEELLQFHLPHHLEALCV

SEQ ID NO: 2353992 - protein, 24 aa, Cryptosporidium parvum
STYVFLKIIKSFTFCLENINNNDY

SEQ ID NO: 2353993 - protein, 18 aa, Cryptosporidium parvum
SVEEGVRIHSKWIQEQNQ

SEQ ID NO: 2353994 - protein, 19 aa, Cryptosporidium parvum
SVGERWPLNIMSITALEED

SEQ ID NO: 2353995 - protein, 19 aa, Cryptosporidium parvum
SVHSGHYICYNKRKIDSSI

SEQ ID NO: 2353996 - protein, 22 aa, Cryptosporidium parvum
SVINKRRGNVFNEELKEGTSTF

SEQ ID NO: 2353997 - protein, 25 aa, Cryptosporidium parvum
SVISCFWKSMVASIEQIYSIESLPL

SEQ ID NO: 2353998 - protein, 17 aa, Cryptosporidium parvum
SVIVGELVKVFSKGSKH

SEQ ID NO: 2353999 - protein, 24 aa, Cryptosporidium parvum
SVKSSECIPLLPCIQNLKDENHLE

SEQ ID NO: 2354000 - protein, 25 aa, Cryptosporidium parvum
SVSGSIKSYSKVTFTAPETTTTGAA

SEQ ID NO: 2354001 - protein, 18 aa, Cryptosporidium parvum
SWFSKTCISNFPEIQKLI

SEQ ID NO: 2354002 - protein, 18 aa, Cryptosporidium parvum
SYFRAYRGLLSCLKSHKV

SEQ ID NO: 2354003 - protein, 17 aa, Cryptosporidium parvum
SYHNFKFISSSNKKTFD

SEQ ID NO: 2354004 - protein, 25 aa, Cryptosporidium parvum
SYLPFLPSLFIVSSSKPLLRIVNVD

SEQ ID NO: 2354005 - protein, 25 aa, Cryptosporidium parvum
SYTFRENFESLPLFSSINGIFEFDI

SEQ ID NO: 2354006 - protein, 17 aa, Cryptosporidium parvum
SYTSFILARSLNPIKYT

SEQ ID NO: 2354007 - protein, 18 aa, Cryptosporidium parvum
TAEWQVFDTDKWCKVPIS

SEQ ID NO: 2354008 - protein, 24 aa, Cryptosporidium parvum
TALHYASACGWLPTMKLLLKYNCD

SEQ ID NO: 2354009 - protein, 17 aa, Cryptosporidium parvum
TANEIQKILSIPVFVNP

SEQ ID NO: 2354010 - protein, 19 aa, Cryptosporidium parvum
TAPGTAQICCDFVQEIHAS

SEQ ID NO: 2354011 - protein, 25 aa, Cryptosporidium parvum
TAQSEAVTSQVCYFDTTDNTMTFVY

SEQ ID NO: 2354012 - protein, 22 aa, Cryptosporidium parvum
TASFCTRLFIVTSLGTWGEIPP

SEQ ID NO: 2354013 - protein, 25 aa, Cryptosporidium parvum
TCDLEFCVELFWLLISEISIQEYPK

SEQ ID NO: 2354014 - protein, 26 aa, Cryptosporidium parvum
TCIRGRPCRIMWCLRDPASRRNNDGN

SEQ ID NO: 2354015 - protein, 22 aa, Cryptosporidium parvum
TCPQLLKWKPPHLNTADFAAIF

SEQ ID NO: 2354016 - protein, 27 aa, Cryptosporidium parvum
TCQCGKQDRLLPVLPQSSNSRMMRMIQ

SEQ ID NO: 2354017 - protein, 19 aa, Cryptosporidium parvum
TCYSISDGRVFIIRNSEII

SEQ ID NO: 2354018 - protein, 19 aa, Cryptosporidium parvum
TDELDNWKNLLPKSSQGTW

SEQ ID NO: 2354019 - protein, 18 aa, Cryptosporidium parvum
TDGIRLLLYAASRRVFLI

SEQ ID NO: 2354020 - protein, 18 aa, Cryptosporidium parvum
TDIRHFAFILFKKNLNVL

SEQ ID NO: 2354021 - protein, 25 aa, Cryptosporidium parvum
TDKDSKVTYKEEYMAQIDSSYTSTT

SEQ ID NO: 2354022 - protein, 29 aa, Cryptosporidium parvum
TDRREIIELVLEYLHPCRGLDLRLNSLYG

SEQ ID NO: 2354023 - protein, 33 aa, Cryptosporidium parvum
TDSSTNVNACMDISGYVSDLSLKNVTTGTKTGE

SEQ ID NO: 2354024 - protein, 19 aa, Cryptosporidium parvum
TECDVSCVLYSYPELQPVL

SEQ ID NO: 2354025 - protein, 24 aa, Cryptosporidium parvum
TEFLREELRFVRGICERAPKCYQS

SEQ ID NO: 2354026 - protein, 21 aa, Cryptosporidium parvum
TEGDIAIIFSQWGEPIDINLI

SEQ ID NO: 2354027 - protein, 19 aa, Cryptosporidium parvum
TEIIWRDKPELLSLAEPLA

SEQ ID NO: 2354028 - protein, 18 aa, Cryptosporidium parvum
TELLEYINRSIIKNSVSH

SEQ ID NO: 2354029 - protein, 26 aa, Cryptosporidium parvum
TENPELFANILIEWSKKGYKSEKDIF

SEQ ID NO: 2354030 - protein, 20 aa, Cryptosporidium parvum
TETFVTKADGSTVTTVDQVF

SEQ ID NO: 2354031 - protein, 18 aa, Cryptosporidium parvum
TFCQRLSNTIGRNVTKEE

SEQ ID NO: 2354032 - protein, 20 aa, Cryptosporidium parvum
TFEKTCRRPTFPFVSILATS

SEQ ID NO: 2354033 - protein, 30 aa, Cryptosporidium parvum; identical to SEQ ID NO: 2182561

SEQ ID NO: 2354034 - protein, 29 aa, Cryptosporidium parvum
TFKSTHGWTDYQLRCNLAVAIGVSKDLFD

SEQ ID NO: 2354035 - protein, 29 aa, Cryptosporidium parvum
TFKVLRKRLLCFSASTAFWIPYTFSNEEH

SEQ ID NO: 2354036 - protein, 22 aa, Cryptosporidium parvum
TFLNKKRHSSLMITDSEDVYSI

SEQ ID NO: 2354037 - protein, 18 aa, Cryptosporidium parvum
TFVKLNLWWELMVYILRW

SEQ ID NO: 2354038 - protein, 17 aa, Cryptosporidium parvum
TGNCRVIYWKDLYKSGV

SEQ ID NO: 2354039 - protein, 17 aa, Cryptosporidium parvum
TGSRFLPPNSSIYSFEK

SEQ ID NO: 2354040 - protein, 19 aa, Cryptosporidium parvum
TIGTLRFGIRAKMVKNAPK

SEQ ID NO: 2354041 - protein, 17 aa, Cryptosporidium parvum
TIKYCIEHLKSVLSETF

SEQ ID NO: 2354042 - protein, 19 aa, Cryptosporidium parvum
TIYESVRIVEFLGGTIDKN

SEQ ID NO: 2354043 - protein, 20 aa, Cryptosporidium parvum
TKADGSTVTTVDQVFQDCSR

SEQ ID NO: 2354044 - protein, 20 aa, Cryptosporidium parvum
TKDSELIWLDSIHNHTKKKP

SEQ ID NO: 2354045 - protein, 26 aa, Cryptosporidium parvum
TKIQSLWRMILCRNQYSKAIKAIITI

SEQ ID NO: 2354046 - protein, 22 aa, Cryptosporidium parvum
TKKNLREIENWKKSDHKNSASI

SEQ ID NO: 2354047 - protein, 19 aa, Cryptosporidium parvum
TKNAFSLGNTRSFVKSILA

SEQ ID NO: 2354048 - protein, 21 aa, Cryptosporidium parvum
TKQIQCRIVILTAGDEDFNTL

SEQ ID NO: 2354049 - protein, 19 aa, Cryptosporidium parvum
TKTLRDLSGFGKINQTPEG

SEQ ID NO: 2354050 - protein, 17 aa, Cryptosporidium parvum
TKTPVCMYPCMDLDLII

SEQ ID NO: 2354051 - protein, 20 aa, Cryptosporidium parvum
TLCPDVYVYASWTFFLQHLR

SEQ ID NO: 2354052 - protein, 26 aa, Cryptosporidium parvum
TLDTIPWFCSYNKLQVLSNSEYEVME

SEQ ID NO: 2354053 - protein, 23 aa, Cryptosporidium parvum
TLFDGCLCSEVLELERRGLIELI

SEQ ID NO: 2354054 - protein, 32 aa, Cryptosporidium parvum; identical to SEQ ID NO: 2305424

SEQ ID NO: 2354055 - protein, 20 aa, Cryptosporidium parvum
TLHFCEYCLDFFCFEDELIR

SEQ ID NO: 2354056 - protein, 24 aa, Cryptosporidium parvum
TLLKKGPEELADWNRYFKRIQSSK

SEQ ID NO: 2354057 - protein, 21 aa, Cryptosporidium parvum
TLRILPSLIYRIPNLTPGLIN

SEQ ID NO: 2354058 - protein, 18 aa, Cryptosporidium parvum
TLSELKNDPWMKIKCENE

SEQ ID NO: 2354059 - protein, 27 aa, Cryptosporidium parvum
TLTILFLILTLCKLYSTLTNLNRSGCY

SEQ ID NO: 2354060 - protein, 18 aa, Cryptosporidium parvum
TMDFWFAAIRFFFLEAGR

SEQ ID NO: 2354061 - protein, 24 aa, Cryptosporidium parvum
TMLLYEIIRRLSIESRDNLVNMMQ

SEQ ID NO: 2354062 - protein, 23 aa, Cryptosporidium parvum
TNEYLMLYSFPFGGFSSCFQFNF

SEQ ID NO: 2354063 - protein, 37 aa, Cryptosporidium parvum; identical to SEQ ID NO: 2182811

SEQ ID NO: 2354064 - protein, 18 aa, Cryptosporidium parvum
TNILDLVRQFIKIRFPFV

SEQ ID NO: 2354065 - protein, 27 aa, Cryptosporidium parvum
TNKEVPIRIRFLINDVIDSRKNNWKSK

SEQ ID NO: 2354066 - protein, 21 aa, Cryptosporidium parvum
TNKIQWVILALISVHTIDSYN

SEQ ID NO: 2354067 - protein, 25 aa, Cryptosporidium parvum
TNKKCRNGVHCCFCHFQHKERKRGK

SEQ ID NO: 2354068 - protein, 19 aa, Cryptosporidium parvum
TNLTNLRGNFMGNDGSDYI

SEQ ID NO: 2354069 - protein, 20 aa, Cryptosporidium parvum
TPCDKSRYGVQEFHQELPTE

SEQ ID NO: 2354070 - protein, 21 aa, Cryptosporidium parvum
TPGLFDAKLINFTGSTNSSTA

SEQ ID NO: 2354071 - protein, 17 aa, Cryptosporidium parvum
TPKGFEFATSERAEQRL

SEQ ID NO: 2354072 - protein, 22 aa, Cryptosporidium parvum
TPKWVYDVVLDFTIIKPTSKRN

SEQ ID NO: 2354073 - protein, 17 aa, Cryptosporidium parvum
TPPECFKLECTKDGIDG

SEQ ID NO: 2354074 - protein, 23 aa, Cryptosporidium parvum
TPRGELKPAISQLLVDDETSNKE

SEQ ID NO: 2354075 - protein, 23 aa, Cryptosporidium parvum
TPRPQMSSCFLLRIPEDSINGIF

SEQ ID NO: 2354076 - protein, 30 aa, Cryptosporidium parvum; identical to SEQ ID NO: 2182895

SEQ ID NO: 2354077 - protein, 20 aa, Cryptosporidium parvum
TRDILPYFIEYVKPERVINC

SEQ ID NO: 2354078 - protein, 23 aa, Cryptosporidium parvum
TRHMSSLWKSYTFTHETLFTMTS

SEQ ID NO: 2354079 - protein, 23 aa, Cryptosporidium parvum
TRSNLQKAISCNFYYNSKTKKVS

SEQ ID NO: 2354080 - protein, 25 aa, Cryptosporidium parvum
TRSSNDIYRRVDFLIKAFKKRDLNN

SEQ ID NO: 2354081 - protein, 19 aa, Cryptosporidium parvum
TRTAIGIKTVFKVLFSLEF

SEQ ID NO: 2354082 - protein, 20 aa, Cryptosporidium parvum
TSNIDLGVCSFQVNVPNNIS

SEQ ID NO: 2354083 - protein, 22 aa, Cryptosporidium parvum
TSQLTALAMLCMDPYYRTIQGF

SEQ ID NO: 2354084 - protein, 24 aa, Cryptosporidium parvum
TSTFKIEAYIPIIESLGISQELRS

SEQ ID NO: 2354085 - protein, 20 aa, Cryptosporidium parvum
TSTVPSIHHPDARWMETAET

SEQ ID NO: 2354086 - protein, 36 aa, Cryptosporidium parvum; identical to SEQ ID NO: 2183027

SEQ ID NO: 2354087 - protein, 25 aa, Cryptosporidium parvum
TSYFNIPLLHLWCADHIRFRKGNQA

SEQ ID NO: 2354088 - protein, 18 aa, Cryptosporidium parvum
TTDNTMTFVYQAPTKTET

SEQ ID NO: 2354089 - protein, 24 aa, Cryptosporidium parvum
TTEKSYKGTVTRETYSVDGKQTSK

SEQ ID NO: 2354090 - protein, 17 aa, Cryptosporidium parvum
TTGRYVSDWSQVFQAQQ

SEQ ID NO: 2354091 - protein, 21 aa, Cryptosporidium parvum
TTGVCDSASSVSVSGSIKSYS

SEQ ID NO: 2354092 - protein, 19 aa, Cryptosporidium parvum
TTIENLFCIGALDSTTAAS

SEQ ID NO: 2354093 - protein, 23 aa, Cryptosporidium parvum
TTPEWKRQYLGKSLSFGKKNVTA

SEQ ID NO: 2354094 - protein, 24 aa, Cryptosporidium parvum
TTTMTETFSNGSITSRQIDIEVSK

SEQ ID NO: 2354095 - protein, 23 aa, Cryptosporidium parvum
TTVIRKALNLSIHRLNNSISNKP

SEQ ID NO: 2354096 - protein, 22 aa, Cryptosporidium parvum
TTVVMFWEIVKKLDLKLQKKLL

SEQ ID NO: 2354097 - protein, 25 aa, Cryptosporidium parvum
TVDDCPLQLIEKGIRESSTYSLGMN

SEQ ID NO: 2354098 - protein, 18 aa, Cryptosporidium parvum
TVEKLLSLEQWGTLIQTM

SEQ ID NO: 2354099 - protein, 28 aa, Cryptosporidium parvum
TVFTKLKIGCKVLELYGKQSLQKRLEVV

SEQ ID NO: 2354100 - protein, 26 aa, Cryptosporidium parvum
TVQDYRFLPKPTFRIEDNNLYSNLNQ

SEQ ID NO: 2354101 - protein, 24 aa, Cryptosporidium parvum
TWVKTCIKAASSMGKFSTDRTIEE

SEQ ID NO: 2354102 - protein, 17 aa, Cryptosporidium parvum
TYKAWENPRIVLANFLK

SEQ ID NO: 2354103 - protein, 19 aa, Cryptosporidium parvum
TYLIDEFMYLVSELGFLTK

SEQ ID NO: 2354104 - protein, 21 aa, Cryptosporidium parvum
VAELLWEISCEDLQKKGTEYQ

SEQ ID NO: 2354105 - protein, 20 aa, Cryptosporidium parvum
VASMKRLWENKTPKLSSIWR

SEQ ID NO: 2354106 - protein, 23 aa, Cryptosporidium parvum
VCINFENCFLKPPISQGILSGNQ

SEQ ID NO: 2354107 - protein, 19 aa, Cryptosporidium parvum
VCMYPCMDLDLIIENNIIA

SEQ ID NO: 2354108 - protein, 19 aa, Cryptosporidium parvum
VCREFPDLLRPKARYSEKV

SEQ ID NO: 2354109 - protein, 22 aa, Cryptosporidium parvum
VDEVPAILNFSRRLPHPSDGII

SEQ ID NO: 2354110 - protein, 23 aa, Cryptosporidium parvum
VDLMSLYLKFAHGLDYYSLSTSH

SEQ ID NO: 2354111 - protein, 21 aa, Cryptosporidium parvum
VDSFLPISCEFPESLLPINGV

SEQ ID NO: 2354112 - protein, 17 aa, Cryptosporidium parvum
VECLNYLIKQHKKENFE

SEQ ID NO: 2354113 - protein, 21 aa, Cryptosporidium parvum
VEGKKSLAIEAFANALRQIPT

SEQ ID NO: 2354114 - protein, 32 aa, Cryptosporidium parvum
VEGKSKIIGSGMKRVIKKEIIKNINSEKPIKN

SEQ ID NO: 2354115 - protein, 19 aa, Cryptosporidium parvum
VEGLIRYGLDKEGRPCIFM

SEQ ID NO: 2354116 - protein, 17 aa, Cryptosporidium parvum
VEISLYHALSFYNAIYS

SEQ ID NO: 2354117 - protein, 36 aa, Cryptosporidium parvum; identical to SEQ ID NO: 2183262

SEQ ID NO: 2354118 - protein, 17 aa, Cryptosporidium parvum
VELKKKLEASLLDIYSF

SEQ ID NO: 2354119 - protein, 26 aa, Cryptosporidium parvum
VENWLPKRLGGGLGKVRGQEKPESKS

SEQ ID NO: 2354120 - protein, 22 aa, Cryptosporidium parvum
VESFKFGSEQAILANLSSTNNK

SEQ ID NO: 2354121 - protein, 18 aa, Cryptosporidium parvum
VEVKPMLASPTIVPESRS

SEQ ID NO: 2354122 - protein, 24 aa, Cryptosporidium parvum
VFDSSIKVGKLFLVDLAGSEKISK

SEQ ID NO: 2354123 - protein, 19 aa, Cryptosporidium parvum
VFIEPRNSFELGSVLDSYM

SEQ ID NO: 2354124 - protein, 18 aa, Cryptosporidium parvum
VFRALRRIVSDDFVSALL

SEQ ID NO: 2354125 - protein, 17 aa, Cryptosporidium parvum
VFYWICNLPELSLNMLK

SEQ ID NO: 2354126 - protein, 23 aa, Cryptosporidium parvum
VGEISKCYFYFLFENKSSDSGGR

SEQ ID NO: 2354127 - protein, 23 aa, Cryptosporidium parvum
VGKVNGFSICKGVNKNGTLCTNP

SEQ ID NO: 2354128 - protein, 19 aa, Cryptosporidium parvum
VHDKYVIPILMVIQECFTR

SEQ ID NO: 2354129 - protein, 19 aa, Cryptosporidium parvum
VHLSNVFSHPKYRSNMEYQ

SEQ ID NO: 2354130 - protein, 23 aa, Cryptosporidium parvum
VHPQILKSLGIKTIMDFTPNKIK

SEQ ID NO: 2354131 - protein, 53 aa, Cryptosporidium parvum; identical to SEQ ID NO: 2306104

SEQ ID NO: 2354132 - protein, 19 aa, Cryptosporidium parvum
VIFPSILMNLIIIDKKDIN

SEQ ID NO: 2354133 - protein, 21 aa, Cryptosporidium parvum
VIGDNCIIKGCSILDNTVIEN

SEQ ID NO: 2354134 - protein, 18 aa, Cryptosporidium parvum
VIHKEFPGVFTMAEESTA

SEQ ID NO: 2354135 - protein, 17 aa, Cryptosporidium parvum
VIKHCKELEGKVEELGC

SEQ ID NO: 2354136 - protein, 22 aa, Cryptosporidium parvum
VIKKEFSVWGPVDYIRVIPSKN

SEQ ID NO: 2354137 - protein, 24 aa, Cryptosporidium parvum
VINKEQFSHLLAEYAEIIDLKDQN

SEQ ID NO: 2354138 - protein, 18 aa, Cryptosporidium parvum
VINPFNIKDFFTLNINEI

SEQ ID NO: 2354139 - protein, 18 aa, Cryptosporidium parvum
VINYLKMRSQEYIAELCS

SEQ ID NO: 2354140 - protein, 18 aa, Cryptosporidium parvum
VIPELYGRNLFNLYRNGL

SEQ ID NO: 2354141 - protein, 23 aa, Cryptosporidium parvum
VKELKCVSEECTIVLDKLNVSIS

SEQ ID NO: 2354142 - protein, 17 aa, Cryptosporidium parvum
VKGEIGYTLPTISPGLE

SEQ ID NO: 2354143 - protein, 25 aa, Cryptosporidium parvum
VKKGLQCMNCKTIIKEGPLCKDCSK

SEQ ID NO: 2354144 - protein, 21 aa, Cryptosporidium parvum
VKLNCLDWDKSITEFIEDIII

SEQ ID NO: 2354145 - protein, 24 aa, Cryptosporidium parvum
VKNYCQRGRMCMFSHTKEEQMYHV

SEQ ID NO: 2354146 - protein, 19 aa, Cryptosporidium parvum
VKPPLKPKPKFLAPPKNPP

SEQ ID NO: 2354147 - protein, 25 aa, Cryptosporidium parvum
VKRFRKALCPIVERLVCSLMMHGRN

SEQ ID NO: 2354148 - protein, 19 aa, Cryptosporidium parvum
VKRGCLTPLSLIFEKSGGI

SEQ ID NO: 2354149 - protein, 20 aa, Cryptosporidium parvum
VKRSIKELAQHSLLQKELLK

SEQ ID NO: 2354150 - protein, 26 aa, Cryptosporidium parvum
VLARAIFKSGCEKVDAGLNPMDLLRG

SEQ ID NO: 2354151 - protein, 22 aa, Cryptosporidium parvum
VLEEIKQSIILINESLGSEKYD

SEQ ID NO: 2354152 - protein, 24 aa, Cryptosporidium parvum
VLEKWEIPEPCITPEGKLLTQIEK

SEQ ID NO: 2354153 - protein, 20 aa, Cryptosporidium parvum
VLEYLKKCIQSIKSIYLLKN

SEQ ID NO: 2354154 - protein, 29 aa, Cryptosporidium parvum
VLFKILFERCFQEYLLLCCDPTESAANAI

SEQ ID NO: 2354155 - protein, 17 aa, Cryptosporidium parvum
VLHGSLFSPIPLSFSHL

SEQ ID NO: 2354156 - protein, 19 aa, Cryptosporidium parvum
VLHNLCSLTELGHEKQNFF

SEQ ID NO: 2354157 - protein, 19 aa, Cryptosporidium parvum
VLKNWFIKLPLEYLEQAVS

SEQ ID NO: 2354158 - protein, 17 aa, Cryptosporidium parvum
VLLGVKLPDDYINNIKI

SEQ ID NO: 2354159 - protein, 32 aa, Cryptosporidium parvum; identical to SEQ ID NO: 2306281

SEQ ID NO: 2354160 - protein, 22 aa, Cryptosporidium parvum
VLLPDLPVPLSYNKSSGQTTSN

SEQ ID NO: 2354161 - protein, 22 aa, Cryptosporidium parvum
VLPNIFPSISHRPLPVNVCYIK

SEQ ID NO: 2354162 - protein, 24 aa, Cryptosporidium parvum
VLPTSRDPKLWLVKVDRAGLEKDI

SEQ ID NO: 2354163 - protein, 18 aa, Cryptosporidium parvum
VLSETFNPYEIYSICAVS

SEQ ID NO: 2354164 - protein, 18 aa, Cryptosporidium parvum
VLTVSFHKFGEFFPGTGD

SEQ ID NO: 2354165 - protein, 19 aa, Cryptosporidium parvum
VMENYRPGAIVLQCGADSL

SEQ ID NO: 2354166 - protein, 20 aa, Cryptosporidium parvum
VMGVRCLPASTAITSLGSII

SEQ ID NO: 2354167 - protein, 19 aa, Cryptosporidium parvum
VMLGGAFPFDERKGNLERL

SEQ ID NO: 2354168 - protein, 19 aa, Cryptosporidium parvum
VMRWRYYFVKMAINIDKFF

SEQ ID NO: 2354169 - protein, 23 aa, Cryptosporidium parvum
VNIKELICKAFSFLRNSIRFCDQ

SEQ ID NO: 2354170 - protein, 27 aa, Cryptosporidium parvum
VNKAVDLLGLIPIYPVKNIKTFTNNLH

SEQ ID NO: 2354171 - protein, 32 aa, Cryptosporidium parvum
VNKGCEILEKMNINWNRPDDMLAEMLKTDQHM

SEQ ID NO: 2354172 - protein, 18 aa, Cryptosporidium parvum
VNLLRFLIWHIISEKEEA

SEQ ID NO: 2354173 - protein, 25 aa, Cryptosporidium parvum
VNTETVFDSGMKIQKTVNKTSTEDV

SEQ ID NO: 2354174 - protein, 20 aa, Cryptosporidium parvum
VPEELQRHFEIYDGIEGVLG

SEQ ID NO: 2354175 - protein, 19 aa, Cryptosporidium parvum
VPKSINARIELYKQYLAQW

SEQ ID NO: 2354176 - protein, 20 aa, Cryptosporidium parvum
VPLGGPRAAIVVKKCKNAIQ

SEQ ID NO: 2354177 - protein, 19 aa, Cryptosporidium parvum
VPQDFRWKIWNSLLQISSL

SEQ ID NO: 2354178 - protein, 19 aa, Cryptosporidium parvum
VPQFKEIVLTEFITDAISK

SEQ ID NO: 2354179 - protein, 23 aa, Cryptosporidium parvum
VPQSLKRRFYMQIQFVKYMEKHI

SEQ ID NO: 2354180 - protein, 24 aa, Cryptosporidium parvum
VQHIMVALDMLMRIYNNREFPLVQ

SEQ ID NO: 2354181 - protein, 20 aa, Cryptosporidium parvum
VQLQCIKSFCIIAETESGAK

SEQ ID NO: 2354182 - protein, 19 aa, Cryptosporidium parvum
VQNLRIAVERALKSQVTGI

SEQ ID NO: 2354183 - protein, 30 aa, Cryptosporidium parvum
VQRIRTPLRYRSSLLGALSNRTNSSCRILS

SEQ ID NO: 2354184 - protein, 36 aa, Cryptosporidium parvum; identical to SEQ ID NO: 2306457

SEQ ID NO: 2354185 - protein, 24 aa, Cryptosporidium parvum
VRASVNCFCVPKGSVYNQLVDQFK

SEQ ID NO: 2354186 - protein, 22 aa, Cryptosporidium parvum
VREEAKLITACKVYTNELESDK

SEQ ID NO: 2354187 - protein, 25 aa, Cryptosporidium parvum
VRIEPEERIRMGIFDDSLVESDVKF

SEQ ID NO: 2354188 - protein, 20 aa, Cryptosporidium parvum
VRIGKFILDTWYFSPLPDEY

SEQ ID NO: 2354189 - protein, 22 aa, Cryptosporidium parvum
VRKGPFKTVFVSESIKDLDYTS

SEQ ID NO: 2354190 - protein, 23 aa, Cryptosporidium parvum
VRKKVCIFLSDLLAVYKNNVSLH

SEQ ID NO: 2354191 - protein, 17 aa, Cryptosporidium parvum
VRLKKLIENGSLLKLSG

SEQ ID NO: 2354192 - protein, 19 aa, Cryptosporidium parvum
VRLPIAASMSLILATALSC

SEQ ID NO: 2354193 - protein, 25 aa, Cryptosporidium parvum
VRQFIKIRFPFVLVLNKADIMSESS

SEQ ID NO: 2354194 - protein, 20 aa, Cryptosporidium parvum
VRREIPGIPADVSIACVEQE

SEQ ID NO: 2354195 - protein, 18 aa, Cryptosporidium parvum
VRSIYKFKGQVHDENEVM

SEQ ID NO: 2354196 - protein, 26 aa, Cryptosporidium parvum
VRYVKCVYLNYLICLVRQIRVWGPRE

SEQ ID NO: 2354197 - protein, 17 aa, Cryptosporidium parvum
VSCSQGGCKENQDGWFV

SEQ ID NO: 2354198 - protein, 25 aa, Cryptosporidium parvum
VSEFIPEIIDFISTIISRGFAYESE

SEQ ID NO: 2354199 - protein, 22 aa, Cryptosporidium parvum
VSEYRTGTIALWNSGLDLKSIS

SEQ ID NO: 2354200 - protein, 18 aa, Cryptosporidium parvum
VSIGEYLLNIVVTLESTC

SEQ ID NO: 2354201 - protein, 31 aa, Cryptosporidium parvum; identical to SEQ ID NO: 2183746

SEQ ID NO: 2354202 - protein, 24 aa, Cryptosporidium parvum
VSKKKCRETNEILAKYVNDLASEY

SEQ ID NO: 2354203 - protein, 20 aa, Cryptosporidium parvum
VSNELVHWGKFDDDYCSRLS

SEQ ID NO: 2354204 - protein, 19 aa, Cryptosporidium parvum
VSPLQSFRTPRLENQNHNN

SEQ ID NO: 2354205 - protein, 17 aa, Cryptosporidium parvum
VSSCTDSYIAHELQNKC

SEQ ID NO: 2354206 - protein, 26 aa, Cryptosporidium parvum
VSSKRYVCSGIRVLSGCLNNPYTRNY

SEQ ID NO: 2354207 - protein, 25 aa, Cryptosporidium parvum
VSSLESIPEFSARIERYKSLENTIL

SEQ ID NO: 2354208 - protein, 26 aa, Cryptosporidium parvum
VSSSIKRTLKFLWAISKGLPIISPST

SEQ ID NO: 2354209 - protein, 34 aa, Cryptosporidium parvum; identical to SEQ ID NO: 2183773

SEQ ID NO: 2354210 - protein, 24 aa, Cryptosporidium parvum
VSTGTSLFGSSLFQINKTSENSAA

SEQ ID NO: 2354211 - protein, 17 aa, Cryptosporidium parvum
VSVCTKPSIKHLELQNC

SEQ ID NO: 2354212 - protein, 30 aa, Cryptosporidium parvum
VSYYYFRGVPSWRWYYPYRYAPFACDIAII

SEQ ID NO: 2354213 - protein, 25 aa, Cryptosporidium parvum
VTGLCNRTSCPLSNLLYATVIEHEG

SEQ ID NO: 2354214 - protein, 17 aa, Cryptosporidium parvum
VTGSWDKTIKFWNGQSQ

SEQ ID NO: 2354215 - protein, 20 aa, Cryptosporidium parvum
VTHIYSFDAAMPIWMIKRFV

SEQ ID NO: 2354216 - protein, 19 aa, Cryptosporidium parvum
VTITPKFAASPPKPVSGAA

SEQ ID NO: 2354217 - protein, 18 aa, Cryptosporidium parvum
VTKCGKVYTWGQGGRLGH

SEQ ID NO: 2354218 - protein, 32 aa, Cryptosporidium parvum
VTLLEVFSKLSLRAKRNLFDFVEDKYLLELRL

SEQ ID NO: 2354219 - protein, 25 aa, Cryptosporidium parvum
VTSPEEVFELMALGHKHRAVASTNM

SEQ ID NO: 2354220 - protein, 18 aa, Cryptosporidium parvum
VVIIWDYLLANGLQSLIS

SEQ ID NO: 2354221 - protein, 24 aa, Cryptosporidium parvum
VVKKIKKAFCPPGIIEGNPCIEYI

SEQ ID NO: 2354222 - protein, 19 aa, Cryptosporidium parvum
VVNVFKRRNIEAVEFSAMG

SEQ ID NO: 2354223 - protein, 27 aa, Cryptosporidium parvum
VVVMPWRTFRFNECACAPYNADFDGDE

SEQ ID NO: 2354224 - protein, 19 aa, Cryptosporidium parvum
VVVVPSLYLNQIIRMDYIM

SEQ ID NO: 2354225 - protein, 19 aa, Cryptosporidium parvum
VVWSSVIACDFSKQENDNE

SEQ ID NO: 2354226 - protein, 23 aa, Cryptosporidium parvum
VVYGGGCSEMLMSVSVDELSKRV

SEQ ID NO: 2354227 - protein, 24 aa, Cryptosporidium parvum
VWVKHPKLAWAPATILRREEQGFV

SEQ ID NO: 2354228 - protein, 30 aa, Cryptosporidium parvum; identical to SEQ ID NO: 2183851

SEQ ID NO: 2354229 - protein, 24 aa, Cryptosporidium parvum
VYHGKKYYFGPVIEGIRYDKIQNR

SEQ ID NO: 2354230 - protein, 27 aa, Cryptosporidium parvum
VYQIEEVRDSLGYQKKRLIPIDQDELF

SEQ ID NO: 2354231 - protein, 17 aa, Cryptosporidium parvum
WATLPPIRILSFDIECI

SEQ ID NO: 2354232 - protein, 30 aa, Cryptosporidium parvum; identical to SEQ ID NO: 2183879

SEQ ID NO: 2354233 - protein, 17 aa, Cryptosporidium parvum
WDFAWNITSECFNYTNH

SEQ ID NO: 2354234 - protein, 17 aa, Cryptosporidium parvum
WDFPAGFTPSLSCKGFH

SEQ ID NO: 2354235 - protein, 20 aa, Cryptosporidium parvum
WDPSNGLIFGGNIHNCGTWM

SEQ ID NO: 2354236 - protein, 17 aa, Cryptosporidium parvum
WDSKLSKIYSIKKKIEE

SEQ ID NO: 2354237 - protein, 17 aa, Cryptosporidium parvum
WDVRKGPFKTVFVSESI

SEQ ID NO: 2354238 - protein, 21 aa, Cryptosporidium parvum
WEDLSNFYLRFNGNCKLLLEY

SEQ ID NO: 2354239 - protein, 25 aa, Cryptosporidium parvum
WETMNIPLRLVDMIRKRIFSQVNEP

SEQ ID NO: 2354240 - protein, 18 aa, Cryptosporidium parvum
WGERLLSYFQFERNADCL

SEQ ID NO: 2354241 - protein, 24 aa, Cryptosporidium parvum
WGETYKIYLGNVFQSVHPQILKSL

SEQ ID NO: 2354242 - protein, 25 aa, Cryptosporidium parvum
WKGVLSRRRFKLLLKEKAALKIQTI

SEQ ID NO: 2354243 - protein, 19 aa, Cryptosporidium parvum
WKPPHLNTADFAAIFYAES

SEQ ID NO: 2354244 - protein, 18 aa, Cryptosporidium parvum
WKTIGGVFDSENSINNLI

SEQ ID NO: 2354245 - protein, 22 aa, Cryptosporidium parvum
WKYNHWEVKGVCLRFEVGPRDI

SEQ ID NO: 2354246 - protein, 31 aa, Cryptosporidium parvum
WLLKNITFRLKEEFPGRFLIAEVVPENPNYL

SEQ ID NO: 2354247 - protein, 25 aa, Cryptosporidium parvum
WLPTMKLLLKYNCDINRRDHKNWTA

SEQ ID NO: 2354248 - protein, 21 aa, Cryptosporidium parvum
WLRIEIEMWIFNNINSNWSSV

SEQ ID NO: 2354249 - protein, 19 aa, Cryptosporidium parvum
WLYPYRILPMMFKDINNSV

SEQ ID NO: 2354250 - protein, 21 aa, Cryptosporidium parvum
WNNVYLLGRYIKFSRRISQSK

SEQ ID NO: 2354251 - protein, 23 aa, Cryptosporidium parvum
WPITCKKMSHILTREIGFQDLIE

SEQ ID NO: 2354252 - protein, 17 aa, Cryptosporidium parvum
WPLNIMSITALEEDESR

SEQ ID NO: 2354253 - protein, 24 aa, Cryptosporidium parvum
WQVFDTDKWCKVPISDPPSSNLLS

SEQ ID NO: 2354254 - protein, 26 aa, Cryptosporidium parvum
WRFDCSRCSISFSIKKNICERLSLGE

SEQ ID NO: 2354255 - protein, 20 aa, Cryptosporidium parvum
WRKKEVNIIINVGGIPFLLN

SEQ ID NO: 2354256 - protein, 31 aa, Cryptosporidium parvum; identical to SEQ ID NO: 2184076

SEQ ID NO: 2354257 - protein, 20 aa, Cryptosporidium parvum
WRNLIPRIWSIFIEEPLDIN

SEQ ID NO: 2354258 - protein, 17 aa, Cryptosporidium parvum
WRVPTCEMLYYSKPFDK

SEQ ID NO: 2354259 - protein, 18 aa, Cryptosporidium parvum
WSFELGPSKSRSLLIDKR

SEQ ID NO: 2354260 - protein, 17 aa, Cryptosporidium parvum
WSSSIKIRSLFQFIQCL

SEQ ID NO: 2354261 - protein, 17 aa, Cryptosporidium parvum
WSVGCILGELVLQQPLF

SEQ ID NO: 2354262 - protein, 26 aa, Cryptosporidium parvum
WTNPDLKCTLWRSSQPKSAFKRCIED

SEQ ID NO: 2354263 - protein, 20 aa, Cryptosporidium parvum
WTTRIEKILKAAAFMQQLKG

SEQ ID NO: 2354264 - protein, 17 aa, Cryptosporidium parvum
WYHSHPGFGCWFSGTDV

SEQ ID NO: 2354265 - protein, 18 aa, Cryptosporidium parvum
YAPIWLLSLKYLIQISQQ

SEQ ID NO: 2354266 - protein, 17 aa, Cryptosporidium parvum
YCEHEFLHGNLFSCEPN

SEQ ID NO: 2354267 - protein, 19 aa, Cryptosporidium parvum
YCHDYGASILCQGNRCNRQ

SEQ ID NO: 2354268 - protein, 21 aa, Cryptosporidium parvum
YCSKKRNLLSLKFVSSHNIES

SEQ ID NO: 2354269 - protein, 19 aa, Cryptosporidium parvum
YDFGRFAWNGYFDRNKNLL

SEQ ID NO: 2354270 - protein, 18 aa, Cryptosporidium parvum
YDFILSFTCIIANNIDEF

SEQ ID NO: 2354271 - protein, 17 aa, Cryptosporidium parvum
YDGAVLFCTDIASRGLD

SEQ ID NO: 2354272 - protein, 17 aa, Cryptosporidium parvum
YDGIEGVLGRGAYSSVF

SEQ ID NO: 2354273 - protein, 19 aa, Cryptosporidium parvum
YDGIIPLSINEIFNPEYTN

SEQ ID NO: 2354274 - protein, 24 aa, Cryptosporidium parvum
YDKCKSEIIEYILSQKEKVSTLTE

SEQ ID NO: 2354275 - protein, 26 aa, Cryptosporidium parvum
YDSGFKQKLLDILSIRPNQYGERITS

SEQ ID NO: 2354276 - protein, 19 aa, Cryptosporidium parvum
YEAFEAFNIANDERALQSL

SEQ ID NO: 2354277 - protein, 18 aa, Cryptosporidium parvum
YEKLCLLLGNLTDKLIEF

SEQ ID NO: 2354278 - protein, 19 aa, Cryptosporidium parvum
YELNARVALENHDLGQFNQ

SEQ ID NO: 2354279 - protein, 19 aa, Cryptosporidium parvum
YEPIKDIYSLPAKETKKTK

SEQ ID NO: 2354280 - protein, 18 aa, Cryptosporidium parvum
YEQARYNFISSLAGYSIA

SEQ ID NO: 2354281 - protein, 17 aa, Cryptosporidium parvum
YERAIETGVEILRRTLN

SEQ ID NO: 2354282 - protein, 22 aa, Cryptosporidium parvum
YEVISSLRISDGALLLVDVAEG

SEQ ID NO: 2354283 - protein, 18 aa, Cryptosporidium parvum
YFGHIVIDLLFFQAKKFA

SEQ ID NO: 2354284 - protein, 17 aa, Cryptosporidium parvum
YFKELLDYYCRTEDSVL

SEQ ID NO: 2354285 - protein, 32 aa, Cryptosporidium parvum; identical to SEQ ID NO: 2184265

SEQ ID NO: 2354286 - protein, 50 aa, Cryptosporidium parvum
YFSGKICPKCFSVYLIGINCKLEVKPIKGIIRKRLKKKLLKLSKISGQNF

SEQ ID NO: 2354287 - protein, 17 aa, Cryptosporidium parvum
YGGCGQLGFGNLEDCLV

SEQ ID NO: 2354288 - protein, 21 aa, Cryptosporidium parvum
YGKILNLRIVKDFQGESRGYA

SEQ ID NO: 2354289 - protein, 25 aa, Cryptosporidium parvum
YGNCESESTFLWKWMSDYCKSIANI

SEQ ID NO: 2354290 - protein, 24 aa, Cryptosporidium parvum
YHASISIFLFWAIWKTPSIVKNIN

SEQ ID NO: 2354291 - protein, 24 aa, Cryptosporidium parvum
YIAKPRKLLYIAVDGVAPRAKMNQ

SEQ ID NO: 2354292 - protein, 17 aa, Cryptosporidium parvum
YIAVWGIINEDDHLLLY

SEQ ID NO: 2354293 - protein, 27 aa, Cryptosporidium parvum
YIETNELFKVWSPHIVSPYVLSLYLKS

SEQ ID NO: 2354294 - protein, 25 aa, Cryptosporidium parvum
YINIIKGLKFIGSIFKMRKKNNLNI

SEQ ID NO: 2354295 - protein, 19 aa, Cryptosporidium parvum
YIQEKRKLGVWADNIEVQA

SEQ ID NO: 2354296 - protein, 22 aa, Cryptosporidium parvum
YISEVNPELIFEFQKYSKSSIQ

SEQ ID NO: 2354297 - protein, 24 aa, Cryptosporidium parvum
YKEVKEKVFIVGRLIRYVSKALNI

SEQ ID NO: 2354298 - protein, 22 aa, Cryptosporidium parvum
YKEYVELEMKRIIGESDPNALN

SEQ ID NO: 2354299 - protein, 19 aa, Cryptosporidium parvum
YKITFTIILDSKMAFFQSI

SEQ ID NO: 2354300 - protein, 20 aa, Cryptosporidium parvum
YKNELDSFSGIGIVDNSLNM

SEQ ID NO: 2354301 - protein, 26 aa, Cryptosporidium parvum
YKNYLKSRRKFFKSVEAILSNFSANP

SEQ ID NO: 2354302 - protein, 17 aa, Cryptosporidium parvum
YKPRDYDPVPGFDSENS

SEQ ID NO: 2354303 - protein, 27 aa, Cryptosporidium parvum
YKSFNKKSIDGWKVLVDVERGRTVENW

SEQ ID NO: 2354304 - protein, 22 aa, Cryptosporidium parvum
YKVRILLCLVDIPPSGAIDAAI

SEQ ID NO: 2354305 - protein, 21 aa, Cryptosporidium parvum
YKVSTSMLFDIQVKRIHEYKR

SEQ ID NO: 2354306 - protein, 25 aa, Cryptosporidium parvum
YLDDIGALCACIRVFQDSLSPISQH

SEQ ID NO: 2354307 - protein, 19 aa, Cryptosporidium parvum
YLEKLSPTAFKGFQKRFFK

SEQ ID NO: 2354308 - protein, 25 aa, Cryptosporidium parvum
YLGISCKLKYFYDIEEFLKDYNTIS

SEQ ID NO: 2354309 - protein, 17 aa, Cryptosporidium parvum
YLHVIRWKVRNTKLELE

SEQ ID NO: 2354310 - protein, 17 aa, Cryptosporidium parvum
YLINYTYQYGYGSWDQI

SEQ ID NO: 2354311 - protein, 19 aa, Cryptosporidium parvum
YLKAMLRKYMNAGCHINKI

SEQ ID NO: 2354312 - protein, 23 aa, Cryptosporidium parvum
YLKELRFLVENTILAVADRNSEN

SEQ ID NO: 2354313 - protein, 22 aa, Cryptosporidium parvum
YLKSLLKRKVHSHSSIRVVFPD

SEQ ID NO: 2354314 - protein, 41 aa, Cryptosporidium parvum; identical to SEQ ID NO: 2307359

SEQ ID NO: 2354315 - protein, 25 aa, Cryptosporidium parvum
YLLEFKDSFQAWQICSELLEVSVEP

SEQ ID NO: 2354316 - protein, 17 aa, Cryptosporidium parvum
YLLYILEDFVPAFIETI

SEQ ID NO: 2354317 - protein, 25 aa, Cryptosporidium parvum
YLNGVWIKNGLSFVVSQKYGSFEIY

SEQ ID NO: 2354318 - protein, 19 aa, Cryptosporidium parvum
YLNPYCPRCKVDTVCNLKR

SEQ ID NO: 2354319 - protein, 19 aa, Cryptosporidium parvum
YLSYIECARQCIPNNIEIV

SEQ ID NO: 2354320 - protein, 17 aa, Cryptosporidium parvum
YMEEVLGSLWCLDNVPG

SEQ ID NO: 2354321 - protein, 25 aa, Cryptosporidium parvum
YMHKRKRVCSIIDKLKKLDKLKPVQ

SEQ ID NO: 2354322 - protein, 19 aa, Cryptosporidium parvum
YNEGIPFVQPMTADNLKHS

SEQ ID NO: 2354323 - protein, 25 aa, Cryptosporidium parvum
YNKPGSCGWDIFTLDFNIPERTNLS

SEQ ID NO: 2354324 - protein, 41 aa, Cryptosporidium parvum; identical to SEQ ID NO: 2184552

SEQ ID NO: 2354325 - protein, 23 aa, Cryptosporidium parvum
YNQFFPRVKFITKIVEKNKENKD

SEQ ID NO: 2354326 - protein, 31 aa, Cryptosporidium parvum
YNSWKKQRYSVPWCYENFLQSRALKGAQDVR

SEQ ID NO: 2354327 - protein, 24 aa, Cryptosporidium parvum
YPKFSEKLRVLFSLDGENGNCKLF

SEQ ID NO: 2354328 - protein, 20 aa, Cryptosporidium parvum
YPMYVSLAVSVGRLVQNPLA

SEQ ID NO: 2354329 - protein, 29 aa, Cryptosporidium parvum
YRKKKLLNIRMLYPFTIRCNGCEVYHYVG

SEQ ID NO: 2354330 - protein, 23 aa, Cryptosporidium parvum
YRMALEEARKALSSNSFNNRENR

SEQ ID NO: 2354331 - protein, 26 aa, Cryptosporidium parvum
YRQKLHPCEICAAFLSETDNDQRLND

SEQ ID NO: 2354332 - protein, 17 aa, Cryptosporidium parvum
YRTRSSSYCTSTCSSSS

SEQ ID NO: 2354333 - protein, 28 aa, Cryptosporidium parvum
YRVSGYAGKVLFGWDFPAGFTPSLSCKG

SEQ ID NO: 2354334 - protein, 23 aa, Cryptosporidium parvum
YRYSFPEQFFLNDFSEILRDDTF

SEQ ID NO: 2354335 - protein, 22 aa, Cryptosporidium parvum
YSHPYNFPKASFLPPNTEPSSN

SEQ ID NO: 2354336 - protein, 27 aa, Cryptosporidium parvum
YSKLICINFRLPVILTNFMAPTKKMGK

SEQ ID NO: 2354337 - protein, 19 aa, Cryptosporidium parvum
YSLIKHVYFLLDTVQEEAK

SEQ ID NO: 2354338 - protein, 24 aa, Cryptosporidium parvum
YSLSCISFGIPMVFMGTENLQGKW

SEQ ID NO: 2354339 - protein, 25 aa, Cryptosporidium parvum
YSRKNGYCYFHLDLSFGEVRNPHYW

SEQ ID NO: 2354340 - protein, 24 aa, Cryptosporidium parvum
YSSNFIWDLVRSIPIESLNRLYVS

SEQ ID NO: 2354341 - protein, 17 aa, Cryptosporidium parvum
YSVPLFVLEKCLLSPTQ

SEQ ID NO: 2354342 - protein, 18 aa, Cryptosporidium parvum
YSWSDCGESIEIYISLQD

SEQ ID NO: 2354343 - protein, 23 aa, Cryptosporidium parvum
YTEYKTGKTLTFFEELNRSFPII

SEQ ID NO: 2354344 - protein, 26 aa, Cryptosporidium parvum
YTGMFPRFEHSTELTILLDQQSVSNK

SEQ ID NO: 2354345 - protein, 17 aa, Cryptosporidium parvum
YTLFSHINGFKELRFIP

SEQ ID NO: 2354346 - protein, 18 aa, Cryptosporidium parvum
YTPGWKYNHWEVKGVCLR

SEQ ID NO: 2354347 - protein, 37 aa, Cryptosporidium parvum; identical to SEQ ID NO: 2307669

SEQ ID NO: 2354348 - protein, 23 aa, Cryptosporidium parvum
YVELYLDWFLNKSIESQFRAFYN

SEQ ID NO: 2354349 - protein, 26 aa, Cryptosporidium parvum
YVFEKLRNYDIMLIIIEYISEVNPEL

SEQ ID NO: 2354350 - protein, 19 aa, Cryptosporidium parvum
YVHPLKVHLSNVFSHPKYR

SEQ ID NO: 2354351 - protein, 41 aa, Cryptosporidium parvum; identical to SEQ ID NO: 2307688

SEQ ID NO: 2354352 - protein, 25 aa, Cryptosporidium parvum
YVLERCNNGTFLPHIGEILEKYQSD

SEQ ID NO: 2354353 - protein, 17 aa, Cryptosporidium parvum
YWICNLPELSLNMLKGF

SEQ ID NO: 2354354 - protein, 20 aa, Cryptosporidium parvum
YWQLIKRLLNLFVDESESEN

SEQ ID NO: 2354355 - protein, 17 aa, Cryptosporidium parvum
YWSQKPQGWRVVYYTGK

SEQ ID NO: 2354356 - protein, 30 aa, Cryptosporidium parvum; identical to SEQ ID NO: 2307718

SEQ ID NO: 2354357 - protein, 26 aa, Cryptosporidium parvum
YYSQIYIPGYLFGMISTRLTVDDCPL

SEQ ID NO: 2354358 - protein, 17 aa, Cryptosporidium parvum
ACQIFKSSLSKIRYNDI

SEQ ID NO: 2354359 - protein, 20 aa, Cryptosporidium parvum
ACVSIIPSVRSIYKFKGQVH

SEQ ID NO: 2354360 - protein, 24 aa, Cryptosporidium parvum
ADAQEFKPTFGITGSNVIPNSGIY

SEQ ID NO: 2354361 - protein, 25 aa, Cryptosporidium parvum
AEEKLYIRRVCLIQSTFRMYLQRRY

SEQ ID NO: 2354362 - protein, 17 aa, Cryptosporidium parvum
AELSLKVVYDMLKRREA

SEQ ID NO: 2354363 - protein, 20 aa, Cryptosporidium parvum
AFGIPPRFSESLIMNTNEGK

SEQ ID NO: 2354364 - protein, 20 aa, Cryptosporidium parvum
AFRCSGCPYKGMPAFKPGEK

SEQ ID NO: 2354365 - protein, 17 aa, Cryptosporidium parvum
AIARLLPYHTFYVDEIK

SEQ ID NO: 2354366 - protein, 24 aa, Cryptosporidium parvum
AIDEAHCVCQWGFDFRPDYIQLCK

SEQ ID NO: 2354367 - protein, 19 aa, Cryptosporidium parvum
AKLLEDWDVIGHFFQDCMS

SEQ ID NO: 2354368 - protein, 23 aa, Cryptosporidium parvum
AKPLKRLSCPAIFFDCTHDNETP

SEQ ID NO: 2354369 - protein, 20 aa, Cryptosporidium parvum
ALTIRCLNIRHTISLEAIIG

SEQ ID NO: 2354370 - protein, 24 aa, Cryptosporidium parvum
ASIVGTRCVVVWIGIRDCLSQESL

SEQ ID NO: 2354371 - protein, 17 aa, Cryptosporidium parvum
ATSFSWKSLYQADTTFT

SEQ ID NO: 2354372 - protein, 18 aa, Cryptosporidium parvum
CGQCKRYLTYISNILPQR

SEQ ID NO: 2354373 - protein, 19 aa, Cryptosporidium parvum
CKGILFAIQVCKAIMEGNY

SEQ ID NO: 2354374 - protein, 18 aa, Cryptosporidium parvum
CLKCIGLCESEIFEILRI

SEQ ID NO: 2354375 - protein, 20 aa, Cryptosporidium parvum
CQNYFLYKRIRSIIGKGEKI

SEQ ID NO: 2354376 - protein, 20 aa, Cryptosporidium parvum
CRRCNSMAGTFCYMAPEILK

SEQ ID NO: 2354377 - protein, 17 aa, Cryptosporidium parvum
CSYLVLWLDCDREGENI

SEQ ID NO: 2354378 - protein, 17 aa, Cryptosporidium parvum
CVEFCKKFNIPLLILGG

SEQ ID NO: 2354379 - protein, 17 aa, Cryptosporidium parvum
CYILRPWSYFIWETIQS

SEQ ID NO: 2354380 - protein, 17 aa, Cryptosporidium parvum
DCLCWRCYFNQRPFFEE

SEQ ID NO: 2354381 - protein, 25 aa, Cryptosporidium parvum
DILLERWNPFLLYKFEQEYLKNGAI

SEQ ID NO: 2354382 - protein, 18 aa, Cryptosporidium parvum
DKQIPCRFHLISVPPNSR

SEQ ID NO: 2354383 - protein, 20 aa, Cryptosporidium parvum
DLKCLICFNTGILKRVLIPQ

SEQ ID NO: 2354384 - protein, 24 aa, Cryptosporidium parvum
DLLSSCFAFHFSLMKTRKIFYDLL

SEQ ID NO: 2354385 - protein, 20 aa, Cryptosporidium parvum
DYKAIFTWKRFNQIKYVLDT

SEQ ID NO: 2354386 - protein, 21 aa, Cryptosporidium parvum
EDIELRFTLNLEEDLSKFKEA

SEQ ID NO: 2354387 - protein, 20 aa, Cryptosporidium parvum
EFIKCKLINISYAFPSDTEH

SEQ ID NO: 2354388 - protein, 17 aa, Cryptosporidium parvum
EKFNCYNCQAELEIISN

SEQ ID NO: 2354389 - protein, 23 aa, Cryptosporidium parvum
EKKRIFEGLTFFISREVPLLPLA

SEQ ID NO: 2354390 - protein, 20 aa, Cryptosporidium parvum
ELKTNLWLERSWIIHFSGSN

SEQ ID NO: 2354391 - protein, 17 aa, Cryptosporidium parvum
EMLYSKQVKDYIVKFNN

SEQ ID NO: 2354392 - protein, 17 aa, Cryptosporidium parvum
ENKCRVVVCSDLLARGI

SEQ ID NO: 2354393 - protein, 24 aa, Cryptosporidium parvum
ENPELFANILIEWSKKGYKSEKDI

SEQ ID NO: 2354394 - protein, 21 aa, Cryptosporidium parvum
ESAFKRLAFKRFKSVPLYIEW

SEQ ID NO: 2354395 - protein, 23 aa, Cryptosporidium parvum
ESCLPLRILIKFERKTLKDKDRE

SEQ ID NO: 2354396 - protein, 19 aa, Cryptosporidium parvum
ESFCRYVSLVLEDDFFEKS

SEQ ID NO: 2354397 - protein, 19 aa, Cryptosporidium parvum
ESLSSKSGWNKKQLFGNEV

SEQ ID NO: 2354398 - protein, 19 aa, Cryptosporidium parvum
ETCIKRPKFRLIVTSATLE

SEQ ID NO: 2354399 - protein, 23 aa, Cryptosporidium parvum
ETDFKLSIPILIELIKKDNLDEI

SEQ ID NO: 2354400 - protein, 25 aa, Cryptosporidium parvum
ETLSEWRNELLLAILEKISESKMFQ

SEQ ID NO: 2354401 - protein, 17 aa, Cryptosporidium parvum
EYLDLFPCFVLAIFKSL

SEQ ID NO: 2354402 - protein, 17 aa, Cryptosporidium parvum
FASGNVDGVTTRTETFV

SEQ ID NO: 2354403 - protein, 21 aa, Cryptosporidium parvum
FDLSLFIKMILILRFEVKLIR

SEQ ID NO: 2354404 - protein, 17 aa, Cryptosporidium parvum
FEQEYLKNGAILMDNNI

SEQ ID NO: 2354405 - protein, 25 aa, Cryptosporidium parvum
FGITPWMPFWFRFTPINAKTVSNPL

SEQ ID NO: 2354406 - protein, 22 aa, Cryptosporidium parvum
FGRIGRLVLRACMERNDITVVA

SEQ ID NO: 2354407 - protein, 19 aa, Cryptosporidium parvum
FIDRGWRDCFECFKHENRY

SEQ ID NO: 2354408 - protein, 24 aa, Cryptosporidium parvum
FIIKSSQCPIIFSCRMAIVNNSKK

SEQ ID NO: 2354409 - protein, 19 aa, Cryptosporidium parvum
FILNYCKKCFENIMNGESV

SEQ ID NO: 2354410 - protein, 18 aa, Cryptosporidium parvum
FINFILLWLRFGEIPLEG

SEQ ID NO: 2354411 - protein, 19 aa, Cryptosporidium parvum
FKIAIALAENCQLPVFITL

SEQ ID NO: 2354412 - protein, 21 aa, Cryptosporidium parvum
FKRFKSVPLYIEWAPVNLFVS

SEQ ID NO: 2354413 - protein, 23 aa, Cryptosporidium parvum
FKSGWKLDKEWEIEQKKKRLKIE

SEQ ID NO: 2354414 - protein, 20 aa, Cryptosporidium parvum
FLLNLLIKFGILRSDASDLH

SEQ ID NO: 2354415 - protein, 22 aa, Cryptosporidium parvum
FLSFKPKFMYSIPFKCNENKYS

SEQ ID NO: 2354416 - protein, 18 aa, Cryptosporidium parvum
FNGPSYFCSYSFASVFSR

SEQ ID NO: 2354417 - protein, 20 aa, Cryptosporidium parvum
FNPRSGIRWLCFILGEYGKL

SEQ ID NO: 2354418 - protein, 18 aa, Cryptosporidium parvum
FPCILKIIPQYIFNARDP

SEQ ID NO: 2354419 - protein, 20 aa, Cryptosporidium parvum
FPHFEFLLDYMILFSPCGQL

SEQ ID NO: 2354420 - protein, 23 aa, Cryptosporidium parvum
FPPDAWHLCCWLLRKNSNERASP

SEQ ID NO: 2354421 - protein, 18 aa, Cryptosporidium parvum
FSVYLIGINCKLEVKPIK

SEQ ID NO: 2354422 - protein, 17 aa, Cryptosporidium parvum
FTCEGRQLLTLKTAESS

SEQ ID NO: 2354423 - protein, 25 aa, Cryptosporidium parvum
FYLHSRCLITIPFLQWELINDQVYT

SEQ ID NO: 2354424 - protein, 19 aa, Cryptosporidium parvum
GDRLGCFNLSLKGHGHAVS

SEQ ID NO: 2354425 - protein, 22 aa, Cryptosporidium parvum
GFKLWTRREFNLLLRCLETNGV

SEQ ID NO: 2354426 - protein, 18 aa, Cryptosporidium parvum
GFMFSMVVSYTWNNVYLL

SEQ ID NO: 2354427 - protein, 19 aa, Cryptosporidium parvum
GFSSLHWASLKGHSQVVEE

SEQ ID NO: 2354428 - protein, 20 aa, Cryptosporidium parvum
GGAIALRLAEYIGQICQEDN

SEQ ID NO: 2354429 - protein, 19 aa, Cryptosporidium parvum
GHRIPMGLLLGGRDALENE

SEQ ID NO: 2354430 - protein, 20 aa, Cryptosporidium parvum
GKICPKCFSVYLIGINCKLE

SEQ ID NO: 2354431 - protein, 33 aa, Cryptosporidium parvum
GKRKFRFSSLCPKLLNCLFPWIRSEQYFEDHDQ

SEQ ID NO: 2354432 - protein, 18 aa, Cryptosporidium parvum
GLGMKLTLSGNVSSVKPI

SEQ ID NO: 2354433 - protein, 17 aa, Cryptosporidium parvum
GLIPVCVFDGATLPMKR

SEQ ID NO: 2354434 - protein, 22 aa, Cryptosporidium parvum
GRCNCGYPIFIINGEVIAGSSG

SEQ ID NO: 2354435 - protein, 21 aa, Cryptosporidium parvum
GRNWIRRMVYQISSSFVTIPI

SEQ ID NO: 2354436 - protein, 17 aa, Cryptosporidium parvum
GRPGWHIECSVMASNTL

SEQ ID NO: 2354437 - protein, 18 aa, Cryptosporidium parvum
GTLKFTTNNYLKWDPSHL

SEQ ID NO: 2354438 - protein, 17 aa, Cryptosporidium parvum
GVEKSYEMALRFYQVNI

SEQ ID NO: 2354439 - protein, 23 aa, Cryptosporidium parvum
GVQARLLPLFSFVSRYSTINESY

SEQ ID NO: 2354440 - protein, 19 aa, Cryptosporidium parvum
GYCFIEFLGKLEAISALEQ

SEQ ID NO: 2354441 - protein, 17 aa, Cryptosporidium parvum
GYCYFHLDLSFGEVRNP

SEQ ID NO: 2354442 - protein, 18 aa, Cryptosporidium parvum
GYGLLKLMGINGIIGTTT

SEQ ID NO: 2354443 - protein, 17 aa, Cryptosporidium parvum
HAILRIKIESHINSNDV

SEQ ID NO: 2354444 - protein, 18 aa, Cryptosporidium parvum
HILSVFGFEELYRMNILE

SEQ ID NO: 2354445 - protein, 19 aa, Cryptosporidium parvum
HMRGFPYCRIDGNTSGDDR

SEQ ID NO: 2354446 - protein, 17 aa, Cryptosporidium parvum
HMRVIRELLGFDIEELN

SEQ ID NO: 2354447 - protein, 17 aa, Cryptosporidium parvum
HNLEFKTSFPYVSNGGV

SEQ ID NO: 2354448 - protein, 17 aa, Cryptosporidium parvum
ICELLRSPRFCRSTSII

SEQ ID NO: 2354449 - protein, 18 aa, Cryptosporidium parvum
ICGVYCLDVGFLTDASKF

SEQ ID NO: 2354450 - protein, 20 aa, Cryptosporidium parvum
ICINFRLPVILTNFMAPTKK

SEQ ID NO: 2354451 - protein, 17 aa, Cryptosporidium parvum
IEILKRDIDIFLKSGDV

SEQ ID NO: 2354452 - protein, 17 aa, Cryptosporidium parvum
IESSIAIRCGKGKMRNR

SEQ ID NO: 2354453 - protein, 25 aa, Cryptosporidium parvum
IFEILRICAGILHLCNFDFIQESAS

SEQ ID NO: 2354454 - protein, 17 aa, Cryptosporidium parvum
IFESLGIAQPKGVLLYG

SEQ ID NO: 2354455 - protein, 18 aa, Cryptosporidium parvum
IGLLKLVFDKATTQHHFI

SEQ ID NO: 2354456 - protein, 17 aa, Cryptosporidium parvum
IGYKICDRLGAGSASVV

SEQ ID NO: 2354457 - protein, 22 aa, Cryptosporidium parvum
IKKAYHKLAIKWHPDKNMGNDR

SEQ ID NO: 2354458 - protein, 24 aa, Cryptosporidium parvum
IKLFTSIGMWKSLFLTLNYSTYIR

SEQ ID NO: 2354459 - protein, 19 aa, Cryptosporidium parvum
IKTCKEWYRRIQSHFLNGL

SEQ ID NO: 2354460 - protein, 23 aa, Cryptosporidium parvum
ILFERCFQEYLLLCCDPTESAAN

SEQ ID NO: 2354461 - protein, 18 aa, Cryptosporidium parvum
ILPFDWFPNLCRIPYRIY

SEQ ID NO: 2354462 - protein, 17 aa, Cryptosporidium parvum
ILTLCKLYSTLTNLNRS

SEQ ID NO: 2354463 - protein, 17 aa, Cryptosporidium parvum
ILVTALQRWDFRICGVY

SEQ ID NO: 2354464 - protein, 19 aa, Cryptosporidium parvum
ILWPECLKSPFSYKFETNI

SEQ ID NO: 2354465 - protein, 22 aa, Cryptosporidium parvum
IMITSLWSCIYKSLRYNMNRYN

SEQ ID NO: 2354466 - protein, 19 aa, Cryptosporidium parvum
INLSSVIAIHIEDALNFVI

SEQ ID NO: 2354467 - protein, 22 aa, Cryptosporidium parvum
INNGNKWKGWGIKSGESTNADL

SEQ ID NO: 2354468 - protein, 18 aa, Cryptosporidium parvum
INQWTSIVRWEFKHPTPF

SEQ ID NO: 2354469 - protein, 21 aa, Cryptosporidium parvum
IPKERSCIFLDSIDEQDSSVN

SEQ ID NO: 2354470 - protein, 18 aa, Cryptosporidium parvum
IPVLCIKLGSTILNKEFS

SEQ ID NO: 2354471 - protein, 17 aa, Cryptosporidium parvum
IQIFSCLSVSTETRVRV

SEQ ID NO: 2354472 - protein, 17 aa, Cryptosporidium parvum
IRRKSWLILNVLLLMVD

SEQ ID NO: 2354473 - protein, 27 aa, Cryptosporidium parvum
ISELRYIVLICIRWRLQNSSELSSNVS

SEQ ID NO: 2354474 - protein, 17 aa, Cryptosporidium parvum
ISSFLLGRTSLYSPTSV

SEQ ID NO: 2354475 - protein, 18 aa, Cryptosporidium parvum
IVEGLKLDKGYISPYFIT

SEQ ID NO: 2354476 - protein, 17 aa, Cryptosporidium parvum
IVFSIIIHSNRWLQDNS

SEQ ID NO: 2354477 - protein, 17 aa, Cryptosporidium parvum
IVKRSGRPGITLIDKNF

SEQ ID NO: 2354478 - protein, 17 aa, Cryptosporidium parvum
IVRWEFKHPTPFIRTRE

SEQ ID NO: 2354479 - protein, 20 aa, Cryptosporidium parvum
KAICCLTKLFQCCPDRLRAN

SEQ ID NO: 2354480 - protein, 18 aa, Cryptosporidium parvum
KAPWKSRYLFEIFRNRQL

SEQ ID NO: 2354481 - protein, 21 aa, Cryptosporidium parvum
KDGGLPCIVWLLLAIVHCSVN

SEQ ID NO: 2354482 - protein, 21 aa, Cryptosporidium parvum
KDLKHIFGFGNPKIFSLNTCP

SEQ ID NO: 2354483 - protein, 17 aa, Cryptosporidium parvum
KDRCTGLIANLHRMGIN

SEQ ID NO: 2354484 - protein, 25 aa, Cryptosporidium parvum
KDSILPLRLMKHLKLFPNIIEMARV

SEQ ID NO: 2354485 - protein, 24 aa, Cryptosporidium parvum
KEMRRLCSILTFLFDSKNSGCLEF

SEQ ID NO: 2354486 - protein, 18 aa, Cryptosporidium parvum
KERLKIILVLNKMDRLIL

SEQ ID NO: 2354487 - protein, 24 aa, Cryptosporidium parvum
KFYLCGLCPHELFENTKLYMGPCK

SEQ ID NO: 2354488 - protein, 21 aa, Cryptosporidium parvum
KGSFKYAWVLDKLKAERERGI

SEQ ID NO: 2354489 - protein, 18 aa, Cryptosporidium parvum
KIPMFWLQVKLIEILELF

SEQ ID NO: 2354490 - protein, 17 aa, Cryptosporidium parvum
KIPQLIRHLGWDESIPL

SEQ ID NO: 2354491 - protein, 20 aa, Cryptosporidium parvum
KKCRNGVHCCFCHFQHKERK

SEQ ID NO: 2354492 - protein, 20 aa, Cryptosporidium parvum
KKFVPRCCFFGGKAAPGYAT

SEQ ID NO: 2354493 - protein, 22 aa, Cryptosporidium parvum
KKKKAPILRRIFGKKGSSNTDE

SEQ ID NO: 2354494 - protein, 24 aa, Cryptosporidium parvum
KKLLNIRMLYPFTIRCNGCEVYHY

SEQ ID NO: 2354495 - protein, 19 aa, Cryptosporidium parvum
KLASFYVRDILKFILNEES

SEQ ID NO: 2354496 - protein, 23 aa, Cryptosporidium parvum
KLKIGCKVLELYGKQSLQKRLEV

SEQ ID NO: 2354497 - protein, 24 aa, Cryptosporidium parvum
KLLSECGTILRWSRQEDPTTKKLS

SEQ ID NO: 2354498 - protein, 18 aa, Cryptosporidium parvum
KLPIIYQCYGDFYYYHYN

SEQ ID NO: 2354499 - protein, 18 aa, Cryptosporidium parvum
KLTFNWPGARLVRDLWAL

SEQ ID NO: 2354500 - protein, 18 aa, Cryptosporidium parvum
KMYLAIKTCKEWYRRIQS

SEQ ID NO: 2354501 - protein, 17 aa, Cryptosporidium parvum
KMYYPHYICVGISDRKS

SEQ ID NO: 2354502 - protein, 17 aa, Cryptosporidium parvum
KNWFCFQCLSLTLRILP

SEQ ID NO: 2354503 - protein, 19 aa, Cryptosporidium parvum
KPFPGLISKVSVPWKRVKT

SEQ ID NO: 2354504 - protein, 20 aa, Cryptosporidium parvum
KPGSCGWDIFTLDFNIPERT

SEQ ID NO: 2354505 - protein, 21 aa, Cryptosporidium parvum
KPQGWRVVYYTGKDREFEYFK

SEQ ID NO: 2354506 - protein, 20 aa, Cryptosporidium parvum
KQRYSVPWCYENFLQSRALK

SEQ ID NO: 2354507 - protein, 22 aa, Cryptosporidium parvum
KQTKEFNIEFGLEKNTGIKQSN

SEQ ID NO: 2354508 - protein, 20 aa, Cryptosporidium parvum
KRDLIVWSDCVKLKYGNCES

SEQ ID NO: 2354509 - protein, 21 aa, Cryptosporidium parvum
KRFTLLFHISKMYLAIKTCKE

SEQ ID NO: 2354510 - protein, 23 aa, Cryptosporidium parvum
KRSFPRFEFEDHFQVSLLDSQQY

SEQ ID NO: 2354511 - protein, 20 aa, Cryptosporidium parvum
KSDQAVKCLIQDANLNMPKV

SEQ ID NO: 2354512 - protein, 17 aa, Cryptosporidium parvum
KSILPILEFCISSRSPL

SEQ ID NO: 2354513 - protein, 18 aa, Cryptosporidium parvum
KSSLWKSLAIYLIGALEI

SEQ ID NO: 2354514 - protein, 20 aa, Cryptosporidium parvum
KSTWSRIFSPLSFGFDKREL

SEQ ID NO: 2354515 - protein, 28 aa, Cryptosporidium parvum
KTQECAFPHYWRYLAIWKLFTNQELVTY

SEQ ID NO: 2354516 - protein, 18 aa, Cryptosporidium parvum
KTTTRFASGNVDGVTTRT

SEQ ID NO: 2354517 - protein, 22 aa, Cryptosporidium parvum
KVPLTFSLRGKKMFLRAKGIQR

SEQ ID NO: 2354518 - protein, 20 aa, Cryptosporidium parvum
KVVIDCFRLISPHSVIAGQE

SEQ ID NO: 2354519 - protein, 17 aa, Cryptosporidium parvum
KYWLHIRRLPVAKDGGL

SEQ ID NO: 2354520 - protein, 18 aa, Cryptosporidium parvum
LARRLFRKPVNTLLPGTY

SEQ ID NO: 2354521 - protein, 23 aa, Cryptosporidium parvum
LAYRLCFLACHIEVVNAIASADD

SEQ ID NO: 2354522 - protein, 18 aa, Cryptosporidium parvum
LDALKTLPGWGARQKLER

SEQ ID NO: 2354523 - protein, 18 aa, Cryptosporidium parvum
LDLFPCFVLAIFKSLVLL

SEQ ID NO: 2354524 - protein, 22 aa, Cryptosporidium parvum
LDLKEFYTCIGLVSDLLVSILK

SEQ ID NO: 2354525 - protein, 24 aa, Cryptosporidium parvum
LDPRIVMRILFNFRKLYPVSYKTR

SEQ ID NO: 2354526 - protein, 17 aa, Cryptosporidium parvum
LDYELICIDFFLRYISN

SEQ ID NO: 2354527 - protein, 19 aa, Cryptosporidium parvum
LEEIISFQGLWKSICEIEG

SEQ ID NO: 2354528 - protein, 24 aa, Cryptosporidium parvum
LENFLKEWDKICVIVSHSRDLLNQ

SEQ ID NO: 2354529 - protein, 20 aa, Cryptosporidium parvum
LEYMRFSTLFLKKLIIGPIQ

SEQ ID NO: 2354530 - protein, 18 aa, Cryptosporidium parvum
LFHPDCIQQLLFCFHNNF

SEQ ID NO: 2354531 - protein, 17 aa, Cryptosporidium parvum
LFLTLNYSTYIRRKREM

SEQ ID NO: 2354532 - protein, 24 aa, Cryptosporidium parvum
LGKGWKIFLSRSVDLGRWTIIQKL

SEQ ID NO: 2354533 - protein, 18 aa, Cryptosporidium parvum
LGLCKPCVFVNKTNKKCR

SEQ ID NO: 2354534 - protein, 17 aa, Cryptosporidium parvum
LHRAFIIQPGWFFKAVW

SEQ ID NO: 2354535 - protein, 17 aa, Cryptosporidium parvum
LILELGFDVKEAYIHIT

SEQ ID NO: 2354536 - protein, 18 aa, Cryptosporidium parvum
LIPPEFKKSCTIALHSQY

SEQ ID NO: 2354537 - protein, 17 aa, Cryptosporidium parvum
LKTLPGWGARQKLERFG

SEQ ID NO: 2354538 - protein, 20 aa, Cryptosporidium parvum
LLGFNCTIFAYGQTGTGKTY

SEQ ID NO: 2354539 - protein, 17 aa, Cryptosporidium parvum
LLHPERFVQLGIDPPKG

SEQ ID NO: 2354540 - protein, 17 aa, Cryptosporidium parvum
LLKYWLHIRRLPVAKDG

SEQ ID NO: 2354541 - protein, 17 aa, Cryptosporidium parvum
LLNCHVGDWQPVDSDRV

SEQ ID NO: 2354542 - protein, 19 aa, Cryptosporidium parvum
LNNLLSFKGNLLRIGKPKV

SEQ ID NO: 2354543 - protein, 19 aa, Cryptosporidium parvum
LNRSFPIICLLLFERRVRS

SEQ ID NO: 2354544 - protein, 18 aa, Cryptosporidium parvum
LNVLKSVGFVIVKLKPSQ

SEQ ID NO: 2354545 - protein, 19 aa, Cryptosporidium parvum
LPKDSRLVIYGKFKDNPLV

SEQ ID NO: 2354546 - protein, 19 aa, Cryptosporidium parvum
LQVSLADFRRLCILKGVYP

SEQ ID NO: 2354547 - protein, 18 aa, Cryptosporidium parvum
LRFFGNMVLSLWDCGGQD

SEQ ID NO: 2354548 - protein, 19 aa, Cryptosporidium parvum
LRQSSCLIRSLIITLNTIQ

SEQ ID NO: 2354549 - protein, 18 aa, Cryptosporidium parvum
LRVGAAIGVNEIERAKLL

SEQ ID NO: 2354550 - protein, 24 aa, Cryptosporidium parvum
LSGSVLKAQILWRGKLARRQFQKL

SEQ ID NO: 2354551 - protein, 18 aa, Cryptosporidium parvum
LSIFCSRFKAPICSTCGA

SEQ ID NO: 2354552 - protein, 19 aa, Cryptosporidium parvum
LSNFILELCIDDILTSLDT

SEQ ID NO: 2354553 - protein, 19 aa, Cryptosporidium parvum
LTDNALLYWREEPTFPDQQ

SEQ ID NO: 2354554 - protein, 19 aa, Cryptosporidium parvum
LYLKACKFVSVSQTNNKVI

SEQ ID NO: 2354555 - protein, 17 aa, Cryptosporidium parvum
MILILRFEVKLIRICNN

SEQ ID NO: 2354556 - protein, 19 aa, Cryptosporidium parvum
MKKVFCKSKKPIGSLKDFV

SEQ ID NO: 2354557 - protein, 19 aa, Cryptosporidium parvum
MKNQFCKLVDNFVEETSKA

SEQ ID NO: 2354558 - protein, 21 aa, Cryptosporidium parvum
MPIWMIKRFVDLFNASRTTYC

SEQ ID NO: 2354559 - protein, 19 aa, Cryptosporidium parvum
MTSKHVWGPINLFYPDVKS

SEQ ID NO: 2354560 - protein, 18 aa, Cryptosporidium parvum
MVVSYTWNNVYLLGRYIK

SEQ ID NO: 2354561 - protein, 25 aa, Cryptosporidium parvum
MYWCDIMQFYLFFCPKCIYLKQSNV

SEQ ID NO: 2354562 - protein, 21 aa, Cryptosporidium parvum
NALLASCCGKGQLLLTLVYGN

SEQ ID NO: 2354563 - protein, 23 aa, Cryptosporidium parvum
NCPSYSELFLFSIIYDDSILIKE

SEQ ID NO: 2354564 - protein, 18 aa, Cryptosporidium parvum
NCSYWGRRAFERHFSETR

SEQ ID NO: 2354565 - protein, 19 aa, Cryptosporidium parvum
NCVRIMFGISEFMKESQDA

SEQ ID NO: 2354566 - protein, 17 aa, Cryptosporidium parvum
NDLKILRFHDGISGKTY

SEQ ID NO: 2354567 - protein, 17 aa, Cryptosporidium parvum
NELFKVWSPHIVSPYVL

SEQ ID NO: 2354568 - protein, 17 aa, Cryptosporidium parvum
NFFGRFGITGSLALEPL

SEQ ID NO: 2354569 - protein, 22 aa, Cryptosporidium parvum
NFIAKLFIRFGMKPEQTQIHDQ

SEQ ID NO: 2354570 - protein, 21 aa, Cryptosporidium parvum
NIIKGLKFIGSIFKMRKKNNL

SEQ ID NO: 2354571 - protein, 19 aa, Cryptosporidium parvum
NKGRLRVGAAIGVNEIERA

SEQ ID NO: 2354572 - protein, 18 aa, Cryptosporidium parvum
NKRLSWQQILALGKSTEK

SEQ ID NO: 2354573 - protein, 18 aa, Cryptosporidium parvum
NLDYAKWVIEKGADVNAK

SEQ ID NO: 2354574 - protein, 19 aa, Cryptosporidium parvum
NLNRSGCYRGCKFQNKDAI

SEQ ID NO: 2354575 - protein, 23 aa, Cryptosporidium parvum
NMFCSCCTCPMQQQFPSCQCGTN

SEQ ID NO: 2354576 - protein, 19 aa, Cryptosporidium parvum
NMIAAKLLEDWDVIGHFFQ

SEQ ID NO: 2354577 - protein, 17 aa, Cryptosporidium parvum
NNGYSWRKNKPITDNNV

SEQ ID NO: 2354578 - protein, 21 aa, Cryptosporidium parvum
NPRRVCICIKWNSSHHLEDNE

SEQ ID NO: 2354579 - protein, 18 aa, Cryptosporidium parvum
NSMLRPALNIGKRTKSTG

SEQ ID NO: 2354580 - protein, 17 aa, Cryptosporidium parvum
NSVKICNAVRCKKCGIW

SEQ ID NO: 2354581 - protein, 19 aa, Cryptosporidium parvum
NTLLRLNNLLSFKGNLLRI

SEQ ID NO: 2354582 - protein, 19 aa, Cryptosporidium parvum
NTSRFPLRFTNVNQNFELC

SEQ ID NO: 2354583 - protein, 23 aa, Cryptosporidium parvum
NVILRLVPRLDVPALIRKSQNSQ

SEQ ID NO: 2354584 - protein, 20 aa, Cryptosporidium parvum
NYCQRGRMCMFSHTKEEQMY

SEQ ID NO: 2354585 - protein, 18 aa, Cryptosporidium parvum
PEIEWKPANLSGELVLPL

SEQ ID NO: 2354586 - protein, 29 aa, Cryptosporidium parvum
PEIFKITYKIPFYWASLIANIYVFEKLRN

SEQ ID NO: 2354587 - protein, 18 aa, Cryptosporidium parvum
PFENICGFTNPYYGENNG

SEQ ID NO: 2354588 - protein, 19 aa, Cryptosporidium parvum
PGVCSRIACLIPHPVSPGI

SEQ ID NO: 2354589 - protein, 21 aa, Cryptosporidium parvum
PIKHPEIFESLGIAQPKGVLL

SEQ ID NO: 2354590 - protein, 17 aa, Cryptosporidium parvum
PKREVIQNFKLKASDQS

SEQ ID NO: 2354591 - protein, 21 aa, Cryptosporidium parvum
PLPERHEIVLFKSMEDANNTT

SEQ ID NO: 2354592 - protein, 22 aa, Cryptosporidium parvum
PNPHSLMPLRSCFSSRNGLWVA

SEQ ID NO: 2354593 - protein, 18 aa, Cryptosporidium parvum
PNPMCFHRTVTPIQRRRK

SEQ ID NO: 2354594 - protein, 22 aa, Cryptosporidium parvum
PSCRSLRTSIRINRSSTLSHLG

SEQ ID NO: 2354595 - protein, 19 aa, Cryptosporidium parvum
PWGKGRPGWHIECSVMASN

SEQ ID NO: 2354596 - protein, 20 aa, Cryptosporidium parvum
QGCMEICITPPLSSELITSN

SEQ ID NO: 2354597 - protein, 21 aa, Cryptosporidium parvum
QKIDVCFYIGFVPFYSKVILR

SEQ ID NO: 2354598 - protein, 21 aa, Cryptosporidium parvum
QKLPKLRGFLSMNSLAHLGRQ

SEQ ID NO: 2354599 - protein, 17 aa, Cryptosporidium parvum
QKRFFKLNLTDNALLYW

SEQ ID NO: 2354600 - protein, 18 aa, Cryptosporidium parvum
QLLFCFHNNFPILWHPQV

SEQ ID NO: 2354601 - protein, 25 aa, Cryptosporidium parvum
QRSLARLWFDYVFSVKCLSPSTSPY

SEQ ID NO: 2354602 - protein, 21 aa, Cryptosporidium parvum
QTGPKLQEWLGLRDWKNNQSK

SEQ ID NO: 2354603 - protein, 21 aa, Cryptosporidium parvum
QTKCQETMRGAGYETSIQGQD

SEQ ID NO: 2354604 - protein, 17 aa, Cryptosporidium parvum
QVYILGWLIHLRILNRI

SEQ ID NO: 2354605 - protein, 19 aa, Cryptosporidium parvum
RALSHCLLELTGINNDLKK

SEQ ID NO: 2354606 - protein, 18 aa, Cryptosporidium parvum
REILDIYLAMGVSSEADE

SEQ ID NO: 2354607 - protein, 20 aa, Cryptosporidium parvum
RELWSLLNFLYPEIFSSSEE

SEQ ID NO: 2354608 - protein, 21 aa, Cryptosporidium parvum
REVQTGFQFRLQVPMGSILAS

SEQ ID NO: 2354609 - protein, 23 aa, Cryptosporidium parvum
RFDCSRCSISFSIKKNICERLSL

SEQ ID NO: 2354610 - protein, 22 aa, Cryptosporidium parvum
RFRTGKIWILICTDLMARGVDF

SEQ ID NO: 2354611 - protein, 21 aa, Cryptosporidium parvum
RGGAVPPVLRPGAIPPGPPGV

SEQ ID NO: 2354612 - protein, 24 aa, Cryptosporidium parvum
RIEPEERIRMGIFDDSLVESDVKF

SEQ ID NO: 2354613 - protein, 18 aa, Cryptosporidium parvum
RKIFLGQWQSAYIILTKD

SEQ ID NO: 2354614 - protein, 17 aa, Cryptosporidium parvum
RKRIPCMFKIIPCNEHS

SEQ ID NO: 2354615 - protein, 19 aa, Cryptosporidium parvum
RKRLLCFSASTAFWIPYTF

SEQ ID NO: 2354616 - protein, 18 aa, Cryptosporidium parvum
RKRVCSIIDKLKKLDKLK

SEQ ID NO: 2354617 - protein, 23 aa, Cryptosporidium parvum
RLDKLDIVDGFLFKDDDTEKKDG

SEQ ID NO: 2354618 - protein, 18 aa, Cryptosporidium parvum
RLWWKRIFKGSIETDISK

SEQ ID NO: 2354619 - protein, 18 aa, Cryptosporidium parvum
RNNLFLKRDEIIIRKISH

SEQ ID NO: 2354620 - protein, 22 aa, Cryptosporidium parvum
RNPHYWRYIGIIKLYKKVQGLL

SEQ ID NO: 2354621 - protein, 24 aa, Cryptosporidium parvum
RPEKAPDVCYSWWIFSLLYFLGRA

SEQ ID NO: 2354622 - protein, 23 aa, Cryptosporidium parvum
RQKLHPCEICAAFLSETDNDQRL

SEQ ID NO: 2354623 - protein, 21 aa, Cryptosporidium parvum
RRLASFPAIRAKIFEYFLSNA

SEQ ID NO: 2354624 - protein, 23 aa, Cryptosporidium parvum
RRNPYEYAYRPNLCPNVVFQNEN

SEQ ID NO: 2354625 - protein, 17 aa, Cryptosporidium parvum
RRYCFKFTVYQIEEVRD

SEQ ID NO: 2354626 - protein, 20 aa, Cryptosporidium parvum
RSALFKALILYSLKNKEYMN

SEQ ID NO: 2354627 - protein, 17 aa, Cryptosporidium parvum
RSPRFCRSTSIIYCLSR

SEQ ID NO: 2354628 - protein, 19 aa, Cryptosporidium parvum
RYRLSVSLYNLFGCGDVFS

SEQ ID NO: 2354629 - protein, 22 aa, Cryptosporidium parvum
SAPILSRFDLFFVMIDDPEDVY

SEQ ID NO: 2354630 - protein, 17 aa, Cryptosporidium parvum
SATEFDVCHSLLQKIKT

SEQ ID NO: 2354631 - protein, 19 aa, Cryptosporidium parvum
SAVSLKFKYEEEIKLEVED

SEQ ID NO: 2354632 - protein, 17 aa, Cryptosporidium parvum
SCKRCIVEVEMWKRKLK

SEQ ID NO: 2354633 - protein, 20 aa, Cryptosporidium parvum
SCSCSCPLVTFSSSNSFLIQ

SEQ ID NO: 2354634 - protein, 18 aa, Cryptosporidium parvum
SECIPLLPCIQNLKDENH

SEQ ID NO: 2354635 - protein, 18 aa, Cryptosporidium parvum
SFCLPNWFSSSKISKESY

SEQ ID NO: 2354636 - protein, 18 aa, Cryptosporidium parvum
SIDGWKVLVDVERGRTVE

SEQ ID NO: 2354637 - protein, 19 aa, Cryptosporidium parvum
SKFFPFFISKYIRSLQKSN

SEQ ID NO: 2354638 - protein, 18 aa, Cryptosporidium parvum
SKGSILWVRNFRVITKEF

SEQ ID NO: 2354639 - protein, 20 aa, Cryptosporidium parvum
SKLSRLSFRGDKESKGLDKI

SEQ ID NO: 2354640 - protein, 22 aa, Cryptosporidium parvum
SKRYVCSGIRVLSGCLNNPYTR

SEQ ID NO: 2354641 - protein, 19 aa, Cryptosporidium parvum
SKSAFSVAIRFRPAVCSEI

SEQ ID NO: 2354642 - protein, 24 aa, Cryptosporidium parvum
SLGFKLFVDKCCDYYRYIRRKSWL

SEQ ID NO: 2354643 - protein, 18 aa, Cryptosporidium parvum
SLKNCLRNLLLSQITSDE

SEQ ID NO: 2354644 - protein, 23 aa, Cryptosporidium parvum
SLLRISSPFLWHFFQNGGNVHDL

SEQ ID NO: 2354645 - protein, 17 aa, Cryptosporidium parvum
SLRELWSLLNFLYPEIF

SEQ ID NO: 2354646 - protein, 23 aa, Cryptosporidium parvum
SMLEKRIGPVFSRNINGEKSDGT

SEQ ID NO: 2354647 - protein, 24 aa, Cryptosporidium parvum
SMYRKCLRALWDMFQYDDEINLKI

SEQ ID NO: 2354648 - protein, 23 aa, Cryptosporidium parvum
SNKSFKLSICNANELIIECKHSD

SEQ ID NO: 2354649 - protein, 18 aa, Cryptosporidium parvum
SNSLVGLYAEWVDKNTIW

SEQ ID NO: 2354650 - protein, 24 aa, Cryptosporidium parvum
SPLILEKFHPIWIRKIIDERRNLV

SEQ ID NO: 2354651 - protein, 19 aa, Cryptosporidium parvum
SQKLPSFGFENRFQDNIKG

SEQ ID NO: 2354652 - protein, 18 aa, Cryptosporidium parvum
SREFKIAIALAENCQLPV

SEQ ID NO: 2354653 - protein, 21 aa, Cryptosporidium parvum
SRSNLRLPPKVPGISSNNAFK

SEQ ID NO: 2354654 - protein, 19 aa, Cryptosporidium parvum
SRTIIICNCSPDRVNYYET

SEQ ID NO: 2354655 - protein, 17 aa, Cryptosporidium parvum
SSIKVGKLFLVDLAGSE

SEQ ID NO: 2354656 - protein, 24 aa, Cryptosporidium parvum
STNVNACMDISGYVSDLSLKNVTT

SEQ ID NO: 2354657 - protein, 18 aa, Cryptosporidium parvum
SVPTGSFLIRAFYSNNGV

SEQ ID NO: 2354658 - protein, 28 aa, Cryptosporidium parvum
SWGHKLRWVKIFKCEMHYFLSPKESNIK

SEQ ID NO: 2354659 - protein, 19 aa, Cryptosporidium parvum
SWPEFSKLLAHLVESPHYS

SEQ ID NO: 2354660 - protein, 19 aa, Cryptosporidium parvum
SYLGIPIWRFYGRCTQCGN

SEQ ID NO: 2354661 - protein, 17 aa, Cryptosporidium parvum
TAFKGFQKRFFKLNLTD

SEQ ID NO: 2354662 - protein, 22 aa, Cryptosporidium parvum
TALQRWDFRICGVYCLDVGFLT

SEQ ID NO: 2354663 - protein, 18 aa, Cryptosporidium parvum
TDPLWKHLEVVLSGADVP

SEQ ID NO: 2354664 - protein, 18 aa, Cryptosporidium parvum
TELSRFRTRICERKALHG

SEQ ID NO: 2354665 - protein, 25 aa, Cryptosporidium parvum
TENRIAFDFIIDEVFLRGTIYDYMR

SEQ ID NO: 2354666 - protein, 21 aa, Cryptosporidium parvum
TETVFDSGMKIQKTVNKTSTE

SEQ ID NO: 2354667 - protein, 20 aa, Cryptosporidium parvum
TFEFLKEFYGVLDFGSVLKV

SEQ ID NO: 2354668 - protein, 18 aa, Cryptosporidium parvum
TGYAITFFTLRDIPKIKS

SEQ ID NO: 2354669 - protein, 19 aa, Cryptosporidium parvum
THGWTDYQLRCNLAVAIGV

SEQ ID NO: 2354670 - protein, 24 aa, Cryptosporidium parvum
TIVKRFSVSWMYKSGFLHIPIHSI

SEQ ID NO: 2354671 - protein, 19 aa, Cryptosporidium parvum
TKLKPCYLCYSSSTISNQM

SEQ ID NO: 2354672 - protein, 21 aa, Cryptosporidium parvum
TNPDLKCTLWRSSQPKSAFKR

SEQ ID NO: 2354673 - protein, 17 aa, Cryptosporidium parvum
TPSYYPNPMIKMPGQSM

SEQ ID NO: 2354674 - protein, 17 aa, Cryptosporidium parvum
TRFPSVITIFSAPNYCD

SEQ ID NO: 2354675 - protein, 18 aa, Cryptosporidium parvum
TRLMISHLFIWRQRNSMF

SEQ ID NO: 2354676 - protein, 23 aa, Cryptosporidium parvum
TRYRLAMYFYEFLKSIKMLTEKG

SEQ ID NO: 2354677 - protein, 24 aa, Cryptosporidium parvum
TTQWAVGLTRVFLKIEAFRDLEQL

SEQ ID NO: 2354678 - protein, 19 aa, Cryptosporidium parvum
TTTRSGRFVSLKYGYDDIL

SEQ ID NO: 2354679 - protein, 17 aa, Cryptosporidium parvum
TVFKRLLLYDSKAVRKC

SEQ ID NO: 2354680 - protein, 25 aa, Cryptosporidium parvum
TVVSKPGWGAVRWADLSISDASNSW

SEQ ID NO: 2354681 - protein, 18 aa, Cryptosporidium parvum
VAIRFRPAVCSEINEIEN

SEQ ID NO: 2354682 - protein, 19 aa, Cryptosporidium parvum
VCPTKGCGNRTAWQLRLEN

SEQ ID NO: 2354683 - protein, 19 aa, Cryptosporidium parvum
VEHIWKSTCFIKLPSKLDD

SEQ ID NO: 2354684 - protein, 18 aa, Cryptosporidium parvum
VFELMALGHKHRAVASTN

SEQ ID NO: 2354685 - protein, 23 aa, Cryptosporidium parvum
VGFFEVWLLLSLWKRYPARIYRH

SEQ ID NO: 2354686 - protein, 20 aa, Cryptosporidium parvum
VGLIWKYRFYLFRFKAGIPM

SEQ ID NO: 2354687 - protein, 19 aa, Cryptosporidium parvum
VIQECFTRRNELMRELDIL

SEQ ID NO: 2354688 - protein, 19 aa, Cryptosporidium parvum
VKEKVFIVGRLIRYVSKAL

SEQ ID NO: 2354689 - protein, 18 aa, Cryptosporidium parvum
VKIPVCDPLAWGETLGCT

SEQ ID NO: 2354690 - protein, 21 aa, Cryptosporidium parvum
VKRIPDGILLFFGSYSLMDQA

SEQ ID NO: 2354691 - protein, 18 aa, Cryptosporidium parvum
VLRMLKCEFEVFGKVQGV

SEQ ID NO: 2354692 - protein, 25 aa, Cryptosporidium parvum
VMHYWKEIPLPFSFTSIINRIRNNY

SEQ ID NO: 2354693 - protein, 19 aa, Cryptosporidium parvum
VPIRIRFLINDVIDSRKNN

SEQ ID NO: 2354694 - protein, 28 aa, Cryptosporidium parvum
VPKSGIRLRLEWDRRRYCFKFTVYQIEE

SEQ ID NO: 2354695 - protein, 24 aa, Cryptosporidium parvum
VQDYRFLPKPTFRIEDNNLYSNLN

SEQ ID NO: 2354696 - protein, 21 aa, Cryptosporidium parvum
VQYRIPLLNCHVGDWQPVDSD

SEQ ID NO: 2354697 - protein, 19 aa, Cryptosporidium parvum
VRDSLGYQKKRLIPIDQDE

SEQ ID NO: 2354698 - protein, 27 aa, Cryptosporidium parvum
VRKFSCKRWGKGKAYSHAMNFLASLTS

SEQ ID NO: 2354699 - protein, 24 aa, Cryptosporidium parvum
VSGYAGKVLFGWDFPAGFTPSLSC

SEQ ID NO: 2354700 - protein, 18 aa, Cryptosporidium parvum
VVEFFKYPIPFFSKKNIS

SEQ ID NO: 2354701 - protein, 19 aa, Cryptosporidium parvum
VVMFWEIVKKLDLKLQKKL

SEQ ID NO: 2354702 - protein, 18 aa, Cryptosporidium parvum
VVPQCCWIWSTYVFLKII

SEQ ID NO: 2354703 - protein, 18 aa, Cryptosporidium parvum
VVYYTGKDREFEYFKVPA

SEQ ID NO: 2354704 - protein, 17 aa, Cryptosporidium parvum
VYLNYLICLVRQIRVWG

SEQ ID NO: 2354705 - protein, 23 aa, Cryptosporidium parvum
WGCTYRSLQMVFSWYLINNYTNK

SEQ ID NO: 2354706 - protein, 19 aa, Cryptosporidium parvum
WKSTCFIKLPSKLDDGGYF

SEQ ID NO: 2354707 - protein, 22 aa, Cryptosporidium parvum
WLPKRLGGGLGKVRGQEKPESK

SEQ ID NO: 2354708 - protein, 18 aa, Cryptosporidium parvum
YEMALRFYQVNIIGNFGN

SEQ ID NO: 2354709 - protein, 18 aa, Cryptosporidium parvum
YFCSYSFASVFSRMGPNS

SEQ ID NO: 2354710 - protein, 19 aa, Cryptosporidium parvum
YGKCGVKYETTQSGKTQIK

SEQ ID NO: 2354711 - protein, 26 aa, Cryptosporidium parvum
YGVLCCICKSCGAFLLKGEEKRQHLA

SEQ ID NO: 2354712 - protein, 17 aa, Cryptosporidium parvum
YKRIRSIIGKGEKINLT

SEQ ID NO: 2354713 - protein, 21 aa, Cryptosporidium parvum
YLLYKACRIFKQLGVEYVTIF

SEQ ID NO: 2354714 - protein, 18 aa, Cryptosporidium parvum
YLVSNIFLYRSCISDSHR

SEQ ID NO: 2354715 - protein, 18 aa, Cryptosporidium parvum
YRDIKGLHLVLSPKSTLG

SEQ ID NO: 2354716 - protein, 17 aa, Cryptosporidium parvum
YRLAELFVIGLPRCSFY

SEQ ID NO: 2354717 - protein, 17 aa, Cryptosporidium parvum
YRSSLLGALSNRTNSSC

SEQ ID NO: 2354718 - protein, 20 aa, Cryptosporidium parvum
YVRDILKFILNEESISNDKL

SEQ ID NO: 2354719 - protein, 17 aa, Cryptosporidium parvum
PPPSEELPPPPPPSEEL

SEQ ID NO: 2354720 - protein, 22 aa, Cryptosporidium parvum
AADLLNELAAMHYEWALDNYAK

SEQ ID NO: 2354721 - protein, 23 aa, Cryptosporidium parvum
AAGIKHKPVILSHKMLPGLLEGQ

SEQ ID NO: 2354722 - protein, 32 aa, Cryptosporidium parvum; identical to SEQ ID NO: 2187148

SEQ ID NO: 2354723 - protein, 25 aa, Cryptosporidium parvum
AATQDFLLGMYVLTGRDIFLTRDQF

SEQ ID NO: 2354724 - protein, 17 aa, Cryptosporidium parvum
ACKVPCHLISSNAGFDG

SEQ ID NO: 2354725 - protein, 19 aa, Cryptosporidium parvum
ADDTPLCAQYFLGFCKYGP

SEQ ID NO: 2354726 - protein, 26 aa, Cryptosporidium parvum
ADDVGTIIIIEIYPKGEANDPLNITY

SEQ ID NO: 2354727 - protein, 21 aa, Cryptosporidium parvum
ADFELQIPGLLFIDTPGHESF

SEQ ID NO: 2354728 - protein, 23 aa, Cryptosporidium parvum
ADGSTVLIKKRGLLGSLKEENVK

SEQ ID NO: 2354729 - protein, 29 aa, Cryptosporidium parvum
ADIPIYKINISPWGGLSLPIIQRIIRLVE

SEQ ID NO: 2354730 - protein, 26 aa, Cryptosporidium parvum
ADTTFTYYFSILDLNRLVGFNQIIIN

SEQ ID NO: 2354731 - protein, 23 aa, Cryptosporidium parvum
AELVIPRLSLTEKRRSISKKRSE

SEQ ID NO: 2354732 - protein, 26 aa, Cryptosporidium parvum
AENCQLPVFITLRAPGSPLIISIGQR

SEQ ID NO: 2354733 - protein, 26 aa, Cryptosporidium parvum
AEQFTSMFRRKAFLHWYTGEGMDEME

SEQ ID NO: 2354734 - protein, 31 aa, Cryptosporidium parvum
AESVLGSQFLLSKLPFPNYGTFLGKETAEYT

SEQ ID NO: 2354735 - protein, 21 aa, Cryptosporidium parvum
AETYEFMRILAEDPTGAQYVA

SEQ ID NO: 2354736 - protein, 34 aa, Cryptosporidium parvum; identical to SEQ ID NO: 2187201

SEQ ID NO: 2354737 - protein, 18 aa, Cryptosporidium parvum
AEYESRKKDIFSRGVVSG

SEQ ID NO: 2354738 - protein, 33 aa, Cryptosporidium parvum; identical to SEQ ID NO: 2187211

SEQ ID NO: 2354739 - protein, 17 aa, Cryptosporidium parvum
AFNGILISSKRYLEAKQ

SEQ ID NO: 2354740 - protein, 17 aa, Cryptosporidium parvum
AGIPMLFHFINLSDKEI

SEQ ID NO: 2354741 - protein, 17 aa, Cryptosporidium parvum
AGQERFRTITSAYYRGA

SEQ ID NO: 2354742 - protein, 28 aa, Cryptosporidium parvum
AGYPVRFPHFEFLLDYMILFSPCGQLSI

SEQ ID NO: 2354743 - protein, 25 aa, Cryptosporidium parvum
AHTPRYLWEKIKLSNNFLVAISQIN

SEQ ID NO: 2354744 - protein, 19 aa, Cryptosporidium parvum
AIEAFANALRQIPTILLDN

SEQ ID NO: 2354745 - protein, 24 aa, Cryptosporidium parvum
AILYKSPSFAFFLSSSCLTESTFQ

SEQ ID NO: 2354746 - protein, 20 aa, Cryptosporidium parvum
AIPSHLRLDSLSLSCISTGL

SEQ ID NO: 2354747 - protein, 21 aa, Cryptosporidium parvum
AIRAKIFEYFLSNACITTVTT

SEQ ID NO: 2354748 - protein, 35 aa, Cryptosporidium parvum; identical to SEQ ID NO: 2310597

SEQ ID NO: 2354749 - protein, 20 aa, Cryptosporidium parvum
AISSFLLGRTSLYSPTSVLS

SEQ ID NO: 2354750 - protein, 22 aa, Cryptosporidium parvum
AISYNRTNYGLLGILNVIRMTD

SEQ ID NO: 2354751 - protein, 27 aa, Cryptosporidium parvum
AKDGGLPCIVWLLLAIVHCSVNGNKSS

SEQ ID NO: 2354752 - protein, 25 aa, Cryptosporidium parvum
AKEGLSIFYSYDLCSSSCSVPTVVT

SEQ ID NO: 2354753 - protein, 31 aa, Cryptosporidium parvum; identical to SEQ ID NO: 2310617

SEQ ID NO: 2354754 - protein, 21 aa, Cryptosporidium parvum
ALEEIISFQGLWKSICEIEGT

SEQ ID NO: 2354755 - protein, 17 aa, Cryptosporidium parvum
ALGVNDLLNFDFMDPPP

SEQ ID NO: 2354756 - protein, 31 aa, Cryptosporidium parvum; identical to SEQ ID NO: 2187338

SEQ ID NO: 2354757 - protein, 22 aa, Cryptosporidium parvum
ALQPYPTGIKWINETHSWKVVY

SEQ ID NO: 2354758 - protein, 24 aa, Cryptosporidium parvum
ALSKFSAYTFQQLRDAILDLDKKI

SEQ ID NO: 2354759 - protein, 19 aa, Cryptosporidium parvum
ALTRRSLGYAYVNYNSVAD

SEQ ID NO: 2354760 - protein, 25 aa, Cryptosporidium parvum
ALVARMLSMLWSKPLIGVNHCVAHI

SEQ ID NO: 2354761 - protein, 30 aa, Cryptosporidium parvum; identical to SEQ ID NO: 2310724

SEQ ID NO: 2354762 - protein, 20 aa, Cryptosporidium parvum
ANTVLLLKALGVNDLLNFDF

SEQ ID NO: 2354763 - protein, 37 aa, Cryptosporidium parvum; identical to SEQ ID NO: 2310733

SEQ ID NO: 2354764 - protein, 25 aa, Cryptosporidium parvum
APLIDQRSFFLGKILGRMISSILSG

SEQ ID NO: 2354765 - protein, 25 aa, Cryptosporidium parvum
APVQVIIIPIIFKTVITEEQKKICN

SEQ ID NO: 2354766 - protein, 30 aa, Cryptosporidium parvum; identical to SEQ ID NO: 2310750

SEQ ID NO: 2354767 - protein, 18 aa, Cryptosporidium parvum
AQHSLLQKELLKAAVDMV

SEQ ID NO: 2354768 - protein, 25 aa, Cryptosporidium parvum
AQLMPSIPGVYFDRRQIGYRVRYHN

SEQ ID NO: 2354769 - protein, 19 aa, Cryptosporidium parvum
AQPFKNCKGILFAIQVCKA

SEQ ID NO: 2354770 - protein, 17 aa, Cryptosporidium parvum
ARKMALTVRPKLVPIKK

SEQ ID NO: 2354771 - protein, 20 aa, Cryptosporidium parvum
ARLNAQLFILSFDNSFNELM

SEQ ID NO: 2354772 - protein, 18 aa, Cryptosporidium parvum
ARLTGRVALIKIGGYSDT

SEQ ID NO: 2354773 - protein, 22 aa, Cryptosporidium parvum
ASFYGLRWIESLRTLRCEKLGK

SEQ ID NO: 2354774 - protein, 20 aa, Cryptosporidium parvum
ASTNLWLNLSDGFIGCGRRL

SEQ ID NO: 2354775 - protein, 26 aa, Cryptosporidium parvum
ATCDLEFCVELFWLLISEISIQEYPK

SEQ ID NO: 2354776 - protein, 32 aa, Cryptosporidium parvum; identical to SEQ ID NO: 2310867

SEQ ID NO: 2354777 - protein, 25 aa, Cryptosporidium parvum
AVFLVLDWILNERLDVPYISLHKMH

SEQ ID NO: 2354778 - protein, 20 aa, Cryptosporidium parvum
AVKVSGVSLLALFKEKKEKP

SEQ ID NO: 2354779 - protein, 28 aa, Cryptosporidium parvum
AVSFLKKFNVPLLILGGGGYTLRNVPKC

SEQ ID NO: 2354780 - protein, 20 aa, Cryptosporidium parvum
AWCYRHFIFTNLKKMNALKE

SEQ ID NO: 2354781 - protein, 21 aa, Cryptosporidium parvum
AYFMNCNIFTIPGRTFPVEIL

SEQ ID NO: 2354782 - protein, 21 aa, Cryptosporidium parvum
AYSHAMNFLASLTSCGIIKDS

SEQ ID NO: 2354783 - protein, 25 aa, Cryptosporidium parvum
CAQLQKLLYDLPRIKQKELKRLKLV

SEQ ID NO: 2354784 - protein, 21 aa, Cryptosporidium parvum
CAQYFLGFCKYGPKCKRRHEP

SEQ ID NO: 2354785 - protein, 17 aa, Cryptosporidium parvum
CDGKPWKDSYIVIMSDG

SEQ ID NO: 2354786 - protein, 22 aa, Cryptosporidium parvum
CDTWYFDQIYRHNINKFIQAQT

SEQ ID NO: 2354787 - protein, 25 aa, Cryptosporidium parvum
CEDLLRLHLKAFPLFSTQLNISKRN

SEQ ID NO: 2354788 - protein, 20 aa, Cryptosporidium parvum
CENCAISQIVLYDHNIRQYE

SEQ ID NO: 2354789 - protein, 17 aa, Cryptosporidium parvum
CFQCGLPTKGTFNIASI

SEQ ID NO: 2354790 - protein, 31 aa, Cryptosporidium parvum; identical to SEQ ID NO: 2187580

SEQ ID NO: 2354791 - protein, 17 aa, Cryptosporidium parvum
CFVQYYSHADALTAVTF

SEQ ID NO: 2354792 - protein, 20 aa, Cryptosporidium parvum
CGEWGYNPRLLLSINSHLGS

SEQ ID NO: 2354793 - protein, 19 aa, Cryptosporidium parvum
CGGEQSGWFWDGELNVCLK

SEQ ID NO: 2354794 - protein, 42 aa, Cryptosporidium parvum; identical to SEQ ID NO: 2310953

SEQ ID NO: 2354795 - protein, 26 aa, Cryptosporidium parvum
CGNMPFKTFIFKILEDSGLSSKRGFN

SEQ ID NO: 2354796 - protein, 24 aa, Cryptosporidium parvum
CGPIKAIYLGLNHQTMQPCGFCFV

SEQ ID NO: 2354797 - protein, 38 aa, Cryptosporidium parvum; identical to SEQ ID NO: 2310973

SEQ ID NO: 2354798 - protein, 19 aa, Cryptosporidium parvum
CIGNVFLIKTIPITIYNEF

SEQ ID NO: 2354799 - protein, 17 aa, Cryptosporidium parvum
CISSLPEDLLFYVLSML

SEQ ID NO: 2354800 - protein, 27 aa, Cryptosporidium parvum
CITIGKWNSYNWSNLLEYFANQFDEST

SEQ ID NO: 2354801 - protein, 18 aa, Cryptosporidium parvum
CITPPLSSELITSNNFYF

SEQ ID NO: 2354802 - protein, 34 aa, Cryptosporidium parvum; identical to SEQ ID NO: 2310994

SEQ ID NO: 2354803 - protein, 21 aa, Cryptosporidium parvum
CKRYLTYISNILPQRLYCSFC

SEQ ID NO: 2354804 - protein, 24 aa, Cryptosporidium parvum
CLEHNGYVFLILEKKKNHVIRAGA

SEQ ID NO: 2354805 - protein, 18 aa, Cryptosporidium parvum
CLGFIHPETHLAFDDPIN

SEQ ID NO: 2354806 - protein, 17 aa, Cryptosporidium parvum
CMTLLKKGDGAVFDVPL

SEQ ID NO: 2354807 - protein, 25 aa, Cryptosporidium parvum
CNILNYLIDGVWRQQQYRLDMIEKH

SEQ ID NO: 2354808 - protein, 22 aa, Cryptosporidium parvum
CNYTNVYIFKLLDENYLGNGEF

SEQ ID NO: 2354809 - protein, 31 aa, Cryptosporidium parvum; identical to SEQ ID NO: 2311070

SEQ ID NO: 2354810 - protein, 35 aa, Cryptosporidium parvum; identical to SEQ ID NO: 2187676

SEQ ID NO: 2354811 - protein, 17 aa, Cryptosporidium parvum
CPPLLQADIDLQSGIIL

SEQ ID NO: 2354812 - protein, 18 aa, Cryptosporidium parvum
CPSFQRKGSLRPSPNTQV

SEQ ID NO: 2354813 - protein, 20 aa, Cryptosporidium parvum
CQTPTLFFTVQRRDSINSFI

SEQ ID NO: 2354814 - protein, 17 aa, Cryptosporidium parvum
CRDALTRRSLGYAYVNY

SEQ ID NO: 2354815 - protein, 25 aa, Cryptosporidium parvum
CSIDGLLSLILTPTRELASQVFDVI

SEQ ID NO: 2354816 - protein, 29 aa, Cryptosporidium parvum
CTDLDDSFHNYLMKGLLGENVEGGSGSNN

SEQ ID NO: 2354817 - protein, 22 aa, Cryptosporidium parvum
CTSISATWRMYKAKKEYKQIRK

SEQ ID NO: 2354818 - protein, 28 aa, Cryptosporidium parvum
CTTIEEFSPYQVILAPFETNNLNLIAIE

SEQ ID NO: 2354819 - protein, 19 aa, Cryptosporidium parvum
CVEAFTDYPPLGRFAVRDM

SEQ ID NO: 2354820 - protein, 23 aa, Cryptosporidium parvum
CVKRIPDGILLFFGSYSLMDQAV

SEQ ID NO: 2354821 - protein, 33 aa, Cryptosporidium parvum; identical to SEQ ID NO: 2311137

SEQ ID NO: 2354822 - protein, 21 aa, Cryptosporidium parvum
CVYCKFYFQEILEDHIPGYRI

SEQ ID NO: 2354823 - protein, 24 aa, Cryptosporidium parvum
CYEISRAFLSKYLGHPLEGIMVVE

SEQ ID NO: 2354824 - protein, 17 aa, Cryptosporidium parvum
CYSLAVEGYGLLKLMGI

SEQ ID NO: 2354825 - protein, 19 aa, Cryptosporidium parvum
CYSTLIPPLNLKNVPEDLR

SEQ ID NO: 2354826 - protein, 17 aa, Cryptosporidium parvum
DALLRPGRIDRKIEFPN

SEQ ID NO: 2354827 - protein, 17 aa, Cryptosporidium parvum
DAQLSYLSRIKYIDAVI

SEQ ID NO: 2354828 - protein, 22 aa, Cryptosporidium parvum
DASLNLTLKHKYGLIGRNGIGK

SEQ ID NO: 2354829 - protein, 26 aa, Cryptosporidium parvum
DAVSKALYSLVFDYILHLVNTQISRA

SEQ ID NO: 2354830 - protein, 24 aa, Cryptosporidium parvum
DAYEYAKQLWLKARNKSKLNKCQT

SEQ ID NO: 2354831 - protein, 34 aa, Cryptosporidium parvum; identical to SEQ ID NO: 2187785

SEQ ID NO: 2354832 - protein, 23 aa, Cryptosporidium parvum
DDDIKEMWKSLISKKGMNLEDII

SEQ ID NO: 2354833 - protein, 18 aa, Cryptosporidium parvum
DDEFVDLLIRIRNSFDNC

SEQ ID NO: 2354834 - protein, 27 aa, Cryptosporidium parvum
DDEIPRFFKDIGYPITINKTTIIAPGA

SEQ ID NO: 2354835 - protein, 22 aa, Cryptosporidium parvum
DDEKLIYYYPSSDSIIIKRQQM

SEQ ID NO: 2354836 - protein, 23 aa, Cryptosporidium parvum
DDGMIRLWNTFTGSLLASVRKHT

SEQ ID NO: 2354837 - protein, 21 aa, Cryptosporidium parvum
DDKKALTWGLGLQGRLGHGDT

SEQ ID NO: 2354838 - protein, 20 aa, Cryptosporidium parvum
DDLHSQIFSNFGLSGSGFGN

SEQ ID NO: 2354839 - protein, 18 aa, Cryptosporidium parvum
DDLSKDDWKLVIQLKKTF

SEQ ID NO: 2354840 - protein, 24 aa, Cryptosporidium parvum
DDMNGFYIMPVKEYYRFLDMESIA

SEQ ID NO: 2354841 - protein, 23 aa, Cryptosporidium parvum
DEITTRIKDEIRKGLVDCSTDTE

SEQ ID NO: 2354842 - protein, 23 aa, Cryptosporidium parvum
DERENFTVYLQMPEGLLVFSQSI

SEQ ID NO: 2354843 - protein, 21 aa, Cryptosporidium parvum
DERLQDILDLYSPGNLRGEAK

SEQ ID NO: 2354844 - protein, 25 aa, Cryptosporidium parvum
DESTGLPFYLPLVDYAGKEEMKAYF

SEQ ID NO: 2354845 - protein, 27 aa, Cryptosporidium parvum
DEVDRMLDMGFLNDIKIILDGIPSSSS

SEQ ID NO: 2354846 - protein, 25 aa, Cryptosporidium parvum
DEVEEEIFSIPKHPTFFATANSNIS

SEQ ID NO: 2354847 - protein, 25 aa, Cryptosporidium parvum
DFEPFKPINTSLYLCDNKFHVDALK

SEQ ID NO: 2354848 - protein, 21 aa, Cryptosporidium parvum
DFGVAKFLRQGYTQARTLVGT

SEQ ID NO: 2354849 - protein, 21 aa, Cryptosporidium parvum
DFLNLSFYIQVIEGGACINGL

SEQ ID NO: 2354850 - protein, 19 aa, Cryptosporidium parvum
DFTHITCLCSDKSLKLFRI

SEQ ID NO: 2354851 - protein, 20 aa, Cryptosporidium parvum
DFVLKSKRISSSGSLLIAVC

SEQ ID NO: 2354852 - protein, 24 aa, Cryptosporidium parvum
DGDKPLATLIITVAPKPGNSMLPA

SEQ ID NO: 2354853 - protein, 24 aa, Cryptosporidium parvum
DGDSWRLYDLITRHFFATISNDIK

SEQ ID NO: 2354854 - protein, 25 aa, Cryptosporidium parvum
DGFERKRIEYEHEIDLIRNNFTEKL

SEQ ID NO: 2354855 - protein, 25 aa, Cryptosporidium parvum
DGINSLLYEFWIKKFYSITNVEISR

SEQ ID NO: 2354856 - protein, 26 aa, Cryptosporidium parvum
DGQYEYYVVRAWVRNARRIQIKAIDY

SEQ ID NO: 2354857 - protein, 33 aa, Cryptosporidium parvum; identical to SEQ ID NO: 2187977

SEQ ID NO: 2354858 - protein, 24 aa, Cryptosporidium parvum
DGSERYYLCIPSKGDFLVTTPTDQ

SEQ ID NO: 2354859 - protein, 22 aa, Cryptosporidium parvum
DGSPPLYVIELDNIQLSSKIRE

SEQ ID NO: 2354860 - protein, 24 aa, Cryptosporidium parvum
DGTNKGYCFIEFLGKLEAISALEQ

SEQ ID NO: 2354861 - protein, 22 aa, Cryptosporidium parvum
DGVFSHEFILNYIKLKRDEVVL

SEQ ID NO: 2354862 - protein, 18 aa, Cryptosporidium parvum
DGVLPVKIESVPKKSDIS

SEQ ID NO: 2354863 - protein, 23 aa, Cryptosporidium parvum
DHEPSWLIYPLKNYGIRVQDNSD

SEQ ID NO: 2354864 - protein, 20 aa, Cryptosporidium parvum
DHFNGKIHVGYLKIRKQAKD

SEQ ID NO: 2354865 - protein, 23 aa, Cryptosporidium parvum
DHIDYMVSYFRKYDLRGNGKISR

SEQ ID NO: 2354866 - protein, 20 aa, Cryptosporidium parvum
DHIFSFDWFIKTRSSNDIYR

SEQ ID NO: 2354867 - protein, 31 aa, Cryptosporidium parvum; identical to SEQ ID NO: 2188005

SEQ ID NO: 2354868 - protein, 26 aa, Cryptosporidium parvum
DICFDLNMTLFLAWSPKEAGHILETL

SEQ ID NO: 2354869 - protein, 17 aa, Cryptosporidium parvum
DIDKIIRFSICSSSLQM

SEQ ID NO: 2354870 - protein, 18 aa, Cryptosporidium parvum
DIFTLDFNIPERTNLSLI

SEQ ID NO: 2354871 - protein, 18 aa, Cryptosporidium parvum
DIGQLMIEYIAVWGIINE

SEQ ID NO: 2354872 - protein, 20 aa, Cryptosporidium parvum
DIHGIIKTGMKSRRVAETAM

SEQ ID NO: 2354873 - protein, 20 aa, Cryptosporidium parvum
DIKVIIRQLLSSLEYCHLNN

SEQ ID NO: 2354874 - protein, 17 aa, Cryptosporidium parvum
DILLIKGNFIQSLLLCD

SEQ ID NO: 2354875 - protein, 19 aa, Cryptosporidium parvum
DIPSYISYLDITKFFNSDF

SEQ ID NO: 2354876 - protein, 17 aa, Cryptosporidium parvum
DIVLGILELLKYHARVM

SEQ ID NO: 2354877 - protein, 22 aa, Cryptosporidium parvum
DIYRRVDFLIKAFKKRDLNNIN

SEQ ID NO: 2354878 - protein, 22 aa, Cryptosporidium parvum
DKAQYWLDIMYRMIYIKDEHNI

SEQ ID NO: 2354879 - protein, 32 aa, Cryptosporidium parvum
DKCCDYYRYIRRKSWLILNVLLLMVDSSIKDL

SEQ ID NO: 2354880 - protein, 18 aa, Cryptosporidium parvum
DKLPPMHDWQFYDKKRIM

SEQ ID NO: 2354881 - protein, 20 aa, Cryptosporidium parvum
DKRILIKKCVPICQRLFYSD

SEQ ID NO: 2354882 - protein, 24 aa, Cryptosporidium parvum
DKSNLIFIGTVLDSNKLFKNQKIY

SEQ ID NO: 2354883 - protein, 23 aa, Cryptosporidium parvum
DKSTNYLIYDKLIKDAVKSCLSG

SEQ ID NO: 2354884 - protein, 27 aa, Cryptosporidium parvum
DKTGNCRVIYWKDLYKSGVISQLMFSY

SEQ ID NO: 2354885 - protein, 19 aa, Cryptosporidium parvum
DLFKMRFLGRNMKISYYCE

SEQ ID NO: 2354886 - protein, 27 aa, Cryptosporidium parvum
DLGKYVGLGGAIRFFMLCKQIKHSFVN

SEQ ID NO: 2354887 - protein, 20 aa, Cryptosporidium parvum
DLIKIFCWMTTQNGQNNPLS

SEQ ID NO: 2354888 - protein, 17 aa, Cryptosporidium parvum
DLKILRFHDGISGKTYK

SEQ ID NO: 2354889 - protein, 19 aa, Cryptosporidium parvum
DLKLQKKLLFFVTGSDRVP

SEQ ID NO: 2354890 - protein, 20 aa, Cryptosporidium parvum
DLKNIRILKFSDIIQYIMVK

SEQ ID NO: 2354891 - protein, 17 aa, Cryptosporidium parvum
DLLIRIRNSFDNCNETS

SEQ ID NO: 2354892 - protein, 32 aa, Cryptosporidium parvum; identical to SEQ ID NO: 2188160

SEQ ID NO: 2354893 - protein, 27 aa, Cryptosporidium parvum
DLLNFDFMDPPPTTTLLIALETLFELG

SEQ ID NO: 2354894 - protein, 24 aa, Cryptosporidium parvum
DLLPKPFRKLFTNPNSPLLSFYPA

SEQ ID NO: 2354895 - protein, 22 aa, Cryptosporidium parvum
DLLQGFAAVELCNRGWLYYPDS

SEQ ID NO: 2354896 - protein, 18 aa, Cryptosporidium parvum
DLLSITEKSKLILSSYIT

SEQ ID NO: 2354897 - protein, 17 aa, Cryptosporidium parvum
DLMNEIMILRNTEDLSD

SEQ ID NO: 2354898 - protein, 21 aa, Cryptosporidium parvum
DLNQDLLVHWKNKSQLSHVEI

SEQ ID NO: 2354899 - protein, 18 aa, Cryptosporidium parvum
DLPLKINQWTSIVRWEFK

SEQ ID NO: 2354900 - protein, 35 aa, Cryptosporidium parvum; identical to SEQ ID NO: 2311634

SEQ ID NO: 2354901 - protein, 37 aa, Cryptosporidium parvum; identical to SEQ ID NO: 2188177

SEQ ID NO: 2354902 - protein, 35 aa, Cryptosporidium parvum
DLSNFYLRFNGNCKLLLEYIPFSEPEDINYYVSMI

SEQ ID NO: 2354903 - protein, 19 aa, Cryptosporidium parvum
DLWALDCELLVDWGDGVLT

SEQ ID NO: 2354904 - protein, 17 aa, Cryptosporidium parvum
DMLYTQLDTLIQAFAGI

SEQ ID NO: 2354905 - protein, 24 aa, Cryptosporidium parvum
DNEAFLPTIDLLMALKATYGNELT

SEQ ID NO: 2354906 - protein, 26 aa, Cryptosporidium parvum
DNFNFSYVFIVFYSISDDLNYSNDEI

SEQ ID NO: 2354907 - protein, 27 aa, Cryptosporidium parvum
DNIFIKSHILSLYLYYNQEYDTQKSIR

SEQ ID NO: 2354908 - protein, 26 aa, Cryptosporidium parvum
DNKGLVLPPKVAPVQVIIIPIIFKTV

SEQ ID NO: 2354909 - protein, 35 aa, Cryptosporidium parvum; identical to SEQ ID NO: 2188245

SEQ ID NO: 2354910 - protein, 26 aa, Cryptosporidium parvum
DNTKNFIPYRDSKLTRILQNSLGGNS

SEQ ID NO: 2354911 - protein, 25 aa, Cryptosporidium parvum
DPAKHIIQGLWRKLTGKASRKRNRL

SEQ ID NO: 2354912 - protein, 25 aa, Cryptosporidium parvum
DPNKKSYWQLIKRLLNLFVDESESE

SEQ ID NO: 2354913 - protein, 18 aa, Cryptosporidium parvum
DPNPNTRWSIKKALFHPD

SEQ ID NO: 2354914 - protein, 23 aa, Cryptosporidium parvum
DPNTKSYFCLYFAKGACVNGSKC

SEQ ID NO: 2354915 - protein, 32 aa, Cryptosporidium parvum; identical to SEQ ID NO: 2311781

SEQ ID NO: 2354916 - protein, 24 aa, Cryptosporidium parvum
DQTNQILYKVPYSNNININNGNKW

SEQ ID NO: 2354917 - protein, 23 aa, Cryptosporidium parvum
DRELIFELFMEFKTHIEVFTSHD

SEQ ID NO: 2354918 - protein, 18 aa, Cryptosporidium parvum
DRLYGWIEQNWSSSRSTL

SEQ ID NO: 2354919 - protein, 17 aa, Cryptosporidium parvum
DRVNYYETLSTIDFARR

SEQ ID NO: 2354920 - protein, 18 aa, Cryptosporidium parvum
DSKIELFLDFLNHLDSIK

SEQ ID NO: 2354921 - protein, 19 aa, Cryptosporidium parvum
DSQWKQFYSARMRTNAFNS

SEQ ID NO: 2354922 - protein, 24 aa, Cryptosporidium parvum
DSTALICQYISFLSKYALDLVPGI

SEQ ID NO: 2354923 - protein, 25 aa, Cryptosporidium parvum
DSVHNMPNWLLKNITFRLKEEFPGR

SEQ ID NO: 2354924 - protein, 28 aa, Cryptosporidium parvum
DSWSVGILIYELYMGNVPFIPNNSSGGG

SEQ ID NO: 2354925 - protein, 17 aa, Cryptosporidium parvum
DSYGFSINKIKRIYAYA

SEQ ID NO: 2354926 - protein, 27 aa, Cryptosporidium parvum
DTASTKIQSLWRMILCRNQYSKAIKAI

SEQ ID NO: 2354927 - protein, 20 aa, Cryptosporidium parvum
DTCIIMALDLLGKNSKEFLV

SEQ ID NO: 2354928 - protein, 33 aa, Cryptosporidium parvum; identical to SEQ ID NO: 2311911

SEQ ID NO: 2354929 - protein, 20 aa, Cryptosporidium parvum
DTGLAPPSQWDLAADRQNMQ

SEQ ID NO: 2354930 - protein, 32 aa, Cryptosporidium parvum
DTHVRYVKCVYLNYLICLVRQIRVWGPREVND

SEQ ID NO: 2354931 - protein, 25 aa, Cryptosporidium parvum
DTLDPALLRPGRLDRKVEFGLPDLE

SEQ ID NO: 2354932 - protein, 43 aa, Cryptosporidium parvum; identical to SEQ ID NO: 2311922

SEQ ID NO: 2354933 - protein, 21 aa, Cryptosporidium parvum
DTYNCINLRLWKATPSREFDF

SEQ ID NO: 2354934 - protein, 18 aa, Cryptosporidium parvum
DVILVSGILREGDTIIVC

SEQ ID NO: 2354935 - protein, 32 aa, Cryptosporidium parvum
DVIVTSYEMLLKERTWFLRRNFHSVIIDEAHR

SEQ ID NO: 2354936 - protein, 22 aa, Cryptosporidium parvum
DVKELPSILLFTCQSLKPYKVI

SEQ ID NO: 2354937 - protein, 23 aa, Cryptosporidium parvum
DVKPAVIKPKIATAAPVINIKKP

SEQ ID NO: 2354938 - protein, 18 aa, Cryptosporidium parvum
DVLNQIEFNYKALSVTLE

SEQ ID NO: 2354939 - protein, 24 aa, Cryptosporidium parvum
DVRKQLINIFDKYKLDIISAENDH

SEQ ID NO: 2354940 - protein, 26 aa, Cryptosporidium parvum
DWCTDACLLRYLRGYNLKVIKSFEAL

SEQ ID NO: 2354941 - protein, 18 aa, Cryptosporidium parvum
DYCHMRGFPYCRIDGNTS

SEQ ID NO: 2354942 - protein, 30 aa, Cryptosporidium parvum; identical to SEQ ID NO: 2188472

SEQ ID NO: 2354943 - protein, 21 aa, Cryptosporidium parvum
DYPPKYYPPLHFSIYKPKVTK

SEQ ID NO: 2354944 - protein, 18 aa, Cryptosporidium parvum
DYSKTCPSFQRKGSLRPS

SEQ ID NO: 2354945 - protein, 27 aa, Cryptosporidium parvum
EADLWSLGVLFYVMLGGAFPFDERKGN

SEQ ID NO: 2354946 - protein, 17 aa, Cryptosporidium parvum
EAFVFWFESEKDMLLAW

SEQ ID NO: 2354947 - protein, 36 aa, Cryptosporidium parvum; identical to SEQ ID NO: 2188530

SEQ ID NO: 2354948 - protein, 25 aa, Cryptosporidium parvum
EALRPQLRVLKISLKKSLFNEVSKL

SEQ ID NO: 2354949 - protein, 23 aa, Cryptosporidium parvum
EALYDICFRTLKLTNPSYGDLNH

SEQ ID NO: 2354950 - protein, 32 aa, Cryptosporidium parvum; identical to SEQ ID NO: 2312052

SEQ ID NO: 2354951 - protein, 25 aa, Cryptosporidium parvum
EAVCGWNIKFPTFSLSTQNSMVGNV

SEQ ID NO: 2354952 - protein, 25 aa, Cryptosporidium parvum
ECGSFLPMNKLFKKGDLLTALVGLE

SEQ ID NO: 2354953 - protein, 18 aa, Cryptosporidium parvum
ECLYLNFDSPWSSSKPAQ

SEQ ID NO: 2354954 - protein, 25 aa, Cryptosporidium parvum
ECNKYLTNIKFLPKNTLKRVEFLSV

SEQ ID NO: 2354955 - protein, 18 aa, Cryptosporidium parvum
EDDGCIHGIRFYKDSNLD

SEQ ID NO: 2354956 - protein, 33 aa, Cryptosporidium parvum; identical to SEQ ID NO: 2312102

SEQ ID NO: 2354957 - protein, 25 aa, Cryptosporidium parvum
EDNKTPLHYASFRSNLDYAKWVIEK

SEQ ID NO: 2354958 - protein, 24 aa, Cryptosporidium parvum
EDVRKKVCIFLSDLLAVYKNNVSL

SEQ ID NO: 2354959 - protein, 33 aa, Cryptosporidium parvum; identical to SEQ ID NO: 2312150

SEQ ID NO: 2354960 - protein, 24 aa, Cryptosporidium parvum
EEDELLYQLVQRLGPSSWSETARL

SEQ ID NO: 2354961 - protein, 23 aa, Cryptosporidium parvum
EEFPDRILQTFSVFPSPKVSDTV

SEQ ID NO: 2354962 - protein, 24 aa, Cryptosporidium parvum
EEFYESQVHFTGTLMGACIYTKKE

SEQ ID NO: 2354963 - protein, 27 aa, Cryptosporidium parvum
EELKRKFGSFESHIRRLLDARDNEIIQ

SEQ ID NO: 2354964 - protein, 31 aa, Cryptosporidium parvum; identical to SEQ ID NO: 2188653

SEQ ID NO: 2354965 - protein, 28 aa, Cryptosporidium parvum
EENSSLFLENILIPKVRLKKLIENGSLL

SEQ ID NO: 2354966 - protein, 25 aa, Cryptosporidium parvum
EEQNAVLVSLLDVSVRKLEILRKEN

SEQ ID NO: 2354967 - protein, 32 aa, Cryptosporidium parvum; identical to SEQ ID NO: 2188660

SEQ ID NO: 2354968 - protein, 22 aa, Cryptosporidium parvum
EERPFAILDARPKLNAFANKAT

SEQ ID NO: 2354969 - protein, 30 aa, Cryptosporidium parvum; identical to SEQ ID NO: 2188665

SEQ ID NO: 2354970 - protein, 30 aa, Cryptosporidium parvum; identical to SEQ ID NO: 2188691

SEQ ID NO: 2354971 - protein, 25 aa, Cryptosporidium parvum
EFERPGFICLKPEPSSISSISKEMR

SEQ ID NO: 2354972 - protein, 29 aa, Cryptosporidium parvum
EFKDTIMYYIIFLKYVIIVTKLQNCLNEQ

SEQ ID NO: 2354973 - protein, 25 aa, Cryptosporidium parvum
EFKTGLDSLIRRKILQGIKDKLKAG

SEQ ID NO: 2354974 - protein, 25 aa, Cryptosporidium parvum
EFNSLNKILLYMHKRKRVCSIIDKL

SEQ ID NO: 2354975 - protein, 19 aa, Cryptosporidium parvum
EFPDLLRPKARYSEKVVKT

SEQ ID NO: 2354976 - protein, 18 aa, Cryptosporidium parvum
EFRDLKTSSKNWFCFQCL

SEQ ID NO: 2354977 - protein, 24 aa, Cryptosporidium parvum
EFRENLKKCLNILELLSMDIEEQV

SEQ ID NO: 2354978 - protein, 17 aa, Cryptosporidium parvum
EFYPILICKKNDYNLNC

SEQ ID NO: 2354979 - protein, 18 aa, Cryptosporidium parvum
EFYVHFRGLNRRLDRWVK

SEQ ID NO: 2354980 - protein, 26 aa, Cryptosporidium parvum
EGCKQYLHCLPFFKTYSKLSKLGIQF

SEQ ID NO: 2354981 - protein, 33 aa, Cryptosporidium parvum
EGDIAIIFSQWGEPIDINLIRDKKLGISKGYCF

SEQ ID NO: 2354982 - protein, 25 aa, Cryptosporidium parvum
EGDRRKEGMSINRSLLALSQVISQL

SEQ ID NO: 2354983 - protein, 25 aa, Cryptosporidium parvum
EGEALTALILNKLQLNLKVCAVKAP

SEQ ID NO: 2354984 - protein, 26 aa, Cryptosporidium parvum
EGGELYNIWYGKYQFDYDKRGKVASK

SEQ ID NO: 2354985 - protein, 31 aa, Cryptosporidium parvum
EGIFDPVYLHPWFLTLFVSTLPLKTVVIIWD

SEQ ID NO: 2354986 - protein, 38 aa, Cryptosporidium parvum; identical to SEQ ID NO: 2312316

SEQ ID NO: 2354987 - protein, 21 aa, Cryptosporidium parvum
EHIWKSTCFIKLPSKLDDGGY

SEQ ID NO: 2354988 - protein, 25 aa, Cryptosporidium parvum
EHSSYVPYRDSKLTRLLQDSLGGRT

SEQ ID NO: 2354989 - protein, 18 aa, Cryptosporidium parvum
EIENPQIIPICNPNKSSN

SEQ ID NO: 2354990 - protein, 24 aa, Cryptosporidium parvum
EIIDLILCQIQFRATLLWIHRISV

SEQ ID NO: 2354991 - protein, 17 aa, Cryptosporidium parvum
EIIGVSPNAGAAEIKKE

SEQ ID NO: 2354992 - protein, 22 aa, Cryptosporidium parvum
EIKDYVNPLLSECSCINIFAFG

SEQ ID NO: 2354993 - protein, 28 aa, Cryptosporidium parvum
EILNTIRFSAIEILAWTQSRLSEIFIKE

SEQ ID NO: 2354994 - protein, 22 aa, Cryptosporidium parvum
EINPPEVLTFKGPLTEKIDNYA

SEQ ID NO: 2354995 - protein, 31 aa, Cryptosporidium parvum; identical to SEQ ID NO: 2188854

SEQ ID NO: 2354996 - protein, 33 aa, Cryptosporidium parvum
EISIPSHGSHLPLLPPSRFPFQSEARRTINRLS

SEQ ID NO: 2354997 - protein, 17 aa, Cryptosporidium parvum
EIVIKAEKPSWKPEEGK

SEQ ID NO: 2354998 - protein, 19 aa, Cryptosporidium parvum
EIVYALIPNVGLLEKNLKI

SEQ ID NO: 2354999 - protein, 29 aa, Cryptosporidium parvum
EIYEFKIIGIGILLLLRQELDLKEFYTCI

SEQ ID NO: 2355000 - protein, 30 aa, Cryptosporidium parvum; identical to SEQ ID NO: 2312436

SEQ ID NO: 2355001 - protein, 18 aa, Cryptosporidium parvum
EIYLLAYSHKDLLMDHIE

SEQ ID NO: 2355002 - protein, 21 aa, Cryptosporidium parvum
EKAFFLSLSNHLHILESRKNS

SEQ ID NO: 2355003 - protein, 25 aa, Cryptosporidium parvum
EKARNFFGRFGITGSLALEPLYVLS

SEQ ID NO: 2355004 - protein, 22 aa, Cryptosporidium parvum
EKDIFLLRAVLVLLSLNKTQFA

SEQ ID NO: 2355005 - protein, 23 aa, Cryptosporidium parvum
EKFFGSMEFGEIESLTLVLACKL

SEQ ID NO: 2355006 - protein, 17 aa, Cryptosporidium parvum
EKHPLGMHIIANSSNKG

SEQ ID NO: 2355007 - protein, 23 aa, Cryptosporidium parvum
EKIDTLFNFLRTHSNKKIIVFVS

SEQ ID NO: 2355008 - protein, 17 aa, Cryptosporidium parvum
EKLCLLLGNLTDKLIEF

SEQ ID NO: 2355009 - protein, 20 aa, Cryptosporidium parvum
EKLNKLKSALSELGDFNKKL

SEQ ID NO: 2355010 - protein, 26 aa, Cryptosporidium parvum
EKLNNYGRYLLSCDSSLNLEFMNSNQ

SEQ ID NO: 2355011 - protein, 50 aa, Cryptosporidium parvum
EKLYIRRVCLIQSTFRMYLQRRYFIRLSGSVLKAQILWRGKLARRQFQKL

SEQ ID NO: 2355012 - protein, 24 aa, Cryptosporidium parvum
EKLYLTGIQQNKFLRFIMILSTQL

SEQ ID NO: 2355013 - protein, 24 aa, Cryptosporidium parvum
EKNLSHDLLLDEYSIHEKCFTDNI

SEQ ID NO: 2355014 - protein, 23 aa, Cryptosporidium parvum
EKNSLILLLTSYCNWDEQIADVS

SEQ ID NO: 2355015 - protein, 28 aa, Cryptosporidium parvum
EKQTKYWVPSFLSFKPKFMYSIPFKCNE

SEQ ID NO: 2355016 - protein, 24 aa, Cryptosporidium parvum
EKSKLLKDFSSLKLDFDKLKEQHN

SEQ ID NO: 2355017 - protein, 20 aa, Cryptosporidium parvum
EKTEQLLKEKFVQMYPVVAR

SEQ ID NO: 2355018 - protein, 26 aa, Cryptosporidium parvum
ELAQLQALELTWKYPIENSSNFPNDK

SEQ ID NO: 2355019 - protein, 26 aa, Cryptosporidium parvum
ELEAFQHFIQLIQSVLYFQDKGVVHR

SEQ ID NO: 2355020 - protein, 21 aa, Cryptosporidium parvum
ELENPYILISQGKISSLKSIL

SEQ ID NO: 2355021 - protein, 21 aa, Cryptosporidium parvum
ELENWRATSVKLTFNYFLVKQ

SEQ ID NO: 2355022 - protein, 27 aa, Cryptosporidium parvum
ELFTVFKRLLLYDSKAVRKCAVKVIIG

SEQ ID NO: 2355023 - protein, 18 aa, Cryptosporidium parvum
ELIRFITDNIARQGLISS

SEQ ID NO: 2355024 - protein, 26 aa, Cryptosporidium parvum
ELKDLNHFIILFQYDDHKGIRGLYSF

SEQ ID NO: 2355025 - protein, 25 aa, Cryptosporidium parvum
ELKKLDFSAFALSLGLAIPPKIKIN

SEQ ID NO: 2355026 - protein, 30 aa, Cryptosporidium parvum; identical to SEQ ID NO: 2189038

SEQ ID NO: 2355027 - protein, 21 aa, Cryptosporidium parvum
ELNIEYDFCKMVSKKSKLDDS

SEQ ID NO: 2355028 - protein, 18 aa, Cryptosporidium parvum
ELPIAYISRLTDCHHLLA

SEQ ID NO: 2355029 - protein, 25 aa, Cryptosporidium parvum
ELPPPPPPSEELPPPPPPSSGELPP

SEQ ID NO: 2355030 - protein, 17 aa, Cryptosporidium parvum
ELRLKQQYFFVCATIQD

SEQ ID NO: 2355031 - protein, 19 aa, Cryptosporidium parvum
ELYLDWFLNKSIESQFRAF

SEQ ID NO: 2355032 - protein, 34 aa, Cryptosporidium parvum
EMCPEEYLDAGYPLGSLLWVSTLDIESHIKKWRY

SEQ ID NO: 2355033 - protein, 35 aa, Cryptosporidium parvum; identical to SEQ ID NO: 2189082

SEQ ID NO: 2355034 - protein, 25 aa, Cryptosporidium parvum
EMRCRDLFPALWVPDLFMERVEKDQ

SEQ ID NO: 2355035 - protein, 29 aa, Cryptosporidium parvum
EMRQEIDMLNIPIWLYKESGSLTVNGPFS

SEQ ID NO: 2355036 - protein, 25 aa, Cryptosporidium parvum
ENFEVMRWRYYFVKMAINIDKFFPE

SEQ ID NO: 2355037 - protein, 24 aa, Cryptosporidium parvum
ENGMYRQKLHPCEICAAFLSETDN

SEQ ID NO: 2355038 - protein, 25 aa, Cryptosporidium parvum
ENGVLYLLYKACRIFKQLGVEYVTI

SEQ ID NO: 2355039 - protein, 25 aa, Cryptosporidium parvum
ENISLFESLFRLGFTNITASCSRIS

SEQ ID NO: 2355040 - protein, 24 aa, Cryptosporidium parvum
ENQDRPRLLPYLNRMLRELKKPYD

SEQ ID NO: 2355041 - protein, 24 aa, Cryptosporidium parvum
ENQKSLELFIKKLKEDEIDSCLGE

SEQ ID NO: 2355042 - protein, 26 aa, Cryptosporidium parvum
ENSDNFMIFLDVINYILVSTLSASKV

SEQ ID NO: 2355043 - protein, 36 aa, Cryptosporidium parvum; identical to SEQ ID NO: 2312735

SEQ ID NO: 2355044 - protein, 29 aa, Cryptosporidium parvum
ENSPRHIRMLFLLHKWDAPMNYSPETSLQ

SEQ ID NO: 2355045 - protein, 23 aa, Cryptosporidium parvum
ENTFSFLLYHYHPQYYHDRMSGK

SEQ ID NO: 2355046 - protein, 18 aa, Cryptosporidium parvum
ENTVKTLLKNGADPRYKN

SEQ ID NO: 2355047 - protein, 33 aa, Cryptosporidium parvum; identical to SEQ ID NO: 2189208

SEQ ID NO: 2355048 - protein, 20 aa, Cryptosporidium parvum
EQILFVLNRGFTYAHDSVIN

SEQ ID NO: 2355049 - protein, 21 aa, Cryptosporidium parvum
EQMDYLVSAGIYRVIISIVEG

SEQ ID NO: 2355050 - protein, 30 aa, Cryptosporidium parvum; identical to SEQ ID NO: 2312804

SEQ ID NO: 2355051 - protein, 22 aa, Cryptosporidium parvum
ERAFSAYIKSLFILTPNDKREE

SEQ ID NO: 2355052 - protein, 33 aa, Cryptosporidium parvum; identical to SEQ ID NO: 2189249

SEQ ID NO: 2355053 - protein, 23 aa, Cryptosporidium parvum
EREAQTVGFLERKLRQVELEHKT

SEQ ID NO: 2355054 - protein, 29 aa, Cryptosporidium parvum
ERIIKPIAEKFPYLIYPMNADELNISSIN

SEQ ID NO: 2355055 - protein, 25 aa, Cryptosporidium parvum
ERKIYELETFYWNQTTDIGNMLRGW

SEQ ID NO: 2355056 - protein, 24 aa, Cryptosporidium parvum
ERNYHIFYCLAAGVSKGIFPESIS

SEQ ID NO: 2355057 - protein, 17 aa, Cryptosporidium parvum
ESKCILYYSYKDVSRLQ

SEQ ID NO: 2355058 - protein, 17 aa, Cryptosporidium parvum
ESLAGLPIKEISCGGHH

SEQ ID NO: 2355059 - protein, 25 aa, Cryptosporidium parvum
ESLNRLYVSWLDGNIPGVTKLIVKS

SEQ ID NO: 2355060 - protein, 20 aa, Cryptosporidium parvum
ESPQSINWFWNILDLNETGY

SEQ ID NO: 2355061 - protein, 18 aa, Cryptosporidium parvum
ESQEFRFGEGTFTGGLTD

SEQ ID NO: 2355062 - protein, 30 aa, Cryptosporidium parvum
ESSLQLVAYSLYWLLKFTNSTNVPIYSIGS

SEQ ID NO: 2355063 - protein, 26 aa, Cryptosporidium parvum
ETEFSFVSCWIIIRNWAIVKMKTGEP

SEQ ID NO: 2355064 - protein, 24 aa, Cryptosporidium parvum
ETKLTKNVSLKIPLISSAMDTVTE

SEQ ID NO: 2355065 - protein, 23 aa, Cryptosporidium parvum
ETKSLIDIYLLRSVANEKTNKQR

SEQ ID NO: 2355066 - protein, 21 aa, Cryptosporidium parvum
ETLSEWRNELLLAILEKISES

SEQ ID NO: 2355067 - protein, 21 aa, Cryptosporidium parvum
ETNEILAKYVNDLASEYCHRN

SEQ ID NO: 2355068 - protein, 24 aa, Cryptosporidium parvum
ETNNIGKIFFGKPIRDFSSFSNVI

SEQ ID NO: 2355069 - protein, 41 aa, Cryptosporidium parvum; identical to SEQ ID NO: 2312983

SEQ ID NO: 2355070 - protein, 23 aa, Cryptosporidium parvum
EVEIPIHSEVYIRYGILSSSECL

SEQ ID NO: 2355071 - protein, 18 aa, Cryptosporidium parvum
EVFGLCGPIKAIYLGLNH

SEQ ID NO: 2355072 - protein, 36 aa, Cryptosporidium parvum
EVINSKRTILYHKALYLAIQQHLLMYSSELQALLKA

SEQ ID NO: 2355073 - protein, 24 aa, Cryptosporidium parvum
EVKEKVFIVGRLIRYVSKALNISS

SEQ ID NO: 2355074 - protein, 28 aa, Cryptosporidium parvum
EVKPIKGIIRKRLKKKLLKLSKISGQNF

SEQ ID NO: 2355075 - protein, 19 aa, Cryptosporidium parvum
EVLASFIVGLHSKATEVSG

SEQ ID NO: 2355076 - protein, 36 aa, Cryptosporidium parvum
EVLESRSLVWVKHPKLAWAPATILRREEQGFVARVE

SEQ ID NO: 2355077 - protein, 19 aa, Cryptosporidium parvum
EVLLGFNCTIFAYGQTGTG

SEQ ID NO: 2355078 - protein, 24 aa, Cryptosporidium parvum
EVNPELIFEFQKYSKSSIQSNNNN

SEQ ID NO: 2355079 - protein, 26 aa, Cryptosporidium parvum
EVPQVTCYIILIINGQICPDEMIAIA

SEQ ID NO: 2355080 - protein, 25 aa, Cryptosporidium parvum
EVYNEKLFDLLAPQSNLNNSSNDFN

SEQ ID NO: 2355081 - protein, 19 aa, Cryptosporidium parvum
EVYVTEPCFTPSPNPLANG

SEQ ID NO: 2355082 - protein, 18 aa, Cryptosporidium parvum
EYEYELATNPVLENLDEE

SEQ ID NO: 2355083 - protein, 31 aa, Cryptosporidium parvum; identical to SEQ ID NO: 2313071

SEQ ID NO: 2355084 - protein, 17 aa, Cryptosporidium parvum
EYLFEWQVLSRRSSIIY

SEQ ID NO: 2355085 - protein, 28 aa, Cryptosporidium parvum
FAKDSLELSLLLNFRSLSTKLQTEILHA

SEQ ID NO: 2355086 - protein, 30 aa, Cryptosporidium parvum; identical to SEQ ID NO: 2313097

SEQ ID NO: 2355087 - protein, 31 aa, Cryptosporidium parvum; identical to SEQ ID NO: 2313098

SEQ ID NO: 2355088 - protein, 21 aa, Cryptosporidium parvum
FANALRQIPTILLDNGGYDSA

SEQ ID NO: 2355089 - protein, 17 aa, Cryptosporidium parvum
FAQEYLSPVAFSLLLDP

SEQ ID NO: 2355090 - protein, 30 aa, Cryptosporidium parvum; identical to SEQ ID NO: 2189490

SEQ ID NO: 2355091 - protein, 18 aa, Cryptosporidium parvum
FCGRFILSNFIYAHQHIE

SEQ ID NO: 2355092 - protein, 17 aa, Cryptosporidium parvum
FCIGALDSTTAASCLGK

SEQ ID NO: 2355093 - protein, 25 aa, Cryptosporidium parvum
FCKKFNIPLLILGGGGYTIRNVART

SEQ ID NO: 2355094 - protein, 17 aa, Cryptosporidium parvum
FCPSIKAVKFLGNGQER

SEQ ID NO: 2355095 - protein, 19 aa, Cryptosporidium parvum
FCRGVPDPKIRIYDVGRKK

SEQ ID NO: 2355096 - protein, 17 aa, Cryptosporidium parvum
FDGSWQPSSFYDKIKAN

SEQ ID NO: 2355097 - protein, 26 aa, Cryptosporidium parvum
FDKGILSFVFLIDTVYNIIPGTNETL

SEQ ID NO: 2355098 - protein, 28 aa, Cryptosporidium parvum
FDKTKNDLPLFIRLLQDGSSEAVLSSGC

SEQ ID NO: 2355099 - protein, 20 aa, Cryptosporidium parvum
FDLNAQIYEILFPQENKFQD

SEQ ID NO: 2355100 - protein, 28 aa, Cryptosporidium parvum
FDNLSEAIARLLPYHTFYVDEIKSNRIS

SEQ ID NO: 2355101 - protein, 25 aa, Cryptosporidium parvum
FDQNYTVAIIYPLNGAQPIRCPTNF

SEQ ID NO: 2355102 - protein, 25 aa, Cryptosporidium parvum
FDTSKIFKSYKLPFIKVKINNCNYV

SEQ ID NO: 2355103 - protein, 27 aa, Cryptosporidium parvum
FDVFRRLYSLLIKFAPLDLKDLISIEK

SEQ ID NO: 2355104 - protein, 18 aa, Cryptosporidium parvum
FEIFILIYELIENIKIKN

SEQ ID NO: 2355105 - protein, 17 aa, Cryptosporidium parvum
FEKRLIEEYIRCNNSCP

SEQ ID NO: 2355106 - protein, 17 aa, Cryptosporidium parvum
FEYFLSNACITTVTTTK

SEQ ID NO: 2355107 - protein, 18 aa, Cryptosporidium parvum
FFEESVLLIKSGLENPVH

SEQ ID NO: 2355108 - protein, 20 aa, Cryptosporidium parvum
FFPNEFQLPMPIEEAKRRLR

SEQ ID NO: 2355109 - protein, 26 aa, Cryptosporidium parvum
FFSDLWSTGMAYKIVIITNAGLRTVE

SEQ ID NO: 2355110 - protein, 28 aa, Cryptosporidium parvum
FFSNLKSYLNFISIYNQISKQGSINYTL

SEQ ID NO: 2355111 - protein, 24 aa, Cryptosporidium parvum
FGDKKGSFAIFYGIGFRIIQSEER

SEQ ID NO: 2355112 - protein, 24 aa, Cryptosporidium parvum
FGDLINCFVTHFDFNRVKIFSQRR

SEQ ID NO: 2355113 - protein, 53 aa, Cryptosporidium parvum; identical to SEQ ID NO: 2313241

SEQ ID NO: 2355114 - protein, 30 aa, Cryptosporidium parvum; identical to SEQ ID NO: 2189613

SEQ ID NO: 2355115 - protein, 21 aa, Cryptosporidium parvum
FGGLMCSNSDFRRISPLLGVL

SEQ ID NO: 2355116 - protein, 19 aa, Cryptosporidium parvum
FGYQVGMPGRPLLFQGAEI

SEQ ID NO: 2355117 - protein, 18 aa, Cryptosporidium parvum
FIGCGRRLYGVGGGCFDG

SEQ ID NO: 2355118 - protein, 18 aa, Cryptosporidium parvum
FILIYELIENIKIKNSKA

SEQ ID NO: 2355119 - protein, 17 aa, Cryptosporidium parvum
FITLLNDVEWYSVDDMN

SEQ ID NO: 2355120 - protein, 17 aa, Cryptosporidium parvum
FIYCNYYDYAAKFLNKY

SEQ ID NO: 2355121 - protein, 25 aa, Cryptosporidium parvum
FKDLDYKAIFTWKRFNQIKYVLDTR

SEQ ID NO: 2355122 - protein, 19 aa, Cryptosporidium parvum
FKLLLIGDSGVGKSCLLLR

SEQ ID NO: 2355123 - protein, 26 aa, Cryptosporidium parvum
FKVLRKRLLCFSASTAFWIPYTFSNE

SEQ ID NO: 2355124 - protein, 30 aa, Cryptosporidium parvum; identical to SEQ ID NO: 2313373

SEQ ID NO: 2355125 - protein, 25 aa, Cryptosporidium parvum
FLKEFYGVLDFGSVLKVNILALDSI

SEQ ID NO: 2355126 - protein, 26 aa, Cryptosporidium parvum
FLLKQDPLYIHLQLATYQVYSYVPSS

SEQ ID NO: 2355127 - protein, 25 aa, Cryptosporidium parvum
FLPKLDRVLLDAPCTGLGIIARDPS

SEQ ID NO: 2355128 - protein, 25 aa, Cryptosporidium parvum
FLSKGYIDTLFTNKFKIWYQRDEGS

SEQ ID NO: 2355129 - protein, 18 aa, Cryptosporidium parvum
FLSKYALDLVPGIVNDDF

SEQ ID NO: 2355130 - protein, 19 aa, Cryptosporidium parvum
FLYNPNGPISLLSFNILIE

SEQ ID NO: 2355131 - protein, 22 aa, Cryptosporidium parvum
FNDGIRAFGLRIPKFPVPKITL

SEQ ID NO: 2355132 - protein, 25 aa, Cryptosporidium parvum
FNDSFFGDFIGYNKLINEASEMNNW

SEQ ID NO: 2355133 - protein, 36 aa, Cryptosporidium parvum; identical to SEQ ID NO: 2313443

SEQ ID NO: 2355134 - protein, 24 aa, Cryptosporidium parvum
FNHTSYALLRKKAIKKFPVNYGSS

SEQ ID NO: 2355135 - protein, 21 aa, Cryptosporidium parvum
FNIIQMLKIELLKHSGDKNNE

SEQ ID NO: 2355136 - protein, 22 aa, Cryptosporidium parvum
FNKECRTIFVGDLYINRSKSNY

SEQ ID NO: 2355137 - protein, 19 aa, Cryptosporidium parvum
FNLLQDDLSALIWTDIRHF

SEQ ID NO: 2355138 - protein, 27 aa, Cryptosporidium parvum
FNLSFNKSWNLFFSKFLNGFRLEMSDG

SEQ ID NO: 2355139 - protein, 17 aa, Cryptosporidium parvum
FNNNFNFRINVQWHSVY

SEQ ID NO: 2355140 - protein, 24 aa, Cryptosporidium parvum
FNPQLIFQIFEWFEYRTKSINTEQ

SEQ ID NO: 2355141 - protein, 19 aa, Cryptosporidium parvum
FNQKGIISDILFPPEVPQV

SEQ ID NO: 2355142 - protein, 27 aa, Cryptosporidium parvum
FNQNTLPYLNHTILSKPNVTTQLSMLN

SEQ ID NO: 2355143 - protein, 26 aa, Cryptosporidium parvum
FNSYIGYWDVINSLGVLIVNLGYKKD

SEQ ID NO: 2355144 - protein, 30 aa, Cryptosporidium parvum; identical to SEQ ID NO: 2130659

SEQ ID NO: 2355145 - protein, 34 aa, Cryptosporidium parvum; identical to SEQ ID NO: 2189837

SEQ ID NO: 2355146 - protein, 20 aa, Cryptosporidium parvum
FQNFVLEEIAHIKNDIAKES

SEQ ID NO: 2355147 - protein, 18 aa, Cryptosporidium parvum
FQSISTMSADLAKNGIVF

SEQ ID NO: 2355148 - protein, 20 aa, Cryptosporidium parvum
FSDIIQYIMVKHVVGIKFRE

SEQ ID NO: 2355149 - protein, 23 aa, Cryptosporidium parvum
FSGKICPKCFSVYLIGINCKLEV

SEQ ID NO: 2355150 - protein, 24 aa, Cryptosporidium parvum
FSKGFRQKGVPMLSRYLKPIKVGD

SEQ ID NO: 2355151 - protein, 30 aa, Cryptosporidium parvum; identical to SEQ ID NO: 2189892

SEQ ID NO: 2355152 - protein, 25 aa, Cryptosporidium parvum
FSSLNSMVNLFTSLRFYHYSVEVRN

SEQ ID NO: 2355153 - protein, 18 aa, Cryptosporidium parvum
FTISEGIPALIPRIEELA

SEQ ID NO: 2355154 - protein, 27 aa, Cryptosporidium parvum
FTMVSKKYIYFFFSNATPNSIFCFIEK

SEQ ID NO: 2355155 - protein, 24 aa, Cryptosporidium parvum
FTTGATTTTTFKKTATTGTQKQGE

SEQ ID NO: 2355156 - protein, 24 aa, Cryptosporidium parvum
FTTILYVSFRLIDEFYPILICKKN

SEQ ID NO: 2355157 - protein, 18 aa, Cryptosporidium parvum
FTYCKNDFNLSFNKSWNL

SEQ ID NO: 2355158 - protein, 23 aa, Cryptosporidium parvum
FTYIPDLEVILQRLTDSSIQNDK

SEQ ID NO: 2355159 - protein, 18 aa, Cryptosporidium parvum
FVFIKKAMLRLYNQRISF

SEQ ID NO: 2355160 - protein, 24 aa, Cryptosporidium parvum
FVGPPGSGFLPRETAEFHRNNILH

SEQ ID NO: 2355161 - protein, 17 aa, Cryptosporidium parvum
FVILNRLREYTASFCTR

SEQ ID NO: 2355162 - protein, 17 aa, Cryptosporidium parvum
FVLVLNKADIMSESSDS

SEQ ID NO: 2355163 - protein, 31 aa, Cryptosporidium parvum
FWNSVKGTWIFRIATFGLFSFIGYVDKGYTV

SEQ ID NO: 2355164 - protein, 21 aa, Cryptosporidium parvum
FWRSLEFIRTDKYLYKMKPDI

SEQ ID NO: 2355165 - protein, 24 aa, Cryptosporidium parvum
FYGNGIQILLQPFSDLSINPSEIL

SEQ ID NO: 2355166 - protein, 28 aa, Cryptosporidium parvum
FYLHSRCLITIPFLQWELINDQVYTNLF

SEQ ID NO: 2355167 - protein, 18 aa, Cryptosporidium parvum
FYNNLIPHCNLYPKFEYE

SEQ ID NO: 2355168 - protein, 30 aa, Cryptosporidium parvum; identical to SEQ ID NO: 2189988

SEQ ID NO: 2355169 - protein, 22 aa, Cryptosporidium parvum
GAIELLIVWENLETKRMVVKNP

SEQ ID NO: 2355170 - protein, 21 aa, Cryptosporidium parvum
GAVRKSGVPGVYWSQKPQGWR

SEQ ID NO: 2355171 - protein, 33 aa, Cryptosporidium parvum; identical to SEQ ID NO: 2313705

SEQ ID NO: 2355172 - protein, 20 aa, Cryptosporidium parvum
GCSKAPHAPPLVNRTRNIYI

SEQ ID NO: 2355173 - protein, 23 aa, Cryptosporidium parvum
GDFKQVIEHPWFKSYHLMNFHED

SEQ ID NO: 2355174 - protein, 34 aa, Cryptosporidium parvum; identical to SEQ ID NO: 2190024

SEQ ID NO: 2355175 - protein, 18 aa, Cryptosporidium parvum
GDTVYKYYRGMGSVGAMK

SEQ ID NO: 2355176 - protein, 26 aa, Cryptosporidium parvum
GEDCPVFDGLWEFCQLSAGGSLGGAQ

SEQ ID NO: 2355177 - protein, 23 aa, Cryptosporidium parvum
GEMRAPIIGIPSKKPDYYVAGRH

SEQ ID NO: 2355178 - protein, 20 aa, Cryptosporidium parvum
GFSINKIKRIYAYAASSYTI

SEQ ID NO: 2355179 - protein, 18 aa, Cryptosporidium parvum
GFSSLHWASLKGHSQVVE

SEQ ID NO: 2355180 - protein, 33 aa, Cryptosporidium parvum; identical to SEQ ID NO: 2313808

SEQ ID NO: 2355181 - protein, 18 aa, Cryptosporidium parvum
GGKRKGAIAIYLEPWHVD

SEQ ID NO: 2355182 - protein, 36 aa, Cryptosporidium parvum; identical to SEQ ID NO: 2313841

SEQ ID NO: 2355183 - protein, 25 aa, Cryptosporidium parvum
GHMHLSRCALLPTPDYRILNLGGIP

SEQ ID NO: 2355184 - protein, 28 aa, Cryptosporidium parvum
GHNFITEIDPLLSLTKLKSLNISKNPCI

SEQ ID NO: 2355185 - protein, 26 aa, Cryptosporidium parvum
GIDDDSFLSLFKPIISKCIEVYRPGA

SEQ ID NO: 2355186 - protein, 40 aa, Cryptosporidium parvum
GIEGFHQFFPGLNMGGEYIGGLLPGALAAAGLNIGGGINS

SEQ ID NO: 2355187 - protein, 24 aa, Cryptosporidium parvum
GIELPLLNITNLSDLLLLPIDVNR

SEQ ID NO: 2355188 - protein, 35 aa, Cryptosporidium parvum
GIIFTPVHLPYVPGTCPQLLKWKPPHLNTADFAAI

SEQ ID NO: 2355189 - protein, 20 aa, Cryptosporidium parvum
GILSMKIVEFGFQGTNVLRM

SEQ ID NO: 2355190 - protein, 20 aa, Cryptosporidium parvum
GIMVVELIIIAKCCGLTGEL

SEQ ID NO: 2355191 - protein, 25 aa, Cryptosporidium parvum
GKFGTAIMFCNMSDYPFLSSIEKAS

SEQ ID NO: 2355192 - protein, 25 aa, Cryptosporidium parvum
GKQDRLLPVLPQSSNSRMMRMIQQQ

SEQ ID NO: 2355193 - protein, 23 aa, Cryptosporidium parvum
GKSSLWKSLAIYLIGALEIETTD

SEQ ID NO: 2355194 - protein, 23 aa, Cryptosporidium parvum
GKVGVIVFVGRNKNLRLLTSTGE

SEQ ID NO: 2355195 - protein, 31 aa, Cryptosporidium parvum; identical to SEQ ID NO: 2190255

SEQ ID NO: 2355196 - protein, 33 aa, Cryptosporidium parvum; identical to SEQ ID NO: 2313971

SEQ ID NO: 2355197 - protein, 25 aa, Cryptosporidium parvum
GLEEQFQIISKCKQFIIALEEIISF

SEQ ID NO: 2355198 - protein, 25 aa, Cryptosporidium parvum
GLERIDIPIILGKIEKPRNSLFVAD

SEQ ID NO: 2355199 - protein, 19 aa, Cryptosporidium parvum
GLISAARLLVHLYESNTLE

SEQ ID NO: 2355200 - protein, 18 aa, Cryptosporidium parvum
GLLKSPINGLSRSSQDLR

SEQ ID NO: 2355201 - protein, 18 aa, Cryptosporidium parvum
GLNPMDLLRGIKLGVEHV

SEQ ID NO: 2355202 - protein, 24 aa, Cryptosporidium parvum
GLQDNIFGFIKLLSSFIELCKFNK

SEQ ID NO: 2355203 - protein, 26 aa, Cryptosporidium parvum
GLRTVELFYLKYCLPKLGDILKKYNV

SEQ ID NO: 2355204 - protein, 18 aa, Cryptosporidium parvum
GLSFYRSIQKATLGCIKE

SEQ ID NO: 2355205 - protein, 26 aa, Cryptosporidium parvum
GLTFEDILLVPNYSEVLPREVSLETK

SEQ ID NO: 2355206 - protein, 22 aa, Cryptosporidium parvum
GMFIYYEDTRLFWFNMASLESN

SEQ ID NO: 2355207 - protein, 17 aa, Cryptosporidium parvum
GMHIIANSSNKGLFSMF

SEQ ID NO: 2355208 - protein, 23 aa, Cryptosporidium parvum
GNILRRCATYVYKILSILGLCGE

SEQ ID NO: 2355209 - protein, 25 aa, Cryptosporidium parvum
GNPLHSLVICHPDLHLIEQRFFEIY

SEQ ID NO: 2355210 - protein, 26 aa, Cryptosporidium parvum
GNRIIKPFQIRFILVLLQGNILEHGF

SEQ ID NO: 2355211 - protein, 25 aa, Cryptosporidium parvum
GPFSTRHMSSLWKSYTFTHETLFTM

SEQ ID NO: 2355212 - protein, 23 aa, Cryptosporidium parvum
GPKLQEWLGLRDWKNNQSKKQNV

SEQ ID NO: 2355213 - protein, 30 aa, Cryptosporidium parvum; identical to SEQ ID NO: 2314116

SEQ ID NO: 2355214 - protein, 18 aa, Cryptosporidium parvum
GQLLVKYQHGIDKEIAKW

SEQ ID NO: 2355215 - protein, 17 aa, Cryptosporidium parvum
GQNIESQEFRFGEGTFT

SEQ ID NO: 2355216 - protein, 24 aa, Cryptosporidium parvum
GQRCDHIFLPPTHLSKKLAQYEPY

SEQ ID NO: 2355217 - protein, 26 aa, Cryptosporidium parvum
GRCNCGYPIFIINGEVIAGSSGFGCN

SEQ ID NO: 2355218 - protein, 26 aa, Cryptosporidium parvum
GRHLRLMRAGFGIMAYLLSENLCIES

SEQ ID NO: 2355219 - protein, 25 aa, Cryptosporidium parvum
GRTGYAITFFTLRDIPKIKSIAKVI

SEQ ID NO: 2355220 - protein, 20 aa, Cryptosporidium parvum
GRVGWDYCLWIDIPEFSCMY

SEQ ID NO: 2355221 - protein, 26 aa, Cryptosporidium parvum
GRVRIGKFILDTWYFSPLPDEYQNVD

SEQ ID NO: 2355222 - protein, 21 aa, Cryptosporidium parvum
GSAYFSIGNTKVLCGIYGPNL

SEQ ID NO: 2355223 - protein, 32 aa, Cryptosporidium parvum; identical to SEQ ID NO: 2190465

SEQ ID NO: 2355224 - protein, 30 aa, Cryptosporidium parvum; identical to SEQ ID NO: 2190468

SEQ ID NO: 2355225 - protein, 24 aa, Cryptosporidium parvum
GSGKTLCYILPILGRLKNDKVYCA

SEQ ID NO: 2355226 - protein, 25 aa, Cryptosporidium parvum
GSGWHYYHQILNQYKPCQSMIQFKY

SEQ ID NO: 2355227 - protein, 42 aa, Cryptosporidium parvum
GSINMPELSLPYKLWIDAKSRDWILEWQTKNGRWSVRKFSCK

SEQ ID NO: 2355228 - protein, 26 aa, Cryptosporidium parvum
GSKEGLFFYILLENNAKKSSECMGRI

SEQ ID NO: 2355229 - protein, 25 aa, Cryptosporidium parvum
GSKNILIKTIGFWDVSPPGTPTLTI

SEQ ID NO: 2355230 - protein, 28 aa, Cryptosporidium parvum
GSSIKFFMKRYWLDIKLFGKMLYENKRE

SEQ ID NO: 2355231 - protein, 24 aa, Cryptosporidium parvum
GSTDDVLIPRLLEGPLEDIQITKV

SEQ ID NO: 2355232 - protein, 28 aa, Cryptosporidium parvum
GSYDETLRFWDFRMINSPIYEHKTNGGI

SEQ ID NO: 2355233 - protein, 17 aa, Cryptosporidium parvum
GTAVFNFRRNEVRSFLL

SEQ ID NO: 2355234 - protein, 27 aa, Cryptosporidium parvum
GTGKTIAFVLFILNKLLDSLDNCLERS

SEQ ID NO: 2355235 - protein, 29 aa, Cryptosporidium parvum
GTGKTLAFVLPVIERLLKKGKFDPNKHGR

SEQ ID NO: 2355236 - protein, 23 aa, Cryptosporidium parvum
GTGNLTMRLLPLARKVVAFDIDP

SEQ ID NO: 2355237 - protein, 25 aa, Cryptosporidium parvum
GTHFTLMGSIFPNQLPPGIQNHVPT

SEQ ID NO: 2355238 - protein, 26 aa, Cryptosporidium parvum
GTSYFNIPLLHLWCADHIRFRKGNQA

SEQ ID NO: 2355239 - protein, 24 aa, Cryptosporidium parvum
GTYKIAYLPFNKKGLIMLDGLAKA

SEQ ID NO: 2355240 - protein, 22 aa, Cryptosporidium parvum
GVGKSCLLLRFAQDDSFTDSYI

SEQ ID NO: 2355241 - protein, 31 aa, Cryptosporidium parvum; identical to SEQ ID NO: 2190548

SEQ ID NO: 2355242 - protein, 17 aa, Cryptosporidium parvum
GVNSKQTKCQETMRGAG

SEQ ID NO: 2355243 - protein, 18 aa, Cryptosporidium parvum
GVVYQLVGGLRSCMGYLG

SEQ ID NO: 2355244 - protein, 18 aa, Cryptosporidium parvum
GYGFVQYEFVEHAVSALS

SEQ ID NO: 2355245 - protein, 20 aa, Cryptosporidium parvum
GYIRYSLKNCYFFNVPLTRM

SEQ ID NO: 2355246 - protein, 27 aa, Cryptosporidium parvum
GYRKKKLLNIRMLYPFTIRCNGCEVYH

SEQ ID NO: 2355247 - protein, 22 aa, Cryptosporidium parvum
GYSLVFMIPLEHSHSKSGINLI

SEQ ID NO: 2355248 - protein, 21 aa, Cryptosporidium parvum
GYTNWDVLFPVQNLRIAVERA

SEQ ID NO: 2355249 - protein, 26 aa, Cryptosporidium parvum
HASKTFIDPYTLLPEQPWDVMKEDGD

SEQ ID NO: 2355250 - protein, 36 aa, Cryptosporidium parvum; identical to SEQ ID NO: 2190611

SEQ ID NO: 2355251 - protein, 21 aa, Cryptosporidium parvum
HDAPISNIFWCDEQKFVVTGS

SEQ ID NO: 2355252 - protein, 18 aa, Cryptosporidium parvum
HEILIRNIKQNFIWESIE

SEQ ID NO: 2355253 - protein, 25 aa, Cryptosporidium parvum
HENDVFYWICNLPELSLNMLKGFVQ

SEQ ID NO: 2355254 - protein, 25 aa, Cryptosporidium parvum
HFANLALKAILRLGDNMNLDYIQII

SEQ ID NO: 2355255 - protein, 25 aa, Cryptosporidium parvum
HFRKDNLLWHWRSGDWIAHLSELKL

SEQ ID NO: 2355256 - protein, 27 aa, Cryptosporidium parvum
HGCNVFINRQLIYNYPDQLFKEAGIVA

SEQ ID NO: 2355257 - protein, 17 aa, Cryptosporidium parvum
HGFLPQEKRLENFSKFK

SEQ ID NO: 2355258 - protein, 19 aa, Cryptosporidium parvum
HGITWCYRSARFKVRYRRS

SEQ ID NO: 2355259 - protein, 18 aa, Cryptosporidium parvum
HGIYVKDLSEYFVTSPEE

SEQ ID NO: 2355260 - protein, 22 aa, Cryptosporidium parvum
HGWTDYQLRCNLAVAIGVSKDL

SEQ ID NO: 2355261 - protein, 17 aa, Cryptosporidium parvum
HGYIVMECILLLLNQNN

SEQ ID NO: 2355262 - protein, 20 aa, Cryptosporidium parvum
HHILTNFLYNPNGPISLLSF

SEQ ID NO: 2355263 - protein, 29 aa, Cryptosporidium parvum
HHPWDIRNLCYLHYSLYVDLFNLVRTSAD

SEQ ID NO: 2355264 - protein, 18 aa, Cryptosporidium parvum
HIDKIEFVLWPRHYKDWE

SEQ ID NO: 2355265 - protein, 22 aa, Cryptosporidium parvum
HIPLLKSTILLSFTKLYCNSDH

SEQ ID NO: 2355266 - protein, 24 aa, Cryptosporidium parvum
HISDNVFRIFIYSNIKTFSNQMDY

SEQ ID NO: 2355267 - protein, 26 aa, Cryptosporidium parvum
HKALSNFHFHHNFSMFGEVIQDNGQR

SEQ ID NO: 2355268 - protein, 25 aa, Cryptosporidium parvum
HKLNSTWIKLIKYLRQSELCVPSDS

SEQ ID NO: 2355269 - protein, 18 aa, Cryptosporidium parvum
HKSGILSMKIVEFGFQGT

SEQ ID NO: 2355270 - protein, 17 aa, Cryptosporidium parvum
HLISLYLVSRKYKLDIL

SEQ ID NO: 2355271 - protein, 19 aa, Cryptosporidium parvum
HLQSPLKFVSGLGPRKAKS

SEQ ID NO: 2355272 - protein, 21 aa, Cryptosporidium parvum
HLRTDILPFLHDIIGKLLDDS

SEQ ID NO: 2355273 - protein, 23 aa, Cryptosporidium parvum
HMKKIKMDLLKQEQKIKAVELKK

SEQ ID NO: 2355274 - protein, 31 aa, Cryptosporidium parvum
HMSNKILELKGLRFAFFKDDLDILDTCIIMA

SEQ ID NO: 2355275 - protein, 29 aa, Cryptosporidium parvum
HNHTKKKPLKYWRQILDGIIVRHRRITRS

SEQ ID NO: 2355276 - protein, 17 aa, Cryptosporidium parvum
HPDYWLVQSNPWEIERQ

SEQ ID NO: 2355277 - protein, 31 aa, Cryptosporidium parvum
HQDRILLHETIFWKRRHGLRISSGLLKDIFG

SEQ ID NO: 2355278 - protein, 18 aa, Cryptosporidium parvum
HQLSELRRRHSNELQRFE

SEQ ID NO: 2355279 - protein, 25 aa, Cryptosporidium parvum
HRITARLAMVYLNSSQFVKGLDYIE

SEQ ID NO: 2355280 - protein, 30 aa, Cryptosporidium parvum
HRPLPVNVCYIKLTFNWPGARLVRDLWALD

SEQ ID NO: 2355281 - protein, 18 aa, Cryptosporidium parvum
HRRSIETISFRGKKLENY

SEQ ID NO: 2355282 - protein, 17 aa, Cryptosporidium parvum
HSHPGFGCWFSGTDVST

SEQ ID NO: 2355283 - protein, 21 aa, Cryptosporidium parvum
HSLMPLRSCFSSRNGLWVASA

SEQ ID NO: 2355284 - protein, 26 aa, Cryptosporidium parvum
HSRQNKFQVLLFSATVPPWVKNILTE

SEQ ID NO: 2355285 - protein, 34 aa, Cryptosporidium parvum
HSVRFENGLVLMTKRFIQYLYEQGESRIIDLAAA

SEQ ID NO: 2355286 - protein, 29 aa, Cryptosporidium parvum
HTAILLVTGKLYMFGGGAFGKLGFGSTDD

SEQ ID NO: 2355287 - protein, 24 aa, Cryptosporidium parvum
HVKNRKVYILASLEPSKELSGGTF

SEQ ID NO: 2355288 - protein, 17 aa, Cryptosporidium parvum
HYKDWESISFLVLSKDF

SEQ ID NO: 2355289 - protein, 17 aa, Cryptosporidium parvum
HYLANNGWVMGWNAKED

SEQ ID NO: 2355290 - protein, 33 aa, Cryptosporidium parvum; identical to SEQ ID NO: 2190862

SEQ ID NO: 2355291 - protein, 20 aa, Cryptosporidium parvum
IAAFRLLRRCMSDPSNALDF

SEQ ID NO: 2355292 - protein, 23 aa, Cryptosporidium parvum
IAAKKFLQSFLKLPEEALREDFD

SEQ ID NO: 2355293 - protein, 20 aa, Cryptosporidium parvum
IAAMIGIPMFGARLNAQLFI

SEQ ID NO: 2355294 - protein, 25 aa, Cryptosporidium parvum
IADHLNLPPIKLHCSLLAEDAIKHA

SEQ ID NO: 2355295 - protein, 33 aa, Cryptosporidium parvum
IASVIVSYLRKMQITATLIFTLNQIGLDNNIIS

SEQ ID NO: 2355296 - protein, 20 aa, Cryptosporidium parvum
ICIENFQFKLVFTNSQIQKN

SEQ ID NO: 2355297 - protein, 32 aa, Cryptosporidium parvum; identical to SEQ ID NO: 2190910

SEQ ID NO: 2355298 - protein, 55 aa, Cryptosporidium parvum; identical to SEQ ID NO: 2314662

SEQ ID NO: 2355299 - protein, 25 aa, Cryptosporidium parvum
IDCTDNSWNLFHPSLLGSSTRDGDF

SEQ ID NO: 2355300 - protein, 17 aa, Cryptosporidium parvum
IDDFIILGFIVGNDFLP

SEQ ID NO: 2355301 - protein, 23 aa, Cryptosporidium parvum
IDELYSLIKHVYFLLDTVQEEAK

SEQ ID NO: 2355302 - protein, 19 aa, Cryptosporidium parvum
IDILDDALLRPGRIDRKIE

SEQ ID NO: 2355303 - protein, 25 aa, Cryptosporidium parvum
IDNIRSYFLYHIDTPRFKQIEETSI

SEQ ID NO: 2355304 - protein, 26 aa, Cryptosporidium parvum
IDNKTLFDTFSLFGNIMSCKIATDVE

SEQ ID NO: 2355305 - protein, 29 aa, Cryptosporidium parvum
IDNYAVGMNLLLFLTGRFICRQKGLDVTE

SEQ ID NO: 2355306 - protein, 17 aa, Cryptosporidium parvum
IDTFRMNNTLFGFSCSF

SEQ ID NO: 2355307 - protein, 28 aa, Cryptosporidium parvum
IDVCFYIGFVPFYSKVILRLLHQQLASL

SEQ ID NO: 2355308 - protein, 23 aa, Cryptosporidium parvum
IDVQNAMITFFHQTVYDPIEGNM

SEQ ID NO: 2355309 - protein, 18 aa, Cryptosporidium parvum
IEFYKDVLQHPDFNEIGS

SEQ ID NO: 2355310 - protein, 26 aa, Cryptosporidium parvum
IEIGNILTHHYLFYPKNIQVMDLKEN

SEQ ID NO: 2355311 - protein, 19 aa, Cryptosporidium parvum
IEKILKAAAFMQQLKGIIR

SEQ ID NO: 2355312 - protein, 25 aa, Cryptosporidium parvum
IELSDDFFIKIPRNVFIGLNSIDFA

SEQ ID NO: 2355313 - protein, 19 aa, Cryptosporidium parvum
IENLFCIGALDSTTAASCL

SEQ ID NO: 2355314 - protein, 23 aa, Cryptosporidium parvum
IEPKLEISNLPQYLGKVSNENFE

SEQ ID NO: 2355315 - protein, 26 aa, Cryptosporidium parvum
IEPKRIQDLPLMLRGLELLSRSDPCI

SEQ ID NO: 2355316 - protein, 28 aa, Cryptosporidium parvum
IESVCNVVLLPYNYLLDSITRQNLKIDL

SEQ ID NO: 2355317 - protein, 31 aa, Cryptosporidium parvum; identical to SEQ ID NO: 2191068

SEQ ID NO: 2355318 - protein, 30 aa, Cryptosporidium parvum
IFGSFIMTNFRIILAPLFQKNINNKALTIV

SEQ ID NO: 2355319 - protein, 19 aa, Cryptosporidium parvum
IFIQWLDCVYQCYNQFPTE

SEQ ID NO: 2355320 - protein, 26 aa, Cryptosporidium parvum
IFQENLELFLRNCELNREVGWREVEN

SEQ ID NO: 2355321 - protein, 18 aa, Cryptosporidium parvum
IFTPKLIESLAGLPIKEI

SEQ ID NO: 2355322 - protein, 18 aa, Cryptosporidium parvum
IGDLLKTTFGPKGMDKIL

SEQ ID NO: 2355323 - protein, 29 aa, Cryptosporidium parvum
IGHTHFKNLFLIVWFEYNASIGKVHIKFN

SEQ ID NO: 2355324 - protein, 24 aa, Cryptosporidium parvum
IGNLQLVRQLIASPKFNANATNEK

SEQ ID NO: 2355325 - protein, 25 aa, Cryptosporidium parvum
IGSMLPWFVNLSLKLNAHVLAYDYR

SEQ ID NO: 2355326 - protein, 20 aa, Cryptosporidium parvum
IGVFIDFVPAHFCKDAWGLV

SEQ ID NO: 2355327 - protein, 21 aa, Cryptosporidium parvum
IHEDKIHGIYVKDLSEYFVTS

SEQ ID NO: 2355328 - protein, 31 aa, Cryptosporidium parvum; identical to SEQ ID NO: 2191151

SEQ ID NO: 2355329 - protein, 19 aa, Cryptosporidium parvum
IHFRRKYAPQFISPRNISS

SEQ ID NO: 2355330 - protein, 17 aa, Cryptosporidium parvum
IHSPTSLIGNSSLPLST

SEQ ID NO: 2355331 - protein, 17 aa, Cryptosporidium parvum
IIALTTMTKAFRFIEIS

SEQ ID NO: 2355332 - protein, 18 aa, Cryptosporidium parvum
IIGYANKRYKILGETLDI

SEQ ID NO: 2355333 - protein, 17 aa, Cryptosporidium parvum
IIMVPIATSLNGLSSIS

SEQ ID NO: 2355334 - protein, 18 aa, Cryptosporidium parvum
IIPICNPNKSSNSDKICF

SEQ ID NO: 2355335 - protein, 17 aa, Cryptosporidium parvum
IITGFSAVFLLSTSIDP

SEQ ID NO: 2355336 - protein, 18 aa, Cryptosporidium parvum
IKECCEILNLKISNLNND

SEQ ID NO: 2355337 - protein, 25 aa, Cryptosporidium parvum
IKKAYHKLAIKWHPDKNMGNDRQMC

SEQ ID NO: 2355338 - protein, 21 aa, Cryptosporidium parvum
IKKEYRLRALALHPDKNQNDE

SEQ ID NO: 2355339 - protein, 23 aa, Cryptosporidium parvum
IKKKGLLSLINNKLSKSAPELGS

SEQ ID NO: 2355340 - protein, 20 aa, Cryptosporidium parvum
IKKSYRKLALKWHPDKNPDN

SEQ ID NO: 2355341 - protein, 20 aa, Cryptosporidium parvum
IKNELILFRLRFNSGNNQGS

SEQ ID NO: 2355342 - protein, 21 aa, Cryptosporidium parvum
IKQPIRKYKIGSPGAIHVYDE

SEQ ID NO: 2355343 - protein, 23 aa, Cryptosporidium parvum
IKSHLDPYDWYYSSSNNENGDNE

SEQ ID NO: 2355344 - protein, 19 aa, Cryptosporidium parvum
IKTIRPIIGGLPKARVAKI

SEQ ID NO: 2355345 - protein, 22 aa, Cryptosporidium parvum
IKVCLAFLQRTKVLLECQIAGF

SEQ ID NO: 2355346 - protein, 24 aa, Cryptosporidium parvum
IKVQKLYSSLVRLGLLLTDQTSIS

SEQ ID NO: 2355347 - protein, 32 aa, Cryptosporidium parvum; identical to SEQ ID NO: 2315144

SEQ ID NO: 2355348 - protein, 19 aa, Cryptosporidium parvum
ILEELIIGEPYSPTDSRWY

SEQ ID NO: 2355349 - protein, 17 aa, Cryptosporidium parvum
ILEYLIMRKLNHSSIPR

SEQ ID NO: 2355350 - protein, 18 aa, Cryptosporidium parvum
ILLMSQYSRIKGIQFHEF

SEQ ID NO: 2355351 - protein, 21 aa, Cryptosporidium parvum
ILNGVLYKYILNPYKLNIEEI

SEQ ID NO: 2355352 - protein, 23 aa, Cryptosporidium parvum
ILNIELEHFFGYSKNLKVLVLSN

SEQ ID NO: 2355353 - protein, 20 aa, Cryptosporidium parvum
ILNKSIHLISLYLVSRKYKL

SEQ ID NO: 2355354 - protein, 18 aa, Cryptosporidium parvum
ILNQMKWIYKLFHNKEED

SEQ ID NO: 2355355 - protein, 19 aa, Cryptosporidium parvum
ILQNKIMNLFRAATKHVYE

SEQ ID NO: 2355356 - protein, 17 aa, Cryptosporidium parvum
ILRLLHQQLASLKVTPE

SEQ ID NO: 2355357 - protein, 20 aa, Cryptosporidium parvum
ILTTIIYSIPLLIDILVNLK

SEQ ID NO: 2355358 - protein, 25 aa, Cryptosporidium parvum
IMDINSLLDLQLSVAYKLHGIYIAF

SEQ ID NO: 2355359 - protein, 17 aa, Cryptosporidium parvum
IMNLFRAATKHVYEELI

SEQ ID NO: 2355360 - protein, 19 aa, Cryptosporidium parvum
INCLPDQYKDLFSRFIRVM

SEQ ID NO: 2355361 - protein, 24 aa, Cryptosporidium parvum
INDSVVIGIFFSTLGRQGSFAIVE

SEQ ID NO: 2355362 - protein, 18 aa, Cryptosporidium parvum
INELKYIESILDKEIEEL

SEQ ID NO: 2355363 - protein, 26 aa, Cryptosporidium parvum
INEQIEQVWKLLWSLTTFGSQNKASE

SEQ ID NO: 2355364 - protein, 22 aa, Cryptosporidium parvum
INESIGWWIISVNEYGYLRETT

SEQ ID NO: 2355365 - protein, 24 aa, Cryptosporidium parvum
INYMQIVYEILESLLKPCIEHHNM

SEQ ID NO: 2355366 - protein, 26 aa, Cryptosporidium parvum
IPAQPQNMPPIVPPTPQGVAQQLSQM

SEQ ID NO: 2355367 - protein, 17 aa, Cryptosporidium parvum
IPDKFLIPTIPSRANYV

SEQ ID NO: 2355368 - protein, 17 aa, Cryptosporidium parvum
IPKKPTFNPYLNKYGLV

SEQ ID NO: 2355369 - protein, 17 aa, Cryptosporidium parvum
IPMLFHFINLSDKEIMV

SEQ ID NO: 2355370 - protein, 29 aa, Cryptosporidium parvum
IPQEYFDGVYKSIFIRIAEYKVKQRSALF

SEQ ID NO: 2355371 - protein, 18 aa, Cryptosporidium parvum
IPQLIRHLGWDESIPLRN

SEQ ID NO: 2355372 - protein, 25 aa, Cryptosporidium parvum
IQAQTKFFETILLTIDNLMELENWR

SEQ ID NO: 2355373 - protein, 26 aa, Cryptosporidium parvum
IQGDIPYCDTILYLDNPKPKKYDTTF

SEQ ID NO: 2355374 - protein, 28 aa, Cryptosporidium parvum
IQKLIQQFINLFSFFIGERLECKQTGSV

SEQ ID NO: 2355375 - protein, 20 aa, Cryptosporidium parvum
IQLTALTNLVNKFEKNKMIK

SEQ ID NO: 2355376 - protein, 18 aa, Cryptosporidium parvum
IQPFLVLKVHRDSIVNDS

SEQ ID NO: 2355377 - protein, 25 aa, Cryptosporidium parvum
IQQHIHKWRILQQRSYIAIGKFKQT

SEQ ID NO: 2355378 - protein, 22 aa, Cryptosporidium parvum
IQQRLEDVFSGKLDQLSIACKS

SEQ ID NO: 2355379 - protein, 32 aa, Cryptosporidium parvum; identical to SEQ ID NO: 2191558

SEQ ID NO: 2355380 - protein, 27 aa, Cryptosporidium parvum
IRITNEYLMLYSFPFGGFSSCFQFNFD

SEQ ID NO: 2355381 - protein, 27 aa, Cryptosporidium parvum
IRVMNTLQFIGLLYLPQKNTKFEQDVF

SEQ ID NO: 2355382 - protein, 19 aa, Cryptosporidium parvum
IRYDLLDIGLAICSPQLLK

SEQ ID NO: 2355383 - protein, 26 aa, Cryptosporidium parvum
ISAPTPIKIVPKIIPKPAITKEQPTN

SEQ ID NO: 2355384 - protein, 17 aa, Cryptosporidium parvum
ISAYPMINIGDPPRKRK

SEQ ID NO: 2355385 - protein, 18 aa, Cryptosporidium parvum
ISCEFPESLLPINGVPII

SEQ ID NO: 2355386 - protein, 25 aa, Cryptosporidium parvum
ISDESYSFQLTFKSSAFKFTGAVVS

SEQ ID NO: 2355387 - protein, 18 aa, Cryptosporidium parvum
ISDFLLKQDPLYIHLQLA

SEQ ID NO: 2355388 - protein, 31 aa, Cryptosporidium parvum; identical to SEQ ID NO: 2191609

SEQ ID NO: 2355389 - protein, 21 aa, Cryptosporidium parvum
ISKCYFYFLFENKSSDSGGRS

SEQ ID NO: 2355390 - protein, 29 aa, Cryptosporidium parvum
ISKSRILFRNLFVLLTWASDYIGKSEFSK

SEQ ID NO: 2355391 - protein, 31 aa, Cryptosporidium parvum; identical to SEQ ID NO: 2315532

SEQ ID NO: 2355392 - protein, 18 aa, Cryptosporidium parvum
ISNKIFETLKLPTSARLN

SEQ ID NO: 2355393 - protein, 31 aa, Cryptosporidium parvum; identical to SEQ ID NO: 2315540

SEQ ID NO: 2355394 - protein, 32 aa, Cryptosporidium parvum
ISPRESNMYWCDIMQFYLFFCPKCIYLKQSNV

SEQ ID NO: 2355395 - protein, 21 aa, Cryptosporidium parvum
ISRYMDNELLKVWCMEMCPEE

SEQ ID NO: 2355396 - protein, 20 aa, Cryptosporidium parvum
ISSLALLKMLKHGRAGVPME

SEQ ID NO: 2355397 - protein, 25 aa, Cryptosporidium parvum
ISSLEIPIFLQLLNFCVYSVMDSID

SEQ ID NO: 2355398 - protein, 27 aa, Cryptosporidium parvum
ISSYRKYLAHFFLMKLSSSPWILEDCG

SEQ ID NO: 2355399 - protein, 24 aa, Cryptosporidium parvum
ISTAVCQSLYPLFVRETTAVAAAS

SEQ ID NO: 2355400 - protein, 32 aa, Cryptosporidium parvum
ISTSYFLSCRILPYLWSFYESYPTYKDIYTRL

SEQ ID NO: 2355401 - protein, 21 aa, Cryptosporidium parvum
ITIDIALWQFETPKYHYTVID

SEQ ID NO: 2355402 - protein, 40 aa, Cryptosporidium parvum; identical to SEQ ID NO: 2315609

SEQ ID NO: 2355403 - protein, 27 aa, Cryptosporidium parvum
ITQNKFLSMLIFFPNIESQISIFLASV

SEQ ID NO: 2355404 - protein, 25 aa, Cryptosporidium parvum
ITTEIQSFVPVILGENQKLDTSEME

SEQ ID NO: 2355405 - protein, 31 aa, Cryptosporidium parvum; identical to SEQ ID NO: 2315623

SEQ ID NO: 2355406 - protein, 24 aa, Cryptosporidium parvum
IVCDNRINNKRFSEGSLQSIPTPI

SEQ ID NO: 2355407 - protein, 19 aa, Cryptosporidium parvum
IVDQLFKGINGTVLAYGQT

SEQ ID NO: 2355408 - protein, 24 aa, Cryptosporidium parvum
IVEISLYHALSFYNAIYSEDFGYI

SEQ ID NO: 2355409 - protein, 17 aa, Cryptosporidium parvum
IVGEYFVHIWKAAGMDM

SEQ ID NO: 2355410 - protein, 18 aa, Cryptosporidium parvum
IVKQPYSIGSTKIKCIEA

SEQ ID NO: 2355411 - protein, 22 aa, Cryptosporidium parvum
IVSICCLILRIISCTWSNNFSS

SEQ ID NO: 2355412 - protein, 20 aa, Cryptosporidium parvum
IWAAIFRYINKLVYIAKPRK

SEQ ID NO: 2355413 - protein, 19 aa, Cryptosporidium parvum
IWRLAYISVMGYEIDFGWL

SEQ ID NO: 2355414 - protein, 19 aa, Cryptosporidium parvum
IYDKVKLIHKFIIQECKMN

SEQ ID NO: 2355415 - protein, 27 aa, Cryptosporidium parvum
IYDSGFKQKLLDILSIRPNQYGERITS

SEQ ID NO: 2355416 - protein, 19 aa, Cryptosporidium parvum
IYKLHVWASNYYFVHQNFS

SEQ ID NO: 2355417 - protein, 25 aa, Cryptosporidium parvum
KAFERNLLFSGFIKVKKLKGDGLNS

SEQ ID NO: 2355418 - protein, 25 aa, Cryptosporidium parvum
KAKAPLGVINFKIAEWSLQISDSDE

SEQ ID NO: 2355419 - protein, 17 aa, Cryptosporidium parvum
KAKLDLFKMRFLGRNMK

SEQ ID NO: 2355420 - protein, 30 aa, Cryptosporidium parvum; identical to SEQ ID NO: 2209764

SEQ ID NO: 2355421 - protein, 27 aa, Cryptosporidium parvum
KALRKLWSNILNIYPLIPSITKNLALI

SEQ ID NO: 2355422 - protein, 17 aa, Cryptosporidium parvum
KAMWSAFVSVRHTLAKY

SEQ ID NO: 2355423 - protein, 17 aa, Cryptosporidium parvum
KANLIAQALQPYPTGIK

SEQ ID NO: 2355424 - protein, 21 aa, Cryptosporidium parvum
KANNLFGMNKPMKVSPKNQNG

SEQ ID NO: 2355425 - protein, 29 aa, Cryptosporidium parvum
KAPDVCYSWWIFSLLYFLGRANYIDKNLL

SEQ ID NO: 2355426 - protein, 27 aa, Cryptosporidium parvum
KAPPVYKIDIFPLSPKAFDICLNPIAN

SEQ ID NO: 2355427 - protein, 25 aa, Cryptosporidium parvum
KARIRNQYTISWLKMGIFALNDIKK

SEQ ID NO: 2355428 - protein, 25 aa, Cryptosporidium parvum
KCFNNTQWFKATRFIFEISGNDDDT

SEQ ID NO: 2355429 - protein, 17 aa, Cryptosporidium parvum
KCTLWRSSQPKSAFKRC

SEQ ID NO: 2355430 - protein, 17 aa, Cryptosporidium parvum
KCVPICQRLFYSDTVHD

SEQ ID NO: 2355431 - protein, 24 aa, Cryptosporidium parvum
KDGKGILRFAMGHSIQGVWKDGVL

SEQ ID NO: 2355432 - protein, 22 aa, Cryptosporidium parvum
KDHKFTPGFLFVSMDVSRALVR

SEQ ID NO: 2355433 - protein, 27 aa, Cryptosporidium parvum
KDKKSPLDFALWKKAKPEEPCWDSPWG

SEQ ID NO: 2355434 - protein, 29 aa, Cryptosporidium parvum
KDNFHLRIRVHPFHVLRINKMLSCAGADR

SEQ ID NO: 2355435 - protein, 25 aa, Cryptosporidium parvum
KDRRNVIVVLFLIREYPLAFKTSNM

SEQ ID NO: 2355436 - protein, 26 aa, Cryptosporidium parvum
KDSEIVVCFIMQLPYYIKVQAGETVD

SEQ ID NO: 2355437 - protein, 18 aa, Cryptosporidium parvum
KDVLQHPDFNEIGSIKSM

SEQ ID NO: 2355438 - protein, 20 aa, Cryptosporidium parvum
KDWFNPITCLKLHRLQDSVD

SEQ ID NO: 2355439 - protein, 32 aa, Cryptosporidium parvum; identical to SEQ ID NO: 2315867

SEQ ID NO: 2355440 - protein, 30 aa, Cryptosporidium parvum; identical to SEQ ID NO: 2315881

SEQ ID NO: 2355441 - protein, 24 aa, Cryptosporidium parvum
KEGNIFLYNRIALDSPRVLFSSLL

SEQ ID NO: 2355442 - protein, 17 aa, Cryptosporidium parvum
KEKMIILQCVELLVRET

SEQ ID NO: 2355443 - protein, 35 aa, Cryptosporidium parvum; identical to SEQ ID NO: 2191931

SEQ ID NO: 2355444 - protein, 26 aa, Cryptosporidium parvum
KEKSTWSRIFSPLSFGFDKRELSYSG

SEQ ID NO: 2355445 - protein, 26 aa, Cryptosporidium parvum
KEKVSLLHYNLACILTLPCYQRKGYG

SEQ ID NO: 2355446 - protein, 20 aa, Cryptosporidium parvum
KELDYYRHTVKPEFKEIDSN

SEQ ID NO: 2355447 - protein, 17 aa, Cryptosporidium parvum
KELIKTIRPIIGGLPKA

SEQ ID NO: 2355448 - protein, 21 aa, Cryptosporidium parvum
KEMEQLLALDDFKKVIGLLER

SEQ ID NO: 2355449 - protein, 30 aa, Cryptosporidium parvum; identical to SEQ ID NO: 2315919

SEQ ID NO: 2355450 - protein, 24 aa, Cryptosporidium parvum
KENKMKFRRLVKSNLNGFEHPNTS

SEQ ID NO: 2355451 - protein, 20 aa, Cryptosporidium parvum
KETILITGINKKFVLEDIKE

SEQ ID NO: 2355452 - protein, 29 aa, Cryptosporidium parvum
KETIRIYQVILPPKLLFKLPKHHVLKSLP

SEQ ID NO: 2355453 - protein, 24 aa, Cryptosporidium parvum
KEVPIRIRFLINDVIDSRKNNWKS

SEQ ID NO: 2355454 - protein, 20 aa, Cryptosporidium parvum
KEWNHIYALQNYIIERKGEM

SEQ ID NO: 2355455 - protein, 19 aa, Cryptosporidium parvum
KFEIMTDSLLLLQRLEESR

SEQ ID NO: 2355456 - protein, 23 aa, Cryptosporidium parvum
KFEIPLFTHNPLSLAISNLLKSD

SEQ ID NO: 2355457 - protein, 20 aa, Cryptosporidium parvum
KFENKLKNKLYLPLYSKFVD

SEQ ID NO: 2355458 - protein, 17 aa, Cryptosporidium parvum
KFGKSTGRCNCGYPIFI

SEQ ID NO: 2355459 - protein, 23 aa, Cryptosporidium parvum
KFGLGKWRIILATSKLTNRDEVG

SEQ ID NO: 2355460 - protein, 19 aa, Cryptosporidium parvum
KFHFNIPTLLVSTPGRFIQ

SEQ ID NO: 2355461 - protein, 20 aa, Cryptosporidium parvum
KFLFKPDHYALFSKLKSLLD

SEQ ID NO: 2355462 - protein, 20 aa, Cryptosporidium parvum
KFLHDRSDFKSGWKLDKEWE

SEQ ID NO: 2355463 - protein, 23 aa, Cryptosporidium parvum
KFYLCGLCPHELFENTKLYMGPC

SEQ ID NO: 2355464 - protein, 27 aa, Cryptosporidium parvum
KGDSQVEVFFWTKIKDPRLQAPEGSFM

SEQ ID NO: 2355465 - protein, 22 aa, Cryptosporidium parvum
KGEFRIVSIYLSSGSILGEIFT

SEQ ID NO: 2355466 - protein, 25 aa, Cryptosporidium parvum
KGERNFHIFYQLCSAAKHIISQGSS

SEQ ID NO: 2355467 - protein, 23 aa, Cryptosporidium parvum
KGGACLELLMNPQKLMECLVVIK

SEQ ID NO: 2355468 - protein, 21 aa, Cryptosporidium parvum
KGILQFDMWGVTPDSGLCDWD

SEQ ID NO: 2355469 - protein, 23 aa, Cryptosporidium parvum
KGKNLISLPYVVKGMDLSFSGIL

SEQ ID NO: 2355470 - protein, 25 aa, Cryptosporidium parvum
KGLQNWIYRLFSTYRSNGTSKEDIE

SEQ ID NO: 2355471 - protein, 20 aa, Cryptosporidium parvum
KGLQSEYPMYVSLAVSVGRL

SEQ ID NO: 2355472 - protein, 24 aa, Cryptosporidium parvum
KGNLYKYPAIIKTIPDFLESSIQT

SEQ ID NO: 2355473 - protein, 22 aa, Cryptosporidium parvum
KGRIPILSWTNPDLKCTLWRSS

SEQ ID NO: 2355474 - protein, 17 aa, Cryptosporidium parvum
KGTYIFPCGNVYEGEWV

SEQ ID NO: 2355475 - protein, 25 aa, Cryptosporidium parvum
KGYGKLLVDLSYKLSLKEGKWGHPE

SEQ ID NO: 2355476 - protein, 24 aa, Cryptosporidium parvum
KHDEKPIWSFFIGSQDISIELNEK

SEQ ID NO: 2355477 - protein, 17 aa, Cryptosporidium parvum
KHNMSVIDILFLIEEGD

SEQ ID NO: 2355478 - protein, 22 aa, Cryptosporidium parvum
KHPNCEFIQPQWVFDSMNESIR

SEQ ID NO: 2355479 - protein, 23 aa, Cryptosporidium parvum
KHSDYIIESLQPVYPYFARETKQ

SEQ ID NO: 2355480 - protein, 22 aa, Cryptosporidium parvum
KHYEDFNTLFLQFEEFSTNKEV

SEQ ID NO: 2355481 - protein, 22 aa, Cryptosporidium parvum
KIEFVLWPRHYKDWESISFLVL

SEQ ID NO: 2355482 - protein, 19 aa, Cryptosporidium parvum
KIFETLKLPTSARLNPTVG

SEQ ID NO: 2355483 - protein, 22 aa, Cryptosporidium parvum
KIGARLLLPNENEYILSADKTC

SEQ ID NO: 2355484 - protein, 18 aa, Cryptosporidium parvum
KIIEFKGIKIQRAINSAN

SEQ ID NO: 2355485 - protein, 24 aa, Cryptosporidium parvum
KIIGSGMKRVIKKEIIKNINSEKP

SEQ ID NO: 2355486 - protein, 25 aa, Cryptosporidium parvum
KIILSVYERVILEYLIMRKLNHSSI

SEQ ID NO: 2355487 - protein, 24 aa, Cryptosporidium parvum
KIIRDYFICFNGDFSDLLIKNMEN

SEQ ID NO: 2355488 - protein, 30 aa, Cryptosporidium parvum
KIKLKLEDIQVLDLWKLSILIGGGISQIGS

SEQ ID NO: 2355489 - protein, 19 aa, Cryptosporidium parvum
KILNLRIVKDFQGESRGYA

SEQ ID NO: 2355490 - protein, 25 aa, Cryptosporidium parvum
KISKHYLLPLILLYSDLKESEAERF

SEQ ID NO: 2355491 - protein, 35 aa, Cryptosporidium parvum; identical to SEQ ID NO: 2244568

SEQ ID NO: 2355492 - protein, 25 aa, Cryptosporidium parvum
KKEELLIVRIQLVEKIAVSRQLFVG

SEQ ID NO: 2355493 - protein, 22 aa, Cryptosporidium parvum
KKFDDIINYFKQFTKKISEKDI

SEQ ID NO: 2355494 - protein, 24 aa, Cryptosporidium parvum
KKFDEALGFYLKALGILELEQSLK

SEQ ID NO: 2355495 - protein, 24 aa, Cryptosporidium parvum
KKGDPETCPAFLFVTPEKLKHSKT

SEQ ID NO: 2355496 - protein, 21 aa, Cryptosporidium parvum
KKILLNQIGIMIPKLKNRQNT

SEQ ID NO: 2355497 - protein, 17 aa, Cryptosporidium parvum
KKIWSKFTIIQDEYQKE

SEQ ID NO: 2355498 - protein, 19 aa, Cryptosporidium parvum
KKKAPILRRIFGKKGSSNT

SEQ ID NO: 2355499 - protein, 32 aa, Cryptosporidium parvum; identical to SEQ ID NO: 2316243

SEQ ID NO: 2355500 - protein, 17 aa, Cryptosporidium parvum
KKKYEVNFFDLPENMPT

SEQ ID NO: 2355501 - protein, 30 aa, Cryptosporidium parvum; identical to SEQ ID NO: 2316245

SEQ ID NO: 2355502 - protein, 25 aa, Cryptosporidium parvum
KKMLNEICELLRSPRFCRSTSIIYC

SEQ ID NO: 2355503 - protein, 20 aa, Cryptosporidium parvum
KLCNRMYKNELDSFSGIGIV

SEQ ID NO: 2355504 - protein, 26 aa, Cryptosporidium parvum
KLDPNELLNVFQWKKLKDPETGRIIR

SEQ ID NO: 2355505 - protein, 27 aa, Cryptosporidium parvum
KLEFEKVYCPFLLMNKKRYAGVLFKNP

SEQ ID NO: 2355506 - protein, 25 aa, Cryptosporidium parvum
KLFQLNDFFFFTRLAKTKITSKDTR

SEQ ID NO: 2355507 - protein, 25 aa, Cryptosporidium parvum
KLHGIYIAFRHNSAICRVIQQHIHK

SEQ ID NO: 2355508 - protein, 20 aa, Cryptosporidium parvum
KLKIDELEHLNLNLKLNEDV

SEQ ID NO: 2355509 - protein, 17 aa, Cryptosporidium parvum
KLKIEYLKTLGKPSIKI

SEQ ID NO: 2355510 - protein, 17 aa, Cryptosporidium parvum
KLKPCYLCYSSSTISNQ

SEQ ID NO: 2355511 - protein, 19 aa, Cryptosporidium parvum
KLKQFWSEYPEKLNKKIEF

SEQ ID NO: 2355512 - protein, 27 aa, Cryptosporidium parvum
KLKQQLQLHTLLISELRKYHTEIEDLK

SEQ ID NO: 2355513 - protein, 23 aa, Cryptosporidium parvum
KLNKQIFEVIYYAALDASCELAE

SEQ ID NO: 2355514 - protein, 21 aa, Cryptosporidium parvum
KLPIIYQCYGDFYYYHYNHDN

SEQ ID NO: 2355515 - protein, 33 aa, Cryptosporidium parvum
KLPVALNPNLPYLQHSMIAFANRIPYQTTPEVQ

SEQ ID NO: 2355516 - protein, 35 aa, Cryptosporidium parvum; identical to SEQ ID NO: 2316406

SEQ ID NO: 2355517 - protein, 27 aa, Cryptosporidium parvum
KMSQYSALETMRKLYYATQEYMEKWPS

SEQ ID NO: 2355518 - protein, 17 aa, Cryptosporidium parvum
KNDHIFSFDWFIKTRSS

SEQ ID NO: 2355519 - protein, 24 aa, Cryptosporidium parvum
KNEENLTLDLLLFEETQSYEERYL

SEQ ID NO: 2355520 - protein, 51 aa, Cryptosporidium parvum
KNEMGFFSSLFFESDLLQYLFELSIICLQNCKFYKLLKSHQKYFHYHKFGQ

SEQ ID NO: 2355521 - protein, 20 aa, Cryptosporidium parvum
KNILLNDEIWELNRIIKSNN

SEQ ID NO: 2355522 - protein, 19 aa, Cryptosporidium parvum
KNIQNPLIAPKSSLKLDPT

SEQ ID NO: 2355523 - protein, 28 aa, Cryptosporidium parvum
KNKLESVSFLKYCWNLTDINLSNNNLTS

SEQ ID NO: 2355524 - protein, 19 aa, Cryptosporidium parvum
KNKLYLPLYSKFVDENSFI

SEQ ID NO: 2355525 - protein, 23 aa, Cryptosporidium parvum
KNLDLYSLPPDMLKTERFSNISN

SEQ ID NO: 2355526 - protein, 27 aa, Cryptosporidium parvum
KNLFSYTFRENFESLPLFSSINGIFEF

SEQ ID NO: 2355527 - protein, 28 aa, Cryptosporidium parvum
KNLLEQKMLLNLHKPTWSEPLRCDKEEN

SEQ ID NO: 2355528 - protein, 19 aa, Cryptosporidium parvum
KNLPIYPMRDSLVDAIRNN

SEQ ID NO: 2355529 - protein, 24 aa, Cryptosporidium parvum
KNNTRLTFFRYIQILDKGEWIYHP

SEQ ID NO: 2355530 - protein, 18 aa, Cryptosporidium parvum
KNSSYIYISGLDLRLTEG

SEQ ID NO: 2355531 - protein, 27 aa, Cryptosporidium parvum
KNVSNKLLIKNLPFQATKSDIMSLFNS

SEQ ID NO: 2355532 - protein, 17 aa, Cryptosporidium parvum
KPCYLCYSSSTISNQMI

SEQ ID NO: 2355533 - protein, 25 aa, Cryptosporidium parvum
KPLKRLSCPAIFFDCTHDNETPCEI

SEQ ID NO: 2355534 - protein, 27 aa, Cryptosporidium parvum
KPYQLEGLNWLINLYEGGLNGILADEM

SEQ ID NO: 2355535 - protein, 17 aa, Cryptosporidium parvum
KQFYSARMRTNAFNSRH

SEQ ID NO: 2355536 - protein, 21 aa, Cryptosporidium parvum
KQRLLKIKNILKNISKKRYEE

SEQ ID NO: 2355537 - protein, 22 aa, Cryptosporidium parvum
KQRYSVPWCYENFLQSRALKGA

SEQ ID NO: 2355538 - protein, 18 aa, Cryptosporidium parvum
KQTKCQETMRGAGYETSI

SEQ ID NO: 2355539 - protein, 19 aa, Cryptosporidium parvum
KQWKVRRLIATLEAARGNG

SEQ ID NO: 2355540 - protein, 24 aa, Cryptosporidium parvum
KRDNIIQRFRTGKIWILICTDLMA

SEQ ID NO: 2355541 - protein, 30 aa, Cryptosporidium parvum; identical to SEQ ID NO: 2316643

SEQ ID NO: 2355542 - protein, 28 aa, Cryptosporidium parvum
KRIFEGLTFFISREVPLLPLAFVIKSFG

SEQ ID NO: 2355543 - protein, 17 aa, Cryptosporidium parvum
KRMEHILNMRILEEEKN

SEQ ID NO: 2355544 - protein, 29 aa, Cryptosporidium parvum
KRNLLQKGFKLWTRREFNLLLRCLETNGV

SEQ ID NO: 2355545 - protein, 25 aa, Cryptosporidium parvum
KRPTDKPLRLPLQDVYKIGGVGTVP

SEQ ID NO: 2355546 - protein, 23 aa, Cryptosporidium parvum
KRREKLWYLMESYLPTDIESIQR

SEQ ID NO: 2355547 - protein, 20 aa, Cryptosporidium parvum
KRTFLRHRITARLAMVYLNS

SEQ ID NO: 2355548 - protein, 27 aa, Cryptosporidium parvum
KRTKTKFYTFPFKVLQKIPVCISFDVH

SEQ ID NO: 2355549 - protein, 20 aa, Cryptosporidium parvum
KSALSELGDFNKKLLEENTR

SEQ ID NO: 2355550 - protein, 27 aa, Cryptosporidium parvum
KSENTLRKLLNWWKTEGFFKRSKHLED

SEQ ID NO: 2355551 - protein, 23 aa, Cryptosporidium parvum
KSHCYLYIENKKDFFLKLQTKYD

SEQ ID NO: 2355552 - protein, 27 aa, Cryptosporidium parvum
KSHQTIYSSYFFPTIYISRFKFEYDAS

SEQ ID NO: 2355553 - protein, 30 aa, Cryptosporidium parvum; identical to SEQ ID NO: 2316722

SEQ ID NO: 2355554 - protein, 25 aa, Cryptosporidium parvum
KSINARIELYKQYLAQWLKNAENNG

SEQ ID NO: 2355555 - protein, 29 aa, Cryptosporidium parvum
KSINFRDFHVRLIAILRSSQLVEILENML

SEQ ID NO: 2355556 - protein, 24 aa, Cryptosporidium parvum
KSKDFFLNLLQDKNLIYFKTELTK

SEQ ID NO: 2355557 - protein, 21 aa, Cryptosporidium parvum
KSLEKLMIPSILKVGKEPVIQ

SEQ ID NO: 2355558 - protein, 18 aa, Cryptosporidium parvum
KSLGITEPILTQVDLVCK

SEQ ID NO: 2355559 - protein, 21 aa, Cryptosporidium parvum
KSNFEIIKLSQKVDLLQKDLI

SEQ ID NO: 2355560 - protein, 21 aa, Cryptosporidium parvum
KSNFIKSMPKYLIIHMQRFYL

SEQ ID NO: 2355561 - protein, 20 aa, Cryptosporidium parvum
KSNKLRFPSIYTELISSKVE

SEQ ID NO: 2355562 - protein, 19 aa, Cryptosporidium parvum
KSNKPMLTLRKLLHRMNDQ

SEQ ID NO: 2355563 - protein, 39 aa, Cryptosporidium parvum; identical to SEQ ID NO: 2316756

SEQ ID NO: 2355564 - protein, 21 aa, Cryptosporidium parvum
KSRDEFTWRASQDLYKLEWKV

SEQ ID NO: 2355565 - protein, 28 aa, Cryptosporidium parvum
KSRVAIAIMAYLNPHLLILDEPTNHLDL

SEQ ID NO: 2355566 - protein, 24 aa, Cryptosporidium parvum
KSTYLIDEFMYLVSELGFLTKSFI

SEQ ID NO: 2355567 - protein, 28 aa, Cryptosporidium parvum
KSVMDKLTTLKIWYTKNGLKWCRNNETC

SEQ ID NO: 2355568 - protein, 22 aa, Cryptosporidium parvum
KSYTFTHETLFTMTSKHVWGPI

SEQ ID NO: 2355569 - protein, 24 aa, Cryptosporidium parvum
KTCDPWIDKFLILNGPKKIEKEPN

SEQ ID NO: 2355570 - protein, 17 aa, Cryptosporidium parvum
KTCKEWYRRIQSHFLNG

SEQ ID NO: 2355571 - protein, 22 aa, Cryptosporidium parvum
KTDGIRLLLYAASRRVFLIDRN

SEQ ID NO: 2355572 - protein, 25 aa, Cryptosporidium parvum
KTEATKIILCYLANIQKSTSSFDFT

SEQ ID NO: 2355573 - protein, 17 aa, Cryptosporidium parvum
KTGIYYLRTQSATRPIQ

SEQ ID NO: 2355574 - protein, 25 aa, Cryptosporidium parvum
KTIGGVFCYLLKQLVAEDQITIQEW

SEQ ID NO: 2355575 - protein, 20 aa, Cryptosporidium parvum
KTIPQLLLDNLRKKGLKSFQ

SEQ ID NO: 2355576 - protein, 23 aa, Cryptosporidium parvum
KTLHVACFVLFHTGEPSPGCVRS

SEQ ID NO: 2355577 - protein, 17 aa, Cryptosporidium parvum
KTLLKNGADPRYKNKQG

SEQ ID NO: 2355578 - protein, 25 aa, Cryptosporidium parvum
KTLLQYITEIIWRDKPELLSLAEPL

SEQ ID NO: 2355579 - protein, 28 aa, Cryptosporidium parvum
KTMKAQKLWFLILQAQIETGTPFICYKD

SEQ ID NO: 2355580 - protein, 23 aa, Cryptosporidium parvum
KTNYYFDHVFDDKSTNYLIYDKL

SEQ ID NO: 2355581 - protein, 24 aa, Cryptosporidium parvum
KTPDYRMNMLNAPDYRTPNYIQQQ

SEQ ID NO: 2355582 - protein, 17 aa, Cryptosporidium parvum
KTPYPHVYKPDSYLKNE

SEQ ID NO: 2355583 - protein, 32 aa, Cryptosporidium parvum
KTQECAFPHYWRYLAIWKLFTNQELVTYNKKI

SEQ ID NO: 2355584 - protein, 19 aa, Cryptosporidium parvum
KTQIKITETYQTDGTYTSK

SEQ ID NO: 2355585 - protein, 42 aa, Cryptosporidium parvum; identical to SEQ ID NO: 2316851

SEQ ID NO: 2355586 - protein, 26 aa, Cryptosporidium parvum
KVFSSKLIFHWLTHHILTNFLYNPNG

SEQ ID NO: 2355587 - protein, 45 aa, Cryptosporidium parvum; identical to SEQ ID NO: 2192747

SEQ ID NO: 2355588 - protein, 17 aa, Cryptosporidium parvum
KVMQILPDSKRAYNISI

SEQ ID NO: 2355589 - protein, 20 aa, Cryptosporidium parvum
KVPIISYLGFSQILKFILNY

SEQ ID NO: 2355590 - protein, 31 aa, Cryptosporidium parvum; identical to SEQ ID NO: 2316897

SEQ ID NO: 2355591 - protein, 17 aa, Cryptosporidium parvum
KVRILRGKHKALLGSIR

SEQ ID NO: 2355592 - protein, 17 aa, Cryptosporidium parvum
KVVLQRLVLIREFIDIC

SEQ ID NO: 2355593 - protein, 23 aa, Cryptosporidium parvum
KVVSSFSFFPPKLSGLVLRDRDG

SEQ ID NO: 2355594 - protein, 18 aa, Cryptosporidium parvum
KVWLLKDKITGKKYAGKL

SEQ ID NO: 2355595 - protein, 30 aa, Cryptosporidium parvum; identical to SEQ ID NO: 2192783

SEQ ID NO: 2355596 - protein, 19 aa, Cryptosporidium parvum
KYEVNFFDLPENMPTTLEQ

SEQ ID NO: 2355597 - protein, 29 aa, Cryptosporidium parvum
KYFRFTLGNLYAHKLFWGNNIPISCMITN

SEQ ID NO: 2355598 - protein, 47 aa, Cryptosporidium parvum
KYVFEQYFAKFDYIQERRLYYKSDFTRFMLNLIINKSDPKLTSPIFN

SEQ ID NO: 2355599 - protein, 25 aa, Cryptosporidium parvum
LAELFVIGLPRCSFYMQKQGLIGDP

SEQ ID NO: 2355600 - protein, 20 aa, Cryptosporidium parvum
LAQILAPYLVKYLKSSTISK

SEQ ID NO: 2355601 - protein, 26 aa, Cryptosporidium parvum
LCILNSYLNHLSLYVRNFTYKTKING

SEQ ID NO: 2355602 - protein, 17 aa, Cryptosporidium parvum
LCKISSLAPLFSSLNIC

SEQ ID NO: 2355603 - protein, 23 aa, Cryptosporidium parvum
LCNAKIEIIGLFSATNIIAVNSN

SEQ ID NO: 2355604 - protein, 30 aa, Cryptosporidium parvum; identical to SEQ ID NO: 2317031

SEQ ID NO: 2355605 - protein, 24 aa, Cryptosporidium parvum
LCNDWNLIRPVKSIHVKNRKVYIL

SEQ ID NO: 2355606 - protein, 19 aa, Cryptosporidium parvum
LDCKASFTVFSSSPLLLNR

SEQ ID NO: 2355607 - protein, 19 aa, Cryptosporidium parvum
LDERLLRIEQLEMNYQNVN

SEQ ID NO: 2355608 - protein, 20 aa, Cryptosporidium parvum
LDFLRGYLERLKRSDFLNLS

SEQ ID NO: 2355609 - protein, 24 aa, Cryptosporidium parvum
LDIIRFPFRNIASSSIKSLKPAFL

SEQ ID NO: 2355610 - protein, 30 aa, Cryptosporidium parvum; identical to SEQ ID NO: 2317073

SEQ ID NO: 2355611 - protein, 17 aa, Cryptosporidium parvum
LDKYFRFTLGNLYAHKL

SEQ ID NO: 2355612 - protein, 17 aa, Cryptosporidium parvum
LDLVPGIVNDDFRNALE

SEQ ID NO: 2355613 - protein, 24 aa, Cryptosporidium parvum
LDNKIHLWDLRKSAILDSLELSTL

SEQ ID NO: 2355614 - protein, 30 aa, Cryptosporidium parvum; identical to SEQ ID NO: 2317094

SEQ ID NO: 2355615 - protein, 32 aa, Cryptosporidium parvum; identical to SEQ ID NO: 2192936

SEQ ID NO: 2355616 - protein, 24 aa, Cryptosporidium parvum
LDTRSFSIKWWPLNEKFYKHEKLG

SEQ ID NO: 2355617 - protein, 45 aa, Cryptosporidium parvum; identical to SEQ ID NO: 2192948

SEQ ID NO: 2355618 - protein, 30 aa, Cryptosporidium parvum
LEDCGRINYVNLLRFLIWHIISEKEEAEKR

SEQ ID NO: 2355619 - protein, 19 aa, Cryptosporidium parvum
LEEAMILHKLRHPNIVSLV

SEQ ID NO: 2355620 - protein, 19 aa, Cryptosporidium parvum
LEEIFAKYGKIESIKMFNS

SEQ ID NO: 2355621 - protein, 38 aa, Cryptosporidium parvum; identical to SEQ ID NO: 2317151

SEQ ID NO: 2355622 - protein, 22 aa, Cryptosporidium parvum
LEGIGILKKMGRNAFMCSASVP

SEQ ID NO: 2355623 - protein, 39 aa, Cryptosporidium parvum
LEGLQWVSYYYFRGVPSWRWYYPYRYAPFACDIAIILSC

SEQ ID NO: 2355624 - protein, 20 aa, Cryptosporidium parvum
LEGLTKLKPCYLCYSSSTIS

SEQ ID NO: 2355625 - protein, 25 aa, Cryptosporidium parvum
LEHRESILLSALEDSSYRMTDIDKA

SEQ ID NO: 2355626 - protein, 31 aa, Cryptosporidium parvum; identical to SEQ ID NO: 2317174

SEQ ID NO: 2355627 - protein, 19 aa, Cryptosporidium parvum
LEKKPNGIFPLLDSECLMP

SEQ ID NO: 2355628 - protein, 35 aa, Cryptosporidium parvum
LELDYELICIDFFLRYISNLYPLWGEYGDNLMFHI

SEQ ID NO: 2355629 - protein, 18 aa, Cryptosporidium parvum
LELFVERRALMDENKSLN

SEQ ID NO: 2355630 - protein, 25 aa, Cryptosporidium parvum
LEMLYRSFLSLYISIEIPHALMGAI

SEQ ID NO: 2355631 - protein, 25 aa, Cryptosporidium parvum
LENIGKLHRKIIGSELFQSSQNTQL

SEQ ID NO: 2355632 - protein, 19 aa, Cryptosporidium parvum
LEQFQHTHLYGRHLIIEVA

SEQ ID NO: 2355633 - protein, 19 aa, Cryptosporidium parvum
LEQLNISRTMLASMGSPSS

SEQ ID NO: 2355634 - protein, 25 aa, Cryptosporidium parvum
LERRGLIELIVHPLCIDDPAPWRGS

SEQ ID NO: 2355635 - protein, 21 aa, Cryptosporidium parvum
LERSLINAKTKYTKLLMQCNS

SEQ ID NO: 2355636 - protein, 17 aa, Cryptosporidium parvum
LETFLFDPKNLRGLNRS

SEQ ID NO: 2355637 - protein, 18 aa, Cryptosporidium parvum
LEVYGKILNLRIVKDFQG

SEQ ID NO: 2355638 - protein, 17 aa, Cryptosporidium parvum
LFGKWSYDDVNVSDLSL

SEQ ID NO: 2355639 - protein, 18 aa, Cryptosporidium parvum
LFHKCVSVWLQDLNLILR

SEQ ID NO: 2355640 - protein, 20 aa, Cryptosporidium parvum
LFIHGSLYHLALMKRREFPE

SEQ ID NO: 2355641 - protein, 17 aa, Cryptosporidium parvum
LFILSFDNSFNELMTPL

SEQ ID NO: 2355642 - protein, 19 aa, Cryptosporidium parvum
LFIVVDLVLHHGASKLNSL

SEQ ID NO: 2355643 - protein, 20 aa, Cryptosporidium parvum
LFKILFERCFQEYLLLCCDP

SEQ ID NO: 2355644 - protein, 25 aa, Cryptosporidium parvum
LFNKSPEWILYHELVFTSKEYIRDC

SEQ ID NO: 2355645 - protein, 18 aa, Cryptosporidium parvum
LFVGTSMLDILLSIWEAY

SEQ ID NO: 2355646 - protein, 18 aa, Cryptosporidium parvum
LGDFVYCGIYSCIHAFDT

SEQ ID NO: 2355647 - protein, 28 aa, Cryptosporidium parvum
LGDGSKFFPFFISKYIRSLQKSNYFGEL

SEQ ID NO: 2355648 - protein, 17 aa, Cryptosporidium parvum
LGDYCEGALLHNVRTRY

SEQ ID NO: 2355649 - protein, 26 aa, Cryptosporidium parvum
LGGGADPPYSPYCLRCIMVCTISPSV

SEQ ID NO: 2355650 - protein, 17 aa, Cryptosporidium parvum
LGIGPFQTLNIAEKLYL

SEQ ID NO: 2355651 - protein, 27 aa, Cryptosporidium parvum
LGKCEGFLDILLSPPRFTRGILNRHCY

SEQ ID NO: 2355652 - protein, 22 aa, Cryptosporidium parvum
LGKGWKIFLSRSVDLGRWTIIQ

SEQ ID NO: 2355653 - protein, 28 aa, Cryptosporidium parvum
LGLTQYSHPYNFPKASFLPPNTEPSSNI

SEQ ID NO: 2355654 - protein, 27 aa, Cryptosporidium parvum
LGNDIIPFEYHWEKPLFHSKLFEIDHE

SEQ ID NO: 2355655 - protein, 25 aa, Cryptosporidium parvum
LGNKEKMLFFFNDIAFLKDNCIELK

SEQ ID NO: 2355656 - protein, 29 aa, Cryptosporidium parvum
LGPDGRPMPYWLYKLNGLGIEFKCEICGN

SEQ ID NO: 2355657 - protein, 25 aa, Cryptosporidium parvum
LGSLEALLVFLKSSNIPVVALNIGT

SEQ ID NO: 2355658 - protein, 22 aa, Cryptosporidium parvum
LHDLFQAVMSYPLITQWYKEME

SEQ ID NO: 2355659 - protein, 25 aa, Cryptosporidium parvum
LHINDIYFFLLSLGPSHGQGFVTYI

SEQ ID NO: 2355660 - protein, 18 aa, Cryptosporidium parvum
LHKSYMWGNNNRIMTCNQ

SEQ ID NO: 2355661 - protein, 26 aa, Cryptosporidium parvum
LHNGLLVLSKYPILNARFTCFSDVTL

SEQ ID NO: 2355662 - protein, 25 aa, Cryptosporidium parvum
LHNSLKLCTLIKSNYDFILSFTCII

SEQ ID NO: 2355663 - protein, 17 aa, Cryptosporidium parvum
LHQLYNGRIPAAPMSAR

SEQ ID NO: 2355664 - protein, 18 aa, Cryptosporidium parvum
LHTIIWQGDKKQLCGTGK

SEQ ID NO: 2355665 - protein, 19 aa, Cryptosporidium parvum
LICNGPYLNPPMISLLIRA

SEQ ID NO: 2355666 - protein, 30 aa, Cryptosporidium parvum
LIEFRSLFCQCIIYIILKRTKTKFYTFPFK

SEQ ID NO: 2355667 - protein, 23 aa, Cryptosporidium parvum
LIEGYSVPFPYDAYKCQINYMQK

SEQ ID NO: 2355668 - protein, 31 aa, Cryptosporidium parvum; identical to SEQ ID NO: 2317417

SEQ ID NO: 2355669 - protein, 20 aa, Cryptosporidium parvum
LILELFDIFNNKLSILIIDV

SEQ ID NO: 2355670 - protein, 20 aa, Cryptosporidium parvum
LINNNPLTIATTASSGIITA

SEQ ID NO: 2355671 - protein, 17 aa, Cryptosporidium parvum
LINSTHLSKLIKLHTVH

SEQ ID NO: 2355672 - protein, 34 aa, Cryptosporidium parvum; identical to SEQ ID NO: 2193214

SEQ ID NO: 2355673 - protein, 18 aa, Cryptosporidium parvum
LISKSQCVFFLSASYTGM

SEQ ID NO: 2355674 - protein, 26 aa, Cryptosporidium parvum
LIYIHDPEDFRFWKQKPESFMKQLSE

SEQ ID NO: 2355675 - protein, 18 aa, Cryptosporidium parvum
LKEEASSVSIPPAPAPAP

SEQ ID NO: 2355676 - protein, 23 aa, Cryptosporidium parvum
LKELNPYYVLQGDSFSSSKICNI

SEQ ID NO: 2355677 - protein, 28 aa, Cryptosporidium parvum
LKHSLSVFKLKFLYFAENISLFESLFRL

SEQ ID NO: 2355678 - protein, 28 aa, Cryptosporidium parvum
LKITKAQKKIPLWARSMNWIPKMKEQRN

SEQ ID NO: 2355679 - protein, 24 aa, Cryptosporidium parvum
LKLRRRGRRRRPGKLNISKQLTKD

SEQ ID NO: 2355680 - protein, 38 aa, Cryptosporidium parvum; identical to SEQ ID NO: 2317540

SEQ ID NO: 2355681 - protein, 31 aa, Cryptosporidium parvum; identical to SEQ ID NO: 2317553

SEQ ID NO: 2355682 - protein, 22 aa, Cryptosporidium parvum
LKQKIFEYEFKDNKLDVEALIE

SEQ ID NO: 2355683 - protein, 22 aa, Cryptosporidium parvum
LKQQYFFVCATIQDILRRFKKS

SEQ ID NO: 2355684 - protein, 27 aa, Cryptosporidium parvum
LKQSQYFMWEIFIGFTDPNPNTRWSIK

SEQ ID NO: 2355685 - protein, 27 aa, Cryptosporidium parvum
LKSILPILEFCISSRSPLLIIAEEIEG

SEQ ID NO: 2355686 - protein, 27 aa, Cryptosporidium parvum
LLDENITHLFYKTLVYISAISGINSNG

SEQ ID NO: 2355687 - protein, 27 aa, Cryptosporidium parvum
LLDTNKIQWVILALISVHTIDSYNPHV

SEQ ID NO: 2355688 - protein, 19 aa, Cryptosporidium parvum
LLEYRICGVKLYQNPPYTS

SEQ ID NO: 2355689 - protein, 25 aa, Cryptosporidium parvum
LLHASPLLFNLFELKLNLLTEEGTE

SEQ ID NO: 2355690 - protein, 17 aa, Cryptosporidium parvum
LLHYRYNINWDIPDKFL

SEQ ID NO: 2355691 - protein, 24 aa, Cryptosporidium parvum
LLKFVNFKLYQLNNLTYPPTINTP

SEQ ID NO: 2355692 - protein, 22 aa, Cryptosporidium parvum
LLNLESIPVPLAYQQIKKLEWD

SEQ ID NO: 2355693 - protein, 23 aa, Cryptosporidium parvum
LLNSFQSIFKRYGSLSKSPGSFE

SEQ ID NO: 2355694 - protein, 17 aa, Cryptosporidium parvum
LLPINHSFSKHTDSIPA

SEQ ID NO: 2355695 - protein, 21 aa, Cryptosporidium parvum
LLQASIRMISNPRVDILRFVH

SEQ ID NO: 2355696 - protein, 17 aa, Cryptosporidium parvum
LLQEYLGGGADPPYSPY

SEQ ID NO: 2355697 - protein, 28 aa, Cryptosporidium parvum
LLRSRKCPFIIALNKIDRLYGWIEQNWS

SEQ ID NO: 2355698 - protein, 25 aa, Cryptosporidium parvum
LLSSCFAFHFSLMKTRKIFYDLLQT

SEQ ID NO: 2355699 - protein, 31 aa, Cryptosporidium parvum
LLVDHEYAPIWLLSLKYLIQISQQSNLLLLS

SEQ ID NO: 2355700 - protein, 20 aa, Cryptosporidium parvum
LNDSILLKKISNLNFDEMSL

SEQ ID NO: 2355701 - protein, 25 aa, Cryptosporidium parvum
LNEDNFQYRYILGKILLDKNPGIKT

SEQ ID NO: 2355702 - protein, 22 aa, Cryptosporidium parvum
LNQIEELYKPLEYPKLCNRMYK

SEQ ID NO: 2355703 - protein, 24 aa, Cryptosporidium parvum
LNQQNLWGNRWADIARHLPGRTTH

SEQ ID NO: 2355704 - protein, 31 aa, Cryptosporidium parvum; identical to SEQ ID NO: 2193480

SEQ ID NO: 2355705 - protein, 17 aa, Cryptosporidium parvum
LPIQTIPFNFDSSKFSL

SEQ ID NO: 2355706 - protein, 43 aa, Cryptosporidium parvum
LPKDSRLVIYGKFKDNPLVSLIGEVPLELSSFANSYRLAGYET

SEQ ID NO: 2355707 - protein, 18 aa, Cryptosporidium parvum
LPLLNSQSSTFSFGQGID

SEQ ID NO: 2355708 - protein, 18 aa, Cryptosporidium parvum
LPNIFPSISHRPLPVNVC

SEQ ID NO: 2355709 - protein, 30 aa, Cryptosporidium parvum; identical to SEQ ID NO: 2193512

SEQ ID NO: 2355710 - protein, 26 aa, Cryptosporidium parvum
LPTSRDPKLWLVKVDRAGLEKDICIA

SEQ ID NO: 2355711 - protein, 25 aa, Cryptosporidium parvum
LQHYLLNVGVLLMSLRRLETLIFCI

SEQ ID NO: 2355712 - protein, 24 aa, Cryptosporidium parvum
LQLRQHAERLLGFTGNPVLRTRFD

SEQ ID NO: 2355713 - protein, 17 aa, Cryptosporidium parvum
LQNSLGGNSLTALIVTC

SEQ ID NO: 2355714 - protein, 27 aa, Cryptosporidium parvum
LQQEALWISRKFLQTYPELFKEELLRR

SEQ ID NO: 2355715 - protein, 23 aa, Cryptosporidium parvum
LQQPVFHVGYFKHLYGVLCCICK

SEQ ID NO: 2355716 - protein, 19 aa, Cryptosporidium parvum
LQQQKPVLGILPAIDEECF

SEQ ID NO: 2355717 - protein, 23 aa, Cryptosporidium parvum
LQSIYLIADPPWNSGWIDIWFSE

SEQ ID NO: 2355718 - protein, 17 aa, Cryptosporidium parvum
LQVLLNSAQRKLAERNN

SEQ ID NO: 2355719 - protein, 18 aa, Cryptosporidium parvum
LQVRFRIPNPHSLMPLRS

SEQ ID NO: 2355720 - protein, 20 aa, Cryptosporidium parvum
LRRLDRTLLLIEENFEQVSK

SEQ ID NO: 2355721 - protein, 27 aa, Cryptosporidium parvum
LRSAAIRFGMRYISSGKELSFGGKARK

SEQ ID NO: 2355722 - protein, 24 aa, Cryptosporidium parvum
LRSRLVCIVLLSPMLSLESIKKKT

SEQ ID NO: 2355723 - protein, 17 aa, Cryptosporidium parvum
LSEILNKGQIFPIDGIN

SEQ ID NO: 2355724 - protein, 28 aa, Cryptosporidium parvum
LSFQGKIRNMLFKLLIHPVHELVNNLKT

SEQ ID NO: 2355725 - protein, 25 aa, Cryptosporidium parvum
LSGGWRMRVALARAIYANPDILLLD

SEQ ID NO: 2355726 - protein, 23 aa, Cryptosporidium parvum
LSIPERVYAMDLKYPALVVAAAD

SEQ ID NO: 2355727 - protein, 17 aa, Cryptosporidium parvum
LSLCWMNEHTIYTGGST

SEQ ID NO: 2355728 - protein, 24 aa, Cryptosporidium parvum
LSLGSFTHVLGLCKPCVFVNKTNK

SEQ ID NO: 2355729 - protein, 18 aa, Cryptosporidium parvum
LSLKKITPISVIPLKKTE

SEQ ID NO: 2355730 - protein, 27 aa, Cryptosporidium parvum
LSQSDGEILFTSPSYRISPNNTIRRKF

SEQ ID NO: 2355731 - protein, 17 aa, Cryptosporidium parvum
LSRFRTRICERKALHGV

SEQ ID NO: 2355732 - protein, 25 aa, Cryptosporidium parvum
LTALAMLCMDPYYRTIQGFLSLIEK

SEQ ID NO: 2355733 - protein, 25 aa, Cryptosporidium parvum
LTRGQRKRRLVLERVKRKQDLTSYL

SEQ ID NO: 2355734 - protein, 26 aa, Cryptosporidium parvum
LTSPIFNLKLEIVTMIIFYSEDDLQV

SEQ ID NO: 2355735 - protein, 23 aa, Cryptosporidium parvum
LTYNSVLPILATSALPVVTADPY

SEQ ID NO: 2355736 - protein, 19 aa, Cryptosporidium parvum
LVGLYAEWVDKNTIWDVRK

SEQ ID NO: 2355737 - protein, 29 aa, Cryptosporidium parvum
LVHEYLPFQLMYWNRRIMVYSEKISIIIL

SEQ ID NO: 2355738 - protein, 19 aa, Cryptosporidium parvum
LVKTLLDTSVPKSGIRLRL

SEQ ID NO: 2355739 - protein, 26 aa, Cryptosporidium parvum
LVLEDDFFEKSILFAIKTYSKKSNTE

SEQ ID NO: 2355740 - protein, 29 aa, Cryptosporidium parvum
LVPELQHLSVPYWNLFPDVIDDVLNDTNK

SEQ ID NO: 2355741 - protein, 24 aa, Cryptosporidium parvum
LVRPEHILKKSLDFVYNNYIKYSS

SEQ ID NO: 2355742 - protein, 24 aa, Cryptosporidium parvum
LWKNPFYWTEIFSINSLYFKSSFL

SEQ ID NO: 2355743 - protein, 17 aa, Cryptosporidium parvum
LYEDEVGLIWKYRFYLF

SEQ ID NO: 2355744 - protein, 21 aa, Cryptosporidium parvum
LYELVKLFPEKMDISNDLTFR

SEQ ID NO: 2355745 - protein, 24 aa, Cryptosporidium parvum
LYIDSFESLPWKGQTMFSNFRELQ

SEQ ID NO: 2355746 - protein, 17 aa, Cryptosporidium parvum
MALDLLGKNSKEFLVEE

SEQ ID NO: 2355747 - protein, 27 aa, Cryptosporidium parvum
MDISNDLTFRYLLDILQESYHNFKFIS

SEQ ID NO: 2355748 - protein, 29 aa, Cryptosporidium parvum
MDLEDVFQRPWYISTIARDNRIKSWQNDR

SEQ ID NO: 2355749 - protein, 17 aa, Cryptosporidium parvum
MEKISINLPKFQKHQFE

SEQ ID NO: 2355750 - protein, 22 aa, Cryptosporidium parvum
METDFKLSIPILIELIKKDNLD

SEQ ID NO: 2355751 - protein, 20 aa, Cryptosporidium parvum
MFSYETFVLGCILTGCDYVK

SEQ ID NO: 2355752 - protein, 22 aa, Cryptosporidium parvum
MGKGSFKYAWVLDKLKAERERG

SEQ ID NO: 2355753 - protein, 19 aa, Cryptosporidium parvum
MGRNKVLVKLNPEGKFLVD

SEQ ID NO: 2355754 - protein, 26 aa, Cryptosporidium parvum
MHAKEDILLQMLKHARSKSVASFIGI

SEQ ID NO: 2355755 - protein, 17 aa, Cryptosporidium parvum
MHDWQFYDKKRIMELHK

SEQ ID NO: 2355756 - protein, 22 aa, Cryptosporidium parvum
MHLKLVRGKPLYVGLHERKEQR

SEQ ID NO: 2355757 - protein, 18 aa, Cryptosporidium parvum
MIEYIAVWGIINEDDHLL

SEQ ID NO: 2355758 - protein, 19 aa, Cryptosporidium parvum
MINQSLLTLGRVINALVEH

SEQ ID NO: 2355759 - protein, 25 aa, Cryptosporidium parvum
MIQNPSKVFYLYEPFSKKITRETYS

SEQ ID NO: 2355760 - protein, 22 aa, Cryptosporidium parvum
MKANIIYHLCDMFTKYYSDVQE

SEQ ID NO: 2355761 - protein, 29 aa, Cryptosporidium parvum
MKYVLSLDMDAILKEALRPQLRVLKISLK

SEQ ID NO: 2355762 - protein, 17 aa, Cryptosporidium parvum
MLELLNQLDGFESTQNI

SEQ ID NO: 2355763 - protein, 18 aa, Cryptosporidium parvum
MLEMLKRVGRSELVVGWY

SEQ ID NO: 2355764 - protein, 25 aa, Cryptosporidium parvum
MLESIRIRRSGYSILYPSFESHDFT

SEQ ID NO: 2355765 - protein, 29 aa, Cryptosporidium parvum
MLQQLLMDFEYIIPIFVIYRIFEVHSENC

SEQ ID NO: 2355766 - protein, 17 aa, Cryptosporidium parvum
MLSLRYHPFENICGFTN

SEQ ID NO: 2355767 - protein, 20 aa, Cryptosporidium parvum
MNEIARFCPSIKAVKFLGNG

SEQ ID NO: 2355768 - protein, 19 aa, Cryptosporidium parvum
MNIPLRLVDMIRKRIFSQV

SEQ ID NO: 2355769 - protein, 20 aa, Cryptosporidium parvum
MPKILPFTMSNWNVIKLLAY

SEQ ID NO: 2355770 - protein, 18 aa, Cryptosporidium parvum
MQQQFPSCQCGTNYFNTQ

SEQ ID NO: 2355771 - protein, 17 aa, Cryptosporidium parvum
MRIENICVDWEGGWWSK

SEQ ID NO: 2355772 - protein, 19 aa, Cryptosporidium parvum
MSLRRLETLIFCIQVLALQ

SEQ ID NO: 2355773 - protein, 18 aa, Cryptosporidium parvum
MSPLDFEDILMNCPKSWV

SEQ ID NO: 2355774 - protein, 20 aa, Cryptosporidium parvum
MSQYISTIGYKTSNIDLGVC

SEQ ID NO: 2355775 - protein, 29 aa, Cryptosporidium parvum
MTSKHVWGPINLFYPDVKSTFTYIPDLEV

SEQ ID NO: 2355776 - protein, 17 aa, Cryptosporidium parvum
MTVRRFLTATGHAISLF

SEQ ID NO: 2355777 - protein, 19 aa, Cryptosporidium parvum
MVHFTPLQIFGQSGSCYSL

SEQ ID NO: 2355778 - protein, 18 aa, Cryptosporidium parvum
MVNPAVFITLLNDVEWYS

SEQ ID NO: 2355779 - protein, 26 aa, Cryptosporidium parvum
MYRKCLRALWDMFQYDDEINLKIAGI

SEQ ID NO: 2355780 - protein, 33 aa, Cryptosporidium parvum; identical to SEQ ID NO: 2318431

SEQ ID NO: 2355781 - protein, 25 aa, Cryptosporidium parvum
NACRGVIIAGLPFPSIADARVCLKK

SEQ ID NO: 2355782 - protein, 20 aa, Cryptosporidium parvum
NADGLYFDNHSHYHVPTNYS

SEQ ID NO: 2355783 - protein, 18 aa, Cryptosporidium parvum
NAEKFRFDLRVENLHIFL

SEQ ID NO: 2355784 - protein, 23 aa, Cryptosporidium parvum
NANPLQVVVLTKSNLYITSAEIF

SEQ ID NO: 2355785 - protein, 43 aa, Cryptosporidium parvum; identical to SEQ ID NO: 2194109

SEQ ID NO: 2355786 - protein, 28 aa, Cryptosporidium parvum
NDFSSTYYHFLIGLTVIVNRGLIGGDEL

SEQ ID NO: 2355787 - protein, 25 aa, Cryptosporidium parvum
NDQLYNIIKIIKAVMFLGNITFIEN

SEQ ID NO: 2355788 - protein, 20 aa, Cryptosporidium parvum
NDRILTKKILLNQIGIMIPK

SEQ ID NO: 2355789 - protein, 24 aa, Cryptosporidium parvum
NDVRAVLGDGPWISKMSIYEEGWD

SEQ ID NO: 2355790 - protein, 18 aa, Cryptosporidium parvum
NDYFLNPVKIPVCDPLAW

SEQ ID NO: 2355791 - protein, 26 aa, Cryptosporidium parvum
NEEDSFEWQLKYKNKMKGNMIFMASL

SEQ ID NO: 2355792 - protein, 25 aa, Cryptosporidium parvum
NEHFKEVFPISFRSNIPLICESFVD

SEQ ID NO: 2355793 - protein, 17 aa, Cryptosporidium parvum
NELLKVWCMEMCPEEYL

SEQ ID NO: 2355794 - protein, 26 aa, Cryptosporidium parvum
NENKLWLLPIDTIYESVRIVEFLGGT

SEQ ID NO: 2355795 - protein, 23 aa, Cryptosporidium parvum
NESKSIGLTSLLQKNIKLNDSSS

SEQ ID NO: 2355796 - protein, 30 aa, Cryptosporidium parvum; identical to SEQ ID NO: 2318595

SEQ ID NO: 2355797 - protein, 27 aa, Cryptosporidium parvum
NEVCSFNLLQPLSLNISYSGSNDKSQG

SEQ ID NO: 2355798 - protein, 21 aa, Cryptosporidium parvum
NFMTGSLIHNFPLFQNQDTSL

SEQ ID NO: 2355799 - protein, 26 aa, Cryptosporidium parvum
NFSGDFLLNLLIKFGILRSDASDLHS

SEQ ID NO: 2355800 - protein, 23 aa, Cryptosporidium parvum
NGEYYNQFFPRVKFITKIVEKNK

SEQ ID NO: 2355801 - protein, 26 aa, Cryptosporidium parvum
NGFDLKYNGFYILYAKSNKPDSQWKQ

SEQ ID NO: 2355802 - protein, 34 aa, Cryptosporidium parvum; identical to SEQ ID NO: 2194293

SEQ ID NO: 2355803 - protein, 18 aa, Cryptosporidium parvum
NGFNSLFVILNRLREYTA

SEQ ID NO: 2355804 - protein, 34 aa, Cryptosporidium parvum
NGIMLFKNSLFSLQLVFQVLIKQAYRNSLLYNGE

SEQ ID NO: 2355805 - protein, 20 aa, Cryptosporidium parvum
NGINMLAKYVAPHVYGYSQL

SEQ ID NO: 2355806 - protein, 39 aa, Cryptosporidium parvum; identical to SEQ ID NO: 2318676

SEQ ID NO: 2355807 - protein, 17 aa, Cryptosporidium parvum
NGLIPMLRVYNDTARYI

SEQ ID NO: 2355808 - protein, 25 aa, Cryptosporidium parvum
NGNCKLFNELALIWCILKTFAISTK

SEQ ID NO: 2355809 - protein, 32 aa, Cryptosporidium parvum; identical to SEQ ID NO: 2194324

SEQ ID NO: 2355810 - protein, 23 aa, Cryptosporidium parvum
NGSGFFQIIPATSNLPELSIPVT

SEQ ID NO: 2355811 - protein, 26 aa, Cryptosporidium parvum
NGYRYVPIKMLDIAGLIPGAHLGNGL

SEQ ID NO: 2355812 - protein, 24 aa, Cryptosporidium parvum
NHFKDYSLVLWKKLIKKCKNDNKL

SEQ ID NO: 2355813 - protein, 19 aa, Cryptosporidium parvum
NICVDWEGGWWSKEFLSRR

SEQ ID NO: 2355814 - protein, 29 aa, Cryptosporidium parvum
NIDDETLDTIPWFCSYNKLQVLSNSEYEV

SEQ ID NO: 2355815 - protein, 19 aa, Cryptosporidium parvum
NIFLNNQIYIILDTKSSGS

SEQ ID NO: 2355816 - protein, 17 aa, Cryptosporidium parvum
NIFTPFGAVRPFTYCKN

SEQ ID NO: 2355817 - protein, 18 aa, Cryptosporidium parvum
NIIFTSCLHGWCLDITGG

SEQ ID NO: 2355818 - protein, 17 aa, Cryptosporidium parvum
NIILIYISAPNQDEATS

SEQ ID NO: 2355819 - protein, 26 aa, Cryptosporidium parvum
NIITKKQLIELLIQDGITNENSIKLF

SEQ ID NO: 2355820 - protein, 23 aa, Cryptosporidium parvum
NIKNNPLGYPKKVYYFIYGFFHR

SEQ ID NO: 2355821 - protein, 25 aa, Cryptosporidium parvum
NINQEPAKCLLIGSPFKLPCSKGCH

SEQ ID NO: 2355822 - protein, 27 aa, Cryptosporidium parvum
NINQFVSQLQNLLPPIVPGHNSGNIQN

SEQ ID NO: 2355823 - protein, 37 aa, Cryptosporidium parvum; identical to SEQ ID NO: 2194448

SEQ ID NO: 2355824 - protein, 27 aa, Cryptosporidium parvum
NITIINFNRFPPGSLVILHTIRHKGFS

SEQ ID NO: 2355825 - protein, 26 aa, Cryptosporidium parvum
NITKNMSIILLPGEKLLLFSKECGIS

SEQ ID NO: 2355826 - protein, 18 aa, Cryptosporidium parvum
NIYLKKFLQLEDLKWDIN

SEQ ID NO: 2355827 - protein, 17 aa, Cryptosporidium parvum
NIYQNIFINFNEEKIRK

SEQ ID NO: 2355828 - protein, 25 aa, Cryptosporidium parvum
NKAVDLLGLIPIYPVKNIKTFTNNL

SEQ ID NO: 2355829 - protein, 38 aa, Cryptosporidium parvum
NKELKSYFTPTKTKLLYLAIYEYLVVYSTLEDNLEKVV

SEQ ID NO: 2355830 - protein, 26 aa, Cryptosporidium parvum
NKHGRRPLVLVLLPTRELAQQVSNEF

SEQ ID NO: 2355831 - protein, 33 aa, Cryptosporidium parvum
NKKHGIFLHIMSHPWLLAINNLTNIDIELGKGW

SEQ ID NO: 2355832 - protein, 31 aa, Cryptosporidium parvum; identical to SEQ ID NO: 2194507

SEQ ID NO: 2355833 - protein, 18 aa, Cryptosporidium parvum
NKPHKYFENILSPNKSIK

SEQ ID NO: 2355834 - protein, 32 aa, Cryptosporidium parvum
NKQMFYRDNVFFNFLLVKHFSFGENDKILKTN

SEQ ID NO: 2355835 - protein, 32 aa, Cryptosporidium parvum; identical to SEQ ID NO: 2318933

SEQ ID NO: 2355836 - protein, 26 aa, Cryptosporidium parvum
NLDSLMDFIFFIWAADDEFWDKNKLC

SEQ ID NO: 2355837 - protein, 24 aa, Cryptosporidium parvum
NLELTEHAGIIPRAVQLIFERLES

SEQ ID NO: 2355838 - protein, 23 aa, Cryptosporidium parvum
NLERYERFIGSTKLLEEVSIHDA

SEQ ID NO: 2355839 - protein, 20 aa, Cryptosporidium parvum
NLIFSPKVFLPCNPDKGYKL

SEQ ID NO: 2355840 - protein, 20 aa, Cryptosporidium parvum
NLIVNKLGVSRLDKLDIVDG

SEQ ID NO: 2355841 - protein, 24 aa, Cryptosporidium parvum
NLKDFLLAAKQFNLLRPDYAICGV

SEQ ID NO: 2355842 - protein, 22 aa, Cryptosporidium parvum
NLLKENDILFKFPRVSPIINDE

SEQ ID NO: 2355843 - protein, 31 aa, Cryptosporidium parvum; identical to SEQ ID NO: 2194594

SEQ ID NO: 2355844 - protein, 23 aa, Cryptosporidium parvum
NLNIKPIIILIPSSECLAPGQLG

SEQ ID NO: 2355845 - protein, 23 aa, Cryptosporidium parvum
NLQEKISNHLIGLSIAKSNNSFS

SEQ ID NO: 2355846 - protein, 18 aa, Cryptosporidium parvum
NLQPVNQISKPFLQNTNT

SEQ ID NO: 2355847 - protein, 21 aa, Cryptosporidium parvum
NLSLSTILDICDVRIVDELPP

SEQ ID NO: 2355848 - protein, 24 aa, Cryptosporidium parvum
NLTKRACLNPAYTSLRKSARLAQI

SEQ ID NO: 2355849 - protein, 23 aa, Cryptosporidium parvum
NLTSPIPITPFRRPEFQLNSTPK

SEQ ID NO: 2355850 - protein, 20 aa, Cryptosporidium parvum
NMFGRYYGMTLPQGQTNHSP

SEQ ID NO: 2355851 - protein, 19 aa, Cryptosporidium parvum
NMLRDYFQLSTSSSNTNYT

SEQ ID NO: 2355852 - protein, 24 aa, Cryptosporidium parvum
NMNYRVFPTTIWDETLFAAWSEIV

SEQ ID NO: 2355853 - protein, 18 aa, Cryptosporidium parvum
NMYVWNHRTWFIRKYNSV

SEQ ID NO: 2355854 - protein, 25 aa, Cryptosporidium parvum
NNEEEMIGLLKLVFDKATTQHHFIP

SEQ ID NO: 2355855 - protein, 19 aa, Cryptosporidium parvum
NNFNFRINVQWHSVYVDGW

SEQ ID NO: 2355856 - protein, 22 aa, Cryptosporidium parvum
NNHPLFCRRGVEVTVISQGEFF

SEQ ID NO: 2355857 - protein, 18 aa, Cryptosporidium parvum
NNLANFLMEAMETRFSTI

SEQ ID NO: 2355858 - protein, 28 aa, Cryptosporidium parvum
NNNLDFSYLNIRWRRKMGEKLIDIQGKD

SEQ ID NO: 2355859 - protein, 31 aa, Cryptosporidium parvum; identical to SEQ ID NO: 2194724

SEQ ID NO: 2355860 - protein, 26 aa, Cryptosporidium parvum
NNPGKDLFFSYLYFSPTSISDVVSYY

SEQ ID NO: 2355861 - protein, 28 aa, Cryptosporidium parvum
NNPLSVVEFFKYPIPFFSKKNISKNGFS

SEQ ID NO: 2355862 - protein, 17 aa, Cryptosporidium parvum
NNPQLNPLTFFQEISKL

SEQ ID NO: 2355863 - protein, 25 aa, Cryptosporidium parvum
NNRELLLFDLAINMYQKYTHLSRIL

SEQ ID NO: 2355864 - protein, 19 aa, Cryptosporidium parvum
NNTLFGFSCSFYDKTALIF

SEQ ID NO: 2355865 - protein, 24 aa, Cryptosporidium parvum
NPCLVHILPSILKRTISKGNPEFS

SEQ ID NO: 2355866 - protein, 20 aa, Cryptosporidium parvum
NPDPKDIFPIMIVGTRVTNE

SEQ ID NO: 2355867 - protein, 25 aa, Cryptosporidium parvum
NPPYTSHRLLQIPSALRGINADIIA

SEQ ID NO: 2355868 - protein, 19 aa, Cryptosporidium parvum
NPTRLFYYSQLYSSSTTFS

SEQ ID NO: 2355869 - protein, 28 aa, Cryptosporidium parvum
NPVLKNMIFFLYDSFLSEIFQLDGLTEN

SEQ ID NO: 2355870 - protein, 21 aa, Cryptosporidium parvum
NPYLNGVWIKNGLSFVVSQKY

SEQ ID NO: 2355871 - protein, 25 aa, Cryptosporidium parvum
NQEGRPFIFYLDNYAFPTPKIESTV

SEQ ID NO: 2355872 - protein, 31 aa, Cryptosporidium parvum
NQFPTEFQFHPNLLIIIADHLNNSLFGNFHC

SEQ ID NO: 2355873 - protein, 29 aa, Cryptosporidium parvum
NQLKISYILVRVLAQLRMIESILGRCVAF

SEQ ID NO: 2355874 - protein, 22 aa, Cryptosporidium parvum
NQNQFGMFVLSSLSLTNVTAHK

SEQ ID NO: 2355875 - protein, 20 aa, Cryptosporidium parvum
NQSYSRELIMDHSEGIDWIS

SEQ ID NO: 2355876 - protein, 20 aa, Cryptosporidium parvum
NRENLYFNSLKKCVIFDTDW

SEQ ID NO: 2355877 - protein, 27 aa, Cryptosporidium parvum
NRGSIWMVFEYLPYDLSGYIEGLKLEG

SEQ ID NO: 2355878 - protein, 22 aa, Cryptosporidium parvum
NRIELDLKIPKNISLEEICETE

SEQ ID NO: 2355879 - protein, 17 aa, Cryptosporidium parvum
NRLLAKFHKKRPSSSET

SEQ ID NO: 2355880 - protein, 17 aa, Cryptosporidium parvum
NRQLIIALTTMTKAFRF

SEQ ID NO: 2355881 - protein, 23 aa, Cryptosporidium parvum
NRSFPIICLLLFERRVRSKSDGI

SEQ ID NO: 2355882 - protein, 21 aa, Cryptosporidium parvum
NRYEGYWENDRRHGKGIFYCA

SEQ ID NO: 2355883 - protein, 21 aa, Cryptosporidium parvum
NSELEFLIDASKFYSLICPSL

SEQ ID NO: 2355884 - protein, 18 aa, Cryptosporidium parvum
NSFPIQIPVFFSQNIQHI

SEQ ID NO: 2355885 - protein, 31 aa, Cryptosporidium parvum; identical to SEQ ID NO: 2194892

SEQ ID NO: 2355886 - protein, 22 aa, Cryptosporidium parvum
NSITIMYGLETILFEKFEYEVK

SEQ ID NO: 2355887 - protein, 24 aa, Cryptosporidium parvum
NSKVQITSLFYLLGSDLIPVNQVK

SEQ ID NO: 2355888 - protein, 17 aa, Cryptosporidium parvum
NSLIPPLNKSIFDQYNV

SEQ ID NO: 2355889 - protein, 23 aa, Cryptosporidium parvum
NSNDVCVGILNFVDLAGSESIKR

SEQ ID NO: 2355890 - protein, 25 aa, Cryptosporidium parvum
NSNENFFMCLKWPESLSVTPEAEDV

SEQ ID NO: 2355891 - protein, 28 aa, Cryptosporidium parvum
NSNNTVQDYRFLPKPTFRIEDNNLYSNL

SEQ ID NO: 2355892 - protein, 31 aa, Cryptosporidium parvum
NSQLRNNALFINYLVNYFSIPQGAISQLHCI

SEQ ID NO: 2355893 - protein, 19 aa, Cryptosporidium parvum
NSRSITYTVPSLRVKLRRD

SEQ ID NO: 2355894 - protein, 25 aa, Cryptosporidium parvum
NSVHTNFWLRLKGKEKRIISRNAMK

SEQ ID NO: 2355895 - protein, 27 aa, Cryptosporidium parvum
NSYPTPFSDIPYLLKLVNVLSDSYGFS

SEQ ID NO: 2355896 - protein, 24 aa, Cryptosporidium parvum
NTGILKRVLIPQKFDLFQTSESKF

SEQ ID NO: 2355897 - protein, 29 aa, Cryptosporidium parvum
NTNNKIIIPKPFPGLISKVSVPWKRVKTS

SEQ ID NO: 2355898 - protein, 24 aa, Cryptosporidium parvum
NTRCILGMMSMENTAILSVRTEYA

SEQ ID NO: 2355899 - protein, 24 aa, Cryptosporidium parvum
NTSNFVVVFIRKSKDKAFLCVVNM

SEQ ID NO: 2355900 - protein, 27 aa, Cryptosporidium parvum
NVDINEYFRLLFEFNKNGVHFVNIIQG

SEQ ID NO: 2355901 - protein, 24 aa, Cryptosporidium parvum
NVFSEKDRWFSLSSVTSPVDIEAL

SEQ ID NO: 2355902 - protein, 26 aa, Cryptosporidium parvum
NVGGIPFLLNLRHFYQFNFITQRHRR

SEQ ID NO: 2355903 - protein, 19 aa, Cryptosporidium parvum
NVQFSFFYILCQLGEMAKY

SEQ ID NO: 2355904 - protein, 32 aa, Cryptosporidium parvum; identical to SEQ ID NO: 2319533

SEQ ID NO: 2355905 - protein, 20 aa, Cryptosporidium parvum
NYISAFCIQIAILANHQTGR

SEQ ID NO: 2355906 - protein, 17 aa, Cryptosporidium parvum
NYLLERAKLFQLNDFFF

SEQ ID NO: 2355907 - protein, 17 aa, Cryptosporidium parvum
NYQYLLNQCLSFVMSSL

SEQ ID NO: 2355908 - protein, 34 aa, Cryptosporidium parvum; identical to SEQ ID NO: 2319573

SEQ ID NO: 2355909 - protein, 34 aa, Cryptosporidium parvum
NYSFKNILISCKLCKFSFKKPYWEKKIKNTNRHE

SEQ ID NO: 2355910 - protein, 27 aa, Cryptosporidium parvum
NYSNLLYDLFYFHVDVTIRIFYRENEN

SEQ ID NO: 2355911 - protein, 21 aa, Cryptosporidium parvum
NYYETLSTIDFARRAKKIQNK

SEQ ID NO: 2355912 - protein, 18 aa, Cryptosporidium parvum
NYYRRLESLVFDIFLVRS

SEQ ID NO: 2355913 - protein, 30 aa, Cryptosporidium parvum; identical to SEQ ID NO: 2195107

SEQ ID NO: 2355914 - protein, 17 aa, Cryptosporidium parvum
PAVVRAIPRVNKRYAKP

SEQ ID NO: 2355915 - protein, 20 aa, Cryptosporidium parvum
PDAPRHLLQSRTNHFPEEGL

SEQ ID NO: 2355916 - protein, 24 aa, Cryptosporidium parvum
PDSRPFWFQDWGERAISYYSSQID

SEQ ID NO: 2355917 - protein, 27 aa, Cryptosporidium parvum
PDTKDYLMCVFLPNYNVSNAQIIIPAS

SEQ ID NO: 2355918 - protein, 17 aa, Cryptosporidium parvum
PEDIHGIIKTGMKSRRV

SEQ ID NO: 2355919 - protein, 23 aa, Cryptosporidium parvum
PEDQQMFVLGEKLRSLLFNSFNL

SEQ ID NO: 2355920 - protein, 33 aa, Cryptosporidium parvum; identical to SEQ ID NO: 2195156

SEQ ID NO: 2355921 - protein, 17 aa, Cryptosporidium parvum
PERHEIVLFKSMEDANN

SEQ ID NO: 2355922 - protein, 19 aa, Cryptosporidium parvum
PEYLAGHYMIQSASSLIPV

SEQ ID NO: 2355923 - protein, 18 aa, Cryptosporidium parvum
PFGAVRPFTYCKNDFNLS

SEQ ID NO: 2355924 - protein, 17 aa, Cryptosporidium parvum
PFIADIPIYKINISPWG

SEQ ID NO: 2355925 - protein, 26 aa, Cryptosporidium parvum
PFMDVEYMAYLLKYDSVHGNFNGTVE

SEQ ID NO: 2355926 - protein, 20 aa, Cryptosporidium parvum
PFSYHALLDFLFGVQKTYVD

SEQ ID NO: 2355927 - protein, 17 aa, Cryptosporidium parvum
PGGGSALLWASRNLGKL

SEQ ID NO: 2355928 - protein, 24 aa, Cryptosporidium parvum
PGRILDMLLNTLSIQLELLEIIIL

SEQ ID NO: 2355929 - protein, 42 aa, Cryptosporidium parvum; identical to SEQ ID NO: 2319711

SEQ ID NO: 2355930 - protein, 19 aa, Cryptosporidium parvum
PGVRFKAVKVSGVSLLALF

SEQ ID NO: 2355931 - protein, 23 aa, Cryptosporidium parvum
PHTVLLRREDIVLVGATIGSGQA

SEQ ID NO: 2355932 - protein, 29 aa, Cryptosporidium parvum
PHVYGYSQLKKGILLLLVGGVEKRTKDNI

SEQ ID NO: 2355933 - protein, 24 aa, Cryptosporidium parvum
PIDDFELLLFIDQKGKKSIFCPRC

SEQ ID NO: 2355934 - protein, 38 aa, Cryptosporidium parvum; identical to SEQ ID NO: 2319737

SEQ ID NO: 2355935 - protein, 20 aa, Cryptosporidium parvum
PIFVQTLLERVPYQDLDILE

SEQ ID NO: 2355936 - protein, 19 aa, Cryptosporidium parvum
PIITLQHIVKERYPCFVDA

SEQ ID NO: 2355937 - protein, 17 aa, Cryptosporidium parvum
PILNSYEAFVLLGNLSN

SEQ ID NO: 2355938 - protein, 26 aa, Cryptosporidium parvum
PINDNYFILDLLAQAGTYIKEFVNGD

SEQ ID NO: 2355939 - protein, 17 aa, Cryptosporidium parvum
PIPLSFSHLGNGGSACC

SEQ ID NO: 2355940 - protein, 18 aa, Cryptosporidium parvum
PIVEYCGEWGYNPRLLLS

SEQ ID NO: 2355941 - protein, 24 aa, Cryptosporidium parvum
PKDDIVRLLTCRKIQLREGEIMKH

SEQ ID NO: 2355942 - protein, 19 aa, Cryptosporidium parvum
PKIRLMSVKAIFSENFLSI

SEQ ID NO: 2355943 - protein, 25 aa, Cryptosporidium parvum
PKKVYYFIYGFFHRIYEKIYHYRHP

SEQ ID NO: 2355944 - protein, 21 aa, Cryptosporidium parvum
PKLLEEFQNRLLFKAKQRQNE

SEQ ID NO: 2355945 - protein, 35 aa, Cryptosporidium parvum
PKNEDSVLFLKSKFDYLLCNGCNRAFHWYCVNRPE

SEQ ID NO: 2355946 - protein, 24 aa, Cryptosporidium parvum
PLDRPKQCFIQVKRLLLGENNFHK

SEQ ID NO: 2355947 - protein, 19 aa, Cryptosporidium parvum
PLEILLHLPLVCEDKNTPY

SEQ ID NO: 2355948 - protein, 18 aa, Cryptosporidium parvum
PLFVLEKCLLSPTQELAL

SEQ ID NO: 2355949 - protein, 25 aa, Cryptosporidium parvum
PLILEKFHPIWIRKIIDERRNLVLK

SEQ ID NO: 2355950 - protein, 19 aa, Cryptosporidium parvum
PLLSILDKFIETFTLLHGE

SEQ ID NO: 2355951 - protein, 22 aa, Cryptosporidium parvum
PLNDYYDYFAPDFKLHIPPLNL

SEQ ID NO: 2355952 - protein, 20 aa, Cryptosporidium parvum
PLSLDALKTLPGWGARQKLE

SEQ ID NO: 2355953 - protein, 26 aa, Cryptosporidium parvum
PMKYVDYYIETLPRPNIDFNQTHKML

SEQ ID NO: 2355954 - protein, 24 aa, Cryptosporidium parvum
PNGNFIAKLFIRFGMKPEQTQIHD

SEQ ID NO: 2355955 - protein, 31 aa, Cryptosporidium parvum; identical to SEQ ID NO: 2195364

SEQ ID NO: 2355956 - protein, 29 aa, Cryptosporidium parvum
PNKPGKIIKTRLLLKAPLSPYELDWCTDA

SEQ ID NO: 2355957 - protein, 24 aa, Cryptosporidium parvum
PNPKYQYLFVGAEPYNTIGIRIPN

SEQ ID NO: 2355958 - protein, 19 aa, Cryptosporidium parvum
PNPSPFNLSLISPGSSSIS

SEQ ID NO: 2355959 - protein, 18 aa, Cryptosporidium parvum
PNRYVSQPPIYYYEQQPS

SEQ ID NO: 2355960 - protein, 25 aa, Cryptosporidium parvum
PNSEKLVFLLSTRAGGLGINLATAD

SEQ ID NO: 2355961 - protein, 23 aa, Cryptosporidium parvum
PNSQLFLSNNYFDDYRFDFINDN

SEQ ID NO: 2355962 - protein, 17 aa, Cryptosporidium parvum
PNSYIEIYISCSSLGQV

SEQ ID NO: 2355963 - protein, 23 aa, Cryptosporidium parvum
PNTKNVMLCTPLHFSASNGFDEI

SEQ ID NO: 2355964 - protein, 22 aa, Cryptosporidium parvum
PNTRWSIKKALFHPDCIQQLLF

SEQ ID NO: 2355965 - protein, 30 aa, Cryptosporidium parvum; identical to SEQ ID NO: 2319921

SEQ ID NO: 2355966 - protein, 26 aa, Cryptosporidium parvum
PPKKEILLYVPLTNMQRRLYKDLLSK

SEQ ID NO: 2355967 - protein, 18 aa, Cryptosporidium parvum
PPPPAKPLGGKPATKIPP

SEQ ID NO: 2355968 - protein, 24 aa, Cryptosporidium parvum
PPSNKPLLMYLSGAKGQLINIAQM

SEQ ID NO: 2355969 - protein, 36 aa, Cryptosporidium parvum
PQANPMLNSFLSNPFMNPFGLQVPPILGQNANLIAQ

SEQ ID NO: 2355970 - protein, 27 aa, Cryptosporidium parvum
PQDLTRTGFIIFWGGRELDSFNIGNNI

SEQ ID NO: 2355971 - protein, 31 aa, Cryptosporidium parvum; identical to SEQ ID NO: 2319961

SEQ ID NO: 2355972 - protein, 24 aa, Cryptosporidium parvum
PQSLKRRFYMQIQFVKYMEKHIGA

SEQ ID NO: 2355973 - protein, 25 aa, Cryptosporidium parvum
PRPQMSSCFLLRIPEDSINGIFDTL

SEQ ID NO: 2355974 - protein, 26 aa, Cryptosporidium parvum
PRSGIRWLCFILGEYGKLISSKVSII

SEQ ID NO: 2355975 - protein, 23 aa, Cryptosporidium parvum
PRSLYIRIVNLTDFDLTLQLPAA

SEQ ID NO: 2355976 - protein, 23 aa, Cryptosporidium parvum
PSAPIQMAFFIISACELSDKKTA

SEQ ID NO: 2355977 - protein, 32 aa, Cryptosporidium parvum; identical to SEQ ID NO: 2319999

SEQ ID NO: 2355978 - protein, 19 aa, Cryptosporidium parvum
PSCRSLRTSIRINRSSTLS

SEQ ID NO: 2355979 - protein, 37 aa, Cryptosporidium parvum; identical to SEQ ID NO: 2195484

SEQ ID NO: 2355980 - protein, 32 aa, Cryptosporidium parvum
PSMQKQLLGERLFPIIAQFQPELAGKITGMML

SEQ ID NO: 2355981 - protein, 19 aa, Cryptosporidium parvum
PSRKNSFFGINRTAERIKI

SEQ ID NO: 2355982 - protein, 36 aa, Cryptosporidium parvum; identical to SEQ ID NO: 2320040

SEQ ID NO: 2355983 - protein, 18 aa, Cryptosporidium parvum
PSYNNDIYFSIKLISIIP

SEQ ID NO: 2355984 - protein, 27 aa, Cryptosporidium parvum
PTMMEQFILDPIWNIYQNIFINFNEEK

SEQ ID NO: 2355985 - protein, 25 aa, Cryptosporidium parvum
PTNHLDILAVTWLENFLKEWDKICV

SEQ ID NO: 2355986 - protein, 19 aa, Cryptosporidium parvum
PTNTYGLPLSMIDDDYKPD

SEQ ID NO: 2355987 - protein, 26 aa, Cryptosporidium parvum
PTSISFQYLMYLSEYLELPLELISKS

SEQ ID NO: 2355988 - protein, 32 aa, Cryptosporidium parvum; identical to SEQ ID NO: 2195528

SEQ ID NO: 2355989 - protein, 25 aa, Cryptosporidium parvum
PYFNNIPLVLKKKETILITGINKKF

SEQ ID NO: 2355990 - protein, 27 aa, Cryptosporidium parvum
QALSDLYRIPIYIFEKVRNSKLNASLL

SEQ ID NO: 2355991 - protein, 27 aa, Cryptosporidium parvum
QAYEANIPFILRYLIDRDLSTGSWVSI

SEQ ID NO: 2355992 - protein, 27 aa, Cryptosporidium parvum
QCCWIWSTYVFLKIIKSFTFCLENINN

SEQ ID NO: 2355993 - protein, 21 aa, Cryptosporidium parvum
QDCIIAFLRKYKEWYNDVVVV

SEQ ID NO: 2355994 - protein, 34 aa, Cryptosporidium parvum; identical to SEQ ID NO: 2195597

SEQ ID NO: 2355995 - protein, 22 aa, Cryptosporidium parvum
QDFVLIGIFVKKGSITILTSNE

SEQ ID NO: 2355996 - protein, 18 aa, Cryptosporidium parvum
QDINLIWSRSRVFELQVA

SEQ ID NO: 2355997 - protein, 24 aa, Cryptosporidium parvum
QDNILALGCIFHQAGNFRYALELY

SEQ ID NO: 2355998 - protein, 22 aa, Cryptosporidium parvum
QDVLSLLSYLVPNSGGDVNCSS

SEQ ID NO: 2355999 - protein, 25 aa, Cryptosporidium parvum
QDYDSFLYFFNQLGINSLRFSDCFM

SEQ ID NO: 2356000 - protein, 22 aa, Cryptosporidium parvum
QESYHNFKFISSSNKKTFDMIS

SEQ ID NO: 2356001 - protein, 24 aa, Cryptosporidium parvum
QEVLKNWFIKLPLEYLEQAVSTLQ

SEQ ID NO: 2356002 - protein, 17 aa, Cryptosporidium parvum
QEYLGGGADPPYSPYCL

SEQ ID NO: 2356003 - protein, 20 aa, Cryptosporidium parvum
QEYLSPVAFSLLLDPVSEVR

SEQ ID NO: 2356004 - protein, 21 aa, Cryptosporidium parvum
QFEIWVTWMEKLSLINDILVS

SEQ ID NO: 2356005 - protein, 37 aa, Cryptosporidium parvum; identical to SEQ ID NO: 2320204

SEQ ID NO: 2356006 - protein, 23 aa, Cryptosporidium parvum
QFHDYLHYIGHSLPFPVKFMSNS

SEQ ID NO: 2356007 - protein, 26 aa, Cryptosporidium parvum
QGEELHLIYYGLLTLNCFTHQTQGES

SEQ ID NO: 2356008 - protein, 29 aa, Cryptosporidium parvum
QGPEWVWPMGHFLMAKYQLLKEKYEKTIS

SEQ ID NO: 2356009 - protein, 23 aa, Cryptosporidium parvum
QGPWYINYVIQRLKEYKGTGFNG

SEQ ID NO: 2356010 - protein, 17 aa, Cryptosporidium parvum
QGQIISSKFLLDSENKA

SEQ ID NO: 2356011 - protein, 19 aa, Cryptosporidium parvum
QGQLLGLEKQLRNDTRQKR

SEQ ID NO: 2356012 - protein, 17 aa, Cryptosporidium parvum
QGQLRRTIRPTLDQFMK

SEQ ID NO: 2356013 - protein, 20 aa, Cryptosporidium parvum
QGVSFRKYTFLKANELNVFG

SEQ ID NO: 2356014 - protein, 30 aa, Cryptosporidium parvum
QGYSSNFIWDLVRSIPIESLNRLYVSWLDG

SEQ ID NO: 2356015 - protein, 20 aa, Cryptosporidium parvum
QHIMVALDMLMRIYNNREFP

SEQ ID NO: 2356016 - protein, 25 aa, Cryptosporidium parvum
QIEDRYLINYTYQYGYGSWDQILSA

SEQ ID NO: 2356017 - protein, 23 aa, Cryptosporidium parvum
QIHQQQLMLLNAIQQQHIKQQQQ

SEQ ID NO: 2356018 - protein, 17 aa, Cryptosporidium parvum
QIRGILLFICDKEIQSS

SEQ ID NO: 2356019 - protein, 22 aa, Cryptosporidium parvum
QKDVIDLYRKVINGIITGFEIA

SEQ ID NO: 2356020 - protein, 18 aa, Cryptosporidium parvum
QKGFGGFGGILRYKVDFQ

SEQ ID NO: 2356021 - protein, 32 aa, Cryptosporidium parvum; identical to SEQ ID NO: 2132981

SEQ ID NO: 2356022 - protein, 24 aa, Cryptosporidium parvum
QKIHPQVIIAGYRMALEEARKALS

SEQ ID NO: 2356023 - protein, 17 aa, Cryptosporidium parvum
QKRILELFVERRALMDE

SEQ ID NO: 2356024 - protein, 31 aa, Cryptosporidium parvum; identical to SEQ ID NO: 2195776

SEQ ID NO: 2356025 - protein, 17 aa, Cryptosporidium parvum
QLALHNGLLVLSKYPIL

SEQ ID NO: 2356026 - protein, 25 aa, Cryptosporidium parvum
QLEENVNILLKLPSIFDLLPQPIED

SEQ ID NO: 2356027 - protein, 27 aa, Cryptosporidium parvum
QLKDFRNQLLLLRRNLAAEFGISNTNS

SEQ ID NO: 2356028 - protein, 24 aa, Cryptosporidium parvum
QLKMRSPAIFSLSFDRPNLKYEVR

SEQ ID NO: 2356029 - protein, 24 aa, Cryptosporidium parvum
QLLEDEYFIVYEKNKQIGQELEEE

SEQ ID NO: 2356030 - protein, 19 aa, Cryptosporidium parvum
QLLLTLVYGNDWVPMAIIE

SEQ ID NO: 2356031 - protein, 18 aa, Cryptosporidium parvum
QLMQAYPQNRFVSKKKCR

SEQ ID NO: 2356032 - protein, 18 aa, Cryptosporidium parvum
QLSRLLIVLFSVYHNFEK

SEQ ID NO: 2356033 - protein, 41 aa, Cryptosporidium parvum
QMCDRFIRDIPRGFFYAYFLNPLILLASDPIRNVRSTWLRV

SEQ ID NO: 2356034 - protein, 23 aa, Cryptosporidium parvum
QMDYFLEEILTPNFIPKIINELD

SEQ ID NO: 2356035 - protein, 29 aa, Cryptosporidium parvum
QNIELLTVIYPFLTPPSYKKVLTPVEVVN

SEQ ID NO: 2356036 - protein, 24 aa, Cryptosporidium parvum
QNLNSIILNMFELLCNLITERNDC

SEQ ID NO: 2356037 - protein, 29 aa, Cryptosporidium parvum
QNNIPIFNNYKFVISPNIKVPSISEISWL

SEQ ID NO: 2356038 - protein, 24 aa, Cryptosporidium parvum
QNQFNFFNHLGYLNHLAGLTITGV

SEQ ID NO: 2356039 - protein, 27 aa, Cryptosporidium parvum
QNSLRELWSLLNFLYPEIFSSSEEFEA

SEQ ID NO: 2356040 - protein, 18 aa, Cryptosporidium parvum
QNTSLILYGLGGNNSKCH

SEQ ID NO: 2356041 - protein, 36 aa, Cryptosporidium parvum; identical to SEQ ID NO: 2320474

SEQ ID NO: 2356042 - protein, 22 aa, Cryptosporidium parvum
QPKGVLLYGPPGTGKTLLARAV

SEQ ID NO: 2356043 - protein, 33 aa, Cryptosporidium parvum; identical to SEQ ID NO: 2320484

SEQ ID NO: 2356044 - protein, 30 aa, Cryptosporidium parvum; identical to SEQ ID NO: 2320487

SEQ ID NO: 2356045 - protein, 25 aa, Cryptosporidium parvum
QQDTLEYFTFLQEKLSDDLKKYYNH

SEQ ID NO: 2356046 - protein, 34 aa, Cryptosporidium parvum; identical to SEQ ID NO: 2195902

SEQ ID NO: 2356047 - protein, 25 aa, Cryptosporidium parvum
QQGLDLLLQLLQYSPESRLTARQAL

SEQ ID NO: 2356048 - protein, 25 aa, Cryptosporidium parvum
QRIEFRIPDSSACPHLAFSAILCAG

SEQ ID NO: 2356049 - protein, 19 aa, Cryptosporidium parvum
QRIVELIPRKSIVFDLTCG

SEQ ID NO: 2356050 - protein, 27 aa, Cryptosporidium parvum
QRNRLLQQQLEAMFKLVNDLSIKLDES

SEQ ID NO: 2356051 - protein, 23 aa, Cryptosporidium parvum
QSDIFDQRLASKILKIVDVSYGG

SEQ ID NO: 2356052 - protein, 21 aa, Cryptosporidium parvum
QSLLYGQFLLNNQNQFGMFVL

SEQ ID NO: 2356053 - protein, 19 aa, Cryptosporidium parvum
QSPKHLQLSLSSRNIKQNQ

SEQ ID NO: 2356054 - protein, 23 aa, Cryptosporidium parvum
QSTAIPPPPLSPPPPPPSSTIKS

SEQ ID NO: 2356055 - protein, 43 aa, Cryptosporidium parvum
QSTPNHYFLINTFVKLNLWWELMVYILRWSFELGPSKSRSLLI

SEQ ID NO: 2356056 - protein, 18 aa, Cryptosporidium parvum
QSVDPIRKFYWKWRADNL

SEQ ID NO: 2356057 - protein, 23 aa, Cryptosporidium parvum
QTGFQFRLQVPMGSILASLRSQD

SEQ ID NO: 2356058 - protein, 18 aa, Cryptosporidium parvum
QTITQLKTRIRRLAMINS

SEQ ID NO: 2356059 - protein, 28 aa, Cryptosporidium parvum
QTKVHSNFYFLFNNYLNFLENQPLKNDL

SEQ ID NO: 2356060 - protein, 20 aa, Cryptosporidium parvum
QTLHLRFSDIEQGKLDILSI

SEQ ID NO: 2356061 - protein, 25 aa, Cryptosporidium parvum
QTPSQTTYGKCGVKYETTQSGKTQI

SEQ ID NO: 2356062 - protein, 24 aa, Cryptosporidium parvum
QTVLDYYQHWLKVSPPHEITVLYS

SEQ ID NO: 2356063 - protein, 18 aa, Cryptosporidium parvum
QVYGRLKNDLKLIQIFER

SEQ ID NO: 2356064 - protein, 17 aa, Cryptosporidium parvum
QWHEILIRNIKQNFIWE

SEQ ID NO: 2356065 - protein, 17 aa, Cryptosporidium parvum
QWIEFPPEKIYANSIVE

SEQ ID NO: 2356066 - protein, 18 aa, Cryptosporidium parvum
QYLLNQCLSFVMSSLENI

SEQ ID NO: 2356067 - protein, 25 aa, Cryptosporidium parvum
RAIETGVEILRRTLNKRENEIRASL

SEQ ID NO: 2356068 - protein, 22 aa, Cryptosporidium parvum
RAKVHKIFTSKLKMIQHEKLKN

SEQ ID NO: 2356069 - protein, 18 aa, Cryptosporidium parvum
RCELMLSINTRKEPSIDQ

SEQ ID NO: 2356070 - protein, 28 aa, Cryptosporidium parvum
RCIEFTSRMFVFIQKVPIISYLGFSQIL

SEQ ID NO: 2356071 - protein, 19 aa, Cryptosporidium parvum
RCIMVCTISPSVTFFQQTY

SEQ ID NO: 2356072 - protein, 19 aa, Cryptosporidium parvum
RCIVEVEMWKRKLKTQEVQ

SEQ ID NO: 2356073 - protein, 22 aa, Cryptosporidium parvum
RCYYLSLEFLLGRAMQNALVNL

SEQ ID NO: 2356074 - protein, 19 aa, Cryptosporidium parvum
RDELIPSCDIISFLDIFLL

SEQ ID NO: 2356075 - protein, 22 aa, Cryptosporidium parvum
RDERKMFRLESSAESWVVKQKE

SEQ ID NO: 2356076 - protein, 17 aa, Cryptosporidium parvum
RDIWDMSPLSLALTREH

SEQ ID NO: 2356077 - protein, 25 aa, Cryptosporidium parvum
RDLAYRLCFLACHIEVVNAIASADD

SEQ ID NO: 2356078 - protein, 23 aa, Cryptosporidium parvum
RDNVNIPPPPYNAIGLNFPCNEG

SEQ ID NO: 2356079 - protein, 25 aa, Cryptosporidium parvum
RDPRRSLLIRSLRFDTPTSLVRREF

SEQ ID NO: 2356080 - protein, 32 aa, Cryptosporidium parvum; identical to SEQ ID NO: 2320727

SEQ ID NO: 2356081 - protein, 24 aa, Cryptosporidium parvum
RDSQINILFFMPHCDRCVFGMIIN

SEQ ID NO: 2356082 - protein, 17 aa, Cryptosporidium parvum
RDYCLRALSPGDKDIWL

SEQ ID NO: 2356083 - protein, 18 aa, Cryptosporidium parvum
REALIASCRARHAAKENR

SEQ ID NO: 2356084 - protein, 34 aa, Cryptosporidium parvum; identical to SEQ ID NO: 2320740

SEQ ID NO: 2356085 - protein, 17 aa, Cryptosporidium parvum
REKWSSSIKIRSLFQFI

SEQ ID NO: 2356086 - protein, 19 aa, Cryptosporidium parvum
RERGITIDIALWQFETPKY

SEQ ID NO: 2356087 - protein, 20 aa, Cryptosporidium parvum
RESKLTRLLQEYLGGGADPP

SEQ ID NO: 2356088 - protein, 29 aa, Cryptosporidium parvum
RESWNRAMSMNLINLKWLLVRSSESIRNK

SEQ ID NO: 2356089 - protein, 20 aa, Cryptosporidium parvum
RFDLRVENLHIFLHEQCEIT

SEQ ID NO: 2356090 - protein, 19 aa, Cryptosporidium parvum
RFFGNMVLSLWDCGGQDIF

SEQ ID NO: 2356091 - protein, 19 aa, Cryptosporidium parvum
RFKIFQPDLEEIFKIADIP

SEQ ID NO: 2356092 - protein, 18 aa, Cryptosporidium parvum
RFNEALRIYLVVKYNQMS

SEQ ID NO: 2356093 - protein, 33 aa, Cryptosporidium parvum
RFQGKSLNVNLLRLYRLICKLDSILNTFFSNKS

SEQ ID NO: 2356094 - protein, 18 aa, Cryptosporidium parvum
RFRTITSAYYRGADGVVL

SEQ ID NO: 2356095 - protein, 17 aa, Cryptosporidium parvum
RFRTITSSYYRGAHGII

SEQ ID NO: 2356096 - protein, 20 aa, Cryptosporidium parvum
RFVLILDRPILQNSEVLLSE

SEQ ID NO: 2356097 - protein, 28 aa, Cryptosporidium parvum
RGEAKRFTLLFHISKMYLAIKTCKEWYR

SEQ ID NO: 2356098 - protein, 24 aa, Cryptosporidium parvum
RGKRCLSIRFKKQKFFTKKMTIRC

SEQ ID NO: 2356099 - protein, 18 aa, Cryptosporidium parvum
RGLYMSHEHWVLPLSHDE

SEQ ID NO: 2356100 - protein, 26 aa, Cryptosporidium parvum
RGPSRCPITLWFDQYNMKVVLEDFDT

SEQ ID NO: 2356101 - protein, 21 aa, Cryptosporidium parvum
RGRPCRIMWCLRDPASRRNND

SEQ ID NO: 2356102 - protein, 30 aa, Cryptosporidium parvum; identical to SEQ ID NO: 2320854

SEQ ID NO: 2356103 - protein, 48 aa, Cryptosporidium parvum; identical to SEQ ID NO: 2320856

SEQ ID NO: 2356104 - protein, 24 aa, Cryptosporidium parvum
RGVPQDFRWKIWNSLLQISSLDDE

SEQ ID NO: 2356105 - protein, 19 aa, Cryptosporidium parvum
RIIRMPVSLEAAFQTRDSM

SEQ ID NO: 2356106 - protein, 17 aa, Cryptosporidium parvum
RILLCLVDIPPSGAIDA

SEQ ID NO: 2356107 - protein, 25 aa, Cryptosporidium parvum
RIRGGAVPPVLRPGAIPPGPPGVHG

SEQ ID NO: 2356108 - protein, 21 aa, Cryptosporidium parvum
RISPNNTIRRKFIVGITETAE

SEQ ID NO: 2356109 - protein, 19 aa, Cryptosporidium parvum
RITCGTWLVYLYELKRCHN

SEQ ID NO: 2356110 - protein, 23 aa, Cryptosporidium parvum
RITIYITLQVVFILENLKNHFSS

SEQ ID NO: 2356111 - protein, 34 aa, Cryptosporidium parvum; identical to SEQ ID NO: 2320957

SEQ ID NO: 2356112 - protein, 20 aa, Cryptosporidium parvum
RKGAIAIYLEPWHVDVVEFI

SEQ ID NO: 2356113 - protein, 23 aa, Cryptosporidium parvum
RKIYDLMISPINDNYFILDLLAQ

SEQ ID NO: 2356114 - protein, 25 aa, Cryptosporidium parvum
RKKLPIINIPKLTRGFPVMGEQSVT

SEQ ID NO: 2356115 - protein, 26 aa, Cryptosporidium parvum
RKKNQKGKWRVKLRNGIAQIANQEIP

SEQ ID NO: 2356116 - protein, 18 aa, Cryptosporidium parvum
RKLVILYGNLSFPSKMIG

SEQ ID NO: 2356117 - protein, 26 aa, Cryptosporidium parvum
RKRIESLQKNYKVRILLCLVDIPPSG

SEQ ID NO: 2356118 - protein, 24 aa, Cryptosporidium parvum
RKSLDRTFYLFFEDSKIPLSKVLG

SEQ ID NO: 2356119 - protein, 39 aa, Cryptosporidium parvum
RKVLQHAFKERLKIILVLNKMDRLILELGFDVKEAYIHI

SEQ ID NO: 2356120 - protein, 27 aa, Cryptosporidium parvum
RLENMKPPPLIILPVYSSQPSEIQSLI

SEQ ID NO: 2356121 - protein, 21 aa, Cryptosporidium parvum
RLETLIFCIQVLALQKTQSIL

SEQ ID NO: 2356122 - protein, 18 aa, Cryptosporidium parvum
RLFQIAIGKGTRAYQNFL

SEQ ID NO: 2356123 - protein, 31 aa, Cryptosporidium parvum; identical to SEQ ID NO: 2321030

SEQ ID NO: 2356124 - protein, 25 aa, Cryptosporidium parvum
RLKNDLKLIQIFERETKSMGTLEII

SEQ ID NO: 2356125 - protein, 17 aa, Cryptosporidium parvum
RLMLENLRLRDSGGIQI

SEQ ID NO: 2356126 - protein, 26 aa, Cryptosporidium parvum
RLQVSLADFRRLCILKGVYPREPKKK

SEQ ID NO: 2356127 - protein, 19 aa, Cryptosporidium parvum
RLSWQQILALGKSTEKIVG

SEQ ID NO: 2356128 - protein, 19 aa, Cryptosporidium parvum
RLVVQLLEISYKLLNEWNA

SEQ ID NO: 2356129 - protein, 34 aa, Cryptosporidium parvum
RLYKEIKNWRFHKIPMFWLQVKLIEILELFPEVI

SEQ ID NO: 2356130 - protein, 25 aa, Cryptosporidium parvum
RMIHRDMILYISFQEEIMSQRNQSE

SEQ ID NO: 2356131 - protein, 25 aa, Cryptosporidium parvum
RMLESIRLFGVFHDSFRNLLKKLEG

SEQ ID NO: 2356132 - protein, 31 aa, Cryptosporidium parvum; identical to SEQ ID NO: 2196422

SEQ ID NO: 2356133 - protein, 29 aa, Cryptosporidium parvum
RNELVQVGLFDLLDQFFSDLWSTGMAYKI

SEQ ID NO: 2356134 - protein, 27 aa, Cryptosporidium parvum
RNEVRSFLLGAAYHWLRRYHIDGLRID

SEQ ID NO: 2356135 - protein, 25 aa, Cryptosporidium parvum
RNIRKVPFPILILHGTNDQVIHISN

SEQ ID NO: 2356136 - protein, 22 aa, Cryptosporidium parvum
RNKGWKLCLDGYAEKFFGSMEF

SEQ ID NO: 2356137 - protein, 23 aa, Cryptosporidium parvum
RNNRNVISLALNWISLSGEHNKK

SEQ ID NO: 2356138 - protein, 32 aa, Cryptosporidium parvum; identical to SEQ ID NO: 2321124

SEQ ID NO: 2356139 - protein, 35 aa, Cryptosporidium parvum
RNSSYSFVLQLAKDLKHIFGFGNPKIFSLNTCPVP

SEQ ID NO: 2356140 - protein, 24 aa, Cryptosporidium parvum
RNSWMHIFSFDSAIPRSNQRETIG

SEQ ID NO: 2356141 - protein, 20 aa, Cryptosporidium parvum
RNTWLSLCLSNKGSLYNFSL

SEQ ID NO: 2356142 - protein, 18 aa, Cryptosporidium parvum
RNVNELNIEYDFCKMVSK

SEQ ID NO: 2356143 - protein, 18 aa, Cryptosporidium parvum
RPIANNEAFFPLPNNFSL

SEQ ID NO: 2356144 - protein, 20 aa, Cryptosporidium parvum
RQIGYRVRYHNSYVGWVALS

SEQ ID NO: 2356145 - protein, 24 aa, Cryptosporidium parvum
RQKSYRCICYISTPIYIHEYHEIS

SEQ ID NO: 2356146 - protein, 28 aa, Cryptosporidium parvum
RQLNTRFRLLLTGTPLQNSLRELWSLLN

SEQ ID NO: 2356147 - protein, 18 aa, Cryptosporidium parvum
RQLRYEVNNLRKKLLETY

SEQ ID NO: 2356148 - protein, 26 aa, Cryptosporidium parvum
RQVYILGWLIHLRILNRIVDNIFIKS

SEQ ID NO: 2356149 - protein, 24 aa, Cryptosporidium parvum
RRAELWVEVFEPKFNKWISVDIHR

SEQ ID NO: 2356150 - protein, 17 aa, Cryptosporidium parvum
RREFERFGAIRDVYLPL

SEQ ID NO: 2356151 - protein, 22 aa, Cryptosporidium parvum
RRIKTILESIKKFNLSNSDPSL

SEQ ID NO: 2356152 - protein, 17 aa, Cryptosporidium parvum
RRKILQGIKDKLKAGGD

SEQ ID NO: 2356153 - protein, 20 aa, Cryptosporidium parvum
RRNTTVPKTPKFATQMRSES

SEQ ID NO: 2356154 - protein, 18 aa, Cryptosporidium parvum
RRQLHDQSHFLPSNSLVN

SEQ ID NO: 2356155 - protein, 19 aa, Cryptosporidium parvum
RRRVCAVGPLVVYAEDNGI

SEQ ID NO: 2356156 - protein, 24 aa, Cryptosporidium parvum
RRSNRKFEFIKCKLINISYAFPSD

SEQ ID NO: 2356157 - protein, 19 aa, Cryptosporidium parvum
RRTIRPTLDQFMKLTHTIK

SEQ ID NO: 2356158 - protein, 19 aa, Cryptosporidium parvum
RSCFSSRNGLWVASAAEDC

SEQ ID NO: 2356159 - protein, 28 aa, Cryptosporidium parvum
RSIEYELLRLIFSKRLPRYIIQTNTNIL

SEQ ID NO: 2356160 - protein, 18 aa, Cryptosporidium parvum
RSILSWSGVIFSLLEGYS

SEQ ID NO: 2356161 - protein, 22 aa, Cryptosporidium parvum
RSSIDCYFYIIDDDGSAFSAAI

SEQ ID NO: 2356162 - protein, 23 aa, Cryptosporidium parvum
RSSLCFELKSLFIAPTREICIQI

SEQ ID NO: 2356163 - protein, 17 aa, Cryptosporidium parvum
RSSVLRRQLHDQSHFLP

SEQ ID NO: 2356164 - protein, 25 aa, Cryptosporidium parvum
RSTRLMISHLFIWRQRNSMFRVSKD

SEQ ID NO: 2356165 - protein, 26 aa, Cryptosporidium parvum
RSVTDAMHYFFKLHPSIITNSPSSPR

SEQ ID NO: 2356166 - protein, 23 aa, Cryptosporidium parvum
RTHLRNMVILPEMVGSVAGVYNG

SEQ ID NO: 2356167 - protein, 18 aa, Cryptosporidium parvum
RTISLGLQDDYIPHSILE

SEQ ID NO: 2356168 - protein, 33 aa, Cryptosporidium parvum; identical to SEQ ID NO: 2321283

SEQ ID NO: 2356169 - protein, 22 aa, Cryptosporidium parvum
RTNLIKLIYQGIQDLFGSISIC

SEQ ID NO: 2356170 - protein, 18 aa, Cryptosporidium parvum
RVIVFFQTKKEAHRCAIL

SEQ ID NO: 2356171 - protein, 26 aa, Cryptosporidium parvum
RVPTCEMLYYSKPFDKLFFSEGTYNS

SEQ ID NO: 2356172 - protein, 17 aa, Cryptosporidium parvum
RVRYHNSYVGWVALSRH

SEQ ID NO: 2356173 - protein, 19 aa, Cryptosporidium parvum
RVTKDEAMQWFQSKYDGII

SEQ ID NO: 2356174 - protein, 26 aa, Cryptosporidium parvum
RYERIFKTIWKLKLTIHKLNSTWIKL

SEQ ID NO: 2356175 - protein, 19 aa, Cryptosporidium parvum
RYFPPDFDPKKLEESKKLL

SEQ ID NO: 2356176 - protein, 24 aa, Cryptosporidium parvum
RYINKLVYIAKPRKLLYIAVDGVA

SEQ ID NO: 2356177 - protein, 27 aa, Cryptosporidium parvum
RYNARDATWFFLNAALDYCVNIPNGYQ

SEQ ID NO: 2356178 - protein, 21 aa, Cryptosporidium parvum
RYRLAMYFYEFLKSIKMLTEK

SEQ ID NO: 2356179 - protein, 27 aa, Cryptosporidium parvum
RYSDLIDLWTILWRNYLNENIHLFYNK

SEQ ID NO: 2356180 - protein, 26 aa, Cryptosporidium parvum
SALLWASRNLGKLYSQSPPPGKTLTP

SEQ ID NO: 2356181 - protein, 21 aa, Cryptosporidium parvum
SAPILSRFDLFFVMIDDPEDV

SEQ ID NO: 2356182 - protein, 17 aa, Cryptosporidium parvum
SCDSSVLCSLVLTVSDL

SEQ ID NO: 2356183 - protein, 20 aa, Cryptosporidium parvum
SCGYNIYHFLKSGSIKVFVN

SEQ ID NO: 2356184 - protein, 20 aa, Cryptosporidium parvum
SCIPYRESKLTRLLQEYLGG

SEQ ID NO: 2356185 - protein, 21 aa, Cryptosporidium parvum
SCLPLRILIKFERKTLKDKDR

SEQ ID NO: 2356186 - protein, 23 aa, Cryptosporidium parvum
SCQICLNYYFPSKAIKQMESNSN

SEQ ID NO: 2356187 - protein, 25 aa, Cryptosporidium parvum
SDDGTIIMWIFSNLSIYNQTNLYTY

SEQ ID NO: 2356188 - protein, 23 aa, Cryptosporidium parvum
SDEKLNLRIYDDIAGKRGLNVDR

SEQ ID NO: 2356189 - protein, 18 aa, Cryptosporidium parvum
SDELEFIRWHPRGPCIFG

SEQ ID NO: 2356190 - protein, 40 aa, Cryptosporidium parvum; identical to SEQ ID NO: 2321464

SEQ ID NO: 2356191 - protein, 30 aa, Cryptosporidium parvum
SDGSNNFKSILYFEFYWMPEWTRNNDRYLF

SEQ ID NO: 2356192 - protein, 23 aa, Cryptosporidium parvum
SDKENEFFLYSSKIHKVNVKDTI

SEQ ID NO: 2356193 - protein, 25 aa, Cryptosporidium parvum
SDLQFVFAQIPLSVSKPLIAIREGL

SEQ ID NO: 2356194 - protein, 25 aa, Cryptosporidium parvum
SDNYEFEFYLFKVSHISFPITLLNT

SEQ ID NO: 2356195 - protein, 24 aa, Cryptosporidium parvum
SDSFKLHRIFPNKVDPLVSLMKVE

SEQ ID NO: 2356196 - protein, 23 aa, Cryptosporidium parvum
SDSILLLFTIFQVFQGEKSKWNK

SEQ ID NO: 2356197 - protein, 17 aa, Cryptosporidium parvum
SECSCINIFAFGSSGTG

SEQ ID NO: 2356198 - protein, 22 aa, Cryptosporidium parvum
SEKFIRNKLVMALEGIDSRISQ

SEQ ID NO: 2356199 - protein, 24 aa, Cryptosporidium parvum
SEKHRVELLYKLEKLRKIQDEYFR

SEQ ID NO: 2356200 - protein, 20 aa, Cryptosporidium parvum
SELIFICVKPHILSQILSEI

SEQ ID NO: 2356201 - protein, 24 aa, Cryptosporidium parvum
SENFLIRNTLHPRSDLVMMSTLTE

SEQ ID NO: 2356202 - protein, 24 aa, Cryptosporidium parvum
SEQAKQLIRRLLTVDPSQRMTLSE

SEQ ID NO: 2356203 - protein, 22 aa, Cryptosporidium parvum
SESYTSFILARSLNPIKYTHEN

SEQ ID NO: 2356204 - protein, 21 aa, Cryptosporidium parvum
SEVLSILRYLSNFDTFSTSLD

SEQ ID NO: 2356205 - protein, 18 aa, Cryptosporidium parvum
SFFGINRTAERIKIPSDG

SEQ ID NO: 2356206 - protein, 25 aa, Cryptosporidium parvum
SFFGNYINFASMKYVFEQYFAKFDY

SEQ ID NO: 2356207 - protein, 21 aa, Cryptosporidium parvum
SFLEIFKRANYKCILKMEQTF

SEQ ID NO: 2356208 - protein, 23 aa, Cryptosporidium parvum
SFRNTMNHFFFYCFSKDPNPKKD

SEQ ID NO: 2356209 - protein, 18 aa, Cryptosporidium parvum
SFTSKPLREVYVGNLPQG

SEQ ID NO: 2356210 - protein, 23 aa, Cryptosporidium parvum
SFYQDFCFSLQETLFAMLIEVTE

SEQ ID NO: 2356211 - protein, 25 aa, Cryptosporidium parvum
SGDTFYLVMDLVEGGELFYKIVEHG

SEQ ID NO: 2356212 - protein, 24 aa, Cryptosporidium parvum
SGGTTVIRKALNLSIHRLNNSISN

SEQ ID NO: 2356213 - protein, 28 aa, Cryptosporidium parvum
SGIRLRLEWDRRRYCFKFTVYQIEEVRD

SEQ ID NO: 2356214 - protein, 27 aa, Cryptosporidium parvum
SGLDEKIRVIKYLWETKRDFNIHEVFD

SEQ ID NO: 2356215 - protein, 17 aa, Cryptosporidium parvum
SGLFWGIGSMKLLFNNL

SEQ ID NO: 2356216 - protein, 20 aa, Cryptosporidium parvum
SGMHINISLWKNEKNIFFDP

SEQ ID NO: 2356217 - protein, 33 aa, Cryptosporidium parvum; identical to SEQ ID NO: 2321720

SEQ ID NO: 2356218 - protein, 26 aa, Cryptosporidium parvum
SGSILGEIFTFEFLKEFYGVLDFGSV

SEQ ID NO: 2356219 - protein, 24 aa, Cryptosporidium parvum
SGVGKSCLLLRFADDTYTDSYIST

SEQ ID NO: 2356220 - protein, 24 aa, Cryptosporidium parvum
SGVSRGFGFVSFLSPDEATKAITE

SEQ ID NO: 2356221 - protein, 27 aa, Cryptosporidium parvum
SGYAGKVLFGWDFPAGFTPSLSCKGFH

SEQ ID NO: 2356222 - protein, 33 aa, Cryptosporidium parvum; identical to SEQ ID NO: 2321748

SEQ ID NO: 2356223 - protein, 17 aa, Cryptosporidium parvum
SHLRFFGNMVLSLWDCG

SEQ ID NO: 2356224 - protein, 25 aa, Cryptosporidium parvum
SIAKYSYHILICIINIIEDKSFQLD

SEQ ID NO: 2356225 - protein, 25 aa, Cryptosporidium parvum
SICQGTWLYYENPVAHFTKYKQNNS

SEQ ID NO: 2356226 - protein, 22 aa, Cryptosporidium parvum
SIEYPLVISWGETYKIYLGNVF

SEQ ID NO: 2356227 - protein, 22 aa, Cryptosporidium parvum
SIHFQDLLEIYSKYFIQKTRPR

SEQ ID NO: 2356228 - protein, 24 aa, Cryptosporidium parvum
SIIARFHRILRPFMLRRVKSEVEI

SEQ ID NO: 2356229 - protein, 23 aa, Cryptosporidium parvum
SIKSKIDFFKGKRVAIDTYGWLH

SEQ ID NO: 2356230 - protein, 22 aa, Cryptosporidium parvum
SILIIDVQPLLHASPLLFNLFE

SEQ ID NO: 2356231 - protein, 20 aa, Cryptosporidium parvum
SILQWLKEYLNNFSQTSICS

SEQ ID NO: 2356232 - protein, 26 aa, Cryptosporidium parvum
SIMNSMDSFRFFYINKSNYAIRRSNR

SEQ ID NO: 2356233 - protein, 17 aa, Cryptosporidium parvum
SINLPKFQKHQFENPIE

SEQ ID NO: 2356234 - protein, 17 aa, Cryptosporidium parvum
SIPLYLYGDLEPFIESK

SEQ ID NO: 2356235 - protein, 20 aa, Cryptosporidium parvum
SIPNNWKFQATVARKQLRQF

SEQ ID NO: 2356236 - protein, 19 aa, Cryptosporidium parvum
SIQLELLEIIILDEADRLL

SEQ ID NO: 2356237 - protein, 26 aa, Cryptosporidium parvum
SIQVTPKWVYDVVLDFTIIKPTSKRN

SEQ ID NO: 2356238 - protein, 19 aa, Cryptosporidium parvum
SISTNVPIFVLQKDDPNKK

SEQ ID NO: 2356239 - protein, 34 aa, Cryptosporidium parvum; identical to SEQ ID NO: 2197108

SEQ ID NO: 2356240 - protein, 18 aa, Cryptosporidium parvum
SKGYCFLCYEDQKSTILA

SEQ ID NO: 2356241 - protein, 23 aa, Cryptosporidium parvum
SKHAKLYHEKYKDLFMQMNQSLE

SEQ ID NO: 2356242 - protein, 27 aa, Cryptosporidium parvum
SKKEGLFNFLFLFQKLNGRPTENENLE

SEQ ID NO: 2356243 - protein, 30 aa, Cryptosporidium parvum
SKKVGFFEVWLLLSLWKRYPARIYRHMMKT

SEQ ID NO: 2356244 - protein, 18 aa, Cryptosporidium parvum
SKNKWLPIQTIPFNFDSS

SEQ ID NO: 2356245 - protein, 23 aa, Cryptosporidium parvum
SKNKYINYRDSKITRILSDSLGG

SEQ ID NO: 2356246 - protein, 17 aa, Cryptosporidium parvum
SKNLIVNKLGVSRLDKL

SEQ ID NO: 2356247 - protein, 29 aa, Cryptosporidium parvum
SKQQEIIKRLLRLSSYPFSKLGLLESIPE

SEQ ID NO: 2356248 - protein, 34 aa, Cryptosporidium parvum; identical to SEQ ID NO: 2321975

SEQ ID NO: 2356249 - protein, 19 aa, Cryptosporidium parvum
SKVLLPDLPVPLSYNKSSG

SEQ ID NO: 2356250 - protein, 22 aa, Cryptosporidium parvum
SKYKKFLAIKDPSKQIYGPKML

SEQ ID NO: 2356251 - protein, 25 aa, Cryptosporidium parvum
SLAALNHLAPFIKTLQPISEFGGIS

SEQ ID NO: 2356252 - protein, 30 aa, Cryptosporidium parvum
SLASTRDLLLDFLFLPASICNVPPTGVESL

SEQ ID NO: 2356253 - protein, 21 aa, Cryptosporidium parvum
SLCFQLPGLLKYNNPASVTVV

SEQ ID NO: 2356254 - protein, 30 aa, Cryptosporidium parvum
SLENTFDFNGILLKASFLGKTDIIKSCLDN

SEQ ID NO: 2356255 - protein, 22 aa, Cryptosporidium parvum
SLEPFFMWQISILGNCHTPTLS

SEQ ID NO: 2356256 - protein, 27 aa, Cryptosporidium parvum
SLEYMRFSTLFLKKLIIGPIQVKCNDS

SEQ ID NO: 2356257 - protein, 25 aa, Cryptosporidium parvum
SLGYQKKRLIPIDQDELFVNVNASK

SEQ ID NO: 2356258 - protein, 31 aa, Cryptosporidium parvum; identical to SEQ ID NO: 2247675

SEQ ID NO: 2356259 - protein, 18 aa, Cryptosporidium parvum
SLKPQLSIFGRPSPVDEE

SEQ ID NO: 2356260 - protein, 18 aa, Cryptosporidium parvum
SLLAYLREYRDIKGLHLV

SEQ ID NO: 2356261 - protein, 17 aa, Cryptosporidium parvum
SLLPINGVPIINYIIEM

SEQ ID NO: 2356262 - protein, 21 aa, Cryptosporidium parvum
SLPEDLLFYVLSMLVTPVVYE

SEQ ID NO: 2356263 - protein, 20 aa, Cryptosporidium parvum
SLRPFPDNLDWCDSTFSFVV

SEQ ID NO: 2356264 - protein, 18 aa, Cryptosporidium parvum
SLSDLCVPPTLLYKENSL

SEQ ID NO: 2356265 - protein, 29 aa, Cryptosporidium parvum
SLSKSLKTGLIRFPVEIIKDEFESLINPE

SEQ ID NO: 2356266 - protein, 17 aa, Cryptosporidium parvum
SMHGKGTYIFPCGNVYE

SEQ ID NO: 2356267 - protein, 19 aa, Cryptosporidium parvum
SMRSIIFANYLPKDTSRLT

SEQ ID NO: 2356268 - protein, 26 aa, Cryptosporidium parvum
SNDLNPYLQQTLNKLPVALNPNLPYL

SEQ ID NO: 2356269 - protein, 27 aa, Cryptosporidium parvum
SNFDWRSSYLPHIYSATLGLKNGFIDP

SEQ ID NO: 2356270 - protein, 17 aa, Cryptosporidium parvum
SNHGLLLGASSSSKVLG

SEQ ID NO: 2356271 - protein, 22 aa, Cryptosporidium parvum
SNIPSIISKLEGLQIEFDSLNN

SEQ ID NO: 2356272 - protein, 24 aa, Cryptosporidium parvum
SNISGCLFCQRLQHCCICDFSRRT

SEQ ID NO: 2356273 - protein, 25 aa, Cryptosporidium parvum
SNISKAFGIPPRFSESLIMNTNEGK

SEQ ID NO: 2356274 - protein, 26 aa, Cryptosporidium parvum
SNITLYIEYLYYIRGDVRKLPIYQKN

SEQ ID NO: 2356275 - protein, 24 aa, Cryptosporidium parvum
SNIYKAELGLNLHQLYNGRIPAAP

SEQ ID NO: 2356276 - protein, 30 aa, Cryptosporidium parvum; identical to SEQ ID NO: 2322199

SEQ ID NO: 2356277 - protein, 26 aa, Cryptosporidium parvum
SNLRLPPKVPGISSNNAFKFNISQPA

SEQ ID NO: 2356278 - protein, 26 aa, Cryptosporidium parvum
SNNKKYYEYYIAGKKVEDFITSKISD

SEQ ID NO: 2356279 - protein, 32 aa, Cryptosporidium parvum
SNNPNPPLSSLQKFFALLISSRPIANNEAFFP

SEQ ID NO: 2356280 - protein, 22 aa, Cryptosporidium parvum
SNNQEFVIFFPGVNLSINRFVL

SEQ ID NO: 2356281 - protein, 27 aa, Cryptosporidium parvum
SNPEEPFLLISSVLPNIFPSISHRPLP

SEQ ID NO: 2356282 - protein, 25 aa, Cryptosporidium parvum
SNPVVTLCNHYFCEKCAFSHYTNTS

SEQ ID NO: 2356283 - protein, 20 aa, Cryptosporidium parvum
SNQALYFIGGILSHAKAIMA

SEQ ID NO: 2356284 - protein, 24 aa, Cryptosporidium parvum
SNQETLISLPILQGAKPLKRLSCP

SEQ ID NO: 2356285 - protein, 31 aa, Cryptosporidium parvum; identical to SEQ ID NO: 2197412

SEQ ID NO: 2356286 - protein, 25 aa, Cryptosporidium parvum
SNQKYINIIKGLKFIGSIFKMRKKN

SEQ ID NO: 2356287 - protein, 18 aa, Cryptosporidium parvum
SNQRKLFQEKSEYDYFSG

SEQ ID NO: 2356288 - protein, 26 aa, Cryptosporidium parvum
SNREEFLCYYIIYVTLQNMKADLIRV

SEQ ID NO: 2356289 - protein, 23 aa, Cryptosporidium parvum
SNRSKILNWFRDQKPIWDEEDYF

SEQ ID NO: 2356290 - protein, 22 aa, Cryptosporidium parvum
SNWKQTSLGLLKSPINGLSRSS

SEQ ID NO: 2356291 - protein, 29 aa, Cryptosporidium parvum
SPEIDEKFLFYLFSNFGKILSLKIVGNDQ

SEQ ID NO: 2356292 - protein, 19 aa, Cryptosporidium parvum
SPFGRINRLCLSPSKTIAI

SEQ ID NO: 2356293 - protein, 25 aa, Cryptosporidium parvum
SPHYSVRLPIAASMSLILATALSCG

SEQ ID NO: 2356294 - protein, 26 aa, Cryptosporidium parvum
SPKRVEILLAEPSFNNLLTRLVNTVN

SEQ ID NO: 2356295 - protein, 19 aa, Cryptosporidium parvum
SPLPYLPPHSTRPKETIRI

SEQ ID NO: 2356296 - protein, 18 aa, Cryptosporidium parvum
SPPELFKRNFGSKELDRD

SEQ ID NO: 2356297 - protein, 32 aa, Cryptosporidium parvum
SPPGTPTLTILFLILTLCKLYSTLTNLNRSGC

SEQ ID NO: 2356298 - protein, 23 aa, Cryptosporidium parvum
SQIRRVKFQPTLSPIAQSPLSEN

SEQ ID NO: 2356299 - protein, 23 aa, Cryptosporidium parvum
SQRDVFVMMPTGGGKSLCFQLPG

SEQ ID NO: 2356300 - protein, 17 aa, Cryptosporidium parvum
SQSQKEWNHIYALQNYI

SEQ ID NO: 2356301 - protein, 34 aa, Cryptosporidium parvum; identical to SEQ ID NO: 2197543

SEQ ID NO: 2356302 - protein, 25 aa, Cryptosporidium parvum
SRFGKFIEIYFDATGKLRGASISNY

SEQ ID NO: 2356303 - protein, 18 aa, Cryptosporidium parvum
SRFYIKFEKNSLILLLTS

SEQ ID NO: 2356304 - protein, 22 aa, Cryptosporidium parvum
SRGIERLFPIQAQSFESIYGKK

SEQ ID NO: 2356305 - protein, 19 aa, Cryptosporidium parvum
SRIKYLERLPILEEVRKDP

SEQ ID NO: 2356306 - protein, 22 aa, Cryptosporidium parvum
SRINMLNILVATPGRLIQHMDE

SEQ ID NO: 2356307 - protein, 19 aa, Cryptosporidium parvum
SRLLKLELLDDFELEKIIH

SEQ ID NO: 2356308 - protein, 28 aa, Cryptosporidium parvum
SRNSIQSILNLKAPRRPSLLVQQRNYSE

SEQ ID NO: 2356309 - protein, 27 aa, Cryptosporidium parvum
SRREGLKTILTFLSKRGYPNQINPKTL

SEQ ID NO: 2356310 - protein, 24 aa, Cryptosporidium parvum
SRSKKITIPSYILKKMNLSNISEN

SEQ ID NO: 2356311 - protein, 21 aa, Cryptosporidium parvum
SSAFYLEKYLSLVNEVYGSGD

SEQ ID NO: 2356312 - protein, 32 aa, Cryptosporidium parvum; identical to SEQ ID NO: 2322435

SEQ ID NO: 2356313 - protein, 27 aa, Cryptosporidium parvum
SSFQDKILRLLLPLFDTGSRDKYDQEN

SEQ ID NO: 2356314 - protein, 24 aa, Cryptosporidium parvum
SSGKWATLPPIRILSFDIECITES

SEQ ID NO: 2356315 - protein, 25 aa, Cryptosporidium parvum
SSIDKKTWNLLYISGNSAVNAFIDN

SEQ ID NO: 2356316 - protein, 28 aa, Cryptosporidium parvum
SSIKRTLKFLWAISKGLPIISPSTLRNI

SEQ ID NO: 2356317 - protein, 30 aa, Cryptosporidium parvum; identical to SEQ ID NO: 2197630

SEQ ID NO: 2356318 - protein, 18 aa, Cryptosporidium parvum
SSKLLTIEKDHFANLALK

SEQ ID NO: 2356319 - protein, 27 aa, Cryptosporidium parvum
SSNIDWNKRISSRLFQIAIGKGTRAYQ

SEQ ID NO: 2356320 - protein, 32 aa, Cryptosporidium parvum; identical to SEQ ID NO: 2197659

SEQ ID NO: 2356321 - protein, 29 aa, Cryptosporidium parvum
SSNSNFEKKIVWSAKYFGGNIHIQLNHQS

SEQ ID NO: 2356322 - protein, 29 aa, Cryptosporidium parvum
SSPLQSPPLLVLTPSTPIPIVPTTISHQA

SEQ ID NO: 2356323 - protein, 18 aa, Cryptosporidium parvum
SSQCPIIFSCRMAIVNNS

SEQ ID NO: 2356324 - protein, 20 aa, Cryptosporidium parvum
SSRIIIKNLPSYLSEKRLKD

SEQ ID NO: 2356325 - protein, 22 aa, Cryptosporidium parvum
SSSFCLPNWFSSSKISKESYFK

SEQ ID NO: 2356326 - protein, 29 aa, Cryptosporidium parvum
SSSLQMDLINKTLNFWFNNRKSRRECLTE

SEQ ID NO: 2356327 - protein, 19 aa, Cryptosporidium parvum
STCFQEYLSDLLSITEKSK

SEQ ID NO: 2356328 - protein, 19 aa, Cryptosporidium parvum
STDIDICINWILTNIDSIN

SEQ ID NO: 2356329 - protein, 26 aa, Cryptosporidium parvum
STEKLLEEFPKLHDLFQAVMSYPLIT

SEQ ID NO: 2356330 - protein, 19 aa, Cryptosporidium parvum
STFLWKWMSDYCKSIANIF

SEQ ID NO: 2356331 - protein, 20 aa, Cryptosporidium parvum
STHFTFKDKLLARVSTNNNN

SEQ ID NO: 2356332 - protein, 25 aa, Cryptosporidium parvum
STSVPPPAPPAPPAPPAPPAPPAPP

SEQ ID NO: 2356333 - protein, 24 aa, Cryptosporidium parvum
STTFTTLPLVAVPTPRKASEKEKL

SEQ ID NO: 2356334 - protein, 24 aa, Cryptosporidium parvum
STVENLKLLSPKSHLFCLVHKMDK

SEQ ID NO: 2356335 - protein, 27 aa, Cryptosporidium parvum
STVEYLSNFILELCIDDILTSLDTSIH

SEQ ID NO: 2356336 - protein, 32 aa, Cryptosporidium parvum; identical to SEQ ID NO: 2322648

SEQ ID NO: 2356337 - protein, 26 aa, Cryptosporidium parvum
SVASKFGIPIIADGGIRYSGDIGKAL

SEQ ID NO: 2356338 - protein, 25 aa, Cryptosporidium parvum
SVDLGRWTIIQKLSFFFNKFRVVDE

SEQ ID NO: 2356339 - protein, 26 aa, Cryptosporidium parvum
SVEQMSYLMHLQLLSLSDSPEKLLET

SEQ ID NO: 2356340 - protein, 24 aa, Cryptosporidium parvum
SVYVDGWPHIILTSIPGVGIKLGD

SEQ ID NO: 2356341 - protein, 23 aa, Cryptosporidium parvum
SYEMALRFYQVNIIGNFGNDSKS

SEQ ID NO: 2356342 - protein, 17 aa, Cryptosporidium parvum
SYIYISGLDLRLTEGDI

SEQ ID NO: 2356343 - protein, 20 aa, Cryptosporidium parvum
SYLGFSQILKFILNYCKKCF

SEQ ID NO: 2356344 - protein, 20 aa, Cryptosporidium parvum
SYLQTYPMNYWASNGNIWCN

SEQ ID NO: 2356345 - protein, 22 aa, Cryptosporidium parvum
SYSFEKTSLVPGKLFCLVENFI

SEQ ID NO: 2356346 - protein, 27 aa, Cryptosporidium parvum
SYSSRSHLIFMLQLQQKNVFDSSIKVG

SEQ ID NO: 2356347 - protein, 26 aa, Cryptosporidium parvum
SYVPSSPLIWNSKIPSISAGLPHFST

SEQ ID NO: 2356348 - protein, 23 aa, Cryptosporidium parvum
TAEWQVFDTDKWCKVPISDPPSS

SEQ ID NO: 2356349 - protein, 31 aa, Cryptosporidium parvum
TAFKGFQKRFFKLNLTDNALLYWREEPTFPD

SEQ ID NO: 2356350 - protein, 19 aa, Cryptosporidium parvum
TAIMVIFPSILMNLIIIDK

SEQ ID NO: 2356351 - protein, 21 aa, Cryptosporidium parvum
TANEIQKILSIPVFVNPDLCE

SEQ ID NO: 2356352 - protein, 24 aa, Cryptosporidium parvum
TAVMALRRAKYKFPGRQKVVVSDK

SEQ ID NO: 2356353 - protein, 18 aa, Cryptosporidium parvum
TCFIKLPSKLDDGGYFTC

SEQ ID NO: 2356354 - protein, 18 aa, Cryptosporidium parvum
TCLCSDKSLKLFRIDSDF

SEQ ID NO: 2356355 - protein, 23 aa, Cryptosporidium parvum
TCSVERLNLLRLAPGGTFGRLTI

SEQ ID NO: 2356356 - protein, 24 aa, Cryptosporidium parvum
TDIQIPNITIFISGRALLSDASLN

SEQ ID NO: 2356357 - protein, 24 aa, Cryptosporidium parvum
TDLKSHIMLLTDIPSYISYLDITK

SEQ ID NO: 2356358 - protein, 30 aa, Cryptosporidium parvum; identical to SEQ ID NO: 2322829

SEQ ID NO: 2356359 - protein, 27 aa, Cryptosporidium parvum
TDQGLSLYLSFWCFSAAAALSSLVSAG

SEQ ID NO: 2356360 - protein, 25 aa, Cryptosporidium parvum
TDSALSLFLLRLRNLEFLEIIDCNS

SEQ ID NO: 2356361 - protein, 20 aa, Cryptosporidium parvum
TDTLFGLWKIASIEEWVDLI

SEQ ID NO: 2356362 - protein, 27 aa, Cryptosporidium parvum
TDYSTKLPLWHLFSSLCWQGYHNQQEC

SEQ ID NO: 2356363 - protein, 29 aa, Cryptosporidium parvum
TEAKKDEPVPWWLANVDKPNLVEVDNEGV

SEQ ID NO: 2356364 - protein, 23 aa, Cryptosporidium parvum
TEFDVCHSLLQKIKTRDEDLSST

SEQ ID NO: 2356365 - protein, 25 aa, Cryptosporidium parvum
TEHFKKYASLMLLLSDILRCMKRQK

SEQ ID NO: 2356366 - protein, 26 aa, Cryptosporidium parvum
TENRIAFDFIIDEVFLRGTIYDYMRQ

SEQ ID NO: 2356367 - protein, 18 aa, Cryptosporidium parvum
TFDPYNTLFIARLNYDTT

SEQ ID NO: 2356368 - protein, 17 aa, Cryptosporidium parvum
TFERIIKPIAEKFPYLI

SEQ ID NO: 2356369 - protein, 18 aa, Cryptosporidium parvum
TFFQQTYATLNTPSYGNN

SEQ ID NO: 2356370 - protein, 21 aa, Cryptosporidium parvum
TFGEKIIICGISMGGAIALRL

SEQ ID NO: 2356371 - protein, 33 aa, Cryptosporidium parvum
TFHLSNQFTPLSLLDIPLVWRDKSFGHKNNHIN

SEQ ID NO: 2356372 - protein, 32 aa, Cryptosporidium parvum
TFSDSSERLIPPRMSPLLRSQRQRLKQILQEE

SEQ ID NO: 2356373 - protein, 32 aa, Cryptosporidium parvum; identical to SEQ ID NO: 2322906

SEQ ID NO: 2356374 - protein, 26 aa, Cryptosporidium parvum
TGEGVPDLIYLIAQLTQNYMGLHCLQ

SEQ ID NO: 2356375 - protein, 23 aa, Cryptosporidium parvum
TGKTLCLLASTLAFQKHFLISHG

SEQ ID NO: 2356376 - protein, 20 aa, Cryptosporidium parvum
TGLIANLHRMGINNSIVVNM

SEQ ID NO: 2356377 - protein, 34 aa, Cryptosporidium parvum; identical to SEQ ID NO: 2322928

SEQ ID NO: 2356378 - protein, 18 aa, Cryptosporidium parvum
TGMPASGALLPHIPSLGN

SEQ ID NO: 2356379 - protein, 23 aa, Cryptosporidium parvum
TGTTFMALVSFFTSLWNRSSLTC

SEQ ID NO: 2356380 - protein, 31 aa, Cryptosporidium parvum; identical to SEQ ID NO: 2322951

SEQ ID NO: 2356381 - protein, 17 aa, Cryptosporidium parvum
TIDGLLGMVKYCEEQYK

SEQ ID NO: 2356382 - protein, 28 aa, Cryptosporidium parvum
TIHKLASFYVRDILKFILNEESISNDKL

SEQ ID NO: 2356383 - protein, 27 aa, Cryptosporidium parvum
TILGVQARLLPLFSFVSRYSTINESYK

SEQ ID NO: 2356384 - protein, 21 aa, Cryptosporidium parvum
TISPSVTFFQQTYATLNTPSY

SEQ ID NO: 2356385 - protein, 22 aa, Cryptosporidium parvum
TKAFRFIEISVLTSSLGFESNF

SEQ ID NO: 2356386 - protein, 35 aa, Cryptosporidium parvum; identical to SEQ ID NO: 2323029

SEQ ID NO: 2356387 - protein, 24 aa, Cryptosporidium parvum
TKEEQMYHVLVYKTQLCREYPLCT

SEQ ID NO: 2356388 - protein, 26 aa, Cryptosporidium parvum
TKERTFYLDHIFPMDTNQSYVYKTAA

SEQ ID NO: 2356389 - protein, 20 aa, Cryptosporidium parvum
TKHYCPFAHGLDELRNPETI

SEQ ID NO: 2356390 - protein, 22 aa, Cryptosporidium parvum
TKITYICIALNYIRGKTLDNIP

SEQ ID NO: 2356391 - protein, 35 aa, Cryptosporidium parvum; identical to SEQ ID NO: 2323047

SEQ ID NO: 2356392 - protein, 29 aa, Cryptosporidium parvum
TKNRKRNIDYSLLSRKGPMSAPDKSFESL

SEQ ID NO: 2356393 - protein, 20 aa, Cryptosporidium parvum
TKRESYFYSNTLRNVNKGCE

SEQ ID NO: 2356394 - protein, 31 aa, Cryptosporidium parvum
TKTIENISKLKPIFAKLAPPNIVKGIQGGGG

SEQ ID NO: 2356395 - protein, 19 aa, Cryptosporidium parvum
TLEDLSLFDPFPSTQGRSV

SEQ ID NO: 2356396 - protein, 32 aa, Cryptosporidium parvum; identical to SEQ ID NO: 2323077

SEQ ID NO: 2356397 - protein, 27 aa, Cryptosporidium parvum
TLEQQISPLFQFRAKLYFEGNTWKVDE

SEQ ID NO: 2356398 - protein, 25 aa, Cryptosporidium parvum
TLIDKNFNWVPFSRAPPSEVESLPQ

SEQ ID NO: 2356399 - protein, 19 aa, Cryptosporidium parvum
TLLCIIQRVSLLWENKDFE

SEQ ID NO: 2356400 - protein, 22 aa, Cryptosporidium parvum
TLLGVPMSITVLPPIQIQKSEQ

SEQ ID NO: 2356401 - protein, 26 aa, Cryptosporidium parvum
TLLRLNNLLSFKGNLLRIGKPKVSEN

SEQ ID NO: 2356402 - protein, 35 aa, Cryptosporidium parvum; identical to SEQ ID NO: 2323107

SEQ ID NO: 2356403 - protein, 32 aa, Cryptosporidium parvum; identical to SEQ ID NO: 2198172

SEQ ID NO: 2356404 - protein, 20 aa, Cryptosporidium parvum
TLPTISPGLERIDIPIILGK

SEQ ID NO: 2356405 - protein, 24 aa, Cryptosporidium parvum
TLQTPGLFDAKLINFTGSTNSSTA

SEQ ID NO: 2356406 - protein, 37 aa, Cryptosporidium parvum
TLSPNGVFWLARRLFRKPVNTLLPGTYLPLNDDSGLD

SEQ ID NO: 2356407 - protein, 27 aa, Cryptosporidium parvum
TLVLVEAIRVLLGLLYSGSPDSEYSAA

SEQ ID NO: 2356408 - protein, 22 aa, Cryptosporidium parvum
TMDFHVLVDILFREMVIMRDSG

SEQ ID NO: 2356409 - protein, 19 aa, Cryptosporidium parvum
TMLSLPPFSKTERKKLPII

SEQ ID NO: 2356410 - protein, 21 aa, Cryptosporidium parvum
TMLYEIFNSVAVVSSVRICRD

SEQ ID NO: 2356411 - protein, 21 aa, Cryptosporidium parvum
TMNVYFQTQLLKKGLQNVVVS

SEQ ID NO: 2356412 - protein, 24 aa, Cryptosporidium parvum
TMPAPVTDIKFSPSGKLLAYSLSY

SEQ ID NO: 2356413 - protein, 18 aa, Cryptosporidium parvum
TMPELWKNPFYWTEIFSI

SEQ ID NO: 2356414 - protein, 23 aa, Cryptosporidium parvum
TNELILVYFKFGHETRLYKKTMN

SEQ ID NO: 2356415 - protein, 19 aa, Cryptosporidium parvum
TNFNIIPLEKMNYQEILNN

SEQ ID NO: 2356416 - protein, 23 aa, Cryptosporidium parvum
TNHPFVLHLKQGPWYINYVIQRL

SEQ ID NO: 2356417 - protein, 25 aa, Cryptosporidium parvum
TNIPSYNPIVMIKALLVLKSIIKDE

SEQ ID NO: 2356418 - protein, 23 aa, Cryptosporidium parvum
TNNLNLIAIEKVICDLNAFYKSE

SEQ ID NO: 2356419 - protein, 22 aa, Cryptosporidium parvum
TNSGDLILWGYGGCGQLGFGNL

SEQ ID NO: 2356420 - protein, 24 aa, Cryptosporidium parvum
TNSVPPPVFAAYYEGGDNENNNLF

SEQ ID NO: 2356421 - protein, 28 aa, Cryptosporidium parvum
TNTHIRKLLSECGTILRWSRQEDPTTKK

SEQ ID NO: 2356422 - protein, 29 aa, Cryptosporidium parvum
TNTNPNFQNMPIPYPPKAPLSDCNNSDSE

SEQ ID NO: 2356423 - protein, 25 aa, Cryptosporidium parvum
TNVNACMDISGYVSDLSLKNVTTGT

SEQ ID NO: 2356424 - protein, 26 aa, Cryptosporidium parvum
TNVVVDRRQLFDRFLIYYNRNKSGKI

SEQ ID NO: 2356425 - protein, 20 aa, Cryptosporidium parvum
TPAAKTILVRTYKALRMGDA

SEQ ID NO: 2356426 - protein, 17 aa, Cryptosporidium parvum
TPDYRILNLGGIPPRKE

SEQ ID NO: 2356427 - protein, 18 aa, Cryptosporidium parvum
TPEYEPHPIYTCLANRAR

SEQ ID NO: 2356428 - protein, 21 aa, Cryptosporidium parvum
TPSHIMPLNVALANLLEDYSI

SEQ ID NO: 2356429 - protein, 25 aa, Cryptosporidium parvum
TPSKEYLVSNIFLYRSCISDSHRVE

SEQ ID NO: 2356430 - protein, 21 aa, Cryptosporidium parvum
TQHHFIPMYVELCDKLRDHLK

SEQ ID NO: 2356431 - protein, 17 aa, Cryptosporidium parvum
TQILKAINYLHEMSIVH

SEQ ID NO: 2356432 - protein, 17 aa, Cryptosporidium parvum
TREHALLAFTLGVRQMI

SEQ ID NO: 2356433 - protein, 24 aa, Cryptosporidium parvum
TREKGLRKIFLKMAKYGMDNTSIL

SEQ ID NO: 2356434 - protein, 23 aa, Cryptosporidium parvum
TRNIHFFKFIVDGEWRYSPEYPI

SEQ ID NO: 2356435 - protein, 21 aa, Cryptosporidium parvum
TRQTMLFSATLSRSVTDLALL

SEQ ID NO: 2356436 - protein, 24 aa, Cryptosporidium parvum
TSDSKLRISIQRLLAGMTFELDSE

SEQ ID NO: 2356437 - protein, 24 aa, Cryptosporidium parvum
TSESKASLRKFLESTIMDSGEDSI

SEQ ID NO: 2356438 - protein, 26 aa, Cryptosporidium parvum
TSFDISLFLIVWKNYVTLITRKEYRN

SEQ ID NO: 2356439 - protein, 21 aa, Cryptosporidium parvum
TSIHFGINLYVLTVGYRNIKD

SEQ ID NO: 2356440 - protein, 24 aa, Cryptosporidium parvum
TSISKLFVKPIKLEFEKVYCPFLL

SEQ ID NO: 2356441 - protein, 24 aa, Cryptosporidium parvum
TSQLNNVLSLPIPKDLITYSSDTR

SEQ ID NO: 2356442 - protein, 27 aa, Cryptosporidium parvum
TSQRELFKQYVVPIVDEVLLGFNCTIF

SEQ ID NO: 2356443 - protein, 29 aa, Cryptosporidium parvum
TSSAPMSTPLPAIPQPPVPFQNNSSISGG

SEQ ID NO: 2356444 - protein, 25 aa, Cryptosporidium parvum
TSSLKTIFIIFQLHFTDNHFDFLFQ

SEQ ID NO: 2356445 - protein, 34 aa, Cryptosporidium parvum
TSTLIPLDPRIVMRILFNFRKLYPVSYKTRIIKD

SEQ ID NO: 2356446 - protein, 23 aa, Cryptosporidium parvum
TTEKSYKGTVTRETYSVDGKQTS

SEQ ID NO: 2356447 - protein, 21 aa, Cryptosporidium parvum
TTKFDGSLFGGGAKFARQGTN

SEQ ID NO: 2356448 - protein, 17 aa, Cryptosporidium parvum
TTNTITYRLAPPKSQVI

SEQ ID NO: 2356449 - protein, 25 aa, Cryptosporidium parvum
TTRSGRFVSLKYGYDDILMSDDDAI

SEQ ID NO: 2356450 - protein, 23 aa, Cryptosporidium parvum
TTYPGSHIYSLFASSGFGIDNFQ

SEQ ID NO: 2356451 - protein, 21 aa, Cryptosporidium parvum
TVENWLPKRLGGGLGKVRGQE

SEQ ID NO: 2356452 - protein, 19 aa, Cryptosporidium parvum
TVESLYLKACKFVSVSQTN

SEQ ID NO: 2356453 - protein, 24 aa, Cryptosporidium parvum
TVKSLLKNLLEMLELAFQESIMNI

SEQ ID NO: 2356454 - protein, 26 aa, Cryptosporidium parvum
TVKSLPLLERLKLAYLKVVIPKCKYD

SEQ ID NO: 2356455 - protein, 21 aa, Cryptosporidium parvum
TVLARAIFKSGCEKVDAGLNP

SEQ ID NO: 2356456 - protein, 24 aa, Cryptosporidium parvum
TVTTVDQVFQDCSRMTTTTTVPST

SEQ ID NO: 2356457 - protein, 25 aa, Cryptosporidium parvum
TVVSKPGWGAVRWADLSISDASNSW

SEQ ID NO: 2356458 - protein, 23 aa, Cryptosporidium parvum
TWIVPFLMDHLIHYSILVKNNYI

SEQ ID NO: 2356459 - protein, 23 aa, Cryptosporidium parvum
TYIRRKREMLYSKQVKDYIVKFN

SEQ ID NO: 2356460 - protein, 24 aa, Cryptosporidium parvum
TYRSLQMVFSWYLINNYTNKHILT

SEQ ID NO: 2356461 - protein, 24 aa, Cryptosporidium parvum
VAKHMLRVCRETRPNIWVYAELFT

SEQ ID NO: 2356462 - protein, 26 aa, Cryptosporidium parvum
VAPAYHRMNFLLQVSQQYALVSNELS

SEQ ID NO: 2356463 - protein, 19 aa, Cryptosporidium parvum
VAQQLSQMMGFMGGGGGSG

SEQ ID NO: 2356464 - protein, 32 aa, Cryptosporidium parvum; identical to SEQ ID NO: 2323467

SEQ ID NO: 2356465 - protein, 28 aa, Cryptosporidium parvum
VCQDFINFILLWLRFGEIPLEGKISFCN

SEQ ID NO: 2356466 - protein, 18 aa, Cryptosporidium parvum
VDAVILFKEGIQPMWEDP

SEQ ID NO: 2356467 - protein, 30 aa, Cryptosporidium parvum; identical to SEQ ID NO: 2323492

SEQ ID NO: 2356468 - protein, 26 aa, Cryptosporidium parvum
VDGQKRYILRYLIYDCICIERDDTVK

SEQ ID NO: 2356469 - protein, 18 aa, Cryptosporidium parvum
VDIHRGGWNFTGCSTVPF

SEQ ID NO: 2356470 - protein, 27 aa, Cryptosporidium parvum
VDPKMLQFHLLLAIRSVVANLGVQINR

SEQ ID NO: 2356471 - protein, 27 aa, Cryptosporidium parvum
VDRTKYKIQIPLPPKIDPSVAMMTVED

SEQ ID NO: 2356472 - protein, 18 aa, Cryptosporidium parvum
VDSSLLAFGIRSDKPRNL

SEQ ID NO: 2356473 - protein, 22 aa, Cryptosporidium parvum
VDVFSFFDTVKRIYYSWQKNPV

SEQ ID NO: 2356474 - protein, 25 aa, Cryptosporidium parvum
VEASYLLMMYLGISCKLKYFYDIEE

SEQ ID NO: 2356475 - protein, 28 aa, Cryptosporidium parvum
VEGLKLDKGYISPYFITNQKYQKVELEN

SEQ ID NO: 2356476 - protein, 25 aa, Cryptosporidium parvum
VEILKDSLFFIIFDEADRLLEDCFI

SEQ ID NO: 2356477 - protein, 26 aa, Cryptosporidium parvum
VELCNRGWLYYPDSLQWYSKVQNEEK

SEQ ID NO: 2356478 - protein, 19 aa, Cryptosporidium parvum
VELKKKLEASLLDIYSFIS

SEQ ID NO: 2356479 - protein, 25 aa, Cryptosporidium parvum
VENTALVDGLFGRIWEFPKCENVRE

SEQ ID NO: 2356480 - protein, 25 aa, Cryptosporidium parvum
VESTLPFDVGPIKRLLFQDKAPGKS

SEQ ID NO: 2356481 - protein, 30 aa, Cryptosporidium parvum; identical to SEQ ID NO: 2323575

SEQ ID NO: 2356482 - protein, 26 aa, Cryptosporidium parvum
VFSLKKHVFLLLKLKIDKKNKIIQLF

SEQ ID NO: 2356483 - protein, 25 aa, Cryptosporidium parvum
VFTYNEIMVVILFNPELDLNTTDNF

SEQ ID NO: 2356484 - protein, 34 aa, Cryptosporidium parvum; identical to SEQ ID NO: 2323598

SEQ ID NO: 2356485 - protein, 25 aa, Cryptosporidium parvum
VGGLRSCMGYLGSASIEELWKKSSY

SEQ ID NO: 2356486 - protein, 28 aa, Cryptosporidium parvum
VGSDCLCWRCYFNQRPFFEEMDYSRIPI

SEQ ID NO: 2356487 - protein, 17 aa, Cryptosporidium parvum
VHFEGFGTFYMPPPTRA

SEQ ID NO: 2356488 - protein, 33 aa, Cryptosporidium parvum; identical to SEQ ID NO: 2198668

SEQ ID NO: 2356489 - protein, 27 aa, Cryptosporidium parvum
VIDATPFRQFYLQRYGVELGRRKNADE

SEQ ID NO: 2356490 - protein, 19 aa, Cryptosporidium parvum
VIIGHFEKVIRPYTRKKNQ

SEQ ID NO: 2356491 - protein, 19 aa, Cryptosporidium parvum
VIIWDYLLANGLQSLISIA

SEQ ID NO: 2356492 - protein, 24 aa, Cryptosporidium parvum
VILRLVPRLDVPALIRKSQNSQDV

SEQ ID NO: 2356493 - protein, 25 aa, Cryptosporidium parvum
VINKEQFSHLLAEYAEIIDLKDQNI

SEQ ID NO: 2356494 - protein, 18 aa, Cryptosporidium parvum
VINSLHTIIWQGDKKQLC

SEQ ID NO: 2356495 - protein, 28 aa, Cryptosporidium parvum
VISLLLPQKPCRCILLSNILTVEELLIP

SEQ ID NO: 2356496 - protein, 27 aa, Cryptosporidium parvum
VIVNGLEYFFIYKYESRIIGDCEANAW

SEQ ID NO: 2356497 - protein, 31 aa, Cryptosporidium parvum; identical to SEQ ID NO: 2198737

SEQ ID NO: 2356498 - protein, 19 aa, Cryptosporidium parvum
VKKNLVTLLRFTCSFDEDT

SEQ ID NO: 2356499 - protein, 25 aa, Cryptosporidium parvum
VKNINFDLLLLYPAAKFNFSSNIPD

SEQ ID NO: 2356500 - protein, 18 aa, Cryptosporidium parvum
VKRFSVSWMYKSGFLHIP

SEQ ID NO: 2356501 - protein, 23 aa, Cryptosporidium parvum
VLDNIMNILKYQKPTAIQSQVIP

SEQ ID NO: 2356502 - protein, 17 aa, Cryptosporidium parvum
VLEDYFGYDVYLVMNIT

SEQ ID NO: 2356503 - protein, 19 aa, Cryptosporidium parvum
VLESPLLHFDEKLVFNVFS

SEQ ID NO: 2356504 - protein, 29 aa, Cryptosporidium parvum
VLEYLKKCIQSIKSIYLLKNGYSSFSLEF

SEQ ID NO: 2356505 - protein, 18 aa, Cryptosporidium parvum
VLFGLLKETCIKRPKFRL

SEQ ID NO: 2356506 - protein, 44 aa, Cryptosporidium parvum; identical to SEQ ID NO: 2323786

SEQ ID NO: 2356507 - protein, 17 aa, Cryptosporidium parvum
VLMDRLIKKLVSGGSRI

SEQ ID NO: 2356508 - protein, 24 aa, Cryptosporidium parvum
VLRQPYLIEKVSLDRWKYITTLIP

SEQ ID NO: 2356509 - protein, 24 aa, Cryptosporidium parvum
VLSKDFIMNVYHPKLLLSIVSNVM

SEQ ID NO: 2356510 - protein, 26 aa, Cryptosporidium parvum
VLSRRRFKLLLKEKAALKIQTIFRGH

SEQ ID NO: 2356511 - protein, 24 aa, Cryptosporidium parvum
VLSTFLEFYHSLLKFVNFKLYQLN

SEQ ID NO: 2356512 - protein, 37 aa, Cryptosporidium parvum
VLYSYPELQPVLRLLKYWLHIRRLPVAKDGGLPCIVW

SEQ ID NO: 2356513 - protein, 24 aa, Cryptosporidium parvum
VMKNPQWFKLYIHYEPDSYKEING

SEQ ID NO: 2356514 - protein, 25 aa, Cryptosporidium parvum
VMMSLLNYLKLLYDKLRQIPLPINS

SEQ ID NO: 2356515 - protein, 24 aa, Cryptosporidium parvum
VNDILYKSFQPLYIHKQNSSIIYS

SEQ ID NO: 2356516 - protein, 22 aa, Cryptosporidium parvum
VNHLILLFENYLSNGSCELLNN

SEQ ID NO: 2356517 - protein, 27 aa, Cryptosporidium parvum
VNIEKKYLLYILEDFVPAFIETIDLNT

SEQ ID NO: 2356518 - protein, 25 aa, Cryptosporidium parvum
VNLKSIDWVLYMDLDAMFTNYQVKV

SEQ ID NO: 2356519 - protein, 20 aa, Cryptosporidium parvum
VNRTRNIYIVTPLNYDGNKV

SEQ ID NO: 2356520 - protein, 25 aa, Cryptosporidium parvum
VNSLLSYPIKMSGLFWGIGSMKLLF

SEQ ID NO: 2356521 - protein, 24 aa, Cryptosporidium parvum
VNTGTILRHRIWHQLYASWGSSIN

SEQ ID NO: 2356522 - protein, 17 aa, Cryptosporidium parvum
VPGVYWSQKPQGWRVVY

SEQ ID NO: 2356523 - protein, 25 aa, Cryptosporidium parvum
VPHGKEWLVMLNSDDWKYGGAMFGP

SEQ ID NO: 2356524 - protein, 25 aa, Cryptosporidium parvum
VPIINYIIEMLLKNGVTEIYLLAYS

SEQ ID NO: 2356525 - protein, 27 aa, Cryptosporidium parvum
VPLIPFEMLKWMEFLIRMTRELVPSSL

SEQ ID NO: 2356526 - protein, 24 aa, Cryptosporidium parvum
VPNAQLYFKLELPPNHTLKGNYIK

SEQ ID NO: 2356527 - protein, 26 aa, Cryptosporidium parvum
VPNLSMTMIFMESPPLSTLRTKKNEN

SEQ ID NO: 2356528 - protein, 25 aa, Cryptosporidium parvum
VPQVNDYLYFFPNAYICSGLDDIFF

SEQ ID NO: 2356529 - protein, 20 aa, Cryptosporidium parvum
VQKALLKDLVFLLGNREFDV

SEQ ID NO: 2356530 - protein, 18 aa, Cryptosporidium parvum
VQLPSCRSLRTSIRINRS

SEQ ID NO: 2356531 - protein, 24 aa, Cryptosporidium parvum
VQNFCPHIPFPPWSGSTTNQNKEE

SEQ ID NO: 2356532 - protein, 26 aa, Cryptosporidium parvum
VQRIRTPLRYRSSLLGALSNRTNSSC

SEQ ID NO: 2356533 - protein, 24 aa, Cryptosporidium parvum
VQRRRLYDITNVLEGIGILKKMGR

SEQ ID NO: 2356534 - protein, 21 aa, Cryptosporidium parvum
VQYRIPLLNCHVGDWQPVDSD

SEQ ID NO: 2356535 - protein, 28 aa, Cryptosporidium parvum
VRDNLNYYPIDVPLLICHCVHDILTDFE

SEQ ID NO: 2356536 - protein, 26 aa, Cryptosporidium parvum
VRNPHYWRYIGIIKLYKKVQGLLSDH

SEQ ID NO: 2356537 - protein, 32 aa, Cryptosporidium parvum; identical to SEQ ID NO: 2323918

SEQ ID NO: 2356538 - protein, 21 aa, Cryptosporidium parvum
VSEFIPEIIDFISTIISRGFA

SEQ ID NO: 2356539 - protein, 25 aa, Cryptosporidium parvum
VSIKTLRYILRPKLLTKPIIEPNNN

SEQ ID NO: 2356540 - protein, 20 aa, Cryptosporidium parvum
VSIPFFDGSWQPSSFYDKIK

SEQ ID NO: 2356541 - protein, 18 aa, Cryptosporidium parvum
VSPHLFLIEQMKLKNSKI

SEQ ID NO: 2356542 - protein, 27 aa, Cryptosporidium parvum
VSRKIVRSLLMVWKAKLDQVSAEAWIT

SEQ ID NO: 2356543 - protein, 31 aa, Cryptosporidium parvum
VSVSGSIKSYSKVTFTAPETTTTGAAGVTGS

SEQ ID NO: 2356544 - protein, 21 aa, Cryptosporidium parvum
VSWMYKSGFLHIPIHSITQIG

SEQ ID NO: 2356545 - protein, 20 aa, Cryptosporidium parvum
VTDILFKIIDSIIKEPRKGK

SEQ ID NO: 2356546 - protein, 20 aa, Cryptosporidium parvum
VTEHLMAVGMARLGGIGIIH

SEQ ID NO: 2356547 - protein, 25 aa, Cryptosporidium parvum
VTLIPFIDEFLLLDSITYVLSKCGF

SEQ ID NO: 2356548 - protein, 35 aa, Cryptosporidium parvum; identical to SEQ ID NO: 2324007

SEQ ID NO: 2356549 - protein, 18 aa, Cryptosporidium parvum
VVCLQTYGLLGLYSTFDR

SEQ ID NO: 2356550 - protein, 18 aa, Cryptosporidium parvum
VVMPWRTFRFNECACAPY

SEQ ID NO: 2356551 - protein, 19 aa, Cryptosporidium parvum
VYGLRYFFSRETLLEHYPY

SEQ ID NO: 2356552 - protein, 26 aa, Cryptosporidium parvum
VYSEKISIIILYQLLVCVDYLHEHRI

SEQ ID NO: 2356553 - protein, 18 aa, Cryptosporidium parvum
WCMEMCPEEYLDAGYPLG

SEQ ID NO: 2356554 - protein, 34 aa, Cryptosporidium parvum; identical to SEQ ID NO: 2199060

SEQ ID NO: 2356555 - protein, 17 aa, Cryptosporidium parvum
WGIFYKKVNKIILNIKN

SEQ ID NO: 2356556 - protein, 27 aa, Cryptosporidium parvum
WGSAKVLMIIQFWQTSLTFTDRLVNNR

SEQ ID NO: 2356557 - protein, 18 aa, Cryptosporidium parvum
WGYGIRYTYGIFEQKIVQ

SEQ ID NO: 2356558 - protein, 18 aa, Cryptosporidium parvum
WKGIYYDNRNKGWKLCLD

SEQ ID NO: 2356559 - protein, 31 aa, Cryptosporidium parvum; identical to SEQ ID NO: 2199090

SEQ ID NO: 2356560 - protein, 19 aa, Cryptosporidium parvum
WKRIPKERSCIFLDSIDEQ

SEQ ID NO: 2356561 - protein, 17 aa, Cryptosporidium parvum
WNFTGCSTVPFVTYPEK

SEQ ID NO: 2356562 - protein, 27 aa, Cryptosporidium parvum
WPKADCILILRNMPFDIPINGFNSLFV

SEQ ID NO: 2356563 - protein, 19 aa, Cryptosporidium parvum
WSAFVSVRHTLAKYCDRQA

SEQ ID NO: 2356564 - protein, 27 aa, Cryptosporidium parvum
WSFESQILPCPQLCKYIDYSLKNCKPL

SEQ ID NO: 2356565 - protein, 25 aa, Cryptosporidium parvum
WSVGCILGELVLQQPLFCSETEAGV

SEQ ID NO: 2356566 - protein, 19 aa, Cryptosporidium parvum
WTTRIEKILKAAAFMQQLK

SEQ ID NO: 2356567 - protein, 20 aa, Cryptosporidium parvum
YALLILIMIGKLDQADSAKI

SEQ ID NO: 2356568 - protein, 37 aa, Cryptosporidium parvum; identical to SEQ ID NO: 2199177

SEQ ID NO: 2356569 - protein, 23 aa, Cryptosporidium parvum
YDFLFKLVLIGDSGVGKSCLLLR

SEQ ID NO: 2356570 - protein, 19 aa, Cryptosporidium parvum
YEDFERWIMSITHPEDHID

SEQ ID NO: 2356571 - protein, 41 aa, Cryptosporidium parvum; identical to SEQ ID NO: 2324265

SEQ ID NO: 2356572 - protein, 17 aa, Cryptosporidium parvum
YEPLFLRGQSIKKFNFD

SEQ ID NO: 2356573 - protein, 18 aa, Cryptosporidium parvum
YEQAVFPHLNYSKDGEFG

SEQ ID NO: 2356574 - protein, 18 aa, Cryptosporidium parvum
YEVISSLRISDGALLLVD

SEQ ID NO: 2356575 - protein, 27 aa, Cryptosporidium parvum
YGNHEYNLFFNNFYKDYELGILEEFNT

SEQ ID NO: 2356576 - protein, 20 aa, Cryptosporidium parvum
YHDKLVSPHLFLIEQMKLKN

SEQ ID NO: 2356577 - protein, 40 aa, Cryptosporidium parvum; identical to SEQ ID NO: 2324339

SEQ ID NO: 2356578 - protein, 18 aa, Cryptosporidium parvum
YIQILDKGEWIYHPVERI

SEQ ID NO: 2356579 - protein, 30 aa, Cryptosporidium parvum; identical to SEQ ID NO: 2324377

SEQ ID NO: 2356580 - protein, 24 aa, Cryptosporidium parvum
YISDYVILVLVFSDQIKILKDLSE

SEQ ID NO: 2356581 - protein, 29 aa, Cryptosporidium parvum
YITNLLEYLRDFFLRIHPLLDEGTIQTEL

SEQ ID NO: 2356582 - protein, 17 aa, Cryptosporidium parvum
YIVMECILLLLNQNNSI

SEQ ID NO: 2356583 - protein, 25 aa, Cryptosporidium parvum
YIVNWLMFAPHNDSIWNYIISFFSK

SEQ ID NO: 2356584 - protein, 25 aa, Cryptosporidium parvum
YKCILKMEQTFLPSSFKPIISFAIV

SEQ ID NO: 2356585 - protein, 29 aa, Cryptosporidium parvum
YKCQINYMQKILYSLKYKKHALLESPTGT

SEQ ID NO: 2356586 - protein, 24 aa, Cryptosporidium parvum
YKEFGICIFRLWVVHCKNVWLVNS

SEQ ID NO: 2356587 - protein, 34 aa, Cryptosporidium parvum; identical to SEQ ID NO: 2324398

SEQ ID NO: 2356588 - protein, 25 aa, Cryptosporidium parvum
YKHDYPLIDLLIALPRPKVFEKVLQ

SEQ ID NO: 2356589 - protein, 30 aa, Cryptosporidium parvum; identical to SEQ ID NO: 2199337

SEQ ID NO: 2356590 - protein, 25 aa, Cryptosporidium parvum
YLGTWWRTEFNYSPLPYLPPHSTRP

SEQ ID NO: 2356591 - protein, 27 aa, Cryptosporidium parvum
YLKAMLRKYMNAGCHINKILNGEKITS

SEQ ID NO: 2356592 - protein, 19 aa, Cryptosporidium parvum
YLLPDLAPKVTSSLQLEEG

SEQ ID NO: 2356593 - protein, 25 aa, Cryptosporidium parvum
YLNPNAQEFIPRGWVNPTNEPFINH

SEQ ID NO: 2356594 - protein, 20 aa, Cryptosporidium parvum
YLNPPMISLLIRAFSNTKDE

SEQ ID NO: 2356595 - protein, 29 aa, Cryptosporidium parvum
YLSKQGCLQLYILLLYHKNPELDNSNTQK

SEQ ID NO: 2356596 - protein, 17 aa, Cryptosporidium parvum
YLTQILKAINYLHEMSI

SEQ ID NO: 2356597 - protein, 19 aa, Cryptosporidium parvum
YNFRHRRSIETISFRGKKL

SEQ ID NO: 2356598 - protein, 25 aa, Cryptosporidium parvum
YNGIILDVHFPLAVYKKLLGYKVDI

SEQ ID NO: 2356599 - protein, 23 aa, Cryptosporidium parvum
YNQYIVLEYIWEYFINGNTMILI

SEQ ID NO: 2356600 - protein, 17 aa, Cryptosporidium parvum
YNSFGPRNKHINTRSNP

SEQ ID NO: 2356601 - protein, 18 aa, Cryptosporidium parvum
YPITINKTTIIAPGAPNT

SEQ ID NO: 2356602 - protein, 18 aa, Cryptosporidium parvum
YQDLDILETFKPGNLLIS

SEQ ID NO: 2356603 - protein, 27 aa, Cryptosporidium parvum
YQISSSFVTIPIPRILQGLEVFNLTGR

SEQ ID NO: 2356604 - protein, 22 aa, Cryptosporidium parvum
YQKYTHLSRILTNTFYGRYISD

SEQ ID NO: 2356605 - protein, 17 aa, Cryptosporidium parvum
YQLAIRDVVLHNLCSLT

SEQ ID NO: 2356606 - protein, 29 aa, Cryptosporidium parvum
YQNNQFIDYYLFFSHIFTNLDKIYNKTEI

SEQ ID NO: 2356607 - protein, 24 aa, Cryptosporidium parvum
YSAKRQECILKSVKLKASIAPIEA

SEQ ID NO: 2356608 - protein, 26 aa, Cryptosporidium parvum
YSHIEISQLALFLNLSSERVYSKVIE

SEQ ID NO: 2356609 - protein, 24 aa, Cryptosporidium parvum
YSILIKRIIKLLKLSRTRQFTQKS

SEQ ID NO: 2356610 - protein, 25 aa, Cryptosporidium parvum
YSLNILRHVFRALRRIVSDDFVSAL

SEQ ID NO: 2356611 - protein, 21 aa, Cryptosporidium parvum
YSLVEKIMNIQKAPLENCKMQ

SEQ ID NO: 2356612 - protein, 28 aa, Cryptosporidium parvum
YSNSRPIRLLYYNDLHYDSLFYRREHQT

SEQ ID NO: 2356613 - protein, 21 aa, Cryptosporidium parvum
YSQGFAYLKCFVPHKPPGRAD

SEQ ID NO: 2356614 - protein, 19 aa, Cryptosporidium parvum
YSTLLGLERKFCLGDWSGY

SEQ ID NO: 2356615 - protein, 17 aa, Cryptosporidium parvum
YSVPLFVLEKCLLSPTQ

SEQ ID NO: 2356616 - protein, 24 aa, Cryptosporidium parvum
YTRRIYPHLNNMDGFFVAKLKKIS

SEQ ID NO: 2356617 - protein, 17 aa, Cryptosporidium parvum
YVKIMRIGQGAFGDVWL

SEQ ID NO: 2356618 - protein, 17 aa, Cryptosporidium parvum
YVKTPYPHVYKPDSYLK

SEQ ID NO: 2356619 - protein, 22 aa, Cryptosporidium parvum
YVTFDIIRRVLEDYFGYDVYLV

SEQ ID NO: 2356620 - protein, 31 aa, Cryptosporidium parvum; identical to SEQ ID NO: 2324688

SEQ ID NO: 2356621 - protein, 22 aa, Cryptosporidium parvum
YYEWVKRLRTFPRSLYIRIVNL

SEQ ID NO: 2356622 - protein, 18 aa, Cryptosporidium parvum
YYSIAIRYRKNLLEQKML

SEQ ID NO: 2356623 - protein, 21 aa, Cryptosporidium parvum
ACGWLPTMKLLLKYNCDINRR

SEQ ID NO: 2356624 - protein, 24 aa, Cryptosporidium parvum
ADIPERLYLLYGSRWKSLKERKIS

SEQ ID NO: 2356625 - protein, 26 aa, Cryptosporidium parvum
AMSPGPYEWLYNPLLMNLYGNYSAAS

SEQ ID NO: 2356626 - protein, 24 aa, Cryptosporidium parvum
ANQHKKFKRMLLFSLRSLSDLCVP

SEQ ID NO: 2356627 - protein, 18 aa, Cryptosporidium parvum
APLPLPEELPPPPPSEEL

SEQ ID NO: 2356628 - protein, 23 aa, Cryptosporidium parvum
APPPPAPPLPPPSFPPYAASSQS

SEQ ID NO: 2356629 - protein, 17 aa, Cryptosporidium parvum
ASKFGIPIIADGGIRYS

SEQ ID NO: 2356630 - protein, 18 aa, Cryptosporidium parvum
ASSIPYLLPLLMGSGSNN

SEQ ID NO: 2356631 - protein, 34 aa, Cryptosporidium parvum
CNSPEIFKITYKIPFYWASLIANIYVFEKLRNYD

SEQ ID NO: 2356632 - protein, 19 aa, Cryptosporidium parvum
CNVFINRQLIYNYPDQLFK

SEQ ID NO: 2356633 - protein, 17 aa, Cryptosporidium parvum
CPFIIALNKIDRLYGWI

SEQ ID NO: 2356634 - protein, 19 aa, Cryptosporidium parvum
CYILRPWSYFIWETIQSVF

SEQ ID NO: 2356635 - protein, 22 aa, Cryptosporidium parvum
DEKIRVIKYLWETKRDFNIHEV

SEQ ID NO: 2356636 - protein, 29 aa, Cryptosporidium parvum
DELDILLERWNPFLLYKFEQEYLKNGAIL

SEQ ID NO: 2356637 - protein, 21 aa, Cryptosporidium parvum
DETLDTIPWFCSYNKLQVLSN

SEQ ID NO: 2356638 - protein, 22 aa, Cryptosporidium parvum
DETLRFWDFRMINSPIYEHKTN

SEQ ID NO: 2356639 - protein, 17 aa, Cryptosporidium parvum
DFLFLPASICNVPPTGV

SEQ ID NO: 2356640 - protein, 23 aa, Cryptosporidium parvum
DGSKFFPFFISKYIRSLQKSNYF

SEQ ID NO: 2356641 - protein, 22 aa, Cryptosporidium parvum
DLLKFFQARPPLPYVPYPNRRP

SEQ ID NO: 2356642 - protein, 18 aa, Cryptosporidium parvum
DQGLTPFLIFHLLPSIQA

SEQ ID NO: 2356643 - protein, 18 aa, Cryptosporidium parvum
DQIIFFLKKNWGIFYKKV

SEQ ID NO: 2356644 - protein, 20 aa, Cryptosporidium parvum
DSFLSLFKPIISKCIEVYRP

SEQ ID NO: 2356645 - protein, 20 aa, Cryptosporidium parvum
DSLELSLLLNFRSLSTKLQT

SEQ ID NO: 2356646 - protein, 24 aa, Cryptosporidium parvum
DVCYSWWIFSLLYFLGRANYIDKN

SEQ ID NO: 2356647 - protein, 20 aa, Cryptosporidium parvum
DYFGHIVIDLLFFQAKKFAS

SEQ ID NO: 2356648 - protein, 25 aa, Cryptosporidium parvum
EASLLDIYSFISWYIYDYNNEITQK

SEQ ID NO: 2356649 - protein, 23 aa, Cryptosporidium parvum
EFEKVYCPFLLMNKKRYAGVLFK

SEQ ID NO: 2356650 - protein, 25 aa, Cryptosporidium parvum
EIDEKFLFYLFSNFGKILSLKIVGN

SEQ ID NO: 2356651 - protein, 20 aa, Cryptosporidium parvum
EIQKLILEFLFSFKTSQKLS

SEQ ID NO: 2356652 - protein, 17 aa, Cryptosporidium parvum
EKKIVWSAKYFGGNIHI

SEQ ID NO: 2356653 - protein, 23 aa, Cryptosporidium parvum
EKKNSWSWGHKLRWVKIFKCEMH

SEQ ID NO: 2356654 - protein, 23 aa, Cryptosporidium parvum
ELNTSIRLWWKRIFKGSIETDIS

SEQ ID NO: 2356655 - protein, 23 aa, Cryptosporidium parvum
ELQPVLRLLKYWLHIRRLPVAKD

SEQ ID NO: 2356656 - protein, 19 aa, Cryptosporidium parvum
ENYIIFFISIIDYSLRFFL

SEQ ID NO: 2356657 - protein, 22 aa, Cryptosporidium parvum
EQMSYLMHLQLLSLSDSPEKLL

SEQ ID NO: 2356658 - protein, 17 aa, Cryptosporidium parvum
EWQLKYKNKMKGNMIFM

SEQ ID NO: 2356659 - protein, 23 aa, Cryptosporidium parvum
FALETLFYIFYNMPQDLLQGFAA

SEQ ID NO: 2356660 - protein, 18 aa, Cryptosporidium parvum
FDLKYNGFYILYAKSNKP

SEQ ID NO: 2356661 - protein, 25 aa, Cryptosporidium parvum
FDTTDNTMTFVYQAPTKTETTTTMT

SEQ ID NO: 2356662 - protein, 23 aa, Cryptosporidium parvum
FEVWLLLSLWKRYPARIYRHMMK

SEQ ID NO: 2356663 - protein, 24 aa, Cryptosporidium parvum
FEYKNFSIYTLLALRTISSEFKNL

SEQ ID NO: 2356664 - protein, 18 aa, Cryptosporidium parvum
FFNFLLVKHFSFGENDKI

SEQ ID NO: 2356665 - protein, 26 aa, Cryptosporidium parvum
FGITPWMPFWFRFTPINAKTVSNPLL

SEQ ID NO: 2356666 - protein, 18 aa, Cryptosporidium parvum
FICRNIMTNWLPLSKSIF

SEQ ID NO: 2356667 - protein, 19 aa, Cryptosporidium parvum
FILLWLRFGEIPLEGKISF

SEQ ID NO: 2356668 - protein, 25 aa, Cryptosporidium parvum
FIQSLLLCDIAWIFQSMKNISSNLK

SEQ ID NO: 2356669 - protein, 18 aa, Cryptosporidium parvum
FNILIEKLSPFFSKYTEC

SEQ ID NO: 2356670 - protein, 17 aa, Cryptosporidium parvum
FPMFWSSFLASQQFNNT

SEQ ID NO: 2356671 - protein, 33 aa, Cryptosporidium parvum; identical to SEQ ID NO: 2325011

SEQ ID NO: 2356672 - protein, 21 aa, Cryptosporidium parvum
FRDFHVRLIAILRSSQLVEIL

SEQ ID NO: 2356673 - protein, 28 aa, Cryptosporidium parvum
FSSLCPKLLNCLFPWIRSEQYFEDHDQP

SEQ ID NO: 2356674 - protein, 19 aa, Cryptosporidium parvum
FTLLFHISKMYLAIKTCKE

SEQ ID NO: 2356675 - protein, 17 aa, Cryptosporidium parvum
FTSIGMWKSLFLTLNYS

SEQ ID NO: 2356676 - protein, 20 aa, Cryptosporidium parvum
GCVFVFYVADWFALLNNKMG

SEQ ID NO: 2356677 - protein, 22 aa, Cryptosporidium parvum
GGLPCIVWLLLAIVHCSVNGNK

SEQ ID NO: 2356678 - protein, 20 aa, Cryptosporidium parvum
GKDLFFSYLYFSPTSISDVV

SEQ ID NO: 2356679 - protein, 18 aa, Cryptosporidium parvum
GNLQRFLHLFIINQLFSE

SEQ ID NO: 2356680 - protein, 23 aa, Cryptosporidium parvum
GSHLPLLPPSRFPFQSEARRTIN

SEQ ID NO: 2356681 - protein, 17 aa, Cryptosporidium parvum
GVQARLLPLFSFVSRYS

SEQ ID NO: 2356682 - protein, 23 aa, Cryptosporidium parvum
HIRKLLSECGTILRWSRQEDPTT

SEQ ID NO: 2356683 - protein, 31 aa, Cryptosporidium parvum
HSPHPMGLQPFPMHSILLPTLLQAQIQAQMR

SEQ ID NO: 2356684 - protein, 19 aa, Cryptosporidium parvum
IFEILRICAGILHLCNFDF

SEQ ID NO: 2356685 - protein, 20 aa, Cryptosporidium parvum
IHCFFPYLYCEVPKSTPPNP

SEQ ID NO: 2356686 - protein, 29 aa, Cryptosporidium parvum
IINEAFPPVFPLFTLPPLPPKRNGPGWNS

SEQ ID NO: 2356687 - protein, 17 aa, Cryptosporidium parvum
IINIPKLTRGFPVMGEQ

SEQ ID NO: 2356688 - protein, 20 aa, Cryptosporidium parvum
IKRTLKFLWAISKGLPIISP

SEQ ID NO: 2356689 - protein, 17 aa, Cryptosporidium parvum
ILCTQNIYFWIISLERI

SEQ ID NO: 2356690 - protein, 21 aa, Cryptosporidium parvum
ILDLVRQFIKIRFPFVLVLNK

SEQ ID NO: 2356691 - protein, 20 aa, Cryptosporidium parvum
ILPLRLMKHLKLFPNIIEMA

SEQ ID NO: 2356692 - protein, 24 aa, Cryptosporidium parvum
ILYHKALYLAIQQHLLMYSSELQA

SEQ ID NO: 2356693 - protein, 18 aa, Cryptosporidium parvum
IMSHPWLLAINNLTNIDI

SEQ ID NO: 2356694 - protein, 18 aa, Cryptosporidium parvum
IQSRWRSFQIRKSFLAIL

SEQ ID NO: 2356695 - protein, 25 aa, Cryptosporidium parvum
ITDLRGIHIPLSLAGKYFGLLKNER

SEQ ID NO: 2356696 - protein, 18 aa, Cryptosporidium parvum
IYSKLFDWLVFRINKSMT

SEQ ID NO: 2356697 - protein, 21 aa, Cryptosporidium parvum
KEGLFFYILLENNAKKSSECM

SEQ ID NO: 2356698 - protein, 23 aa, Cryptosporidium parvum
KEGLFNFLFLFQKLNGRPTENEN

SEQ ID NO: 2356699 - protein, 22 aa, Cryptosporidium parvum
KEQLNSVFFLVSSLISKSINFR

SEQ ID NO: 2356700 - protein, 21 aa, Cryptosporidium parvum
KFKYLILNFSSLYMKKLVQPY

SEQ ID NO: 2356701 - protein, 20 aa, Cryptosporidium parvum
KFMKSVLLPLKTFEKTCRRP

SEQ ID NO: 2356702 - protein, 26 aa, Cryptosporidium parvum
KLDAYYKFLVLSYSKMFLAFISLKND

SEQ ID NO: 2356703 - protein, 21 aa, Cryptosporidium parvum
KNDLPLFIRLLQDGSSEAVLS

SEQ ID NO: 2356704 - protein, 19 aa, Cryptosporidium parvum
KNWRFHKIPMFWLQVKLIE

SEQ ID NO: 2356705 - protein, 17 aa, Cryptosporidium parvum
KPLKYWRQILDGIIVRH

SEQ ID NO: 2356706 - protein, 24 aa, Cryptosporidium parvum
KQTKYWVPSFLSFKPKFMYSIPFK

SEQ ID NO: 2356707 - protein, 24 aa, Cryptosporidium parvum
KSLNVNLLRLYRLICKLDSILNTF

SEQ ID NO: 2356708 - protein, 24 aa, Cryptosporidium parvum
KTAAFLLPALERLLRSPYVRNSRV

SEQ ID NO: 2356709 - protein, 25 aa, Cryptosporidium parvum
KTINKIMLPLLPIASYLFPNLQIGS

SEQ ID NO: 2356710 - protein, 17 aa, Cryptosporidium parvum
KTYYLPNEYWIYKLHNF

SEQ ID NO: 2356711 - protein, 24 aa, Cryptosporidium parvum
KVHSNFYFLFNNYLNFLENQPLKN

SEQ ID NO: 2356712 - protein, 26 aa, Cryptosporidium parvum
KVVFPCILKIIPQYIFNARDPIICGV

SEQ ID NO: 2356713 - protein, 20 aa, Cryptosporidium parvum
KYKIQIPLPPKIDPSVAMMT

SEQ ID NO: 2356714 - protein, 23 aa, Cryptosporidium parvum
LASFNILIQPLLNLVLNAPGDDP

SEQ ID NO: 2356715 - protein, 22 aa, Cryptosporidium parvum
LCNRGWLYYPDSLQWYSKVQNE

SEQ ID NO: 2356716 - protein, 17 aa, Cryptosporidium parvum
LEYIIRVYIESLLLFAL

SEQ ID NO: 2356717 - protein, 24 aa, Cryptosporidium parvum
LFCPLLHRSAFRLALLVVGISHSV

SEQ ID NO: 2356718 - protein, 19 aa, Cryptosporidium parvum
LFLENILIPKVRLKKLIEN

SEQ ID NO: 2356719 - protein, 17 aa, Cryptosporidium parvum
LHYASFRSNLDYAKWVI

SEQ ID NO: 2356720 - protein, 23 aa, Cryptosporidium parvum
LIPLDPRIVMRILFNFRKLYPVS

SEQ ID NO: 2356721 - protein, 22 aa, Cryptosporidium parvum
LKNMIFFLYDSFLSEIFQLDGL

SEQ ID NO: 2356722 - protein, 18 aa, Cryptosporidium parvum
LLEYIPFSEPEDINYYVS

SEQ ID NO: 2356723 - protein, 19 aa, Cryptosporidium parvum
LLNLFYIIHRYLTLKHISP

SEQ ID NO: 2356724 - protein, 25 aa, Cryptosporidium parvum
LNSGLPPISLPPRAIPPINLSQSLM

SEQ ID NO: 2356725 - protein, 17 aa, Cryptosporidium parvum
LPIIQLLEQVLIRIFSK

SEQ ID NO: 2356726 - protein, 19 aa, Cryptosporidium parvum
LPNEYWIYKLHNFEAKTNN

SEQ ID NO: 2356727 - protein, 18 aa, Cryptosporidium parvum
LQNCKFYKLLKSHQKYFH

SEQ ID NO: 2356728 - protein, 22 aa, Cryptosporidium parvum
LQSPPLLVLTPSTPIPIVPTTI

SEQ ID NO: 2356729 - protein, 19 aa, Cryptosporidium parvum
LSLYLSFWCFSAAAALSSL

SEQ ID NO: 2356730 - protein, 17 aa, Cryptosporidium parvum
LTPFLIFHLLPSIQARE

SEQ ID NO: 2356731 - protein, 17 aa, Cryptosporidium parvum
LTRTGFIIFWGGRELDS

SEQ ID NO: 2356732 - protein, 19 aa, Cryptosporidium parvum
LVDGLFGRIWEFPKCENVR

SEQ ID NO: 2356733 - protein, 18 aa, Cryptosporidium parvum
LWFLILQAQIETGTPFIC

SEQ ID NO: 2356734 - protein, 20 aa, Cryptosporidium parvum
LYGSIYYFKLGIIKDLPPPI

SEQ ID NO: 2356735 - protein, 19 aa, Cryptosporidium parvum
MIFMASLVRKKVIASTVVL

SEQ ID NO: 2356736 - protein, 25 aa, Cryptosporidium parvum
MRELDILLILEFLVDLRLSYESCGI

SEQ ID NO: 2356737 - protein, 23 aa, Cryptosporidium parvum
MSAANPMLLAFNPQLAAAAAATA

SEQ ID NO: 2356738 - protein, 17 aa, Cryptosporidium parvum
NCKLLLEYIPFSEPEDI

SEQ ID NO: 2356739 - protein, 17 aa, Cryptosporidium parvum
NCQLPVFITLRAPGSPL

SEQ ID NO: 2356740 - protein, 23 aa, Cryptosporidium parvum
NDIGVLPDVLYLLGSLAIIPNIK

SEQ ID NO: 2356741 - protein, 18 aa, Cryptosporidium parvum
NDNYFILDLLAQAGTYIK

SEQ ID NO: 2356742 - protein, 17 aa, Cryptosporidium parvum
NDPYFGRAFIFFYNVES

SEQ ID NO: 2356743 - protein, 23 aa, Cryptosporidium parvum
NIDWNKRISSRLFQIAIGKGTRA

SEQ ID NO: 2356744 - protein, 20 aa, Cryptosporidium parvum
NIPVWLYPYRILPMMFKDIN

SEQ ID NO: 2356745 - protein, 19 aa, Cryptosporidium parvum
NIYFWIISLERITNYQLKI

SEQ ID NO: 2356746 - protein, 20 aa, Cryptosporidium parvum
NLWWELMVYILRWSFELGPS

SEQ ID NO: 2356747 - protein, 19 aa, Cryptosporidium parvum
NNVLQDHLMLLKAQLEIST

SEQ ID NO: 2356748 - protein, 21 aa, Cryptosporidium parvum
NSIIRLVPKEQLNSVFFLVSS

SEQ ID NO: 2356749 - protein, 26 aa, Cryptosporidium parvum
NTNPNFQNMPIPYPPKAPLSDCNNSD

SEQ ID NO: 2356750 - protein, 20 aa, Cryptosporidium parvum
NVVLLPYNYLLDSITRQNLK

SEQ ID NO: 2356751 - protein, 26 aa, Cryptosporidium parvum
PDGRPMPYWLYKLNGLGIEFKCEICG

SEQ ID NO: 2356752 - protein, 21 aa, Cryptosporidium parvum
PELSLPYKLWIDAKSRDWILE

SEQ ID NO: 2356753 - protein, 17 aa, Cryptosporidium parvum
PFLIFHLLPSIQAREEI

SEQ ID NO: 2356754 - protein, 19 aa, Cryptosporidium parvum
PFLPSLFIVSSSKPLLRIV

SEQ ID NO: 2356755 - protein, 23 aa, Cryptosporidium parvum
PFNIQLDCLYLFSPDYDGSPPLY

SEQ ID NO: 2356756 - protein, 26 aa, Cryptosporidium parvum
PGTPTLTILFLILTLCKLYSTLTNLN

SEQ ID NO: 2356757 - protein, 17 aa, Cryptosporidium parvum
PLWHLFSSLCWQGYHNQ

SEQ ID NO: 2356758 - protein, 18 aa, Cryptosporidium parvum
PQKLPKLRGFLSMNSLAH

SEQ ID NO: 2356759 - protein, 24 aa, Cryptosporidium parvum
PRHIRMLFLLHKWDAPMNYSPETS

SEQ ID NO: 2356760 - protein, 25 aa, Cryptosporidium parvum
PTKTKLLYLAIYEYLVVYSTLEDNL

SEQ ID NO: 2356761 - protein, 20 aa, Cryptosporidium parvum
QDFINFILLWLRFGEIPLEG

SEQ ID NO: 2356762 - protein, 25 aa, Cryptosporidium parvum
QECAFPHYWRYLAIWKLFTNQELVT

SEQ ID NO: 2356763 - protein, 19 aa, Cryptosporidium parvum
QFFPGLNMGGEYIGGLLPG

SEQ ID NO: 2356764 - protein, 21 aa, Cryptosporidium parvum
QGCLQLYILLLYHKNPELDNS

SEQ ID NO: 2356765 - protein, 17 aa, Cryptosporidium parvum
QKRYILRYLIYDCICIE

SEQ ID NO: 2356766 - protein, 20 aa, Cryptosporidium parvum
QNELIGYLYLIINPSIITSD

SEQ ID NO: 2356767 - protein, 23 aa, Cryptosporidium parvum
QQLLFCFHNNFPILWHPQVIAII

SEQ ID NO: 2356768 - protein, 26 aa, Cryptosporidium parvum
QQQQMPVRYLVPPPPPPPSKTSGALQ

SEQ ID NO: 2356769 - protein, 20 aa, Cryptosporidium parvum
QRSALFKALILYSLKNKEYM

SEQ ID NO: 2356770 - protein, 20 aa, Cryptosporidium parvum
QWFRKYFKTYYLPNEYWIYK

SEQ ID NO: 2356771 - protein, 20 aa, Cryptosporidium parvum
QYEYYVVRAWVRNARRIQIK

SEQ ID NO: 2356772 - protein, 27 aa, Cryptosporidium parvum
RDIPRGFFYAYFLNPLILLASDPIRNV

SEQ ID NO: 2356773 - protein, 21 aa, Cryptosporidium parvum
RDPRRSLLIRSLRFDTPTSLV

SEQ ID NO: 2356774 - protein, 24 aa, Cryptosporidium parvum
REYYKWDYIILLTTRYISPDSNTI

SEQ ID NO: 2356775 - protein, 28 aa, Cryptosporidium parvum
RFSSVQQFWWLWHNIPQPSELLKGKRMI

SEQ ID NO: 2356776 - protein, 17 aa, Cryptosporidium parvum
RISSPFLWHFFQNGGNV

SEQ ID NO: 2356777 - protein, 18 aa, Cryptosporidium parvum
RLIPPRMSPLLRSQRQRL

SEQ ID NO: 2356778 - protein, 19 aa, Cryptosporidium parvum
RMCWLYLKNDWKEIKEFAW

SEQ ID NO: 2356779 - protein, 23 aa, Cryptosporidium parvum
RNSWMHIFSFDSAIPRSNQRETI

SEQ ID NO: 2356780 - protein, 23 aa, Cryptosporidium parvum
RQEIDMLNIPIWLYKESGSLTVN

SEQ ID NO: 2356781 - protein, 19 aa, Cryptosporidium parvum
RSRKCPFIIALNKIDRLYG

SEQ ID NO: 2356782 - protein, 17 aa, Cryptosporidium parvum
RTKYKIQIPLPPKIDPS

SEQ ID NO: 2356783 - protein, 18 aa, Cryptosporidium parvum
RVKPPLKPKPKFLAPPKN

SEQ ID NO: 2356784 - protein, 17 aa, Cryptosporidium parvum
RYVKCVYLNYLICLVRQ

SEQ ID NO: 2356785 - protein, 18 aa, Cryptosporidium parvum
SFLDIFLLSLFRSKIPQL

SEQ ID NO: 2356786 - protein, 23 aa, Cryptosporidium parvum
SGIRWLCFILGEYGKLISSKVSI

SEQ ID NO: 2356787 - protein, 25 aa, Cryptosporidium parvum
SIIHPFYQPMVLIATLFQKSSQKQG

SEQ ID NO: 2356788 - protein, 17 aa, Cryptosporidium parvum
SIILLPGEKLLLFSKEC

SEQ ID NO: 2356789 - protein, 20 aa, Cryptosporidium parvum
SIRGIYQWFRKYFKTYYLPN

SEQ ID NO: 2356790 - protein, 21 aa, Cryptosporidium parvum
SLARLWFDYVFSVKCLSPSTS

SEQ ID NO: 2356791 - protein, 21 aa, Cryptosporidium parvum
SLTLRILPSLIYRIPNLTPGL

SEQ ID NO: 2356792 - protein, 22 aa, Cryptosporidium parvum
SNENFFMCLKWPESLSVTPEAE

SEQ ID NO: 2356793 - protein, 26 aa, Cryptosporidium parvum
SRFPPDAWHLCCWLLRKNSNERASPI

SEQ ID NO: 2356794 - protein, 23 aa, Cryptosporidium parvum
SSELRLIIAPLALALVPVGEVKK

SEQ ID NO: 2356795 - protein, 24 aa, Cryptosporidium parvum
SSKNWFCFQCLSLTLRILPSLIYR

SEQ ID NO: 2356796 - protein, 17 aa, Cryptosporidium parvum
SSPPRVKPPLKPKPKFL

SEQ ID NO: 2356797 - protein, 24 aa, Cryptosporidium parvum
SSVKPIMITSLWSCIYKSLRYNMN

SEQ ID NO: 2356798 - protein, 25 aa, Cryptosporidium parvum
STPSILGILLKYFDVSWPSHIFESL

SEQ ID NO: 2356799 - protein, 22 aa, Cryptosporidium parvum
SYLGIPIWRFYGRCTQCGNEIV

SEQ ID NO: 2356800 - protein, 22 aa, Cryptosporidium parvum
TKAQKKIPLWARSMNWIPKMKE

SEQ ID NO: 2356801 - protein, 20 aa, Cryptosporidium parvum
TQINIKYCFPFIVIYDASNT

SEQ ID NO: 2356802 - protein, 23 aa, Cryptosporidium parvum
TQSLYLCLDLLFESSFFLCKINH

SEQ ID NO: 2356803 - protein, 20 aa, Cryptosporidium parvum
TRDLLLDFLFLPASICNVPP

SEQ ID NO: 2356804 - protein, 20 aa, Cryptosporidium parvum
VAYSLYWLLKFTNSTNVPIY

SEQ ID NO: 2356805 - protein, 24 aa, Cryptosporidium parvum
VDGTGWLWMAPDGRVLSVLSGHGD

SEQ ID NO: 2356806 - protein, 26 aa, Cryptosporidium parvum
VGLIWKYRFYLFRFKAGIPMLFHFIN

SEQ ID NO: 2356807 - protein, 17 aa, Cryptosporidium parvum
VKCVYLNYLICLVRQIR

SEQ ID NO: 2356808 - protein, 22 aa, Cryptosporidium parvum
VKGTWIFRIATFGLFSFIGYVD

SEQ ID NO: 2356809 - protein, 21 aa, Cryptosporidium parvum
VPFPRLHFFMIGFAPLTSRGS

SEQ ID NO: 2356810 - protein, 17 aa, Cryptosporidium parvum
VVVFIRKSKDKAFLCVV

SEQ ID NO: 2356811 - protein, 18 aa, Cryptosporidium parvum
VWVKHPKLAWAPATILRR

SEQ ID NO: 2356812 - protein, 18 aa, Cryptosporidium parvum
VYASWTFFLQHLRNYFFC

SEQ ID NO: 2356813 - protein, 17 aa, Cryptosporidium parvum
WIILNTFRYIPVAGVLL

SEQ ID NO: 2356814 - protein, 19 aa, Cryptosporidium parvum
WTDIRHFAFILFKKNLNVL

SEQ ID NO: 2356815 - protein, 24 aa, Cryptosporidium parvum
YELICIDFFLRYISNLYPLWGEYG

SEQ ID NO: 2356816 - protein, 23 aa, Cryptosporidium parvum
YFKESIWIPNALIPLVRQRNKDK

SEQ ID NO: 2356817 - protein, 26 aa, Cryptosporidium parvum
YFRGVPSWRWYYPYRYAPFACDIAII

SEQ ID NO: 2356818 - protein, 17 aa, Cryptosporidium parvum
YIKPIRYLNDGLPVYRL

SEQ ID NO: 2356819 - protein, 20 aa, Cryptosporidium parvum
YLDLFPCFVLAIFKSLVLLD

SEQ ID NO: 2356820 - protein, 17 aa, Cryptosporidium parvum
YLNIRWRRKMGEKLIDI

SEQ ID NO: 2356821 - protein, 17 aa, Cryptosporidium parvum
YRDNVFFNFLLVKHFSF

SEQ ID NO: 2356822 - protein, 20 aa, Cryptosporidium parvum
YSTKLPLWHLFSSLCWQGYH

SEQ ID NO: 2356823 - protein, 12 aa, Cryptosporidium parvum
AAAAAAASKESV

SEQ ID NO: 2356824 - protein, 10 aa, Cryptosporidium parvum
AAKETSTVYE

SEQ ID NO: 2356825 - protein, 10 aa, Cryptosporidium parvum
AAKGNNHEGI

SEQ ID NO: 2356826 - protein, 12 aa, Cryptosporidium parvum
AAKNGFITIVRD

SEQ ID NO: 2356827 - protein, 11 aa, Cryptosporidium parvum
AATGTADVNNS

SEQ ID NO: 2356828 - protein, 19 aa, Cryptosporidium parvum
ADAKKKEVDVSSSIPGSTD

SEQ ID NO: 2356829 - protein, 7 aa, Cryptosporidium parvum
ADEYGNS

SEQ ID NO: 2356830 - protein, 7 aa, Cryptosporidium parvum
ADHGENP

SEQ ID NO: 2356831 - protein, 4 aa, Cryptosporidium parvum
ADYR

SEQ ID NO: 2356832 - protein, 5 aa, Cryptosporidium parvum
AEDPE

SEQ ID NO: 2356833 - protein, 8 aa, Cryptosporidium parvum
AENASELN

SEQ ID NO: 2356834 - protein, 6 aa, Cryptosporidium parvum
AESEEA

SEQ ID NO: 2356835 - protein, 8 aa, Cryptosporidium parvum
AGGAQERR

SEQ ID NO: 2356836 - protein, 4 aa, Cryptosporidium parvum
AGKD

SEQ ID NO: 2356837 - protein, 7 aa, Cryptosporidium parvum
AGTGGRG

SEQ ID NO: 2356838 - protein, 7 aa, Cryptosporidium parvum
AGYSTGR

SEQ ID NO: 2356839 - protein, 10 aa, Cryptosporidium parvum
AHSSYKEKSE

SEQ ID NO: 2356840 - protein, 11 aa, Cryptosporidium parvum
AILPNGNSTNL

SEQ ID NO: 2356841 - protein, 11 aa, Cryptosporidium parvum
AKEIKTNNDGN

SEQ ID NO: 2356842 - protein, 9 aa, Cryptosporidium parvum
AKEPEESAK

SEQ ID NO: 2356843 - protein, 8 aa, Cryptosporidium parvum
AKKENLDN

SEQ ID NO: 2356844 - protein, 14 aa, Cryptosporidium parvum
AKKPIKTEPTKERR

SEQ ID NO: 2356845 - protein, 4 aa, Cryptosporidium parvum
AKNR

SEQ ID NO: 2356846 - protein, 10 aa, Cryptosporidium parvum
AKQEKERQRL

SEQ ID NO: 2356847 - protein, 10 aa, Cryptosporidium parvum
AKRSNKGNNN

SEQ ID NO: 2356848 - protein, 10 aa, Cryptosporidium parvum
ALKDSGSDFN

SEQ ID NO: 2356849 - protein, 8 aa, Cryptosporidium parvum
ALSSQSKV

SEQ ID NO: 2356850 - protein, 17 aa, Cryptosporidium parvum
ANPIDQKEVSQDPTGSE

SEQ ID NO: 2356851 - protein, 9 aa, Cryptosporidium parvum
ANSVTGRSN

SEQ ID NO: 2356852 - protein, 5 aa, Cryptosporidium parvum
ANTDS

SEQ ID NO: 2356853 - protein, 5 aa, Cryptosporidium parvum
ANTTH

SEQ ID NO: 2356854 - protein, 14 aa, Cryptosporidium parvum
APESAELESTCPPN

SEQ ID NO: 2356855 - protein, 11 aa, Cryptosporidium parvum
APQVKPNIPGV

SEQ ID NO: 2356856 - protein, 7 aa, Cryptosporidium parvum
AQEKPEM

SEQ ID NO: 2356857 - protein, 8 aa, Cryptosporidium parvum
ARDSESLE

SEQ ID NO: 2356858 - protein, 4 aa, Cryptosporidium parvum
ARNA

SEQ ID NO: 2356859 - protein, 17 aa, Cryptosporidium parvum
ASDMTSSGSLKASNNLE

SEQ ID NO: 2356860 - protein, 12 aa, Cryptosporidium parvum
ASEEKQDEKDSI

SEQ ID NO: 2356861 - protein, 9 aa, Cryptosporidium parvum
ASNPTESIT

SEQ ID NO: 2356862 - protein, 12 aa, Cryptosporidium parvum
ASSNLQNAPTLR

SEQ ID NO: 2356863 - protein, 5 aa, Cryptosporidium parvum
ATDFT

SEQ ID NO: 2356864 - protein, 8 aa, Cryptosporidium parvum
ATGNKDLD

SEQ ID NO: 2356865 - protein, 12 aa, Cryptosporidium parvum
ATSNGVSDFSSS

SEQ ID NO: 2356866 - protein, 5 aa, Cryptosporidium parvum
AVKPL

SEQ ID NO: 2356867 - protein, 13 aa, Cryptosporidium parvum
AYNQENGKEFPRI

SEQ ID NO: 2356868 - protein, 7 aa, Cryptosporidium parvum
CATTREK

SEQ ID NO: 2356869 - protein, 10 aa, Cryptosporidium parvum
CDKHGTEEQT

SEQ ID NO: 2356870 - protein, 5 aa, Cryptosporidium parvum
CPNES

SEQ ID NO: 2356871 - protein, 4 aa, Cryptosporidium parvum
CPNG

SEQ ID NO: 2356872 - protein, 5 aa, Cryptosporidium parvum
CPQTK

SEQ ID NO: 2356873 - protein, 13 aa, Cryptosporidium parvum
CPSGGCEKIESTP

SEQ ID NO: 2356874 - protein, 11 aa, Cryptosporidium parvum
CPSGYVTDQDG

SEQ ID NO: 2356875 - protein, 5 aa, Cryptosporidium parvum
CTKHS

SEQ ID NO: 2356876 - protein, 18 aa, Cryptosporidium parvum
CTQTTQAPPQPECPPGTN

SEQ ID NO: 2356877 - protein, 6 aa, Cryptosporidium parvum
DATENM

SEQ ID NO: 2356878 - protein, 8 aa, Cryptosporidium parvum
DDGKGVAP

SEQ ID NO: 2356879 - protein, 13 aa, Cryptosporidium parvum
DDNNDDSNYSSNY

SEQ ID NO: 2356880 - protein, 4 aa, Cryptosporidium parvum
DDRT

SEQ ID NO: 2356881 - protein, 30 aa, Cryptosporidium parvum; identical to SEQ ID NO: 2326690

SEQ ID NO: 2356882 - protein, 8 aa, Cryptosporidium parvum
DDSKQLEY

SEQ ID NO: 2356883 - protein, 5 aa, Cryptosporidium parvum
DDSVS

SEQ ID NO: 2356884 - protein, 32 aa, Cryptosporidium parvum
DEASEGTIGLPSQKGDDAAEKSHEGDVSVSDE

SEQ ID NO: 2356885 - protein, 9 aa, Cryptosporidium parvum
DEEEEDSEI

SEQ ID NO: 2356886 - protein, 6 aa, Cryptosporidium parvum
DEEPVS

SEQ ID NO: 2356887 - protein, 5 aa, Cryptosporidium parvum
DEEVK

SEQ ID NO: 2356888 - protein, 53 aa, Cryptosporidium parvum; identical to SEQ ID NO: 2326714

SEQ ID NO: 2356889 - protein, 11 aa, Cryptosporidium parvum
DEVSTVASENE

SEQ ID NO: 2356890 - protein, 7 aa, Cryptosporidium parvum
DGGSKFK

SEQ ID NO: 2356891 - protein, 5 aa, Cryptosporidium parvum
DGNIP

SEQ ID NO: 2356892 - protein, 14 aa, Cryptosporidium parvum
DGSEYESDPAAKAA

SEQ ID NO: 2356893 - protein, 20 aa, Cryptosporidium parvum
DHEEEKDEENKNEDSGIQEL

SEQ ID NO: 2356894 - protein, 9 aa, Cryptosporidium parvum
DHPNRGDSA

SEQ ID NO: 2356895 - protein, 65 aa, Cryptosporidium parvum; identical to SEQ ID NO: 2326837

SEQ ID NO: 2356896 - protein, 13 aa, Cryptosporidium parvum
DKKTLKSLTPMST

SEQ ID NO: 2356897 - protein, 5 aa, Cryptosporidium parvum
DKRQR

SEQ ID NO: 2356898 - protein, 7 aa, Cryptosporidium parvum
DLDAPET

SEQ ID NO: 2356899 - protein, 14 aa, Cryptosporidium parvum
DLDRNAGTNSQGTI

SEQ ID NO: 2356900 - protein, 20 aa, Cryptosporidium parvum
DLDTTTEDGIYSKSSRTVEK

SEQ ID NO: 2356901 - protein, 6 aa, Cryptosporidium parvum
DLNDPG

SEQ ID NO: 2356902 - protein, 11 aa, Cryptosporidium parvum
DLQETEQPGLY

SEQ ID NO: 2356903 - protein, 5 aa, Cryptosporidium parvum
DNEAP

SEQ ID NO: 2356904 - protein, 7 aa, Cryptosporidium parvum
DNETRDS

SEQ ID NO: 2356905 - protein, 4 aa, Cryptosporidium parvum
DNGS

SEQ ID NO: 2356906 - protein, 5 aa, Cryptosporidium parvum
DNISK

SEQ ID NO: 2356907 - protein, 11 aa, Cryptosporidium parvum
DNKSKRKNIQA

SEQ ID NO: 2356908 - protein, 10 aa, Cryptosporidium parvum
DSDKHDSMNI

SEQ ID NO: 2356909 - protein, 4 aa, Cryptosporidium parvum
DSET

SEQ ID NO: 2356910 - protein, 6 aa, Cryptosporidium parvum
DSEYVQ

SEQ ID NO: 2356911 - protein, 4 aa, Cryptosporidium parvum
DSKD

SEQ ID NO: 2356912 - protein, 6 aa, Cryptosporidium parvum
DTGNNA

SEQ ID NO: 2356913 - protein, 8 aa, Cryptosporidium parvum
DTSESKLP

SEQ ID NO: 2356914 - protein, 11 aa, Cryptosporidium parvum
DVGSESSIDLG

SEQ ID NO: 2356915 - protein, 12 aa, Cryptosporidium parvum
EAAGTGSTSAVG

SEQ ID NO: 2356916 - protein, 6 aa, Cryptosporidium parvum
EAGNPV

SEQ ID NO: 2356917 - protein, 7 aa, Cryptosporidium parvum
ECQSGSP

SEQ ID NO: 2356918 - protein, 4 aa, Cryptosporidium parvum
EDSN

SEQ ID NO: 2356919 - protein, 14 aa, Cryptosporidium parvum
EDSRGISSSEKGSL

SEQ ID NO: 2356920 - protein, 12 aa, Cryptosporidium parvum
EEDDGVNDETEY

SEQ ID NO: 2356921 - protein, 22 aa, Cryptosporidium parvum
EEDKEKYCNKPGAKAMCSSNSE

SEQ ID NO: 2356922 - protein, 18 aa, Cryptosporidium parvum
EEGSHSAAVDHNGEVTDD

SEQ ID NO: 2356923 - protein, 22 aa, Cryptosporidium parvum
EEGTQIKTNNGHEYKVNSGSVG

SEQ ID NO: 2356924 - protein, 6 aa, Cryptosporidium parvum
EEHTDI

SEQ ID NO: 2356925 - protein, 7 aa, Cryptosporidium parvum
EELTPAT

SEQ ID NO: 2356926 - protein, 7 aa, Cryptosporidium parvum
EEYKDND

SEQ ID NO: 2356927 - protein, 9 aa, Cryptosporidium parvum
EGNGRTAKG

SEQ ID NO: 2356928 - protein, 6 aa, Cryptosporidium parvum
EGRSSD

SEQ ID NO: 2356929 - protein, 10 aa, Cryptosporidium parvum
EGSIPEKKEG

SEQ ID NO: 2356930 - protein, 13 aa, Cryptosporidium parvum
EGTGQEKPKPEDE

SEQ ID NO: 2356931 - protein, 11 aa, Cryptosporidium parvum
EHGSKSDGTIE

SEQ ID NO: 2356932 - protein, 8 aa, Cryptosporidium parvum
EIPGGGSK

SEQ ID NO: 2356933 - protein, 17 aa, Cryptosporidium parvum
EKKEKKLKKQKEKERLR

SEQ ID NO: 2356934 - protein, 7 aa, Cryptosporidium parvum
EKKNLKK

SEQ ID NO: 2356935 - protein, 24 aa, Cryptosporidium parvum
EKKVDEDFTNKDSKLDERESNNKV

SEQ ID NO: 2356936 - protein, 5 aa, Cryptosporidium parvum
EKPPP

SEQ ID NO: 2356937 - protein, 14 aa, Cryptosporidium parvum
EKYNKKKSWRKKTR

SEQ ID NO: 2356938 - protein, 18 aa, Cryptosporidium parvum
ELANSGSYSTSTPTFEDV

SEQ ID NO: 2356939 - protein, 26 aa, Cryptosporidium parvum
ELDGADESVSELPDISEEPSPLPEFE

SEQ ID NO: 2356940 - protein, 5 aa, Cryptosporidium parvum
ELEEV

SEQ ID NO: 2356941 - protein, 9 aa, Cryptosporidium parvum
ELGSKRKGK

SEQ ID NO: 2356942 - protein, 11 aa, Cryptosporidium parvum
ELSNDNDNDII

SEQ ID NO: 2356943 - protein, 9 aa, Cryptosporidium parvum
ELSPEQEKE

SEQ ID NO: 2356944 - protein, 10 aa, Cryptosporidium parvum
ELTKESSIKV

SEQ ID NO: 2356945 - protein, 13 aa, Cryptosporidium parvum
EMKNTQSTSGKTL

SEQ ID NO: 2356946 - protein, 8 aa, Cryptosporidium parvum
ENDKTSWE

SEQ ID NO: 2356947 - protein, 8 aa, Cryptosporidium parvum
ENKEEGEV

SEQ ID NO: 2356948 - protein, 8 aa, Cryptosporidium parvum
ENLNDKEA

SEQ ID NO: 2356949 - protein, 6 aa, Cryptosporidium parvum
ENLPSK

SEQ ID NO: 2356950 - protein, 7 aa, Cryptosporidium parvum
ENLSQQL

SEQ ID NO: 2356951 - protein, 10 aa, Cryptosporidium parvum
ENREKTQLRP

SEQ ID NO: 2356952 - protein, 29 aa, Cryptosporidium parvum
EPQRDNSVSTPEQSEKDDSNREASASGFE

SEQ ID NO: 2356953 - protein, 12 aa, Cryptosporidium parvum
EPSYVPDPHPEG

SEQ ID NO: 2356954 - protein, 5 aa, Cryptosporidium parvum
EQING

SEQ ID NO: 2356955 - protein, 16 aa, Cryptosporidium parvum
EQSNRSEFPESGSISS

SEQ ID NO: 2356956 - protein, 8 aa, Cryptosporidium parvum
EQYNSKSA

SEQ ID NO: 2356957 - protein, 30 aa, Cryptosporidium parvum; identical to SEQ ID NO: 2201817

SEQ ID NO: 2356958 - protein, 6 aa, Cryptosporidium parvum
ERNPEK

SEQ ID NO: 2356959 - protein, 7 aa, Cryptosporidium parvum
ESAQSDF

SEQ ID NO: 2356960 - protein, 4 aa, Cryptosporidium parvum
ESCP

SEQ ID NO: 2356961 - protein, 17 aa, Cryptosporidium parvum
ESEETTNEGYSDAESFS

SEQ ID NO: 2356962 - protein, 7 aa, Cryptosporidium parvum
ESETNSS

SEQ ID NO: 2356963 - protein, 7 aa, Cryptosporidium parvum
ESKDIPP

SEQ ID NO: 2356964 - protein, 9 aa, Cryptosporidium parvum
ESNKSPRIG

SEQ ID NO: 2356965 - protein, 4 aa, Cryptosporidium parvum
ESNP

SEQ ID NO: 2356966 - protein, 9 aa, Cryptosporidium parvum
ESPSDVTTL

SEQ ID NO: 2356967 - protein, 5 aa, Cryptosporidium parvum
ESSIQ

SEQ ID NO: 2356968 - protein, 12 aa, Cryptosporidium parvum
ETDVQRKHKDKL

SEQ ID NO: 2356969 - protein, 6 aa, Cryptosporidium parvum
ETISEP

SEQ ID NO: 2356970 - protein, 8 aa, Cryptosporidium parvum
ETLPKGSE

SEQ ID NO: 2356971 - protein, 11 aa, Cryptosporidium parvum
ETYYDSTERYR

SEQ ID NO: 2356972 - protein, 13 aa, Cryptosporidium parvum
EVAPDESEVDSEL

SEQ ID NO: 2356973 - protein, 5 aa, Cryptosporidium parvum
EVSEE

SEQ ID NO: 2356974 - protein, 13 aa, Cryptosporidium parvum
EYDEEKDEKRGSN

SEQ ID NO: 2356975 - protein, 17 aa, Cryptosporidium parvum
EYEEEDDGEEKEEGKKR

SEQ ID NO: 2356976 - protein, 20 aa, Cryptosporidium parvum
EYYPEQSESEEKTQITETGH

SEQ ID NO: 2356977 - protein, 20 aa, Cryptosporidium parvum
FDDSPPEGLPNAPKTTSPEG

SEQ ID NO: 2356978 - protein, 29 aa, Cryptosporidium parvum
FEESKTSERSSSIGKLNTADSSFLNPNTE

SEQ ID NO: 2356979 - protein, 8 aa, Cryptosporidium parvum
FEGDPRDL

SEQ ID NO: 2356980 - protein, 6 aa, Cryptosporidium parvum
FERSGQ

SEQ ID NO: 2356981 - protein, 18 aa, Cryptosporidium parvum
FETSNDKGSSEPLPDGAS

SEQ ID NO: 2356982 - protein, 9 aa, Cryptosporidium parvum
FGEKPGSFT

SEQ ID NO: 2356983 - protein, 10 aa, Cryptosporidium parvum
FGEPGPSIRE

SEQ ID NO: 2356984 - protein, 4 aa, Cryptosporidium parvum
FGSH

SEQ ID NO: 2356985 - protein, 9 aa, Cryptosporidium parvum
FNKQESPVF

SEQ ID NO: 2356986 - protein, 7 aa, Cryptosporidium parvum
FPEDPDK

SEQ ID NO: 2356987 - protein, 9 aa, Cryptosporidium parvum
FPPNPKYNK

SEQ ID NO: 2356988 - protein, 7 aa, Cryptosporidium parvum
FPPNYQS

SEQ ID NO: 2356989 - protein, 4 aa, Cryptosporidium parvum
FPSK

SEQ ID NO: 2356990 - protein, 5 aa, Cryptosporidium parvum
FPTSE

SEQ ID NO: 2356991 - protein, 15 aa, Cryptosporidium parvum
FSEENYKSKDSEISK

SEQ ID NO: 2356992 - protein, 15 aa, Cryptosporidium parvum
FSKNSETNKKKSQFD

SEQ ID NO: 2356993 - protein, 20 aa, Cryptosporidium parvum
FSQKEGTNTHKKDQEGTPLS

SEQ ID NO: 2356994 - protein, 20 aa, Cryptosporidium parvum
FTRPQSNHHSDHAGHGHGHG

SEQ ID NO: 2356995 - protein, 17 aa, Cryptosporidium parvum
GAGSRNEEVKSGQQNVP

SEQ ID NO: 2356996 - protein, 9 aa, Cryptosporidium parvum
GARSKACQS

SEQ ID NO: 2356997 - protein, 16 aa, Cryptosporidium parvum
GCSSPCKSSTNDLDST

SEQ ID NO: 2356998 - protein, 4 aa, Cryptosporidium parvum
GDGN

SEQ ID NO: 2356999 - protein, 8 aa, Cryptosporidium parvum
GEDQTNKD

SEQ ID NO: 2357000 - protein, 9 aa, Cryptosporidium parvum
GELNNETNI

SEQ ID NO: 2357001 - protein, 6 aa, Cryptosporidium parvum
GERSTF

SEQ ID NO: 2357002 - protein, 13 aa, Cryptosporidium parvum
GFEDSDPSSMDET

SEQ ID NO: 2357003 - protein, 4 aa, Cryptosporidium parvum
GFNP

SEQ ID NO: 2357004 - protein, 8 aa, Cryptosporidium parvum
GFRNSESI

SEQ ID NO: 2357005 - protein, 11 aa, Cryptosporidium parvum
GFSSSKPIQPI

SEQ ID NO: 2357006 - protein, 19 aa, Cryptosporidium parvum
GGDASEGLRSSLASSIQPD

SEQ ID NO: 2357007 - protein, 9 aa, Cryptosporidium parvum
GGEEEEQPE

SEQ ID NO: 2357008 - protein, 14 aa, Cryptosporidium parvum
GGGGHIPKYSDSYT

SEQ ID NO: 2357009 - protein, 9 aa, Cryptosporidium parvum
GHKASGASQ

SEQ ID NO: 2357010 - protein, 6 aa, Cryptosporidium parvum
GIPSEK

SEQ ID NO: 2357011 - protein, 12 aa, Cryptosporidium parvum
GIQEKNETKEYY

SEQ ID NO: 2357012 - protein, 23 aa, Cryptosporidium parvum
GIQTEETGTQTEETGMTDAATQT

SEQ ID NO: 2357013 - protein, 13 aa, Cryptosporidium parvum
GISRTRSDDTTKI

SEQ ID NO: 2357014 - protein, 5 aa, Cryptosporidium parvum
GKEDA

SEQ ID NO: 2357015 - protein, 4 aa, Cryptosporidium parvum
GKEV

SEQ ID NO: 2357016 - protein, 5 aa, Cryptosporidium parvum
GKPSL

SEQ ID NO: 2357017 - protein, 22 aa, Cryptosporidium parvum
GKQCTATKTASQQPSCPPGTTL

SEQ ID NO: 2357018 - protein, 12 aa, Cryptosporidium parvum
GKSEHKSIPRSV

SEQ ID NO: 2357019 - protein, 11 aa, Cryptosporidium parvum
GKSPTAQSSQY

SEQ ID NO: 2357020 - protein, 4 aa, Cryptosporidium parvum
GMDP

SEQ ID NO: 2357021 - protein, 7 aa, Cryptosporidium parvum
GMGSGSE

SEQ ID NO: 2357022 - protein, 7 aa, Cryptosporidium parvum
GMTPGDA

SEQ ID NO: 2357023 - protein, 16 aa, Cryptosporidium parvum
GNDRNNNDIRPTYPSA

SEQ ID NO: 2357024 - protein, 6 aa, Cryptosporidium parvum
GNENIY

SEQ ID NO: 2357025 - protein, 46 aa, Cryptosporidium parvum; identical to SEQ ID NO: 2328222

SEQ ID NO: 2357026 - protein, 11 aa, Cryptosporidium parvum
GNGEQSRRVKK

SEQ ID NO: 2357027 - protein, 6 aa, Cryptosporidium parvum
GNGRNV

SEQ ID NO: 2357028 - protein, 35 aa, Cryptosporidium parvum; identical to SEQ ID NO: 2328241

SEQ ID NO: 2357029 - protein, 5 aa, Cryptosporidium parvum
GNNPE

SEQ ID NO: 2357030 - protein, 4 aa, Cryptosporidium parvum
GNQC

SEQ ID NO: 2357031 - protein, 7 aa, Cryptosporidium parvum
GPLETGE

SEQ ID NO: 2357032 - protein, 4 aa, Cryptosporidium parvum
GPSE

SEQ ID NO: 2357033 - protein, 67 aa, Cryptosporidium parvum; identical to SEQ ID NO: 2328321

SEQ ID NO: 2357034 - protein, 8 aa, Cryptosporidium parvum
GSDLSDSA

SEQ ID NO: 2357035 - protein, 20 aa, Cryptosporidium parvum
GSDSYPSQSQMEPSNSLSYA

SEQ ID NO: 2357036 - protein, 7 aa, Cryptosporidium parvum
GSETDLY

SEQ ID NO: 2357037 - protein, 8 aa, Cryptosporidium parvum
GSGSTVST

SEQ ID NO: 2357038 - protein, 17 aa, Cryptosporidium parvum
GSKYRGLPKAHQNERGN

SEQ ID NO: 2357039 - protein, 5 aa, Cryptosporidium parvum
GSSSF

SEQ ID NO: 2357040 - protein, 14 aa, Cryptosporidium parvum
GTRTPIPYDGKRTV

SEQ ID NO: 2357041 - protein, 6 aa, Cryptosporidium parvum
GTYRST

SEQ ID NO: 2357042 - protein, 6 aa, Cryptosporidium parvum
GYGRTK

SEQ ID NO: 2357043 - protein, 7 aa, Cryptosporidium parvum
GYNEYGR

SEQ ID NO: 2357044 - protein, 4 aa, Cryptosporidium parvum
HANE

SEQ ID NO: 2357045 - protein, 14 aa, Cryptosporidium parvum
HDSLEEKLNSQEVV

SEQ ID NO: 2357046 - protein, 5 aa, Cryptosporidium parvum
HESNS

SEQ ID NO: 2357047 - protein, 6 aa, Cryptosporidium parvum
HESQNG

SEQ ID NO: 2357048 - protein, 7 aa, Cryptosporidium parvum
HKEAPRP

SEQ ID NO: 2357049 - protein, 6 aa, Cryptosporidium parvum
HNGDKK

SEQ ID NO: 2357050 - protein, 6 aa, Cryptosporidium parvum
HNHSKQ

SEQ ID NO: 2357051 - protein, 17 aa, Cryptosporidium parvum
HPPTPENLPDKASGRGF

SEQ ID NO: 2357052 - protein, 7 aa, Cryptosporidium parvum
HSHGHSH

SEQ ID NO: 2357053 - protein, 10 aa, Cryptosporidium parvum
HSSTAKFGLP

SEQ ID NO: 2357054 - protein, 5 aa, Cryptosporidium parvum
HTSEE

SEQ ID NO: 2357055 - protein, 54 aa, Cryptosporidium parvum; identical to SEQ ID NO: 2328555

SEQ ID NO: 2357056 - protein, 22 aa, Cryptosporidium parvum
IDEGEQTEAEDDIKVEKSEDQF

SEQ ID NO: 2357057 - protein, 11 aa, Cryptosporidium parvum
IDSGIGAATPM

SEQ ID NO: 2357058 - protein, 4 aa, Cryptosporidium parvum
IEGK

SEQ ID NO: 2357059 - protein, 7 aa, Cryptosporidium parvum
IEIRTPE

SEQ ID NO: 2357060 - protein, 13 aa, Cryptosporidium parvum
IENNSGKGKHLSK

SEQ ID NO: 2357061 - protein, 11 aa, Cryptosporidium parvum
IGSDAQHTEPF

SEQ ID NO: 2357062 - protein, 17 aa, Cryptosporidium parvum
IGSQDQEGGVVTTPEYP

SEQ ID NO: 2357063 - protein, 27 aa, Cryptosporidium parvum
IGTSSSSSTQFTGSSSGQTGGNSTGFR

SEQ ID NO: 2357064 - protein, 12 aa, Cryptosporidium parvum
IKAANNETHNKY

SEQ ID NO: 2357065 - protein, 10 aa, Cryptosporidium parvum
IKPGETTKLE

SEQ ID NO: 2357066 - protein, 10 aa, Cryptosporidium parvum
IKQNNDKIQV

SEQ ID NO: 2357067 - protein, 6 aa, Cryptosporidium parvum
INAAKG

SEQ ID NO: 2357068 - protein, 5 aa, Cryptosporidium parvum
INGDV

SEQ ID NO: 2357069 - protein, 5 aa, Cryptosporidium parvum
INPDF

SEQ ID NO: 2357070 - protein, 25 aa, Cryptosporidium parvum
INPKFNEAESHSAEATKEADNKTLQ

SEQ ID NO: 2357071 - protein, 6 aa, Cryptosporidium parvum
INSEEM

SEQ ID NO: 2357072 - protein, 5 aa, Cryptosporidium parvum
IPAGI

SEQ ID NO: 2357073 - protein, 18 aa, Cryptosporidium parvum
IPEIPGPPSRRGSGPISD

SEQ ID NO: 2357074 - protein, 29 aa, Cryptosporidium parvum
IPGETGPEDFPQYETPGSPYSPTQTPEQF

SEQ ID NO: 2357075 - protein, 12 aa, Cryptosporidium parvum
IPHTGRKGLTQE

SEQ ID NO: 2357076 - protein, 7 aa, Cryptosporidium parvum
IPKGAKI

SEQ ID NO: 2357077 - protein, 21 aa, Cryptosporidium parvum
IQESSVDAKSSDSARDRSEFS

SEQ ID NO: 2357078 - protein, 5 aa, Cryptosporidium parvum
IQMPN

SEQ ID NO: 2357079 - protein, 12 aa, Cryptosporidium parvum
IQPPPEAKKGKN

SEQ ID NO: 2357080 - protein, 15 aa, Cryptosporidium parvum
IQSSRKKGKKPSRFD

SEQ ID NO: 2357081 - protein, 5 aa, Cryptosporidium parvum
IRGGA

SEQ ID NO: 2357082 - protein, 17 aa, Cryptosporidium parvum
ISDSRKDTGAKASAPDF

SEQ ID NO: 2357083 - protein, 9 aa, Cryptosporidium parvum
ISEEKGAKI

SEQ ID NO: 2357084 - protein, 13 aa, Cryptosporidium parvum
ISEGEDEDTSNIS

SEQ ID NO: 2357085 - protein, 20 aa, Cryptosporidium parvum
ISKCSKKTSEPKPERNESDK

SEQ ID NO: 2357086 - protein, 11 aa, Cryptosporidium parvum
ISPEQADYDGK

SEQ ID NO: 2357087 - protein, 5 aa, Cryptosporidium parvum
ISPNS

SEQ ID NO: 2357088 - protein, 17 aa, Cryptosporidium parvum
ISSDSGAIYPNDPKFSE

SEQ ID NO: 2357089 - protein, 5 aa, Cryptosporidium parvum
ISSSD

SEQ ID NO: 2357090 - protein, 5 aa, Cryptosporidium parvum
ITNTP

SEQ ID NO: 2357091 - protein, 4 aa, Cryptosporidium parvum
ITQD

SEQ ID NO: 2357092 - protein, 5 aa, Cryptosporidium parvum
ITSKT

SEQ ID NO: 2357093 - protein, 140 aa, Cryptosporidium parvum; identical to SEQ ID NO: 2328865

SEQ ID NO: 2357094 - protein, 26 aa, Cryptosporidium parvum
KAEGDSISDNSPKGTQNNGELNTNGF

SEQ ID NO: 2357095 - protein, 6 aa, Cryptosporidium parvum
KALETP

SEQ ID NO: 2357096 - protein, 8 aa, Cryptosporidium parvum
KASKRASK

SEQ ID NO: 2357097 - protein, 5 aa, Cryptosporidium parvum
KDAPY

SEQ ID NO: 2357098 - protein, 10 aa, Cryptosporidium parvum
KDDNSDANLK

SEQ ID NO: 2357099 - protein, 12 aa, Cryptosporidium parvum
KDEEKNKRTQKI

SEQ ID NO: 2357100 - protein, 13 aa, Cryptosporidium parvum
KDLEPEPATEISG

SEQ ID NO: 2357101 - protein, 25 aa, Cryptosporidium parvum
KDNTDNKGNSIAKDADNGEISEKGD

SEQ ID NO: 2357102 - protein, 19 aa, Cryptosporidium parvum
KDSNTRPEKVSQYDRMENK

SEQ ID NO: 2357103 - protein, 5 aa, Cryptosporidium parvum
KEADH

SEQ ID NO: 2357104 - protein, 4 aa, Cryptosporidium parvum
KECP

SEQ ID NO: 2357105 - protein, 30 aa, Cryptosporidium parvum; identical to SEQ ID NO: 2328999

SEQ ID NO: 2357106 - protein, 11 aa, Cryptosporidium parvum
KELGDEQDLDQ

SEQ ID NO: 2357107 - protein, 9 aa, Cryptosporidium parvum
KERLEKEKI

SEQ ID NO: 2357108 - protein, 6 aa, Cryptosporidium parvum
KGAKSV

SEQ ID NO: 2357109 - protein, 5 aa, Cryptosporidium parvum
KGCQI

SEQ ID NO: 2357110 - protein, 24 aa, Cryptosporidium parvum
KGGMSSSSSSFSSNKISAKSTKIP

SEQ ID NO: 2357111 - protein, 9 aa, Cryptosporidium parvum
KGNPTTGYS

SEQ ID NO: 2357112 - protein, 8 aa, Cryptosporidium parvum
KGPKSKRL

SEQ ID NO: 2357113 - protein, 5 aa, Cryptosporidium parvum
KGTGK

SEQ ID NO: 2357114 - protein, 8 aa, Cryptosporidium parvum
KHRTPNGN

SEQ ID NO: 2357115 - protein, 5 aa, Cryptosporidium parvum
KHVGP

SEQ ID NO: 2357116 - protein, 10 aa, Cryptosporidium parvum
KIASKFGKDS

SEQ ID NO: 2357117 - protein, 5 aa, Cryptosporidium parvum
KIEDN

SEQ ID NO: 2357118 - protein, 14 aa, Cryptosporidium parvum
KITPKTCTKADSVP

SEQ ID NO: 2357119 - protein, 5 aa, Cryptosporidium parvum
KKAIN

SEQ ID NO: 2357120 - protein, 5 aa, Cryptosporidium parvum
KKIEI

SEQ ID NO: 2357121 - protein, 32 aa, Cryptosporidium parvum; identical to SEQ ID NO: 2329196

SEQ ID NO: 2357122 - protein, 8 aa, Cryptosporidium parvum
KKKSYSLS

SEQ ID NO: 2357123 - protein, 6 aa, Cryptosporidium parvum
KKLTRN

SEQ ID NO: 2357124 - protein, 7 aa, Cryptosporidium parvum
KKNTTPL

SEQ ID NO: 2357125 - protein, 8 aa, Cryptosporidium parvum
KKPSSVNL

SEQ ID NO: 2357126 - protein, 77 aa, Cryptosporidium parvum; identical to SEQ ID NO: 2329227

SEQ ID NO: 2357127 - protein, 6 aa, Cryptosporidium parvum
KKVFNG

SEQ ID NO: 2357128 - protein, 13 aa, Cryptosporidium parvum
KKYRGQSVNYPPS

SEQ ID NO: 2357129 - protein, 11 aa, Cryptosporidium parvum
KLEKEKLKKEK

SEQ ID NO: 2357130 - protein, 6 aa, Cryptosporidium parvum
KLISGD

SEQ ID NO: 2357131 - protein, 6 aa, Cryptosporidium parvum
KLNDDN

SEQ ID NO: 2357132 - protein, 5 aa, Cryptosporidium parvum
KLSNS

SEQ ID NO: 2357133 - protein, 6 aa, Cryptosporidium parvum
KNDEAV

SEQ ID NO: 2357134 - protein, 11 aa, Cryptosporidium parvum
KNDNKKENSEI

SEQ ID NO: 2357135 - protein, 7 aa, Cryptosporidium parvum
KNEPAKN

SEQ ID NO: 2357136 - protein, 17 aa, Cryptosporidium parvum
KNGKKGKNSKSNKSEQW

SEQ ID NO: 2357137 - protein, 8 aa, Cryptosporidium parvum
KNGQYPKL

SEQ ID NO: 2357138 - protein, 13 aa, Cryptosporidium parvum
KNKDRKGVITTSS

SEQ ID NO: 2357139 - protein, 9 aa, Cryptosporidium parvum
KNNDSGLEC

SEQ ID NO: 2357140 - protein, 12 aa, Cryptosporidium parvum
KNNKPKNFKQGN

SEQ ID NO: 2357141 - protein, 8 aa, Cryptosporidium parvum
KNPELSNL

SEQ ID NO: 2357142 - protein, 10 aa, Cryptosporidium parvum
KNQTESREFE

SEQ ID NO: 2357143 - protein, 22 aa, Cryptosporidium parvum
KNVSVSKNDEKKSLDESKFTSD

SEQ ID NO: 2357144 - protein, 9 aa, Cryptosporidium parvum
KPGTKRTDV

SEQ ID NO: 2357145 - protein, 10 aa, Cryptosporidium parvum
KPQDAPATDI

SEQ ID NO: 2357146 - protein, 5 aa, Cryptosporidium parvum
KPSEL

SEQ ID NO: 2357147 - protein, 21 aa, Cryptosporidium parvum
KQEEKQRQKQLQKEEKQKQKL

SEQ ID NO: 2357148 - protein, 31 aa, Cryptosporidium parvum; identical to SEQ ID NO: 2266572

SEQ ID NO: 2357149 - protein, 15 aa, Cryptosporidium parvum
KQGPQNPQKGPIPIG

SEQ ID NO: 2357150 - protein, 6 aa, Cryptosporidium parvum
KQIKTQ

SEQ ID NO: 2357151 - protein, 13 aa, Cryptosporidium parvum
KQQKKEASNNGLK

SEQ ID NO: 2357152 - protein, 4 aa, Cryptosporidium parvum
KRGH

SEQ ID NO: 2357153 - protein, 9 aa, Cryptosporidium parvum
KRGPSREKC

SEQ ID NO: 2357154 - protein, 8 aa, Cryptosporidium parvum
KSCKDKSE

SEQ ID NO: 2357155 - protein, 5 aa, Cryptosporidium parvum
KSCPP

SEQ ID NO: 2357156 - protein, 8 aa, Cryptosporidium parvum
KSEFPSSG

SEQ ID NO: 2357157 - protein, 7 aa, Cryptosporidium parvum
KSFNDNS

SEQ ID NO: 2357158 - protein, 6 aa, Cryptosporidium parvum
KSHTSL

SEQ ID NO: 2357159 - protein, 22 aa, Cryptosporidium parvum
KSKSSRCSARDDSYVSGTIPTS

SEQ ID NO: 2357160 - protein, 31 aa, Cryptosporidium parvum; identical to SEQ ID NO: 2329573

SEQ ID NO: 2357161 - protein, 7 aa, Cryptosporidium parvum
KSQDFSI

SEQ ID NO: 2357162 - protein, 8 aa, Cryptosporidium parvum
KSSSFSGY

SEQ ID NO: 2357163 - protein, 15 aa, Cryptosporidium parvum
KSTDDTSKPEERSSR

SEQ ID NO: 2357164 - protein, 8 aa, Cryptosporidium parvum
KSVRKKDT

SEQ ID NO: 2357165 - protein, 6 aa, Cryptosporidium parvum
KSYSSA

SEQ ID NO: 2357166 - protein, 7 aa, Cryptosporidium parvum
KTCETTE

SEQ ID NO: 2357167 - protein, 7 aa, Cryptosporidium parvum
KTDAFSD

SEQ ID NO: 2357168 - protein, 10 aa, Cryptosporidium parvum
KTKSKKNSHC

SEQ ID NO: 2357169 - protein, 7 aa, Cryptosporidium parvum
KTLNEKN

SEQ ID NO: 2357170 - protein, 18 aa, Cryptosporidium parvum
KTLPKDPTVPASAPAKEA

SEQ ID NO: 2357171 - protein, 5 aa, Cryptosporidium parvum
KTPDV

SEQ ID NO: 2357172 - protein, 14 aa, Cryptosporidium parvum
KTPPTLKCPPGSVD

SEQ ID NO: 2357173 - protein, 4 aa, Cryptosporidium parvum
KVAT

SEQ ID NO: 2357174 - protein, 7 aa, Cryptosporidium parvum
KVCPNNN

SEQ ID NO: 2357175 - protein, 6 aa, Cryptosporidium parvum
KVRSSN

SEQ ID NO: 2357176 - protein, 5 aa, Cryptosporidium parvum
KVSAS

SEQ ID NO: 2357177 - protein, 17 aa, Cryptosporidium parvum
KYPGHQKDGVGSRFSET

SEQ ID NO: 2357178 - protein, 6 aa, Cryptosporidium parvum
KYPSVE

SEQ ID NO: 2357179 - protein, 4 aa, Cryptosporidium parvum
KYSP

SEQ ID NO: 2357180 - protein, 10 aa, Cryptosporidium parvum
KYSSLSNKHY

SEQ ID NO: 2357181 - protein, 6 aa, Cryptosporidium parvum
LASYKR

SEQ ID NO: 2357182 - protein, 12 aa, Cryptosporidium parvum
LCETTSNNERFN

SEQ ID NO: 2357183 - protein, 20 aa, Cryptosporidium parvum
LDGSSSNQGYSGSRAGSGWT

SEQ ID NO: 2357184 - protein, 6 aa, Cryptosporidium parvum
LDPEKA

SEQ ID NO: 2357185 - protein, 5 aa, Cryptosporidium parvum
LDPSN

SEQ ID NO: 2357186 - protein, 18 aa, Cryptosporidium parvum
LDSSDTLDESTPSSNSDL

SEQ ID NO: 2357187 - protein, 16 aa, Cryptosporidium parvum
LEAEAGNEFGGSRADQ

SEQ ID NO: 2357188 - protein, 28 aa, Cryptosporidium parvum
LEEKERKKALKEANKKSSSDKNEANDAK

SEQ ID NO: 2357189 - protein, 4 aa, Cryptosporidium parvum
LEER

SEQ ID NO: 2357190 - protein, 7 aa, Cryptosporidium parvum
LEKERLE

SEQ ID NO: 2357191 - protein, 7 aa, Cryptosporidium parvum
LENRPED

SEQ ID NO: 2357192 - protein, 4 aa, Cryptosporidium parvum
LESA

SEQ ID NO: 2357193 - protein, 9 aa, Cryptosporidium parvum
LGCSQTDND

SEQ ID NO: 2357194 - protein, 23 aa, Cryptosporidium parvum
LGDEETDSSRSQAESGLSQENSA

SEQ ID NO: 2357195 - protein, 36 aa, Cryptosporidium parvum; identical to SEQ ID NO: 2329856

SEQ ID NO: 2357196 - protein, 9 aa, Cryptosporidium parvum
LGNSGKSDK

SEQ ID NO: 2357197 - protein, 9 aa, Cryptosporidium parvum
LIPKPERKS

SEQ ID NO: 2357198 - protein, 7 aa, Cryptosporidium parvum
LKDEKTM

SEQ ID NO: 2357199 - protein, 74 aa, Cryptosporidium parvum
LKSNPLGNENNYQAYSDRNHYSSNKKVGPKGIVSPGGLGSNRANYSYNSQSVNNGGALSHSRTVHSRSSLSPGN

SEQ ID NO: 2357200 - protein, 12 aa, Cryptosporidium parvum
LKTRSKASNHKS

SEQ ID NO: 2357201 - protein, 10 aa, Cryptosporidium parvum
LNSKSKVKHE

SEQ ID NO: 2357202 - protein, 7 aa, Cryptosporidium parvum
LNSSSRQ

SEQ ID NO: 2357203 - protein, 6 aa, Cryptosporidium parvum
LQKKDV

SEQ ID NO: 2357204 - protein, 4 aa, Cryptosporidium parvum
LQKS

SEQ ID NO: 2357205 - protein, 7 aa, Cryptosporidium parvum
LSESADE

SEQ ID NO: 2357206 - protein, 7 aa, Cryptosporidium parvum
LSKDELS

SEQ ID NO: 2357207 - protein, 5 aa, Cryptosporidium parvum
LSKQI

SEQ ID NO: 2357208 - protein, 8 aa, Cryptosporidium parvum
LSRSQKKR

SEQ ID NO: 2357209 - protein, 9 aa, Cryptosporidium parvum
LSSNSSKIL

SEQ ID NO: 2357210 - protein, 6 aa, Cryptosporidium parvum
LSTSMP

SEQ ID NO: 2357211 - protein, 7 aa, Cryptosporidium parvum
LTEKESK

SEQ ID NO: 2357212 - protein, 9 aa, Cryptosporidium parvum
LTESAKQAR

SEQ ID NO: 2357213 - protein, 4 aa, Cryptosporidium parvum
LTSG

SEQ ID NO: 2357214 - protein, 5 aa, Cryptosporidium parvum
LTSPQ

SEQ ID NO: 2357215 - protein, 4 aa, Cryptosporidium parvum
LTSS

SEQ ID NO: 2357216 - protein, 12 aa, Cryptosporidium parvum
LYGRPGVDDDMN

SEQ ID NO: 2357217 - protein, 6 aa, Cryptosporidium parvum
LYQDET

SEQ ID NO: 2357218 - protein, 9 aa, Cryptosporidium parvum
MDSEEGKNK

SEQ ID NO: 2357219 - protein, 6 aa, Cryptosporidium parvum
MHSKYD

SEQ ID NO: 2357220 - protein, 11 aa, Cryptosporidium parvum
MKSPPKSPDDF

SEQ ID NO: 2357221 - protein, 10 aa, Cryptosporidium parvum
MNTGNQRNDQ

SEQ ID NO: 2357222 - protein, 6 aa, Cryptosporidium parvum
MPPQPQ

SEQ ID NO: 2357223 - protein, 11 aa, Cryptosporidium parvum
MRDSDGRLTSR

SEQ ID NO: 2357224 - protein, 6 aa, Cryptosporidium parvum
MRPPTY

SEQ ID NO: 2357225 - protein, 7 aa, Cryptosporidium parvum
MSQKENL

SEQ ID NO: 2357226 - protein, 7 aa, Cryptosporidium parvum
NAARAKL

SEQ ID NO: 2357227 - protein, 4 aa, Cryptosporidium parvum
NATD

SEQ ID NO: 2357228 - protein, 8 aa, Cryptosporidium parvum
NCPTNPSA

SEQ ID NO: 2357229 - protein, 5 aa, Cryptosporidium parvum
NDSCD

SEQ ID NO: 2357230 - protein, 9 aa, Cryptosporidium parvum
NDSNNNKTE

SEQ ID NO: 2357231 - protein, 12 aa, Cryptosporidium parvum
NEAEKNMRNAAE

SEQ ID NO: 2357232 - protein, 18 aa, Cryptosporidium parvum
NEKDILSKSEKTITPVTN

SEQ ID NO: 2357233 - protein, 16 aa, Cryptosporidium parvum
NENKKPDNEISSASDE

SEQ ID NO: 2357234 - protein, 5 aa, Cryptosporidium parvum
NENSD

SEQ ID NO: 2357235 - protein, 15 aa, Cryptosporidium parvum
NFNSKNVKGKYLGGG

SEQ ID NO: 2357236 - protein, 28 aa, Cryptosporidium parvum
NFSSSNNSNLNIENSQAVGNFNSEKENE

SEQ ID NO: 2357237 - protein, 12 aa, Cryptosporidium parvum
NGEIEKKMKESN

SEQ ID NO: 2357238 - protein, 10 aa, Cryptosporidium parvum
NGNEYHDGTK

SEQ ID NO: 2357239 - protein, 10 aa, Cryptosporidium parvum
NGPQNDIPYE

SEQ ID NO: 2357240 - protein, 9 aa, Cryptosporidium parvum
NGQYNTGST

SEQ ID NO: 2357241 - protein, 27 aa, Cryptosporidium parvum
NGSISSTNNNSETNSLNGEIPNNSSEF

SEQ ID NO: 2357242 - protein, 4 aa, Cryptosporidium parvum
NGSV

SEQ ID NO: 2357243 - protein, 5 aa, Cryptosporidium parvum
NGTSA

SEQ ID NO: 2357244 - protein, 5 aa, Cryptosporidium parvum
NHSST

SEQ ID NO: 2357245 - protein, 32 aa, Cryptosporidium parvum; identical to SEQ ID NO: 2203777

SEQ ID NO: 2357246 - protein, 15 aa, Cryptosporidium parvum
NKKGKVKDSKCENKK

SEQ ID NO: 2357247 - protein, 8 aa, Cryptosporidium parvum
NKNKVESL

SEQ ID NO: 2357248 - protein, 10 aa, Cryptosporidium parvum
NKNSSDEDLA

SEQ ID NO: 2357249 - protein, 7 aa, Cryptosporidium parvum
NKSELRS

SEQ ID NO: 2357250 - protein, 8 aa, Cryptosporidium parvum
NKSKIQEG

SEQ ID NO: 2357251 - protein, 23 aa, Cryptosporidium parvum
NKTNKMKDNGVNSNQEKKEEDNL

SEQ ID NO: 2357252 - protein, 11 aa, Cryptosporidium parvum
NLQSKESTFST

SEQ ID NO: 2357253 - protein, 14 aa, Cryptosporidium parvum
NNASSKPQESKENK

SEQ ID NO: 2357254 - protein, 5 aa, Cryptosporidium parvum
NNENE

SEQ ID NO: 2357255 - protein, 4 aa, Cryptosporidium parvum
NNEQ

SEQ ID NO: 2357256 - protein, 4 aa, Cryptosporidium parvum
NNGV

SEQ ID NO: 2357257 - protein, 12 aa, Cryptosporidium parvum
NNKEKRRNNRIP

SEQ ID NO: 2357258 - protein, 11 aa, Cryptosporidium parvum
NNNSNKGPLGS

SEQ ID NO: 2357259 - protein, 5 aa, Cryptosporidium parvum
NNPYS

SEQ ID NO: 2357260 - protein, 15 aa, Cryptosporidium parvum
NNRGAPVDDEGHGTH

SEQ ID NO: 2357261 - protein, 11 aa, Cryptosporidium parvum
NPADQSATPEV

SEQ ID NO: 2357262 - protein, 6 aa, Cryptosporidium parvum
NPKNNF

SEQ ID NO: 2357263 - protein, 7 aa, Cryptosporidium parvum
NPNFPEY

SEQ ID NO: 2357264 - protein, 5 aa, Cryptosporidium parvum
NPQKV

SEQ ID NO: 2357265 - protein, 10 aa, Cryptosporidium parvum
NQANVKEGEA

SEQ ID NO: 2357266 - protein, 5 aa, Cryptosporidium parvum
NQPRM

SEQ ID NO: 2357267 - protein, 10 aa, Cryptosporidium parvum
NRDETKVGDP

SEQ ID NO: 2357268 - protein, 6 aa, Cryptosporidium parvum
NRDVRH

SEQ ID NO: 2357269 - protein, 6 aa, Cryptosporidium parvum
NSKDID

SEQ ID NO: 2357270 - protein, 16 aa, Cryptosporidium parvum
NSKKGRGKGAFENKGK

SEQ ID NO: 2357271 - protein, 11 aa, Cryptosporidium parvum
NSKPGNGEKNY

SEQ ID NO: 2357272 - protein, 4 aa, Cryptosporidium parvum
NSNG

SEQ ID NO: 2357273 - protein, 11 aa, Cryptosporidium parvum
NSPGNKVSKGK

SEQ ID NO: 2357274 - protein, 9 aa, Cryptosporidium parvum
NSQYGNNHE

SEQ ID NO: 2357275 - protein, 6 aa, Cryptosporidium parvum
NSRREP

SEQ ID NO: 2357276 - protein, 6 aa, Cryptosporidium parvum
NSTEVD

SEQ ID NO: 2357277 - protein, 9 aa, Cryptosporidium parvum
NSYESNENI

SEQ ID NO: 2357278 - protein, 10 aa, Cryptosporidium parvum
NTLDRYGSSN

SEQ ID NO: 2357279 - protein, 5 aa, Cryptosporidium parvum
NVQSK

SEQ ID NO: 2357280 - protein, 15 aa, Cryptosporidium parvum
NWDSTDDIDDSNTIS

SEQ ID NO: 2357281 - protein, 14 aa, Cryptosporidium parvum
NWEKYTTTPLDSDC

SEQ ID NO: 2357282 - protein, 10 aa, Cryptosporidium parvum
NYETTSSTDT

SEQ ID NO: 2357283 - protein, 9 aa, Cryptosporidium parvum
PAAASDEEY

SEQ ID NO: 2357284 - protein, 6 aa, Cryptosporidium parvum
PAVPVP

SEQ ID NO: 2357285 - protein, 10 aa, Cryptosporidium parvum
PDMTGASEAL

SEQ ID NO: 2357286 - protein, 10 aa, Cryptosporidium parvum
PDPNNENNGV

SEQ ID NO: 2357287 - protein, 16 aa, Cryptosporidium parvum
PDSRCPDNTEKTSTGC

SEQ ID NO: 2357288 - protein, 10 aa, Cryptosporidium parvum
PDTIGPQSSS

SEQ ID NO: 2357289 - protein, 7 aa, Cryptosporidium parvum
PEDLPKN

SEQ ID NO: 2357290 - protein, 4 aa, Cryptosporidium parvum
PENP

SEQ ID NO: 2357291 - protein, 7 aa, Cryptosporidium parvum
PESDPTQ

SEQ ID NO: 2357292 - protein, 12 aa, Cryptosporidium parvum
PFSDKSGTIGNI

SEQ ID NO: 2357293 - protein, 12 aa, Cryptosporidium parvum
PGAGKRQHCKYC

SEQ ID NO: 2357294 - protein, 30 aa, Cryptosporidium parvum
PGSELEEGEKIGTLKSTSVSGQALTNNIPS

SEQ ID NO: 2357295 - protein, 5 aa, Cryptosporidium parvum
PGTEI

SEQ ID NO: 2357296 - protein, 8 aa, Cryptosporidium parvum
PGYTDSGD

SEQ ID NO: 2357297 - protein, 8 aa, Cryptosporidium parvum
PHKSPTTD

SEQ ID NO: 2357298 - protein, 11 aa, Cryptosporidium parvum
PKSSSIYTQPS

SEQ ID NO: 2357299 - protein, 6 aa, Cryptosporidium parvum
PLSQNK

SEQ ID NO: 2357300 - protein, 6 aa, Cryptosporidium parvum
PLTPQN

SEQ ID NO: 2357301 - protein, 10 aa, Cryptosporidium parvum
PNDGQSYKKR

SEQ ID NO: 2357302 - protein, 4 aa, Cryptosporidium parvum
PNGN

SEQ ID NO: 2357303 - protein, 5 aa, Cryptosporidium parvum
PNYGS

SEQ ID NO: 2357304 - protein, 13 aa, Cryptosporidium parvum
PQGYRNANGIQTA

SEQ ID NO: 2357305 - protein, 8 aa, Cryptosporidium parvum
PQNSQEEE

SEQ ID NO: 2357306 - protein, 6 aa, Cryptosporidium parvum
PRQKEK

SEQ ID NO: 2357307 - protein, 8 aa, Cryptosporidium parvum
PSEESRNS

SEQ ID NO: 2357308 - protein, 8 aa, Cryptosporidium parvum
PSKSFSSN

SEQ ID NO: 2357309 - protein, 92 aa, Cryptosporidium parvum; identical to SEQ ID NO: 2331133

SEQ ID NO: 2357310 - protein, 6 aa, Cryptosporidium parvum
PSSIPD

SEQ ID NO: 2357311 - protein, 33 aa, Cryptosporidium parvum; identical to SEQ ID NO: 2331150

SEQ ID NO: 2357312 - protein, 5 aa, Cryptosporidium parvum
PSVTP

SEQ ID NO: 2357313 - protein, 4 aa, Cryptosporidium parvum
PTME

SEQ ID NO: 2357314 - protein, 7 aa, Cryptosporidium parvum
PTSREEI

SEQ ID NO: 2357315 - protein, 5 aa, Cryptosporidium parvum
PTSTD

SEQ ID NO: 2357316 - protein, 9 aa, Cryptosporidium parvum
PVKEPNIKN

SEQ ID NO: 2357317 - protein, 13 aa, Cryptosporidium parvum
PVPAPTVPTPAQA

SEQ ID NO: 2357318 - protein, 6 aa, Cryptosporidium parvum
PYATPA

SEQ ID NO: 2357319 - protein, 14 aa, Cryptosporidium parvum
QANQPNVSEYNSEQ

SEQ ID NO: 2357320 - protein, 7 aa, Cryptosporidium parvum
QCPPGYE

SEQ ID NO: 2357321 - protein, 5 aa, Cryptosporidium parvum
QCQSI

SEQ ID NO: 2357322 - protein, 20 aa, Cryptosporidium parvum
QDFKPTPSKQPKLPSKDVES

SEQ ID NO: 2357323 - protein, 9 aa, Cryptosporidium parvum
QDGTRSKEC

SEQ ID NO: 2357324 - protein, 8 aa, Cryptosporidium parvum
QDKRGNYR

SEQ ID NO: 2357325 - protein, 13 aa, Cryptosporidium parvum
QEHDPSRGDIIFD

SEQ ID NO: 2357326 - protein, 21 aa, Cryptosporidium parvum
QEYPENRESKKSLLKKRSDEF

SEQ ID NO: 2357327 - protein, 8 aa, Cryptosporidium parvum
QIEGNGRF

SEQ ID NO: 2357328 - protein, 18 aa, Cryptosporidium parvum
QIGGGEQITPSSKKGNKF

SEQ ID NO: 2357329 - protein, 5 aa, Cryptosporidium parvum
QKGIE

SEQ ID NO: 2357330 - protein, 11 aa, Cryptosporidium parvum
QKIESKHDQAR

SEQ ID NO: 2357331 - protein, 9 aa, Cryptosporidium parvum
QKPPEEDYE

SEQ ID NO: 2357332 - protein, 7 aa, Cryptosporidium parvum
QKSTAIY

SEQ ID NO: 2357333 - protein, 38 aa, Cryptosporidium parvum
QLDTSPAKLDESVENEHFESQDPLPTYTQTDKDELQEV

SEQ ID NO: 2357334 - protein, 5 aa, Cryptosporidium parvum
QLSPS

SEQ ID NO: 2357335 - protein, 5 aa, Cryptosporidium parvum
QMQPG

SEQ ID NO: 2357336 - protein, 11 aa, Cryptosporidium parvum
QNLNESNSKTK

SEQ ID NO: 2357337 - protein, 10 aa, Cryptosporidium parvum
QNYSGARSKD

SEQ ID NO: 2357338 - protein, 6 aa, Cryptosporidium parvum
QPIETA

SEQ ID NO: 2357339 - protein, 16 aa, Cryptosporidium parvum
QPSSSYSTSSLNPSVQ

SEQ ID NO: 2357340 - protein, 13 aa, Cryptosporidium parvum
QQFPTKPTATYGV

SEQ ID NO: 2357341 - protein, 4 aa, Cryptosporidium parvum
QSDE

SEQ ID NO: 2357342 - protein, 6 aa, Cryptosporidium parvum
QSPKEN

SEQ ID NO: 2357343 - protein, 8 aa, Cryptosporidium parvum
QSSSCFSG

SEQ ID NO: 2357344 - protein, 13 aa, Cryptosporidium parvum
QSYKYENNTRNAL

SEQ ID NO: 2357345 - protein, 7 aa, Cryptosporidium parvum
QTQGCTS

SEQ ID NO: 2357346 - protein, 13 aa, Cryptosporidium parvum
QTSTAKPLSKSEL

SEQ ID NO: 2357347 - protein, 8 aa, Cryptosporidium parvum
QVSKNQSI

SEQ ID NO: 2357348 - protein, 4 aa, Cryptosporidium parvum
QVTY

SEQ ID NO: 2357349 - protein, 5 aa, Cryptosporidium parvum
QYPEL

SEQ ID NO: 2357350 - protein, 17 aa, Cryptosporidium parvum
QYSANKSHDSIRNTRET

SEQ ID NO: 2357351 - protein, 4 aa, Cryptosporidium parvum
RAYS

SEQ ID NO: 2357352 - protein, 7 aa, Cryptosporidium parvum
RDENDDF

SEQ ID NO: 2357353 - protein, 32 aa, Cryptosporidium parvum; identical to SEQ ID NO: 2331533

SEQ ID NO: 2357354 - protein, 6 aa, Cryptosporidium parvum
RECGPS

SEQ ID NO: 2357355 - protein, 4 aa, Cryptosporidium parvum
RFSE

SEQ ID NO: 2357356 - protein, 6 aa, Cryptosporidium parvum
RGEGDC

SEQ ID NO: 2357357 - protein, 5 aa, Cryptosporidium parvum
RGELA

SEQ ID NO: 2357358 - protein, 7 aa, Cryptosporidium parvum
RGPTQRL

SEQ ID NO: 2357359 - protein, 4 aa, Cryptosporidium parvum
RGRR

SEQ ID NO: 2357360 - protein, 23 aa, Cryptosporidium parvum
RGTEEESEDIVSRPSRFPRLVRV

SEQ ID NO: 2357361 - protein, 8 aa, Cryptosporidium parvum
RHNTNRKI

SEQ ID NO: 2357362 - protein, 9 aa, Cryptosporidium parvum
RIKDDQSQL

SEQ ID NO: 2357363 - protein, 9 aa, Cryptosporidium parvum
RKATGGEKM

SEQ ID NO: 2357364 - protein, 10 aa, Cryptosporidium parvum
RKEKSGGFED

SEQ ID NO: 2357365 - protein, 11 aa, Cryptosporidium parvum
RKLKGKKKKLL

SEQ ID NO: 2357366 - protein, 8 aa, Cryptosporidium parvum
RKNYKDSK

SEQ ID NO: 2357367 - protein, 7 aa, Cryptosporidium parvum
RKRRGIP

SEQ ID NO: 2357368 - protein, 9 aa, Cryptosporidium parvum
RMKQPNNKG

SEQ ID NO: 2357369 - protein, 29 aa, Cryptosporidium parvum
RNANENFKKHPEKKVERKHNEIGSVKTGG

SEQ ID NO: 2357370 - protein, 9 aa, Cryptosporidium parvum
RNEIRPYGY

SEQ ID NO: 2357371 - protein, 4 aa, Cryptosporidium parvum
RPPS

SEQ ID NO: 2357372 - protein, 28 aa, Cryptosporidium parvum
RPRTYESYDRYGSSSDKPLRKVVWWMAD

SEQ ID NO: 2357373 - protein, 5 aa, Cryptosporidium parvum
RSESN

SEQ ID NO: 2357374 - protein, 6 aa, Cryptosporidium parvum
RSRSKR

SEQ ID NO: 2357375 - protein, 12 aa, Cryptosporidium parvum
RTSATAGKVSPR

SEQ ID NO: 2357376 - protein, 10 aa, Cryptosporidium parvum
RTSKDYQPFK

SEQ ID NO: 2357377 - protein, 7 aa, Cryptosporidium parvum
RTYKGGK

SEQ ID NO: 2357378 - protein, 8 aa, Cryptosporidium parvum
SADDDDDV

SEQ ID NO: 2357379 - protein, 41 aa, Cryptosporidium parvum; identical to SEQ ID NO: 2331812

SEQ ID NO: 2357380 - protein, 10 aa, Cryptosporidium parvum
SAEGNGELDV

SEQ ID NO: 2357381 - protein, 9 aa, Cryptosporidium parvum
SCNNENGDF

SEQ ID NO: 2357382 - protein, 7 aa, Cryptosporidium parvum
SDANYNN

SEQ ID NO: 2357383 - protein, 11 aa, Cryptosporidium parvum
SDATPTHSKSN

SEQ ID NO: 2357384 - protein, 8 aa, Cryptosporidium parvum
SDDDSLNK

SEQ ID NO: 2357385 - protein, 8 aa, Cryptosporidium parvum
SDIDNKEE

SEQ ID NO: 2357386 - protein, 10 aa, Cryptosporidium parvum
SDIEDNGYEY

SEQ ID NO: 2357387 - protein, 19 aa, Cryptosporidium parvum
SDIENQTDIETTDDETNAI

SEQ ID NO: 2357388 - protein, 11 aa, Cryptosporidium parvum
SDINNSTQKAT

SEQ ID NO: 2357389 - protein, 4 aa, Cryptosporidium parvum
SDLK

SEQ ID NO: 2357390 - protein, 8 aa, Cryptosporidium parvum
SDMGKSIP

SEQ ID NO: 2357391 - protein, 9 aa, Cryptosporidium parvum
SDSNGSAPT

SEQ ID NO: 2357392 - protein, 8 aa, Cryptosporidium parvum
SDSSEFDL

SEQ ID NO: 2357393 - protein, 11 aa, Cryptosporidium parvum
SDVAGKEFETG

SEQ ID NO: 2357394 - protein, 20 aa, Cryptosporidium parvum
SEDNDQAEQNISPDSQIRDE

SEQ ID NO: 2357395 - protein, 7 aa, Cryptosporidium parvum
SEGKHEL

SEQ ID NO: 2357396 - protein, 12 aa, Cryptosporidium parvum
SEPIPAEQSGPV

SEQ ID NO: 2357397 - protein, 12 aa, Cryptosporidium parvum
SEPLSTAKHSSQ

SEQ ID NO: 2357398 - protein, 6 aa, Cryptosporidium parvum
SEQEEP

SEQ ID NO: 2357399 - protein, 53 aa, Cryptosporidium parvum; identical to SEQ ID NO: 2332038

SEQ ID NO: 2357400 - protein, 16 aa, Cryptosporidium parvum
SFDNDGESKYNSENGL

SEQ ID NO: 2357401 - protein, 6 aa, Cryptosporidium parvum
SFDSKY

SEQ ID NO: 2357402 - protein, 4 aa, Cryptosporidium parvum
SFKT

SEQ ID NO: 2357403 - protein, 5 aa, Cryptosporidium parvum
SFNSN

SEQ ID NO: 2357404 - protein, 14 aa, Cryptosporidium parvum
SFSAPNRECPPGYT

SEQ ID NO: 2357405 - protein, 24 aa, Cryptosporidium parvum
SGAIKGSVVPDSSGTTVVTSGNPI

SEQ ID NO: 2357406 - protein, 4 aa, Cryptosporidium parvum
SGDE

SEQ ID NO: 2357407 - protein, 4 aa, Cryptosporidium parvum
SGEC

SEQ ID NO: 2357408 - protein, 6 aa, Cryptosporidium parvum
SGHREH

SEQ ID NO: 2357409 - protein, 4 aa, Cryptosporidium parvum
SGIG

SEQ ID NO: 2357410 - protein, 18 aa, Cryptosporidium parvum
SGISNYQGFGSTGNGELS

SEQ ID NO: 2357411 - protein, 11 aa, Cryptosporidium parvum
SGLSTSDPRVE

SEQ ID NO: 2357412 - protein, 8 aa, Cryptosporidium parvum
SGNSETII

SEQ ID NO: 2357413 - protein, 21 aa, Cryptosporidium parvum
SGSQCEQIKEAPPVSECPPGY

SEQ ID NO: 2357414 - protein, 6 aa, Cryptosporidium parvum
SGTITS

SEQ ID NO: 2357415 - protein, 10 aa, Cryptosporidium parvum
SGVSPSNTKD

SEQ ID NO: 2357416 - protein, 15 aa, Cryptosporidium parvum
SIKNETEQNSSIQTG

SEQ ID NO: 2357417 - protein, 7 aa, Cryptosporidium parvum
SKASEYI

SEQ ID NO: 2357418 - protein, 6 aa, Cryptosporidium parvum
SKASPL

SEQ ID NO: 2357419 - protein, 9 aa, Cryptosporidium parvum
SKEIGSGCN

SEQ ID NO: 2357420 - protein, 15 aa, Cryptosporidium parvum
SKKQSKKQKSNNKKS

SEQ ID NO: 2357421 - protein, 10 aa, Cryptosporidium parvum
SKNDEPKYSS

SEQ ID NO: 2357422 - protein, 17 aa, Cryptosporidium parvum
SKNDRQIIGSNKDETNK

SEQ ID NO: 2357423 - protein, 9 aa, Cryptosporidium parvum
SKNSEEIST

SEQ ID NO: 2357424 - protein, 7 aa, Cryptosporidium parvum
SKPSEIV

SEQ ID NO: 2357425 - protein, 21 aa, Cryptosporidium parvum
SKQFSTGKTWERPSGAQGNNN

SEQ ID NO: 2357426 - protein, 10 aa, Cryptosporidium parvum
SKSEKTLTTE

SEQ ID NO: 2357427 - protein, 164 aa, Cryptosporidium parvum; identical to SEQ ID NO: 2332299

SEQ ID NO: 2357428 - protein, 30 aa, Cryptosporidium parvum; identical to SEQ ID NO: 2332302

SEQ ID NO: 2357429 - protein, 5 aa, Cryptosporidium parvum
SKVSK

SEQ ID NO: 2357430 - protein, 6 aa, Cryptosporidium parvum
SLADKL

SEQ ID NO: 2357431 - protein, 6 aa, Cryptosporidium parvum
SLGAQY

SEQ ID NO: 2357432 - protein, 6 aa, Cryptosporidium parvum
SLSNKQ

SEQ ID NO: 2357433 - protein, 6 aa, Cryptosporidium parvum
SNDREV

SEQ ID NO: 2357434 - protein, 10 aa, Cryptosporidium parvum
SNETSTVRGP

SEQ ID NO: 2357435 - protein, 7 aa, Cryptosporidium parvum
SNEYNER

SEQ ID NO: 2357436 - protein, 10 aa, Cryptosporidium parvum
SNFDNTSRGF

SEQ ID NO: 2357437 - protein, 4 aa, Cryptosporidium parvum
SNKK

SEQ ID NO: 2357438 - protein, 4 aa, Cryptosporidium parvum
SNKY

SEQ ID NO: 2357439 - protein, 6 aa, Cryptosporidium parvum
SNPIDS

SEQ ID NO: 2357440 - protein, 8 aa, Cryptosporidium parvum
SNSDDGVQ

SEQ ID NO: 2357441 - protein, 7 aa, Cryptosporidium parvum
SNSNSNP

SEQ ID NO: 2357442 - protein, 25 aa, Cryptosporidium parvum
SNSSLDNIKGQDDDELTSSEYLSEE

SEQ ID NO: 2357443 - protein, 6 aa, Cryptosporidium parvum
SPGIAK

SEQ ID NO: 2357444 - protein, 13 aa, Cryptosporidium parvum
SPLPHTKGQVPTY

SEQ ID NO: 2357445 - protein, 13 aa, Cryptosporidium parvum
SPMTNNENNSTKQ

SEQ ID NO: 2357446 - protein, 17 aa, Cryptosporidium parvum
SPPTTQTATSVAVPTPE

SEQ ID NO: 2357447 - protein, 8 aa, Cryptosporidium parvum
SPPTTQTV

SEQ ID NO: 2357448 - protein, 4 aa, Cryptosporidium parvum
SPPV

SEQ ID NO: 2357449 - protein, 8 aa, Cryptosporidium parvum
SPSKIRSG

SEQ ID NO: 2357450 - protein, 9 aa, Cryptosporidium parvum
SQEGNKAYG

SEQ ID NO: 2357451 - protein, 27 aa, Cryptosporidium parvum
SQIDGSEGQTDQSEYPNYNKEASISYS

SEQ ID NO: 2357452 - protein, 12 aa, Cryptosporidium parvum
SQNRSGSPNSKV

SEQ ID NO: 2357453 - protein, 8 aa, Cryptosporidium parvum
SQPEKECP

SEQ ID NO: 2357454 - protein, 7 aa, Cryptosporidium parvum
SQPPQPV

SEQ ID NO: 2357455 - protein, 9 aa, Cryptosporidium parvum
SQSSTPSCK

SEQ ID NO: 2357456 - protein, 7 aa, Cryptosporidium parvum
SQTHNKM

SEQ ID NO: 2357457 - protein, 7 aa, Cryptosporidium parvum
SRPARSV

SEQ ID NO: 2357458 - protein, 4 aa, Cryptosporidium parvum
SRPL

SEQ ID NO: 2357459 - protein, 9 aa, Cryptosporidium parvum
SRPMNPGKQ

SEQ ID NO: 2357460 - protein, 6 aa, Cryptosporidium parvum
SRTDDF

SEQ ID NO: 2357461 - protein, 6 aa, Cryptosporidium parvum
SSDENL

SEQ ID NO: 2357462 - protein, 24 aa, Cryptosporidium parvum
SSFKSSTDMSVNNKKSGIDSAVNN

SEQ ID NO: 2357463 - protein, 12 aa, Cryptosporidium parvum
SSFPQEKESRDE

SEQ ID NO: 2357464 - protein, 7 aa, Cryptosporidium parvum
SSGGSVE

SEQ ID NO: 2357465 - protein, 9 aa, Cryptosporidium parvum
SSGSCNNSS

SEQ ID NO: 2357466 - protein, 12 aa, Cryptosporidium parvum
SSGSTHKSKNNY

SEQ ID NO: 2357467 - protein, 12 aa, Cryptosporidium parvum
SSIVSEAEISIL

SEQ ID NO: 2357468 - protein, 8 aa, Cryptosporidium parvum
SSKDESEL

SEQ ID NO: 2357469 - protein, 4 aa, Cryptosporidium parvum
SSKG

SEQ ID NO: 2357470 - protein, 16 aa, Cryptosporidium parvum
SSKHTAGTHHYSTPSA

SEQ ID NO: 2357471 - protein, 7 aa, Cryptosporidium parvum
SSKSMSS

SEQ ID NO: 2357472 - protein, 12 aa, Cryptosporidium parvum
SSLLDKKTSTTS

SEQ ID NO: 2357473 - protein, 4 aa, Cryptosporidium parvum
SSPC

SEQ ID NO: 2357474 - protein, 12 aa, Cryptosporidium parvum
SSSSSSSFPVGT

SEQ ID NO: 2357475 - protein, 5 aa, Cryptosporidium parvum
SSTDE

SEQ ID NO: 2357476 - protein, 13 aa, Cryptosporidium parvum
SSTPYFQNTTSTE

SEQ ID NO: 2357477 - protein, 7 aa, Cryptosporidium parvum
SSTTSKN

SEQ ID NO: 2357478 - protein, 11 aa, Cryptosporidium parvum
STESDLASSSY

SEQ ID NO: 2357479 - protein, 10 aa, Cryptosporidium parvum
STHENNSKQG

SEQ ID NO: 2357480 - protein, 8 aa, Cryptosporidium parvum
STKKTSTR

SEQ ID NO: 2357481 - protein, 7 aa, Cryptosporidium parvum
STKNVNV

SEQ ID NO: 2357482 - protein, 7 aa, Cryptosporidium parvum
STNTSNF

SEQ ID NO: 2357483 - protein, 5 aa, Cryptosporidium parvum
STPGE

SEQ ID NO: 2357484 - protein, 5 aa, Cryptosporidium parvum
STQTE

SEQ ID NO: 2357485 - protein, 13 aa, Cryptosporidium parvum
STTTKTTTTEPVK

SEQ ID NO: 2357486 - protein, 25 aa, Cryptosporidium parvum
STVSQESQISKDNLEPNEARSSLRS

SEQ ID NO: 2357487 - protein, 7 aa, Cryptosporidium parvum
STYIPND

SEQ ID NO: 2357488 - protein, 11 aa, Cryptosporidium parvum
SVEESISDTQK

SEQ ID NO: 2357489 - protein, 5 aa, Cryptosporidium parvum
SVKQN

SEQ ID NO: 2357490 - protein, 8 aa, Cryptosporidium parvum
SVPSGNEI

SEQ ID NO: 2357491 - protein, 16 aa, Cryptosporidium parvum
SVPVSGPASAMPSRVQ

SEQ ID NO: 2357492 - protein, 4 aa, Cryptosporidium parvum
SVRS

SEQ ID NO: 2357493 - protein, 7 aa, Cryptosporidium parvum
SVRTSGT

SEQ ID NO: 2357494 - protein, 7 aa, Cryptosporidium parvum
SVSSQLN

SEQ ID NO: 2357495 - protein, 12 aa, Cryptosporidium parvum
SWGGGSFSQATY

SEQ ID NO: 2357496 - protein, 6 aa, Cryptosporidium parvum
SYAPPH

SEQ ID NO: 2357497 - protein, 6 aa, Cryptosporidium parvum
SYDSPP

SEQ ID NO: 2357498 - protein, 11 aa, Cryptosporidium parvum
SYNRGEEPSKL

SEQ ID NO: 2357499 - protein, 5 aa, Cryptosporidium parvum
SYPTK

SEQ ID NO: 2357500 - protein, 6 aa, Cryptosporidium parvum
TAEQNY

SEQ ID NO: 2357501 - protein, 5 aa, Cryptosporidium parvum
TAPPS

SEQ ID NO: 2357502 - protein, 7 aa, Cryptosporidium parvum
TAYPKPQ

SEQ ID NO: 2357503 - protein, 6 aa, Cryptosporidium parvum
TDENKE

SEQ ID NO: 2357504 - protein, 7 aa, Cryptosporidium parvum
TDHRGSL

SEQ ID NO: 2357505 - protein, 6 aa, Cryptosporidium parvum
TDSNKY

SEQ ID NO: 2357506 - protein, 9 aa, Cryptosporidium parvum
TDVSSGNRV

SEQ ID NO: 2357507 - protein, 23 aa, Cryptosporidium parvum
TEEDEEDFGGGFGSGVGSRYRRE

SEQ ID NO: 2357508 - protein, 7 aa, Cryptosporidium parvum
TENPNSV

SEQ ID NO: 2357509 - protein, 12 aa, Cryptosporidium parvum
TESRLNSDLSSE

SEQ ID NO: 2357510 - protein, 44 aa, Cryptosporidium parvum
TETSAISGPNQVSQSAQVEPSKTASISVEPPSPPTSAIEERTVG

SEQ ID NO: 2357511 - protein, 4 aa, Cryptosporidium parvum
TFTR

SEQ ID NO: 2357512 - protein, 8 aa, Cryptosporidium parvum
TGGEQQFS

SEQ ID NO: 2357513 - protein, 5 aa, Cryptosporidium parvum
TGPAV

SEQ ID NO: 2357514 - protein, 15 aa, Cryptosporidium parvum
TGQVQTNKKTDSDGS

SEQ ID NO: 2357515 - protein, 9 aa, Cryptosporidium parvum
TGSESPIKE

SEQ ID NO: 2357516 - protein, 5 aa, Cryptosporidium parvum
TGSTL

SEQ ID NO: 2357517 - protein, 18 aa, Cryptosporidium parvum
TIGQPSKSTSISKPGEIG

SEQ ID NO: 2357518 - protein, 7 aa, Cryptosporidium parvum
TISNEEL

SEQ ID NO: 2357519 - protein, 5 aa, Cryptosporidium parvum
TISYD

SEQ ID NO: 2357520 - protein, 8 aa, Cryptosporidium parvum
TKECPPGF

SEQ ID NO: 2357521 - protein, 5 aa, Cryptosporidium parvum
TKPGL

SEQ ID NO: 2357522 - protein, 12 aa, Cryptosporidium parvum
TKSQKKKLEKER

SEQ ID NO: 2357523 - protein, 19 aa, Cryptosporidium parvum
TKTDLSNTNQENQSENVPV

SEQ ID NO: 2357524 - protein, 6 aa, Cryptosporidium parvum
TNPPSF

SEQ ID NO: 2357525 - protein, 10 aa, Cryptosporidium parvum
TPKKPSLDAF

SEQ ID NO: 2357526 - protein, 4 aa, Cryptosporidium parvum
TPVY

SEQ ID NO: 2357527 - protein, 10 aa, Cryptosporidium parvum
TQEPDDAFPE

SEQ ID NO: 2357528 - protein, 4 aa, Cryptosporidium parvum
TREG

SEQ ID NO: 2357529 - protein, 6 aa, Cryptosporidium parvum
TRELTN

SEQ ID NO: 2357530 - protein, 8 aa, Cryptosporidium parvum
TRGRRENT

SEQ ID NO: 2357531 - protein, 15 aa, Cryptosporidium parvum
TRNIRGTRGFGQGVT

SEQ ID NO: 2357532 - protein, 13 aa, Cryptosporidium parvum
TRNRSTGAEVPRK

SEQ ID NO: 2357533 - protein, 11 aa, Cryptosporidium parvum
TRSRPCGGYSE

SEQ ID NO: 2357534 - protein, 13 aa, Cryptosporidium parvum
TSANKGYKRLSGT

SEQ ID NO: 2357535 - protein, 5 aa, Cryptosporidium parvum
TSDEI

SEQ ID NO: 2357536 - protein, 10 aa, Cryptosporidium parvum
TSEIQNPGHH

SEQ ID NO: 2357537 - protein, 4 aa, Cryptosporidium parvum
TSGH

SEQ ID NO: 2357538 - protein, 4 aa, Cryptosporidium parvum
TSGR

SEQ ID NO: 2357539 - protein, 8 aa, Cryptosporidium parvum
TSKDSAEY

SEQ ID NO: 2357540 - protein, 9 aa, Cryptosporidium parvum
TSQPTKPYD

SEQ ID NO: 2357541 - protein, 5 aa, Cryptosporidium parvum
TSRSY

SEQ ID NO: 2357542 - protein, 11 aa, Cryptosporidium parvum
TSSAPTQPVCP

SEQ ID NO: 2357543 - protein, 8 aa, Cryptosporidium parvum
TSSGSFVG

SEQ ID NO: 2357544 - protein, 10 aa, Cryptosporidium parvum
TSVSKGSGVY

SEQ ID NO: 2357545 - protein, 4 aa, Cryptosporidium parvum
TTET

SEQ ID NO: 2357546 - protein, 5 aa, Cryptosporidium parvum
TTNSN

SEQ ID NO: 2357547 - protein, 18 aa, Cryptosporidium parvum
TVKHSEKSLDIEDEKQYK

SEQ ID NO: 2357548 - protein, 11 aa, Cryptosporidium parvum
TVSGPSGPQQK

SEQ ID NO: 2357549 - protein, 5 aa, Cryptosporidium parvum
TWEGE

SEQ ID NO: 2357550 - protein, 4 aa, Cryptosporidium parvum
TYFQ

SEQ ID NO: 2357551 - protein, 21 aa, Cryptosporidium parvum
VAQGTRRSLGTASNHPHHSSG

SEQ ID NO: 2357552 - protein, 6 aa, Cryptosporidium parvum
VCPNGD

SEQ ID NO: 2357553 - protein, 8 aa, Cryptosporidium parvum
VDKTSKEL

SEQ ID NO: 2357554 - protein, 7 aa, Cryptosporidium parvum
VDLAGQD

SEQ ID NO: 2357555 - protein, 20 aa, Cryptosporidium parvum
VDSVDKKKSLKSAAKAKSRE

SEQ ID NO: 2357556 - protein, 10 aa, Cryptosporidium parvum
VEPSTSQQRS

SEQ ID NO: 2357557 - protein, 6 aa, Cryptosporidium parvum
VESNST

SEQ ID NO: 2357558 - protein, 13 aa, Cryptosporidium parvum
VGAESTNQEVNEQ

SEQ ID NO: 2357559 - protein, 38 aa, Cryptosporidium parvum; identical to SEQ ID NO: 2333456

SEQ ID NO: 2357560 - protein, 4 aa, Cryptosporidium parvum
VGSQ

SEQ ID NO: 2357561 - protein, 5 aa, Cryptosporidium parvum
VGTKQ

SEQ ID NO: 2357562 - protein, 9 aa, Cryptosporidium parvum
VKAGNVKPI

SEQ ID NO: 2357563 - protein, 12 aa, Cryptosporidium parvum
VKIEKDNGKGFG

SEQ ID NO: 2357564 - protein, 7 aa, Cryptosporidium parvum
VKPVQKS

SEQ ID NO: 2357565 - protein, 20 aa, Cryptosporidium parvum
VKTESAPRLTECPPGTTLEN

SEQ ID NO: 2357566 - protein, 41 aa, Cryptosporidium parvum
VNQAQSSSKDLEEEKDDDEEKEIGVSREARDVEENEFGRLD

SEQ ID NO: 2357567 - protein, 13 aa, Cryptosporidium parvum
VPAKTDSSQASFE

SEQ ID NO: 2357568 - protein, 8 aa, Cryptosporidium parvum
VPTETPAV

SEQ ID NO: 2357569 - protein, 11 aa, Cryptosporidium parvum
VPTPAQTPDIE

SEQ ID NO: 2357570 - protein, 9 aa, Cryptosporidium parvum
VQPQTINQP

SEQ ID NO: 2357571 - protein, 15 aa, Cryptosporidium parvum
VQSDTAPPNPECPPG

SEQ ID NO: 2357572 - protein, 12 aa, Cryptosporidium parvum
VQSTSQKGYSHG

SEQ ID NO: 2357573 - protein, 23 aa, Cryptosporidium parvum
VQTTTSPKTPECPPGSALDGDSC

SEQ ID NO: 2357574 - protein, 4 aa, Cryptosporidium parvum
VSGY

SEQ ID NO: 2357575 - protein, 26 aa, Cryptosporidium parvum
VSKQNGMKTNGSSDEQKDEEDKEIDN

SEQ ID NO: 2357576 - protein, 20 aa, Cryptosporidium parvum
VSNDIDQNVQDEENKSFGSD

SEQ ID NO: 2357577 - protein, 5 aa, Cryptosporidium parvum
VSNES

SEQ ID NO: 2357578 - protein, 9 aa, Cryptosporidium parvum
VSSSDGAAS

SEQ ID NO: 2357579 - protein, 23 aa, Cryptosporidium parvum
VTGSPLKTPRTDSISEASAQGAH

SEQ ID NO: 2357580 - protein, 15 aa, Cryptosporidium parvum
VTSARKSESLPTSAE

SEQ ID NO: 2357581 - protein, 9 aa, Cryptosporidium parvum
VYKSNSKSE

SEQ ID NO: 2357582 - protein, 5 aa, Cryptosporidium parvum
WTGNS

SEQ ID NO: 2357583 - protein, 11 aa, Cryptosporidium parvum
YGEQGAGELIG

SEQ ID NO: 2357584 - protein, 6 aa, Cryptosporidium parvum
YKPINT

SEQ ID NO: 2357585 - protein, 10 aa, Cryptosporidium parvum
YKSSQPPKGF

SEQ ID NO: 2357586 - protein, 5 aa, Cryptosporidium parvum
YKTEE

SEQ ID NO: 2357587 - protein, 9 aa, Cryptosporidium parvum
YLKNSNNSL

SEQ ID NO: 2357588 - protein, 4 aa, Cryptosporidium parvum
YRPQ

SEQ ID NO: 2357589 - protein, 14 aa, Cryptosporidium parvum
YRSSAGDGKIPPCY

SEQ ID NO: 2357590 - protein, 8 aa, Cryptosporidium parvum
YSLETGKQ

SEQ ID NO: 2357591 - protein, 4 aa, Cryptosporidium parvum
YSPE

SEQ ID NO: 2357592 - protein, 9 aa, Cryptosporidium parvum
YSPLNPHRT

SEQ ID NO: 2357593 - protein, 16 aa, Cryptosporidium parvum
YSPSNVKSNIKNPKLP

SEQ ID NO: 2357594 - protein, 5 aa, Cryptosporidium parvum
YTKSL

SEQ ID NO: 2357595 - protein, 9 aa, Cryptosporidium parvum
YTPENHPKR

SEQ ID NO: 2357596 - protein, 6 aa, Cryptosporidium parvum
YVEPDQ

SEQ ID NO: 2357597 - protein, 9 aa, Cryptosporidium parvum
YYKKSEDVR

SEQ ID NO: 2357598 - protein, 25 aa, Cryptosporidium parvum
ADYELACPPGLIVISDKCAKYADKV

SEQ ID NO: 2357599 - protein, 18 aa, Cryptosporidium parvum
AFTKQEWLATSSGSFVGR

SEQ ID NO: 2357600 - protein, 18 aa, Cryptosporidium parvum
AIDGFAHFDFLYKKLYDI

SEQ ID NO: 2357601 - protein, 17 aa, Cryptosporidium parvum
AIRSLLHHLIQVTNPNI

SEQ ID NO: 2357602 - protein, 31 aa, Cryptosporidium parvum; identical to SEQ ID NO: 2333920

SEQ ID NO: 2357603 - protein, 24 aa, Cryptosporidium parvum
ALNSKSFIVRRWGKNVQSKLRKLR

SEQ ID NO: 2357604 - protein, 17 aa, Cryptosporidium parvum
AQLLFSKQTEEIIMTGE

SEQ ID NO: 2357605 - protein, 24 aa, Cryptosporidium parvum
AQTCNSINGPFCKYLNQISDSSEF

SEQ ID NO: 2357606 - protein, 27 aa, Cryptosporidium parvum
ASFKYRKCKYWSWRATDFSCSLKSKSS

SEQ ID NO: 2357607 - protein, 19 aa, Cryptosporidium parvum
ATCAEISKLSPPVHCGSVD

SEQ ID NO: 2357608 - protein, 18 aa, Cryptosporidium parvum
AVSIAKEIHTLFPQIKFK

SEQ ID NO: 2357609 - protein, 24 aa, Cryptosporidium parvum
AYRALSIPFSDYFLDTDKKTLKSL

SEQ ID NO: 2357610 - protein, 17 aa, Cryptosporidium parvum
CKSVAFPPNPKYNKDFV

SEQ ID NO: 2357611 - protein, 21 aa, Cryptosporidium parvum
DAESFSRRLATGFEDSDPSSM

SEQ ID NO: 2357612 - protein, 20 aa, Cryptosporidium parvum
DFFIGKSIFNLFLIPKIADL

SEQ ID NO: 2357613 - protein, 29 aa, Cryptosporidium parvum
DFNYKARISLRLEAQYSLAHSLIAAILTL

SEQ ID NO: 2357614 - protein, 25 aa, Cryptosporidium parvum
DHELFKFLEFKGIPILNKNSKDIDG

SEQ ID NO: 2357615 - protein, 28 aa, Cryptosporidium parvum
DILRYPEVVSTPGERLVSMFRKSKISKC

SEQ ID NO: 2357616 - protein, 21 aa, Cryptosporidium parvum
DLANSFSCLFDESTECVPVES

SEQ ID NO: 2357617 - protein, 25 aa, Cryptosporidium parvum
DLVRKLPCKHIYHFNCIDEWVKIKS

SEQ ID NO: 2357618 - protein, 26 aa, Cryptosporidium parvum
DQQCKDFGISSCRRALINILNIYSKV

SEQ ID NO: 2357619 - protein, 23 aa, Cryptosporidium parvum
DRSEFSDPVIMESFENVPAKTDS

SEQ ID NO: 2357620 - protein, 22 aa, Cryptosporidium parvum
DSELVKDIIIWVTIPTDENKEV

SEQ ID NO: 2357621 - protein, 26 aa, Cryptosporidium parvum
DSKSSCACCSCSKSGNTKEPKPEKES

SEQ ID NO: 2357622 - protein, 22 aa, Cryptosporidium parvum
DSLPPTWHVYGIRPIQASIIRT

SEQ ID NO: 2357623 - protein, 23 aa, Cryptosporidium parvum
DTDICFKSCMAFSTLDGQVHVAD

SEQ ID NO: 2357624 - protein, 24 aa, Cryptosporidium parvum
EAVIWSHLMRKWIFLPRRVSFDEY

SEQ ID NO: 2357625 - protein, 23 aa, Cryptosporidium parvum
EDSEIKARILAGNESDFKTERIS

SEQ ID NO: 2357626 - protein, 25 aa, Cryptosporidium parvum
EDSMIRFGYLGGYLAVDFLPSRKKI

SEQ ID NO: 2357627 - protein, 17 aa, Cryptosporidium parvum
EERRICEKIPLFSTSPM

SEQ ID NO: 2357628 - protein, 23 aa, Cryptosporidium parvum
EEYSLVCSSGFVLLGDRCALFTN

SEQ ID NO: 2357629 - protein, 20 aa, Cryptosporidium parvum
EEYWTPFGIDPALLKKDIDS

SEQ ID NO: 2357630 - protein, 19 aa, Cryptosporidium parvum
EFTCPGMLHSPRAQLLFSK

SEQ ID NO: 2357631 - protein, 28 aa, Cryptosporidium parvum
EGKKRRWEFVIEWRNVFLKSEQYNSKSA

SEQ ID NO: 2357632 - protein, 21 aa, Cryptosporidium parvum
EGMEYCRKGILSLLKEGQIEL

SEQ ID NO: 2357633 - protein, 17 aa, Cryptosporidium parvum
EIEFSKPDIKRCNQISG

SEQ ID NO: 2357634 - protein, 24 aa, Cryptosporidium parvum
ENSFKPRIYLRFKSLRDPSSTGFE

SEQ ID NO: 2357635 - protein, 24 aa, Cryptosporidium parvum
EPAKNTFIFKNRYEEMKNTQSTSG

SEQ ID NO: 2357636 - protein, 24 aa, Cryptosporidium parvum
EPFALLECHALTWIDFSVVMDIKF

SEQ ID NO: 2357637 - protein, 17 aa, Cryptosporidium parvum
ERILRFLGSNPVDLAGQ

SEQ ID NO: 2357638 - protein, 20 aa, Cryptosporidium parvum
ERPPKCIFKTEIQFKVIDLP

SEQ ID NO: 2357639 - protein, 18 aa, Cryptosporidium parvum
ERSSRMEFVITRNAEIAI

SEQ ID NO: 2357640 - protein, 18 aa, Cryptosporidium parvum
ESDYDLNSLMVFRHDDIK

SEQ ID NO: 2357641 - protein, 22 aa, Cryptosporidium parvum
ETWTASCPLSSWHDEFSDALVS

SEQ ID NO: 2357642 - protein, 24 aa, Cryptosporidium parvum
EVIIFKLKLGKIIKNENKKPDNEI

SEQ ID NO: 2357643 - protein, 18 aa, Cryptosporidium parvum
EVVVQCKSVAFPPNPKYN

SEQ ID NO: 2357644 - protein, 19 aa, Cryptosporidium parvum
EWIDYLTILIDDWLDSDAN

SEQ ID NO: 2357645 - protein, 24 aa, Cryptosporidium parvum
EYVQEGAVLLGIWNDNTIFLRFEA

SEQ ID NO: 2357646 - protein, 24 aa, Cryptosporidium parvum
FAIDLRDICRFVGKVEPWIYTKRS

SEQ ID NO: 2357647 - protein, 23 aa, Cryptosporidium parvum
FEHFKLSFTYTLHGDRNCTRLLL

SEQ ID NO: 2357648 - protein, 27 aa, Cryptosporidium parvum
FEIHHPPKLLFFFGSINKFEAYPSHLT

SEQ ID NO: 2357649 - protein, 20 aa, Cryptosporidium parvum
FEVEVAKILYWRIKTDAELS

SEQ ID NO: 2357650 - protein, 19 aa, Cryptosporidium parvum
FGNMPFSYINTVKELPVGL

SEQ ID NO: 2357651 - protein, 18 aa, Cryptosporidium parvum
FGVDSCSIESGIASLRAY

SEQ ID NO: 2357652 - protein, 17 aa, Cryptosporidium parvum
FHNSCFGVLSFGLRGYL

SEQ ID NO: 2357653 - protein, 19 aa, Cryptosporidium parvum
FIACILYFISLVSANGVCI

SEQ ID NO: 2357654 - protein, 18 aa, Cryptosporidium parvum
FIIPFVLSQSTLLNLGAG

SEQ ID NO: 2357655 - protein, 24 aa, Cryptosporidium parvum
FKPFAEVARAVGIPAHSSYKEKSE

SEQ ID NO: 2357656 - protein, 18 aa, Cryptosporidium parvum
FLGFSCLSKVVLGGDEAH

SEQ ID NO: 2357657 - protein, 17 aa, Cryptosporidium parvum
FLLFLELQNAWSSLNLS

SEQ ID NO: 2357658 - protein, 18 aa, Cryptosporidium parvum
FLPSRKKICFEIEENGEI

SEQ ID NO: 2357659 - protein, 20 aa, Cryptosporidium parvum
FNRRSILKLLPDIFKSNPID

SEQ ID NO: 2357660 - protein, 22 aa, Cryptosporidium parvum
FPPELVCPPGYTMEAGVAQGTR

SEQ ID NO: 2357661 - protein, 26 aa, Cryptosporidium parvum
FSDFDFYWRKDFLCDTASKIIKFGIE

SEQ ID NO: 2357662 - protein, 26 aa, Cryptosporidium parvum
FSGDEFKGLCGRVMHGSMLISSIGFE

SEQ ID NO: 2357663 - protein, 24 aa, Cryptosporidium parvum
FSIPCKEAIYLGDIPKLMTKFNYT

SEQ ID NO: 2357664 - protein, 25 aa, Cryptosporidium parvum
FSNLRFLRKLIANFIGFQKFNVEIE

SEQ ID NO: 2357665 - protein, 17 aa, Cryptosporidium parvum
FSQESEDLIAKEKAVKP

SEQ ID NO: 2357666 - protein, 26 aa, Cryptosporidium parvum
FTKYRPKIRELINFGQETLRVAEKYN

SEQ ID NO: 2357667 - protein, 18 aa, Cryptosporidium parvum
FTLSIGRLNTDPLMNTGN

SEQ ID NO: 2357668 - protein, 25 aa, Cryptosporidium parvum
FTMPEKSCPPGFVFSGKQCVQSDTA

SEQ ID NO: 2357669 - protein, 19 aa, Cryptosporidium parvum
FVIYPNLLFEQEICDLSII

SEQ ID NO: 2357670 - protein, 20 aa, Cryptosporidium parvum
FYKYYLESIGKSPTAQSSQY

SEQ ID NO: 2357671 - protein, 23 aa, Cryptosporidium parvum
GDRCALFTNKICPNGNCERLISK

SEQ ID NO: 2357672 - protein, 24 aa, Cryptosporidium parvum
GDRNCTRLLLHFVNKHTGSTLYKN

SEQ ID NO: 2357673 - protein, 24 aa, Cryptosporidium parvum
GFDKRGFRPITFHMMHDTSRMEFF

SEQ ID NO: 2357674 - protein, 20 aa, Cryptosporidium parvum
GFNPESFCKISDQFIIPAII

SEQ ID NO: 2357675 - protein, 24 aa, Cryptosporidium parvum
GFSPRAFPTILFVKAGTRTPIPYD

SEQ ID NO: 2357676 - protein, 33 aa, Cryptosporidium parvum
GISGINWKGVKIMALKFLRGNGVGFLSDSVKAI

SEQ ID NO: 2357677 - protein, 26 aa, Cryptosporidium parvum
GKEFPRIGTSWITFKAPDTIGPQSSS

SEQ ID NO: 2357678 - protein, 20 aa, Cryptosporidium parvum
GKRLYNCKTKNWEKYTTTPL

SEQ ID NO: 2357679 - protein, 23 aa, Cryptosporidium parvum
GKVSPRIASVINTLVGQFEKLNL

SEQ ID NO: 2357680 - protein, 28 aa, Cryptosporidium parvum
GLVKEYSYFLSVYYRLRCENGNEYHDGT

SEQ ID NO: 2357681 - protein, 18 aa, Cryptosporidium parvum
GNMDLFFSDVVALKKIIN

SEQ ID NO: 2357682 - protein, 26 aa, Cryptosporidium parvum
GNNNYLRWAGSAIKYAEKYLIMSIGF

SEQ ID NO: 2357683 - protein, 34 aa, Cryptosporidium parvum; identical to SEQ ID NO: 2206827

SEQ ID NO: 2357684 - protein, 28 aa, Cryptosporidium parvum
GQGRRSKVIPGRLIIKYKEKVLSKAVKE

SEQ ID NO: 2357685 - protein, 18 aa, Cryptosporidium parvum
GRGKGAFENKGKEIALIM

SEQ ID NO: 2357686 - protein, 27 aa, Cryptosporidium parvum
GSFVGRGKIPAGINLGSSINFVLVPSS

SEQ ID NO: 2357687 - protein, 17 aa, Cryptosporidium parvum
GSIECPSGLAVENIQLL

SEQ ID NO: 2357688 - protein, 19 aa, Cryptosporidium parvum
GSIKDNCKIYRDENDDFEH

SEQ ID NO: 2357689 - protein, 35 aa, Cryptosporidium parvum; identical to SEQ ID NO: 2334883

SEQ ID NO: 2357690 - protein, 22 aa, Cryptosporidium parvum
GTDFMIPSVVCFGTNENLSQQL

SEQ ID NO: 2357691 - protein, 27 aa, Cryptosporidium parvum
GVIIVYFFFHYVLKLFISVVTARDLWI

SEQ ID NO: 2357692 - protein, 26 aa, Cryptosporidium parvum
GVMAPKYILSFLCLQYPTGQVQTNKK

SEQ ID NO: 2357693 - protein, 25 aa, Cryptosporidium parvum
GWYITAFCRAVYFAEKDVCISKGVK

SEQ ID NO: 2357694 - protein, 19 aa, Cryptosporidium parvum
GYTAWFCGTNEDFAKYASN

SEQ ID NO: 2357695 - protein, 22 aa, Cryptosporidium parvum
HIGCMFKLEGWVSGNSETIISE

SEQ ID NO: 2357696 - protein, 24 aa, Cryptosporidium parvum
HIKLELLPDMAFLIGDQRKRRGIP

SEQ ID NO: 2357697 - protein, 22 aa, Cryptosporidium parvum
HIVEWLKRHILIEISNVDGNIP

SEQ ID NO: 2357698 - protein, 19 aa, Cryptosporidium parvum
HSEICRLCGCDSTKNVNVE

SEQ ID NO: 2357699 - protein, 18 aa, Cryptosporidium parvum
IASKFGKDSKFRVFVSAF

SEQ ID NO: 2357700 - protein, 20 aa, Cryptosporidium parvum
IDAICPPEFLDNGKDCVKYS

SEQ ID NO: 2357701 - protein, 23 aa, Cryptosporidium parvum
IDIHGRLGVFSNYGHRSVDMAAP

SEQ ID NO: 2357702 - protein, 18 aa, Cryptosporidium parvum
IEKLRGTYRSTLSKQFST

SEQ ID NO: 2357703 - protein, 25 aa, Cryptosporidium parvum
IEWFAVRDGILWVGSFGKEFVSNGI

SEQ ID NO: 2357704 - protein, 19 aa, Cryptosporidium parvum
IEYYIPVLMKLYPPSFDYQ

SEQ ID NO: 2357705 - protein, 25 aa, Cryptosporidium parvum
IFCNFALIFCRRIPCEFEGNRDVRH

SEQ ID NO: 2357706 - protein, 17 aa, Cryptosporidium parvum
IFLAARDGHSLKIMTEM

SEQ ID NO: 2357707 - protein, 21 aa, Cryptosporidium parvum
IGQRFQRGSSLVILEISAPLT

SEQ ID NO: 2357708 - protein, 18 aa, Cryptosporidium parvum
IGTNIAVVICNDNKSKRK

SEQ ID NO: 2357709 - protein, 17 aa, Cryptosporidium parvum
IHTVKVCPDGNCEQLIR

SEQ ID NO: 2357710 - protein, 24 aa, Cryptosporidium parvum
IIAERHIIFLQAFIHHFSALSNIQ

SEQ ID NO: 2357711 - protein, 18 aa, Cryptosporidium parvum
IIHGLGYVYSNVVMSKGT

SEQ ID NO: 2357712 - protein, 17 aa, Cryptosporidium parvum
IIMVRFLCSDYITSFSI

SEQ ID NO: 2357713 - protein, 22 aa, Cryptosporidium parvum
IISILAVIAVFYSFTSTESDLA

SEQ ID NO: 2357714 - protein, 23 aa, Cryptosporidium parvum
IKDAPYKISLMKYTYSALSSQSK

SEQ ID NO: 2357715 - protein, 19 aa, Cryptosporidium parvum
IKLFSKFVIKKNGKKGKNS

SEQ ID NO: 2357716 - protein, 17 aa, Cryptosporidium parvum
IKLKSGFYRPLAGTGGR

SEQ ID NO: 2357717 - protein, 26 aa, Cryptosporidium parvum
IKYAEKYLIMSIGFAFKRKITRNRST

SEQ ID NO: 2357718 - protein, 32 aa, Cryptosporidium parvum
IMGPSLRDVIKFFKSSALLKWLKNSRTDDFNY

SEQ ID NO: 2357719 - protein, 23 aa, Cryptosporidium parvum
INEIIKCRGGKNWITAQEHMIKM

SEQ ID NO: 2357720 - protein, 17 aa, Cryptosporidium parvum
INIWKEFLSLIKNKKLF

SEQ ID NO: 2357721 - protein, 26 aa, Cryptosporidium parvum
INMGLKALMGCILLISGLLSIVDESF

SEQ ID NO: 2357722 - protein, 24 aa, Cryptosporidium parvum
INNKSCVYWSYGIWDQTIGERSTF

SEQ ID NO: 2357723 - protein, 20 aa, Cryptosporidium parvum
INPELLFKLIQTAILKNTNC

SEQ ID NO: 2357724 - protein, 17 aa, Cryptosporidium parvum
INRKASKRASKMMYEKK

SEQ ID NO: 2357725 - protein, 28 aa, Cryptosporidium parvum
IPEIPGPPSRRGSGPISDRVIPTSTDEI

SEQ ID NO: 2357726 - protein, 23 aa, Cryptosporidium parvum
IPHSLEGFISGHLMLRYNKGGMS

SEQ ID NO: 2357727 - protein, 21 aa, Cryptosporidium parvum
ISDQFIIPAIISYFEKKNIEY

SEQ ID NO: 2357728 - protein, 25 aa, Cryptosporidium parvum
ISKAFRYLYEQGYGRTKKRVILGWS

SEQ ID NO: 2357729 - protein, 22 aa, Cryptosporidium parvum
ISSVSFVYRMIYYCTGRIILPK

SEQ ID NO: 2357730 - protein, 20 aa, Cryptosporidium parvum
IVSPCDGFGYTFNSPGNKVS

SEQ ID NO: 2357731 - protein, 21 aa, Cryptosporidium parvum
IVSPCKGYVFREQELKKGCQI

SEQ ID NO: 2357732 - protein, 25 aa, Cryptosporidium parvum
IWLFYLFFGPCLGLRANTTHKLAID

SEQ ID NO: 2357733 - protein, 31 aa, Cryptosporidium parvum; identical to SEQ ID NO: 2335312

SEQ ID NO: 2357734 - protein, 26 aa, Cryptosporidium parvum
KDILSVFIEACIRPYVSFKGNEIMYV

SEQ ID NO: 2357735 - protein, 24 aa, Cryptosporidium parvum
KDLKNSWLRHLCRTGGEQQFSSNY

SEQ ID NO: 2357736 - protein, 17 aa, Cryptosporidium parvum
KDLMIGLVLPGLEQEVE

SEQ ID NO: 2357737 - protein, 17 aa, Cryptosporidium parvum
KEIGSGCNCSNVENLYN

SEQ ID NO: 2357738 - protein, 18 aa, Cryptosporidium parvum
KEKKSSCFSKKKKQNYVQ

SEQ ID NO: 2357739 - protein, 20 aa, Cryptosporidium parvum
KESKQMCLLLKPANHKSCIK

SEQ ID NO: 2357740 - protein, 19 aa, Cryptosporidium parvum
KFGKDSKFRVFVSAFDVEF

SEQ ID NO: 2357741 - protein, 22 aa, Cryptosporidium parvum
KFKKICRLASSLSLIVPFDIKL

SEQ ID NO: 2357742 - protein, 22 aa, Cryptosporidium parvum
KIADLNGGYVYDSKIKGISRTR

SEQ ID NO: 2357743 - protein, 22 aa, Cryptosporidium parvum
KKEGKFLFKPFAEVARAVGIPA

SEQ ID NO: 2357744 - protein, 18 aa, Cryptosporidium parvum
KKGNKFTRFFKRLFKKPS

SEQ ID NO: 2357745 - protein, 18 aa, Cryptosporidium parvum
KKRSDEFIAKNKDRKGVI

SEQ ID NO: 2357746 - protein, 20 aa, Cryptosporidium parvum
KKSLLKKRSDEFIAKNKDRK

SEQ ID NO: 2357747 - protein, 17 aa, Cryptosporidium parvum
KLFKLINRKASKRASKM

SEQ ID NO: 2357748 - protein, 20 aa, Cryptosporidium parvum
KLFTRIAFGSIWSDKKYRGQ

SEQ ID NO: 2357749 - protein, 21 aa, Cryptosporidium parvum
KLPVLEVAFTKQEWLATSSGS

SEQ ID NO: 2357750 - protein, 25 aa, Cryptosporidium parvum
KLTRKSLFYCIKIIILSYYKSSIQQ

SEQ ID NO: 2357751 - protein, 22 aa, Cryptosporidium parvum
KMIDAICPDGFLPNGDDCIQFS

SEQ ID NO: 2357752 - protein, 21 aa, Cryptosporidium parvum
KMKEYRKLKGKKKKLLDEEIE

SEQ ID NO: 2357753 - protein, 17 aa, Cryptosporidium parvum
KPDMTGASEALRNLKSV

SEQ ID NO: 2357754 - protein, 26 aa, Cryptosporidium parvum
KPIRSEILRILAILEEIEFNSKEVIK

SEQ ID NO: 2357755 - protein, 20 aa, Cryptosporidium parvum
KRHIEGKTVRYCEFTGLSTN

SEQ ID NO: 2357756 - protein, 24 aa, Cryptosporidium parvum
KSAQYIWLIARMKFNVFILEAESF

SEQ ID NO: 2357757 - protein, 21 aa, Cryptosporidium parvum
KSIKHIPGFHFHNPEISYRNG

SEQ ID NO: 2357758 - protein, 18 aa, Cryptosporidium parvum
KSIPKLRGLAQISPEQAD

SEQ ID NO: 2357759 - protein, 19 aa, Cryptosporidium parvum
KTLILRSVTVLTTLRNSVR

SEQ ID NO: 2357760 - protein, 23 aa, Cryptosporidium parvum
KTMRISWECFTKVNNVIWIPNKK

SEQ ID NO: 2357761 - protein, 21 aa, Cryptosporidium parvum
KTRLSSMYHEGVIKGEYELFI

SEQ ID NO: 2357762 - protein, 23 aa, Cryptosporidium parvum
KVLEIPLLVAAPFMLTSDSNGSA

SEQ ID NO: 2357763 - protein, 18 aa, Cryptosporidium parvum
KVLMAWKHLGINTSVSKG

SEQ ID NO: 2357764 - protein, 26 aa, Cryptosporidium parvum
KYENNTRNALDYGDLNDPGFTIRIVD

SEQ ID NO: 2357765 - protein, 18 aa, Cryptosporidium parvum
KYLKFLINGEEHFYPFIS

SEQ ID NO: 2357766 - protein, 28 aa, Cryptosporidium parvum
LASLRKCFEYQYVCLLARHLEDDEILEL

SEQ ID NO: 2357767 - protein, 19 aa, Cryptosporidium parvum
LEDAICPPGYLDNGSDCVQ

SEQ ID NO: 2357768 - protein, 20 aa, Cryptosporidium parvum
LELDSYLFSYGVKLPLEKDS

SEQ ID NO: 2357769 - protein, 19 aa, Cryptosporidium parvum
LEYLLLKNGLMFRVSLTER

SEQ ID NO: 2357770 - protein, 18 aa, Cryptosporidium parvum
LFFFAIYIMIGISNASDM

SEQ ID NO: 2357771 - protein, 18 aa, Cryptosporidium parvum
LFFFLELSLIITNSSTYI

SEQ ID NO: 2357772 - protein, 17 aa, Cryptosporidium parvum
LFLSFVSTISLCSRLEW

SEQ ID NO: 2357773 - protein, 24 aa, Cryptosporidium parvum
LGDRCARFAPKVCPSGGCEKIEST

SEQ ID NO: 2357774 - protein, 25 aa, Cryptosporidium parvum
LITYKQLLLVVAFLFHLFLVLNAIP

SEQ ID NO: 2357775 - protein, 20 aa, Cryptosporidium parvum
LKFMPPDIANWLTSYKNYKF

SEQ ID NO: 2357776 - protein, 21 aa, Cryptosporidium parvum
LKLELIPRYKVSSTDEIVYNI

SEQ ID NO: 2357777 - protein, 22 aa, Cryptosporidium parvum
LKTALILLLKFIGSSGISNYQG

SEQ ID NO: 2357778 - protein, 20 aa, Cryptosporidium parvum
LLATIIFCNFALIFCRRIPC

SEQ ID NO: 2357779 - protein, 19 aa, Cryptosporidium parvum
LLEEMLIQATTAFSILHSS

SEQ ID NO: 2357780 - protein, 25 aa, Cryptosporidium parvum
LLETKRLGVFQIHMNDHPYEISQEV

SEQ ID NO: 2357781 - protein, 24 aa, Cryptosporidium parvum
LLEYLKIKIIKVVHLLNEYNVNEI

SEQ ID NO: 2357782 - protein, 19 aa, Cryptosporidium parvum
LLFCVKFAREVILTTGNEN

SEQ ID NO: 2357783 - protein, 18 aa, Cryptosporidium parvum
LLLLFIFFSYCMCGDMIS

SEQ ID NO: 2357784 - protein, 20 aa, Cryptosporidium parvum
LLPYLLVFFQKRVICNIFNT

SEQ ID NO: 2357785 - protein, 23 aa, Cryptosporidium parvum
LMCESCQLITFALKEYISKKLSI

SEQ ID NO: 2357786 - protein, 19 aa, Cryptosporidium parvum
LNFHFNNFILRYLKSGELN

SEQ ID NO: 2357787 - protein, 19 aa, Cryptosporidium parvum
LNLCCKTLASYKWMVKNWP

SEQ ID NO: 2357788 - protein, 17 aa, Cryptosporidium parvum
LNTNGFGNMPFSYINTV

SEQ ID NO: 2357789 - protein, 18 aa, Cryptosporidium parvum
LPLEKDSNLIWSISESLV

SEQ ID NO: 2357790 - protein, 18 aa, Cryptosporidium parvum
LPSSPLYIKGKKFGIKNL

SEQ ID NO: 2357791 - protein, 20 aa, Cryptosporidium parvum
LQAVILVCLLYLCIHVEGNG

SEQ ID NO: 2357792 - protein, 20 aa, Cryptosporidium parvum
LQPELYCLLFTNSMKPNIFS

SEQ ID NO: 2357793 - protein, 22 aa, Cryptosporidium parvum
LRKKLLLACSGIHMHLFEIKPK

SEQ ID NO: 2357794 - protein, 20 aa, Cryptosporidium parvum
LRLTGVSVKAFIIYVKYKAD

SEQ ID NO: 2357795 - protein, 24 aa, Cryptosporidium parvum
LRSESNRLVFAYQLIDGSLIPSSA

SEQ ID NO: 2357796 - protein, 22 aa, Cryptosporidium parvum
LSSYHASSRFIKLRDSFDNDGE

SEQ ID NO: 2357797 - protein, 17 aa, Cryptosporidium parvum
LTIMLYLLAKEFPSKNH

SEQ ID NO: 2357798 - protein, 17 aa, Cryptosporidium parvum
LVCPPGFSSSKPIQPIS

SEQ ID NO: 2357799 - protein, 31 aa, Cryptosporidium parvum
LVKKEAFDLADFCKVMHALGPFSDKSGTIGN

SEQ ID NO: 2357800 - protein, 17 aa, Cryptosporidium parvum
LVYYFPFGEDKVSKMFL

SEQ ID NO: 2357801 - protein, 21 aa, Cryptosporidium parvum
MIYKVGWKAVIPSTFEDQTFK

SEQ ID NO: 2357802 - protein, 20 aa, Cryptosporidium parvum
MKGERFLGIICDARDYKPIN

SEQ ID NO: 2357803 - protein, 19 aa, Cryptosporidium parvum
MLHSPRAQLLFSKQTEEII

SEQ ID NO: 2357804 - protein, 19 aa, Cryptosporidium parvum
MNFMLKKSIIKLCSIVVNS

SEQ ID NO: 2357805 - protein, 18 aa, Cryptosporidium parvum
MPCNFRLVADLDMNSKPG

SEQ ID NO: 2357806 - protein, 25 aa, Cryptosporidium parvum
MPNMKIKLLEKLFPRRNFTNDELDV

SEQ ID NO: 2357807 - protein, 17 aa, Cryptosporidium parvum
MTRGYKDLRGVKELDGA

SEQ ID NO: 2357808 - protein, 18 aa, Cryptosporidium parvum
MVGYGGKYTFRFSAVGSG

SEQ ID NO: 2357809 - protein, 21 aa, Cryptosporidium parvum
NAARAKLGYYREINPFNKSEK

SEQ ID NO: 2357810 - protein, 19 aa, Cryptosporidium parvum
NCNYYNEWSSWSACTNECG

SEQ ID NO: 2357811 - protein, 23 aa, Cryptosporidium parvum
NETRDSLDFACKIMDNIRKYTRL

SEQ ID NO: 2357812 - protein, 28 aa, Cryptosporidium parvum
NFHIKCPNGYRIIGIDAIVGDQITAVSL

SEQ ID NO: 2357813 - protein, 20 aa, Cryptosporidium parvum
NFSETLFALQGFKIIEKQVS

SEQ ID NO: 2357814 - protein, 17 aa, Cryptosporidium parvum
NGLMFRVSLTERYSKLL

SEQ ID NO: 2357815 - protein, 24 aa, Cryptosporidium parvum
NGQYPKLDGVAFLTRVVSALSESA

SEQ ID NO: 2357816 - protein, 18 aa, Cryptosporidium parvum
NHKSCIKLSSGDLTLAYK

SEQ ID NO: 2357817 - protein, 28 aa, Cryptosporidium parvum
NHKSRIWRGGRWTGVCIGLLNLGGGILK

SEQ ID NO: 2357818 - protein, 24 aa, Cryptosporidium parvum
NHSKLLWKATIPINEFITEDSNEI

SEQ ID NO: 2357819 - protein, 22 aa, Cryptosporidium parvum
NKAYGIEDFEIIAARIDPTNLH

SEQ ID NO: 2357820 - protein, 23 aa, Cryptosporidium parvum
NKGKEIALIMPFSIKINKIKADL

SEQ ID NO: 2357821 - protein, 25 aa, Cryptosporidium parvum
NKVSKGKYFAAIQCKDEEKNKRTQK

SEQ ID NO: 2357822 - protein, 19 aa, Cryptosporidium parvum
NLADICSILKGYQDLESRV

SEQ ID NO: 2357823 - protein, 24 aa, Cryptosporidium parvum
NLEDYSSYGFVTWIKPVESNSTKV

SEQ ID NO: 2357824 - protein, 24 aa, Cryptosporidium parvum
NLGCKKPNCIKRLSKNDEPKYSSD

SEQ ID NO: 2357825 - protein, 17 aa, Cryptosporidium parvum
NLKWRHVSNSNGIYQVY

SEQ ID NO: 2357826 - protein, 18 aa, Cryptosporidium parvum
NLSRQVCYSYYKKRAATV

SEQ ID NO: 2357827 - protein, 29 aa, Cryptosporidium parvum
NNQIKVYLEQRFNPIVKAIKSNKYLKKKL

SEQ ID NO: 2357828 - protein, 19 aa, Cryptosporidium parvum
NPEVEVVSLSPSVTPVEYI

SEQ ID NO: 2357829 - protein, 18 aa, Cryptosporidium parvum
NRIPSISMTTMYASKASP

SEQ ID NO: 2357830 - protein, 33 aa, Cryptosporidium parvum; identical to SEQ ID NO: 2336289

SEQ ID NO: 2357831 - protein, 22 aa, Cryptosporidium parvum
NSYKFAQKVCSMIFEQPIHNIL

SEQ ID NO: 2357832 - protein, 23 aa, Cryptosporidium parvum
NTIKEQIVRDVAALNAIVKLEAE

SEQ ID NO: 2357833 - protein, 18 aa, Cryptosporidium parvum
NYSCVICLNNICDEDLVR

SEQ ID NO: 2357834 - protein, 23 aa, Cryptosporidium parvum
PAKECPPNFILQGLQCIQTSSAP

SEQ ID NO: 2357835 - protein, 21 aa, Cryptosporidium parvum
PEKECPTGFVLIGKQCTQTTQ

SEQ ID NO: 2357836 - protein, 24 aa, Cryptosporidium parvum
PETTISGFILFKGLENSFKPRIYL

SEQ ID NO: 2357837 - protein, 17 aa, Cryptosporidium parvum
PFDIKLFSKFVIKKNGK

SEQ ID NO: 2357838 - protein, 19 aa, Cryptosporidium parvum
PHPEGMVGYGGKYTFRFSA

SEQ ID NO: 2357839 - protein, 25 aa, Cryptosporidium parvum
PINTDRFKWYVAIGNDLSFTARYYV

SEQ ID NO: 2357840 - protein, 19 aa, Cryptosporidium parvum
PIRSLLIKACDDALFHEKD

SEQ ID NO: 2357841 - protein, 25 aa, Cryptosporidium parvum
PKNVLKEKIELFKLTGTVISIPLPL

SEQ ID NO: 2357842 - protein, 24 aa, Cryptosporidium parvum
PKYSSDFIPRIYLLSRSIPKENFY

SEQ ID NO: 2357843 - protein, 19 aa, Cryptosporidium parvum
PLFTEASNLKWRHVSNSNG

SEQ ID NO: 2357844 - protein, 23 aa, Cryptosporidium parvum
PNDPKFSEQWGMYNRVANTDSKV

SEQ ID NO: 2357845 - protein, 24 aa, Cryptosporidium parvum
PPGYYRPQAGVAIRSHGHKASGAS

SEQ ID NO: 2357846 - protein, 17 aa, Cryptosporidium parvum
PPPLAVLPYKGFIQTGI

SEQ ID NO: 2357847 - protein, 21 aa, Cryptosporidium parvum
PRHPFPLPSSPLYIKGKKFGI

SEQ ID NO: 2357848 - protein, 20 aa, Cryptosporidium parvum
PRKKIKIAENIPKVKLQHKA

SEQ ID NO: 2357849 - protein, 19 aa, Cryptosporidium parvum
PSKNHFASIAKDILRYPEV

SEQ ID NO: 2357850 - protein, 19 aa, Cryptosporidium parvum
QCPDGFRLLGDMCQQSTAK

SEQ ID NO: 2357851 - protein, 24 aa, Cryptosporidium parvum
QDVYKKFGGIFWARNIPRVSITNM

SEQ ID NO: 2357852 - protein, 21 aa, Cryptosporidium parvum
QFEKLNLYGAGSRNEEVKSGQ

SEQ ID NO: 2357853 - protein, 18 aa, Cryptosporidium parvum
QFPLGSFSDNWKSQFVGT

SEQ ID NO: 2357854 - protein, 20 aa, Cryptosporidium parvum
QISQLIPAWIEALTMMTEGQ

SEQ ID NO: 2357855 - protein, 20 aa, Cryptosporidium parvum
QITDRMAVSIAKEIHTLFPQ

SEQ ID NO: 2357856 - protein, 18 aa, Cryptosporidium parvum
QKEKSMNFMLKKSIIKLC

SEQ ID NO: 2357857 - protein, 17 aa, Cryptosporidium parvum
QKICEIVNVMIREPASF

SEQ ID NO: 2357858 - protein, 28 aa, Cryptosporidium parvum
QKKRALSLFRVLKYLYKGHTTGWYITAF

SEQ ID NO: 2357859 - protein, 23 aa, Cryptosporidium parvum
QKVNLPRSWYFLGEKIDEIYVSV

SEQ ID NO: 2357860 - protein, 18 aa, Cryptosporidium parvum
QLKHSSTAKFGLPHQAKN

SEQ ID NO: 2357861 - protein, 18 aa, Cryptosporidium parvum
QSTFYKYYLESIGKSPTA

SEQ ID NO: 2357862 - protein, 25 aa, Cryptosporidium parvum
QWPLYTEIWRSCAYVYKRKATGGEK

SEQ ID NO: 2357863 - protein, 19 aa, Cryptosporidium parvum
RAGSGWTQQHICEGIYLLN

SEQ ID NO: 2357864 - protein, 19 aa, Cryptosporidium parvum
REIVSLFYRAGDVSRHSLF

SEQ ID NO: 2357865 - protein, 25 aa, Cryptosporidium parvum
REKTQLRPELKVVKRTKPLISKFPI

SEQ ID NO: 2357866 - protein, 27 aa, Cryptosporidium parvum
REQELKKGCQIDESIVFIKIKCDKKKS

SEQ ID NO: 2357867 - protein, 24 aa, Cryptosporidium parvum
RGHVSRFNWSFVYEKIRNSLGAQY

SEQ ID NO: 2357868 - protein, 25 aa, Cryptosporidium parvum
RGIGRIYGYCMLKGEPLNFHFNNFI

SEQ ID NO: 2357869 - protein, 33 aa, Cryptosporidium parvum; identical to SEQ ID NO: 2336651

SEQ ID NO: 2357870 - protein, 20 aa, Cryptosporidium parvum
RICEKIPLFSTSPMTNNENN

SEQ ID NO: 2357871 - protein, 17 aa, Cryptosporidium parvum
RKIHPRHPFPLPSSPLY

SEQ ID NO: 2357872 - protein, 19 aa, Cryptosporidium parvum
RKKICFEIEENGEIEKKMK

SEQ ID NO: 2357873 - protein, 22 aa, Cryptosporidium parvum
RKLCSGPILLLIILSLSNSTEV

SEQ ID NO: 2357874 - protein, 17 aa, Cryptosporidium parvum
RLHGHILLTLLGVSHIV

SEQ ID NO: 2357875 - protein, 24 aa, Cryptosporidium parvum
RNASIGVIWIYEPGLLLAEELVSP

SEQ ID NO: 2357876 - protein, 26 aa, Cryptosporidium parvum
RNEIRPYGYRGSPMILTQFIENIDLN

SEQ ID NO: 2357877 - protein, 19 aa, Cryptosporidium parvum
RPYVSFKGNEIMYVHESSN

SEQ ID NO: 2357878 - protein, 29 aa, Cryptosporidium parvum
RQKFRQICKEAGYSTGRWDVYNDRAYSQY

SEQ ID NO: 2357879 - protein, 19 aa, Cryptosporidium parvum
RRALINILNIYSKVLKEEL

SEQ ID NO: 2357880 - protein, 21 aa, Cryptosporidium parvum
RRRFFCQAFNREIMRDADHGE

SEQ ID NO: 2357881 - protein, 22 aa, Cryptosporidium parvum
RRVSRCCILIQDFVDIALMIIS

SEQ ID NO: 2357882 - protein, 27 aa, Cryptosporidium parvum
RSDIILSGKCLNGIIFTAMALDSGAIK

SEQ ID NO: 2357883 - protein, 18 aa, Cryptosporidium parvum
RSLSECKIIAERHIIFLQ

SEQ ID NO: 2357884 - protein, 21 aa, Cryptosporidium parvum
RTVHSRSSLSPGNQILLTQPS

SEQ ID NO: 2357885 - protein, 28 aa, Cryptosporidium parvum
SCNHSSTNMCISEFDLSISSKYWDPVYF

SEQ ID NO: 2357886 - protein, 17 aa, Cryptosporidium parvum
SDEEYWTPFGIDPALLK

SEQ ID NO: 2357887 - protein, 22 aa, Cryptosporidium parvum
SDGRLTSRIPSLGTSGPDFSNE

SEQ ID NO: 2357888 - protein, 17 aa, Cryptosporidium parvum
SEECKFPQIDIEDSNLC

SEQ ID NO: 2357889 - protein, 25 aa, Cryptosporidium parvum
SEQNLLAALCWSLPFKFIKCDIDFE

SEQ ID NO: 2357890 - protein, 34 aa, Cryptosporidium parvum
SEVMKLGLHLGDFIYPRLFPIFVSDLCIARKMMK

SEQ ID NO: 2357891 - protein, 18 aa, Cryptosporidium parvum
SGNEIPIKLRGLVAQNSL

SEQ ID NO: 2357892 - protein, 25 aa, Cryptosporidium parvum
SIIECAEALITFFKLKAETYYDSTE

SEQ ID NO: 2357893 - protein, 30 aa, Cryptosporidium parvum
SIMEGLRMLRKDKKMIIQIHALGYLVNTIK

SEQ ID NO: 2357894 - protein, 22 aa, Cryptosporidium parvum
SITLEICESVNLMHSCSNSNSN

SEQ ID NO: 2357895 - protein, 24 aa, Cryptosporidium parvum
SKNVKGKYLGGGINEIAFGYDSET

SEQ ID NO: 2357896 - protein, 19 aa, Cryptosporidium parvum
SKPDIKRCNQISGVSPSNT

SEQ ID NO: 2357897 - protein, 25 aa, Cryptosporidium parvum
SKQNLLVQCKILYQAFYSYKNSVRS

SEQ ID NO: 2357898 - protein, 18 aa, Cryptosporidium parvum
SLIVLILAIVISSNYCFG

SEQ ID NO: 2357899 - protein, 23 aa, Cryptosporidium parvum
SLLFLFLLQFSFGSSLKSNPLGN

SEQ ID NO: 2357900 - protein, 17 aa, Cryptosporidium parvum
SLTCTDLGFFFASFTNR

SEQ ID NO: 2357901 - protein, 20 aa, Cryptosporidium parvum
SMPRSCYRSSAGDGKIPPCY

SEQ ID NO: 2357902 - protein, 19 aa, Cryptosporidium parvum
SNLCTLHLLLKKYSQNRSG

SEQ ID NO: 2357903 - protein, 17 aa, Cryptosporidium parvum
SQFLKSRYVRVNFINSL

SEQ ID NO: 2357904 - protein, 21 aa, Cryptosporidium parvum
SRLPISISKGFIKSQTHNKMD

SEQ ID NO: 2357905 - protein, 18 aa, Cryptosporidium parvum
SRPARSVGRVAIKSRARC

SEQ ID NO: 2357906 - protein, 17 aa, Cryptosporidium parvum
SRSKRTLLRSINFRCPE

SEQ ID NO: 2357907 - protein, 40 aa, Cryptosporidium parvum
SSSYYELSFVKVKCGGGFCKRLRRALCCCSGGEEEEQPEM

SEQ ID NO: 2357908 - protein, 17 aa, Cryptosporidium parvum
STGKTWERPSGAQGNNN

SEQ ID NO: 2357909 - protein, 28 aa, Cryptosporidium parvum
SVGRVAIKSRARCSGIIVLCKTGPLETG

SEQ ID NO: 2357910 - protein, 26 aa, Cryptosporidium parvum
SVLSKLVALKNYWKRLHKNRMKQPNN

SEQ ID NO: 2357911 - protein, 21 aa, Cryptosporidium parvum
SVVAYGECIKRLNGINSALDV

SEQ ID NO: 2357912 - protein, 19 aa, Cryptosporidium parvum
SWSDWSGCSSPCKSSTNDL

SEQ ID NO: 2357913 - protein, 21 aa, Cryptosporidium parvum
TCTDLGFFFASFTNRFSIFPP

SEQ ID NO: 2357914 - protein, 25 aa, Cryptosporidium parvum
TFEFLYRMIDPRIKDAPYKISLMKY

SEQ ID NO: 2357915 - protein, 30 aa, Cryptosporidium parvum; identical to SEQ ID NO: 2337143

SEQ ID NO: 2357916 - protein, 17 aa, Cryptosporidium parvum
TKDDLLIILSLATRTYK

SEQ ID NO: 2357917 - protein, 17 aa, Cryptosporidium parvum
TKKRVILGWSSKDLEPE

SEQ ID NO: 2357918 - protein, 24 aa, Cryptosporidium parvum
TKLLSLDPSNKFALSITHGPYIDE

SEQ ID NO: 2357919 - protein, 19 aa, Cryptosporidium parvum
TLASYKWMVKNWPKKKWYM

SEQ ID NO: 2357920 - protein, 17 aa, Cryptosporidium parvum
TLAYKLAFELGKIHNGD

SEQ ID NO: 2357921 - protein, 24 aa, Cryptosporidium parvum
TMSTGFKMWWNEVVNSVGAESTNQ

SEQ ID NO: 2357922 - protein, 17 aa, Cryptosporidium parvum
TQSVLKPDMTGASEALR

SEQ ID NO: 2357923 - protein, 28 aa, Cryptosporidium parvum
TRFFKRLFKKPSCIKCVKSKKQSKKQKS

SEQ ID NO: 2357924 - protein, 20 aa, Cryptosporidium parvum
TRSGICSLLPQNLREKAIQL

SEQ ID NO: 2357925 - protein, 25 aa, Cryptosporidium parvum
TSTEMLKLVLLNGTEYALVNNETAY

SEQ ID NO: 2357926 - protein, 28 aa, Cryptosporidium parvum
TVLIAFEFCSVASNGLVGRDHVGTGVQF

SEQ ID NO: 2357927 - protein, 17 aa, Cryptosporidium parvum
TVLRSIRKISFKVNENS

SEQ ID NO: 2357928 - protein, 24 aa, Cryptosporidium parvum
TWIDFSVVMDIKFRMKRRGMFLET

SEQ ID NO: 2357929 - protein, 17 aa, Cryptosporidium parvum
VCSREVFAPYSLSCTAD

SEQ ID NO: 2357930 - protein, 22 aa, Cryptosporidium parvum
VDCYRLRLENWILEQELVLISE

SEQ ID NO: 2357931 - protein, 25 aa, Cryptosporidium parvum
VDLMARFHGQWSLFYKMFRQKFRQI

SEQ ID NO: 2357932 - protein, 19 aa, Cryptosporidium parvum
VFQKFRLRLDVSDNISKYE

SEQ ID NO: 2357933 - protein, 24 aa, Cryptosporidium parvum
VICSFLVIFLCLGPEHVEFHLVNG

SEQ ID NO: 2357934 - protein, 23 aa, Cryptosporidium parvum
VILPKANVKFDWVNIGINQETIL

SEQ ID NO: 2357935 - protein, 17 aa, Cryptosporidium parvum
VISRLPISISKGFIKSQ

SEQ ID NO: 2357936 - protein, 18 aa, Cryptosporidium parvum
VKNWPKKKWYMKLDDDTF

SEQ ID NO: 2357937 - protein, 20 aa, Cryptosporidium parvum
VLLECLILFGERYSPESIFE

SEQ ID NO: 2357938 - protein, 22 aa, Cryptosporidium parvum
VNQKAKWIVRAPCSGTITSKKL

SEQ ID NO: 2357939 - protein, 24 aa, Cryptosporidium parvum
VRVDLYYGMKGIRLQLGNGEQSRR

SEQ ID NO: 2357940 - protein, 19 aa, Cryptosporidium parvum
VTTKPGLVTKMFKENQANV

SEQ ID NO: 2357941 - protein, 23 aa, Cryptosporidium parvum
WARNIPRVSITNMINLISHTGSE

SEQ ID NO: 2357942 - protein, 20 aa, Cryptosporidium parvum
WSLPFKFIKCDIDFEENVLE

SEQ ID NO: 2357943 - protein, 29 aa, Cryptosporidium parvum
WSSWSACTNECGWGIQTRGRRINANLIDK

SEQ ID NO: 2357944 - protein, 19 aa, Cryptosporidium parvum
WTQQHICEGIYLLNTYRGE

SEQ ID NO: 2357945 - protein, 24 aa, Cryptosporidium parvum
WVNEKELYGRPGVDDDMNGYVDDI

SEQ ID NO: 2357946 - protein, 24 aa, Cryptosporidium parvum
YDGKRTVEAFKEFISEHSSFPQEK

SEQ ID NO: 2357947 - protein, 23 aa, Cryptosporidium parvum
YDIIPRRFLRSFYLSNLSHFTQG

SEQ ID NO: 2357948 - protein, 20 aa, Cryptosporidium parvum
YDLACPAGYALVGDKCATTR

SEQ ID NO: 2357949 - protein, 18 aa, Cryptosporidium parvum
YHGEVIKGIRGGAGYLMS

SEQ ID NO: 2357950 - protein, 18 aa, Cryptosporidium parvum
YIITCPNGDLALKDSGSD

SEQ ID NO: 2357951 - protein, 23 aa, Cryptosporidium parvum
YLKKKLSKQIPDVIILMNTDQYP

SEQ ID NO: 2357952 - protein, 17 aa, Cryptosporidium parvum
YNKEASISYSKDVELSP

SEQ ID NO: 2357953 - protein, 17 aa, Cryptosporidium parvum
YNLIEGACECPNGVSYC

SEQ ID NO: 2357954 - protein, 18 aa, Cryptosporidium parvum
YPPSRFAYLHGETVEVAP

SEQ ID NO: 2357955 - protein, 18 aa, Cryptosporidium parvum
YRMIYYCTGRIILPKEAW

SEQ ID NO: 2357956 - protein, 23 aa, Cryptosporidium parvum
YSEMCSGCMDLLPIWNSISSKIA

SEQ ID NO: 2357957 - protein, 18 aa, Cryptosporidium parvum
YSGPYVRTSATAGKVSPR

SEQ ID NO: 2357958 - protein, 32 aa, Cryptosporidium parvum
YYCTGRIILPKEAWEIWGLVYSYGGGGHIPKY

SEQ ID NO: 2357959 - protein, 18 aa, Cryptosporidium parvum
ACCSCSKSGNTKEPKPEK

SEQ ID NO: 2357960 - protein, 21 aa, Cryptosporidium parvum
AEKYLIMSIGFAFKRKITRNR

SEQ ID NO: 2357961 - protein, 18 aa, Cryptosporidium parvum
ARISLRLEAQYSLAHSLI

SEQ ID NO: 2357962 - protein, 26 aa, Cryptosporidium parvum
CDGHLSFRLPLNHSFERSDIILSGKC

SEQ ID NO: 2357963 - protein, 19 aa, Cryptosporidium parvum
CPNGYRIIGIDAIVGDQIT

SEQ ID NO: 2357964 - protein, 17 aa, Cryptosporidium parvum
DEFKGLCGRVMHGSMLI

SEQ ID NO: 2357965 - protein, 18 aa, Cryptosporidium parvum
DYSSYGFVTWIKPVESNS

SEQ ID NO: 2357966 - protein, 19 aa, Cryptosporidium parvum
EFPRIGTSWITFKAPDTIG

SEQ ID NO: 2357967 - protein, 20 aa, Cryptosporidium parvum
EIHHPPKLLFFFGSINKFEA

SEQ ID NO: 2357968 - protein, 17 aa, Cryptosporidium parvum
ELFKFLEFKGIPILNKN

SEQ ID NO: 2357969 - protein, 18 aa, Cryptosporidium parvum
ENNTRNALDYGDLNDPGF

SEQ ID NO: 2357970 - protein, 20 aa, Cryptosporidium parvum
ETKRLGVFQIHMNDHPYEIS

SEQ ID NO: 2357971 - protein, 18 aa, Cryptosporidium parvum
EVVSTPGERLVSMFRKSK

SEQ ID NO: 2357972 - protein, 18 aa, Cryptosporidium parvum
FIEACIRPYVSFKGNEIM

SEQ ID NO: 2357973 - protein, 20 aa, Cryptosporidium parvum
FKFLEFKGIPILNKNSKDID

SEQ ID NO: 2357974 - protein, 20 aa, Cryptosporidium parvum
FKGLCGRVMHGSMLISSIGF

SEQ ID NO: 2357975 - protein, 19 aa, Cryptosporidium parvum
FKRLFKKPSCIKCVKSKKQ

SEQ ID NO: 2357976 - protein, 22 aa, Cryptosporidium parvum
FKYRKCKYWSWRATDFSCSLKS

SEQ ID NO: 2357977 - protein, 17 aa, Cryptosporidium parvum
FVGRGKIPAGINLGSSI

SEQ ID NO: 2357978 - protein, 19 aa, Cryptosporidium parvum
GLRMLRKDKKMIIQIHALG

SEQ ID NO: 2357979 - protein, 18 aa, Cryptosporidium parvum
ICKEAGYSTGRWDVYNDR

SEQ ID NO: 2357980 - protein, 17 aa, Cryptosporidium parvum
IHGRLGVFSNYGHRSVD

SEQ ID NO: 2357981 - protein, 24 aa, Cryptosporidium parvum
IILPKEAWEIWGLVYSYGGGGHIP

SEQ ID NO: 2357982 - protein, 17 aa, Cryptosporidium parvum
IKSRARCSGIIVLCKTG

SEQ ID NO: 2357983 - protein, 17 aa, Cryptosporidium parvum
KKKSWRKKTRKFKLEFL

SEQ ID NO: 2357984 - protein, 18 aa, Cryptosporidium parvum
KNTFIFKNRYEEMKNTQS

SEQ ID NO: 2357985 - protein, 18 aa, Cryptosporidium parvum
KPLMKISCAEYFGISVFL

SEQ ID NO: 2357986 - protein, 17 aa, Cryptosporidium parvum
KRGFRPITFHMMHDTSR

SEQ ID NO: 2357987 - protein, 17 aa, Cryptosporidium parvum
LFFFAIYIMIGISNASD

SEQ ID NO: 2357988 - protein, 19 aa, Cryptosporidium parvum
LKKGCQIDESIVFIKIKCD

SEQ ID NO: 2357989 - protein, 17 aa, Cryptosporidium parvum
LLFFFGSINKFEAYPSH

SEQ ID NO: 2357990 - protein, 17 aa, Cryptosporidium parvum
LLPYLLVFFQKRVICNI

SEQ ID NO: 2357991 - protein, 19 aa, Cryptosporidium parvum
LRYPEVVSTPGERLVSMFR

SEQ ID NO: 2357992 - protein, 18 aa, Cryptosporidium parvum
LVCSSGFVLLGDRCALFT

SEQ ID NO: 2357993 - protein, 18 aa, Cryptosporidium parvum
NLRFLRKLIANFIGFQKF

SEQ ID NO: 2357994 - protein, 17 aa, Cryptosporidium parvum
NSWLRHLCRTGGEQQFS

SEQ ID NO: 2357995 - protein, 19 aa, Cryptosporidium parvum
PEKSCPPGFVFSGKQCVQS

SEQ ID NO: 2357996 - protein, 24 aa, Cryptosporidium parvum
PTQRLPVSQIWRATPLENRPEDSL

SEQ ID NO: 2357997 - protein, 18 aa, Cryptosporidium parvum
QLLLVVAFLFHLFLVLNA

SEQ ID NO: 2357998 - protein, 20 aa, Cryptosporidium parvum
RALSLFRVLKYLYKGHTTGW

SEQ ID NO: 2357999 - protein, 17 aa, Cryptosporidium parvum
RKLCSGPILLLIILSLS

SEQ ID NO: 2358000 - protein, 19 aa, Cryptosporidium parvum
RPYGYRGSPMILTQFIENI

SEQ ID NO: 2358001 - protein, 20 aa, Cryptosporidium parvum
RRWEFVIEWRNVFLKSEQYN

SEQ ID NO: 2358002 - protein, 21 aa, Cryptosporidium parvum
RSEILRILAILEEIEFNSKEV

SEQ ID NO: 2358003 - protein, 19 aa, Cryptosporidium parvum
RSKVIPGRLIIKYKEKVLS

SEQ ID NO: 2358004 - protein, 19 aa, Cryptosporidium parvum
SGINWKGVKIMALKFLRGN

SEQ ID NO: 2358005 - protein, 17 aa, Cryptosporidium parvum
SLIVLILAIVISSNYCF

SEQ ID NO: 2358006 - protein, 17 aa, Cryptosporidium parvum
SMIRFGYLGGYLAVDFL

SEQ ID NO: 2358007 - protein, 17 aa, Cryptosporidium parvum
SRFNWSFVYEKIRNSLG

SEQ ID NO: 2358008 - protein, 20 aa, Cryptosporidium parvum
SRIWRGGRWTGVCIGLLNLG

SEQ ID NO: 2358009 - protein, 21 aa, Cryptosporidium parvum
STEMLKLVLLNGTEYALVNNE

SEQ ID NO: 2358010 - protein, 20 aa, Cryptosporidium parvum
TVLIAFEFCSVASNGLVGRD

SEQ ID NO: 2358011 - protein, 18 aa, Cryptosporidium parvum
VAEKYNKKKSWRKKTRKF

SEQ ID NO: 2358012 - protein, 19 aa, Cryptosporidium parvum
VICSFLVIFLCLGPEHVEF

SEQ ID NO: 2358013 - protein, 19 aa, Cryptosporidium parvum
VIIFKLKLGKIIKNENKKP

SEQ ID NO: 2358014 - protein, 30 aa, Cryptosporidium parvum
VKVKCGGGFCKRLRRALCCCSGGEEEEQPE

SEQ ID NO: 2358015 - protein, 19 aa, Cryptosporidium parvum
VNLPRSWYFLGEKIDEIYV

SEQ ID NO: 2358016 - protein, 19 aa, Cryptosporidium parvum
VYLEQRFNPIVKAIKSNKY

SEQ ID NO: 2358017 - protein, 18 aa, Cryptosporidium parvum
YELCTRFITTLSITKSVK

SEQ ID NO: 2358018 - protein, 25 aa, Cryptosporidium parvum
AASEYLEYLLLKNGLMFRVSLTERY

SEQ ID NO: 2358019 - protein, 25 aa, Cryptosporidium parvum
AEELVSPCFGIISYYPNMQITVMKG

SEQ ID NO: 2358020 - protein, 26 aa, Cryptosporidium parvum
AGSKVLEIPLLVAAPFMLTSDSNGSA

SEQ ID NO: 2358021 - protein, 24 aa, Cryptosporidium parvum
AIDGFAHFDFLYKKLYDIINTIHY

SEQ ID NO: 2358022 - protein, 23 aa, Cryptosporidium parvum
AIKSNKYLKKKLSKQIPDVIILM

SEQ ID NO: 2358023 - protein, 25 aa, Cryptosporidium parvum
AKGMKIEWFAVRDGILWVGSFGKEF

SEQ ID NO: 2358024 - protein, 23 aa, Cryptosporidium parvum
ALNSKSFIVRRWGKNVQSKLRKL

SEQ ID NO: 2358025 - protein, 17 aa, Cryptosporidium parvum
CFEYQYVCLLARHLEDD

SEQ ID NO: 2358026 - protein, 24 aa, Cryptosporidium parvum
CKTPDVKALRRLAAAKETSTVYET

SEQ ID NO: 2358027 - protein, 23 aa, Cryptosporidium parvum
CSQNYYNSLLAVGPIYDAVREMT

SEQ ID NO: 2358028 - protein, 17 aa, Cryptosporidium parvum
CTALKMIDAICPDGFLP

SEQ ID NO: 2358029 - protein, 20 aa, Cryptosporidium parvum
CTRLVPGALQYVCPVGTREG

SEQ ID NO: 2358030 - protein, 17 aa, Cryptosporidium parvum
CVAFTMPEKSCPPGFVF

SEQ ID NO: 2358031 - protein, 26 aa, Cryptosporidium parvum
DADNVIFATSLLLLTNIYSDNLGMSS

SEQ ID NO: 2358032 - protein, 17 aa, Cryptosporidium parvum
DDYFSFYISTYSNIYKL

SEQ ID NO: 2358033 - protein, 25 aa, Cryptosporidium parvum
DETNKFLENLFPSKLSSIKNETEQN

SEQ ID NO: 2358034 - protein, 25 aa, Cryptosporidium parvum
DFASKYSFIKLKSGFYRPLAGTGGR

SEQ ID NO: 2358035 - protein, 24 aa, Cryptosporidium parvum
DFDFYWRKDFLCDTASKIIKFGIE

SEQ ID NO: 2358036 - protein, 23 aa, Cryptosporidium parvum
DFNRRSILKLLPDIFKSNPIDSR

SEQ ID NO: 2358037 - protein, 27 aa, Cryptosporidium parvum
DGNYHIQSYISFILSKYNFDDSELVKD

SEQ ID NO: 2358038 - protein, 28 aa, Cryptosporidium parvum
DGTCYIVEYAPFSLTCNDPYTLFDNKEC

SEQ ID NO: 2358039 - protein, 25 aa, Cryptosporidium parvum
DICRFVGKVEPWIYTKRSGFTNHCI

SEQ ID NO: 2358040 - protein, 25 aa, Cryptosporidium parvum
DIINTIHYPGFQFIDDVRVDLYYGM

SEQ ID NO: 2358041 - protein, 21 aa, Cryptosporidium parvum
DIIPRRFLRSFYLSNLSHFTQ

SEQ ID NO: 2358042 - protein, 24 aa, Cryptosporidium parvum
DLNTRSIYLDRIVWSWSSRKIEDN

SEQ ID NO: 2358043 - protein, 24 aa, Cryptosporidium parvum
DQARSLFDVLLECLILFGERYSPE

SEQ ID NO: 2358044 - protein, 17 aa, Cryptosporidium parvum
DRNEILIDYFWDSMMDS

SEQ ID NO: 2358045 - protein, 24 aa, Cryptosporidium parvum
DSLPPTWHVYGIRPIQASIIRTRF

SEQ ID NO: 2358046 - protein, 18 aa, Cryptosporidium parvum
DTRFVIYPNLLFEQEICD

SEQ ID NO: 2358047 - protein, 26 aa, Cryptosporidium parvum
DVYKKFGGIFWARNIPRVSITNMINL

SEQ ID NO: 2358048 - protein, 20 aa, Cryptosporidium parvum
DYKIIMFPQTVFFKNEINKV

SEQ ID NO: 2358049 - protein, 18 aa, Cryptosporidium parvum
DYMFNYFDTYLPDPNNEN

SEQ ID NO: 2358050 - protein, 29 aa, Cryptosporidium parvum
EAVIWSHLMRKWIFLPRRVSFDEYDEEKD

SEQ ID NO: 2358051 - protein, 24 aa, Cryptosporidium parvum
ECAEALITFFKLKAETYYDSTERY

SEQ ID NO: 2358052 - protein, 20 aa, Cryptosporidium parvum
EETFPSLIRLYNPGFNPESF

SEQ ID NO: 2358053 - protein, 19 aa, Cryptosporidium parvum
EFLSLIKNKKLFKLINRKA

SEQ ID NO: 2358054 - protein, 23 aa, Cryptosporidium parvum
EFTCPGMLHSPRAQLLFSKQTEE

SEQ ID NO: 2358055 - protein, 22 aa, Cryptosporidium parvum
EGFISGHLMLRYNKGGMSSSSS

SEQ ID NO: 2358056 - protein, 22 aa, Cryptosporidium parvum
EHNYAFIAFFQEGEQKLEVLHK

SEQ ID NO: 2358057 - protein, 18 aa, Cryptosporidium parvum
EIEKLRGTYRSTLSKQFS

SEQ ID NO: 2358058 - protein, 19 aa, Cryptosporidium parvum
EILTTYPTPVYQTGTIYQG

SEQ ID NO: 2358059 - protein, 24 aa, Cryptosporidium parvum
EKAIEFCYNLEPFALLECHALTWI

SEQ ID NO: 2358060 - protein, 23 aa, Cryptosporidium parvum
ELKSFCRTLLERRLRDGEIQIFP

SEQ ID NO: 2358061 - protein, 22 aa, Cryptosporidium parvum
ELLDTLKHFGIKDLYSMFVRFQ

SEQ ID NO: 2358062 - protein, 18 aa, Cryptosporidium parvum
ELLPDMAFLIGDQRKRRG

SEQ ID NO: 2358063 - protein, 22 aa, Cryptosporidium parvum
ENPKVPWFQLSETIVPPLQRAQ

SEQ ID NO: 2358064 - protein, 27 aa, Cryptosporidium parvum
EQEEPLSFLMLSYGITSTHWQNFIPEE

SEQ ID NO: 2358065 - protein, 23 aa, Cryptosporidium parvum
ETHNKYYKSLKLSSTPYFQNTTS

SEQ ID NO: 2358066 - protein, 17 aa, Cryptosporidium parvum
FASIAKDILRYPEVVST

SEQ ID NO: 2358067 - protein, 21 aa, Cryptosporidium parvum
FDLATILFSVVAYGECIKRLN

SEQ ID NO: 2358068 - protein, 25 aa, Cryptosporidium parvum
FEDHELFKFLEFKGIPILNKNSKDI

SEQ ID NO: 2358069 - protein, 23 aa, Cryptosporidium parvum
FETFIKEIIPPPQLIDPKYDIRS

SEQ ID NO: 2358070 - protein, 22 aa, Cryptosporidium parvum
FIACILYFISLVSANGVCILKK

SEQ ID NO: 2358071 - protein, 25 aa, Cryptosporidium parvum
FIDGNNLVLVLFYDSSTTSKNIIHG

SEQ ID NO: 2358072 - protein, 18 aa, Cryptosporidium parvum
FIDKFVPLIKRHSNKKIK

SEQ ID NO: 2358073 - protein, 17 aa, Cryptosporidium parvum
FIDYKIIMFPQTVFFKN

SEQ ID NO: 2358074 - protein, 31 aa, Cryptosporidium parvum; identical to SEQ ID NO: 2338557

SEQ ID NO: 2358075 - protein, 25 aa, Cryptosporidium parvum
FIINNASFIYIYLSSISLPISKNQA

SEQ ID NO: 2358076 - protein, 25 aa, Cryptosporidium parvum
FKAKKDLMKFTPQKGIELGKKIARN

SEQ ID NO: 2358077 - protein, 17 aa, Cryptosporidium parvum
FKLFLQKFEEKLMHVLG

SEQ ID NO: 2358078 - protein, 19 aa, Cryptosporidium parvum
FLLFLELQNAWSSLNLSLN

SEQ ID NO: 2358079 - protein, 24 aa, Cryptosporidium parvum
FSDKNLMIMAKGKRLYNCKTKNWE

SEQ ID NO: 2358080 - protein, 20 aa, Cryptosporidium parvum
FSNYSPLNPHRTPFYDYYLS

SEQ ID NO: 2358081 - protein, 24 aa, Cryptosporidium parvum
FTDSLELFITGIRFICNDGSSSFH

SEQ ID NO: 2358082 - protein, 22 aa, Cryptosporidium parvum
FTNRFSIFPPTAYAGRIRIVEI

SEQ ID NO: 2358083 - protein, 17 aa, Cryptosporidium parvum
FTRIAFGSIWSDKKYRG

SEQ ID NO: 2358084 - protein, 19 aa, Cryptosporidium parvum
FTTPYHFLELNPSSIRELI

SEQ ID NO: 2358085 - protein, 33 aa, Cryptosporidium parvum
FVDLMARFHGQWSLFYKMFRQKFRQICKEAGYS

SEQ ID NO: 2358086 - protein, 21 aa, Cryptosporidium parvum
GARLYSPTYFKPAAASDEEYW

SEQ ID NO: 2358087 - protein, 22 aa, Cryptosporidium parvum
GDPVLFKLVHESRPLSKIQLEI

SEQ ID NO: 2358088 - protein, 40 aa, Cryptosporidium parvum; identical to SEQ ID NO: 2338693

SEQ ID NO: 2358089 - protein, 25 aa, Cryptosporidium parvum
GHTTGWYITAFCRAVYFAEKDVCIS

SEQ ID NO: 2358090 - protein, 26 aa, Cryptosporidium parvum
GINWKGVKIMALKFLRGNGVGFLSDS

SEQ ID NO: 2358091 - protein, 23 aa, Cryptosporidium parvum
GKECVLTNYYPLEAICQDGTRSK

SEQ ID NO: 2358092 - protein, 17 aa, Cryptosporidium parvum
GSLTISSPCDGHLSFRL

SEQ ID NO: 2358093 - protein, 23 aa, Cryptosporidium parvum
GSVKFNYLSIPWEDLEDSRGISS

SEQ ID NO: 2358094 - protein, 23 aa, Cryptosporidium parvum
GSVSHGFLCLGLNKLKSFKTESW

SEQ ID NO: 2358095 - protein, 29 aa, Cryptosporidium parvum
GYFNKDFFIGKSIFNLFLIPKIADLNGGY

SEQ ID NO: 2358096 - protein, 19 aa, Cryptosporidium parvum
GYRGSPMILTQFIENIDLN

SEQ ID NO: 2358097 - protein, 25 aa, Cryptosporidium parvum
HADHAPYNLICPVGSRLVADKCVTY

SEQ ID NO: 2358098 - protein, 22 aa, Cryptosporidium parvum
HNFNYELGYIKRDYYKLVKAVR

SEQ ID NO: 2358099 - protein, 35 aa, Cryptosporidium parvum; identical to SEQ ID NO: 2209592

SEQ ID NO: 2358100 - protein, 24 aa, Cryptosporidium parvum
IANEYADYELACPPGLIVISDKCA

SEQ ID NO: 2358101 - protein, 31 aa, Cryptosporidium parvum; identical to SEQ ID NO: 2338838

SEQ ID NO: 2358102 - protein, 45 aa, Cryptosporidium parvum; identical to SEQ ID NO: 2338847

SEQ ID NO: 2358103 - protein, 28 aa, Cryptosporidium parvum
IEDSNLCTLHLLLKKYSQNRSGSPNSKV

SEQ ID NO: 2358104 - protein, 28 aa, Cryptosporidium parvum
IFSKIINPELLFKLIQTAILKNTNCKPI

SEQ ID NO: 2358105 - protein, 26 aa, Cryptosporidium parvum
IFTGALILLEYLKIKIIKVVHLLNEY

SEQ ID NO: 2358106 - protein, 27 aa, Cryptosporidium parvum
IIAERHIIFLQAFIHHFSALSNIQLQP

SEQ ID NO: 2358107 - protein, 18 aa, Cryptosporidium parvum
IIIGLLSITFVQASTVQS

SEQ ID NO: 2358108 - protein, 21 aa, Cryptosporidium parvum
IILQVMFIHNIKHHIIVSPCD

SEQ ID NO: 2358109 - protein, 28 aa, Cryptosporidium parvum
IISILAVIAVFYSFTSTESDLASSSYYE

SEQ ID NO: 2358110 - protein, 20 aa, Cryptosporidium parvum
IKDIIVENLLRIYPNIELTG

SEQ ID NO: 2358111 - protein, 24 aa, Cryptosporidium parvum
IKNKKLFKLINRKASKRASKMMYE

SEQ ID NO: 2358112 - protein, 25 aa, Cryptosporidium parvum
ILELDSYLFSYGVKLPLEKDSNLIW

SEQ ID NO: 2358113 - protein, 20 aa, Cryptosporidium parvum
IMEFYDDWYKGPKSKRLCSQ

SEQ ID NO: 2358114 - protein, 18 aa, Cryptosporidium parvum
INIWKEFLSLIKNKKLFK

SEQ ID NO: 2358115 - protein, 31 aa, Cryptosporidium parvum
INMGLKALMGCILLISGLLSIVDESFDVITV

SEQ ID NO: 2358116 - protein, 22 aa, Cryptosporidium parvum
INNIGFGFVFPFQPTSREEISD

SEQ ID NO: 2358117 - protein, 20 aa, Cryptosporidium parvum
INQYKLPPRVTLLFIGLEHA

SEQ ID NO: 2358118 - protein, 25 aa, Cryptosporidium parvum
INTDRFKWYVAIGNDLSFTARYYVK

SEQ ID NO: 2358119 - protein, 21 aa, Cryptosporidium parvum
IPERGFSSLKFLPGSFDQIIV

SEQ ID NO: 2358120 - protein, 27 aa, Cryptosporidium parvum
IQLQPELYCLLFTNSMKPNIFSFVSNL

SEQ ID NO: 2358121 - protein, 20 aa, Cryptosporidium parvum
IQVPPMPFCQEPAIYHEGHC

SEQ ID NO: 2358122 - protein, 25 aa, Cryptosporidium parvum
IRNTLVLFIIFFIHNINCKAQEKPE

SEQ ID NO: 2358123 - protein, 18 aa, Cryptosporidium parvum
IRRRFFCQAFNREIMRDA

SEQ ID NO: 2358124 - protein, 17 aa, Cryptosporidium parvum
IRTFPPELVCPPGYTME

SEQ ID NO: 2358125 - protein, 24 aa, Cryptosporidium parvum
ISEDSMIRFGYLGGYLAVDFLPSR

SEQ ID NO: 2358126 - protein, 25 aa, Cryptosporidium parvum
ISSVSFVYRMIYYCTGRIILPKEAW

SEQ ID NO: 2358127 - protein, 23 aa, Cryptosporidium parvum
IVGQFEYNLLNPIFNYVPRTGEI

SEQ ID NO: 2358128 - protein, 20 aa, Cryptosporidium parvum
IVRDVAALNAIVKLEAENAS

SEQ ID NO: 2358129 - protein, 23 aa, Cryptosporidium parvum
IWLFYLFFGPCLGLRANTTHKLA

SEQ ID NO: 2358130 - protein, 17 aa, Cryptosporidium parvum
IYGQRFSNYSPLNPHRT

SEQ ID NO: 2358131 - protein, 18 aa, Cryptosporidium parvum
IYQQNLLNYLNKQSFNKS

SEQ ID NO: 2358132 - protein, 21 aa, Cryptosporidium parvum
KATYELFYFNNTQSYKYENNT

SEQ ID NO: 2358133 - protein, 19 aa, Cryptosporidium parvum
KCGGGFCKRLRRALCCCSG

SEQ ID NO: 2358134 - protein, 18 aa, Cryptosporidium parvum
KDLNFHIKCPNGYRIIGI

SEQ ID NO: 2358135 - protein, 23 aa, Cryptosporidium parvum
KEKSMNFMLKKSIIKLCSIVVNS

SEQ ID NO: 2358136 - protein, 22 aa, Cryptosporidium parvum
KENLKYTLQKYKTKIKNIAEAL

SEQ ID NO: 2358137 - protein, 23 aa, Cryptosporidium parvum
KFEVEVAKILYWRIKTDAELSAF

SEQ ID NO: 2358138 - protein, 20 aa, Cryptosporidium parvum
KFGIKNLFRKNAARAKLGYY

SEQ ID NO: 2358139 - protein, 25 aa, Cryptosporidium parvum
KHIDILSILIALREFLNSKNSEEIS

SEQ ID NO: 2358140 - protein, 21 aa, Cryptosporidium parvum
KIINEKIVISRLPISISKGFI

SEQ ID NO: 2358141 - protein, 19 aa, Cryptosporidium parvum
KILGLLEWNKDILSVFIEA

SEQ ID NO: 2358142 - protein, 24 aa, Cryptosporidium parvum
KKEGKFLFKPFAEVARAVGIPAHS

SEQ ID NO: 2358143 - protein, 17 aa, Cryptosporidium parvum
KLDKLRCPANCPDYGIV

SEQ ID NO: 2358144 - protein, 17 aa, Cryptosporidium parvum
KLINQYKLPPRVTLLFI

SEQ ID NO: 2358145 - protein, 19 aa, Cryptosporidium parvum
KMIDAICPDGFLPNGDDCI

SEQ ID NO: 2358146 - protein, 24 aa, Cryptosporidium parvum
KRKGKFKVYPPLGTILTVGEDQTN

SEQ ID NO: 2358147 - protein, 19 aa, Cryptosporidium parvum
KSFVGPIIIPIHTSTTTKT

SEQ ID NO: 2358148 - protein, 24 aa, Cryptosporidium parvum
KSKEHVIVTFFAPWCGHCTALEPE

SEQ ID NO: 2358149 - protein, 24 aa, Cryptosporidium parvum
LAKALIMFNFLLETKRLGVFQIHM

SEQ ID NO: 2358150 - protein, 20 aa, Cryptosporidium parvum
LAPIIGNVRIQFLEKRPLSQ

SEQ ID NO: 2358151 - protein, 23 aa, Cryptosporidium parvum
LASSSYYELSFVKVKCGGGFCKR

SEQ ID NO: 2358152 - protein, 25 aa, Cryptosporidium parvum
LEDYSSYGFVTWIKPVESNSTKVVL

SEQ ID NO: 2358153 - protein, 23 aa, Cryptosporidium parvum
LEERRICEKIPLFSTSPMTNNEN

SEQ ID NO: 2358154 - protein, 22 aa, Cryptosporidium parvum
LFAFLKAIYATDHRGSLTISSP

SEQ ID NO: 2358155 - protein, 19 aa, Cryptosporidium parvum
LFATYFLTKTGFRNSESIS

SEQ ID NO: 2358156 - protein, 21 aa, Cryptosporidium parvum
LFFFAIYIMIGISNASDMTSS

SEQ ID NO: 2358157 - protein, 20 aa, Cryptosporidium parvum
LFFFLELSLIITNSSTYIPN

SEQ ID NO: 2358158 - protein, 17 aa, Cryptosporidium parvum
LFLSFVSTISLCSRLEW

SEQ ID NO: 2358159 - protein, 29 aa, Cryptosporidium parvum
LGLHLGDFIYPRLFPIFVSDLCIARKMMK

SEQ ID NO: 2358160 - protein, 25 aa, Cryptosporidium parvum
LIGPNEVIIFKLKLGKIIKNENKKP

SEQ ID NO: 2358161 - protein, 21 aa, Cryptosporidium parvum
LILFTLAIYSQSIHANEDDVI

SEQ ID NO: 2358162 - protein, 24 aa, Cryptosporidium parvum
LKTALILLLKFIGSSGISNYQGFG

SEQ ID NO: 2358163 - protein, 24 aa, Cryptosporidium parvum
LLACSGIHMHLFEIKPKGVSFTKL

SEQ ID NO: 2358164 - protein, 26 aa, Cryptosporidium parvum
LLATIIFCNFALIFCRRIPCEFEGNR

SEQ ID NO: 2358165 - protein, 18 aa, Cryptosporidium parvum
LLFCVKFAREVILTTGNE

SEQ ID NO: 2358166 - protein, 24 aa, Cryptosporidium parvum
LLLLFIFFSYCMCGDMISAIIESA

SEQ ID NO: 2358167 - protein, 29 aa, Cryptosporidium parvum
LLLPHKRNLVKWFHIALNSLTCTDLGFFF

SEQ ID NO: 2358168 - protein, 24 aa, Cryptosporidium parvum
LLPYLLVFFQKRVICNIFNTSSIS

SEQ ID NO: 2358169 - protein, 18 aa, Cryptosporidium parvum
LMIGLVLPGLEQEVENFT

SEQ ID NO: 2358170 - protein, 18 aa, Cryptosporidium parvum
LNGKTCLLLTACFASTLS

SEQ ID NO: 2358171 - protein, 35 aa, Cryptosporidium parvum; identical to SEQ ID NO: 2210022

SEQ ID NO: 2358172 - protein, 20 aa, Cryptosporidium parvum
LQAVILVCLLYLCIHVEGNG

SEQ ID NO: 2358173 - protein, 18 aa, Cryptosporidium parvum
LQRAQMIYKVGWKAVIPS

SEQ ID NO: 2358174 - protein, 17 aa, Cryptosporidium parvum
LRCPANCPDYGIVALGW

SEQ ID NO: 2358175 - protein, 33 aa, Cryptosporidium parvum; identical to SEQ ID NO: 2339492

SEQ ID NO: 2358176 - protein, 17 aa, Cryptosporidium parvum
LSIPFSDYFLDTDKKTL

SEQ ID NO: 2358177 - protein, 25 aa, Cryptosporidium parvum
LSKQIPDVIILMNTDQYPELSQIGG

SEQ ID NO: 2358178 - protein, 25 aa, Cryptosporidium parvum
LTGTVISIPLPLFTEASNLKWRHVS

SEQ ID NO: 2358179 - protein, 27 aa, Cryptosporidium parvum
LTILEKLVMDLFRKYGFNAATCQALLV

SEQ ID NO: 2358180 - protein, 20 aa, Cryptosporidium parvum
MCESCQLITFALKEYISKKL

SEQ ID NO: 2358181 - protein, 26 aa, Cryptosporidium parvum
MQIEKIPLVYYFPFGEDKVSKMFLYD

SEQ ID NO: 2358182 - protein, 23 aa, Cryptosporidium parvum
MSNSLANLFIKNGQRYLDICNDG

SEQ ID NO: 2358183 - protein, 25 aa, Cryptosporidium parvum
NAAFEFWNNSFLLHDNPDILSINCN

SEQ ID NO: 2358184 - protein, 22 aa, Cryptosporidium parvum
NDLSFTARYYVKEGMYIKEGQE

SEQ ID NO: 2358185 - protein, 31 aa, Cryptosporidium parvum; identical to SEQ ID NO: 2210134

SEQ ID NO: 2358186 - protein, 17 aa, Cryptosporidium parvum
NEIQTIGLLINHTNLQK

SEQ ID NO: 2358187 - protein, 24 aa, Cryptosporidium parvum
NETAYPIYPMDEESMFNEIQTIGL

SEQ ID NO: 2358188 - protein, 17 aa, Cryptosporidium parvum
NEYIDYMFNYFDTYLPD

SEQ ID NO: 2358189 - protein, 19 aa, Cryptosporidium parvum
NFFVVLERLIEIQEPSWDV

SEQ ID NO: 2358190 - protein, 19 aa, Cryptosporidium parvum
NFHIKCPNGYRIIGIDAIV

SEQ ID NO: 2358191 - protein, 26 aa, Cryptosporidium parvum
NGFGNMPFSYINTVKELPVGLKPQDA

SEQ ID NO: 2358192 - protein, 25 aa, Cryptosporidium parvum
NGILDKIIILHKLAIEIELTKIVYL

SEQ ID NO: 2358193 - protein, 24 aa, Cryptosporidium parvum
NGVMAPKYILSFLCLQYPTGQVQT

SEQ ID NO: 2358194 - protein, 26 aa, Cryptosporidium parvum
NHKSRIWRGGRWTGVCIGLLNLGGGI

SEQ ID NO: 2358195 - protein, 17 aa, Cryptosporidium parvum
NKEWIDYLTILIDDWLD

SEQ ID NO: 2358196 - protein, 25 aa, Cryptosporidium parvum
NKGKEIALIMPFSIKINKIKADLQE

SEQ ID NO: 2358197 - protein, 38 aa, Cryptosporidium parvum; identical to SEQ ID NO: 2339681

SEQ ID NO: 2358198 - protein, 21 aa, Cryptosporidium parvum
NKYRGLIYTGVPEIEFSKPDI

SEQ ID NO: 2358199 - protein, 17 aa, Cryptosporidium parvum
NLFLIPKIADLNGGYVY

SEQ ID NO: 2358200 - protein, 26 aa, Cryptosporidium parvum
NNFNILSDDILLKNPYKYIDDSESSD

SEQ ID NO: 2358201 - protein, 23 aa, Cryptosporidium parvum
NNGEIIMVRFLCSDYITSFSIGQ

SEQ ID NO: 2358202 - protein, 25 aa, Cryptosporidium parvum
NNNCERISYIPPILSCPQNFERSGQ

SEQ ID NO: 2358203 - protein, 25 aa, Cryptosporidium parvum
NNQIKVYLEQRFNPIVKAIKSNKYL

SEQ ID NO: 2358204 - protein, 27 aa, Cryptosporidium parvum
NPKIIHERLLIIFQLINSQSSTPSCKM

SEQ ID NO: 2358205 - protein, 23 aa, Cryptosporidium parvum
NVRIQFLEKRPLSQNKYRGLIYT

SEQ ID NO: 2358206 - protein, 25 aa, Cryptosporidium parvum
PACNGLMIVLLDHAEFVHSYFTSLV

SEQ ID NO: 2358207 - protein, 25 aa, Cryptosporidium parvum
PAIYHEGHCLIVTAPLKQCPPGYEI

SEQ ID NO: 2358208 - protein, 30 aa, Cryptosporidium parvum; identical to SEQ ID NO: 2339822

SEQ ID NO: 2358209 - protein, 19 aa, Cryptosporidium parvum
PEKRIIIDPLLLICGKKQV

SEQ ID NO: 2358210 - protein, 17 aa, Cryptosporidium parvum
PEKSCPPGFVFSGKQCV

SEQ ID NO: 2358211 - protein, 17 aa, Cryptosporidium parvum
PFFECYYFRVENGSLYR

SEQ ID NO: 2358212 - protein, 17 aa, Cryptosporidium parvum
PIGIFIAILLVNSFGPS

SEQ ID NO: 2358213 - protein, 36 aa, Cryptosporidium parvum; identical to SEQ ID NO: 2210274

SEQ ID NO: 2358214 - protein, 20 aa, Cryptosporidium parvum
PLAYTTLKPMKGMLSTESRL

SEQ ID NO: 2358215 - protein, 23 aa, Cryptosporidium parvum
PLNFHFNNFILRYLKSGELNNET

SEQ ID NO: 2358216 - protein, 25 aa, Cryptosporidium parvum
PLNPHRTPFYDYYLSSVGQSSYRKD

SEQ ID NO: 2358217 - protein, 17 aa, Cryptosporidium parvum
PMQIIFQDKIIPGSELE

SEQ ID NO: 2358218 - protein, 20 aa, Cryptosporidium parvum
PPGYTLCSSIDYYFGNHIST

SEQ ID NO: 2358219 - protein, 22 aa, Cryptosporidium parvum
PSIRYMYGPAKFDSVEPLKEFM

SEQ ID NO: 2358220 - protein, 24 aa, Cryptosporidium parvum
PTMECPPGYYRPQAGVAIRSHGHK

SEQ ID NO: 2358221 - protein, 23 aa, Cryptosporidium parvum
QGRLKTIINVVSIPKPKAILPNG

SEQ ID NO: 2358222 - protein, 19 aa, Cryptosporidium parvum
QLMTINEIIKCRGGKNWIT

SEQ ID NO: 2358223 - protein, 35 aa, Cryptosporidium parvum; identical to SEQ ID NO: 2210359

SEQ ID NO: 2358224 - protein, 25 aa, Cryptosporidium parvum
QNLLAALCWSLPFKFIKCDIDFEEN

SEQ ID NO: 2358225 - protein, 23 aa, Cryptosporidium parvum
QPRMERILRFLGSNPVDLAGQDK

SEQ ID NO: 2358226 - protein, 26 aa, Cryptosporidium parvum
RCVQYLPANKICPPGFNLSGQQCMAP

SEQ ID NO: 2358227 - protein, 18 aa, Cryptosporidium parvum
RGTYRSTLSKQFSTGKTW

SEQ ID NO: 2358228 - protein, 22 aa, Cryptosporidium parvum
RHSLFDLSILVKESLESAYRAL

SEQ ID NO: 2358229 - protein, 17 aa, Cryptosporidium parvum
RIFVDLMARFHGQWSLF

SEQ ID NO: 2358230 - protein, 20 aa, Cryptosporidium parvum
RIPETTISGFILFKGLENSF

SEQ ID NO: 2358231 - protein, 22 aa, Cryptosporidium parvum
RKFKLEFLELSNEFLQHTKAIR

SEQ ID NO: 2358232 - protein, 25 aa, Cryptosporidium parvum
RKLCSGPILLLIILSLSNSTEVDKA

SEQ ID NO: 2358233 - protein, 25 aa, Cryptosporidium parvum
RNVYEPYALQCPDGFRLLGDMCQQS

SEQ ID NO: 2358234 - protein, 17 aa, Cryptosporidium parvum
RPKIRELINFGQETLRV

SEQ ID NO: 2358235 - protein, 23 aa, Cryptosporidium parvum
RSKDAFIKYIKKLTGPAVQVAES

SEQ ID NO: 2358236 - protein, 18 aa, Cryptosporidium parvum
RTKPLISKFPIEEGSHSA

SEQ ID NO: 2358237 - protein, 27 aa, Cryptosporidium parvum
RVAEKYNKKKSWRKKTRKFKLEFLELS

SEQ ID NO: 2358238 - protein, 22 aa, Cryptosporidium parvum
RVNFINSLTWILQQNNPYSDIW

SEQ ID NO: 2358239 - protein, 17 aa, Cryptosporidium parvum
RYTIGPFASLVHKRDQD

SEQ ID NO: 2358240 - protein, 18 aa, Cryptosporidium parvum
SACTNECGWGIQTRGRRI

SEQ ID NO: 2358241 - protein, 21 aa, Cryptosporidium parvum
SASFKYRKCKYWSWRATDFSC

SEQ ID NO: 2358242 - protein, 32 aa, Cryptosporidium parvum
SDIILSGKCLNGIIFTAMALDSGAIKGSVVPD

SEQ ID NO: 2358243 - protein, 18 aa, Cryptosporidium parvum
SDQFIIPAIISYFEKKNI

SEQ ID NO: 2358244 - protein, 19 aa, Cryptosporidium parvum
SDSIIYFITVKPGTEITVN

SEQ ID NO: 2358245 - protein, 25 aa, Cryptosporidium parvum
SENLQILEYDFIFSKLKDINGDVND

SEQ ID NO: 2358246 - protein, 26 aa, Cryptosporidium parvum
SFFTVLFNFLLLLSDQVFFNDFLNTS

SEQ ID NO: 2358247 - protein, 25 aa, Cryptosporidium parvum
SFRRVSRCCILIQDFVDIALMIISN

SEQ ID NO: 2358248 - protein, 34 aa, Cryptosporidium parvum; identical to SEQ ID NO: 2340198

SEQ ID NO: 2358249 - protein, 35 aa, Cryptosporidium parvum; identical to SEQ ID NO: 2340216

SEQ ID NO: 2358250 - protein, 20 aa, Cryptosporidium parvum
SIFLPLLKHSFGYQANQPNV

SEQ ID NO: 2358251 - protein, 41 aa, Cryptosporidium parvum
SIHTSIMEGLRMLRKDKKMIIQIHALGYLVNTIKEQIVRDV

SEQ ID NO: 2358252 - protein, 18 aa, Cryptosporidium parvum
SIMNVPLFSAISAENYSL

SEQ ID NO: 2358253 - protein, 33 aa, Cryptosporidium parvum; identical to SEQ ID NO: 2340231

SEQ ID NO: 2358254 - protein, 26 aa, Cryptosporidium parvum
SKDIPPHLIYGKFQLVTAPCSGILRN

SEQ ID NO: 2358255 - protein, 26 aa, Cryptosporidium parvum
SKKGNKFTRFFKRLFKKPSCIKCVKS

SEQ ID NO: 2358256 - protein, 27 aa, Cryptosporidium parvum
SKLQKFVKMLHLLANFELFLNGCFNSP

SEQ ID NO: 2358257 - protein, 21 aa, Cryptosporidium parvum
SKQMCLLLKPANHKSCIKLSS

SEQ ID NO: 2358258 - protein, 19 aa, Cryptosporidium parvum
SKRTLLRSINFRCPEKSVI

SEQ ID NO: 2358259 - protein, 26 aa, Cryptosporidium parvum
SLIVLILAIVISSNYCFGKDNTDNKG

SEQ ID NO: 2358260 - protein, 25 aa, Cryptosporidium parvum
SLLFLFLLQFSFGSSLKSNPLGNEN

SEQ ID NO: 2358261 - protein, 23 aa, Cryptosporidium parvum
SLSLIVPFDIKLFSKFVIKKNGK

SEQ ID NO: 2358262 - protein, 18 aa, Cryptosporidium parvum
SNFKFINFGYMKSTLEVS

SEQ ID NO: 2358263 - protein, 33 aa, Cryptosporidium parvum; identical to SEQ ID NO: 2340317

SEQ ID NO: 2358264 - protein, 26 aa, Cryptosporidium parvum
SPCDGHLSFRLPLNHSFERSDIILSG

SEQ ID NO: 2358265 - protein, 22 aa, Cryptosporidium parvum
SQRFHSTPLAYTTLKPMKGMLS

SEQ ID NO: 2358266 - protein, 18 aa, Cryptosporidium parvum
SRLLKKISDLNFVEVLNN

SEQ ID NO: 2358267 - protein, 31 aa, Cryptosporidium parvum; identical to SEQ ID NO: 2210593

SEQ ID NO: 2358268 - protein, 21 aa, Cryptosporidium parvum
SSPVLECPPGYSLETGKQCVR

SEQ ID NO: 2358269 - protein, 18 aa, Cryptosporidium parvum
SVRSRLLKKISDLNFVEV

SEQ ID NO: 2358270 - protein, 24 aa, Cryptosporidium parvum
TCTDLGFFFASFTNRFSIFPPTAY

SEQ ID NO: 2358271 - protein, 18 aa, Cryptosporidium parvum
TEDVIVLPVPREVEVTSD

SEQ ID NO: 2358272 - protein, 24 aa, Cryptosporidium parvum
TETFINEFTKYRPKIRELINFGQE

SEQ ID NO: 2358273 - protein, 21 aa, Cryptosporidium parvum
TETVLLLLVLLILSHNGTSAL

SEQ ID NO: 2358274 - protein, 21 aa, Cryptosporidium parvum
TKNFMILQNILPNPSFVTKKQ

SEQ ID NO: 2358275 - protein, 27 aa, Cryptosporidium parvum
TNPLKSAQYIWLIARMKFNVFILEAES

SEQ ID NO: 2358276 - protein, 23 aa, Cryptosporidium parvum
TPGERLVSMFRKSKISKCSKKTS

SEQ ID NO: 2358277 - protein, 19 aa, Cryptosporidium parvum
TPILRLIQVIKEETLPKGS

SEQ ID NO: 2358278 - protein, 22 aa, Cryptosporidium parvum
TPLSNFSIPCKEAIYLGDIPKL

SEQ ID NO: 2358279 - protein, 17 aa, Cryptosporidium parvum
TQHLLIEKFPGLVIQSV

SEQ ID NO: 2358280 - protein, 25 aa, Cryptosporidium parvum
TQLRPELKVVKRTKPLISKFPIEEG

SEQ ID NO: 2358281 - protein, 20 aa, Cryptosporidium parvum
TQQHICEGIYLLNTYRGEGD

SEQ ID NO: 2358282 - protein, 30 aa, Cryptosporidium parvum; identical to SEQ ID NO: 2340503

SEQ ID NO: 2358283 - protein, 22 aa, Cryptosporidium parvum
TSRMEFFDYLLNGSMRPPTYSC

SEQ ID NO: 2358284 - protein, 24 aa, Cryptosporidium parvum
TTSTEMLKLVLLNGTEYALVNNET

SEQ ID NO: 2358285 - protein, 21 aa, Cryptosporidium parvum
TVLIAFEFCSVASNGLVGRDH

SEQ ID NO: 2358286 - protein, 20 aa, Cryptosporidium parvum
TYILCKVESNCMVSSWSDWS

SEQ ID NO: 2358287 - protein, 22 aa, Cryptosporidium parvum
VEAPLKVYTPKKPSLDAFKTRG

SEQ ID NO: 2358288 - protein, 17 aa, Cryptosporidium parvum
VGQFEKLNLYGAGSRNE

SEQ ID NO: 2358289 - protein, 26 aa, Cryptosporidium parvum
VICSFLVIFLCLGPEHVEFHLVNGNK

SEQ ID NO: 2358290 - protein, 21 aa, Cryptosporidium parvum
VKAFIIYVKYKADIGLHIYRL

SEQ ID NO: 2358291 - protein, 32 aa, Cryptosporidium parvum
VKAVRKIHPRHPFPLPSSPLYIKGKKFGIKNL

SEQ ID NO: 2358292 - protein, 29 aa, Cryptosporidium parvum
VKRYTSYLRGPTQRLPVSQIWRATPLENR

SEQ ID NO: 2358293 - protein, 28 aa, Cryptosporidium parvum
VKSFFGKIKSFFKKKPSSVNLGCKKPNC

SEQ ID NO: 2358294 - protein, 33 aa, Cryptosporidium parvum
VLDSTTLLELYYFDYDRFVISRPILDGKEDAWI

SEQ ID NO: 2358295 - protein, 26 aa, Cryptosporidium parvum
VLSKLVALKNYWKRLHKNRMKQPNNK

SEQ ID NO: 2358296 - protein, 24 aa, Cryptosporidium parvum
VNLPRSWYFLGEKIDEIYVSVNGF

SEQ ID NO: 2358297 - protein, 19 aa, Cryptosporidium parvum
VRNNWRILTSPCDGLLIYT

SEQ ID NO: 2358298 - protein, 32 aa, Cryptosporidium parvum; identical to SEQ ID NO: 2340643

SEQ ID NO: 2358299 - protein, 24 aa, Cryptosporidium parvum
WIDFSVVMDIKFRMKRRGMFLETK

SEQ ID NO: 2358300 - protein, 18 aa, Cryptosporidium parvum
WKYHGEVIKGIRGGAGYL

SEQ ID NO: 2358301 - protein, 27 aa, Cryptosporidium parvum
YAEKYLIMSIGFAFKRKITRNRSTGAE

SEQ ID NO: 2358302 - protein, 19 aa, Cryptosporidium parvum
YFSFYISTYSNIYKLPVLE

SEQ ID NO: 2358303 - protein, 18 aa, Cryptosporidium parvum
YIAKKKILGLLEWNKDIL

SEQ ID NO: 2358304 - protein, 21 aa, Cryptosporidium parvum
YKFSNMFFVVPIYSDGNKVLG

SEQ ID NO: 2358305 - protein, 17 aa, Cryptosporidium parvum
YKLVKAVRKIHPRHPFP

SEQ ID NO: 2358306 - protein, 18 aa, Cryptosporidium parvum
YLAGLKFSNATDLTQLYA

SEQ ID NO: 2358307 - protein, 24 aa, Cryptosporidium parvum
YLITLTFIIPFVLSQSTLLNLGAG

SEQ ID NO: 2358308 - protein, 20 aa, Cryptosporidium parvum
YQIIGLEYFTDSLELFITGI

SEQ ID NO: 2358309 - protein, 28 aa, Cryptosporidium parvum
YRNNISLHLIKPLMKISCAEYFGISVFL

SEQ ID NO: 2358310 - protein, 19 aa, Cryptosporidium parvum
YRPIRSLLIKACDDALFHE

SEQ ID NO: 2358311 - protein, 20 aa, Cryptosporidium parvum
YRVPEIISSLRSESNRLVFA

SEQ ID NO: 2358312 - protein, 21 aa, Cryptosporidium parvum
YSPYDLACPAGYALVGDKCAT

SEQ ID NO: 2358313 - protein, 43 aa, Cryptosporidium parvum
YTVQTTATFEFLYRMIDPRIKDAPYKISLMKYTYSALSSQSKV

SEQ ID NO: 2358314 - protein, 18 aa, Cryptosporidium parvum
YVERYTFGPVFINVNEFV

SEQ ID NO: 2358315 - protein, 22 aa, Cryptosporidium parvum
YVQEGAVLLGIWNDNTIFLRFE

SEQ ID NO: 2358316 - protein, 19 aa, Cryptosporidium parvum
YWDPVYFGPLSSNSSKILG

SEQ ID NO: 2358317 - protein, 24 aa, Cryptosporidium parvum
EEMDDLTIMLYLLAKEFPSKNHFA

SEQ ID NO: 2358318 - protein, 18 aa, Cryptosporidium parvum
ELYCLLFTNSMKPNIFSF

SEQ ID NO: 2358319 - protein, 17 aa, Cryptosporidium parvum
FAYQLIDGSLIPSSALA

SEQ ID NO: 2358320 - protein, 18 aa, Cryptosporidium parvum
FIACILYFISLVSANGVC

SEQ ID NO: 2358321 - protein, 20 aa, Cryptosporidium parvum
FYCIKIIILSYYKSSIQQFT

SEQ ID NO: 2358322 - protein, 20 aa, Cryptosporidium parvum
HPRHPFPLPSSPLYIKGKKF

SEQ ID NO: 2358323 - protein, 19 aa, Cryptosporidium parvum
IHHPPKLLFFFGSINKFEA

SEQ ID NO: 2358324 - protein, 20 aa, Cryptosporidium parvum
IINPELLFKLIQTAILKNTN

SEQ ID NO: 2358325 - protein, 27 aa, Cryptosporidium parvum
INMGLKALMGCILLISGLLSIVDESFD

SEQ ID NO: 2358326 - protein, 17 aa, Cryptosporidium parvum
IRNTLVLFIIFFIHNIN

SEQ ID NO: 2358327 - protein, 21 aa, Cryptosporidium parvum
IWLFYLFFGPCLGLRANTTHK

SEQ ID NO: 2358328 - protein, 18 aa, Cryptosporidium parvum
KFTRFFKRLFKKPSCIKC

SEQ ID NO: 2358329 - protein, 25 aa, Cryptosporidium parvum
KQLLLVVAFLFHLFLVLNAIPIIQI

SEQ ID NO: 2358330 - protein, 24 aa, Cryptosporidium parvum
KQNLLVQCKILYQAFYSYKNSVRS

SEQ ID NO: 2358331 - protein, 23 aa, Cryptosporidium parvum
LDSTTLLELYYFDYDRFVISRPI

SEQ ID NO: 2358332 - protein, 22 aa, Cryptosporidium parvum
LEKLVMDLFRKYGFNAATCQAL

SEQ ID NO: 2358333 - protein, 18 aa, Cryptosporidium parvum
LFAFLKAIYATDHRGSLT

SEQ ID NO: 2358334 - protein, 18 aa, Cryptosporidium parvum
LFFFAIYIMIGISNASDM

SEQ ID NO: 2358335 - protein, 18 aa, Cryptosporidium parvum
LILFTLAIYSQSIHANED

SEQ ID NO: 2358336 - protein, 17 aa, Cryptosporidium parvum
LIMSIGFAFKRKITRNR

SEQ ID NO: 2358337 - protein, 22 aa, Cryptosporidium parvum
LKTALILLLKFIGSSGISNYQG

SEQ ID NO: 2358338 - protein, 22 aa, Cryptosporidium parvum
LLLLFIFFSYCMCGDMISAIIE

SEQ ID NO: 2358339 - protein, 18 aa, Cryptosporidium parvum
MIIQIHALGYLVNTIKEQ

SEQ ID NO: 2358340 - protein, 19 aa, Cryptosporidium parvum
MLITYKQLLLVVAFLFHLF

SEQ ID NO: 2358341 - protein, 24 aa, Cryptosporidium parvum
QTTATFEFLYRMIDPRIKDAPYKI

SEQ ID NO: 2358342 - protein, 18 aa, Cryptosporidium parvum
SFFTVLFNFLLLLSDQVF

SEQ ID NO: 2358343 - protein, 23 aa, Cryptosporidium parvum
SLIVLILAIVISSNYCFGKDNTD

SEQ ID NO: 2358344 - protein, 23 aa, Cryptosporidium parvum
SLLFLFLLQFSFGSSLKSNPLGN

SEQ ID NO: 2358345 - protein, 23 aa, Cryptosporidium parvum
SNLCTLHLLLKKYSQNRSGSPNS

SEQ ID NO: 2358346 - protein, 18 aa, Cryptosporidium parvum
VICSFLVIFLCLGPEHVE

SEQ ID NO: 2358347 - protein, 17 aa, Cryptosporidium parvum
VIWIYEPGLLLAEELVS

SEQ ID NO: 2358348 - protein, 20 aa, Cryptosporidium parvum
VPYILKCESPFILDGDKCIE

SEQ ID NO: 2358349 - protein, 19 aa, Cryptosporidium parvum
YKKFGGIFWARNIPRVSIT

SEQ ID NO: 2358350 - protein, 25 aa, Cryptosporidium parvum
YSSDFIPRIYLLSRSIPKENFYRVP

SEQ ID NO: 2358351 - protein, 11 aa, Entamoeba dispar
KCKETKNNKCS

SEQ ID NO: 2358352 - protein, 11 aa, Entamoeba dispar
KEKKEQEKTTT

SEQ ID NO: 2358353 - protein, 5 aa, Entamoeba dispar
CSKCG

SEQ ID NO: 2358354 - protein, 7 aa, Entamoeba dispar
EEGTKCN

SEQ ID NO: 2358355 - protein, 6 aa, Entamoeba dispar
ECNKCE

SEQ ID NO: 2358356 - protein, 12 aa, Entamoeba dispar
EIEIGEGEEIEV

SEQ ID NO: 2358357 - protein, 18 aa, Entamoeba dispar
CKSTTTIKGCKGEIDKEY

SEQ ID NO: 2358358 - protein, 7 aa, Entamoeba dispar
LNKTQEE

SEQ ID NO: 2358359 - protein, 9 aa, Entamoeba dispar
KRTNTEIPN

SEQ ID NO: 2358360 - protein, 6 aa, Entamoeba dispar
DFGSSR

SEQ ID NO: 2358361 - protein, 18 aa, Entamoeba dispar
DKYLRNDKTCQSNEELNG

SEQ ID NO: 2358362 - protein, 5 aa, Entamoeba dispar
GSGCG

SEQ ID NO: 2358363 - protein, 7 aa, Entamoeba dispar
NKTCEED

SEQ ID NO: 2358364 - protein, 5 aa, Entamoeba dispar
EICQT

SEQ ID NO: 2358365 - protein, 12 aa, Entamoeba dispar
QIDKDEDKMKEF

SEQ ID NO: 2358366 - protein, 6 aa, Entamoeba dispar
CETCYG

SEQ ID NO: 2358367 - protein, 8 aa, Entamoeba dispar
KGIGTPKY

SEQ ID NO: 2358368 - protein, 12 aa, Entamoeba dispar
YYRNGKGCSKCE

SEQ ID NO: 2358369 - protein, 4 aa, Entamoeba dispar
KYIN

SEQ ID NO: 2358370 - protein, 8 aa, Entamoeba dispar
EEQNTYGC

SEQ ID NO: 2358371 - protein, 8 aa, Entamoeba dispar
EGDYGDRT

SEQ ID NO: 2358372 - protein, 26 aa, Entamoeba dispar
IKGETQISTRLDPDEIKEEHKIGEGS

SEQ ID NO: 2358373 - protein, 8 aa, Entamoeba dispar
YSPNLKGE

SEQ ID NO: 2358374 - protein, 9 aa, Entamoeba dispar
WKQEPKERI

SEQ ID NO: 2358375 - protein, 25 aa, Entamoeba dispar
NEKKEKKKIQISSKEENEKYSIRTN

SEQ ID NO: 2358376 - protein, 14 aa, Entamoeba dispar
GHGGYECGDNGEWS

SEQ ID NO: 2358377 - protein, 4 aa, Entamoeba dispar
KYGS

SEQ ID NO: 2358378 - protein, 20 aa, Entamoeba dispar
NGYKIENNQCNGDKEDQCYY

SEQ ID NO: 2358379 - protein, 9 aa, Entamoeba dispar
EQSNEGTTL

SEQ ID NO: 2358380 - protein, 10 aa, Entamoeba dispar
KDQNGKCNNN

SEQ ID NO: 2358381 - protein, 5 aa, Entamoeba dispar
PFPKT

SEQ ID NO: 2358382 - protein, 5 aa, Entamoeba dispar
ESSNQ

SEQ ID NO: 2358383 - protein, 9 aa, Entamoeba dispar
GNSKSGRVV

SEQ ID NO: 2358384 - protein, 4 aa, Entamoeba dispar
GSGC

SEQ ID NO: 2358385 - protein, 5 aa, Entamoeba dispar
KYIDN

SEQ ID NO: 2358386 - protein, 25 aa, Entamoeba dispar
NENKEKKKIQISSKEENEKYSIRTN

SEQ ID NO: 2358387 - protein, 12 aa, Entamoeba dispar
QIDKDENKMKEF

SEQ ID NO: 2358388 - protein, 6 aa, Entamoeba dispar
CKIGNE

SEQ ID NO: 2358389 - protein, 6 aa, Entamoeba dispar
ECNTCE

SEQ ID NO: 2358390 - protein, 8 aa, Entamoeba dispar
EWPSGPRR

SEQ ID NO: 2358391 - protein, 16 aa, Entamoeba dispar
HSCPSGLRGPSQERLS

SEQ ID NO: 2358392 - protein, 4 aa, Entamoeba dispar
PNNP

SEQ ID NO: 2358393 - protein, 7 aa, Entamoeba dispar
TINGEDP

SEQ ID NO: 2358394 - protein, 7 aa, Entamoeba dispar
TYTTYTT

SEQ ID NO: 2358395 - protein, 8 aa, Entamoeba dispar
VENNDKSI

SEQ ID NO: 2358396 - protein, 8 aa, Entamoeba dispar
WKQEPKER

SEQ ID NO: 2358397 - protein, 8 aa, Entamoeba dispar
EFEEETKK

SEQ ID NO: 2358398 - protein, 5 aa, Entamoeba dispar
EPYKE

SEQ ID NO: 2358399 - protein, 5 aa, Entamoeba dispar
EQGTH

SEQ ID NO: 2358400 - protein, 4 aa, Entamoeba dispar
ESIP

SEQ ID NO: 2358401 - protein, 6 aa, Entamoeba dispar
KTCEEF

SEQ ID NO: 2358402 - protein, 10 aa, Entamoeba dispar
LDKASKGRTT

SEQ ID NO: 2358403 - protein, 6 aa, Entamoeba dispar
PPIGGG

SEQ ID NO: 2358404 - protein, 15 aa, Entamoeba dispar
QSMEEEVDQETVEND

SEQ ID NO: 2358405 - protein, 7 aa, Entamoeba dispar
SALSTKL

SEQ ID NO: 2358406 - protein, 6 aa, Entamoeba dispar
TDFGTS

SEQ ID NO: 2358407 - protein, 7 aa, Entamoeba dispar
VGSGKSS

SEQ ID NO: 2358408 - protein, 10 aa, Entamoeba dispar
VKRDEKCDKE

SEQ ID NO: 2358409 - protein, 13 aa, Entamoeba dispar
ATSALDSESEKIV

SEQ ID NO: 2358410 - protein, 7 aa, Entamoeba dispar
DDNGETE

SEQ ID NO: 2358411 - protein, 6 aa, Entamoeba dispar
DFGASR

SEQ ID NO: 2358412 - protein, 7 aa, Entamoeba dispar
EDGTKCN

SEQ ID NO: 2358413 - protein, 5 aa, Entamoeba dispar
EETRE

SEQ ID NO: 2358414 - protein, 13 aa, Entamoeba dispar
EIEIGEGEKIEVN

SEQ ID NO: 2358415 - protein, 4 aa, Entamoeba dispar
ESPL

SEQ ID NO: 2358416 - protein, 9 aa, Entamoeba dispar
FKKDEEDDF

SEQ ID NO: 2358417 - protein, 7 aa, Entamoeba dispar
GKSNEKF

SEQ ID NO: 2358418 - protein, 8 aa, Entamoeba dispar
IENNDKSI

SEQ ID NO: 2358419 - protein, 6 aa, Entamoeba dispar
IKEYTQ

SEQ ID NO: 2358420 - protein, 26 aa, Entamoeba dispar
IKGETQISTRLDPDEIKEENKIGEGS

SEQ ID NO: 2358421 - protein, 5 aa, Entamoeba dispar
KKGET

SEQ ID NO: 2358422 - protein, 11 aa, Entamoeba dispar
KNPPQPSFSNN

SEQ ID NO: 2358423 - protein, 7 aa, Entamoeba dispar
KTNSQYI

SEQ ID NO: 2358424 - protein, 21 aa, Entamoeba dispar
NENKEKKKIQISSKEENEKYS

SEQ ID NO: 2358425 - protein, 20 aa, Entamoeba dispar
NGYKIQNNQCNGDKEDQCYY

SEQ ID NO: 2358426 - protein, 4 aa, Entamoeba dispar
NKTC

SEQ ID NO: 2358427 - protein, 16 aa, Entamoeba dispar
NYDPNSGKITIDGKDI

SEQ ID NO: 2358428 - protein, 6 aa, Entamoeba dispar
QTPPLA

SEQ ID NO: 2358429 - protein, 9 aa, Entamoeba dispar
SETTLTTKK

SEQ ID NO: 2358430 - protein, 6 aa, Entamoeba dispar
TRPSHQ

SEQ ID NO: 2358431 - protein, 11 aa, Entamoeba dispar
TSALDTQSEKI

SEQ ID NO: 2358432 - protein, 12 aa, Entamoeba dispar
YYRNGKGCSKCG

SEQ ID NO: 2358433 - protein, 4 aa, Entamoeba dispar
DTTT

SEQ ID NO: 2358434 - protein, 7 aa, Entamoeba dispar
EEPAGGS

SEQ ID NO: 2358435 - protein, 5 aa, Entamoeba dispar
EICKT

SEQ ID NO: 2358436 - protein, 6 aa, Entamoeba dispar
EQGTHQ

SEQ ID NO: 2358437 - protein, 7 aa, Entamoeba dispar
EQNTYGC

SEQ ID NO: 2358438 - protein, 13 aa, Entamoeba dispar
ERGANLSGGQRQR

SEQ ID NO: 2358439 - protein, 8 aa, Entamoeba dispar
ERRSATEL

SEQ ID NO: 2358440 - protein, 9 aa, Entamoeba dispar
ESGELTTRI

SEQ ID NO: 2358441 - protein, 10 aa, Entamoeba dispar
GRTGSGKSTM

SEQ ID NO: 2358442 - protein, 7 aa, Entamoeba dispar
IAEETIG

SEQ ID NO: 2358443 - protein, 9 aa, Entamoeba dispar
ISRKDQMTL

SEQ ID NO: 2358444 - protein, 19 aa, Entamoeba dispar
KENGECKEIDNKCNKSERN

SEQ ID NO: 2358445 - protein, 5 aa, Entamoeba dispar
KESVN

SEQ ID NO: 2358446 - protein, 11 aa, Entamoeba dispar
KGCKGEIDKEY

SEQ ID NO: 2358447 - protein, 5 aa, Entamoeba dispar
KINNQ

SEQ ID NO: 2358448 - protein, 8 aa, Entamoeba dispar
KINTKTTS

SEQ ID NO: 2358449 - protein, 7 aa, Entamoeba dispar
KKEPYQR

SEQ ID NO: 2358450 - protein, 8 aa, Entamoeba dispar
KLHDTEGK

SEQ ID NO: 2358451 - protein, 10 aa, Entamoeba dispar
LLSGGQKQRI

SEQ ID NO: 2358452 - protein, 20 aa, Entamoeba dispar
LNQEHKFSEEYEEKIKENEH

SEQ ID NO: 2358453 - protein, 6 aa, Entamoeba dispar
LPDGYD

SEQ ID NO: 2358454 - protein, 5 aa, Entamoeba dispar
MSARS

SEQ ID NO: 2358455 - protein, 6 aa, Entamoeba dispar
NEESVT

SEQ ID NO: 2358456 - protein, 6 aa, Entamoeba dispar
NKECQY

SEQ ID NO: 2358457 - protein, 4 aa, Entamoeba dispar
NLGG

SEQ ID NO: 2358458 - protein, 5 aa, Entamoeba dispar
NLGGT

SEQ ID NO: 2358459 - protein, 6 aa, Entamoeba dispar
NNNGNN

SEQ ID NO: 2358460 - protein, 8 aa, Entamoeba dispar
NPDPNEIL

SEQ ID NO: 2358461 - protein, 6 aa, Entamoeba dispar
NSPTRI

SEQ ID NO: 2358462 - protein, 8 aa, Entamoeba dispar
NSSSSTPL

SEQ ID NO: 2358463 - protein, 15 aa, Entamoeba dispar
PLAGYDNSRSENEIE

SEQ ID NO: 2358464 - protein, 6 aa, Entamoeba dispar
QDGIGP

SEQ ID NO: 2358465 - protein, 7 aa, Entamoeba dispar
QSGCAEE

SEQ ID NO: 2358466 - protein, 4 aa, Entamoeba dispar
SNNY

SEQ ID NO: 2358467 - protein, 9 aa, Entamoeba dispar
STGKRPTII

SEQ ID NO: 2358468 - protein, 13 aa, Entamoeba dispar
STVGECPNECNGN

SEQ ID NO: 2358469 - protein, 5 aa, Entamoeba dispar
TIQNA

SEQ ID NO: 2358470 - protein, 20 aa, Entamoeba dispar
TKCNPKNKRLVKRDEKCDKE

SEQ ID NO: 2358471 - protein, 10 aa, Entamoeba dispar
TKCNPNNKRL

SEQ ID NO: 2358472 - protein, 8 aa, Entamoeba dispar
TNNREKNV

SEQ ID NO: 2358473 - protein, 10 aa, Entamoeba dispar
TREGETLNEE

SEQ ID NO: 2358474 - protein, 9 aa, Entamoeba dispar
TSGCGKSTT

SEQ ID NO: 2358475 - protein, 7 aa, Entamoeba dispar
VGSNPTG

SEQ ID NO: 2358476 - protein, 9 aa, Entamoeba dispar
WKQEAKERI

SEQ ID NO: 2358477 - protein, 6 aa, Entamoeba dispar
YDESIP

SEQ ID NO: 2358478 - protein, 11 aa, Entamoeba dispar
YRNGKGCSKCE

SEQ ID NO: 2358479 - protein, 11 aa, Entamoeba dispar
YRNGKGCSKCG

SEQ ID NO: 2358480 - protein, 22 aa, Entamoeba dispar
YTLNNKKCSNKEKNQNGKNEEI

SEQ ID NO: 2358481 - protein, 4 aa, Entamoeba dispar
ASID

SEQ ID NO: 2358482 - protein, 6 aa, Entamoeba dispar
AYQTST

SEQ ID NO: 2358483 - protein, 15 aa, Entamoeba dispar
CLNKEKNQNGKNEEI

SEQ ID NO: 2358484 - protein, 8 aa, Entamoeba dispar
CNKTNEQN

SEQ ID NO: 2358485 - protein, 6 aa, Entamoeba dispar
DFGTSR

SEQ ID NO: 2358486 - protein, 11 aa, Entamoeba dispar
DGDPNGKDEEF

SEQ ID NO: 2358487 - protein, 12 aa, Entamoeba dispar
DGDPNGKDEEFE

SEQ ID NO: 2358488 - protein, 7 aa, Entamoeba dispar
DKLKAGQ

SEQ ID NO: 2358489 - protein, 23 aa, Entamoeba dispar
DKQKESDEIELGNEHQESNPIED

SEQ ID NO: 2358490 - protein, 9 aa, Entamoeba dispar
DNQEESELF

SEQ ID NO: 2358491 - protein, 12 aa, Entamoeba dispar
DPYDPMKFPDSE

SEQ ID NO: 2358492 - protein, 4 aa, Entamoeba dispar
DRKH

SEQ ID NO: 2358493 - protein, 5 aa, Entamoeba dispar
EAGNL

SEQ ID NO: 2358494 - protein, 7 aa, Entamoeba dispar
EDEPETW

SEQ ID NO: 2358495 - protein, 8 aa, Entamoeba dispar
EDEYNNEM

SEQ ID NO: 2358496 - protein, 8 aa, Entamoeba dispar
EEGNSKSY

SEQ ID NO: 2358497 - protein, 10 aa, Entamoeba dispar
EKKEQEKTTT

SEQ ID NO: 2358498 - protein, 8 aa, Entamoeba dispar
ENGENFSL

SEQ ID NO: 2358499 - protein, 5 aa, Entamoeba dispar
EPTNG

SEQ ID NO: 2358500 - protein, 6 aa, Entamoeba dispar
ETCYGT

SEQ ID NO: 2358501 - protein, 4 aa, Entamoeba dispar
ETRE

SEQ ID NO: 2358502 - protein, 10 aa, Entamoeba dispar
ETTEKENEDI

SEQ ID NO: 2358503 - protein, 10 aa, Entamoeba dispar
ETTEKENNDI

SEQ ID NO: 2358504 - protein, 8 aa, Entamoeba dispar
ETTPSLNQ

SEQ ID NO: 2358505 - protein, 6 aa, Entamoeba dispar
FNDGDD

SEQ ID NO: 2358506 - protein, 9 aa, Entamoeba dispar
FTKDEEDDF

SEQ ID NO: 2358507 - protein, 8 aa, Entamoeba dispar
GCGKSTSI

SEQ ID NO: 2358508 - protein, 14 aa, Entamoeba dispar
GDRGSQLSGGQKQR

SEQ ID NO: 2358509 - protein, 24 aa, Entamoeba dispar
GETQISTRLDPDEIKEEHKIGEGS

SEQ ID NO: 2358510 - protein, 7 aa, Entamoeba dispar
GGIESGV

SEQ ID NO: 2358511 - protein, 7 aa, Entamoeba dispar
GNSPTRI

SEQ ID NO: 2358512 - protein, 15 aa, Entamoeba dispar
GRSKKNIVNEEVPSQ

SEQ ID NO: 2358513 - protein, 7 aa, Entamoeba dispar
GTDLDTS

SEQ ID NO: 2358514 - protein, 9 aa, Entamoeba dispar
GTDVAKQAS

SEQ ID NO: 2358515 - protein, 4 aa, Entamoeba dispar
GYGF

SEQ ID NO: 2358516 - protein, 15 aa, Entamoeba dispar
HGHGGYECGDNGEWS

SEQ ID NO: 2358517 - protein, 4 aa, Entamoeba dispar
ICQT

SEQ ID NO: 2358518 - protein, 5 aa, Entamoeba dispar
IGSSG

SEQ ID NO: 2358519 - protein, 11 aa, Entamoeba dispar
IKDQNGKCNNN

SEQ ID NO: 2358520 - protein, 26 aa, Entamoeba dispar
IKGETQISTRLDPDEIKEEHKIGEGT

SEQ ID NO: 2358521 - protein, 26 aa, Entamoeba dispar
IKGETQISTRLDPDEIKEEKKIGEGS

SEQ ID NO: 2358522 - protein, 7 aa, Entamoeba dispar
IKQEIDD

SEQ ID NO: 2358523 - protein, 9 aa, Entamoeba dispar
INEPTKKIG

SEQ ID NO: 2358524 - protein, 9 aa, Entamoeba dispar
INRKETRFQ

SEQ ID NO: 2358525 - protein, 7 aa, Entamoeba dispar
KAEQGKT

SEQ ID NO: 2358526 - protein, 11 aa, Entamoeba dispar
KAIVDQEYEET

SEQ ID NO: 2358527 - protein, 12 aa, Entamoeba dispar
KDQNGKCNNNNN

SEQ ID NO: 2358528 - protein, 14 aa, Entamoeba dispar
KDQNGKCNNNNNIQ

SEQ ID NO: 2358529 - protein, 19 aa, Entamoeba dispar
KENGECKEKDNKCNKSERN

SEQ ID NO: 2358530 - protein, 4 aa, Entamoeba dispar
KEPY

SEQ ID NO: 2358531 - protein, 5 aa, Entamoeba dispar
KHKTI

SEQ ID NO: 2358532 - protein, 5 aa, Entamoeba dispar
KINKQ

SEQ ID NO: 2358533 - protein, 28 aa, Entamoeba dispar
KIREQENKEAEEINQHKNADTNEDPDVV

SEQ ID NO: 2358534 - protein, 7 aa, Entamoeba dispar
KKEGEGL

SEQ ID NO: 2358535 - protein, 5 aa, Entamoeba dispar
KKEPY

SEQ ID NO: 2358536 - protein, 7 aa, Entamoeba dispar
KKEPYQK

SEQ ID NO: 2358537 - protein, 7 aa, Entamoeba dispar
KKIGEGS

SEQ ID NO: 2358538 - protein, 18 aa, Entamoeba dispar
KKTKSTKELLGNDKSING

SEQ ID NO: 2358539 - protein, 8 aa, Entamoeba dispar
KNPHDPIT

SEQ ID NO: 2358540 - protein, 12 aa, Entamoeba dispar
KNPPQPSFSNNY

SEQ ID NO: 2358541 - protein, 9 aa, Entamoeba dispar
KNPSDPITA

SEQ ID NO: 2358542 - protein, 8 aa, Entamoeba dispar
KSEIQTNG

SEQ ID NO: 2358543 - protein, 6 aa, Entamoeba dispar
KSYVNG

SEQ ID NO: 2358544 - protein, 10 aa, Entamoeba dispar
LEQSKGETII

SEQ ID NO: 2358545 - protein, 8 aa, Entamoeba dispar
LNDDPGTY

SEQ ID NO: 2358546 - protein, 10 aa, Entamoeba dispar
LNSASIEETG

SEQ ID NO: 2358547 - protein, 15 aa, Entamoeba dispar
LQPQDRTSAPNSEYA

SEQ ID NO: 2358548 - protein, 6 aa, Entamoeba dispar
NAGPKI

SEQ ID NO: 2358549 - protein, 8 aa, Entamoeba dispar
NEKFPLKT

SEQ ID NO: 2358550 - protein, 21 aa, Entamoeba dispar
NEKKEKKKIQISSKEENEKYS

SEQ ID NO: 2358551 - protein, 4 aa, Entamoeba dispar
NEQI

SEQ ID NO: 2358552 - protein, 7 aa, Entamoeba dispar
NETEGTV

SEQ ID NO: 2358553 - protein, 9 aa, Entamoeba dispar
NFPNGETAF

SEQ ID NO: 2358554 - protein, 7 aa, Entamoeba dispar
NGATPFD

SEQ ID NO: 2358555 - protein, 10 aa, Entamoeba dispar
NKDKECETYT

SEQ ID NO: 2358556 - protein, 6 aa, Entamoeba dispar
NPTPSI

SEQ ID NO: 2358557 - protein, 4 aa, Entamoeba dispar
NRGT

SEQ ID NO: 2358558 - protein, 10 aa, Entamoeba dispar
NYDSSKTHTV

SEQ ID NO: 2358559 - protein, 5 aa, Entamoeba dispar
PDKLG

SEQ ID NO: 2358560 - protein, 4 aa, Entamoeba dispar
PEGY

SEQ ID NO: 2358561 - protein, 5 aa, Entamoeba dispar
PIGSG

SEQ ID NO: 2358562 - protein, 13 aa, Entamoeba dispar
PLTTNAGTGSQFE

SEQ ID NO: 2358563 - protein, 4 aa, Entamoeba dispar
PNYD

SEQ ID NO: 2358564 - protein, 7 aa, Entamoeba dispar
PSKRAPF

SEQ ID NO: 2358565 - protein, 26 aa, Entamoeba dispar
PVEETKEKKRKYQEIPEDWPKEGKIE

SEQ ID NO: 2358566 - protein, 7 aa, Entamoeba dispar
QALTNGK

SEQ ID NO: 2358567 - protein, 13 aa, Entamoeba dispar
QCSEYTTNEIDTV

SEQ ID NO: 2358568 - protein, 6 aa, Entamoeba dispar
QTTGSE

SEQ ID NO: 2358569 - protein, 15 aa, Entamoeba dispar
RDPPKEKKDEEGIDL

SEQ ID NO: 2358570 - protein, 4 aa, Entamoeba dispar
REGI

SEQ ID NO: 2358571 - protein, 7 aa, Entamoeba dispar
REKYNNA

SEQ ID NO: 2358572 - protein, 10 aa, Entamoeba dispar
RGIPKGVEVN

SEQ ID NO: 2358573 - protein, 4 aa, Entamoeba dispar
RHPL

SEQ ID NO: 2358574 - protein, 4 aa, Entamoeba dispar
SDAS

SEQ ID NO: 2358575 - protein, 12 aa, Entamoeba dispar
SDTLTDDQKDTI

SEQ ID NO: 2358576 - protein, 5 aa, Entamoeba dispar
SECTA

SEQ ID NO: 2358577 - protein, 4 aa, Entamoeba dispar
SETT

SEQ ID NO: 2358578 - protein, 7 aa, Entamoeba dispar
SGWATAA

SEQ ID NO: 2358579 - protein, 4 aa, Entamoeba dispar
SKCG

SEQ ID NO: 2358580 - protein, 7 aa, Entamoeba dispar
SKSTLES

SEQ ID NO: 2358581 - protein, 5 aa, Entamoeba dispar
SLGGG

SEQ ID NO: 2358582 - protein, 4 aa, Entamoeba dispar
SNEE

SEQ ID NO: 2358583 - protein, 9 aa, Entamoeba dispar
STGTTTYGY

SEQ ID NO: 2358584 - protein, 7 aa, Entamoeba dispar
STNPFKA

SEQ ID NO: 2358585 - protein, 7 aa, Entamoeba dispar
STPNKSL

SEQ ID NO: 2358586 - protein, 5 aa, Entamoeba dispar
TDSFN

SEQ ID NO: 2358587 - protein, 9 aa, Entamoeba dispar
TEGSKERVG

SEQ ID NO: 2358588 - protein, 9 aa, Entamoeba dispar
TGDGKSSLG

SEQ ID NO: 2358589 - protein, 10 aa, Entamoeba dispar
TGPNMGGKST

SEQ ID NO: 2358590 - protein, 13 aa, Entamoeba dispar
TIKGCKGEIDKEY

SEQ ID NO: 2358591 - protein, 11 aa, Entamoeba dispar
TISTGKRPKII

SEQ ID NO: 2358592 - protein, 9 aa, Entamoeba dispar
TKCNPKNKR

SEQ ID NO: 2358593 - protein, 6 aa, Entamoeba dispar
TQTDDR

SEQ ID NO: 2358594 - protein, 7 aa, Entamoeba dispar
TSTGSGR

SEQ ID NO: 2358595 - protein, 4 aa, Entamoeba dispar
TTKI

SEQ ID NO: 2358596 - protein, 4 aa, Entamoeba dispar
TVRN

SEQ ID NO: 2358597 - protein, 6 aa, Entamoeba dispar
TYASQT

SEQ ID NO: 2358598 - protein, 20 aa, Entamoeba dispar
VNPNSETNETKGYSGTGDRS

SEQ ID NO: 2358599 - protein, 6 aa, Entamoeba dispar
YGDPSE

SEQ ID NO: 2358600 - protein, 4 aa, Entamoeba dispar
YQLE

SEQ ID NO: 2358601 - protein, 5 aa, Entamoeba dispar
YRGRE

SEQ ID NO: 2358602 - protein, 6 aa, Entamoeba dispar
YSPNFK

SEQ ID NO: 2358603 - protein, 6 aa, Entamoeba dispar
YSPNLK

SEQ ID NO: 2358604 - protein, 8 aa, Entamoeba dispar
YSPNLNGE

SEQ ID NO: 2358605 - protein, 4 aa, Entamoeba dispar
AAGA

SEQ ID NO: 2358606 - protein, 7 aa, Entamoeba dispar
AAGGIGK

SEQ ID NO: 2358607 - protein, 5 aa, Entamoeba dispar
AASAV

SEQ ID NO: 2358608 - protein, 7 aa, Entamoeba dispar
AATSVRT

SEQ ID NO: 2358609 - protein, 9 aa, Entamoeba dispar
ADASTCSSA

SEQ ID NO: 2358610 - protein, 4 aa, Entamoeba dispar
ADSI

SEQ ID NO: 2358611 - protein, 9 aa, Entamoeba dispar
AEGKYSIDG

SEQ ID NO: 2358612 - protein, 4 aa, Entamoeba dispar
AELT

SEQ ID NO: 2358613 - protein, 7 aa, Entamoeba dispar
AEPDFGP

SEQ ID NO: 2358614 - protein, 7 aa, Entamoeba dispar
AERGTHQ

SEQ ID NO: 2358615 - protein, 16 aa, Entamoeba dispar
AETYNNDHSKYKEEKE

SEQ ID NO: 2358616 - protein, 10 aa, Entamoeba dispar
AFPSHSRTPQ

SEQ ID NO: 2358617 - protein, 8 aa, Entamoeba dispar
AGGSRESY

SEQ ID NO: 2358618 - protein, 9 aa, Entamoeba dispar
AIKEAENIG

SEQ ID NO: 2358619 - protein, 29 aa, Entamoeba dispar
AKARQKRVEKEMRKNMKESAKQHALELAA

SEQ ID NO: 2358620 - protein, 7 aa, Entamoeba dispar
AKTNENI

SEQ ID NO: 2358621 - protein, 7 aa, Entamoeba dispar
ALGPVTS

SEQ ID NO: 2358622 - protein, 4 aa, Entamoeba dispar
ALGT

SEQ ID NO: 2358623 - protein, 8 aa, Entamoeba dispar
ANDEEKSI

SEQ ID NO: 2358624 - protein, 5 aa, Entamoeba dispar
ANGEL

SEQ ID NO: 2358625 - protein, 12 aa, Entamoeba dispar
ANIDIQTDKTIQ

SEQ ID NO: 2358626 - protein, 10 aa, Entamoeba dispar
ANVNRGSALT

SEQ ID NO: 2358627 - protein, 17 aa, Entamoeba dispar
APEDKTLQALTDDSSTF

SEQ ID NO: 2358628 - protein, 4 aa, Entamoeba dispar
APTG

SEQ ID NO: 2358629 - protein, 8 aa, Entamoeba dispar
AQKNCGAA

SEQ ID NO: 2358630 - protein, 13 aa, Entamoeba dispar
AQNIDQEINEQEP

SEQ ID NO: 2358631 - protein, 5 aa, Entamoeba dispar
AQQGA

SEQ ID NO: 2358632 - protein, 13 aa, Entamoeba dispar
ARNLTQEQEKEFN

SEQ ID NO: 2358633 - protein, 9 aa, Entamoeba dispar
ARPTKQYPS

SEQ ID NO: 2358634 - protein, 8 aa, Entamoeba dispar
ASETKTQL

SEQ ID NO: 2358635 - protein, 8 aa, Entamoeba dispar
ASGCGKST

SEQ ID NO: 2358636 - protein, 10 aa, Entamoeba dispar
ASGCGKSTSV

SEQ ID NO: 2358637 - protein, 9 aa, Entamoeba dispar
ASGCGKSTT

SEQ ID NO: 2358638 - protein, 4 aa, Entamoeba dispar
ASLS

SEQ ID NO: 2358639 - protein, 9 aa, Entamoeba dispar
ASSSNGNAL

SEQ ID NO: 2358640 - protein, 5 aa, Entamoeba dispar
ATDPV

SEQ ID NO: 2358641 - protein, 4 aa, Entamoeba dispar
ATGY

SEQ ID NO: 2358642 - protein, 9 aa, Entamoeba dispar
ATNESEKGI

SEQ ID NO: 2358643 - protein, 6 aa, Entamoeba dispar
ATPVLD

SEQ ID NO: 2358644 - protein, 7 aa, Entamoeba dispar
AVGSGTG

SEQ ID NO: 2358645 - protein, 10 aa, Entamoeba dispar
AVRAAKNTYD

SEQ ID NO: 2358646 - protein, 13 aa, Entamoeba dispar
CADKEKKQASNPI

SEQ ID NO: 2358647 - protein, 8 aa, Entamoeba dispar
CENRNTSL

SEQ ID NO: 2358648 - protein, 10 aa, Entamoeba dispar
CEYSSTKGCT

SEQ ID NO: 2358649 - protein, 7 aa, Entamoeba dispar
CGNDPNC

SEQ ID NO: 2358650 - protein, 18 aa, Entamoeba dispar
CGNNVLDEGEECDGGEGC

SEQ ID NO: 2358651 - protein, 12 aa, Entamoeba dispar
CGYTGTTKEGKD

SEQ ID NO: 2358652 - protein, 5 aa, Entamoeba dispar
CKIGN

SEQ ID NO: 2358653 - protein, 10 aa, Entamoeba dispar
CQSCSSYHHD

SEQ ID NO: 2358654 - protein, 10 aa, Entamoeba dispar
CSKSTDSKCS

SEQ ID NO: 2358655 - protein, 11 aa, Entamoeba dispar
CSLDQTADLVS

SEQ ID NO: 2358656 - protein, 26 aa, Entamoeba dispar
CSNGYTLNNKKCSNKEKNQNGKNEEI

SEQ ID NO: 2358657 - protein, 8 aa, Entamoeba dispar
CSPQDKER

SEQ ID NO: 2358658 - protein, 4 aa, Entamoeba dispar
CSSC

SEQ ID NO: 2358659 - protein, 9 aa, Entamoeba dispar
CSSNPFKNK

SEQ ID NO: 2358660 - protein, 7 aa, Entamoeba dispar
CSSNSTY

SEQ ID NO: 2358661 - protein, 8 aa, Entamoeba dispar
CTDENYRS

SEQ ID NO: 2358662 - protein, 6 aa, Entamoeba dispar
CTGDCQ

SEQ ID NO: 2358663 - protein, 5 aa, Entamoeba dispar
CTPNQ

SEQ ID NO: 2358664 - protein, 8 aa, Entamoeba dispar
DAASSTHI

SEQ ID NO: 2358665 - protein, 6 aa, Entamoeba dispar
DAPDIP

SEQ ID NO: 2358666 - protein, 8 aa, Entamoeba dispar
DAPNGTSA

SEQ ID NO: 2358667 - protein, 8 aa, Entamoeba dispar
DCNRETKE

SEQ ID NO: 2358668 - protein, 18 aa, Entamoeba dispar
DCSEKENCKKCSSESNSC

SEQ ID NO: 2358669 - protein, 9 aa, Entamoeba dispar
DCVSSSGNC

SEQ ID NO: 2358670 - protein, 7 aa, Entamoeba dispar
DEDCMPS

SEQ ID NO: 2358671 - protein, 6 aa, Entamoeba dispar
DEDNYS

SEQ ID NO: 2358672 - protein, 22 aa, Entamoeba dispar
DEEGLNDNSSNSDDDDDSLSAG

SEQ ID NO: 2358673 - protein, 9 aa, Entamoeba dispar
DEEHPEGDT

SEQ ID NO: 2358674 - protein, 6 aa, Entamoeba dispar
DEFQKY

SEQ ID NO: 2358675 - protein, 4 aa, Entamoeba dispar
DENC

SEQ ID NO: 2358676 - protein, 4 aa, Entamoeba dispar
DESV

SEQ ID NO: 2358677 - protein, 4 aa, Entamoeba dispar
DETG

SEQ ID NO: 2358678 - protein, 10 aa, Entamoeba dispar
DETKKKPQQQ

SEQ ID NO: 2358679 - protein, 8 aa, Entamoeba dispar
DETQKSLP

SEQ ID NO: 2358680 - protein, 5 aa, Entamoeba dispar
DEWYS

SEQ ID NO: 2358681 - protein, 4 aa, Entamoeba dispar
DFGT

SEQ ID NO: 2358682 - protein, 6 aa, Entamoeba dispar
DGDFEP

SEQ ID NO: 2358683 - protein, 8 aa, Entamoeba dispar
DGKECKSS

SEQ ID NO: 2358684 - protein, 8 aa, Entamoeba dispar
DGKKETSL

SEQ ID NO: 2358685 - protein, 8 aa, Entamoeba dispar
DGNCQPCS

SEQ ID NO: 2358686 - protein, 16 aa, Entamoeba dispar
DGNGNSVLAKTNGKYS

SEQ ID NO: 2358687 - protein, 5 aa, Entamoeba dispar
DGPAI

SEQ ID NO: 2358688 - protein, 7 aa, Entamoeba dispar
DGTIAGE

SEQ ID NO: 2358689 - protein, 7 aa, Entamoeba dispar
DIACPED

SEQ ID NO: 2358690 - protein, 8 aa, Entamoeba dispar
DIPMSESK

SEQ ID NO: 2358691 - protein, 6 aa, Entamoeba dispar
DIPNQI

SEQ ID NO: 2358692 - protein, 9 aa, Entamoeba dispar
DKAAKGRTT

SEQ ID NO: 2358693 - protein, 4 aa, Entamoeba dispar
DKAC

SEQ ID NO: 2358694 - protein, 7 aa, Entamoeba dispar
DKCNSCD

SEQ ID NO: 2358695 - protein, 8 aa, Entamoeba dispar
DKGCQECD

SEQ ID NO: 2358696 - protein, 6 aa, Entamoeba dispar
DKINKR

SEQ ID NO: 2358697 - protein, 9 aa, Entamoeba dispar
DKKISGSSM

SEQ ID NO: 2358698 - protein, 7 aa, Entamoeba dispar
DKRTDEC

SEQ ID NO: 2358699 - protein, 7 aa, Entamoeba dispar
DKTGTLT

SEQ ID NO: 2358700 - protein, 9 aa, Entamoeba dispar
DKTGTLTEN

SEQ ID NO: 2358701 - protein, 18 aa, Entamoeba dispar
DKYLRNDKTCQSNKELNG

SEQ ID NO: 2358702 - protein, 16 aa, Entamoeba dispar
DLENEREVTKEEGMNY

SEQ ID NO: 2358703 - protein, 7 aa, Entamoeba dispar
DLTDEQH

SEQ ID NO: 2358704 - protein, 22 aa, Entamoeba dispar
DMAPANPNNLEEKYESANEEGS

SEQ ID NO: 2358705 - protein, 6 aa, Entamoeba dispar
DNAEAL

SEQ ID NO: 2358706 - protein, 5 aa, Entamoeba dispar
DNEPI

SEQ ID NO: 2358707 - protein, 9 aa, Entamoeba dispar
DNIATARSI

SEQ ID NO: 2358708 - protein, 6 aa, Entamoeba dispar
DNIKKE

SEQ ID NO: 2358709 - protein, 10 aa, Entamoeba dispar
DNKGNEHDFK

SEQ ID NO: 2358710 - protein, 7 aa, Entamoeba dispar
DNKTQLY

SEQ ID NO: 2358711 - protein, 4 aa, Entamoeba dispar
DNNA

SEQ ID NO: 2358712 - protein, 7 aa, Entamoeba dispar
DNNKRTT

SEQ ID NO: 2358713 - protein, 5 aa, Entamoeba dispar
DNSAE

SEQ ID NO: 2358714 - protein, 4 aa, Entamoeba dispar
DNSN

SEQ ID NO: 2358715 - protein, 13 aa, Entamoeba dispar
DPFETTPFTSSSK

SEQ ID NO: 2358716 - protein, 6 aa, Entamoeba dispar
DPSNDV

SEQ ID NO: 2358717 - protein, 4 aa, Entamoeba dispar
DPTH

SEQ ID NO: 2358718 - protein, 10 aa, Entamoeba dispar
DPTSEKCGAC

SEQ ID NO: 2358719 - protein, 6 aa, Entamoeba dispar
DPTTTG

SEQ ID NO: 2358720 - protein, 4 aa, Entamoeba dispar
DQNI

SEQ ID NO: 2358721 - protein, 14 aa, Entamoeba dispar
DQTVNEPSKTDCEE

SEQ ID NO: 2358722 - protein, 8 aa, Entamoeba dispar
DSINRSSQ

SEQ ID NO: 2358723 - protein, 11 aa, Entamoeba dispar
DSISFSSDTPI

SEQ ID NO: 2358724 - protein, 7 aa, Entamoeba dispar
DSPLGES

SEQ ID NO: 2358725 - protein, 9 aa, Entamoeba dispar
DSPNQAGYY

SEQ ID NO: 2358726 - protein, 5 aa, Entamoeba dispar
DSSNE

SEQ ID NO: 2358727 - protein, 16 aa, Entamoeba dispar
DSYQSQSGSDSNSQTD

SEQ ID NO: 2358728 - protein, 7 aa, Entamoeba dispar
DTANQEN

SEQ ID NO: 2358729 - protein, 4 aa, Entamoeba dispar
DTGE

SEQ ID NO: 2358730 - protein, 5 aa, Entamoeba dispar
DTSLS

SEQ ID NO: 2358731 - protein, 9 aa, Entamoeba dispar
DVKNNKEKI

SEQ ID NO: 2358732 - protein, 10 aa, Entamoeba dispar
DVQQIQDGMS

SEQ ID NO: 2358733 - protein, 17 aa, Entamoeba dispar
EACPGKEGINNSTEGGY

SEQ ID NO: 2358734 - protein, 8 aa, Entamoeba dispar
EAGSTEFT

SEQ ID NO: 2358735 - protein, 5 aa, Entamoeba dispar
EATEK

SEQ ID NO: 2358736 - protein, 18 aa, Entamoeba dispar
EDESHQPNTFRQAPPAQS

SEQ ID NO: 2358737 - protein, 4 aa, Entamoeba dispar
EDGI

SEQ ID NO: 2358738 - protein, 7 aa, Entamoeba dispar
EDGSRSY

SEQ ID NO: 2358739 - protein, 8 aa, Entamoeba dispar
EDPTQCNS

SEQ ID NO: 2358740 - protein, 4 aa, Entamoeba dispar
EDQR

SEQ ID NO: 2358741 - protein, 4 aa, Entamoeba dispar
EEAT

SEQ ID NO: 2358742 - protein, 8 aa, Entamoeba dispar
EECDGGEG

SEQ ID NO: 2358743 - protein, 9 aa, Entamoeba dispar
EECSSCTSL

SEQ ID NO: 2358744 - protein, 6 aa, Entamoeba dispar
EEDTSY

SEQ ID NO: 2358745 - protein, 6 aa, Entamoeba dispar
EEEFEE

SEQ ID NO: 2358746 - protein, 5 aa, Entamoeba dispar
EEEIE

SEQ ID NO: 2358747 - protein, 8 aa, Entamoeba dispar
EEENTYGC

SEQ ID NO: 2358748 - protein, 8 aa, Entamoeba dispar
EEIQDAPN

SEQ ID NO: 2358749 - protein, 5 aa, Entamoeba dispar
EEKDI

SEQ ID NO: 2358750 - protein, 9 aa, Entamoeba dispar
EEKDYFKKK

SEQ ID NO: 2358751 - protein, 8 aa, Entamoeba dispar
EEKEGRLR

SEQ ID NO: 2358752 - protein, 11 aa, Entamoeba dispar
EELKNSNLEAS

SEQ ID NO: 2358753 - protein, 7 aa, Entamoeba dispar
EENREEV

SEQ ID NO: 2358754 - protein, 7 aa, Entamoeba dispar
EEPAGGR

SEQ ID NO: 2358755 - protein, 12 aa, Entamoeba dispar
EEQKENNQTTIR

SEQ ID NO: 2358756 - protein, 8 aa, Entamoeba dispar
EEQNGYGC

SEQ ID NO: 2358757 - protein, 6 aa, Entamoeba dispar
EETGSK

SEQ ID NO: 2358758 - protein, 6 aa, Entamoeba dispar
EEYGRS

SEQ ID NO: 2358759 - protein, 5 aa, Entamoeba dispar
EEYSA

SEQ ID NO: 2358760 - protein, 7 aa, Entamoeba dispar
EFEKENI

SEQ ID NO: 2358761 - protein, 8 aa, Entamoeba dispar
EFQTEAPE

SEQ ID NO: 2358762 - protein, 6 aa, Entamoeba dispar
EGCDKY

SEQ ID NO: 2358763 - protein, 7 aa, Entamoeba dispar
EGEEQAD

SEQ ID NO: 2358764 - protein, 6 aa, Entamoeba dispar
EGSANT

SEQ ID NO: 2358765 - protein, 17 aa, Entamoeba dispar
EGSINKITSTSSSDKYF

SEQ ID NO: 2358766 - protein, 5 aa, Entamoeba dispar
EIEDE

SEQ ID NO: 2358767 - protein, 7 aa, Entamoeba dispar
EIGEQNE

SEQ ID NO: 2358768 - protein, 5 aa, Entamoeba dispar
EIRTN

SEQ ID NO: 2358769 - protein, 9 aa, Entamoeba dispar
EITGTTTND

SEQ ID NO: 2358770 - protein, 9 aa, Entamoeba dispar
EKASEGRTT

SEQ ID NO: 2358771 - protein, 6 aa, Entamoeba dispar
EKENSI

SEQ ID NO: 2358772 - protein, 13 aa, Entamoeba dispar
EKGSNLSGGQRQR

SEQ ID NO: 2358773 - protein, 6 aa, Entamoeba dispar
EKINEW

SEQ ID NO: 2358774 - protein, 4 aa, Entamoeba dispar
EKNI

SEQ ID NO: 2358775 - protein, 4 aa, Entamoeba dispar
EKSI

SEQ ID NO: 2358776 - protein, 15 aa, Entamoeba dispar
EKSIGIPMKGSPEDN

SEQ ID NO: 2358777 - protein, 4 aa, Entamoeba dispar
ELEG

SEQ ID NO: 2358778 - protein, 10 aa, Entamoeba dispar
ELKKDPSQMP

SEQ ID NO: 2358779 - protein, 10 aa, Entamoeba dispar
ELRNSNLEAS

SEQ ID NO: 2358780 - protein, 5 aa, Entamoeba dispar
ENIPE

SEQ ID NO: 2358781 - protein, 20 aa, Entamoeba dispar
ENKEQNQNSFNETYLSSVHI

SEQ ID NO: 2358782 - protein, 14 aa, Entamoeba dispar
ENLDPTKQASDEEM

SEQ ID NO: 2358783 - protein, 9 aa, Entamoeba dispar
ENPAAKRTK

SEQ ID NO: 2358784 - protein, 12 aa, Entamoeba dispar
ENPFEDEMTPES

SEQ ID NO: 2358785 - protein, 36 aa, Entamoeba dispar
ENQHKSTNSSFSNTSSVSSQTHSSGSSNEENKKELQ

SEQ ID NO: 2358786 - protein, 8 aa, Entamoeba dispar
EPFSSPDF

SEQ ID NO: 2358787 - protein, 8 aa, Entamoeba dispar
EPKTPMHN

SEQ ID NO: 2358788 - protein, 15 aa, Entamoeba dispar
ESACPYAEENEGQWE

SEQ ID NO: 2358789 - protein, 7 aa, Entamoeba dispar
ESADFSK

SEQ ID NO: 2358790 - protein, 5 aa, Entamoeba dispar
ESEQL

SEQ ID NO: 2358791 - protein, 15 aa, Entamoeba dispar
ESIKPKEVKKEETIK

SEQ ID NO: 2358792 - protein, 16 aa, Entamoeba dispar
ESINQNKNTPTPLQEN

SEQ ID NO: 2358793 - protein, 5 aa, Entamoeba dispar
ESIQP

SEQ ID NO: 2358794 - protein, 4 aa, Entamoeba dispar
ESSN

SEQ ID NO: 2358795 - protein, 5 aa, Entamoeba dispar
ESSQQ

SEQ ID NO: 2358796 - protein, 11 aa, Entamoeba dispar
ESSTCVSCSSG

SEQ ID NO: 2358797 - protein, 5 aa, Entamoeba dispar
ESTNQ

SEQ ID NO: 2358798 - protein, 5 aa, Entamoeba dispar
ESVSC

SEQ ID NO: 2358799 - protein, 5 aa, Entamoeba dispar
ETCYG

SEQ ID NO: 2358800 - protein, 10 aa, Entamoeba dispar
ETGNGKSSLG

SEQ ID NO: 2358801 - protein, 10 aa, Entamoeba dispar
ETGTGKSSLG

SEQ ID NO: 2358802 - protein, 4 aa, Entamoeba dispar
ETKE

SEQ ID NO: 2358803 - protein, 20 aa, Entamoeba dispar
ETPKEIKQLPQEKEEQDNVE

SEQ ID NO: 2358804 - protein, 4 aa, Entamoeba dispar
ETQI

SEQ ID NO: 2358805 - protein, 6 aa, Entamoeba dispar
ETVADT

SEQ ID NO: 2358806 - protein, 9 aa, Entamoeba dispar
EVTKGLKEW

SEQ ID NO: 2358807 - protein, 5 aa, Entamoeba dispar
EYGSL

SEQ ID NO: 2358808 - protein, 7 aa, Entamoeba dispar
FEEETKK

SEQ ID NO: 2358809 - protein, 5 aa, Entamoeba dispar
FGDPN

SEQ ID NO: 2358810 - protein, 4 aa, Entamoeba dispar
FGTS

SEQ ID NO: 2358811 - protein, 6 aa, Entamoeba dispar
FIESSN

SEQ ID NO: 2358812 - protein, 7 aa, Entamoeba dispar
FKTSEGI

SEQ ID NO: 2358813 - protein, 4 aa, Entamoeba dispar
FNGS

SEQ ID NO: 2358814 - protein, 10 aa, Entamoeba dispar
FNQGKNSVDE

SEQ ID NO: 2358815 - protein, 5 aa, Entamoeba dispar
FPDGE

SEQ ID NO: 2358816 - protein, 5 aa, Entamoeba dispar
FPETK

SEQ ID NO: 2358817 - protein, 8 aa, Entamoeba dispar
FPSPDAMY

SEQ ID NO: 2358818 - protein, 5 aa, Entamoeba dispar
FPTGD

SEQ ID NO: 2358819 - protein, 7 aa, Entamoeba dispar
FRDGESS

SEQ ID NO: 2358820 - protein, 10 aa, Entamoeba dispar
FREEEEDKEI

SEQ ID NO: 2358821 - protein, 7 aa, Entamoeba dispar
FSNEERE

SEQ ID NO: 2358822 - protein, 11 aa, Entamoeba dispar
FSRTTSTTKKS

SEQ ID NO: 2358823 - protein, 5 aa, Entamoeba dispar
FSSET

SEQ ID NO: 2358824 - protein, 5 aa, Entamoeba dispar
FSTTT

SEQ ID NO: 2358825 - protein, 4 aa, Entamoeba dispar
FTEE

SEQ ID NO: 2358826 - protein, 11 aa, Entamoeba dispar
FTLTDNNPSTW

SEQ ID NO: 2358827 - protein, 15 aa, Entamoeba dispar
GANITGNCKGDKPLV

SEQ ID NO: 2358828 - protein, 4 aa, Entamoeba dispar
GAQD

SEQ ID NO: 2358829 - protein, 6 aa, Entamoeba dispar
GATDIR

SEQ ID NO: 2358830 - protein, 24 aa, Entamoeba dispar
GATTNKTKNQEDEGPKEANTIQTA

SEQ ID NO: 2358831 - protein, 6 aa, Entamoeba dispar
GDPDDE

SEQ ID NO: 2358832 - protein, 14 aa, Entamoeba dispar
GDRGAQISGGQKQR

SEQ ID NO: 2358833 - protein, 7 aa, Entamoeba dispar
GECGNIT

SEQ ID NO: 2358834 - protein, 8 aa, Entamoeba dispar
GEQLRGVN

SEQ ID NO: 2358835 - protein, 6 aa, Entamoeba dispar
GETSKC

SEQ ID NO: 2358836 - protein, 5 aa, Entamoeba dispar
GFNSD

SEQ ID NO: 2358837 - protein, 4 aa, Entamoeba dispar
GFPT

SEQ ID NO: 2358838 - protein, 4 aa, Entamoeba dispar
GGLS

SEQ ID NO: 2358839 - protein, 16 aa, Entamoeba dispar
GGSRSQWSCDKEKESI

SEQ ID NO: 2358840 - protein, 4 aa, Entamoeba dispar
GGST

SEQ ID NO: 2358841 - protein, 11 aa, Entamoeba dispar
GGSVSDYSKQK

SEQ ID NO: 2358842 - protein, 5 aa, Entamoeba dispar
GGVDN

SEQ ID NO: 2358843 - protein, 5 aa, Entamoeba dispar
GGWGD

SEQ ID NO: 2358844 - protein, 7 aa, Entamoeba dispar
GIGTPAY

SEQ ID NO: 2358845 - protein, 5 aa, Entamoeba dispar
GISST

SEQ ID NO: 2358846 - protein, 7 aa, Entamoeba dispar
GKSNEQF

SEQ ID NO: 2358847 - protein, 8 aa, Entamoeba dispar
GKSYDDQF

SEQ ID NO: 2358848 - protein, 14 aa, Entamoeba dispar
GLDRDKTGCGKNNY

SEQ ID NO: 2358849 - protein, 5 aa, Entamoeba dispar
GLTED

SEQ ID NO: 2358850 - protein, 15 aa, Entamoeba dispar
GLTEEGNHGGSTLEE

SEQ ID NO: 2358851 - protein, 6 aa, Entamoeba dispar
GNDNNY

SEQ ID NO: 2358852 - protein, 4 aa, Entamoeba dispar
GNET

SEQ ID NO: 2358853 - protein, 5 aa, Entamoeba dispar
GNGVC

SEQ ID NO: 2358854 - protein, 4 aa, Entamoeba dispar
GNHD

SEQ ID NO: 2358855 - protein, 6 aa, Entamoeba dispar
GNKTEG

SEQ ID NO: 2358856 - protein, 6 aa, Entamoeba dispar
GPGTMA

SEQ ID NO: 2358857 - protein, 6 aa, Entamoeba dispar
GPYEPT

SEQ ID NO: 2358858 - protein, 24 aa, Entamoeba dispar
GQKSQSEEPQPDSSCKITTGSTDA

SEQ ID NO: 2358859 - protein, 15 aa, Entamoeba dispar
GQRGAQISGGQKQRI

SEQ ID NO: 2358860 - protein, 7 aa, Entamoeba dispar
GRKGNLR

SEQ ID NO: 2358861 - protein, 5 aa, Entamoeba dispar
GRPRP

SEQ ID NO: 2358862 - protein, 4 aa, Entamoeba dispar
GSVT

SEQ ID NO: 2358863 - protein, 7 aa, Entamoeba dispar
GTIRPGD

SEQ ID NO: 2358864 - protein, 6 aa, Entamoeba dispar
GTISGD

SEQ ID NO: 2358865 - protein, 6 aa, Entamoeba dispar
GTKEGF

SEQ ID NO: 2358866 - protein, 4 aa, Entamoeba dispar
GTQL

SEQ ID NO: 2358867 - protein, 5 aa, Entamoeba dispar
GTQTA

SEQ ID NO: 2358868 - protein, 8 aa, Entamoeba dispar
GTSGVGKT

SEQ ID NO: 2358869 - protein, 10 aa, Entamoeba dispar
GTSKDKNYTY

SEQ ID NO: 2358870 - protein, 14 aa, Entamoeba dispar
GTSTSFEGKEYSMN

SEQ ID NO: 2358871 - protein, 5 aa, Entamoeba dispar
GVGGT

SEQ ID NO: 2358872 - protein, 5 aa, Entamoeba dispar
GVGTP

SEQ ID NO: 2358873 - protein, 4 aa, Entamoeba dispar
GVSR

SEQ ID NO: 2358874 - protein, 9 aa, Entamoeba dispar
GVSTDISNY

SEQ ID NO: 2358875 - protein, 4 aa, Entamoeba dispar
GVTR

SEQ ID NO: 2358876 - protein, 9 aa, Entamoeba dispar
GYGLKEDKT

SEQ ID NO: 2358877 - protein, 5 aa, Entamoeba dispar
GYSSQ

SEQ ID NO: 2358878 - protein, 6 aa, Entamoeba dispar
GYYASN

SEQ ID NO: 2358879 - protein, 6 aa, Entamoeba dispar
GYYRDG

SEQ ID NO: 2358880 - protein, 5 aa, Entamoeba dispar
GYYRN

SEQ ID NO: 2358881 - protein, 8 aa, Entamoeba dispar
HDEESEYK

SEQ ID NO: 2358882 - protein, 8 aa, Entamoeba dispar
HDTSDPQD

SEQ ID NO: 2358883 - protein, 14 aa, Entamoeba dispar
HGGYECGDKGEWST

SEQ ID NO: 2358884 - protein, 9 aa, Entamoeba dispar
HGYQQTCEK

SEQ ID NO: 2358885 - protein, 30 aa, Entamoeba dispar
HKDQEKTPLVENEQQPINDYKNNQSPNDLI

SEQ ID NO: 2358886 - protein, 8 aa, Entamoeba dispar
HKVSQPSK

SEQ ID NO: 2358887 - protein, 12 aa, Entamoeba dispar
HKVSQPSTENWE

SEQ ID NO: 2358888 - protein, 15 aa, Entamoeba dispar
HNIKPGEVDFSQLTY

SEQ ID NO: 2358889 - protein, 5 aa, Entamoeba dispar
HNIPP

SEQ ID NO: 2358890 - protein, 16 aa, Entamoeba dispar
HPDKSKEEDAAEKFQK

SEQ ID NO: 2358891 - protein, 4 aa, Entamoeba dispar
HPHP

SEQ ID NO: 2358892 - protein, 9 aa, Entamoeba dispar
HQEPTSSVT

SEQ ID NO: 2358893 - protein, 5 aa, Entamoeba dispar
HQPVP

SEQ ID NO: 2358894 - protein, 6 aa, Entamoeba dispar
HRDSSS

SEQ ID NO: 2358895 - protein, 9 aa, Entamoeba dispar
HSNEKEDGF

SEQ ID NO: 2358896 - protein, 8 aa, Entamoeba dispar
HSTDNPDV

SEQ ID NO: 2358897 - protein, 20 aa, Entamoeba dispar
HTFDKKTNTNLAGKNTGKLS

SEQ ID NO: 2358898 - protein, 10 aa, Entamoeba dispar
HTRCSTSCGN

SEQ ID NO: 2358899 - protein, 6 aa, Entamoeba dispar
IAIEGP

SEQ ID NO: 2358900 - protein, 14 aa, Entamoeba dispar
IDGSSSSSSEESFQ

SEQ ID NO: 2358901 - protein, 4 aa, Entamoeba dispar
IDKD

SEQ ID NO: 2358902 - protein, 5 aa, Entamoeba dispar
IDKRN

SEQ ID NO: 2358903 - protein, 9 aa, Entamoeba dispar
IENKRNDKQ

SEQ ID NO: 2358904 - protein, 9 aa, Entamoeba dispar
IETRGSSIE

SEQ ID NO: 2358905 - protein, 9 aa, Entamoeba dispar
IGDGGNDVS

SEQ ID NO: 2358906 - protein, 17 aa, Entamoeba dispar
IHEGSKSCKKVKVDAQA

SEQ ID NO: 2358907 - protein, 12 aa, Entamoeba dispar
IKDQNGKCNNNI

SEQ ID NO: 2358908 - protein, 10 aa, Entamoeba dispar
IKEETKKIVE

SEQ ID NO: 2358909 - protein, 20 aa, Entamoeba dispar
IKENGECKEIDNKCNKSERN

SEQ ID NO: 2358910 - protein, 9 aa, Entamoeba dispar
IKGDKNKEV

SEQ ID NO: 2358911 - protein, 26 aa, Entamoeba dispar
IKGETQISTRLDPDEIKEENKIGEGT

SEQ ID NO: 2358912 - protein, 7 aa, Entamoeba dispar
IKKDNPD

SEQ ID NO: 2358913 - protein, 14 aa, Entamoeba dispar
IKKNEDITETLKPI

SEQ ID NO: 2358914 - protein, 9 aa, Entamoeba dispar
IKKTIKDDA

SEQ ID NO: 2358915 - protein, 6 aa, Entamoeba dispar
IKPSIS

SEQ ID NO: 2358916 - protein, 8 aa, Entamoeba dispar
IKSKDNKY

SEQ ID NO: 2358917 - protein, 9 aa, Entamoeba dispar
IKSNTSEYC

SEQ ID NO: 2358918 - protein, 19 aa, Entamoeba dispar
IKSSTTCDVPSNSISVSNS

SEQ ID NO: 2358919 - protein, 11 aa, Entamoeba dispar
ILDNDNNLPEY

SEQ ID NO: 2358920 - protein, 4 aa, Entamoeba dispar
INDE

SEQ ID NO: 2358921 - protein, 8 aa, Entamoeba dispar
INDKSDIN

SEQ ID NO: 2358922 - protein, 16 aa, Entamoeba dispar
INEESNEENEKEEEIG

SEQ ID NO: 2358923 - protein, 10 aa, Entamoeba dispar
INEFTSTTKL

SEQ ID NO: 2358924 - protein, 4 aa, Entamoeba dispar
INFT

SEQ ID NO: 2358925 - protein, 7 aa, Entamoeba dispar
INGENKL

SEQ ID NO: 2358926 - protein, 6 aa, Entamoeba dispar
INGNDQ

SEQ ID NO: 2358927 - protein, 11 aa, Entamoeba dispar
INGNSSSITPI

SEQ ID NO: 2358928 - protein, 7 aa, Entamoeba dispar
INKPTDI

SEQ ID NO: 2358929 - protein, 7 aa, Entamoeba dispar
INKSDLE

SEQ ID NO: 2358930 - protein, 10 aa, Entamoeba dispar
INNDKSEKKT

SEQ ID NO: 2358931 - protein, 21 aa, Entamoeba dispar
INNNSANLNIGDDVGGKTMTT

SEQ ID NO: 2358932 - protein, 13 aa, Entamoeba dispar
INQPEGTSTTDPT

SEQ ID NO: 2358933 - protein, 4 aa, Entamoeba dispar
INVN

SEQ ID NO: 2358934 - protein, 9 aa, Entamoeba dispar
INYPKEEVQ

SEQ ID NO: 2358935 - protein, 4 aa, Entamoeba dispar
IPQT

SEQ ID NO: 2358936 - protein, 5 aa, Entamoeba dispar
IPTDL

SEQ ID NO: 2358937 - protein, 4 aa, Entamoeba dispar
IPTT

SEQ ID NO: 2358938 - protein, 4 aa, Entamoeba dispar
IQNA

SEQ ID NO: 2358939 - protein, 5 aa, Entamoeba dispar
IQQKT

SEQ ID NO: 2358940 - protein, 6 aa, Entamoeba dispar
IRSSES

SEQ ID NO: 2358941 - protein, 4 aa, Entamoeba dispar
ISDD

SEQ ID NO: 2358942 - protein, 9 aa, Entamoeba dispar
ISEEPDPGL

SEQ ID NO: 2358943 - protein, 4 aa, Entamoeba dispar
ISEY

SEQ ID NO: 2358944 - protein, 6 aa, Entamoeba dispar
ISNEEI

SEQ ID NO: 2358945 - protein, 10 aa, Entamoeba dispar
ISPPGTYLGS

SEQ ID NO: 2358946 - protein, 4 aa, Entamoeba dispar
ISSI

SEQ ID NO: 2358947 - protein, 16 aa, Entamoeba dispar
ISSNKISRKEKGNSYQ

SEQ ID NO: 2358948 - protein, 5 aa, Entamoeba dispar
ITADG

SEQ ID NO: 2358949 - protein, 14 aa, Entamoeba dispar
ITECPKDPCGTNEA

SEQ ID NO: 2358950 - protein, 10 aa, Entamoeba dispar
ITTGKRPKII

SEQ ID NO: 2358951 - protein, 4 aa, Entamoeba dispar
ITTS

SEQ ID NO: 2358952 - protein, 6 aa, Entamoeba dispar
ITYSSQ

SEQ ID NO: 2358953 - protein, 8 aa, Entamoeba dispar
KADEKNGI

SEQ ID NO: 2358954 - protein, 25 aa, Entamoeba dispar
KAETELSTRLDPDELKEEKKIGEGS

SEQ ID NO: 2358955 - protein, 7 aa, Entamoeba dispar
KAFPSTA

SEQ ID NO: 2358956 - protein, 6 aa, Entamoeba dispar
KAPTSL

SEQ ID NO: 2358957 - protein, 5 aa, Entamoeba dispar
KASAY

SEQ ID NO: 2358958 - protein, 6 aa, Entamoeba dispar
KCDKEI

SEQ ID NO: 2358959 - protein, 25 aa, Entamoeba dispar
KCDKEINKEHGHGGYECGDKGEWST

SEQ ID NO: 2358960 - protein, 8 aa, Entamoeba dispar
KCESLEYS

SEQ ID NO: 2358961 - protein, 12 aa, Entamoeba dispar
KCVNSKDSCYEC

SEQ ID NO: 2358962 - protein, 6 aa, Entamoeba dispar
KDETKI

SEQ ID NO: 2358963 - protein, 12 aa, Entamoeba dispar
KDKYYDGTSCVN

SEQ ID NO: 2358964 - protein, 7 aa, Entamoeba dispar
KDPYNSI

SEQ ID NO: 2358965 - protein, 15 aa, Entamoeba dispar
KDQNGKCNNKNNIQY

SEQ ID NO: 2358966 - protein, 11 aa, Entamoeba dispar
KDQNGKCNNNI

SEQ ID NO: 2358967 - protein, 4 aa, Entamoeba dispar
KDRS

SEQ ID NO: 2358968 - protein, 10 aa, Entamoeba dispar
KECDTTTTEN

SEQ ID NO: 2358969 - protein, 6 aa, Entamoeba dispar
KEGIRR

SEQ ID NO: 2358970 - protein, 4 aa, Entamoeba dispar
KEGS

SEQ ID NO: 2358971 - protein, 7 aa, Entamoeba dispar
KEKATSL

SEQ ID NO: 2358972 - protein, 12 aa, Entamoeba dispar
KEKEKHPKSPSL

SEQ ID NO: 2358973 - protein, 19 aa, Entamoeba dispar
KEKGECKEIDNKCNKSERN

SEQ ID NO: 2358974 - protein, 6 aa, Entamoeba dispar
KENEIK

SEQ ID NO: 2358975 - protein, 4 aa, Entamoeba dispar
KENI

SEQ ID NO: 2358976 - protein, 8 aa, Entamoeba dispar
KENKDVYN

SEQ ID NO: 2358977 - protein, 7 aa, Entamoeba dispar
KENPPDT

SEQ ID NO: 2358978 - protein, 6 aa, Entamoeba dispar
KENRVG

SEQ ID NO: 2358979 - protein, 6 aa, Entamoeba dispar
KEQQYL

SEQ ID NO: 2358980 - protein, 5 aa, Entamoeba dispar
KERVN

SEQ ID NO: 2358981 - protein, 9 aa, Entamoeba dispar
KESSFKEQK

SEQ ID NO: 2358982 - protein, 7 aa, Entamoeba dispar
KETTVGC

SEQ ID NO: 2358983 - protein, 7 aa, Entamoeba dispar
KFEGDEE

SEQ ID NO: 2358984 - protein, 10 aa, Entamoeba dispar
KGCPEPGSHH

SEQ ID NO: 2358985 - protein, 5 aa, Entamoeba dispar
KGCTS

SEQ ID NO: 2358986 - protein, 7 aa, Entamoeba dispar
KGCVSGT

SEQ ID NO: 2358987 - protein, 4 aa, Entamoeba dispar
KGEC

SEQ ID NO: 2358988 - protein, 11 aa, Entamoeba dispar
KGEIKELTEEI

SEQ ID NO: 2358989 - protein, 7 aa, Entamoeba dispar
KGFEELN

SEQ ID NO: 2358990 - protein, 4 aa, Entamoeba dispar
KGGK

SEQ ID NO: 2358991 - protein, 8 aa, Entamoeba dispar
KGIGSPKY

SEQ ID NO: 2358992 - protein, 30 aa, Entamoeba dispar
KIEKQKAKLEKKKAKKTESLTKKGLSPEEI

SEQ ID NO: 2358993 - protein, 5 aa, Entamoeba dispar
KIGNE

SEQ ID NO: 2358994 - protein, 11 aa, Entamoeba dispar
KINTKTTSTYD

SEQ ID NO: 2358995 - protein, 14 aa, Entamoeba dispar
KIQTANTYRSSPNE

SEQ ID NO: 2358996 - protein, 9 aa, Entamoeba dispar
KITKNGEEV

SEQ ID NO: 2358997 - protein, 5 aa, Entamoeba dispar
KITTN

SEQ ID NO: 2358998 - protein, 8 aa, Entamoeba dispar
KKDPQSEV

SEQ ID NO: 2358999 - protein, 14 aa, Entamoeba dispar
KKEYTGQPEGTPYY

SEQ ID NO: 2359000 - protein, 6 aa, Entamoeba dispar
KKGQTV

SEQ ID NO: 2359001 - protein, 5 aa, Entamoeba dispar
KKIKE

SEQ ID NO: 2359002 - protein, 6 aa, Entamoeba dispar
KKIQEE

SEQ ID NO: 2359003 - protein, 4 aa, Entamoeba dispar
KKLE

SEQ ID NO: 2359004 - protein, 4 aa, Entamoeba dispar
KKLP

SEQ ID NO: 2359005 - protein, 7 aa, Entamoeba dispar
KKNGEKY

SEQ ID NO: 2359006 - protein, 8 aa, Entamoeba dispar
KKNKISGS

SEQ ID NO: 2359007 - protein, 7 aa, Entamoeba dispar
KKPYNPI

SEQ ID NO: 2359008 - protein, 7 aa, Entamoeba dispar
KKSGFSL

SEQ ID NO: 2359009 - protein, 8 aa, Entamoeba dispar
KLDTSKYS

SEQ ID NO: 2359010 - protein, 15 aa, Entamoeba dispar
KNEEQKKKRRTSLPN

SEQ ID NO: 2359011 - protein, 9 aa, Entamoeba dispar
KNGGGDYDY

SEQ ID NO: 2359012 - protein, 8 aa, Entamoeba dispar
KNKRKPTE

SEQ ID NO: 2359013 - protein, 7 aa, Entamoeba dispar
KNNIGKT

SEQ ID NO: 2359014 - protein, 5 aa, Entamoeba dispar
KNNTL

SEQ ID NO: 2359015 - protein, 8 aa, Entamoeba dispar
KNPRNPTD

SEQ ID NO: 2359016 - protein, 4 aa, Entamoeba dispar
KNQV

SEQ ID NO: 2359017 - protein, 7 aa, Entamoeba dispar
KNSGGSV

SEQ ID NO: 2359018 - protein, 6 aa, Entamoeba dispar
KNTPPT

SEQ ID NO: 2359019 - protein, 6 aa, Entamoeba dispar
KPENKT

SEQ ID NO: 2359020 - protein, 6 aa, Entamoeba dispar
KPGEVI

SEQ ID NO: 2359021 - protein, 7 aa, Entamoeba dispar
KPRKPTE

SEQ ID NO: 2359022 - protein, 4 aa, Entamoeba dispar
KPSN

SEQ ID NO: 2359023 - protein, 8 aa, Entamoeba dispar
KQCHTPRR

SEQ ID NO: 2359024 - protein, 8 aa, Entamoeba dispar
KQDDLENE

SEQ ID NO: 2359025 - protein, 6 aa, Entamoeba dispar
KQECQI

SEQ ID NO: 2359026 - protein, 7 aa, Entamoeba dispar
KQECQYD

SEQ ID NO: 2359027 - protein, 10 aa, Entamoeba dispar
KQFSTQTERD

SEQ ID NO: 2359028 - protein, 7 aa, Entamoeba dispar
KQGKKGC

SEQ ID NO: 2359029 - protein, 17 aa, Entamoeba dispar
KQQKDIQETQEDTNKIY

SEQ ID NO: 2359030 - protein, 5 aa, Entamoeba dispar
KQTST

SEQ ID NO: 2359031 - protein, 4 aa, Entamoeba dispar
KQTT

SEQ ID NO: 2359032 - protein, 7 aa, Entamoeba dispar
KQVGTDC

SEQ ID NO: 2359033 - protein, 6 aa, Entamoeba dispar
KRNENN

SEQ ID NO: 2359034 - protein, 4 aa, Entamoeba dispar
KRRN

SEQ ID NO: 2359035 - protein, 25 aa, Entamoeba dispar
KRSNSSSGASSDNEGSIQDLSSTPE

SEQ ID NO: 2359036 - protein, 9 aa, Entamoeba dispar
KRTNTEIPK

SEQ ID NO: 2359037 - protein, 7 aa, Entamoeba dispar
KSEYDLP

SEQ ID NO: 2359038 - protein, 7 aa, Entamoeba dispar
KSIQTTR

SEQ ID NO: 2359039 - protein, 7 aa, Entamoeba dispar
KSKNELK

SEQ ID NO: 2359040 - protein, 7 aa, Entamoeba dispar
KSLEGKT

SEQ ID NO: 2359041 - protein, 9 aa, Entamoeba dispar
KSNNKEKSY

SEQ ID NO: 2359042 - protein, 4 aa, Entamoeba dispar
KSPN

SEQ ID NO: 2359043 - protein, 36 aa, Entamoeba dispar
KSQKQNNEEEIPKSLSTSSSPENKDKESIPNKSMTE

SEQ ID NO: 2359044 - protein, 10 aa, Entamoeba dispar
KSTPPAKRSV

SEQ ID NO: 2359045 - protein, 7 aa, Entamoeba dispar
KSTVGGI

SEQ ID NO: 2359046 - protein, 7 aa, Entamoeba dispar
KSYEETV

SEQ ID NO: 2359047 - protein, 4 aa, Entamoeba dispar
KTAT

SEQ ID NO: 2359048 - protein, 7 aa, Entamoeba dispar
KTCSYTN

SEQ ID NO: 2359049 - protein, 15 aa, Entamoeba dispar
KTEEAISEFEEETKK

SEQ ID NO: 2359050 - protein, 4 aa, Entamoeba dispar
KTFP

SEQ ID NO: 2359051 - protein, 9 aa, Entamoeba dispar
KTGTLTKNE

SEQ ID NO: 2359052 - protein, 8 aa, Entamoeba dispar
KTINGEDP

SEQ ID NO: 2359053 - protein, 21 aa, Entamoeba dispar
KTKCNPKNKRLVKRDSRCDKE

SEQ ID NO: 2359054 - protein, 7 aa, Entamoeba dispar
KTKIQTN

SEQ ID NO: 2359055 - protein, 9 aa, Entamoeba dispar
KTKRSDYNK

SEQ ID NO: 2359056 - protein, 8 aa, Entamoeba dispar
KTKTPNGC

SEQ ID NO: 2359057 - protein, 17 aa, Entamoeba dispar
KTNDEQEENYNGLLIND

SEQ ID NO: 2359058 - protein, 6 aa, Entamoeba dispar
KTNKQS

SEQ ID NO: 2359059 - protein, 7 aa, Entamoeba dispar
KTNNDGT

SEQ ID NO: 2359060 - protein, 6 aa, Entamoeba dispar
KTPEEN

SEQ ID NO: 2359061 - protein, 7 aa, Entamoeba dispar
KTSKEVV

SEQ ID NO: 2359062 - protein, 12 aa, Entamoeba dispar
KTSRGCESCEEG

SEQ ID NO: 2359063 - protein, 6 aa, Entamoeba dispar
KVSQPS

SEQ ID NO: 2359064 - protein, 6 aa, Entamoeba dispar
KYGSSG

SEQ ID NO: 2359065 - protein, 6 aa, Entamoeba dispar
KYIGGA

SEQ ID NO: 2359066 - protein, 5 aa, Entamoeba dispar
KYINN

SEQ ID NO: 2359067 - protein, 8 aa, Entamoeba dispar
KYQREEEE

SEQ ID NO: 2359068 - protein, 23 aa, Entamoeba dispar
KYTLNNGKCSNKEKNQNGKNEEI

SEQ ID NO: 2359069 - protein, 35 aa, Entamoeba dispar
LAKGEASIAETLKAEDEKKKKQDDESSESTEKPKE

SEQ ID NO: 2359070 - protein, 23 aa, Entamoeba dispar
LCGNGKKDEGEECEKVSGNNYID

SEQ ID NO: 2359071 - protein, 5 aa, Entamoeba dispar
LDQGN

SEQ ID NO: 2359072 - protein, 4 aa, Entamoeba dispar
LEAC

SEQ ID NO: 2359073 - protein, 25 aa, Entamoeba dispar
LEETNKTRTKENENNEYQPNCSPEN

SEQ ID NO: 2359074 - protein, 11 aa, Entamoeba dispar
LEKKKGESYLN

SEQ ID NO: 2359075 - protein, 4 aa, Entamoeba dispar
LENG

SEQ ID NO: 2359076 - protein, 4 aa, Entamoeba dispar
LEPN

SEQ ID NO: 2359077 - protein, 4 aa, Entamoeba dispar
LETL

SEQ ID NO: 2359078 - protein, 4 aa, Entamoeba dispar
LGGI

SEQ ID NO: 2359079 - protein, 11 aa, Entamoeba dispar
LGLPQGNREEF

SEQ ID NO: 2359080 - protein, 6 aa, Entamoeba dispar
LGNETY

SEQ ID NO: 2359081 - protein, 6 aa, Entamoeba dispar
LGQGTF

SEQ ID NO: 2359082 - protein, 8 aa, Entamoeba dispar
LISKNKSS

SEQ ID NO: 2359083 - protein, 8 aa, Entamoeba dispar
LKDGNEDD

SEQ ID NO: 2359084 - protein, 6 aa, Entamoeba dispar
LKEEEI

SEQ ID NO: 2359085 - protein, 4 aa, Entamoeba dispar
LKEW

SEQ ID NO: 2359086 - protein, 6 aa, Entamoeba dispar
LKKGDK

SEQ ID NO: 2359087 - protein, 6 aa, Entamoeba dispar
LKKRRN

SEQ ID NO: 2359088 - protein, 21 aa, Entamoeba dispar
LKNNPTLDITKGDPIIYNLLN

SEQ ID NO: 2359089 - protein, 10 aa, Entamoeba dispar
LKSEKDMKKK

SEQ ID NO: 2359090 - protein, 33 aa, Entamoeba dispar
LKTNNTQSQRKKNYKKNYKKNKIHNQVDNNKQT

SEQ ID NO: 2359091 - protein, 33 aa, Entamoeba dispar
LKTPKKKHDIKKDDKLQELGYNPNRINTNSPLD

SEQ ID NO: 2359092 - protein, 8 aa, Entamoeba dispar
LNKTQEEI

SEQ ID NO: 2359093 - protein, 5 aa, Entamoeba dispar
LNNKK

SEQ ID NO: 2359094 - protein, 5 aa, Entamoeba dispar
LNPGE

SEQ ID NO: 2359095 - protein, 13 aa, Entamoeba dispar
LNSETSSCEPCPD

SEQ ID NO: 2359096 - protein, 4 aa, Entamoeba dispar
LPDN

SEQ ID NO: 2359097 - protein, 11 aa, Entamoeba dispar
LPPCPNSECND

SEQ ID NO: 2359098 - protein, 6 aa, Entamoeba dispar
LPPSDF

SEQ ID NO: 2359099 - protein, 5 aa, Entamoeba dispar
LQEEN

SEQ ID NO: 2359100 - protein, 5 aa, Entamoeba dispar
LRASD

SEQ ID NO: 2359101 - protein, 7 aa, Entamoeba dispar
LREPRRG

SEQ ID NO: 2359102 - protein, 6 aa, Entamoeba dispar
LRPPDD

SEQ ID NO: 2359103 - protein, 13 aa, Entamoeba dispar
LSDNRLKCEEKSM

SEQ ID NO: 2359104 - protein, 6 aa, Entamoeba dispar
LSDPGS

SEQ ID NO: 2359105 - protein, 8 aa, Entamoeba dispar
LSDTPLTK

SEQ ID NO: 2359106 - protein, 12 aa, Entamoeba dispar
LSPSNNIPDIND

SEQ ID NO: 2359107 - protein, 10 aa, Entamoeba dispar
LSPSNNIPNI

SEQ ID NO: 2359108 - protein, 11 aa, Entamoeba dispar
LSQGIGTPTYM

SEQ ID NO: 2359109 - protein, 10 aa, Entamoeba dispar
LSQTNEGKCY

SEQ ID NO: 2359110 - protein, 10 aa, Entamoeba dispar
LSSDPTKLNG

SEQ ID NO: 2359111 - protein, 16 aa, Entamoeba dispar
LSTDSDGNTICSEQND

SEQ ID NO: 2359112 - protein, 9 aa, Entamoeba dispar
LTDSPNIQA

SEQ ID NO: 2359113 - protein, 8 aa, Entamoeba dispar
LTDTEDIP

SEQ ID NO: 2359114 - protein, 7 aa, Entamoeba dispar
LTSKETV

SEQ ID NO: 2359115 - protein, 10 aa, Entamoeba dispar
LVENDSPSHL

SEQ ID NO: 2359116 - protein, 4 aa, Entamoeba dispar
MKEN

SEQ ID NO: 2359117 - protein, 6 aa, Entamoeba dispar
MKKGES

SEQ ID NO: 2359118 - protein, 7 aa, Entamoeba dispar
MKNNGAV

SEQ ID NO: 2359119 - protein, 9 aa, Entamoeba dispar
MKNPRKPTD

SEQ ID NO: 2359120 - protein, 9 aa, Entamoeba dispar
MKNPRKPTE

SEQ ID NO: 2359121 - protein, 15 aa, Entamoeba dispar
MRSAGTNDITIFHIK

SEQ ID NO: 2359122 - protein, 5 aa, Entamoeba dispar
MSDNT

SEQ ID NO: 2359123 - protein, 4 aa, Entamoeba dispar
MSSM

SEQ ID NO: 2359124 - protein, 8 aa, Entamoeba dispar
NAGPPEPI

SEQ ID NO: 2359125 - protein, 9 aa, Entamoeba dispar
NASGIEEPG

SEQ ID NO: 2359126 - protein, 9 aa, Entamoeba dispar
NAYDGDERF

SEQ ID NO: 2359127 - protein, 7 aa, Entamoeba dispar
NCETTNR

SEQ ID NO: 2359128 - protein, 5 aa, Entamoeba dispar
NDGTC

SEQ ID NO: 2359129 - protein, 6 aa, Entamoeba dispar
NDQLQQ

SEQ ID NO: 2359130 - protein, 4 aa, Entamoeba dispar
NDTH

SEQ ID NO: 2359131 - protein, 17 aa, Entamoeba dispar
NDTVNPIAETDPTSPLA

SEQ ID NO: 2359132 - protein, 4 aa, Entamoeba dispar
NEIK

SEQ ID NO: 2359133 - protein, 5 aa, Entamoeba dispar
NENAK

SEQ ID NO: 2359134 - protein, 9 aa, Entamoeba dispar
NEQETQHEL

SEQ ID NO: 2359135 - protein, 5 aa, Entamoeba dispar
NESIP

SEQ ID NO: 2359136 - protein, 5 aa, Entamoeba dispar
NEYDR

SEQ ID NO: 2359137 - protein, 8 aa, Entamoeba dispar
NGDNFSLG

SEQ ID NO: 2359138 - protein, 5 aa, Entamoeba dispar
NGESL

SEQ ID NO: 2359139 - protein, 10 aa, Entamoeba dispar
NGGPLETVQN

SEQ ID NO: 2359140 - protein, 9 aa, Entamoeba dispar
NGNSPTKII

SEQ ID NO: 2359141 - protein, 6 aa, Entamoeba dispar
NGNSRK

SEQ ID NO: 2359142 - protein, 5 aa, Entamoeba dispar
NGTYS

SEQ ID NO: 2359143 - protein, 4 aa, Entamoeba dispar
NGWN

SEQ ID NO: 2359144 - protein, 24 aa, Entamoeba dispar
NGYTLNNKKCSNKEKNQNGKNEEI

SEQ ID NO: 2359145 - protein, 4 aa, Entamoeba dispar
NIGR

SEQ ID NO: 2359146 - protein, 5 aa, Entamoeba dispar
NIGTP

SEQ ID NO: 2359147 - protein, 7 aa, Entamoeba dispar
NIKTEIE

SEQ ID NO: 2359148 - protein, 4 aa, Entamoeba dispar
NIRQ

SEQ ID NO: 2359149 - protein, 6 aa, Entamoeba dispar
NKCSTA

SEQ ID NO: 2359150 - protein, 7 aa, Entamoeba dispar
NKECQIG

SEQ ID NO: 2359151 - protein, 7 aa, Entamoeba dispar
NKECQYN

SEQ ID NO: 2359152 - protein, 5 aa, Entamoeba dispar
NKEEI

SEQ ID NO: 2359153 - protein, 9 aa, Entamoeba dispar
NKEKYKQAI

SEQ ID NO: 2359154 - protein, 9 aa, Entamoeba dispar
NKESENAIE

SEQ ID NO: 2359155 - protein, 6 aa, Entamoeba dispar
NKGESR

SEQ ID NO: 2359156 - protein, 7 aa, Entamoeba dispar
NKGKNTI

SEQ ID NO: 2359157 - protein, 6 aa, Entamoeba dispar
NKINKQ

SEQ ID NO: 2359158 - protein, 19 aa, Entamoeba dispar
NKKRKLEEKYVEESKRSSI

SEQ ID NO: 2359159 - protein, 15 aa, Entamoeba dispar
NKLDDIDSNVTIADS

SEQ ID NO: 2359160 - protein, 13 aa, Entamoeba dispar
NKLTTAQKIKRGK

SEQ ID NO: 2359161 - protein, 4 aa, Entamoeba dispar
NKNE

SEQ ID NO: 2359162 - protein, 7 aa, Entamoeba dispar
NKQNGRC

SEQ ID NO: 2359163 - protein, 4 aa, Entamoeba dispar
NKRD

SEQ ID NO: 2359164 - protein, 7 aa, Entamoeba dispar
NKREKDA

SEQ ID NO: 2359165 - protein, 11 aa, Entamoeba dispar
NKSNEEDIKKA

SEQ ID NO: 2359166 - protein, 6 aa, Entamoeba dispar
NKTACN

SEQ ID NO: 2359167 - protein, 13 aa, Entamoeba dispar
NLDPTFQKSDEEM

SEQ ID NO: 2359168 - protein, 4 aa, Entamoeba dispar
NLNK

SEQ ID NO: 2359169 - protein, 6 aa, Entamoeba dispar
NNDAHA

SEQ ID NO: 2359170 - protein, 9 aa, Entamoeba dispar
NNITTSTND

SEQ ID NO: 2359171 - protein, 7 aa, Entamoeba dispar
NNLNQNG

SEQ ID NO: 2359172 - protein, 9 aa, Entamoeba dispar
NNNDNTKEG

SEQ ID NO: 2359173 - protein, 4 aa, Entamoeba dispar
NNNI

SEQ ID NO: 2359174 - protein, 8 aa, Entamoeba dispar
NNNNGNNN

SEQ ID NO: 2359175 - protein, 8 aa, Entamoeba dispar
NNNSPSIT

SEQ ID NO: 2359176 - protein, 7 aa, Entamoeba dispar
NNPINNK

SEQ ID NO: 2359177 - protein, 5 aa, Entamoeba dispar
NNQNQ

SEQ ID NO: 2359178 - protein, 5 aa, Entamoeba dispar
NNSEI

SEQ ID NO: 2359179 - protein, 33 aa, Entamoeba dispar
NNSFNNTEPSQPINYSEKSDELRNLQAKQDEQI

SEQ ID NO: 2359180 - protein, 7 aa, Entamoeba dispar
NNTNGNN

SEQ ID NO: 2359181 - protein, 6 aa, Entamoeba dispar
NPEEKG

SEQ ID NO: 2359182 - protein, 14 aa, Entamoeba dispar
NPERGTVKINGRNI

SEQ ID NO: 2359183 - protein, 4 aa, Entamoeba dispar
NPFK

SEQ ID NO: 2359184 - protein, 9 aa, Entamoeba dispar
NPPKHEEEI

SEQ ID NO: 2359185 - protein, 9 aa, Entamoeba dispar
NPPSHSTCQ

SEQ ID NO: 2359186 - protein, 9 aa, Entamoeba dispar
NPPTEEEIN

SEQ ID NO: 2359187 - protein, 7 aa, Entamoeba dispar
NPRKPTE

SEQ ID NO: 2359188 - protein, 4 aa, Entamoeba dispar
NPSL

SEQ ID NO: 2359189 - protein, 5 aa, Entamoeba dispar
NQEDI

SEQ ID NO: 2359190 - protein, 32 aa, Entamoeba dispar
NQEMGKKQQEKFDNDEDLEEDVVPEQNEVDKT

SEQ ID NO: 2359191 - protein, 7 aa, Entamoeba dispar
NQEYEKR

SEQ ID NO: 2359192 - protein, 10 aa, Entamoeba dispar
NQNNNDEKVQ

SEQ ID NO: 2359193 - protein, 7 aa, Entamoeba dispar
NQPSFGT

SEQ ID NO: 2359194 - protein, 7 aa, Entamoeba dispar
NQPSTSI

SEQ ID NO: 2359195 - protein, 5 aa, Entamoeba dispar
NRMDS

SEQ ID NO: 2359196 - protein, 4 aa, Entamoeba dispar
NRND

SEQ ID NO: 2359197 - protein, 12 aa, Entamoeba dispar
NRTLAQSVGGAV

SEQ ID NO: 2359198 - protein, 9 aa, Entamoeba dispar
NSASGQEDP

SEQ ID NO: 2359199 - protein, 9 aa, Entamoeba dispar
NSGTKTENY

SEQ ID NO: 2359200 - protein, 6 aa, Entamoeba dispar
NSISRK

SEQ ID NO: 2359201 - protein, 7 aa, Entamoeba dispar
NSKTSNQ

SEQ ID NO: 2359202 - protein, 7 aa, Entamoeba dispar
NSNPTTL

SEQ ID NO: 2359203 - protein, 5 aa, Entamoeba dispar
NSQCT

SEQ ID NO: 2359204 - protein, 8 aa, Entamoeba dispar
NSQPTYSN

SEQ ID NO: 2359205 - protein, 5 aa, Entamoeba dispar
NSSPN

SEQ ID NO: 2359206 - protein, 13 aa, Entamoeba dispar
NSSPSTSLIEEKG

SEQ ID NO: 2359207 - protein, 8 aa, Entamoeba dispar
NSSTSTPL

SEQ ID NO: 2359208 - protein, 7 aa, Entamoeba dispar
NSTTKYH

SEQ ID NO: 2359209 - protein, 7 aa, Entamoeba dispar
NTGVECE

SEQ ID NO: 2359210 - protein, 4 aa, Entamoeba dispar
NTNN

SEQ ID NO: 2359211 - protein, 4 aa, Entamoeba dispar
NTTT

SEQ ID NO: 2359212 - protein, 8 aa, Entamoeba dispar
NTTTETCT

SEQ ID NO: 2359213 - protein, 6 aa, Entamoeba dispar
NVTQQT

SEQ ID NO: 2359214 - protein, 10 aa, Entamoeba dispar
NYPKERSLSE

SEQ ID NO: 2359215 - protein, 5 aa, Entamoeba dispar
NYSKN

SEQ ID NO: 2359216 - protein, 4 aa, Entamoeba dispar
NYSR

SEQ ID NO: 2359217 - protein, 7 aa, Entamoeba dispar
PAGSQIS

SEQ ID NO: 2359218 - protein, 10 aa, Entamoeba dispar
PAQAAYERSG

SEQ ID NO: 2359219 - protein, 14 aa, Entamoeba dispar
PDPSRAKTTVNSNP

SEQ ID NO: 2359220 - protein, 8 aa, Entamoeba dispar
PDQQKNKF

SEQ ID NO: 2359221 - protein, 6 aa, Entamoeba dispar
PEPDKH

SEQ ID NO: 2359222 - protein, 5 aa, Entamoeba dispar
PERDP

SEQ ID NO: 2359223 - protein, 17 aa, Entamoeba dispar
PETCEEREQENNPKTFG

SEQ ID NO: 2359224 - protein, 4 aa, Entamoeba dispar
PFPK

SEQ ID NO: 2359225 - protein, 10 aa, Entamoeba dispar
PFPKTSYPHP

SEQ ID NO: 2359226 - protein, 9 aa, Entamoeba dispar
PGCNEGLKT

SEQ ID NO: 2359227 - protein, 15 aa, Entamoeba dispar
PGFNDSKGPESQREY

SEQ ID NO: 2359228 - protein, 7 aa, Entamoeba dispar
PGTGAWG

SEQ ID NO: 2359229 - protein, 12 aa, Entamoeba dispar
PHFPNYDNGTLK

SEQ ID NO: 2359230 - protein, 8 aa, Entamoeba dispar
PKKYKTKT

SEQ ID NO: 2359231 - protein, 5 aa, Entamoeba dispar
PLEKY

SEQ ID NO: 2359232 - protein, 13 aa, Entamoeba dispar
PLSSKQGRVESQN

SEQ ID NO: 2359233 - protein, 5 aa, Entamoeba dispar
PNGTL

SEQ ID NO: 2359234 - protein, 8 aa, Entamoeba dispar
PNNKSSLT

SEQ ID NO: 2359235 - protein, 7 aa, Entamoeba dispar
PNRDSDF

SEQ ID NO: 2359236 - protein, 5 aa, Entamoeba dispar
PNSLW

SEQ ID NO: 2359237 - protein, 4 aa, Entamoeba dispar
PPIG

SEQ ID NO: 2359238 - protein, 10 aa, Entamoeba dispar
PPTDDGTPSM

SEQ ID NO: 2359239 - protein, 9 aa, Entamoeba dispar
PPTNGYQSA

SEQ ID NO: 2359240 - protein, 4 aa, Entamoeba dispar
PSHR

SEQ ID NO: 2359241 - protein, 9 aa, Entamoeba dispar
PSLQESREF

SEQ ID NO: 2359242 - protein, 5 aa, Entamoeba dispar
PSNIN

SEQ ID NO: 2359243 - protein, 5 aa, Entamoeba dispar
PSYRY

SEQ ID NO: 2359244 - protein, 15 aa, Entamoeba dispar
PTEKPIQTATKLHNG

SEQ ID NO: 2359245 - protein, 5 aa, Entamoeba dispar
PTRKK

SEQ ID NO: 2359246 - protein, 8 aa, Entamoeba dispar
PTRPDNSV

SEQ ID NO: 2359247 - protein, 5 aa, Entamoeba dispar
PVDPA

SEQ ID NO: 2359248 - protein, 6 aa, Entamoeba dispar
PVGQET

SEQ ID NO: 2359249 - protein, 6 aa, Entamoeba dispar
PVNQET

SEQ ID NO: 2359250 - protein, 11 aa, Entamoeba dispar
QCTEYNQGYEI

SEQ ID NO: 2359251 - protein, 13 aa, Entamoeba dispar
QDVDEGLTQPTLP

SEQ ID NO: 2359252 - protein, 9 aa, Entamoeba dispar
QDVSSKEIK

SEQ ID NO: 2359253 - protein, 8 aa, Entamoeba dispar
QDYEDVQN

SEQ ID NO: 2359254 - protein, 5 aa, Entamoeba dispar
QENPY

SEQ ID NO: 2359255 - protein, 33 aa, Entamoeba dispar
QGEEVKQGIKPKLTPEEIKSRKEIGKRMKTKQG

SEQ ID NO: 2359256 - protein, 4 aa, Entamoeba dispar
QHDR

SEQ ID NO: 2359257 - protein, 12 aa, Entamoeba dispar
QIDKSENKMKEF

SEQ ID NO: 2359258 - protein, 12 aa, Entamoeba dispar
QIEENENKMKEF

SEQ ID NO: 2359259 - protein, 7 aa, Entamoeba dispar
QIENNKD

SEQ ID NO: 2359260 - protein, 5 aa, Entamoeba dispar
QIGQS

SEQ ID NO: 2359261 - protein, 5 aa, Entamoeba dispar
QINEQ

SEQ ID NO: 2359262 - protein, 4 aa, Entamoeba dispar
QKEL

SEQ ID NO: 2359263 - protein, 4 aa, Entamoeba dispar
QKGL

SEQ ID NO: 2359264 - protein, 8 aa, Entamoeba dispar
QKTTQKVE

SEQ ID NO: 2359265 - protein, 7 aa, Entamoeba dispar
QLDGETD

SEQ ID NO: 2359266 - protein, 6 aa, Entamoeba dispar
QLNEEK

SEQ ID NO: 2359267 - protein, 16 aa, Entamoeba dispar
QNNTNKLSTRIGSEYP

SEQ ID NO: 2359268 - protein, 4 aa, Entamoeba dispar
QNPY

SEQ ID NO: 2359269 - protein, 10 aa, Entamoeba dispar
QPTKVRPNSF

SEQ ID NO: 2359270 - protein, 9 aa, Entamoeba dispar
QQHQNASDY

SEQ ID NO: 2359271 - protein, 4 aa, Entamoeba dispar
QQQF

SEQ ID NO: 2359272 - protein, 10 aa, Entamoeba dispar
QRSDARVKEH

SEQ ID NO: 2359273 - protein, 9 aa, Entamoeba dispar
QSCSTRGTY

SEQ ID NO: 2359274 - protein, 11 aa, Entamoeba dispar
QTGLSEPSPGN

SEQ ID NO: 2359275 - protein, 8 aa, Entamoeba dispar
QTKPISTH

SEQ ID NO: 2359276 - protein, 13 aa, Entamoeba dispar
QTNSTSEYSNEIE

SEQ ID NO: 2359277 - protein, 14 aa, Entamoeba dispar
QVNSPSSSFSSPDY

SEQ ID NO: 2359278 - protein, 5 aa, Entamoeba dispar
QYDYK

SEQ ID NO: 2359279 - protein, 8 aa, Entamoeba dispar
RASEASKS

SEQ ID NO: 2359280 - protein, 10 aa, Entamoeba dispar
RDGETPTEEE

SEQ ID NO: 2359281 - protein, 12 aa, Entamoeba dispar
RDSHQDPNLSSG

SEQ ID NO: 2359282 - protein, 11 aa, Entamoeba dispar
REFSEKTGKYY

SEQ ID NO: 2359283 - protein, 8 aa, Entamoeba dispar
REKKDKEL

SEQ ID NO: 2359284 - protein, 10 aa, Entamoeba dispar
RENEQIGAET

SEQ ID NO: 2359285 - protein, 12 aa, Entamoeba dispar
RGKGGKKSVTAG

SEQ ID NO: 2359286 - protein, 10 aa, Entamoeba dispar
RGKGGSKGVI

SEQ ID NO: 2359287 - protein, 20 aa, Entamoeba dispar
RIENTINKEDKSEENTSELG

SEQ ID NO: 2359288 - protein, 6 aa, Entamoeba dispar
RINNGK

SEQ ID NO: 2359289 - protein, 7 aa, Entamoeba dispar
RKEEELR

SEQ ID NO: 2359290 - protein, 7 aa, Entamoeba dispar
RKEKEDY

SEQ ID NO: 2359291 - protein, 7 aa, Entamoeba dispar
RKEYELN

SEQ ID NO: 2359292 - protein, 10 aa, Entamoeba dispar
RKNNKVFDDT

SEQ ID NO: 2359293 - protein, 14 aa, Entamoeba dispar
RKNRKGGRKEVEKI

SEQ ID NO: 2359294 - protein, 8 aa, Entamoeba dispar
RKPPDQYQ

SEQ ID NO: 2359295 - protein, 7 aa, Entamoeba dispar
RKPSIDC

SEQ ID NO: 2359296 - protein, 10 aa, Entamoeba dispar
RKSGDNVTRI

SEQ ID NO: 2359297 - protein, 26 aa, Entamoeba dispar
RNEESESVKENYEQPPNEWPSKGEIK

SEQ ID NO: 2359298 - protein, 7 aa, Entamoeba dispar
RNGKNQK

SEQ ID NO: 2359299 - protein, 9 aa, Entamoeba dispar
RNKTGYVGQ

SEQ ID NO: 2359300 - protein, 10 aa, Entamoeba dispar
RNRSTTPNIA

SEQ ID NO: 2359301 - protein, 4 aa, Entamoeba dispar
RPGM

SEQ ID NO: 2359302 - protein, 6 aa, Entamoeba dispar
RPYESP

SEQ ID NO: 2359303 - protein, 6 aa, Entamoeba dispar
RQVTNH

SEQ ID NO: 2359304 - protein, 15 aa, Entamoeba dispar
RSTAGECPSECNGNI

SEQ ID NO: 2359305 - protein, 5 aa, Entamoeba dispar
RSVGG

SEQ ID NO: 2359306 - protein, 6 aa, Entamoeba dispar
RSVKST

SEQ ID NO: 2359307 - protein, 4 aa, Entamoeba dispar
RTNN

SEQ ID NO: 2359308 - protein, 8 aa, Entamoeba dispar
RTYGGQET

SEQ ID NO: 2359309 - protein, 11 aa, Entamoeba dispar
SCDDSSKYFNG

SEQ ID NO: 2359310 - protein, 6 aa, Entamoeba dispar
SCDNTL

SEQ ID NO: 2359311 - protein, 18 aa, Entamoeba dispar
SCGEETNSNIGVTASGDY

SEQ ID NO: 2359312 - protein, 15 aa, Entamoeba dispar
SCGTPPYGETSPMLD

SEQ ID NO: 2359313 - protein, 11 aa, Entamoeba dispar
SCGTSDPSQFI

SEQ ID NO: 2359314 - protein, 4 aa, Entamoeba dispar
SDEE

SEQ ID NO: 2359315 - protein, 10 aa, Entamoeba dispar
SDKTGTLTEN

SEQ ID NO: 2359316 - protein, 9 aa, Entamoeba dispar
SDNCNSITN

SEQ ID NO: 2359317 - protein, 6 aa, Entamoeba dispar
SDQTKC

SEQ ID NO: 2359318 - protein, 8 aa, Entamoeba dispar
SDSDASYI

SEQ ID NO: 2359319 - protein, 7 aa, Entamoeba dispar
SDSYGIT

SEQ ID NO: 2359320 - protein, 17 aa, Entamoeba dispar
SDTNAGCVSPIKEGKCQ

SEQ ID NO: 2359321 - protein, 9 aa, Entamoeba dispar
SEKPIAEGA

SEQ ID NO: 2359322 - protein, 7 aa, Entamoeba dispar
SEKRNDY

SEQ ID NO: 2359323 - protein, 6 aa, Entamoeba dispar
SESGGI

SEQ ID NO: 2359324 - protein, 10 aa, Entamoeba dispar
SESNDINQQN

SEQ ID NO: 2359325 - protein, 9 aa, Entamoeba dispar
SFPTSEDDP

SEQ ID NO: 2359326 - protein, 7 aa, Entamoeba dispar
SGDVNQN

SEQ ID NO: 2359327 - protein, 8 aa, Entamoeba dispar
SGELTSRI

SEQ ID NO: 2359328 - protein, 9 aa, Entamoeba dispar
SGSKQTAHY

SEQ ID NO: 2359329 - protein, 16 aa, Entamoeba dispar
SGSSSADVKKQLADQR

SEQ ID NO: 2359330 - protein, 4 aa, Entamoeba dispar
SGTF

SEQ ID NO: 2359331 - protein, 6 aa, Entamoeba dispar
SGWDEK

SEQ ID NO: 2359332 - protein, 4 aa, Entamoeba dispar
SISE

SEQ ID NO: 2359333 - protein, 9 aa, Entamoeba dispar
SISEPISIP

SEQ ID NO: 2359334 - protein, 7 aa, Entamoeba dispar
SISPSNC

SEQ ID NO: 2359335 - protein, 23 aa, Entamoeba dispar
SISTTSISVSSSEVSRPSIAASS

SEQ ID NO: 2359336 - protein, 11 aa, Entamoeba dispar
SITTGKRPPII

SEQ ID NO: 2359337 - protein, 4 aa, Entamoeba dispar
SKED

SEQ ID NO: 2359338 - protein, 7 aa, Entamoeba dispar
SKEEKDV

SEQ ID NO: 2359339 - protein, 7 aa, Entamoeba dispar
SKEELPG

SEQ ID NO: 2359340 - protein, 21 aa, Entamoeba dispar
SKENYTNINNKRNEYGDKYDN

SEQ ID NO: 2359341 - protein, 35 aa, Entamoeba dispar
SKEQKKDTDDEDYQHDEEANPIIEDDDEPHLDGFN

SEQ ID NO: 2359342 - protein, 9 aa, Entamoeba dispar
SKGADLSSA

SEQ ID NO: 2359343 - protein, 5 aa, Entamoeba dispar
SKISK

SEQ ID NO: 2359344 - protein, 18 aa, Entamoeba dispar
SKSNTKNKTTTSFNEEDE

SEQ ID NO: 2359345 - protein, 9 aa, Entamoeba dispar
SKTTLTTKK

SEQ ID NO: 2359346 - protein, 6 aa, Entamoeba dispar
SKVNNV

SEQ ID NO: 2359347 - protein, 13 aa, Entamoeba dispar
SLDEKQDAVARAN

SEQ ID NO: 2359348 - protein, 4 aa, Entamoeba dispar
SLGE

SEQ ID NO: 2359349 - protein, 5 aa, Entamoeba dispar
SLGQE

SEQ ID NO: 2359350 - protein, 4 aa, Entamoeba dispar
SLHP

SEQ ID NO: 2359351 - protein, 8 aa, Entamoeba dispar
SLNQGYAA

SEQ ID NO: 2359352 - protein, 5 aa, Entamoeba dispar
SLPED

SEQ ID NO: 2359353 - protein, 5 aa, Entamoeba dispar
SLRDE

SEQ ID NO: 2359354 - protein, 9 aa, Entamoeba dispar
SLSGTPLSK

SEQ ID NO: 2359355 - protein, 4 aa, Entamoeba dispar
SLSQ

SEQ ID NO: 2359356 - protein, 4 aa, Entamoeba dispar
SLTR

SEQ ID NO: 2359357 - protein, 7 aa, Entamoeba dispar
SMEPGFK

SEQ ID NO: 2359358 - protein, 5 aa, Entamoeba dispar
SMGLS

SEQ ID NO: 2359359 - protein, 9 aa, Entamoeba dispar
SMNGPQDGT

SEQ ID NO: 2359360 - protein, 13 aa, Entamoeba dispar
SMNSESPFEEEPK

SEQ ID NO: 2359361 - protein, 13 aa, Entamoeba dispar
SNAGNGVYESTTD

SEQ ID NO: 2359362 - protein, 8 aa, Entamoeba dispar
SNKTNKFT

SEQ ID NO: 2359363 - protein, 4 aa, Entamoeba dispar
SNQC

SEQ ID NO: 2359364 - protein, 5 aa, Entamoeba dispar
SNSTT

SEQ ID NO: 2359365 - protein, 9 aa, Entamoeba dispar
SNTGTGATV

SEQ ID NO: 2359366 - protein, 8 aa, Entamoeba dispar
SNTQSTIN

SEQ ID NO: 2359367 - protein, 9 aa, Entamoeba dispar
SNTYSPNLK

SEQ ID NO: 2359368 - protein, 7 aa, Entamoeba dispar
SNVDTGL

SEQ ID NO: 2359369 - protein, 4 aa, Entamoeba dispar
SNVP

SEQ ID NO: 2359370 - protein, 7 aa, Entamoeba dispar
SPEKSYI

SEQ ID NO: 2359371 - protein, 4 aa, Entamoeba dispar
SPKS

SEQ ID NO: 2359372 - protein, 5 aa, Entamoeba dispar
SPNDI

SEQ ID NO: 2359373 - protein, 17 aa, Entamoeba dispar
SPRKTESPQESPRSSTK

SEQ ID NO: 2359374 - protein, 11 aa, Entamoeba dispar
SPTANGSGVPE

SEQ ID NO: 2359375 - protein, 4 aa, Entamoeba dispar
SPTS

SEQ ID NO: 2359376 - protein, 17 aa, Entamoeba dispar
SQKTKHKEIGVKEGTQL

SEQ ID NO: 2359377 - protein, 4 aa, Entamoeba dispar
SQSK

SEQ ID NO: 2359378 - protein, 13 aa, Entamoeba dispar
SQTISTDKSNYDF

SEQ ID NO: 2359379 - protein, 6 aa, Entamoeba dispar
SRGQMY

SEQ ID NO: 2359380 - protein, 7 aa, Entamoeba dispar
SRPKSTT

SEQ ID NO: 2359381 - protein, 5 aa, Entamoeba dispar
SSCGI

SEQ ID NO: 2359382 - protein, 8 aa, Entamoeba dispar
SSCKPGYY

SEQ ID NO: 2359383 - protein, 8 aa, Entamoeba dispar
SSCNSTTE

SEQ ID NO: 2359384 - protein, 4 aa, Entamoeba dispar
SSEE

SEQ ID NO: 2359385 - protein, 8 aa, Entamoeba dispar
SSGDRCEC

SEQ ID NO: 2359386 - protein, 17 aa, Entamoeba dispar
SSGKGWEYDRNSNPKKF

SEQ ID NO: 2359387 - protein, 6 aa, Entamoeba dispar
SSHTDL

SEQ ID NO: 2359388 - protein, 6 aa, Entamoeba dispar
SSITTN

SEQ ID NO: 2359389 - protein, 17 aa, Entamoeba dispar
SSKNCGDDCNTSDGTCT

SEQ ID NO: 2359390 - protein, 10 aa, Entamoeba dispar
SSKTKTKDFH

SEQ ID NO: 2359391 - protein, 4 aa, Entamoeba dispar
SSLP

SEQ ID NO: 2359392 - protein, 5 aa, Entamoeba dispar
SSPIK

SEQ ID NO: 2359393 - protein, 12 aa, Entamoeba dispar
SSPTQCSSCSKG

SEQ ID NO: 2359394 - protein, 4 aa, Entamoeba dispar
SSSL

SEQ ID NO: 2359395 - protein, 5 aa, Entamoeba dispar
SSSNA

SEQ ID NO: 2359396 - protein, 8 aa, Entamoeba dispar
SSSSISVT

SEQ ID NO: 2359397 - protein, 6 aa, Entamoeba dispar
SSSTKR

SEQ ID NO: 2359398 - protein, 8 aa, Entamoeba dispar
SSTDENAT

SEQ ID NO: 2359399 - protein, 6 aa, Entamoeba dispar
SSTDVN

SEQ ID NO: 2359400 - protein, 4 aa, Entamoeba dispar
SSTK

SEQ ID NO: 2359401 - protein, 8 aa, Entamoeba dispar
SSTKHTAE

SEQ ID NO: 2359402 - protein, 5 aa, Entamoeba dispar
SSVEQ

SEQ ID NO: 2359403 - protein, 5 aa, Entamoeba dispar
STEEL

SEQ ID NO: 2359404 - protein, 9 aa, Entamoeba dispar
STGKRPPII

SEQ ID NO: 2359405 - protein, 8 aa, Entamoeba dispar
STKENRAQ

SEQ ID NO: 2359406 - protein, 15 aa, Entamoeba dispar
STLDSNCQSCSAKSG

SEQ ID NO: 2359407 - protein, 9 aa, Entamoeba dispar
STNNKEIYD

SEQ ID NO: 2359408 - protein, 9 aa, Entamoeba dispar
STQINSNTL

SEQ ID NO: 2359409 - protein, 5 aa, Entamoeba dispar
STQIS

SEQ ID NO: 2359410 - protein, 18 aa, Entamoeba dispar
STQSIATSIKPTTEGSSR

SEQ ID NO: 2359411 - protein, 6 aa, Entamoeba dispar
STSKYK

SEQ ID NO: 2359412 - protein, 5 aa, Entamoeba dispar
STTEY

SEQ ID NO: 2359413 - protein, 11 aa, Entamoeba dispar
STTKIEEDSNG

SEQ ID NO: 2359414 - protein, 7 aa, Entamoeba dispar
STTTTCR

SEQ ID NO: 2359415 - protein, 4 aa, Entamoeba dispar
STVI

SEQ ID NO: 2359416 - protein, 12 aa, Entamoeba dispar
SVDPSTQTNTDY

SEQ ID NO: 2359417 - protein, 10 aa, Entamoeba dispar
SYQNSKTKLY

SEQ ID NO: 2359418 - protein, 8 aa, Entamoeba dispar
SYRDNGIR

SEQ ID NO: 2359419 - protein, 4 aa, Entamoeba dispar
SYVS

SEQ ID NO: 2359420 - protein, 14 aa, Entamoeba dispar
TCKESGDDSCTSCK

SEQ ID NO: 2359421 - protein, 4 aa, Entamoeba dispar
TCKN

SEQ ID NO: 2359422 - protein, 5 aa, Entamoeba dispar
TCQKC

SEQ ID NO: 2359423 - protein, 8 aa, Entamoeba dispar
TCSKCSES

SEQ ID NO: 2359424 - protein, 8 aa, Entamoeba dispar
TCSSCSTN

SEQ ID NO: 2359425 - protein, 7 aa, Entamoeba dispar
TDFGSSR

SEQ ID NO: 2359426 - protein, 8 aa, Entamoeba dispar
TDFGSSRN

SEQ ID NO: 2359427 - protein, 25 aa, Entamoeba dispar
TDKPKCSHINTPAETCDKSKQRLND

SEQ ID NO: 2359428 - protein, 5 aa, Entamoeba dispar
TDSRS

SEQ ID NO: 2359429 - protein, 4 aa, Entamoeba dispar
TEAR

SEQ ID NO: 2359430 - protein, 13 aa, Entamoeba dispar
TECEEGTYLSNGR

SEQ ID NO: 2359431 - protein, 5 aa, Entamoeba dispar
TEEKY

SEQ ID NO: 2359432 - protein, 4 aa, Entamoeba dispar
TEFP

SEQ ID NO: 2359433 - protein, 9 aa, Entamoeba dispar
TFSNGKNDY

SEQ ID NO: 2359434 - protein, 10 aa, Entamoeba dispar
TFSNSKNDYH

SEQ ID NO: 2359435 - protein, 8 aa, Entamoeba dispar
TGIDPSKD

SEQ ID NO: 2359436 - protein, 8 aa, Entamoeba dispar
TGKSVTNK

SEQ ID NO: 2359437 - protein, 6 aa, Entamoeba dispar
THTKIG

SEQ ID NO: 2359438 - protein, 7 aa, Entamoeba dispar
TIDNDEY

SEQ ID NO: 2359439 - protein, 5 aa, Entamoeba dispar
TIGSS

SEQ ID NO: 2359440 - protein, 17 aa, Entamoeba dispar
TISSNKNTIKNNEASTH

SEQ ID NO: 2359441 - protein, 10 aa, Entamoeba dispar
TISTGKRPTI

SEQ ID NO: 2359442 - protein, 9 aa, Entamoeba dispar
TKCNPNNKR

SEQ ID NO: 2359443 - protein, 4 aa, Entamoeba dispar
TKEY

SEQ ID NO: 2359444 - protein, 8 aa, Entamoeba dispar
TKGENNQN

SEQ ID NO: 2359445 - protein, 8 aa, Entamoeba dispar
TKIDPTKD

SEQ ID NO: 2359446 - protein, 8 aa, Entamoeba dispar
TKKYAKAR

SEQ ID NO: 2359447 - protein, 8 aa, Entamoeba dispar
TKLEESWP

SEQ ID NO: 2359448 - protein, 9 aa, Entamoeba dispar
TKPKTIKYG

SEQ ID NO: 2359449 - protein, 9 aa, Entamoeba dispar
TKPRERTNE

SEQ ID NO: 2359450 - protein, 6 aa, Entamoeba dispar
TKSSIT

SEQ ID NO: 2359451 - protein, 6 aa, Entamoeba dispar
TKSSLT

SEQ ID NO: 2359452 - protein, 7 aa, Entamoeba dispar
TKTSQIN

SEQ ID NO: 2359453 - protein, 8 aa, Entamoeba dispar
TKVTDGNG

SEQ ID NO: 2359454 - protein, 6 aa, Entamoeba dispar
TKYNNQ

SEQ ID NO: 2359455 - protein, 11 aa, Entamoeba dispar
TNDTQSEKEYI

SEQ ID NO: 2359456 - protein, 15 aa, Entamoeba dispar
TNENNQRTSSNVCKQ

SEQ ID NO: 2359457 - protein, 9 aa, Entamoeba dispar
TNGDTWSSE

SEQ ID NO: 2359458 - protein, 9 aa, Entamoeba dispar
TNGEQKLPD

SEQ ID NO: 2359459 - protein, 16 aa, Entamoeba dispar
TNKTDCESKYGIRSEP

SEQ ID NO: 2359460 - protein, 7 aa, Entamoeba dispar
TNRQQGW

SEQ ID NO: 2359461 - protein, 6 aa, Entamoeba dispar
TNSQTL

SEQ ID NO: 2359462 - protein, 16 aa, Entamoeba dispar
TNTNKISITAPNENSL

SEQ ID NO: 2359463 - protein, 21 aa, Entamoeba dispar
TPDPDELARKNKKPEDSGSVT

SEQ ID NO: 2359464 - protein, 4 aa, Entamoeba dispar
TPIE

SEQ ID NO: 2359465 - protein, 4 aa, Entamoeba dispar
TPIQ

SEQ ID NO: 2359466 - protein, 4 aa, Entamoeba dispar
TPPL

SEQ ID NO: 2359467 - protein, 8 aa, Entamoeba dispar
TQNATDKR

SEQ ID NO: 2359468 - protein, 6 aa, Entamoeba dispar
TQNGEN

SEQ ID NO: 2359469 - protein, 5 aa, Entamoeba dispar
TQNPK

SEQ ID NO: 2359470 - protein, 8 aa, Entamoeba dispar
TQSATDKR

SEQ ID NO: 2359471 - protein, 8 aa, Entamoeba dispar
TQWQSPVS

SEQ ID NO: 2359472 - protein, 4 aa, Entamoeba dispar
TREC

SEQ ID NO: 2359473 - protein, 4 aa, Entamoeba dispar
TRIS

SEQ ID NO: 2359474 - protein, 8 aa, Entamoeba dispar
TRKDQMTL

SEQ ID NO: 2359475 - protein, 9 aa, Entamoeba dispar
TRKEKQNRY

SEQ ID NO: 2359476 - protein, 18 aa, Entamoeba dispar
TRLASDPTTLQGISGERV

SEQ ID NO: 2359477 - protein, 8 aa, Entamoeba dispar
TRNSSGLS

SEQ ID NO: 2359478 - protein, 5 aa, Entamoeba dispar
TRTSP

SEQ ID NO: 2359479 - protein, 5 aa, Entamoeba dispar
TSALD

SEQ ID NO: 2359480 - protein, 5 aa, Entamoeba dispar
TSALS

SEQ ID NO: 2359481 - protein, 7 aa, Entamoeba dispar
TSGTYCQ

SEQ ID NO: 2359482 - protein, 20 aa, Entamoeba dispar
TSNNNHLKGQALNSIDSKYE

SEQ ID NO: 2359483 - protein, 4 aa, Entamoeba dispar
TSPP

SEQ ID NO: 2359484 - protein, 4 aa, Entamoeba dispar
TSSR

SEQ ID NO: 2359485 - protein, 4 aa, Entamoeba dispar
TSYT

SEQ ID NO: 2359486 - protein, 4 aa, Entamoeba dispar
TTCP

SEQ ID NO: 2359487 - protein, 11 aa, Entamoeba dispar
TTDSQLTLSDS

SEQ ID NO: 2359488 - protein, 11 aa, Entamoeba dispar
TTFKSISGEGT

SEQ ID NO: 2359489 - protein, 25 aa, Entamoeba dispar
TTHAGSLGTIESTESKSKKKTYKIP

SEQ ID NO: 2359490 - protein, 4 aa, Entamoeba dispar
TTID

SEQ ID NO: 2359491 - protein, 11 aa, Entamoeba dispar
TTKRYKTNQTC

SEQ ID NO: 2359492 - protein, 4 aa, Entamoeba dispar
TTND

SEQ ID NO: 2359493 - protein, 6 aa, Entamoeba dispar
TTQMSQ

SEQ ID NO: 2359494 - protein, 5 aa, Entamoeba dispar
TTQPL

SEQ ID NO: 2359495 - protein, 10 aa, Entamoeba dispar
TTREISNNEV

SEQ ID NO: 2359496 - protein, 19 aa, Entamoeba dispar
TVLTSSKECSTIPNSEITS

SEQ ID NO: 2359497 - protein, 6 aa, Entamoeba dispar
TVQEQI

SEQ ID NO: 2359498 - protein, 21 aa, Entamoeba dispar
TVSSKKKDNNKKQDTETVPQD

SEQ ID NO: 2359499 - protein, 5 aa, Entamoeba dispar
VCNSC

SEQ ID NO: 2359500 - protein, 12 aa, Entamoeba dispar
VDEKGTVAAAAT

SEQ ID NO: 2359501 - protein, 12 aa, Entamoeba dispar
VDENGNKKRIEG

SEQ ID NO: 2359502 - protein, 6 aa, Entamoeba dispar
VDNSFG

SEQ ID NO: 2359503 - protein, 8 aa, Entamoeba dispar
VEDGNYTT

SEQ ID NO: 2359504 - protein, 10 aa, Entamoeba dispar
VEEKRSVGGV

SEQ ID NO: 2359505 - protein, 4 aa, Entamoeba dispar
VEIN

SEQ ID NO: 2359506 - protein, 6 aa, Entamoeba dispar
VEQGKT

SEQ ID NO: 2359507 - protein, 15 aa, Entamoeba dispar
VGEKGAALSGGQKQR

SEQ ID NO: 2359508 - protein, 11 aa, Entamoeba dispar
VGRTGSGKSTL

SEQ ID NO: 2359509 - protein, 4 aa, Entamoeba dispar
VGYQ

SEQ ID NO: 2359510 - protein, 7 aa, Entamoeba dispar
VITSRNN

SEQ ID NO: 2359511 - protein, 8 aa, Entamoeba dispar
VKNNEENI

SEQ ID NO: 2359512 - protein, 11 aa, Entamoeba dispar
VKNPEDEERTH

SEQ ID NO: 2359513 - protein, 4 aa, Entamoeba dispar
VKVP

SEQ ID NO: 2359514 - protein, 7 aa, Entamoeba dispar
VNYQSGD

SEQ ID NO: 2359515 - protein, 11 aa, Entamoeba dispar
VPAGTNGGVSS

SEQ ID NO: 2359516 - protein, 7 aa, Entamoeba dispar
VPTNKEL

SEQ ID NO: 2359517 - protein, 6 aa, Entamoeba dispar
VQGDDN

SEQ ID NO: 2359518 - protein, 13 aa, Entamoeba dispar
VRGKGGSKGVSAG

SEQ ID NO: 2359519 - protein, 10 aa, Entamoeba dispar
VRPNNSMCSN

SEQ ID NO: 2359520 - protein, 7 aa, Entamoeba dispar
VSGIDEY

SEQ ID NO: 2359521 - protein, 7 aa, Entamoeba dispar
VSNEVTP

SEQ ID NO: 2359522 - protein, 18 aa, Entamoeba dispar
VSSDEDDHGSKKKEMSSI

SEQ ID NO: 2359523 - protein, 4 aa, Entamoeba dispar
VSSS

SEQ ID NO: 2359524 - protein, 12 aa, Entamoeba dispar
VTGDGTNDVPAL

SEQ ID NO: 2359525 - protein, 7 aa, Entamoeba dispar
VTNGEVP

SEQ ID NO: 2359526 - protein, 6 aa, Entamoeba dispar
VTPEST

SEQ ID NO: 2359527 - protein, 25 aa, Entamoeba dispar
VTREGSGSLTSSSESSNSTVSTPRR

SEQ ID NO: 2359528 - protein, 4 aa, Entamoeba dispar
VTSN

SEQ ID NO: 2359529 - protein, 8 aa, Entamoeba dispar
WPSGPRRP

SEQ ID NO: 2359530 - protein, 9 aa, Entamoeba dispar
YCQKESENS

SEQ ID NO: 2359531 - protein, 16 aa, Entamoeba dispar
YDPVGGSVKLDGKDLR

SEQ ID NO: 2359532 - protein, 9 aa, Entamoeba dispar
YEGKKNHKV

SEQ ID NO: 2359533 - protein, 13 aa, Entamoeba dispar
YEKEQQYQTDIKE

SEQ ID NO: 2359534 - protein, 8 aa, Entamoeba dispar
YENSTGVQ

SEQ ID NO: 2359535 - protein, 4 aa, Entamoeba dispar
YGSC

SEQ ID NO: 2359536 - protein, 6 aa, Entamoeba dispar
YGTQPM

SEQ ID NO: 2359537 - protein, 21 aa, Entamoeba dispar
YIKEKGECKEIDNKCNKSERN

SEQ ID NO: 2359538 - protein, 21 aa, Entamoeba dispar
YIKENGECKEIDNKCNKSERN

SEQ ID NO: 2359539 - protein, 12 aa, Entamoeba dispar
YKKENCQKCGQG

SEQ ID NO: 2359540 - protein, 12 aa, Entamoeba dispar
YKPEDRLTPQEA

SEQ ID NO: 2359541 - protein, 7 aa, Entamoeba dispar
YKPTELG

SEQ ID NO: 2359542 - protein, 9 aa, Entamoeba dispar
YKSVDKNIG

SEQ ID NO: 2359543 - protein, 10 aa, Entamoeba dispar
YKTKNAEGLP

SEQ ID NO: 2359544 - protein, 6 aa, Entamoeba dispar
YNENIP

SEQ ID NO: 2359545 - protein, 6 aa, Entamoeba dispar
YNPEPG

SEQ ID NO: 2359546 - protein, 4 aa, Entamoeba dispar
YNTP

SEQ ID NO: 2359547 - protein, 9 aa, Entamoeba dispar
YNYNENIPS

SEQ ID NO: 2359548 - protein, 6 aa, Entamoeba dispar
YPKRSY

SEQ ID NO: 2359549 - protein, 4 aa, Entamoeba dispar
YPNG

SEQ ID NO: 2359550 - protein, 5 aa, Entamoeba dispar
YPSND

SEQ ID NO: 2359551 - protein, 5 aa, Entamoeba dispar
YPTAP

SEQ ID NO: 2359552 - protein, 9 aa, Entamoeba dispar
YPTRPTKQI

SEQ ID NO: 2359553 - protein, 8 aa, Entamoeba dispar
YQGETNQK

SEQ ID NO: 2359554 - protein, 8 aa, Entamoeba dispar
YRDSTGLI

SEQ ID NO: 2359555 - protein, 11 aa, Entamoeba dispar
YRVTDGQCESC

SEQ ID NO: 2359556 - protein, 6 aa, Entamoeba dispar
YTDDKS

SEQ ID NO: 2359557 - protein, 22 aa, Entamoeba dispar
YTLNNGKCSNKEKNQNGKNEEI

SEQ ID NO: 2359558 - protein, 11 aa, Entamoeba dispar
YTTSPVGRKGT

SEQ ID NO: 2359559 - protein, 5 aa, Entamoeba dispar
YYNNQ

SEQ ID NO: 2359560 - protein, 13 aa, Entamoeba dispar
YYRSSSQNKCLSQ

SEQ ID NO: 2359561 - protein, 7 aa, Entamoeba dispar
AAALATK

SEQ ID NO: 2359562 - protein, 8 aa, Entamoeba dispar
AAASSTHI

SEQ ID NO: 2359563 - protein, 8 aa, Entamoeba dispar
AADNKDLN

SEQ ID NO: 2359564 - protein, 8 aa, Entamoeba dispar
AADNNNLK

SEQ ID NO: 2359565 - protein, 11 aa, Entamoeba dispar
AAIQKSKKFSV

SEQ ID NO: 2359566 - protein, 11 aa, Entamoeba dispar
AAIRDDNKLGE

SEQ ID NO: 2359567 - protein, 13 aa, Entamoeba dispar
AAKEYARKHGQQT

SEQ ID NO: 2359568 - protein, 9 aa, Entamoeba dispar
AAKKECPQL

SEQ ID NO: 2359569 - protein, 6 aa, Entamoeba dispar
AAKPGR

SEQ ID NO: 2359570 - protein, 18 aa, Entamoeba dispar
AAKQPEETKALLDGDEET

SEQ ID NO: 2359571 - protein, 22 aa, Entamoeba dispar
AAKQPSVSNEEKASLLDNDTEK

SEQ ID NO: 2359572 - protein, 9 aa, Entamoeba dispar
AALDGETSL

SEQ ID NO: 2359573 - protein, 9 aa, Entamoeba dispar
AALGEDGGL

SEQ ID NO: 2359574 - protein, 5 aa, Entamoeba dispar
AAMNY

SEQ ID NO: 2359575 - protein, 10 aa, Entamoeba dispar
AANKPKEIDD

SEQ ID NO: 2359576 - protein, 10 aa, Entamoeba dispar
AAPRTTDKGS

SEQ ID NO: 2359577 - protein, 5 aa, Entamoeba dispar
AAPYT

SEQ ID NO: 2359578 - protein, 4 aa, Entamoeba dispar
AAQQ

SEQ ID NO: 2359579 - protein, 10 aa, Entamoeba dispar
AASEATMSST

SEQ ID NO: 2359580 - protein, 7 aa, Entamoeba dispar
AASEGGH

SEQ ID NO: 2359581 - protein, 7 aa, Entamoeba dispar
AASSIPK

SEQ ID NO: 2359582 - protein, 5 aa, Entamoeba dispar
ACDNN

SEQ ID NO: 2359583 - protein, 5 aa, Entamoeba dispar
ACEDI

SEQ ID NO: 2359584 - protein, 7 aa, Entamoeba dispar
ACGENDD

SEQ ID NO: 2359585 - protein, 17 aa, Entamoeba dispar
ACKSDKCGSSGCTECED

SEQ ID NO: 2359586 - protein, 8 aa, Entamoeba dispar
ACSKPSLS

SEQ ID NO: 2359587 - protein, 4 aa, Entamoeba dispar
ACSV

SEQ ID NO: 2359588 - protein, 6 aa, Entamoeba dispar
ACTKSR

SEQ ID NO: 2359589 - protein, 7 aa, Entamoeba dispar
ADAAIGT

SEQ ID NO: 2359590 - protein, 5 aa, Entamoeba dispar
ADADT

SEQ ID NO: 2359591 - protein, 8 aa, Entamoeba dispar
ADAKQNTM

SEQ ID NO: 2359592 - protein, 10 aa, Entamoeba dispar
ADANGCTTCN

SEQ ID NO: 2359593 - protein, 17 aa, Entamoeba dispar
ADAQGAVKFDQKGKYNY

SEQ ID NO: 2359594 - protein, 4 aa, Entamoeba dispar
ADAY

SEQ ID NO: 2359595 - protein, 8 aa, Entamoeba dispar
ADDDVNKK

SEQ ID NO: 2359596 - protein, 6 aa, Entamoeba dispar
ADDGIS

SEQ ID NO: 2359597 - protein, 5 aa, Entamoeba dispar
ADDIP

SEQ ID NO: 2359598 - protein, 7 aa, Entamoeba dispar
ADEEPNG

SEQ ID NO: 2359599 - protein, 9 aa, Entamoeba dispar
ADENQKERI

SEQ ID NO: 2359600 - protein, 11 aa, Entamoeba dispar
ADESGCKECNN

SEQ ID NO: 2359601 - protein, 8 aa, Entamoeba dispar
ADESIEAT

SEQ ID NO: 2359602 - protein, 12 aa, Entamoeba dispar
ADETDPNKAKLT

SEQ ID NO: 2359603 - protein, 6 aa, Entamoeba dispar
ADFDKA

SEQ ID NO: 2359604 - protein, 7 aa, Entamoeba dispar
ADFSSQQ

SEQ ID NO: 2359605 - protein, 9 aa, Entamoeba dispar
ADGCTGESD

SEQ ID NO: 2359606 - protein, 6 aa, Entamoeba dispar
ADGDSE

SEQ ID NO: 2359607 - protein, 19 aa, Entamoeba dispar
ADGDSEKYEYVPATADKEA

SEQ ID NO: 2359608 - protein, 7 aa, Entamoeba dispar
ADGKGNC

SEQ ID NO: 2359609 - protein, 6 aa, Entamoeba dispar
ADGKLS

SEQ ID NO: 2359610 - protein, 6 aa, Entamoeba dispar
ADGTMW

SEQ ID NO: 2359611 - protein, 6 aa, Entamoeba dispar
ADGVPV

SEQ ID NO: 2359612 - protein, 4 aa, Entamoeba dispar
ADHC

SEQ ID NO: 2359613 - protein, 14 aa, Entamoeba dispar
ADKAKDDNVRAQGK

SEQ ID NO: 2359614 - protein, 5 aa, Entamoeba dispar
ADKDD

SEQ ID NO: 2359615 - protein, 9 aa, Entamoeba dispar
ADKKLNKVE

SEQ ID NO: 2359616 - protein, 6 aa, Entamoeba dispar
ADLNDR

SEQ ID NO: 2359617 - protein, 6 aa, Entamoeba dispar
ADLTQE

SEQ ID NO: 2359618 - protein, 11 aa, Entamoeba dispar
ADNDSENHSEL

SEQ ID NO: 2359619 - protein, 5 aa, Entamoeba dispar
ADNQG

SEQ ID NO: 2359620 - protein, 5 aa, Entamoeba dispar
ADPEN

SEQ ID NO: 2359621 - protein, 5 aa, Entamoeba dispar
ADPNM

SEQ ID NO: 2359622 - protein, 14 aa, Entamoeba dispar
ADPYGGCEKCNGGD

SEQ ID NO: 2359623 - protein, 7 aa, Entamoeba dispar
ADPYPDI

SEQ ID NO: 2359624 - protein, 7 aa, Entamoeba dispar
ADQNMPQ

SEQ ID NO: 2359625 - protein, 8 aa, Entamoeba dispar
ADRKTKSV

SEQ ID NO: 2359626 - protein, 8 aa, Entamoeba dispar
ADRTCSST

SEQ ID NO: 2359627 - protein, 8 aa, Entamoeba dispar
ADRVDTTK

SEQ ID NO: 2359628 - protein, 7 aa, Entamoeba dispar
ADSASTN

SEQ ID NO: 2359629 - protein, 10 aa, Entamoeba dispar
ADSKESSELS

SEQ ID NO: 2359630 - protein, 14 aa, Entamoeba dispar
ADSLNAGSISGNTQ

SEQ ID NO: 2359631 - protein, 9 aa, Entamoeba dispar
ADSTDTFDP

SEQ ID NO: 2359632 - protein, 7 aa, Entamoeba dispar
ADSTQFN

SEQ ID NO: 2359633 - protein, 6 aa, Entamoeba dispar
ADTNNQ

SEQ ID NO: 2359634 - protein, 5 aa, Entamoeba dispar
ADTQD

SEQ ID NO: 2359635 - protein, 5 aa, Entamoeba dispar
ADTSL

SEQ ID NO: 2359636 - protein, 9 aa, Entamoeba dispar
ADTSNRATP

SEQ ID NO: 2359637 - protein, 8 aa, Entamoeba dispar
ADTTTTKF

SEQ ID NO: 2359638 - protein, 15 aa, Entamoeba dispar
ADTYDKNDCALRSSS

SEQ ID NO: 2359639 - protein, 10 aa, Entamoeba dispar
ADVKKRGTNI

SEQ ID NO: 2359640 - protein, 11 aa, Entamoeba dispar
ADVNINGTITQ

SEQ ID NO: 2359641 - protein, 6 aa, Entamoeba dispar
ADYEEI

SEQ ID NO: 2359642 - protein, 5 aa, Entamoeba dispar
AEAFG

SEQ ID NO: 2359643 - protein, 5 aa, Entamoeba dispar
AECGS

SEQ ID NO: 2359644 - protein, 25 aa, Entamoeba dispar
AEDKTTGKKNKITITNDKGRLSKEE

SEQ ID NO: 2359645 - protein, 13 aa, Entamoeba dispar
AEEGCKGTNVETQ

SEQ ID NO: 2359646 - protein, 9 aa, Entamoeba dispar
AEEGNNPDN

SEQ ID NO: 2359647 - protein, 16 aa, Entamoeba dispar
AEEKEKFGGSTLGEGQ

SEQ ID NO: 2359648 - protein, 7 aa, Entamoeba dispar
AEEKVNA

SEQ ID NO: 2359649 - protein, 5 aa, Entamoeba dispar
AEELR

SEQ ID NO: 2359650 - protein, 4 aa, Entamoeba dispar
AEEP

SEQ ID NO: 2359651 - protein, 6 aa, Entamoeba dispar
AEERAA

SEQ ID NO: 2359652 - protein, 20 aa, Entamoeba dispar
AEERKKAKKGIQSTKQQKPI

SEQ ID NO: 2359653 - protein, 15 aa, Entamoeba dispar
AEETRTRKLKTKQHR

SEQ ID NO: 2359654 - protein, 78 aa, Entamoeba dispar
AEETTEKDESSNEENQSGESGSGSGSSSGSSSGTGSYKSGSGSGSQSGSNSGSEQLEESKKEDDSSSGSAPESSEEED

SEQ ID NO: 2359655 - protein, 11 aa, Entamoeba dispar
AEFSQPDNINQ

SEQ ID NO: 2359656 - protein, 4 aa, Entamoeba dispar
AEGA

SEQ ID NO: 2359657 - protein, 16 aa, Entamoeba dispar
AEGKDMQNTAQKAIEE

SEQ ID NO: 2359658 - protein, 9 aa, Entamoeba dispar
AEGQSLDKR

SEQ ID NO: 2359659 - protein, 6 aa, Entamoeba dispar
AEGSEY

SEQ ID NO: 2359660 - protein, 15 aa, Entamoeba dispar
AEHKIEKRKCTTESC

SEQ ID NO: 2359661 - protein, 9 aa, Entamoeba dispar
AEHTDKFDQ

SEQ ID NO: 2359662 - protein, 5 aa, Entamoeba dispar
AEIEE

SEQ ID NO: 2359663 - protein, 9 aa, Entamoeba dispar
AEKAGAPRM

SEQ ID NO: 2359664 - protein, 4 aa, Entamoeba dispar
AEKD

SEQ ID NO: 2359665 - protein, 6 aa, Entamoeba dispar
AEKEDM

SEQ ID NO: 2359666 - protein, 8 aa, Entamoeba dispar
AEKEEPHG

SEQ ID NO: 2359667 - protein, 8 aa, Entamoeba dispar
AEKNGEVY

SEQ ID NO: 2359668 - protein, 9 aa, Entamoeba dispar
AEKRDEYKY

SEQ ID NO: 2359669 - protein, 9 aa, Entamoeba dispar
AEKSKNRKE

SEQ ID NO: 2359670 - protein, 14 aa, Entamoeba dispar
AELGDSSNNLPPPL

SEQ ID NO: 2359671 - protein, 10 aa, Entamoeba dispar
AELGSKDAVK

SEQ ID NO: 2359672 - protein, 4 aa, Entamoeba dispar
AELP

SEQ ID NO: 2359673 - protein, 26 aa, Entamoeba dispar
AELPSEQQNKEQEEGEDEKEEIPTLV

SEQ ID NO: 2359674 - protein, 10 aa, Entamoeba dispar
AEMEAQPDVD

SEQ ID NO: 2359675 - protein, 10 aa, Entamoeba dispar
AENKEKSYHK

SEQ ID NO: 2359676 - protein, 12 aa, Entamoeba dispar
AENLRRKEKRKN

SEQ ID NO: 2359677 - protein, 10 aa, Entamoeba dispar
AENPGGKYSN

SEQ ID NO: 2359678 - protein, 6 aa, Entamoeba dispar
AENPNL

SEQ ID NO: 2359679 - protein, 7 aa, Entamoeba dispar
AENQQDA

SEQ ID NO: 2359680 - protein, 6 aa, Entamoeba dispar
AENSRC

SEQ ID NO: 2359681 - protein, 5 aa, Entamoeba dispar
AEPSQ

SEQ ID NO: 2359682 - protein, 6 aa, Entamoeba dispar
AEQAPI

SEQ ID NO: 2359683 - protein, 7 aa, Entamoeba dispar
AEQENTI

SEQ ID NO: 2359684 - protein, 5 aa, Entamoeba dispar
AEQGE

SEQ ID NO: 2359685 - protein, 8 aa, Entamoeba dispar
AEQIKPND

SEQ ID NO: 2359686 - protein, 4 aa, Entamoeba dispar
AEQT

SEQ ID NO: 2359687 - protein, 4 aa, Entamoeba dispar
AERT

SEQ ID NO: 2359688 - protein, 5 aa, Entamoeba dispar
AESGS

SEQ ID NO: 2359689 - protein, 5 aa, Entamoeba dispar
AESIT

SEQ ID NO: 2359690 - protein, 7 aa, Entamoeba dispar
AESKLST

SEQ ID NO: 2359691 - protein, 5 aa, Entamoeba dispar
AESLE

SEQ ID NO: 2359692 - protein, 8 aa, Entamoeba dispar
AESNEGSI

SEQ ID NO: 2359693 - protein, 5 aa, Entamoeba dispar
AESSS

SEQ ID NO: 2359694 - protein, 8 aa, Entamoeba dispar
AESTEESI

SEQ ID NO: 2359695 - protein, 5 aa, Entamoeba dispar
AESTL

SEQ ID NO: 2359696 - protein, 9 aa, Entamoeba dispar
AESTLSTKL

SEQ ID NO: 2359697 - protein, 9 aa, Entamoeba dispar
AESTVSTKL

SEQ ID NO: 2359698 - protein, 10 aa, Entamoeba dispar
AESVAKEGAL

SEQ ID NO: 2359699 - protein, 11 aa, Entamoeba dispar
AETAPKEITTK

SEQ ID NO: 2359700 - protein, 4 aa, Entamoeba dispar
AETI

SEQ ID NO: 2359701 - protein, 6 aa, Entamoeba dispar
AETSIT

SEQ ID NO: 2359702 - protein, 8 aa, Entamoeba dispar
AETTAYSR

SEQ ID NO: 2359703 - protein, 8 aa, Entamoeba dispar
AETYDPRI

SEQ ID NO: 2359704 - protein, 9 aa, Entamoeba dispar
AEVPDYQGR

SEQ ID NO: 2359705 - protein, 11 aa, Entamoeba dispar
AEVRTSNLNEQ

SEQ ID NO: 2359706 - protein, 6 aa, Entamoeba dispar
AEYENS

SEQ ID NO: 2359707 - protein, 6 aa, Entamoeba dispar
AEYSGS

SEQ ID NO: 2359708 - protein, 5 aa, Entamoeba dispar
AFDAP

SEQ ID NO: 2359709 - protein, 10 aa, Entamoeba dispar
AFEKDHKKQY

SEQ ID NO: 2359710 - protein, 8 aa, Entamoeba dispar
AFEQNDPR

SEQ ID NO: 2359711 - protein, 8 aa, Entamoeba dispar
AFESQNEE

SEQ ID NO: 2359712 - protein, 8 aa, Entamoeba dispar
AFKKTDKT

SEQ ID NO: 2359713 - protein, 10 aa, Entamoeba dispar
AFKKTQNKVP

SEQ ID NO: 2359714 - protein, 4 aa, Entamoeba dispar
AFKN

SEQ ID NO: 2359715 - protein, 6 aa, Entamoeba dispar
AFNGTS

SEQ ID NO: 2359716 - protein, 5 aa, Entamoeba dispar
AFNPS

SEQ ID NO: 2359717 - protein, 4 aa, Entamoeba dispar
AFNT

SEQ ID NO: 2359718 - protein, 13 aa, Entamoeba dispar
AFSNGKGGSAQRM

SEQ ID NO: 2359719 - protein, 17 aa, Entamoeba dispar
AFTQETSSACTSSQSKG

SEQ ID NO: 2359720 - protein, 14 aa, Entamoeba dispar
AGAAAGDNPNAEKI

SEQ ID NO: 2359721 - protein, 8 aa, Entamoeba dispar
AGAIAEAT

SEQ ID NO: 2359722 - protein, 24 aa, Entamoeba dispar
AGAVGGLESHSDVKKEFAKKSQYY

SEQ ID NO: 2359723 - protein, 10 aa, Entamoeba dispar
AGDDAQFNQN

SEQ ID NO: 2359724 - protein, 8 aa, Entamoeba dispar
AGDGYSRT

SEQ ID NO: 2359725 - protein, 5 aa, Entamoeba dispar
AGEEQ

SEQ ID NO: 2359726 - protein, 9 aa, Entamoeba dispar
AGEKKTGSM

SEQ ID NO: 2359727 - protein, 4 aa, Entamoeba dispar
AGEV

SEQ ID NO: 2359728 - protein, 5 aa, Entamoeba dispar
AGGAG

SEQ ID NO: 2359729 - protein, 6 aa, Entamoeba dispar
AGGKSQ

SEQ ID NO: 2359730 - protein, 4 aa, Entamoeba dispar
AGGS

SEQ ID NO: 2359731 - protein, 8 aa, Entamoeba dispar
AGGSWGPL

SEQ ID NO: 2359732 - protein, 4 aa, Entamoeba dispar
AGHT

SEQ ID NO: 2359733 - protein, 10 aa, Entamoeba dispar
AGKASSTLET

SEQ ID NO: 2359734 - protein, 6 aa, Entamoeba dispar
AGKEGP

SEQ ID NO: 2359735 - protein, 8 aa, Entamoeba dispar
AGKGRTGL

SEQ ID NO: 2359736 - protein, 14 aa, Entamoeba dispar
AGKRPELKSPMPQE

SEQ ID NO: 2359737 - protein, 8 aa, Entamoeba dispar
AGKSKIKI

SEQ ID NO: 2359738 - protein, 5 aa, Entamoeba dispar
AGKTF

SEQ ID NO: 2359739 - protein, 6 aa, Entamoeba dispar
AGKTLN

SEQ ID NO: 2359740 - protein, 19 aa, Entamoeba dispar
AGKYKNGNSCSYCGPNQYS

SEQ ID NO: 2359741 - protein, 10 aa, Entamoeba dispar
AGLKENKTPY

SEQ ID NO: 2359742 - protein, 16 aa, Entamoeba dispar
AGNCNKGYYAENTSQI

SEQ ID NO: 2359743 - protein, 5 aa, Entamoeba dispar
AGNES

SEQ ID NO: 2359744 - protein, 16 aa, Entamoeba dispar
AGNGGNCELTHSGETY

SEQ ID NO: 2359745 - protein, 5 aa, Entamoeba dispar
AGNNK

SEQ ID NO: 2359746 - protein, 4 aa, Entamoeba dispar
AGPG

SEQ ID NO: 2359747 - protein, 5 aa, Entamoeba dispar
AGPND

SEQ ID NO: 2359748 - protein, 5 aa, Entamoeba dispar
AGPSM

SEQ ID NO: 2359749 - protein, 5 aa, Entamoeba dispar
AGPTK

SEQ ID NO: 2359750 - protein, 13 aa, Entamoeba dispar
AGQAGSPKTITGF

SEQ ID NO: 2359751 - protein, 5 aa, Entamoeba dispar
AGQNI

SEQ ID NO: 2359752 - protein, 8 aa, Entamoeba dispar
AGQSPTAV

SEQ ID NO: 2359753 - protein, 12 aa, Entamoeba dispar
AGRAGRDGKPSD

SEQ ID NO: 2359754 - protein, 9 aa, Entamoeba dispar
AGRASKALE

SEQ ID NO: 2359755 - protein, 10 aa, Entamoeba dispar
AGRDPTDSQS

SEQ ID NO: 2359756 - protein, 15 aa, Entamoeba dispar
AGRENSVASTKSFSS

SEQ ID NO: 2359757 - protein, 4 aa, Entamoeba dispar
AGRI

SEQ ID NO: 2359758 - protein, 8 aa, Entamoeba dispar
AGRKETQR

SEQ ID NO: 2359759 - protein, 9 aa, Entamoeba dispar
AGRNNLTEN

SEQ ID NO: 2359760 - protein, 5 aa, Entamoeba dispar
AGRTK

SEQ ID NO: 2359761 - protein, 6 aa, Entamoeba dispar
AGTATP

SEQ ID NO: 2359762 - protein, 10 aa, Entamoeba dispar
AGTKMTTPRA

SEQ ID NO: 2359763 - protein, 5 aa, Entamoeba dispar
AGTMG

SEQ ID NO: 2359764 - protein, 8 aa, Entamoeba dispar
AGTQATRA

SEQ ID NO: 2359765 - protein, 5 aa, Entamoeba dispar
AGTRK

SEQ ID NO: 2359766 - protein, 4 aa, Entamoeba dispar
AGTS

SEQ ID NO: 2359767 - protein, 6 aa, Entamoeba dispar
AGTSLH

SEQ ID NO: 2359768 - protein, 8 aa, Entamoeba dispar
AGTVGSSS

SEQ ID NO: 2359769 - protein, 9 aa, Entamoeba dispar
AGTVTSENW

SEQ ID NO: 2359770 - protein, 13 aa, Entamoeba dispar
AGTYSSITTANSC

SEQ ID NO: 2359771 - protein, 7 aa, Entamoeba dispar
AGVNDGN

SEQ ID NO: 2359772 - protein, 10 aa, Entamoeba dispar
AGYSLEKDTE

SEQ ID NO: 2359773 - protein, 9 aa, Entamoeba dispar
AHDKSLKKE

SEQ ID NO: 2359774 - protein, 8 aa, Entamoeba dispar
AHENNTKL

SEQ ID NO: 2359775 - protein, 5 aa, Entamoeba dispar
AHGIS

SEQ ID NO: 2359776 - protein, 5 aa, Entamoeba dispar
AHKGT

SEQ ID NO: 2359777 - protein, 9 aa, Entamoeba dispar
AHNPNGEQY

SEQ ID NO: 2359778 - protein, 6 aa, Entamoeba dispar
AHRNDG

SEQ ID NO: 2359779 - protein, 6 aa, Entamoeba dispar
AHTDAP

SEQ ID NO: 2359780 - protein, 8 aa, Entamoeba dispar
AIDEEESR

SEQ ID NO: 2359781 - protein, 7 aa, Entamoeba dispar
AIDSGAT

SEQ ID NO: 2359782 - protein, 27 aa, Entamoeba dispar
AIDTKGSITKLKSSSSLKEENTKRISG

SEQ ID NO: 2359783 - protein, 13 aa, Entamoeba dispar
AIEEDSKVDVASK

SEQ ID NO: 2359784 - protein, 8 aa, Entamoeba dispar
AIENQNTN

SEQ ID NO: 2359785 - protein, 17 aa, Entamoeba dispar
AIEYTKKGAQKAKETIQ

SEQ ID NO: 2359786 - protein, 18 aa, Entamoeba dispar
AIGGAIGGAIGGAIDGGV

SEQ ID NO: 2359787 - protein, 5 aa, Entamoeba dispar
AIGPQ

SEQ ID NO: 2359788 - protein, 7 aa, Entamoeba dispar
AIGQNSK

SEQ ID NO: 2359789 - protein, 8 aa, Entamoeba dispar
AIKENKEI

SEQ ID NO: 2359790 - protein, 8 aa, Entamoeba dispar
AINEPNAV

SEQ ID NO: 2359791 - protein, 12 aa, Entamoeba dispar
AINSKKSSISKA

SEQ ID NO: 2359792 - protein, 5 aa, Entamoeba dispar
AIPEA

SEQ ID NO: 2359793 - protein, 8 aa, Entamoeba dispar
AIPGGTNL

SEQ ID NO: 2359794 - protein, 7 aa, Entamoeba dispar
AIPNTEN

SEQ ID NO: 2359795 - protein, 5 aa, Entamoeba dispar
AIPSG

SEQ ID NO: 2359796 - protein, 10 aa, Entamoeba dispar
AIPSSVPKEM

SEQ ID NO: 2359797 - protein, 7 aa, Entamoeba dispar
AIPTAAQ

SEQ ID NO: 2359798 - protein, 14 aa, Entamoeba dispar
AIQRAGRAGRTSNG

SEQ ID NO: 2359799 - protein, 8 aa, Entamoeba dispar
AIQSATKK

SEQ ID NO: 2359800 - protein, 13 aa, Entamoeba dispar
AIRTASDNTVDSV

SEQ ID NO: 2359801 - protein, 6 aa, Entamoeba dispar
AISDPN

SEQ ID NO: 2359802 - protein, 32 aa, Entamoeba dispar
AISQNHSTNEIEIQNSNDNENKHKNDSIKRKK

SEQ ID NO: 2359803 - protein, 6 aa, Entamoeba dispar
AISSKS

SEQ ID NO: 2359804 - protein, 10 aa, Entamoeba dispar
AISSNDGDLM

SEQ ID NO: 2359805 - protein, 11 aa, Entamoeba dispar
AITSGKRPPII

SEQ ID NO: 2359806 - protein, 12 aa, Entamoeba dispar
AITSTSSNSRIK

SEQ ID NO: 2359807 - protein, 14 aa, Entamoeba dispar
AKAQAAHKAQYAAK

SEQ ID NO: 2359808 - protein, 7 aa, Entamoeba dispar
AKAQYKE

SEQ ID NO: 2359809 - protein, 29 aa, Entamoeba dispar
AKATEKSSSSSDSSSSSGSSRCPKPNIYN

SEQ ID NO: 2359810 - protein, 7 aa, Entamoeba dispar
AKATPPV

SEQ ID NO: 2359811 - protein, 5 aa, Entamoeba dispar
AKCLS

SEQ ID NO: 2359812 - protein, 9 aa, Entamoeba dispar
AKCNSSSCS

SEQ ID NO: 2359813 - protein, 19 aa, Entamoeba dispar
AKCQNGRNERITIRGKNQS

SEQ ID NO: 2359814 - protein, 9 aa, Entamoeba dispar
AKDNHSDSK

SEQ ID NO: 2359815 - protein, 6 aa, Entamoeba dispar
AKDSKC

SEQ ID NO: 2359816 - protein, 8 aa, Entamoeba dispar
AKDTQRDV

SEQ ID NO: 2359817 - protein, 9 aa, Entamoeba dispar
AKEAIQNPN

SEQ ID NO: 2359818 - protein, 7 aa, Entamoeba dispar
AKEEEPE

SEQ ID NO: 2359819 - protein, 17 aa, Entamoeba dispar
AKEEKKSSRKKLNGKRR

SEQ ID NO: 2359820 - protein, 5 aa, Entamoeba dispar
AKEGE

SEQ ID NO: 2359821 - protein, 30 aa, Entamoeba dispar
AKENNLATEESKLPEENPNEMLPADASKCE

SEQ ID NO: 2359822 - protein, 7 aa, Entamoeba dispar
AKEQMKK

SEQ ID NO: 2359823 - protein, 6 aa, Entamoeba dispar
AKERKK

SEQ ID NO: 2359824 - protein, 6 aa, Entamoeba dispar
AKERTI

SEQ ID NO: 2359825 - protein, 7 aa, Entamoeba dispar
AKESDSK

SEQ ID NO: 2359826 - protein, 9 aa, Entamoeba dispar
AKESLQQQG

SEQ ID NO: 2359827 - protein, 9 aa, Entamoeba dispar
AKGKGAEVV

SEQ ID NO: 2359828 - protein, 15 aa, Entamoeba dispar
AKGKSSNGSDGNFPT

SEQ ID NO: 2359829 - protein, 9 aa, Entamoeba dispar
AKGKTKKHR

SEQ ID NO: 2359830 - protein, 7 aa, Entamoeba dispar
AKISDRL

SEQ ID NO: 2359831 - protein, 14 aa, Entamoeba dispar
AKITKKETQTQSDS

SEQ ID NO: 2359832 - protein, 9 aa, Entamoeba dispar
AKKANSAIE

SEQ ID NO: 2359833 - protein, 9 aa, Entamoeba dispar
AKKFTETTN

SEQ ID NO: 2359834 - protein, 4 aa, Entamoeba dispar
AKKG

SEQ ID NO: 2359835 - protein, 13 aa, Entamoeba dispar
AKKKTEDGEYINP

SEQ ID NO: 2359836 - protein, 8 aa, Entamoeba dispar
AKKPKPVD

SEQ ID NO: 2359837 - protein, 5 aa, Entamoeba dispar
AKKRM

SEQ ID NO: 2359838 - protein, 22 aa, Entamoeba dispar
AKKTIEKEKRDEAQGLVPSKEI

SEQ ID NO: 2359839 - protein, 4 aa, Entamoeba dispar
AKLE

SEQ ID NO: 2359840 - protein, 9 aa, Entamoeba dispar
AKLSNEQID

SEQ ID NO: 2359841 - protein, 11 aa, Entamoeba dispar
AKNEAQKNEGI

SEQ ID NO: 2359842 - protein, 13 aa, Entamoeba dispar
AKNEKEMAFELIT

SEQ ID NO: 2359843 - protein, 11 aa, Entamoeba dispar
AKNGDCVEKPK

SEQ ID NO: 2359844 - protein, 10 aa, Entamoeba dispar
AKNGQINEKD

SEQ ID NO: 2359845 - protein, 7 aa, Entamoeba dispar
AKNIPND

SEQ ID NO: 2359846 - protein, 7 aa, Entamoeba dispar
AKNNENI

SEQ ID NO: 2359847 - protein, 10 aa, Entamoeba dispar
AKNNTDKINE

SEQ ID NO: 2359848 - protein, 8 aa, Entamoeba dispar
AKNSPQIL

SEQ ID NO: 2359849 - protein, 8 aa, Entamoeba dispar
AKNTDPGL

SEQ ID NO: 2359850 - protein, 12 aa, Entamoeba dispar
AKNTKGERAEFT

SEQ ID NO: 2359851 - protein, 10 aa, Entamoeba dispar
AKNVEQYKEA

SEQ ID NO: 2359852 - protein, 10 aa, Entamoeba dispar
AKNYIPDGIP

SEQ ID NO: 2359853 - protein, 7 aa, Entamoeba dispar
AKPDVLE

SEQ ID NO: 2359854 - protein, 32 aa, Entamoeba dispar
AKPFTRKNKTKITESSIESQSIGDISDESSII

SEQ ID NO: 2359855 - protein, 15 aa, Entamoeba dispar
AKPGNLKIKTGEEAS

SEQ ID NO: 2359856 - protein, 23 aa, Entamoeba dispar
AKPKTKDEKKQEKKEENEEEEIK

SEQ ID NO: 2359857 - protein, 7 aa, Entamoeba dispar
AKPNEIN

SEQ ID NO: 2359858 - protein, 13 aa, Entamoeba dispar
AKPPEELATTNEQ

SEQ ID NO: 2359859 - protein, 6 aa, Entamoeba dispar
AKPPLT

SEQ ID NO: 2359860 - protein, 9 aa, Entamoeba dispar
AKPQPSFNP

SEQ ID NO: 2359861 - protein, 7 aa, Entamoeba dispar
AKPTFSI

SEQ ID NO: 2359862 - protein, 7 aa, Entamoeba dispar
AKPTVGL

SEQ ID NO: 2359863 - protein, 6 aa, Entamoeba dispar
AKQEIE

SEQ ID NO: 2359864 - protein, 9 aa, Entamoeba dispar
AKQEITIKE

SEQ ID NO: 2359865 - protein, 7 aa, Entamoeba dispar
AKQINVN

SEQ ID NO: 2359866 - protein, 7 aa, Entamoeba dispar
AKQINVS

SEQ ID NO: 2359867 - protein, 4 aa, Entamoeba dispar
AKRG

SEQ ID NO: 2359868 - protein, 6 aa, Entamoeba dispar
AKRRYQ

SEQ ID NO: 2359869 - protein, 11 aa, Entamoeba dispar
AKSPLSDENRE

SEQ ID NO: 2359870 - protein, 9 aa, Entamoeba dispar
AKSTGLNDE

SEQ ID NO: 2359871 - protein, 9 aa, Entamoeba dispar
AKSYSTQPT

SEQ ID NO: 2359872 - protein, 21 aa, Entamoeba dispar
AKTAKNEIKEEEKQEKQEEIR

SEQ ID NO: 2359873 - protein, 21 aa, Entamoeba dispar
AKTAKNEIREEEKQEKQEEIR

SEQ ID NO: 2359874 - protein, 7 aa, Entamoeba dispar
AKTATSL

SEQ ID NO: 2359875 - protein, 4 aa, Entamoeba dispar
AKTC

SEQ ID NO: 2359876 - protein, 7 aa, Entamoeba dispar
AKTEQLN

SEQ ID NO: 2359877 - protein, 7 aa, Entamoeba dispar
AKTGYGV

SEQ ID NO: 2359878 - protein, 11 aa, Entamoeba dispar
AKTKEGSTTVE

SEQ ID NO: 2359879 - protein, 9 aa, Entamoeba dispar
AKTLTTSGD

SEQ ID NO: 2359880 - protein, 9 aa, Entamoeba dispar
AKTNAEYQN

SEQ ID NO: 2359881 - protein, 5 aa, Entamoeba dispar
AKTNE

SEQ ID NO: 2359882 - protein, 7 aa, Entamoeba dispar
AKTNPLF

SEQ ID NO: 2359883 - protein, 6 aa, Entamoeba dispar
AKTNRD

SEQ ID NO: 2359884 - protein, 5 aa, Entamoeba dispar
AKTPQ

SEQ ID NO: 2359885 - protein, 7 aa, Entamoeba dispar
AKTQGIK

SEQ ID NO: 2359886 - protein, 4 aa, Entamoeba dispar
AKTS

SEQ ID NO: 2359887 - protein, 5 aa, Entamoeba dispar
AKTSI

SEQ ID NO: 2359888 - protein, 9 aa, Entamoeba dispar
AKYDKNSTV

SEQ ID NO: 2359889 - protein, 5 aa, Entamoeba dispar
AKYFN

SEQ ID NO: 2359890 - protein, 5 aa, Entamoeba dispar
AKYGK

SEQ ID NO: 2359891 - protein, 9 aa, Entamoeba dispar
ALENGRITP

SEQ ID NO: 2359892 - protein, 9 aa, Entamoeba dispar
ALENNGTAQ

SEQ ID NO: 2359893 - protein, 10 aa, Entamoeba dispar
ALEPTEERFR

SEQ ID NO: 2359894 - protein, 5 aa, Entamoeba dispar
ALESP

SEQ ID NO: 2359895 - protein, 6 aa, Entamoeba dispar
ALESPY

SEQ ID NO: 2359896 - protein, 4 aa, Entamoeba dispar
ALGD

SEQ ID NO: 2359897 - protein, 8 aa, Entamoeba dispar
ALGGQEQW

SEQ ID NO: 2359898 - protein, 16 aa, Entamoeba dispar
ALGKQVKGEETIVGKQ

SEQ ID NO: 2359899 - protein, 10 aa, Entamoeba dispar
ALKDQDPYVR

SEQ ID NO: 2359900 - protein, 10 aa, Entamoeba dispar
ALKNQTSNSL

SEQ ID NO: 2359901 - protein, 16 aa, Entamoeba dispar
ALKSKNKKEEKEPKDV

SEQ ID NO: 2359902 - protein, 7 aa, Entamoeba dispar
ALKYSDN

SEQ ID NO: 2359903 - protein, 18 aa, Entamoeba dispar
ALNGSSQLEDDDHKQKRY

SEQ ID NO: 2359904 - protein, 19 aa, Entamoeba dispar
ALNNLKDKVNKKGIQDNTL

SEQ ID NO: 2359905 - protein, 12 aa, Entamoeba dispar
ALNNSDSMKTDD

SEQ ID NO: 2359906 - protein, 9 aa, Entamoeba dispar
ALPKSTPIS

SEQ ID NO: 2359907 - protein, 4 aa, Entamoeba dispar
ALPQ

SEQ ID NO: 2359908 - protein, 6 aa, Entamoeba dispar
ALPSPT

SEQ ID NO: 2359909 - protein, 6 aa, Entamoeba dispar
ALRDGS

SEQ ID NO: 2359910 - protein, 13 aa, Entamoeba dispar
ALRDSARNKDHNG

SEQ ID NO: 2359911 - protein, 8 aa, Entamoeba dispar
ALRGPEGT

SEQ ID NO: 2359912 - protein, 4 aa, Entamoeba dispar
ALSC

SEQ ID NO: 2359913 - protein, 11 aa, Entamoeba dispar
ALSERGKNEIE

SEQ ID NO: 2359914 - protein, 8 aa, Entamoeba dispar
ALSGGKKA

SEQ ID NO: 2359915 - protein, 8 aa, Entamoeba dispar
ALSQPDNL

SEQ ID NO: 2359916 - protein, 7 aa, Entamoeba dispar
ALSSTSN

SEQ ID NO: 2359917 - protein, 8 aa, Entamoeba dispar
AMAGKENR

SEQ ID NO: 2359918 - protein, 5 aa, Entamoeba dispar
AMENI

SEQ ID NO: 2359919 - protein, 6 aa, Entamoeba dispar
AMTSKN

SEQ ID NO: 2359920 - protein, 7 aa, Entamoeba dispar
AMTTGGV

SEQ ID NO: 2359921 - protein, 7 aa, Entamoeba dispar
ANAGKKY

SEQ ID NO: 2359922 - protein, 8 aa, Entamoeba dispar
ANAHNKSY

SEQ ID NO: 2359923 - protein, 21 aa, Entamoeba dispar
ANAIKTDTITASIRGENDSIQ

SEQ ID NO: 2359924 - protein, 12 aa, Entamoeba dispar
ANDENPKCKGES

SEQ ID NO: 2359925 - protein, 9 aa, Entamoeba dispar
ANDNNDEYK

SEQ ID NO: 2359926 - protein, 9 aa, Entamoeba dispar
ANDQEKDYA

SEQ ID NO: 2359927 - protein, 5 aa, Entamoeba dispar
ANDTY

SEQ ID NO: 2359928 - protein, 6 aa, Entamoeba dispar
ANECDP

SEQ ID NO: 2359929 - protein, 4 aa, Entamoeba dispar
ANEI

SEQ ID NO: 2359930 - protein, 8 aa, Entamoeba dispar
ANESQFDT

SEQ ID NO: 2359931 - protein, 6 aa, Entamoeba dispar
ANGARP

SEQ ID NO: 2359932 - protein, 5 aa, Entamoeba dispar
ANGEH

SEQ ID NO: 2359933 - protein, 7 aa, Entamoeba dispar
ANGENVQ

SEQ ID NO: 2359934 - protein, 7 aa, Entamoeba dispar
ANGGSTE

SEQ ID NO: 2359935 - protein, 16 aa, Entamoeba dispar
ANGKRTNQIEKVTNQQ

SEQ ID NO: 2359936 - protein, 8 aa, Entamoeba dispar
ANGQTQTV

SEQ ID NO: 2359937 - protein, 7 aa, Entamoeba dispar
ANHATQV

SEQ ID NO: 2359938 - protein, 4 aa, Entamoeba dispar
ANID

SEQ ID NO: 2359939 - protein, 8 aa, Entamoeba dispar
ANKDTEVG

SEQ ID NO: 2359940 - protein, 10 aa, Entamoeba dispar
ANKKDIDPYG

SEQ ID NO: 2359941 - protein, 7 aa, Entamoeba dispar
ANKTKKK

SEQ ID NO: 2359942 - protein, 12 aa, Entamoeba dispar
ANKTNAKTRNAK

SEQ ID NO: 2359943 - protein, 12 aa, Entamoeba dispar
ANKVQGDSPADF

SEQ ID NO: 2359944 - protein, 8 aa, Entamoeba dispar
ANNCTGQN

SEQ ID NO: 2359945 - protein, 6 aa, Entamoeba dispar
ANNGYQ

SEQ ID NO: 2359946 - protein, 6 aa, Entamoeba dispar
ANNHSC

SEQ ID NO: 2359947 - protein, 5 aa, Entamoeba dispar
ANNKF

SEQ ID NO: 2359948 - protein, 6 aa, Entamoeba dispar
ANPFKA

SEQ ID NO: 2359949 - protein, 6 aa, Entamoeba dispar
ANPLKD

SEQ ID NO: 2359950 - protein, 4 aa, Entamoeba dispar
ANPN

SEQ ID NO: 2359951 - protein, 5 aa, Entamoeba dispar
ANPND

SEQ ID NO: 2359952 - protein, 5 aa, Entamoeba dispar
ANPNH

SEQ ID NO: 2359953 - protein, 6 aa, Entamoeba dispar
ANPSDA

SEQ ID NO: 2359954 - protein, 10 aa, Entamoeba dispar
ANQEPRVNRT

SEQ ID NO: 2359955 - protein, 6 aa, Entamoeba dispar
ANQYQR

SEQ ID NO: 2359956 - protein, 4 aa, Entamoeba dispar
ANRQ

SEQ ID NO: 2359957 - protein, 5 aa, Entamoeba dispar
ANSDE

SEQ ID NO: 2359958 - protein, 7 aa, Entamoeba dispar
ANSDGAI

SEQ ID NO: 2359959 - protein, 7 aa, Entamoeba dispar
ANSDGTV

SEQ ID NO: 2359960 - protein, 4 aa, Entamoeba dispar
ANSE

SEQ ID NO: 2359961 - protein, 10 aa, Entamoeba dispar
ANSHTNTKNL

SEQ ID NO: 2359962 - protein, 4 aa, Entamoeba dispar
ANSI

SEQ ID NO: 2359963 - protein, 10 aa, Entamoeba dispar
ANSKKLIEGT

SEQ ID NO: 2359964 - protein, 9 aa, Entamoeba dispar
ANSNKKELT

SEQ ID NO: 2359965 - protein, 8 aa, Entamoeba dispar
ANSRGIDP

SEQ ID NO: 2359966 - protein, 6 aa, Entamoeba dispar
ANSSET

SEQ ID NO: 2359967 - protein, 9 aa, Entamoeba dispar
ANSYSINDK

SEQ ID NO: 2359968 - protein, 5 aa, Entamoeba dispar
ANTDP

SEQ ID NO: 2359969 - protein, 11 aa, Entamoeba dispar
ANTFKKQSHEM

SEQ ID NO: 2359970 - protein, 11 aa, Entamoeba dispar
ANTFKKQSHQM

SEQ ID NO: 2359971 - protein, 12 aa, Entamoeba dispar
ANTISTGKRPKI

SEQ ID NO: 2359972 - protein, 9 aa, Entamoeba dispar
ANTKIENEM

SEQ ID NO: 2359973 - protein, 4 aa, Entamoeba dispar
ANTL

SEQ ID NO: 2359974 - protein, 4 aa, Entamoeba dispar
ANTN

SEQ ID NO: 2359975 - protein, 7 aa, Entamoeba dispar
ANTPWPS

SEQ ID NO: 2359976 - protein, 19 aa, Entamoeba dispar
ANTTKGMDDLPQNPSIYTT

SEQ ID NO: 2359977 - protein, 8 aa, Entamoeba dispar
ANVGPDKC

SEQ ID NO: 2359978 - protein, 5 aa, Entamoeba dispar
ANVGQ

SEQ ID NO: 2359979 - protein, 9 aa, Entamoeba dispar
ANVPGKKSP

SEQ ID NO: 2359980 - protein, 5 aa, Entamoeba dispar
ANYNG

SEQ ID NO: 2359981 - protein, 5 aa, Entamoeba dispar
ANYTD

SEQ ID NO: 2359982 - protein, 5 aa, Entamoeba dispar
APAKY

SEQ ID NO: 2359983 - protein, 5 aa, Entamoeba dispar
APATS

SEQ ID NO: 2359984 - protein, 9 aa, Entamoeba dispar
APDDGQFSG

SEQ ID NO: 2359985 - protein, 5 aa, Entamoeba dispar
APDIP

SEQ ID NO: 2359986 - protein, 6 aa, Entamoeba dispar
APDLKD

SEQ ID NO: 2359987 - protein, 6 aa, Entamoeba dispar
APEANF

SEQ ID NO: 2359988 - protein, 5 aa, Entamoeba dispar
APECP

SEQ ID NO: 2359989 - protein, 5 aa, Entamoeba dispar
APEEY

SEQ ID NO: 2359990 - protein, 9 aa, Entamoeba dispar
APEGKEGKR

SEQ ID NO: 2359991 - protein, 5 aa, Entamoeba dispar
APENI

SEQ ID NO: 2359992 - protein, 5 aa, Entamoeba dispar
APENK

SEQ ID NO: 2359993 - protein, 7 aa, Entamoeba dispar
APESLRS

SEQ ID NO: 2359994 - protein, 6 aa, Entamoeba dispar
APFEMT

SEQ ID NO: 2359995 - protein, 11 aa, Entamoeba dispar
APGARGDQCDS

SEQ ID NO: 2359996 - protein, 5 aa, Entamoeba dispar
APGAY

SEQ ID NO: 2359997 - protein, 17 aa, Entamoeba dispar
APGCKECDDDQHYPNST

SEQ ID NO: 2359998 - protein, 8 aa, Entamoeba dispar
APGFGEDD

SEQ ID NO: 2359999 - protein, 14 aa, Entamoeba dispar
APGQYLNETTGECE

SEQ ID NO: 2360000 - protein, 12 aa, Entamoeba dispar
APGSSEQSWGRH

SEQ ID NO: 2360001 - protein, 7 aa, Entamoeba dispar
APGSTNH

SEQ ID NO: 2360002 - protein, 10 aa, Entamoeba dispar
APGYYRSSER

SEQ ID NO: 2360003 - protein, 5 aa, Entamoeba dispar
APHDG

SEQ ID NO: 2360004 - protein, 4 aa, Entamoeba dispar
APIE

SEQ ID NO: 2360005 - protein, 12 aa, Entamoeba dispar
APIIEEKKKEIS

SEQ ID NO: 2360006 - protein, 4 aa, Entamoeba dispar
APKH

SEQ ID NO: 2360007 - protein, 16 aa, Entamoeba dispar
APKINERATYAPLEEG

SEQ ID NO: 2360008 - protein, 7 aa, Entamoeba dispar
APKLPEE

SEQ ID NO: 2360009 - protein, 10 aa, Entamoeba dispar
APKPWSTNEL

SEQ ID NO: 2360010 - protein, 12 aa, Entamoeba dispar
APKQLEEEKSYL

SEQ ID NO: 2360011 - protein, 13 aa, Entamoeba dispar
APKVEDDIPKEED

SEQ ID NO: 2360012 - protein, 4 aa, Entamoeba dispar
APLG

SEQ ID NO: 2360013 - protein, 6 aa, Entamoeba dispar
APLPKR

SEQ ID NO: 2360014 - protein, 7 aa, Entamoeba dispar
APLPSRL

SEQ ID NO: 2360015 - protein, 5 aa, Entamoeba dispar
APLRQ

SEQ ID NO: 2360016 - protein, 11 aa, Entamoeba dispar
APLSSRQSERE

SEQ ID NO: 2360017 - protein, 8 aa, Entamoeba dispar
APNEAFYD

SEQ ID NO: 2360018 - protein, 12 aa, Entamoeba dispar
APNFAQPKPTNV

SEQ ID NO: 2360019 - protein, 12 aa, Entamoeba dispar
APNFIQPKPTNV

SEQ ID NO: 2360020 - protein, 7 aa, Entamoeba dispar
APNIKNA

SEQ ID NO: 2360021 - protein, 4 aa, Entamoeba dispar
APNV

SEQ ID NO: 2360022 - protein, 8 aa, Entamoeba dispar
APPAEEGC

SEQ ID NO: 2360023 - protein, 5 aa, Entamoeba dispar
APPAI

SEQ ID NO: 2360024 - protein, 5 aa, Entamoeba dispar
APPLG

SEQ ID NO: 2360025 - protein, 5 aa, Entamoeba dispar
APQNA

SEQ ID NO: 2360026 - protein, 10 aa, Entamoeba dispar
APQPVNTTPY

SEQ ID NO: 2360027 - protein, 5 aa, Entamoeba dispar
APRDD

SEQ ID NO: 2360028 - protein, 5 aa, Entamoeba dispar
APRYD

SEQ ID NO: 2360029 - protein, 8 aa, Entamoeba dispar
APSPPLEV

SEQ ID NO: 2360030 - protein, 11 aa, Entamoeba dispar
APSPSPAINSS

SEQ ID NO: 2360031 - protein, 8 aa, Entamoeba dispar
APSPTFEE

SEQ ID NO: 2360032 - protein, 10 aa, Entamoeba dispar
APSTSSNRKT

SEQ ID NO: 2360033 - protein, 6 aa, Entamoeba dispar
APSTTL

SEQ ID NO: 2360034 - protein, 4 aa, Entamoeba dispar
APSY

SEQ ID NO: 2360035 - protein, 17 aa, Entamoeba dispar
APTEDGVPNMPQMDPTS

SEQ ID NO: 2360036 - protein, 8 aa, Entamoeba dispar
APTNVAAS

SEQ ID NO: 2360037 - protein, 7 aa, Entamoeba dispar
APTPKNL

SEQ ID NO: 2360038 - protein, 6 aa, Entamoeba dispar
APTPSL

SEQ ID NO: 2360039 - protein, 4 aa, Entamoeba dispar
APTT

SEQ ID NO: 2360040 - protein, 4 aa, Entamoeba dispar
APVD

SEQ ID NO: 2360041 - protein, 5 aa, Entamoeba dispar
APYGS

SEQ ID NO: 2360042 - protein, 5 aa, Entamoeba dispar
APYNN

SEQ ID NO: 2360043 - protein, 13 aa, Entamoeba dispar
AQAKNKSQNQVKN

SEQ ID NO: 2360044 - protein, 7 aa, Entamoeba dispar
AQCTTNG

SEQ ID NO: 2360045 - protein, 5 aa, Entamoeba dispar
AQDDP

SEQ ID NO: 2360046 - protein, 6 aa, Entamoeba dispar
AQDPLN

SEQ ID NO: 2360047 - protein, 7 aa, Entamoeba dispar
AQEPTSY

SEQ ID NO: 2360048 - protein, 24 aa, Entamoeba dispar
AQETNEDLQDFNEEENLQTPQPEF

SEQ ID NO: 2360049 - protein, 12 aa, Entamoeba dispar
AQETNPTNTNCR

SEQ ID NO: 2360050 - protein, 27 aa, Entamoeba dispar
AQEYAKKINDAVQHTSNRKSDRESFEA

SEQ ID NO: 2360051 - protein, 7 aa, Entamoeba dispar
AQGEGVN

SEQ ID NO: 2360052 - protein, 8 aa, Entamoeba dispar
AQGFQGFS

SEQ ID NO: 2360053 - protein, 5 aa, Entamoeba dispar
AQGHP

SEQ ID NO: 2360054 - protein, 5 aa, Entamoeba dispar
AQIDR

SEQ ID NO: 2360055 - protein, 8 aa, Entamoeba dispar
AQKRDNFQ

SEQ ID NO: 2360056 - protein, 8 aa, Entamoeba dispar
AQNPKERL

SEQ ID NO: 2360057 - protein, 15 aa, Entamoeba dispar
AQNPSNSDYIDATPR

SEQ ID NO: 2360058 - protein, 9 aa, Entamoeba dispar
AQNSASTSL

SEQ ID NO: 2360059 - protein, 62 aa, Entamoeba dispar
AQNSQSSQNSEMDNRSHSSNTNNTSNSQPQKSTPSSSKTTNSKSNKSDKSSSKKKKGKSKVS

SEQ ID NO: 2360060 - protein, 71 aa, Entamoeba dispar
AQNSQSSQNSESEGGRSLSSANNNANSSSKQLSSNGQKSHPSKSHASGSTKSKSDSETSTKKKKKGKSKIS

SEQ ID NO: 2360061 - protein, 10 aa, Entamoeba dispar
AQPINDKNNI

SEQ ID NO: 2360062 - protein, 6 aa, Entamoeba dispar
AQPNVT

SEQ ID NO: 2360063 - protein, 14 aa, Entamoeba dispar
AQPPPMGQPVQQQQ

SEQ ID NO: 2360064 - protein, 7 aa, Entamoeba dispar
AQPPTTV

SEQ ID NO: 2360065 - protein, 10 aa, Entamoeba dispar
AQPSSLTTSI

SEQ ID NO: 2360066 - protein, 6 aa, Entamoeba dispar
AQPTTH

SEQ ID NO: 2360067 - protein, 6 aa, Entamoeba dispar
AQPVDN

SEQ ID NO: 2360068 - protein, 9 aa, Entamoeba dispar
AQQGNVKGM

SEQ ID NO: 2360069 - protein, 4 aa, Entamoeba dispar
AQQK

SEQ ID NO: 2360070 - protein, 9 aa, Entamoeba dispar
AQQVTEDEF

SEQ ID NO: 2360071 - protein, 15 aa, Entamoeba dispar
AQREEVRKHEAEGTV

SEQ ID NO: 2360072 - protein, 10 aa, Entamoeba dispar
AQRIRKPNRF

SEQ ID NO: 2360073 - protein, 8 aa, Entamoeba dispar
AQRKIESD

SEQ ID NO: 2360074 - protein, 4 aa, Entamoeba dispar
AQRT

SEQ ID NO: 2360075 - protein, 11 aa, Entamoeba dispar
AQRTGGQGEPY

SEQ ID NO: 2360076 - protein, 8 aa, Entamoeba dispar
AQSDYDGN

SEQ ID NO: 2360077 - protein, 10 aa, Entamoeba dispar
AQSEEKRCTQ

SEQ ID NO: 2360078 - protein, 11 aa, Entamoeba dispar
AQSEGNTQSYA

SEQ ID NO: 2360079 - protein, 4 aa, Entamoeba dispar
AQSG

SEQ ID NO: 2360080 - protein, 4 aa, Entamoeba dispar
AQSI

SEQ ID NO: 2360081 - protein, 8 aa, Entamoeba dispar
AQSNAVGK

SEQ ID NO: 2360082 - protein, 6 aa, Entamoeba dispar
AQSNFS

SEQ ID NO: 2360083 - protein, 6 aa, Entamoeba dispar
AQSNLS

SEQ ID NO: 2360084 - protein, 5 aa, Entamoeba dispar
AQSTN

SEQ ID NO: 2360085 - protein, 14 aa, Entamoeba dispar
AQTTQNSLSCDTDN

SEQ ID NO: 2360086 - protein, 4 aa, Entamoeba dispar
ARAS

SEQ ID NO: 2360087 - protein, 12 aa, Entamoeba dispar
ARDEEDLKRKEE

SEQ ID NO: 2360088 - protein, 14 aa, Entamoeba dispar
ARDVSNGATSANSG

SEQ ID NO: 2360089 - protein, 5 aa, Entamoeba dispar
AREGY

SEQ ID NO: 2360090 - protein, 29 aa, Entamoeba dispar
AREKKTSKVKPNTIQPHKITSSNSPLSNS

SEQ ID NO: 2360091 - protein, 7 aa, Entamoeba dispar
ARESREI

SEQ ID NO: 2360092 - protein, 22 aa, Entamoeba dispar
AREYDNDPYTLTAKASGKTGLE

SEQ ID NO: 2360093 - protein, 6 aa, Entamoeba dispar
ARGELS

SEQ ID NO: 2360094 - protein, 11 aa, Entamoeba dispar
ARGPVASGVSP

SEQ ID NO: 2360095 - protein, 32 aa, Entamoeba dispar
ARGSNSRATESSELNTGTTQTETTTTTTTLTT

SEQ ID NO: 2360096 - protein, 6 aa, Entamoeba dispar
ARHSQK

SEQ ID NO: 2360097 - protein, 7 aa, Entamoeba dispar
ARIGNPQ

SEQ ID NO: 2360098 - protein, 20 aa, Entamoeba dispar
ARKYQKKESNEQVEMESGPV

SEQ ID NO: 2360099 - protein, 13 aa, Entamoeba dispar
ARNLTEEQTKEFN

SEQ ID NO: 2360100 - protein, 13 aa, Entamoeba dispar
ARNMTQEQEKEFT

SEQ ID NO: 2360101 - protein, 7 aa, Entamoeba dispar
ARNSSGA

SEQ ID NO: 2360102 - protein, 6 aa, Entamoeba dispar
ARPVKD

SEQ ID NO: 2360103 - protein, 29 aa, Entamoeba dispar
ARRKSVKGVSSNLEDDINYEQSTNTEDGI

SEQ ID NO: 2360104 - protein, 11 aa, Entamoeba dispar
ARRPKKVGSVK

SEQ ID NO: 2360105 - protein, 11 aa, Entamoeba dispar
ARSAEGKDGDL

SEQ ID NO: 2360106 - protein, 17 aa, Entamoeba dispar
ARSEGRKEIKENGGENE

SEQ ID NO: 2360107 - protein, 13 aa, Entamoeba dispar
ARSKLSTKLDEDE

SEQ ID NO: 2360108 - protein, 6 aa, Entamoeba dispar
ARTNPS

SEQ ID NO: 2360109 - protein, 8 aa, Entamoeba dispar
ARTSGAAA

SEQ ID NO: 2360110 - protein, 8 aa, Entamoeba dispar
ARTSTCTQ

SEQ ID NO: 2360111 - protein, 4 aa, Entamoeba dispar
ASAG

SEQ ID NO: 2360112 - protein, 10 aa, Entamoeba dispar
ASAGAIAEAT

SEQ ID NO: 2360113 - protein, 7 aa, Entamoeba dispar
ASAGRQR

SEQ ID NO: 2360114 - protein, 4 aa, Entamoeba dispar
ASAL

SEQ ID NO: 2360115 - protein, 5 aa, Entamoeba dispar
ASANT

SEQ ID NO: 2360116 - protein, 8 aa, Entamoeba dispar
ASASTDID

SEQ ID NO: 2360117 - protein, 6 aa, Entamoeba dispar
ASATEA

SEQ ID NO: 2360118 - protein, 6 aa, Entamoeba dispar
ASCTSC

SEQ ID NO: 2360119 - protein, 6 aa, Entamoeba dispar
ASDHTH

SEQ ID NO: 2360120 - protein, 9 aa, Entamoeba dispar
ASDKKASQL

SEQ ID NO: 2360121 - protein, 16 aa, Entamoeba dispar
ASDKQTHLPGFSDNSD

SEQ ID NO: 2360122 - protein, 5 aa, Entamoeba dispar
ASDLA

SEQ ID NO: 2360123 - protein, 9 aa, Entamoeba dispar
ASDLSNATN

SEQ ID NO: 2360124 - protein, 9 aa, Entamoeba dispar
ASDQSTNQT

SEQ ID NO: 2360125 - protein, 7 aa, Entamoeba dispar
ASDTNYS

SEQ ID NO: 2360126 - protein, 8 aa, Entamoeba dispar
ASEDKRVQ

SEQ ID NO: 2360127 - protein, 5 aa, Entamoeba dispar
ASEDN

SEQ ID NO: 2360128 - protein, 10 aa, Entamoeba dispar
ASEGSTSDSL

SEQ ID NO: 2360129 - protein, 5 aa, Entamoeba dispar
ASEIQ

SEQ ID NO: 2360130 - protein, 5 aa, Entamoeba dispar
ASEKE

SEQ ID NO: 2360131 - protein, 10 aa, Entamoeba dispar
ASEKEKGKYM

SEQ ID NO: 2360132 - protein, 4 aa, Entamoeba dispar
ASEN

SEQ ID NO: 2360133 - protein, 6 aa, Entamoeba dispar
ASEQVS

SEQ ID NO: 2360134 - protein, 4 aa, Entamoeba dispar
ASET

SEQ ID NO: 2360135 - protein, 8 aa, Entamoeba dispar
ASEVGRVK

SEQ ID NO: 2360136 - protein, 7 aa, Entamoeba dispar
ASFSYGR

SEQ ID NO: 2360137 - protein, 16 aa, Entamoeba dispar
ASGEYIRDDSNAKTCC

SEQ ID NO: 2360138 - protein, 15 aa, Entamoeba dispar
ASGGSCSYGPQSTNI

SEQ ID NO: 2360139 - protein, 6 aa, Entamoeba dispar
ASGNSV

SEQ ID NO: 2360140 - protein, 6 aa, Entamoeba dispar
ASGSTV

SEQ ID NO: 2360141 - protein, 8 aa, Entamoeba dispar
ASGTSLPL

SEQ ID NO: 2360142 - protein, 14 aa, Entamoeba dispar
ASGYKGYPECKNYT

SEQ ID NO: 2360143 - protein, 8 aa, Entamoeba dispar
ASIAGAAL

SEQ ID NO: 2360144 - protein, 4 aa, Entamoeba dispar
ASIG

SEQ ID NO: 2360145 - protein, 10 aa, Entamoeba dispar
ASKAIDTEGT

SEQ ID NO: 2360146 - protein, 10 aa, Entamoeba dispar
ASKEEDAMKT

SEQ ID NO: 2360147 - protein, 7 aa, Entamoeba dispar
ASKEGIE

SEQ ID NO: 2360148 - protein, 13 aa, Entamoeba dispar
ASKGDEESIEEDH

SEQ ID NO: 2360149 - protein, 15 aa, Entamoeba dispar
ASKKVLKKYSISTSY

SEQ ID NO: 2360150 - protein, 7 aa, Entamoeba dispar
ASKNDGM

SEQ ID NO: 2360151 - protein, 17 aa, Entamoeba dispar
ASKTNDNDISLQWDVRE

SEQ ID NO: 2360152 - protein, 7 aa, Entamoeba dispar
ASKTRSY

SEQ ID NO: 2360153 - protein, 19 aa, Entamoeba dispar
ASLKQKSGTLTVNANSNSL

SEQ ID NO: 2360154 - protein, 6 aa, Entamoeba dispar
ASLNSY

SEQ ID NO: 2360155 - protein, 5 aa, Entamoeba dispar
ASLQQ

SEQ ID NO: 2360156 - protein, 13 aa, Entamoeba dispar
ASMDASTAGTALT

SEQ ID NO: 2360157 - protein, 7 aa, Entamoeba dispar
ASNATII

SEQ ID NO: 2360158 - protein, 10 aa, Entamoeba dispar
ASNGDLSDSH

SEQ ID NO: 2360159 - protein, 6 aa, Entamoeba dispar
ASNNFK

SEQ ID NO: 2360160 - protein, 5 aa, Entamoeba dispar
ASNPI

SEQ ID NO: 2360161 - protein, 6 aa, Entamoeba dispar
ASNPSK

SEQ ID NO: 2360162 - protein, 7 aa, Entamoeba dispar
ASNQAGR

SEQ ID NO: 2360163 - protein, 6 aa, Entamoeba dispar
ASNSDL

SEQ ID NO: 2360164 - protein, 6 aa, Entamoeba dispar
ASNSEI

SEQ ID NO: 2360165 - protein, 8 aa, Entamoeba dispar
ASNSRCTS

SEQ ID NO: 2360166 - protein, 10 aa, Entamoeba dispar
ASPDDSKNEI

SEQ ID NO: 2360167 - protein, 5 aa, Entamoeba dispar
ASPEI

SEQ ID NO: 2360168 - protein, 5 aa, Entamoeba dispar
ASPEK

SEQ ID NO: 2360169 - protein, 4 aa, Entamoeba dispar
ASPI

SEQ ID NO: 2360170 - protein, 5 aa, Entamoeba dispar
ASPKK

SEQ ID NO: 2360171 - protein, 9 aa, Entamoeba dispar
ASPKNGVER

SEQ ID NO: 2360172 - protein, 7 aa, Entamoeba dispar
ASPNQHL

SEQ ID NO: 2360173 - protein, 10 aa, Entamoeba dispar
ASPQQPQNEI

SEQ ID NO: 2360174 - protein, 12 aa, Entamoeba dispar
ASPTSSSIPQSQ

SEQ ID NO: 2360175 - protein, 10 aa, Entamoeba dispar
ASPTSTPKGV

SEQ ID NO: 2360176 - protein, 5 aa, Entamoeba dispar
ASQDE

SEQ ID NO: 2360177 - protein, 13 aa, Entamoeba dispar
ASREKDKMNVPDK

SEQ ID NO: 2360178 - protein, 9 aa, Entamoeba dispar
ASRKRKITN

SEQ ID NO: 2360179 - protein, 4 aa, Entamoeba dispar
ASRS

SEQ ID NO: 2360180 - protein, 13 aa, Entamoeba dispar
ASRSENKLKETQE

SEQ ID NO: 2360181 - protein, 6 aa, Entamoeba dispar
ASRTEQ

SEQ ID NO: 2360182 - protein, 17 aa, Entamoeba dispar
ASRYEQRKQSMKSIEDE

SEQ ID NO: 2360183 - protein, 8 aa, Entamoeba dispar
ASSIDDGK

SEQ ID NO: 2360184 - protein, 5 aa, Entamoeba dispar
ASSKI

SEQ ID NO: 2360185 - protein, 9 aa, Entamoeba dispar
ASSKNFQEN

SEQ ID NO: 2360186 - protein, 20 aa, Entamoeba dispar
ASSLELSPSGCDSGTHYTRG

SEQ ID NO: 2360187 - protein, 6 aa, Entamoeba dispar
ASSNYS

SEQ ID NO: 2360188 - protein, 4 aa, Entamoeba dispar
ASSP

SEQ ID NO: 2360189 - protein, 6 aa, Entamoeba dispar
ASSPRL

SEQ ID NO: 2360190 - protein, 7 aa, Entamoeba dispar
ASSSFKT

SEQ ID NO: 2360191 - protein, 7 aa, Entamoeba dispar
ASSTNPL

SEQ ID NO: 2360192 - protein, 8 aa, Entamoeba dispar
ASSTNPVT

SEQ ID NO: 2360193 - protein, 6 aa, Entamoeba dispar
ASSYQQ

SEQ ID NO: 2360194 - protein, 6 aa, Entamoeba dispar
ASSYQY

SEQ ID NO: 2360195 - protein, 7 aa, Entamoeba dispar
ASTANLG

SEQ ID NO: 2360196 - protein, 9 aa, Entamoeba dispar
ASTCGTESN

SEQ ID NO: 2360197 - protein, 11 aa, Entamoeba dispar
ASTGSQNFGNI

SEQ ID NO: 2360198 - protein, 5 aa, Entamoeba dispar
ASTLG

SEQ ID NO: 2360199 - protein, 4 aa, Entamoeba dispar
ASTN

SEQ ID NO: 2360200 - protein, 4 aa, Entamoeba dispar
ASTR

SEQ ID NO: 2360201 - protein, 10 aa, Entamoeba dispar
ASTSPDALDR

SEQ ID NO: 2360202 - protein, 11 aa, Entamoeba dispar
ASTTKLDGNTL

SEQ ID NO: 2360203 - protein, 5 aa, Entamoeba dispar
ASVKG

SEQ ID NO: 2360204 - protein, 6 aa, Entamoeba dispar
ASVSTS

SEQ ID NO: 2360205 - protein, 5 aa, Entamoeba dispar
ASVTI

SEQ ID NO: 2360206 - protein, 7 aa, Entamoeba dispar
ASVTSNP

SEQ ID NO: 2360207 - protein, 5 aa, Entamoeba dispar
ASYAI

SEQ ID NO: 2360208 - protein, 7 aa, Entamoeba dispar
ASYPYGG

SEQ ID NO: 2360209 - protein, 11 aa, Entamoeba dispar
ASYQTSGNSGK

SEQ ID NO: 2360210 - protein, 10 aa, Entamoeba dispar
ASYSCDNPEQ

SEQ ID NO: 2360211 - protein, 6 aa, Entamoeba dispar
ATAEEL

SEQ ID NO: 2360212 - protein, 13 aa, Entamoeba dispar
ATAEELEGQTGDM

SEQ ID NO: 2360213 - protein, 5 aa, Entamoeba dispar
ATANS

SEQ ID NO: 2360214 - protein, 18 aa, Entamoeba dispar
ATANSSSISTNGKKIHEE

SEQ ID NO: 2360215 - protein, 8 aa, Entamoeba dispar
ATAPDDFD

SEQ ID NO: 2360216 - protein, 10 aa, Entamoeba dispar
ATAQGQRPSL

SEQ ID NO: 2360217 - protein, 6 aa, Entamoeba dispar
ATASGF

SEQ ID NO: 2360218 - protein, 7 aa, Entamoeba dispar
ATASPED

SEQ ID NO: 2360219 - protein, 6 aa, Entamoeba dispar
ATATRQ

SEQ ID NO: 2360220 - protein, 17 aa, Entamoeba dispar
ATCEENPDPEVKEYKPA

SEQ ID NO: 2360221 - protein, 4 aa, Entamoeba dispar
ATDK

SEQ ID NO: 2360222 - protein, 10 aa, Entamoeba dispar
ATDKKKYERV

SEQ ID NO: 2360223 - protein, 10 aa, Entamoeba dispar
ATDKQLNTSN

SEQ ID NO: 2360224 - protein, 18 aa, Entamoeba dispar
ATDSRQVRLGSSESSSIS

SEQ ID NO: 2360225 - protein, 4 aa, Entamoeba dispar
ATEC

SEQ ID NO: 2360226 - protein, 19 aa, Entamoeba dispar
ATEEEPTDQVTDEARNTYT

SEQ ID NO: 2360227 - protein, 7 aa, Entamoeba dispar
ATEEGKS

SEQ ID NO: 2360228 - protein, 13 aa, Entamoeba dispar
ATEESYNKYEVDN

SEQ ID NO: 2360229 - protein, 4 aa, Entamoeba dispar
ATEI

SEQ ID NO: 2360230 - protein, 14 aa, Entamoeba dispar
ATEKCNEDGCKECQ

SEQ ID NO: 2360231 - protein, 8 aa, Entamoeba dispar
ATEKGNND

SEQ ID NO: 2360232 - protein, 5 aa, Entamoeba dispar
ATELC

SEQ ID NO: 2360233 - protein, 6 aa, Entamoeba dispar
ATENDV

SEQ ID NO: 2360234 - protein, 6 aa, Entamoeba dispar
ATERVK

SEQ ID NO: 2360235 - protein, 5 aa, Entamoeba dispar
ATETN

SEQ ID NO: 2360236 - protein, 5 aa, Entamoeba dispar
ATEVG

SEQ ID NO: 2360237 - protein, 11 aa, Entamoeba dispar
ATEVRNNVSKA

SEQ ID NO: 2360238 - protein, 5 aa, Entamoeba dispar
ATGRF

SEQ ID NO: 2360239 - protein, 7 aa, Entamoeba dispar
ATGVSED

SEQ ID NO: 2360240 - protein, 13 aa, Entamoeba dispar
ATHAGQTATTDTH

SEQ ID NO: 2360241 - protein, 11 aa, Entamoeba dispar
ATHGSKTNINA

SEQ ID NO: 2360242 - protein, 4 aa, Entamoeba dispar
ATIG

SEQ ID NO: 2360243 - protein, 8 aa, Entamoeba dispar
ATKGYTEA

SEQ ID NO: 2360244 - protein, 7 aa, Entamoeba dispar
ATKITGN

SEQ ID NO: 2360245 - protein, 15 aa, Entamoeba dispar
ATKSSIQGSSLTGSL

SEQ ID NO: 2360246 - protein, 7 aa, Entamoeba dispar
ATKTGGH

SEQ ID NO: 2360247 - protein, 14 aa, Entamoeba dispar
ATKYSQNKKQGSNT

SEQ ID NO: 2360248 - protein, 18 aa, Entamoeba dispar
ATLFNPKNSKYGDEGDES

SEQ ID NO: 2360249 - protein, 6 aa, Entamoeba dispar
ATLSEA

SEQ ID NO: 2360250 - protein, 7 aa, Entamoeba dispar
ATMSDSQ

SEQ ID NO: 2360251 - protein, 8 aa, Entamoeba dispar
ATNASMSS

SEQ ID NO: 2360252 - protein, 4 aa, Entamoeba dispar
ATNC

SEQ ID NO: 2360253 - protein, 13 aa, Entamoeba dispar
ATNGGSDSTSYRV

SEQ ID NO: 2360254 - protein, 6 aa, Entamoeba dispar
ATNGKC

SEQ ID NO: 2360255 - protein, 4 aa, Entamoeba dispar
ATNS

SEQ ID NO: 2360256 - protein, 8 aa, Entamoeba dispar
ATNSTHNI

SEQ ID NO: 2360257 - protein, 7 aa, Entamoeba dispar
ATPAHEQ

SEQ ID NO: 2360258 - protein, 5 aa, Entamoeba dispar
ATPCN

SEQ ID NO: 2360259 - protein, 7 aa, Entamoeba dispar
ATPEHPW

SEQ ID NO: 2360260 - protein, 6 aa, Entamoeba dispar
ATPKGE

SEQ ID NO: 2360261 - protein, 5 aa, Entamoeba dispar
ATPLN

SEQ ID NO: 2360262 - protein, 11 aa, Entamoeba dispar
ATPNEAKGKEE

SEQ ID NO: 2360263 - protein, 5 aa, Entamoeba dispar
ATPPV

SEQ ID NO: 2360264 - protein, 6 aa, Entamoeba dispar
ATQEVK

SEQ ID NO: 2360265 - protein, 23 aa, Entamoeba dispar
ATQTHGQYSYQKKQETPQQKHNT

SEQ ID NO: 2360266 - protein, 29 aa, Entamoeba dispar
ATQTTNSQINPSGTGDEEKPNTSNEEEIK

SEQ ID NO: 2360267 - protein, 4 aa, Entamoeba dispar
ATRS

SEQ ID NO: 2360268 - protein, 7 aa, Entamoeba dispar
ATRTPVT

SEQ ID NO: 2360269 - protein, 12 aa, Entamoeba dispar
ATRTSGCGEDSR

SEQ ID NO: 2360270 - protein, 13 aa, Entamoeba dispar
ATRTSGCGSNSRL

SEQ ID NO: 2360271 - protein, 12 aa, Entamoeba dispar
ATSALDSESEKI

SEQ ID NO: 2360272 - protein, 13 aa, Entamoeba dispar
ATSCGVSSNFGTA

SEQ ID NO: 2360273 - protein, 5 aa, Entamoeba dispar
ATSEW

SEQ ID NO: 2360274 - protein, 9 aa, Entamoeba dispar
ATSIQDAID

SEQ ID NO: 2360275 - protein, 7 aa, Entamoeba dispar
ATSQTSI

SEQ ID NO: 2360276 - protein, 14 aa, Entamoeba dispar
ATSSVDYETDQRIQ

SEQ ID NO: 2360277 - protein, 6 aa, Entamoeba dispar
ATTEQD

SEQ ID NO: 2360278 - protein, 4 aa, Entamoeba dispar
ATTI

SEQ ID NO: 2360279 - protein, 19 aa, Entamoeba dispar
ATTVEHGNSTTFVLPTEFS

SEQ ID NO: 2360280 - protein, 15 aa, Entamoeba dispar
ATVTSDDSNQVTEAD

SEQ ID NO: 2360281 - protein, 5 aa, Entamoeba dispar
ATYQN

SEQ ID NO: 2360282 - protein, 21 aa, Entamoeba dispar
ATYQTNSGDESDTEPQTVQST

SEQ ID NO: 2360283 - protein, 7 aa, Entamoeba dispar
ATYSDSG

SEQ ID NO: 2360284 - protein, 6 aa, Entamoeba dispar
AVDDEK

SEQ ID NO: 2360285 - protein, 6 aa, Entamoeba dispar
AVDRPT

SEQ ID NO: 2360286 - protein, 9 aa, Entamoeba dispar
AVEKNSPIK

SEQ ID NO: 2360287 - protein, 6 aa, Entamoeba dispar
AVEPEV

SEQ ID NO: 2360288 - protein, 16 aa, Entamoeba dispar
AVEQGTKVAVSAAASQ

SEQ ID NO: 2360289 - protein, 9 aa, Entamoeba dispar
AVESSKSLS

SEQ ID NO: 2360290 - protein, 8 aa, Entamoeba dispar
AVGDKKSL

SEQ ID NO: 2360291 - protein, 11 aa, Entamoeba dispar
AVKEDEDGRFS

SEQ ID NO: 2360292 - protein, 7 aa, Entamoeba dispar
AVKQGPV

SEQ ID NO: 2360293 - protein, 4 aa, Entamoeba dispar
AVLQ

SEQ ID NO: 2360294 - protein, 5 aa, Entamoeba dispar
AVNKN

SEQ ID NO: 2360295 - protein, 15 aa, Entamoeba dispar
AVNQNKTKPTPLQEN

SEQ ID NO: 2360296 - protein, 6 aa, Entamoeba dispar
AVPGTA

SEQ ID NO: 2360297 - protein, 5 aa, Entamoeba dispar
AVQDG

SEQ ID NO: 2360298 - protein, 5 aa, Entamoeba dispar
AVQEA

SEQ ID NO: 2360299 - protein, 11 aa, Entamoeba dispar
AVQEDDDLPLN

SEQ ID NO: 2360300 - protein, 9 aa, Entamoeba dispar
AVRKSSALK

SEQ ID NO: 2360301 - protein, 12 aa, Entamoeba dispar
AVSGSDSVTSEM

SEQ ID NO: 2360302 - protein, 8 aa, Entamoeba dispar
AVSSPRIK

SEQ ID NO: 2360303 - protein, 8 aa, Entamoeba dispar
AVTEAKNI

SEQ ID NO: 2360304 - protein, 7 aa, Entamoeba dispar
AWPTQTG

SEQ ID NO: 2360305 - protein, 7 aa, Entamoeba dispar
AYDTDTI

SEQ ID NO: 2360306 - protein, 11 aa, Entamoeba dispar
AYEYGNDQGRE

SEQ ID NO: 2360307 - protein, 6 aa, Entamoeba dispar
AYGAEP

SEQ ID NO: 2360308 - protein, 5 aa, Entamoeba dispar
AYGKE

SEQ ID NO: 2360309 - protein, 12 aa, Entamoeba dispar
AYGTAKSSVGIS

SEQ ID NO: 2360310 - protein, 6 aa, Entamoeba dispar
AYIPNN

SEQ ID NO: 2360311 - protein, 5 aa, Entamoeba dispar
AYKRT

SEQ ID NO: 2360312 - protein, 37 aa, Entamoeba dispar
AYNEKSKKQYQKDFSEQRSNSDVSGSNENDSSEYEKI

SEQ ID NO: 2360313 - protein, 9 aa, Entamoeba dispar
AYPADDPKF

SEQ ID NO: 2360314 - protein, 6 aa, Entamoeba dispar
AYPAPE

SEQ ID NO: 2360315 - protein, 6 aa, Entamoeba dispar
AYPTEE

SEQ ID NO: 2360316 - protein, 8 aa, Entamoeba dispar
AYPTSDPR

SEQ ID NO: 2360317 - protein, 12 aa, Entamoeba dispar
AYQLKAEGKDND

SEQ ID NO: 2360318 - protein, 7 aa, Entamoeba dispar
AYSGNTI

SEQ ID NO: 2360319 - protein, 6 aa, Entamoeba dispar
AYSPFE

SEQ ID NO: 2360320 - protein, 5 aa, Entamoeba dispar
AYTDP

SEQ ID NO: 2360321 - protein, 10 aa, Entamoeba dispar
CAEKSIGRTQ

SEQ ID NO: 2360322 - protein, 7 aa, Entamoeba dispar
CAPGQCD

SEQ ID NO: 2360323 - protein, 8 aa, Entamoeba dispar
CAQREAGL

SEQ ID NO: 2360324 - protein, 12 aa, Entamoeba dispar
CARNEGNSEEGE

SEQ ID NO: 2360325 - protein, 7 aa, Entamoeba dispar
CARSNGI

SEQ ID NO: 2360326 - protein, 10 aa, Entamoeba dispar
CASKSGESKI

SEQ ID NO: 2360327 - protein, 11 aa, Entamoeba dispar
CATCKNSNSCL

SEQ ID NO: 2360328 - protein, 16 aa, Entamoeba dispar
CCNPKAPGKCNTFQER

SEQ ID NO: 2360329 - protein, 12 aa, Entamoeba dispar
CDASGSVPKCSS

SEQ ID NO: 2360330 - protein, 9 aa, Entamoeba dispar
CDASQSCSK

SEQ ID NO: 2360331 - protein, 8 aa, Entamoeba dispar
CDDGSSAK

SEQ ID NO: 2360332 - protein, 5 aa, Entamoeba dispar
CDEKG

SEQ ID NO: 2360333 - protein, 9 aa, Entamoeba dispar
CDESNGKTK

SEQ ID NO: 2360334 - protein, 20 aa, Entamoeba dispar
CDESYNKRQEQFGKNRTPDP

SEQ ID NO: 2360335 - protein, 31 aa, Entamoeba dispar
CDETKKEGNNIKSSEMEIKNKKSIEGIEGKI

SEQ ID NO: 2360336 - protein, 8 aa, Entamoeba dispar
CDGETVPC

SEQ ID NO: 2360337 - protein, 7 aa, Entamoeba dispar
CDGGEGC

SEQ ID NO: 2360338 - protein, 6 aa, Entamoeba dispar
CDGGYG

SEQ ID NO: 2360339 - protein, 5 aa, Entamoeba dispar
CDGPN

SEQ ID NO: 2360340 - protein, 11 aa, Entamoeba dispar
CDGSSNCGSNC

SEQ ID NO: 2360341 - protein, 5 aa, Entamoeba dispar
CDGST

SEQ ID NO: 2360342 - protein, 9 aa, Entamoeba dispar
CDGTSGCGK

SEQ ID NO: 2360343 - protein, 6 aa, Entamoeba dispar
CDKGKS

SEQ ID NO: 2360344 - protein, 30 aa, Entamoeba dispar
CDKKKSSQNDIDEEQVNGSCKTKRQENEDV

SEQ ID NO: 2360345 - protein, 10 aa, Entamoeba dispar
CDNGKHNQRH

SEQ ID NO: 2360346 - protein, 10 aa, Entamoeba dispar
CDNNQYLNDR

SEQ ID NO: 2360347 - protein, 10 aa, Entamoeba dispar
CDNPKKDDQK

SEQ ID NO: 2360348 - protein, 7 aa, Entamoeba dispar
CDPSTVI

SEQ ID NO: 2360349 - protein, 5 aa, Entamoeba dispar
CDPTN

SEQ ID NO: 2360350 - protein, 7 aa, Entamoeba dispar
CDQNSDN

SEQ ID NO: 2360351 - protein, 21 aa, Entamoeba dispar
CDRECASPNECTSCNKEGYEE

SEQ ID NO: 2360352 - protein, 10 aa, Entamoeba dispar
CDRSSGECIP

SEQ ID NO: 2360353 - protein, 5 aa, Entamoeba dispar
CDSCE

SEQ ID NO: 2360354 - protein, 5 aa, Entamoeba dispar
CDSDS

SEQ ID NO: 2360355 - protein, 7 aa, Entamoeba dispar
CDSEEQC

SEQ ID NO: 2360356 - protein, 7 aa, Entamoeba dispar
CDSETCQ

SEQ ID NO: 2360357 - protein, 11 aa, Entamoeba dispar
CDSEYSKDDHC

SEQ ID NO: 2360358 - protein, 8 aa, Entamoeba dispar
CDSGRRKH

SEQ ID NO: 2360359 - protein, 8 aa, Entamoeba dispar
CDSGSECK

SEQ ID NO: 2360360 - protein, 6 aa, Entamoeba dispar
CDSSNT

SEQ ID NO: 2360361 - protein, 16 aa, Entamoeba dispar
CDSSSGWKLSKQKGKC

SEQ ID NO: 2360362 - protein, 6 aa, Entamoeba dispar
CDSTEH

SEQ ID NO: 2360363 - protein, 8 aa, Entamoeba dispar
CDSTTGNC

SEQ ID NO: 2360364 - protein, 4 aa, Entamoeba dispar
CDTM

SEQ ID NO: 2360365 - protein, 11 aa, Entamoeba dispar
CDTSNGCTNGE

SEQ ID NO: 2360366 - protein, 4 aa, Entamoeba dispar
CDTT

SEQ ID NO: 2360367 - protein, 12 aa, Entamoeba dispar
CDYTSTAQMQQT

SEQ ID NO: 2360368 - protein, 16 aa, Entamoeba dispar
CEADNTCRGGCSENYF

SEQ ID NO: 2360369 - protein, 8 aa, Entamoeba dispar
CECEQENE

SEQ ID NO: 2360370 - protein, 11 aa, Entamoeba dispar
CECKEGYGYED

SEQ ID NO: 2360371 - protein, 5 aa, Entamoeba dispar
CECSS

SEQ ID NO: 2360372 - protein, 15 aa, Entamoeba dispar
CEDECEKKPNDDGSI

SEQ ID NO: 2360373 - protein, 8 aa, Entamoeba dispar
CEDGNMGS

SEQ ID NO: 2360374 - protein, 15 aa, Entamoeba dispar
CEDKETTKTQSLTEN

SEQ ID NO: 2360375 - protein, 24 aa, Entamoeba dispar
CEDSVSPEIESTAAVNDIQVFCLR

SEQ ID NO: 2360376 - protein, 10 aa, Entamoeba dispar
CEEESSNKYS

SEQ ID NO: 2360377 - protein, 12 aa, Entamoeba dispar
CEEKQARKEKEA

SEQ ID NO: 2360378 - protein, 12 aa, Entamoeba dispar
CEENPDGEFSES

SEQ ID NO: 2360379 - protein, 11 aa, Entamoeba dispar
CEEQNGHGCKR

SEQ ID NO: 2360380 - protein, 7 aa, Entamoeba dispar
CEETAQE

SEQ ID NO: 2360381 - protein, 9 aa, Entamoeba dispar
CEETPKTRY

SEQ ID NO: 2360382 - protein, 10 aa, Entamoeba dispar
CEGGTADEPL

SEQ ID NO: 2360383 - protein, 6 aa, Entamoeba dispar
CEGHRS

SEQ ID NO: 2360384 - protein, 17 aa, Entamoeba dispar
CEGNSKSRISNISTADT

SEQ ID NO: 2360385 - protein, 7 aa, Entamoeba dispar
CEGTNTK

SEQ ID NO: 2360386 - protein, 5 aa, Entamoeba dispar
CEKCE

SEQ ID NO: 2360387 - protein, 9 aa, Entamoeba dispar
CEKCTNDQN

SEQ ID NO: 2360388 - protein, 7 aa, Entamoeba dispar
CEKDSEY

SEQ ID NO: 2360389 - protein, 5 aa, Entamoeba dispar
CEKQP

SEQ ID NO: 2360390 - protein, 7 aa, Entamoeba dispar
CEKTTSS

SEQ ID NO: 2360391 - protein, 6 aa, Entamoeba dispar
CEKYSS

SEQ ID NO: 2360392 - protein, 5 aa, Entamoeba dispar
CENGN

SEQ ID NO: 2360393 - protein, 9 aa, Entamoeba dispar
CENGNRTRF

SEQ ID NO: 2360394 - protein, 7 aa, Entamoeba dispar
CENGVTT

SEQ ID NO: 2360395 - protein, 5 aa, Entamoeba dispar
CENST

SEQ ID NO: 2360396 - protein, 10 aa, Entamoeba dispar
CEQAKEYTTE

SEQ ID NO: 2360397 - protein, 5 aa, Entamoeba dispar
CERET

SEQ ID NO: 2360398 - protein, 10 aa, Entamoeba dispar
CESCDSTTGD

SEQ ID NO: 2360399 - protein, 38 aa, Entamoeba dispar
CESKDESTDSSQQPDPQPSEGSSSQQSSSSSGNSTNDN

SEQ ID NO: 2360400 - protein, 6 aa, Entamoeba dispar
CESSEF

SEQ ID NO: 2360401 - protein, 6 aa, Entamoeba dispar
CETFTN

SEQ ID NO: 2360402 - protein, 6 aa, Entamoeba dispar
CETGPN

SEQ ID NO: 2360403 - protein, 19 aa, Entamoeba dispar
CETSRAHTCASSNDDDGEI

SEQ ID NO: 2360404 - protein, 12 aa, Entamoeba dispar
CEVREKENNPKI

SEQ ID NO: 2360405 - protein, 7 aa, Entamoeba dispar
CEVSSSE

SEQ ID NO: 2360406 - protein, 10 aa, Entamoeba dispar
CEYDNESGKP

SEQ ID NO: 2360407 - protein, 10 aa, Entamoeba dispar
CEYGDPSITP

SEQ ID NO: 2360408 - protein, 11 aa, Entamoeba dispar
CFASQTGKYDG

SEQ ID NO: 2360409 - protein, 12 aa, Entamoeba dispar
CFPSNAEAIEGL

SEQ ID NO: 2360410 - protein, 16 aa, Entamoeba dispar
CGDGYQTISPKPYGSN

SEQ ID NO: 2360411 - protein, 6 aa, Entamoeba dispar
CGDSMT

SEQ ID NO: 2360412 - protein, 8 aa, Entamoeba dispar
CGDTLSEP

SEQ ID NO: 2360413 - protein, 10 aa, Entamoeba dispar
CGEAGCSEDG

SEQ ID NO: 2360414 - protein, 11 aa, Entamoeba dispar
CGEEARKADNL

SEQ ID NO: 2360415 - protein, 6 aa, Entamoeba dispar
CGEEKR

SEQ ID NO: 2360416 - protein, 5 aa, Entamoeba dispar
CGENK

SEQ ID NO: 2360417 - protein, 6 aa, Entamoeba dispar
CGETQL

SEQ ID NO: 2360418 - protein, 5 aa, Entamoeba dispar
CGGGF

SEQ ID NO: 2360419 - protein, 14 aa, Entamoeba dispar
CGIGTQPEGKQPTN

SEQ ID NO: 2360420 - protein, 4 aa, Entamoeba dispar
CGKC

SEQ ID NO: 2360421 - protein, 10 aa, Entamoeba dispar
CGKEKSKFSC

SEQ ID NO: 2360422 - protein, 4 aa, Entamoeba dispar
CGKP

SEQ ID NO: 2360423 - protein, 6 aa, Entamoeba dispar
CGLTQQ

SEQ ID NO: 2360424 - protein, 4 aa, Entamoeba dispar
CGND

SEQ ID NO: 2360425 - protein, 5 aa, Entamoeba dispar
CGNGI

SEQ ID NO: 2360426 - protein, 16 aa, Entamoeba dispar
CGNGIVDDGEECDGGI

SEQ ID NO: 2360427 - protein, 17 aa, Entamoeba dispar
CGNGRIDSGEECDGGDG

SEQ ID NO: 2360428 - protein, 7 aa, Entamoeba dispar
CGNGTFE

SEQ ID NO: 2360429 - protein, 18 aa, Entamoeba dispar
CGNHRLDEGEECDGGSGC

SEQ ID NO: 2360430 - protein, 18 aa, Entamoeba dispar
CGNKKWDEGEECDGGDGC

SEQ ID NO: 2360431 - protein, 8 aa, Entamoeba dispar
CGNTQQKV

SEQ ID NO: 2360432 - protein, 8 aa, Entamoeba dispar
CGPIEGNT

SEQ ID NO: 2360433 - protein, 5 aa, Entamoeba dispar
CGPSK

SEQ ID NO: 2360434 - protein, 13 aa, Entamoeba dispar
CGQTQAAAVTQPD

SEQ ID NO: 2360435 - protein, 10 aa, Entamoeba dispar
CGRTGSGKSS

SEQ ID NO: 2360436 - protein, 6 aa, Entamoeba dispar
CGSASN

SEQ ID NO: 2360437 - protein, 12 aa, Entamoeba dispar
CGSCESSNSCTN

SEQ ID NO: 2360438 - protein, 10 aa, Entamoeba dispar
CGSCTSSTYC

SEQ ID NO: 2360439 - protein, 5 aa, Entamoeba dispar
CGSDA

SEQ ID NO: 2360440 - protein, 5 aa, Entamoeba dispar
CGSEN

SEQ ID NO: 2360441 - protein, 7 aa, Entamoeba dispar
CGSGNGV

SEQ ID NO: 2360442 - protein, 6 aa, Entamoeba dispar
CGSLSL

SEQ ID NO: 2360443 - protein, 4 aa, Entamoeba dispar
CGSN

SEQ ID NO: 2360444 - protein, 6 aa, Entamoeba dispar
CGSNQD

SEQ ID NO: 2360445 - protein, 4 aa, Entamoeba dispar
CGSP

SEQ ID NO: 2360446 - protein, 7 aa, Entamoeba dispar
CGSTSSI

SEQ ID NO: 2360447 - protein, 14 aa, Entamoeba dispar
CGTDKKDYCKFDEE

SEQ ID NO: 2360448 - protein, 9 aa, Entamoeba dispar
CGTPTSSFN

SEQ ID NO: 2360449 - protein, 9 aa, Entamoeba dispar
CGTQPPQCN

SEQ ID NO: 2360450 - protein, 11 aa, Entamoeba dispar
CGVRGAAQQPK

SEQ ID NO: 2360451 - protein, 9 aa, Entamoeba dispar
CGYDKESIE

SEQ ID NO: 2360452 - protein, 5 aa, Entamoeba dispar
CHDPN

SEQ ID NO: 2360453 - protein, 12 aa, Entamoeba dispar
CHGDTPCPTTPC

SEQ ID NO: 2360454 - protein, 5 aa, Entamoeba dispar
CIETS

SEQ ID NO: 2360455 - protein, 9 aa, Entamoeba dispar
CIPKSKAGI

SEQ ID NO: 2360456 - protein, 14 aa, Entamoeba dispar
CIPQPTTCNANNSR

SEQ ID NO: 2360457 - protein, 11 aa, Entamoeba dispar
CIPSSESPESS

SEQ ID NO: 2360458 - protein, 23 aa, Entamoeba dispar
CKADDYKGCPKKRFDYSTNTGYP

SEQ ID NO: 2360459 - protein, 11 aa, Entamoeba dispar
CKDETQNNENV

SEQ ID NO: 2360460 - protein, 10 aa, Entamoeba dispar
CKDGYQPNGL

SEQ ID NO: 2360461 - protein, 9 aa, Entamoeba dispar
CKDGYYKSN

SEQ ID NO: 2360462 - protein, 6 aa, Entamoeba dispar
CKECNT

SEQ ID NO: 2360463 - protein, 7 aa, Entamoeba dispar
CKEECNE

SEQ ID NO: 2360464 - protein, 6 aa, Entamoeba dispar
CKEKRE

SEQ ID NO: 2360465 - protein, 15 aa, Entamoeba dispar
CKENQLPTVTIPESS

SEQ ID NO: 2360466 - protein, 9 aa, Entamoeba dispar
CKENTTLDA

SEQ ID NO: 2360467 - protein, 5 aa, Entamoeba dispar
CKEVQ

SEQ ID NO: 2360468 - protein, 7 aa, Entamoeba dispar
CKEYAEE

SEQ ID NO: 2360469 - protein, 7 aa, Entamoeba dispar
CKEYNKG

SEQ ID NO: 2360470 - protein, 5 aa, Entamoeba dispar
CKFEG

SEQ ID NO: 2360471 - protein, 8 aa, Entamoeba dispar
CKGAESSI

SEQ ID NO: 2360472 - protein, 8 aa, Entamoeba dispar
CKGESISV

SEQ ID NO: 2360473 - protein, 7 aa, Entamoeba dispar
CKKCENE

SEQ ID NO: 2360474 - protein, 10 aa, Entamoeba dispar
CKKEGEEEEF

SEQ ID NO: 2360475 - protein, 8 aa, Entamoeba dispar
CKKRYSGE

SEQ ID NO: 2360476 - protein, 8 aa, Entamoeba dispar
CKKSMDQN

SEQ ID NO: 2360477 - protein, 8 aa, Entamoeba dispar
CKKYENEN

SEQ ID NO: 2360478 - protein, 13 aa, Entamoeba dispar
CKNDNDKKKYRNI

SEQ ID NO: 2360479 - protein, 15 aa, Entamoeba dispar
CKNNITSKGCDKCED

SEQ ID NO: 2360480 - protein, 12 aa, Entamoeba dispar
CKNNKIKELDYT

SEQ ID NO: 2360481 - protein, 6 aa, Entamoeba dispar
CKNQNT

SEQ ID NO: 2360482 - protein, 7 aa, Entamoeba dispar
CKNSTAA

SEQ ID NO: 2360483 - protein, 7 aa, Entamoeba dispar
CKPEGKA

SEQ ID NO: 2360484 - protein, 17 aa, Entamoeba dispar
CKPEKSGPVKTSDNLKY

SEQ ID NO: 2360485 - protein, 7 aa, Entamoeba dispar
CKPGYTL

SEQ ID NO: 2360486 - protein, 9 aa, Entamoeba dispar
CKPIKENEI

SEQ ID NO: 2360487 - protein, 4 aa, Entamoeba dispar
CKPY

SEQ ID NO: 2360488 - protein, 7 aa, Entamoeba dispar
CKRCEEK

SEQ ID NO: 2360489 - protein, 10 aa, Entamoeba dispar
CKRENNNTCQ

SEQ ID NO: 2360490 - protein, 11 aa, Entamoeba dispar
CKSKTSTGCEE

SEQ ID NO: 2360491 - protein, 5 aa, Entamoeba dispar
CKSQT

SEQ ID NO: 2360492 - protein, 8 aa, Entamoeba dispar
CKSSRDPY

SEQ ID NO: 2360493 - protein, 14 aa, Entamoeba dispar
CKSTQRKRALTGRD

SEQ ID NO: 2360494 - protein, 7 aa, Entamoeba dispar
CKTCDSK

SEQ ID NO: 2360495 - protein, 11 aa, Entamoeba dispar
CKTCSNTASSC

SEQ ID NO: 2360496 - protein, 9 aa, Entamoeba dispar
CKTEEEQIE

SEQ ID NO: 2360497 - protein, 6 aa, Entamoeba dispar
CKTIKD

SEQ ID NO: 2360498 - protein, 6 aa, Entamoeba dispar
CKTNKN

SEQ ID NO: 2360499 - protein, 12 aa, Entamoeba dispar
CKTQKKEAISTE

SEQ ID NO: 2360500 - protein, 8 aa, Entamoeba dispar
CKTSSQQN

SEQ ID NO: 2360501 - protein, 6 aa, Entamoeba dispar
CKTTVD

SEQ ID NO: 2360502 - protein, 10 aa, Entamoeba dispar
CLEKKGDKCV

SEQ ID NO: 2360503 - protein, 7 aa, Entamoeba dispar
CLPSNGG

SEQ ID NO: 2360504 - protein, 7 aa, Entamoeba dispar
CLRGNSK

SEQ ID NO: 2360505 - protein, 13 aa, Entamoeba dispar
CLSNTGCNKIEEG

SEQ ID NO: 2360506 - protein, 13 aa, Entamoeba dispar
CNAETGNGNCLPQ

SEQ ID NO: 2360507 - protein, 8 aa, Entamoeba dispar
CNDDSKTS

SEQ ID NO: 2360508 - protein, 9 aa, Entamoeba dispar
CNDPSVRRD

SEQ ID NO: 2360509 - protein, 29 aa, Entamoeba dispar
CNECDSQEGCKQCKEGYTLNKDKGICSGA

SEQ ID NO: 2360510 - protein, 8 aa, Entamoeba dispar
CNEDKGYF

SEQ ID NO: 2360511 - protein, 17 aa, Entamoeba dispar
CNEKAKKMIESNYKEKE

SEQ ID NO: 2360512 - protein, 8 aa, Entamoeba dispar
CNGKKQTI

SEQ ID NO: 2360513 - protein, 9 aa, Entamoeba dispar
CNGQTQGNG

SEQ ID NO: 2360514 - protein, 8 aa, Entamoeba dispar
CNHNPSDQ

SEQ ID NO: 2360515 - protein, 12 aa, Entamoeba dispar
CNHSFPSGHTAY

SEQ ID NO: 2360516 - protein, 11 aa, Entamoeba dispar
CNKDSDGLKTY

SEQ ID NO: 2360517 - protein, 7 aa, Entamoeba dispar
CNKDTTV

SEQ ID NO: 2360518 - protein, 14 aa, Entamoeba dispar
CNKKKNTKREYQNI

SEQ ID NO: 2360519 - protein, 8 aa, Entamoeba dispar
CNKNNGQY

SEQ ID NO: 2360520 - protein, 7 aa, Entamoeba dispar
CNKPRVS

SEQ ID NO: 2360521 - protein, 9 aa, Entamoeba dispar
CNKTNKQSH

SEQ ID NO: 2360522 - protein, 15 aa, Entamoeba dispar
CNKTNNQKTKNNKCS

SEQ ID NO: 2360523 - protein, 9 aa, Entamoeba dispar
CNKTNNQSH

SEQ ID NO: 2360524 - protein, 7 aa, Entamoeba dispar
CNNENGR

SEQ ID NO: 2360525 - protein, 5 aa, Entamoeba dispar
CNNGG

SEQ ID NO: 2360526 - protein, 8 aa, Entamoeba dispar
CNNPKESN

SEQ ID NO: 2360527 - protein, 6 aa, Entamoeba dispar
CNPDSN

SEQ ID NO: 2360528 - protein, 9 aa, Entamoeba dispar
CNPKITTSL

SEQ ID NO: 2360529 - protein, 9 aa, Entamoeba dispar
CNPKTTVNT

SEQ ID NO: 2360530 - protein, 5 aa, Entamoeba dispar
CNPSL

SEQ ID NO: 2360531 - protein, 7 aa, Entamoeba dispar
CNPSTNK

SEQ ID NO: 2360532 - protein, 5 aa, Entamoeba dispar
CNQNK

SEQ ID NO: 2360533 - protein, 6 aa, Entamoeba dispar
CNRESK

SEQ ID NO: 2360534 - protein, 11 aa, Entamoeba dispar
CNSAPTKCLST

SEQ ID NO: 2360535 - protein, 10 aa, Entamoeba dispar
CNSEETNNNI

SEQ ID NO: 2360536 - protein, 10 aa, Entamoeba dispar
CNSGEYNGKI

SEQ ID NO: 2360537 - protein, 6 aa, Entamoeba dispar
CNSNVT

SEQ ID NO: 2360538 - protein, 18 aa, Entamoeba dispar
CNSSSGVVDGNSISPVCS

SEQ ID NO: 2360539 - protein, 8 aa, Entamoeba dispar
CNSTGDYD

SEQ ID NO: 2360540 - protein, 5 aa, Entamoeba dispar
CNTAT

SEQ ID NO: 2360541 - protein, 7 aa, Entamoeba dispar
CNTENGE

SEQ ID NO: 2360542 - protein, 7 aa, Entamoeba dispar
CNTTSES

SEQ ID NO: 2360543 - protein, 17 aa, Entamoeba dispar
CNVTDQNNFRQIIDALN

SEQ ID NO: 2360544 - protein, 6 aa, Entamoeba dispar
CNYDDP

SEQ ID NO: 2360545 - protein, 15 aa, Entamoeba dispar
CNYDKGHGTCSTRDK

SEQ ID NO: 2360546 - protein, 14 aa, Entamoeba dispar
CPAGKQPNQNKDQC

SEQ ID NO: 2360547 - protein, 7 aa, Entamoeba dispar
CPASKGL

SEQ ID NO: 2360548 - protein, 12 aa, Entamoeba dispar
CPASPDRDTASI

SEQ ID NO: 2360549 - protein, 10 aa, Entamoeba dispar
CPDDPCGTSD

SEQ ID NO: 2360550 - protein, 4 aa, Entamoeba dispar
CPEC

SEQ ID NO: 2360551 - protein, 4 aa, Entamoeba dispar
CPEP

SEQ ID NO: 2360552 - protein, 12 aa, Entamoeba dispar
CPEQVDASGNHY

SEQ ID NO: 2360553 - protein, 11 aa, Entamoeba dispar
CPERTDNGTRF

SEQ ID NO: 2360554 - protein, 4 aa, Entamoeba dispar
CPHD

SEQ ID NO: 2360555 - protein, 8 aa, Entamoeba dispar
CPPGTYSD

SEQ ID NO: 2360556 - protein, 9 aa, Entamoeba dispar
CPSGNQMNS

SEQ ID NO: 2360557 - protein, 28 aa, Entamoeba dispar
CPSNTPDNTNPSSDKSSSNNNNDDAAPS

SEQ ID NO: 2360558 - protein, 7 aa, Entamoeba dispar
CPSPSTL

SEQ ID NO: 2360559 - protein, 15 aa, Entamoeba dispar
CPTGTFSSMKGSDRC

SEQ ID NO: 2360560 - protein, 11 aa, Entamoeba dispar
CPVKGNEKCCS

SEQ ID NO: 2360561 - protein, 9 aa, Entamoeba dispar
CQAKDINKA

SEQ ID NO: 2360562 - protein, 18 aa, Entamoeba dispar
CQAKQEPQQNKIKKEGTI

SEQ ID NO: 2360563 - protein, 4 aa, Entamoeba dispar
CQDE

SEQ ID NO: 2360564 - protein, 4 aa, Entamoeba dispar
CQDL

SEQ ID NO: 2360565 - protein, 24 aa, Entamoeba dispar
CQECDNTNGRCRSCPKGYGYDAKN

SEQ ID NO: 2360566 - protein, 8 aa, Entamoeba dispar
CQEKSNKY

SEQ ID NO: 2360567 - protein, 12 aa, Entamoeba dispar
CQGSDGKIVANS

SEQ ID NO: 2360568 - protein, 13 aa, Entamoeba dispar
CQKDNGISSCSIK

SEQ ID NO: 2360569 - protein, 5 aa, Entamoeba dispar
CQKES

SEQ ID NO: 2360570 - protein, 6 aa, Entamoeba dispar
CQNDNS

SEQ ID NO: 2360571 - protein, 8 aa, Entamoeba dispar
CQNTSSKN

SEQ ID NO: 2360572 - protein, 5 aa, Entamoeba dispar
CQPNE

SEQ ID NO: 2360573 - protein, 7 aa, Entamoeba dispar
CQRCSNS

SEQ ID NO: 2360574 - protein, 24 aa, Entamoeba dispar
CQSGTNLDCPNAKELSNPRCSGQH

SEQ ID NO: 2360575 - protein, 5 aa, Entamoeba dispar
CQSGY

SEQ ID NO: 2360576 - protein, 13 aa, Entamoeba dispar
CQSNSKSFTSNEQ

SEQ ID NO: 2360577 - protein, 4 aa, Entamoeba dispar
CQTG

SEQ ID NO: 2360578 - protein, 12 aa, Entamoeba dispar
CQTMKDKNYYDE

SEQ ID NO: 2360579 - protein, 4 aa, Entamoeba dispar
CQYN

SEQ ID NO: 2360580 - protein, 4 aa, Entamoeba dispar
CQYS

SEQ ID NO: 2360581 - protein, 9 aa, Entamoeba dispar
CRDTTRKPY

SEQ ID NO: 2360582 - protein, 6 aa, Entamoeba dispar
CRGNGN

SEQ ID NO: 2360583 - protein, 11 aa, Entamoeba dispar
CRGPCKEESRV

SEQ ID NO: 2360584 - protein, 6 aa, Entamoeba dispar
CRNKEL

SEQ ID NO: 2360585 - protein, 8 aa, Entamoeba dispar
CRQEPVNK

SEQ ID NO: 2360586 - protein, 18 aa, Entamoeba dispar
CRTENIKTNIKSNDQLKI

SEQ ID NO: 2360587 - protein, 9 aa, Entamoeba dispar
CSAEGVQPK

SEQ ID NO: 2360588 - protein, 12 aa, Entamoeba dispar
CSAEPFDSNTPL

SEQ ID NO: 2360589 - protein, 9 aa, Entamoeba dispar
CSATSANSP

SEQ ID NO: 2360590 - protein, 13 aa, Entamoeba dispar
CSDGTYSDGVGAT

SEQ ID NO: 2360591 - protein, 5 aa, Entamoeba dispar
CSDGY

SEQ ID NO: 2360592 - protein, 8 aa, Entamoeba dispar
CSDKQNQL

SEQ ID NO: 2360593 - protein, 8 aa, Entamoeba dispar
CSDTNNAE

SEQ ID NO: 2360594 - protein, 8 aa, Entamoeba dispar
CSECEPDK

SEQ ID NO: 2360595 - protein, 6 aa, Entamoeba dispar
CSEDSY

SEQ ID NO: 2360596 - protein, 4 aa, Entamoeba dispar
CSEK

SEQ ID NO: 2360597 - protein, 7 aa, Entamoeba dispar
CSESPSI

SEQ ID NO: 2360598 - protein, 7 aa, Entamoeba dispar
CSETAAT

SEQ ID NO: 2360599 - protein, 18 aa, Entamoeba dispar
CSGCKGDCKGGNSGSGLG

SEQ ID NO: 2360600 - protein, 7 aa, Entamoeba dispar
CSGPNTC

SEQ ID NO: 2360601 - protein, 8 aa, Entamoeba dispar
CSGPTKIG

SEQ ID NO: 2360602 - protein, 6 aa, Entamoeba dispar
CSGSEC

SEQ ID NO: 2360603 - protein, 9 aa, Entamoeba dispar
CSGSSPSSM

SEQ ID NO: 2360604 - protein, 5 aa, Entamoeba dispar
CSGTF

SEQ ID NO: 2360605 - protein, 6 aa, Entamoeba dispar
CSIDGN

SEQ ID NO: 2360606 - protein, 8 aa, Entamoeba dispar
CSIKTTGK

SEQ ID NO: 2360607 - protein, 9 aa, Entamoeba dispar
CSKEENNAV

SEQ ID NO: 2360608 - protein, 10 aa, Entamoeba dispar
CSKNEKGKGV

SEQ ID NO: 2360609 - protein, 11 aa, Entamoeba dispar
CSKPEKRGRNS

SEQ ID NO: 2360610 - protein, 13 aa, Entamoeba dispar
CSLNESKNNGISG

SEQ ID NO: 2360611 - protein, 9 aa, Entamoeba dispar
CSNDPGTTL

SEQ ID NO: 2360612 - protein, 8 aa, Entamoeba dispar
CSNGNYLS

SEQ ID NO: 2360613 - protein, 10 aa, Entamoeba dispar
CSNGYSPNFK

SEQ ID NO: 2360614 - protein, 11 aa, Entamoeba dispar
CSNGYSPNLNG

SEQ ID NO: 2360615 - protein, 25 aa, Entamoeba dispar
CSNGYTLNNKKCSNKENQNGKNEEI

SEQ ID NO: 2360616 - protein, 25 aa, Entamoeba dispar
CSNGYTLNNKKCSNKENRNGKNEEI

SEQ ID NO: 2360617 - protein, 15 aa, Entamoeba dispar
CSNKENCKTCSTDSN

SEQ ID NO: 2360618 - protein, 16 aa, Entamoeba dispar
CSNKENCKTCSTNSSE

SEQ ID NO: 2360619 - protein, 17 aa, Entamoeba dispar
CSNKPNCKTCSTDSNEC

SEQ ID NO: 2360620 - protein, 16 aa, Entamoeba dispar
CSNMNKDTIEEEIKKS

SEQ ID NO: 2360621 - protein, 24 aa, Entamoeba dispar
CSNRTSEIDCKQNNCQWNSSLLFC

SEQ ID NO: 2360622 - protein, 11 aa, Entamoeba dispar
CSNSDLSSDNF

SEQ ID NO: 2360623 - protein, 5 aa, Entamoeba dispar
CSPCS

SEQ ID NO: 2360624 - protein, 5 aa, Entamoeba dispar
CSPGC

SEQ ID NO: 2360625 - protein, 15 aa, Entamoeba dispar
CSPGCSSSCVSDGSC

SEQ ID NO: 2360626 - protein, 11 aa, Entamoeba dispar
CSPKEVSTSLK

SEQ ID NO: 2360627 - protein, 8 aa, Entamoeba dispar
CSPQDKKR

SEQ ID NO: 2360628 - protein, 8 aa, Entamoeba dispar
CSPQDKQR

SEQ ID NO: 2360629 - protein, 10 aa, Entamoeba dispar
CSPSINQPSK

SEQ ID NO: 2360630 - protein, 6 aa, Entamoeba dispar
CSPSRF

SEQ ID NO: 2360631 - protein, 9 aa, Entamoeba dispar
CSPSTTSDS

SEQ ID NO: 2360632 - protein, 9 aa, Entamoeba dispar
CSQETNSQC

SEQ ID NO: 2360633 - protein, 6 aa, Entamoeba dispar
CSQSIQ

SEQ ID NO: 2360634 - protein, 13 aa, Entamoeba dispar
CSREDPTKCSECK

SEQ ID NO: 2360635 - protein, 9 aa, Entamoeba dispar
CSRSSPSSM

SEQ ID NO: 2360636 - protein, 15 aa, Entamoeba dispar
CSSCSSEKECSECNS

SEQ ID NO: 2360637 - protein, 4 aa, Entamoeba dispar
CSSD

SEQ ID NO: 2360638 - protein, 15 aa, Entamoeba dispar
CSSDDNSNELTRKQE

SEQ ID NO: 2360639 - protein, 5 aa, Entamoeba dispar
CSSDH

SEQ ID NO: 2360640 - protein, 4 aa, Entamoeba dispar
CSSE

SEQ ID NO: 2360641 - protein, 25 aa, Entamoeba dispar
CSSECTSQCYGEPDVCDKDNKKCND

SEQ ID NO: 2360642 - protein, 10 aa, Entamoeba dispar
CSSEYENDHS

SEQ ID NO: 2360643 - protein, 6 aa, Entamoeba dispar
CSSIPT

SEQ ID NO: 2360644 - protein, 6 aa, Entamoeba dispar
CSSNEN

SEQ ID NO: 2360645 - protein, 8 aa, Entamoeba dispar
CSSQDNRL

SEQ ID NO: 2360646 - protein, 14 aa, Entamoeba dispar
CSSRGCSECNVDTG

SEQ ID NO: 2360647 - protein, 10 aa, Entamoeba dispar
CSSRTTEDDC

SEQ ID NO: 2360648 - protein, 11 aa, Entamoeba dispar
CSSSCSECDKL

SEQ ID NO: 2360649 - protein, 7 aa, Entamoeba dispar
CSSSNTQ

SEQ ID NO: 2360650 - protein, 5 aa, Entamoeba dispar
CSSSQ

SEQ ID NO: 2360651 - protein, 7 aa, Entamoeba dispar
CSSTDTK

SEQ ID NO: 2360652 - protein, 8 aa, Entamoeba dispar
CSSTKSNC

SEQ ID NO: 2360653 - protein, 13 aa, Entamoeba dispar
CSSTLNGKCNSCE

SEQ ID NO: 2360654 - protein, 4 aa, Entamoeba dispar
CSTD

SEQ ID NO: 2360655 - protein, 7 aa, Entamoeba dispar
CSTGTEI

SEQ ID NO: 2360656 - protein, 8 aa, Entamoeba dispar
CSTKKGKC

SEQ ID NO: 2360657 - protein, 8 aa, Entamoeba dispar
CSTNNGEC

SEQ ID NO: 2360658 - protein, 6 aa, Entamoeba dispar
CSTNYR

SEQ ID NO: 2360659 - protein, 5 aa, Entamoeba dispar
CSTSS

SEQ ID NO: 2360660 - protein, 6 aa, Entamoeba dispar
CSTSSA

SEQ ID NO: 2360661 - protein, 18 aa, Entamoeba dispar
CSTSSDEVNEACGRCGDG

SEQ ID NO: 2360662 - protein, 11 aa, Entamoeba dispar
CSTTDGEISKC

SEQ ID NO: 2360663 - protein, 9 aa, Entamoeba dispar
CTANSCTSC

SEQ ID NO: 2360664 - protein, 5 aa, Entamoeba dispar
CTAPA

SEQ ID NO: 2360665 - protein, 15 aa, Entamoeba dispar
CTDDIKPTSITESGI

SEQ ID NO: 2360666 - protein, 15 aa, Entamoeba dispar
CTDPTSSVLTGDYTK

SEQ ID NO: 2360667 - protein, 9 aa, Entamoeba dispar
CTEPPKTRY

SEQ ID NO: 2360668 - protein, 10 aa, Entamoeba dispar
CTESSPKTHY

SEQ ID NO: 2360669 - protein, 6 aa, Entamoeba dispar
CTETHS

SEQ ID NO: 2360670 - protein, 5 aa, Entamoeba dispar
CTEYK

SEQ ID NO: 2360671 - protein, 5 aa, Entamoeba dispar
CTGCQ

SEQ ID NO: 2360672 - protein, 9 aa, Entamoeba dispar
CTGDTLETC

SEQ ID NO: 2360673 - protein, 12 aa, Entamoeba dispar
CTGGKTKGCCSG

SEQ ID NO: 2360674 - protein, 16 aa, Entamoeba dispar
CTKCGNGVLDEGEECE

SEQ ID NO: 2360675 - protein, 6 aa, Entamoeba dispar
CTKCNG

SEQ ID NO: 2360676 - protein, 9 aa, Entamoeba dispar
CTKEDDESI

SEQ ID NO: 2360677 - protein, 8 aa, Entamoeba dispar
CTKETGLG

SEQ ID NO: 2360678 - protein, 6 aa, Entamoeba dispar
CTNGNE

SEQ ID NO: 2360679 - protein, 8 aa, Entamoeba dispar
CTNGTYAN

SEQ ID NO: 2360680 - protein, 5 aa, Entamoeba dispar
CTNPY

SEQ ID NO: 2360681 - protein, 7 aa, Entamoeba dispar
CTPPALN

SEQ ID NO: 2360682 - protein, 5 aa, Entamoeba dispar
CTPPT

SEQ ID NO: 2360683 - protein, 12 aa, Entamoeba dispar
CTQKDSTQFEQS

SEQ ID NO: 2360684 - protein, 11 aa, Entamoeba dispar
CTQTGNTCRSC

SEQ ID NO: 2360685 - protein, 9 aa, Entamoeba dispar
CTQTSPTTF

SEQ ID NO: 2360686 - protein, 5 aa, Entamoeba dispar
CTRCT

SEQ ID NO: 2360687 - protein, 5 aa, Entamoeba dispar
CTREC

SEQ ID NO: 2360688 - protein, 6 aa, Entamoeba dispar
CTRTDD

SEQ ID NO: 2360689 - protein, 15 aa, Entamoeba dispar
CTSAKESKCSSCEEN

SEQ ID NO: 2360690 - protein, 6 aa, Entamoeba dispar
CTSAYS

SEQ ID NO: 2360691 - protein, 7 aa, Entamoeba dispar
CTSDSLE

SEQ ID NO: 2360692 - protein, 6 aa, Entamoeba dispar
CTSGTT

SEQ ID NO: 2360693 - protein, 4 aa, Entamoeba dispar
CTSK

SEQ ID NO: 2360694 - protein, 13 aa, Entamoeba dispar
CTSNSKCEMNNNG

SEQ ID NO: 2360695 - protein, 18 aa, Entamoeba dispar
CTSSNLTSDDLEGDYTNY

SEQ ID NO: 2360696 - protein, 10 aa, Entamoeba dispar
CTSSSLTSSV

SEQ ID NO: 2360697 - protein, 10 aa, Entamoeba dispar
CTSTCEDGYG

SEQ ID NO: 2360698 - protein, 12 aa, Entamoeba dispar
CTTAVEDNQDVT

SEQ ID NO: 2360699 - protein, 10 aa, Entamoeba dispar
CTTCKKGNYL

SEQ ID NO: 2360700 - protein, 4 aa, Entamoeba dispar
CTTL

SEQ ID NO: 2360701 - protein, 16 aa, Entamoeba dispar
CVKPTNGKCPIGTSPY

SEQ ID NO: 2360702 - protein, 9 aa, Entamoeba dispar
CVSNNGNIE

SEQ ID NO: 2360703 - protein, 4 aa, Entamoeba dispar
CYDK

SEQ ID NO: 2360704 - protein, 10 aa, Entamoeba dispar
CYGNPQRTAG

SEQ ID NO: 2360705 - protein, 8 aa, Entamoeba dispar
CYKTSTMT

SEQ ID NO: 2360706 - protein, 6 aa, Entamoeba dispar
CYPSIT

SEQ ID NO: 2360707 - protein, 11 aa, Entamoeba dispar
CYQRTDKVTSY

SEQ ID NO: 2360708 - protein, 7 aa, Entamoeba dispar
CYSRSSI

SEQ ID NO: 2360709 - protein, 16 aa, Entamoeba dispar
DAAEQPNYQSGGYKKK

SEQ ID NO: 2360710 - protein, 20 aa, Entamoeba dispar
DAAPAQPTTAPAQQAPQQQS

SEQ ID NO: 2360711 - protein, 8 aa, Entamoeba dispar
DAASSTHL

SEQ ID NO: 2360712 - protein, 12 aa, Entamoeba dispar
DACDTEHSGSDE

SEQ ID NO: 2360713 - protein, 4 aa, Entamoeba dispar
DADE

SEQ ID NO: 2360714 - protein, 15 aa, Entamoeba dispar
DADELSEEADDTVAT

SEQ ID NO: 2360715 - protein, 5 aa, Entamoeba dispar
DADSI

SEQ ID NO: 2360716 - protein, 6 aa, Entamoeba dispar
DAEETK

SEQ ID NO: 2360717 - protein, 5 aa, Entamoeba dispar
DAELR

SEQ ID NO: 2360718 - protein, 4 aa, Entamoeba dispar
DAEP

SEQ ID NO: 2360719 - protein, 34 aa, Entamoeba dispar
DAEPEHPSNCSGCQQHDHKQCSCNENNHTTLESE

SEQ ID NO: 2360720 - protein, 5 aa, Entamoeba dispar
DAETY

SEQ ID NO: 2360721 - protein, 4 aa, Entamoeba dispar
DAGD

SEQ ID NO: 2360722 - protein, 10 aa, Entamoeba dispar
DAGKPNKAED

SEQ ID NO: 2360723 - protein, 9 aa, Entamoeba dispar
DAGNFQRSK

SEQ ID NO: 2360724 - protein, 10 aa, Entamoeba dispar
DAGNIDENSY

SEQ ID NO: 2360725 - protein, 6 aa, Entamoeba dispar
DAIESV

SEQ ID NO: 2360726 - protein, 6 aa, Entamoeba dispar
DAKRNP

SEQ ID NO: 2360727 - protein, 5 aa, Entamoeba dispar
DAKTP

SEQ ID NO: 2360728 - protein, 8 aa, Entamoeba dispar
DALAPLNK

SEQ ID NO: 2360729 - protein, 6 aa, Entamoeba dispar
DALNND

SEQ ID NO: 2360730 - protein, 8 aa, Entamoeba dispar
DALPNKKG

SEQ ID NO: 2360731 - protein, 29 aa, Entamoeba dispar
DANPKREKDSDEDSNTSEDTNELKLESSS

SEQ ID NO: 2360732 - protein, 7 aa, Entamoeba dispar
DANPLSP

SEQ ID NO: 2360733 - protein, 6 aa, Entamoeba dispar
DAPNHL

SEQ ID NO: 2360734 - protein, 8 aa, Entamoeba dispar
DAPNHPEF

SEQ ID NO: 2360735 - protein, 9 aa, Entamoeba dispar
DAPSNQTEE

SEQ ID NO: 2360736 - protein, 23 aa, Entamoeba dispar
DAPSRKASTSGVDESDNTNGSGF

SEQ ID NO: 2360737 - protein, 11 aa, Entamoeba dispar
DAQGKYTNHRK

SEQ ID NO: 2360738 - protein, 5 aa, Entamoeba dispar
DAREE

SEQ ID NO: 2360739 - protein, 6 aa, Entamoeba dispar
DASAGF

SEQ ID NO: 2360740 - protein, 8 aa, Entamoeba dispar
DASEEGKS

SEQ ID NO: 2360741 - protein, 8 aa, Entamoeba dispar
DASESEGI

SEQ ID NO: 2360742 - protein, 9 aa, Entamoeba dispar
DASGRTPDV

SEQ ID NO: 2360743 - protein, 11 aa, Entamoeba dispar
DASSKAKEGNA

SEQ ID NO: 2360744 - protein, 8 aa, Entamoeba dispar
DATPLTNN

SEQ ID NO: 2360745 - protein, 12 aa, Entamoeba dispar
DAYATKHGNHQL

SEQ ID NO: 2360746 - protein, 4 aa, Entamoeba dispar
DAYD

SEQ ID NO: 2360747 - protein, 7 aa, Entamoeba dispar
DAYLPTE

SEQ ID NO: 2360748 - protein, 4 aa, Entamoeba dispar
DCET

SEQ ID NO: 2360749 - protein, 7 aa, Entamoeba dispar
DCGGQNY

SEQ ID NO: 2360750 - protein, 13 aa, Entamoeba dispar
DCGQSQNDDPEGV

SEQ ID NO: 2360751 - protein, 7 aa, Entamoeba dispar
DCKPCTD

SEQ ID NO: 2360752 - protein, 7 aa, Entamoeba dispar
DCLPSRS

SEQ ID NO: 2360753 - protein, 5 aa, Entamoeba dispar
DCMPS

SEQ ID NO: 2360754 - protein, 13 aa, Entamoeba dispar
DCNEEYTGTNKNK

SEQ ID NO: 2360755 - protein, 8 aa, Entamoeba dispar
DCNSAPAK

SEQ ID NO: 2360756 - protein, 7 aa, Entamoeba dispar
DCNSNVD

SEQ ID NO: 2360757 - protein, 29 aa, Entamoeba dispar
DCNTCTEKTCTSCSSPNAINKDGSCEVDP

SEQ ID NO: 2360758 - protein, 30 aa, Entamoeba dispar
DCNTCTEKTCTSCSSPNAYINKDGSCEVDP

SEQ ID NO: 2360759 - protein, 9 aa, Entamoeba dispar
DCSLEKDST

SEQ ID NO: 2360760 - protein, 12 aa, Entamoeba dispar
DCSNEASPSDLL

SEQ ID NO: 2360761 - protein, 8 aa, Entamoeba dispar
DCSSLSEV

SEQ ID NO: 2360762 - protein, 13 aa, Entamoeba dispar
DCSSRKSQCGNFN

SEQ ID NO: 2360763 - protein, 6 aa, Entamoeba dispar
DDCANG

SEQ ID NO: 2360764 - protein, 20 aa, Entamoeba dispar
DDDDDDDSNDNTRSEEEREK

SEQ ID NO: 2360765 - protein, 8 aa, Entamoeba dispar
DDDDTSCD

SEQ ID NO: 2360766 - protein, 19 aa, Entamoeba dispar
DDDEDETPSLKETIDTSTC

SEQ ID NO: 2360767 - protein, 10 aa, Entamoeba dispar
DDDELTKYGN

SEQ ID NO: 2360768 - protein, 15 aa, Entamoeba dispar
DDDFDNSKRHGIKDG

SEQ ID NO: 2360769 - protein, 9 aa, Entamoeba dispar
DDDQCSNHN

SEQ ID NO: 2360770 - protein, 6 aa, Entamoeba dispar
DDDQDF

SEQ ID NO: 2360771 - protein, 7 aa, Entamoeba dispar
DDDQFHR

SEQ ID NO: 2360772 - protein, 6 aa, Entamoeba dispar
DDDRNA

SEQ ID NO: 2360773 - protein, 22 aa, Entamoeba dispar
DDDSKTKCIRSRTDGCGNNSKL

SEQ ID NO: 2360774 - protein, 15 aa, Entamoeba dispar
DDDYNMNRRYELEIL

SEQ ID NO: 2360775 - protein, 8 aa, Entamoeba dispar
DDEAITNA

SEQ ID NO: 2360776 - protein, 10 aa, Entamoeba dispar
DDEARNDCHS

SEQ ID NO: 2360777 - protein, 7 aa, Entamoeba dispar
DDECSSC

SEQ ID NO: 2360778 - protein, 12 aa, Entamoeba dispar
DDECSSCKITTD

SEQ ID NO: 2360779 - protein, 11 aa, Entamoeba dispar
DDEETKKTQGI

SEQ ID NO: 2360780 - protein, 25 aa, Entamoeba dispar
DDEFEPKEYEFGDEEDKYNTPSEEE

SEQ ID NO: 2360781 - protein, 4 aa, Entamoeba dispar
DDEH

SEQ ID NO: 2360782 - protein, 12 aa, Entamoeba dispar
DDEKGNDLIVID

SEQ ID NO: 2360783 - protein, 4 aa, Entamoeba dispar
DDES

SEQ ID NO: 2360784 - protein, 10 aa, Entamoeba dispar
DDESCTHRDN

SEQ ID NO: 2360785 - protein, 8 aa, Entamoeba dispar
DDESGCDP

SEQ ID NO: 2360786 - protein, 10 aa, Entamoeba dispar
DDETCSHRDD

SEQ ID NO: 2360787 - protein, 21 aa, Entamoeba dispar
DDFSQEKFHGQKEENLKTKET

SEQ ID NO: 2360788 - protein, 12 aa, Entamoeba dispar
DDGIDGCGKASR

SEQ ID NO: 2360789 - protein, 11 aa, Entamoeba dispar
DDGKVKDPQGW

SEQ ID NO: 2360790 - protein, 6 aa, Entamoeba dispar
DDGRYC

SEQ ID NO: 2360791 - protein, 10 aa, Entamoeba dispar
DDGSCSHRDD

SEQ ID NO: 2360792 - protein, 8 aa, Entamoeba dispar
DDGSNTNG

SEQ ID NO: 2360793 - protein, 7 aa, Entamoeba dispar
DDGSYQY

SEQ ID NO: 2360794 - protein, 7 aa, Entamoeba dispar
DDGTCAK

SEQ ID NO: 2360795 - protein, 7 aa, Entamoeba dispar
DDGTNDK

SEQ ID NO: 2360796 - protein, 9 aa, Entamoeba dispar
DDGWGSPNI

SEQ ID NO: 2360797 - protein, 7 aa, Entamoeba dispar
DDHRTNW

SEQ ID NO: 2360798 - protein, 17 aa, Entamoeba dispar
DDHRTNWQKFSAHFFVF

SEQ ID NO: 2360799 - protein, 5 aa, Entamoeba dispar
DDHSK

SEQ ID NO: 2360800 - protein, 11 aa, Entamoeba dispar
DDINASEKTNL

SEQ ID NO: 2360801 - protein, 7 aa, Entamoeba dispar
DDINNKK

SEQ ID NO: 2360802 - protein, 6 aa, Entamoeba dispar
DDINTT

SEQ ID NO: 2360803 - protein, 6 aa, Entamoeba dispar
DDIPTN

SEQ ID NO: 2360804 - protein, 13 aa, Entamoeba dispar
DDISKFDGINEQE

SEQ ID NO: 2360805 - protein, 31 aa, Entamoeba dispar
DDISNNNGFSKSLNDGRRKQKSSKYEKTQRR

SEQ ID NO: 2360806 - protein, 4 aa, Entamoeba dispar
DDIT

SEQ ID NO: 2360807 - protein, 9 aa, Entamoeba dispar
DDKDDITDW

SEQ ID NO: 2360808 - protein, 11 aa, Entamoeba dispar
DDKDKSTSWDR

SEQ ID NO: 2360809 - protein, 5 aa, Entamoeba dispar
DDKDN

SEQ ID NO: 2360810 - protein, 9 aa, Entamoeba dispar
DDKGTKLTG

SEQ ID NO: 2360811 - protein, 8 aa, Entamoeba dispar
DDKHKGNM

SEQ ID NO: 2360812 - protein, 7 aa, Entamoeba dispar
DDKINET

SEQ ID NO: 2360813 - protein, 32 aa, Entamoeba dispar
DDKKETKESKSSKPSNPQQQDLEKPKKEEIKM

SEQ ID NO: 2360814 - protein, 5 aa, Entamoeba dispar
DDKKH

SEQ ID NO: 2360815 - protein, 5 aa, Entamoeba dispar
DDKKS

SEQ ID NO: 2360816 - protein, 6 aa, Entamoeba dispar
DDKNEF

SEQ ID NO: 2360817 - protein, 8 aa, Entamoeba dispar
DDKNTDRL

SEQ ID NO: 2360818 - protein, 14 aa, Entamoeba dispar
DDKRKRQPTNNETE

SEQ ID NO: 2360819 - protein, 16 aa, Entamoeba dispar
DDKSSNCARDSTNKGL

SEQ ID NO: 2360820 - protein, 8 aa, Entamoeba dispar
DDKSYRDN

SEQ ID NO: 2360821 - protein, 7 aa, Entamoeba dispar
DDKTETV

SEQ ID NO: 2360822 - protein, 12 aa, Entamoeba dispar
DDKYNLDSTKKQ

SEQ ID NO: 2360823 - protein, 5 aa, Entamoeba dispar
DDLAR

SEQ ID NO: 2360824 - protein, 15 aa, Entamoeba dispar
DDLEPNTSEDCEFEN

SEQ ID NO: 2360825 - protein, 5 aa, Entamoeba dispar
DDLGV

SEQ ID NO: 2360826 - protein, 5 aa, Entamoeba dispar
DDLPG

SEQ ID NO: 2360827 - protein, 6 aa, Entamoeba dispar
DDLPSQ

SEQ ID NO: 2360828 - protein, 4 aa, Entamoeba dispar
DDLQ

SEQ ID NO: 2360829 - protein, 4 aa, Entamoeba dispar
DDLR

SEQ ID NO: 2360830 - protein, 6 aa, Entamoeba dispar
DDNERD

SEQ ID NO: 2360831 - protein, 7 aa, Entamoeba dispar
DDNETRD

SEQ ID NO: 2360832 - protein, 9 aa, Entamoeba dispar
DDNGCNENG

SEQ ID NO: 2360833 - protein, 9 aa, Entamoeba dispar
DDNNKETAK

SEQ ID NO: 2360834 - protein, 11 aa, Entamoeba dispar
DDNRNTDTQPL

SEQ ID NO: 2360835 - protein, 7 aa, Entamoeba dispar
DDNSETE

SEQ ID NO: 2360836 - protein, 7 aa, Entamoeba dispar
DDNTNSF

SEQ ID NO: 2360837 - protein, 16 aa, Entamoeba dispar
DDNVPSKNKTKKPTKF

SEQ ID NO: 2360838 - protein, 7 aa, Entamoeba dispar
DDNVTKG

SEQ ID NO: 2360839 - protein, 10 aa, Entamoeba dispar
DDPDDENGNN

SEQ ID NO: 2360840 - protein, 5 aa, Entamoeba dispar
DDPFI

SEQ ID NO: 2360841 - protein, 8 aa, Entamoeba dispar
DDPKDNEY

SEQ ID NO: 2360842 - protein, 5 aa, Entamoeba dispar
DDPMQ

SEQ ID NO: 2360843 - protein, 8 aa, Entamoeba dispar
DDPNNTSY

SEQ ID NO: 2360844 - protein, 8 aa, Entamoeba dispar
DDPQNKTF

SEQ ID NO: 2360845 - protein, 5 aa, Entamoeba dispar
DDPTN

SEQ ID NO: 2360846 - protein, 17 aa, Entamoeba dispar
DDQEGQKENIQNQEQMK

SEQ ID NO: 2360847 - protein, 9 aa, Entamoeba dispar
DDQNKETAK

SEQ ID NO: 2360848 - protein, 15 aa, Entamoeba dispar
DDQTEVVQEPKQEEI

SEQ ID NO: 2360849 - protein, 5 aa, Entamoeba dispar
DDQTR

SEQ ID NO: 2360850 - protein, 8 aa, Entamoeba dispar
DDSETISC

SEQ ID NO: 2360851 - protein, 9 aa, Entamoeba dispar
DDSFTGCGS

SEQ ID NO: 2360852 - protein, 4 aa, Entamoeba dispar
DDSI

SEQ ID NO: 2360853 - protein, 12 aa, Entamoeba dispar
DDSIQGNLTNST

SEQ ID NO: 2360854 - protein, 6 aa, Entamoeba dispar
DDSKKF

SEQ ID NO: 2360855 - protein, 17 aa, Entamoeba dispar
DDSKNLPETDSKRNYRK

SEQ ID NO: 2360856 - protein, 9 aa, Entamoeba dispar
DDSNHTNID

SEQ ID NO: 2360857 - protein, 65 aa, Entamoeba dispar
DDSNYSDDSSYSDDSSYSDDSNSSEESSSSNSSTVPNDSQCSSNSNNSNTSSTDSKDSSDEKSNT

SEQ ID NO: 2360858 - protein, 8 aa, Entamoeba dispar
DDSPRLSK

SEQ ID NO: 2360859 - protein, 8 aa, Entamoeba dispar
DDSPSGGI

SEQ ID NO: 2360860 - protein, 13 aa, Entamoeba dispar
DDSQQDTQTNIAQ

SEQ ID NO: 2360861 - protein, 9 aa, Entamoeba dispar
DDSQSESPL

SEQ ID NO: 2360862 - protein, 7 aa, Entamoeba dispar
DDSQYTL

SEQ ID NO: 2360863 - protein, 10 aa, Entamoeba dispar
DDSSKKSQEE

SEQ ID NO: 2360864 - protein, 8 aa, Entamoeba dispar
DDSTTRRY

SEQ ID NO: 2360865 - protein, 7 aa, Entamoeba dispar
DDSVKED

SEQ ID NO: 2360866 - protein, 7 aa, Entamoeba dispar
DDTCEKA

SEQ ID NO: 2360867 - protein, 8 aa, Entamoeba dispar
DDTINKEN

SEQ ID NO: 2360868 - protein, 5 aa, Entamoeba dispar
DDTPY

SEQ ID NO: 2360869 - protein, 14 aa, Entamoeba dispar
DDTQANCTACPDGC

SEQ ID NO: 2360870 - protein, 10 aa, Entamoeba dispar
DDTSNQKRPK

SEQ ID NO: 2360871 - protein, 7 aa, Entamoeba dispar
DDTYTER

SEQ ID NO: 2360872 - protein, 11 aa, Entamoeba dispar
DDVDNRRKTTG

SEQ ID NO: 2360873 - protein, 11 aa, Entamoeba dispar
DDVEEPKTNSA

SEQ ID NO: 2360874 - protein, 7 aa, Entamoeba dispar
DDVEPTF

SEQ ID NO: 2360875 - protein, 24 aa, Entamoeba dispar
DDYDSLSKELTQSLQEQGKLKEQL

SEQ ID NO: 2360876 - protein, 7 aa, Entamoeba dispar
DDYQEDV

SEQ ID NO: 2360877 - protein, 4 aa, Entamoeba dispar
DDYS

SEQ ID NO: 2360878 - protein, 5 aa, Entamoeba dispar
DDYSN

SEQ ID NO: 2360879 - protein, 4 aa, Entamoeba dispar
DEAH

SEQ ID NO: 2360880 - protein, 4 aa, Entamoeba dispar
DEAI

SEQ ID NO: 2360881 - protein, 7 aa, Entamoeba dispar
DEAIDKR

SEQ ID NO: 2360882 - protein, 5 aa, Entamoeba dispar
DEASF

SEQ ID NO: 2360883 - protein, 24 aa, Entamoeba dispar
DECDPTESNLKPLSDQVPKNYTKG

SEQ ID NO: 2360884 - protein, 16 aa, Entamoeba dispar
DECNPTNSTIEPTNGE

SEQ ID NO: 2360885 - protein, 11 aa, Entamoeba dispar
DECSKKEIEVE

SEQ ID NO: 2360886 - protein, 18 aa, Entamoeba dispar
DEDAENKFGYANAASQRL

SEQ ID NO: 2360887 - protein, 7 aa, Entamoeba dispar
DEDAPNH

SEQ ID NO: 2360888 - protein, 8 aa, Entamoeba dispar
DEDKEELE

SEQ ID NO: 2360889 - protein, 8 aa, Entamoeba dispar
DEDSNSPL

SEQ ID NO: 2360890 - protein, 37 aa, Entamoeba dispar
DEEADSNIELPKKKGLSSSSSEEMKKPQRGSSKKSNS

SEQ ID NO: 2360891 - protein, 4 aa, Entamoeba dispar
DEED

SEQ ID NO: 2360892 - protein, 13 aa, Entamoeba dispar
DEEDFNGYSQVSN

SEQ ID NO: 2360893 - protein, 13 aa, Entamoeba dispar
DEEEKKFKDENPF

SEQ ID NO: 2360894 - protein, 6 aa, Entamoeba dispar
DEEELA

SEQ ID NO: 2360895 - protein, 14 aa, Entamoeba dispar
DEEFSKSCKQQTLS

SEQ ID NO: 2360896 - protein, 7 aa, Entamoeba dispar
DEEGGLT

SEQ ID NO: 2360897 - protein, 5 aa, Entamoeba dispar
DEEGI

SEQ ID NO: 2360898 - protein, 11 aa, Entamoeba dispar
DEEGKTVGLGT

SEQ ID NO: 2360899 - protein, 10 aa, Entamoeba dispar
DEEGNSPNAI

SEQ ID NO: 2360900 - protein, 4 aa, Entamoeba dispar
DEEK

SEQ ID NO: 2360901 - protein, 13 aa, Entamoeba dispar
DEEKNFKRQGDDL

SEQ ID NO: 2360902 - protein, 11 aa, Entamoeba dispar
DEEKPSVDEDT

SEQ ID NO: 2360903 - protein, 6 aa, Entamoeba dispar
DEENKE

SEQ ID NO: 2360904 - protein, 6 aa, Entamoeba dispar
DEENWD

SEQ ID NO: 2360905 - protein, 10 aa, Entamoeba dispar
DEEPTKRPEI

SEQ ID NO: 2360906 - protein, 5 aa, Entamoeba dispar
DEEQG

SEQ ID NO: 2360907 - protein, 9 aa, Entamoeba dispar
DEEQNGYEC

SEQ ID NO: 2360908 - protein, 10 aa, Entamoeba dispar
DEETENPDDI

SEQ ID NO: 2360909 - protein, 11 aa, Entamoeba dispar
DEEYNQKGLQN

SEQ ID NO: 2360910 - protein, 12 aa, Entamoeba dispar
DEFDPNNLTDSP

SEQ ID NO: 2360911 - protein, 4 aa, Entamoeba dispar
DEFE

SEQ ID NO: 2360912 - protein, 28 aa, Entamoeba dispar
DEFKTKETRIKQQQESLEREKEAIKKQN

SEQ ID NO: 2360913 - protein, 11 aa, Entamoeba dispar
DEGKKIKDGTV

SEQ ID NO: 2360914 - protein, 11 aa, Entamoeba dispar
DEHKCTSDNSI

SEQ ID NO: 2360915 - protein, 13 aa, Entamoeba dispar
DEIDENEMNIHKE

SEQ ID NO: 2360916 - protein, 4 aa, Entamoeba dispar
DEIK

SEQ ID NO: 2360917 - protein, 20 aa, Entamoeba dispar
DEIKEKKTLDPKRKITSQEA

SEQ ID NO: 2360918 - protein, 15 aa, Entamoeba dispar
DEIKSSDRNITKEKV

SEQ ID NO: 2360919 - protein, 6 aa, Entamoeba dispar
DEIPNT

SEQ ID NO: 2360920 - protein, 12 aa, Entamoeba dispar
DEIPRNQSKACD

SEQ ID NO: 2360921 - protein, 13 aa, Entamoeba dispar
DEIQEEKQIGEGS

SEQ ID NO: 2360922 - protein, 32 aa, Entamoeba dispar
DEIRDDSEELEEENSSQDFEESDEIGDEESQV

SEQ ID NO: 2360923 - protein, 15 aa, Entamoeba dispar
DEITQYEKKDKNTFQ

SEQ ID NO: 2360924 - protein, 6 aa, Entamoeba dispar
DEIYSH

SEQ ID NO: 2360925 - protein, 6 aa, Entamoeba dispar
DEKDKR

SEQ ID NO: 2360926 - protein, 32 aa, Entamoeba dispar
DEKDTVNNQTPVPIEDTSNKSTELQEPTQNVG

SEQ ID NO: 2360927 - protein, 6 aa, Entamoeba dispar
DEKGEL

SEQ ID NO: 2360928 - protein, 8 aa, Entamoeba dispar
DEKGNTPL

SEQ ID NO: 2360929 - protein, 7 aa, Entamoeba dispar
DEKGYRS

SEQ ID NO: 2360930 - protein, 18 aa, Entamoeba dispar
DEKIEGAEVRNSSIPEEL

SEQ ID NO: 2360931 - protein, 32 aa, Entamoeba dispar
DEKKEEHQSLKHKEKKLKKSKKHQEEGDDPMI

SEQ ID NO: 2360932 - protein, 6 aa, Entamoeba dispar
DEKKGI

SEQ ID NO: 2360933 - protein, 5 aa, Entamoeba dispar
DEKLS

SEQ ID NO: 2360934 - protein, 4 aa, Entamoeba dispar
DEKP

SEQ ID NO: 2360935 - protein, 8 aa, Entamoeba dispar
DEKPNENL

SEQ ID NO: 2360936 - protein, 10 aa, Entamoeba dispar
DEKRIDRSWG

SEQ ID NO: 2360937 - protein, 8 aa, Entamoeba dispar
DEKTTSID

SEQ ID NO: 2360938 - protein, 23 aa, Entamoeba dispar
DEKVADGVDEISQAQNYQKKASK

SEQ ID NO: 2360939 - protein, 14 aa, Entamoeba dispar
DELDGNNKDEWGDN

SEQ ID NO: 2360940 - protein, 17 aa, Entamoeba dispar
DELENKTVEIKEEEEVV

SEQ ID NO: 2360941 - protein, 10 aa, Entamoeba dispar
DELPDIEDDE

SEQ ID NO: 2360942 - protein, 9 aa, Entamoeba dispar
DELQDDVQQ

SEQ ID NO: 2360943 - protein, 8 aa, Entamoeba dispar
DELQEDVQ

SEQ ID NO: 2360944 - protein, 7 aa, Entamoeba dispar
DELVPNE

SEQ ID NO: 2360945 - protein, 20 aa, Entamoeba dispar
DENAPDAGQCWSSNNTSGSL

SEQ ID NO: 2360946 - protein, 17 aa, Entamoeba dispar
DENCAFDGSEYGECGEN

SEQ ID NO: 2360947 - protein, 6 aa, Entamoeba dispar
DENDDP

SEQ ID NO: 2360948 - protein, 7 aa, Entamoeba dispar
DENEECD

SEQ ID NO: 2360949 - protein, 9 aa, Entamoeba dispar
DENEEEYGQ

SEQ ID NO: 2360950 - protein, 10 aa, Entamoeba dispar
DENEGQNVTI

SEQ ID NO: 2360951 - protein, 7 aa, Entamoeba dispar
DENGKTI

SEQ ID NO: 2360952 - protein, 15 aa, Entamoeba dispar
DENLPQSNKIEIEQS

SEQ ID NO: 2360953 - protein, 7 aa, Entamoeba dispar
DENTEEA

SEQ ID NO: 2360954 - protein, 6 aa, Entamoeba dispar
DENYAS

SEQ ID NO: 2360955 - protein, 4 aa, Entamoeba dispar
DEPE

SEQ ID NO: 2360956 - protein, 7 aa, Entamoeba dispar
DEPIKKQ

SEQ ID NO: 2360957 - protein, 11 aa, Entamoeba dispar
DEPPTNSKCSE

SEQ ID NO: 2360958 - protein, 8 aa, Entamoeba dispar
DEPSTNCV

SEQ ID NO: 2360959 - protein, 5 aa, Entamoeba dispar
DEPTF

SEQ ID NO: 2360960 - protein, 6 aa, Entamoeba dispar
DEPTKH

SEQ ID NO: 2360961 - protein, 7 aa, Entamoeba dispar
DEPVQTT

SEQ ID NO: 2360962 - protein, 23 aa, Entamoeba dispar
DEQINNRSREETENELEQVVMID

SEQ ID NO: 2360963 - protein, 6 aa, Entamoeba dispar
DEQKEN

SEQ ID NO: 2360964 - protein, 10 aa, Entamoeba dispar
DEQKLQQKEI

SEQ ID NO: 2360965 - protein, 6 aa, Entamoeba dispar
DEQKQQ

SEQ ID NO: 2360966 - protein, 5 aa, Entamoeba dispar
DEQLH

SEQ ID NO: 2360967 - protein, 14 aa, Entamoeba dispar
DEQPMYDKDGQYVP

SEQ ID NO: 2360968 - protein, 5 aa, Entamoeba dispar
DERDS

SEQ ID NO: 2360969 - protein, 7 aa, Entamoeba dispar
DERGNAG

SEQ ID NO: 2360970 - protein, 5 aa, Entamoeba dispar
DERIQ

SEQ ID NO: 2360971 - protein, 16 aa, Entamoeba dispar
DERSTSPNALSETSDA

SEQ ID NO: 2360972 - protein, 12 aa, Entamoeba dispar
DESCYYKKEGNK

SEQ ID NO: 2360973 - protein, 5 aa, Entamoeba dispar
DESDL

SEQ ID NO: 2360974 - protein, 22 aa, Entamoeba dispar
DESEIEQPPKELYEEEMKEQQQ

SEQ ID NO: 2360975 - protein, 11 aa, Entamoeba dispar
DESFDNSKYQP

SEQ ID NO: 2360976 - protein, 13 aa, Entamoeba dispar
DESLQQTNSSCIG

SEQ ID NO: 2360977 - protein, 108 aa, Entamoeba dispar
DESLSDNSSENSETSLSNDSSSISESSENVDSESHFSDNSSESGDNESSLSNDSFSSYEPESSETSSSHGSTETSSETSKTQSSESNSMTNNSDDSNNNTDNDGLSGG

SEQ ID NO: 2360978 - protein, 5 aa, Entamoeba dispar
DESMT

SEQ ID NO: 2360979 - protein, 9 aa, Entamoeba dispar
DESNGTSIR

SEQ ID NO: 2360980 - protein, 9 aa, Entamoeba dispar
DESSLENSL

SEQ ID NO: 2360981 - protein, 9 aa, Entamoeba dispar
DESSNNDNK

SEQ ID NO: 2360982 - protein, 5 aa, Entamoeba dispar
DESYD

SEQ ID NO: 2360983 - protein, 7 aa, Entamoeba dispar
DETDGPE

SEQ ID NO: 2360984 - protein, 9 aa, Entamoeba dispar
DETDRDING

SEQ ID NO: 2360985 - protein, 7 aa, Entamoeba dispar
DETEANK

SEQ ID NO: 2360986 - protein, 11 aa, Entamoeba dispar
DETEECDGGDG

SEQ ID NO: 2360987 - protein, 6 aa, Entamoeba dispar
DETEGQ

SEQ ID NO: 2360988 - protein, 33 aa, Entamoeba dispar
DETETNKTEQQNHQEMDPNARAINENNENEVND

SEQ ID NO: 2360989 - protein, 5 aa, Entamoeba dispar
DETFE

SEQ ID NO: 2360990 - protein, 5 aa, Entamoeba dispar
DETIG

SEQ ID NO: 2360991 - protein, 7 aa, Entamoeba dispar
DETNDVE

SEQ ID NO: 2360992 - protein, 9 aa, Entamoeba dispar
DETPKNCSS

SEQ ID NO: 2360993 - protein, 5 aa, Entamoeba dispar
DETTE

SEQ ID NO: 2360994 - protein, 6 aa, Entamoeba dispar
DETTGF

SEQ ID NO: 2360995 - protein, 4 aa, Entamoeba dispar
DETY

SEQ ID NO: 2360996 - protein, 6 aa, Entamoeba dispar
DETYAG

SEQ ID NO: 2360997 - protein, 4 aa, Entamoeba dispar
DEWQ

SEQ ID NO: 2360998 - protein, 13 aa, Entamoeba dispar
DEWTFNESTSKGF

SEQ ID NO: 2360999 - protein, 8 aa, Entamoeba dispar
DEYDSNDL

SEQ ID NO: 2361000 - protein, 10 aa, Entamoeba dispar
DEYGTTTEQK

SEQ ID NO: 2361001 - protein, 5 aa, Entamoeba dispar
DEYNP

SEQ ID NO: 2361002 - protein, 10 aa, Entamoeba dispar
DEYNTEKEIQ

SEQ ID NO: 2361003 - protein, 13 aa, Entamoeba dispar
DEYSKKINRNELT

SEQ ID NO: 2361004 - protein, 8 aa, Entamoeba dispar
DFDNQSDE

SEQ ID NO: 2361005 - protein, 9 aa, Entamoeba dispar
DFDTGTASY

SEQ ID NO: 2361006 - protein, 26 aa, Entamoeba dispar
DFEETNKTRTKENENNEYQPNCSPEN

SEQ ID NO: 2361007 - protein, 6 aa, Entamoeba dispar
DFEKKS

SEQ ID NO: 2361008 - protein, 13 aa, Entamoeba dispar
DFETWNEKDKENM

SEQ ID NO: 2361009 - protein, 4 aa, Entamoeba dispar
DFGE

SEQ ID NO: 2361010 - protein, 5 aa, Entamoeba dispar
DFGET

SEQ ID NO: 2361011 - protein, 4 aa, Entamoeba dispar
DFGG

SEQ ID NO: 2361012 - protein, 5 aa, Entamoeba dispar
DFGSA

SEQ ID NO: 2361013 - protein, 6 aa, Entamoeba dispar
DFGSAR

SEQ ID NO: 2361014 - protein, 7 aa, Entamoeba dispar
DFGSSRN

SEQ ID NO: 2361015 - protein, 9 aa, Entamoeba dispar
DFGSSRNIN

SEQ ID NO: 2361016 - protein, 16 aa, Entamoeba dispar
DFGTSGVYASSSDKLN

SEQ ID NO: 2361017 - protein, 6 aa, Entamoeba dispar
DFGTSQ

SEQ ID NO: 2361018 - protein, 8 aa, Entamoeba dispar
DFGTSQAY

SEQ ID NO: 2361019 - protein, 14 aa, Entamoeba dispar
DFGTSRAVQEYEGN

SEQ ID NO: 2361020 - protein, 4 aa, Entamoeba dispar
DFNT

SEQ ID NO: 2361021 - protein, 8 aa, Entamoeba dispar
DFNTPGGV

SEQ ID NO: 2361022 - protein, 9 aa, Entamoeba dispar
DFPKEETPI

SEQ ID NO: 2361023 - protein, 9 aa, Entamoeba dispar
DFPNEEESV

SEQ ID NO: 2361024 - protein, 10 aa, Entamoeba dispar
DFPNEEESVE

SEQ ID NO: 2361025 - protein, 11 aa, Entamoeba dispar
DFQSSKESQKL

SEQ ID NO: 2361026 - protein, 19 aa, Entamoeba dispar
DFSQNNAQETDPTKVYLLS

SEQ ID NO: 2361027 - protein, 14 aa, Entamoeba dispar
DFSSGAACPCSSSN

SEQ ID NO: 2361028 - protein, 6 aa, Entamoeba dispar
DFTSIN

SEQ ID NO: 2361029 - protein, 6 aa, Entamoeba dispar
DGAKGI

SEQ ID NO: 2361030 - protein, 18 aa, Entamoeba dispar
DGCGNISEEVKNVEKTVP

SEQ ID NO: 2361031 - protein, 5 aa, Entamoeba dispar
DGCSQ

SEQ ID NO: 2361032 - protein, 7 aa, Entamoeba dispar
DGDAGYE

SEQ ID NO: 2361033 - protein, 14 aa, Entamoeba dispar
DGDCKYDGPCNPSN

SEQ ID NO: 2361034 - protein, 7 aa, Entamoeba dispar
DGDGYCN

SEQ ID NO: 2361035 - protein, 4 aa, Entamoeba dispar
DGDH

SEQ ID NO: 2361036 - protein, 5 aa, Entamoeba dispar
DGDIA

SEQ ID NO: 2361037 - protein, 21 aa, Entamoeba dispar
DGDIAEYNPEDGAGDDNEDPI

SEQ ID NO: 2361038 - protein, 19 aa, Entamoeba dispar
DGDLPSESIEALPEGADED

SEQ ID NO: 2361039 - protein, 5 aa, Entamoeba dispar
DGDLR

SEQ ID NO: 2361040 - protein, 9 aa, Entamoeba dispar
DGDNSESSL

SEQ ID NO: 2361041 - protein, 11 aa, Entamoeba dispar
DGDPNGKDDEF

SEQ ID NO: 2361042 - protein, 20 aa, Entamoeba dispar
DGDPNGKDEEIEVGQAPSNR

SEQ ID NO: 2361043 - protein, 5 aa, Entamoeba dispar
DGDPR

SEQ ID NO: 2361044 - protein, 24 aa, Entamoeba dispar
DGDPYGEDDEFEVGQSPSSNIPNI

SEQ ID NO: 2361045 - protein, 9 aa, Entamoeba dispar
DGDSYEDLG

SEQ ID NO: 2361046 - protein, 5 aa, Entamoeba dispar
DGDYE

SEQ ID NO: 2361047 - protein, 5 aa, Entamoeba dispar
DGEEL

SEQ ID NO: 2361048 - protein, 8 aa, Entamoeba dispar
DGEENDEL

SEQ ID NO: 2361049 - protein, 7 aa, Entamoeba dispar
DGEGKVG

SEQ ID NO: 2361050 - protein, 7 aa, Entamoeba dispar
DGEKNGF

SEQ ID NO: 2361051 - protein, 7 aa, Entamoeba dispar
DGEQNEI

SEQ ID NO: 2361052 - protein, 7 aa, Entamoeba dispar
DGETKEE

SEQ ID NO: 2361053 - protein, 6 aa, Entamoeba dispar
DGETTD

SEQ ID NO: 2361054 - protein, 4 aa, Entamoeba dispar
DGEV

SEQ ID NO: 2361055 - protein, 19 aa, Entamoeba dispar
DGFEDRSGEANSKCTTLGG

SEQ ID NO: 2361056 - protein, 18 aa, Entamoeba dispar
DGFENGKDKQCESRTNDY

SEQ ID NO: 2361057 - protein, 6 aa, Entamoeba dispar
DGFNPE

SEQ ID NO: 2361058 - protein, 14 aa, Entamoeba dispar
DGFTTDPNDPLSCK

SEQ ID NO: 2361059 - protein, 6 aa, Entamoeba dispar
DGGDRL

SEQ ID NO: 2361060 - protein, 6 aa, Entamoeba dispar
DGGHDD

SEQ ID NO: 2361061 - protein, 8 aa, Entamoeba dispar
DGGLKTPG

SEQ ID NO: 2361062 - protein, 6 aa, Entamoeba dispar
DGGYYQ

SEQ ID NO: 2361063 - protein, 7 aa, Entamoeba dispar
DGHPTSW

SEQ ID NO: 2361064 - protein, 7 aa, Entamoeba dispar
DGHSNYS

SEQ ID NO: 2361065 - protein, 11 aa, Entamoeba dispar
DGIEKQTQKNI

SEQ ID NO: 2361066 - protein, 11 aa, Entamoeba dispar
DGIRARSSGIC

SEQ ID NO: 2361067 - protein, 5 aa, Entamoeba dispar
DGISY

SEQ ID NO: 2361068 - protein, 4 aa, Entamoeba dispar
DGIT

SEQ ID NO: 2361069 - protein, 12 aa, Entamoeba dispar
DGKIKEDRTTSY

SEQ ID NO: 2361070 - protein, 17 aa, Entamoeba dispar
DGKKAKVEYSSNKKLGQ

SEQ ID NO: 2361071 - protein, 6 aa, Entamoeba dispar
DGKLSS

SEQ ID NO: 2361072 - protein, 6 aa, Entamoeba dispar
DGKPPL

SEQ ID NO: 2361073 - protein, 7 aa, Entamoeba dispar
DGKPQYT

SEQ ID NO: 2361074 - protein, 15 aa, Entamoeba dispar
DGKQARKTGSGSPLG

SEQ ID NO: 2361075 - protein, 16 aa, Entamoeba dispar
DGKQARKTGSGSPLGE

SEQ ID NO: 2361076 - protein, 9 aa, Entamoeba dispar
DGKQNNKYT

SEQ ID NO: 2361077 - protein, 4 aa, Entamoeba dispar
DGKR

SEQ ID NO: 2361078 - protein, 7 aa, Entamoeba dispar
DGKTPRV

SEQ ID NO: 2361079 - protein, 9 aa, Entamoeba dispar
DGKTYPLRG

SEQ ID NO: 2361080 - protein, 8 aa, Entamoeba dispar
DGKVEQTI

SEQ ID NO: 2361081 - protein, 7 aa, Entamoeba dispar
DGKWSNK

SEQ ID NO: 2361082 - protein, 8 aa, Entamoeba dispar
DGKYGQDD

SEQ ID NO: 2361083 - protein, 5 aa, Entamoeba dispar
DGLTD

SEQ ID NO: 2361084 - protein, 10 aa, Entamoeba dispar
DGLTSDRPDI

SEQ ID NO: 2361085 - protein, 5 aa, Entamoeba dispar
DGNEG

SEQ ID NO: 2361086 - protein, 12 aa, Entamoeba dispar
DGNEYVQNGNYE

SEQ ID NO: 2361087 - protein, 15 aa, Entamoeba dispar
DGNFASTDTRERPSL

SEQ ID NO: 2361088 - protein, 13 aa, Entamoeba dispar
DGNGTSDNAFKPE

SEQ ID NO: 2361089 - protein, 5 aa, Entamoeba dispar
DGNHF

SEQ ID NO: 2361090 - protein, 9 aa, Entamoeba dispar
DGNQKFTQH

SEQ ID NO: 2361091 - protein, 27 aa, Entamoeba dispar
DGNQRFTQNDIETALGKEEAEKNEGVA

SEQ ID NO: 2361092 - protein, 39 aa, Entamoeba dispar
DGNVSESSELDKEEDADEKSPEENENVQPTGTPEQKPSN

SEQ ID NO: 2361093 - protein, 39 aa, Entamoeba dispar
DGNVSESSELDKEEDSDEKSPEENENVQPTGTPEQKPSN

SEQ ID NO: 2361094 - protein, 39 aa, Entamoeba dispar
DGNVSESSELDKEEGADEKSPEENENVQPTGTPEQKPSN

SEQ ID NO: 2361095 - protein, 7 aa, Entamoeba dispar
DGNYEES

SEQ ID NO: 2361096 - protein, 14 aa, Entamoeba dispar
DGPCTENGQCPYEC

SEQ ID NO: 2361097 - protein, 5 aa, Entamoeba dispar
DGPFV

SEQ ID NO: 2361098 - protein, 4 aa, Entamoeba dispar
DGQK

SEQ ID NO: 2361099 - protein, 4 aa, Entamoeba dispar
DGQV

SEQ ID NO: 2361100 - protein, 6 aa, Entamoeba dispar
DGRCSS

SEQ ID NO: 2361101 - protein, 6 aa, Entamoeba dispar
DGRLAK

SEQ ID NO: 2361102 - protein, 11 aa, Entamoeba dispar
DGRSHKPTLIT

SEQ ID NO: 2361103 - protein, 5 aa, Entamoeba dispar
DGSFQ

SEQ ID NO: 2361104 - protein, 5 aa, Entamoeba dispar
DGSGC

SEQ ID NO: 2361105 - protein, 7 aa, Entamoeba dispar
DGSISME

SEQ ID NO: 2361106 - protein, 32 aa, Entamoeba dispar
DGSKEDEEQGRSDDNFEDENEIKEDKSLPPHD

SEQ ID NO: 2361107 - protein, 9 aa, Entamoeba dispar
DGSKPQGKW

SEQ ID NO: 2361108 - protein, 12 aa, Entamoeba dispar
DGSLGCKNKATL

SEQ ID NO: 2361109 - protein, 8 aa, Entamoeba dispar
DGSNGKNI

SEQ ID NO: 2361110 - protein, 7 aa, Entamoeba dispar
DGSPPIL

SEQ ID NO: 2361111 - protein, 10 aa, Entamoeba dispar
DGSPVESNYY

SEQ ID NO: 2361112 - protein, 8 aa, Entamoeba dispar
DGSSQMTL

SEQ ID NO: 2361113 - protein, 6 aa, Entamoeba dispar
DGSTQI

SEQ ID NO: 2361114 - protein, 6 aa, Entamoeba dispar
DGSVGC

SEQ ID NO: 2361115 - protein, 5 aa, Entamoeba dispar
DGSVK

SEQ ID NO: 2361116 - protein, 6 aa, Entamoeba dispar
DGTCTA

SEQ ID NO: 2361117 - protein, 4 aa, Entamoeba dispar
DGTE

SEQ ID NO: 2361118 - protein, 4 aa, Entamoeba dispar
DGTF

SEQ ID NO: 2361119 - protein, 7 aa, Entamoeba dispar
DGTGTSF

SEQ ID NO: 2361120 - protein, 6 aa, Entamoeba dispar
DGTKRS

SEQ ID NO: 2361121 - protein, 12 aa, Entamoeba dispar
DGTKRYKMENNG

SEQ ID NO: 2361122 - protein, 8 aa, Entamoeba dispar
DGTNDVGA

SEQ ID NO: 2361123 - protein, 5 aa, Entamoeba dispar
DGTNS

SEQ ID NO: 2361124 - protein, 6 aa, Entamoeba dispar
DGTPTL

SEQ ID NO: 2361125 - protein, 19 aa, Entamoeba dispar
DGTTGYMTSTDKVRDGIGD

SEQ ID NO: 2361126 - protein, 4 aa, Entamoeba dispar
DGTW

SEQ ID NO: 2361127 - protein, 9 aa, Entamoeba dispar
DGVKRSSKL

SEQ ID NO: 2361128 - protein, 4 aa, Entamoeba dispar
DGVN

SEQ ID NO: 2361129 - protein, 4 aa, Entamoeba dispar
DGVT

SEQ ID NO: 2361130 - protein, 10 aa, Entamoeba dispar
DGYEPTQHKT

SEQ ID NO: 2361131 - protein, 7 aa, Entamoeba dispar
DGYEQDI

SEQ ID NO: 2361132 - protein, 14 aa, Entamoeba dispar
DGYFPTMKDDDDRY

SEQ ID NO: 2361133 - protein, 5 aa, Entamoeba dispar
DGYRL

SEQ ID NO: 2361134 - protein, 4 aa, Entamoeba dispar
DGYS

SEQ ID NO: 2361135 - protein, 10 aa, Entamoeba dispar
DGYSPSRDRL

SEQ ID NO: 2361136 - protein, 20 aa, Entamoeba dispar
DGYVKSEGNQIENTSSSEKL

SEQ ID NO: 2361137 - protein, 6 aa, Entamoeba dispar
DGYYNY

SEQ ID NO: 2361138 - protein, 21 aa, Entamoeba dispar
DHANGTKVSFTQEEINPGKEI

SEQ ID NO: 2361139 - protein, 8 aa, Entamoeba dispar
DHDKQTQE

SEQ ID NO: 2361140 - protein, 9 aa, Entamoeba dispar
DHENQQSQE

SEQ ID NO: 2361141 - protein, 6 aa, Entamoeba dispar
DHGQMY

SEQ ID NO: 2361142 - protein, 4 aa, Entamoeba dispar
DHHE

SEQ ID NO: 2361143 - protein, 10 aa, Entamoeba dispar
DHIKETKPLN

SEQ ID NO: 2361144 - protein, 4 aa, Entamoeba dispar
DHIS

SEQ ID NO: 2361145 - protein, 8 aa, Entamoeba dispar
DHKPLTEN

SEQ ID NO: 2361146 - protein, 14 aa, Entamoeba dispar
DHLRPSNDSKTRTS

SEQ ID NO: 2361147 - protein, 5 aa, Entamoeba dispar
DHQET

SEQ ID NO: 2361148 - protein, 8 aa, Entamoeba dispar
DHTPSNCS

SEQ ID NO: 2361149 - protein, 4 aa, Entamoeba dispar
DHTQ

SEQ ID NO: 2361150 - protein, 8 aa, Entamoeba dispar
DHTSCKRC

SEQ ID NO: 2361151 - protein, 4 aa, Entamoeba dispar
DIAQ

SEQ ID NO: 2361152 - protein, 18 aa, Entamoeba dispar
DIASSTASFNSEKYKSVE

SEQ ID NO: 2361153 - protein, 13 aa, Entamoeba dispar
DIDNPQSRMDRSE

SEQ ID NO: 2361154 - protein, 16 aa, Entamoeba dispar
DIDPTNADAHKRRGQT

SEQ ID NO: 2361155 - protein, 15 aa, Entamoeba dispar
DIDQSRCDDTTSPQT

SEQ ID NO: 2361156 - protein, 7 aa, Entamoeba dispar
DIDTNTE

SEQ ID NO: 2361157 - protein, 24 aa, Entamoeba dispar
DIEAKDITRKDNEGETKENKKIIQ

SEQ ID NO: 2361158 - protein, 5 aa, Entamoeba dispar
DIEDL

SEQ ID NO: 2361159 - protein, 5 aa, Entamoeba dispar
DIEEG

SEQ ID NO: 2361160 - protein, 4 aa, Entamoeba dispar
DIEG

SEQ ID NO: 2361161 - protein, 7 aa, Entamoeba dispar
DIEKTNK

SEQ ID NO: 2361162 - protein, 4 aa, Entamoeba dispar
DIEQ

SEQ ID NO: 2361163 - protein, 4 aa, Entamoeba dispar
DIES

SEQ ID NO: 2361164 - protein, 5 aa, Entamoeba dispar
DIESP

SEQ ID NO: 2361165 - protein, 8 aa, Entamoeba dispar
DIESTSRN

SEQ ID NO: 2361166 - protein, 4 aa, Entamoeba dispar
DIGE

SEQ ID NO: 2361167 - protein, 6 aa, Entamoeba dispar
DIGEGG

SEQ ID NO: 2361168 - protein, 7 aa, Entamoeba dispar
DIGPPQM

SEQ ID NO: 2361169 - protein, 20 aa, Entamoeba dispar
DIGPQNKIESLPDVKPGERA

SEQ ID NO: 2361170 - protein, 20 aa, Entamoeba dispar
DIGQKDVKTEGWQNETNGGK

SEQ ID NO: 2361171 - protein, 13 aa, Entamoeba dispar
DIHSGSSTCQTYK

SEQ ID NO: 2361172 - protein, 15 aa, Entamoeba dispar
DIHTKYQSECNPNNK

SEQ ID NO: 2361173 - protein, 10 aa, Entamoeba dispar
DIKQEDGEVK

SEQ ID NO: 2361174 - protein, 10 aa, Entamoeba dispar
DILPPTYKGE

SEQ ID NO: 2361175 - protein, 4 aa, Entamoeba dispar
DINE

SEQ ID NO: 2361176 - protein, 22 aa, Entamoeba dispar
DINEKEMKDLEEKCKTNKKIGE

SEQ ID NO: 2361177 - protein, 5 aa, Entamoeba dispar
DINNS

SEQ ID NO: 2361178 - protein, 7 aa, Entamoeba dispar
DIPDVDD

SEQ ID NO: 2361179 - protein, 9 aa, Entamoeba dispar
DIPEDEESL

SEQ ID NO: 2361180 - protein, 9 aa, Entamoeba dispar
DIPEDENEF

SEQ ID NO: 2361181 - protein, 17 aa, Entamoeba dispar
DIPEDVTDPSQVPPKPV

SEQ ID NO: 2361182 - protein, 17 aa, Entamoeba dispar
DIPEKTTISLTNKRKET

SEQ ID NO: 2361183 - protein, 10 aa, Entamoeba dispar
DIPKASPWRY

SEQ ID NO: 2361184 - protein, 8 aa, Entamoeba dispar
DIPKLSDT

SEQ ID NO: 2361185 - protein, 7 aa, Entamoeba dispar
DIPNNKQ

SEQ ID NO: 2361186 - protein, 8 aa, Entamoeba dispar
DIPNTDLS

SEQ ID NO: 2361187 - protein, 12 aa, Entamoeba dispar
DIPSGWGKYTNE

SEQ ID NO: 2361188 - protein, 7 aa, Entamoeba dispar
DIQDDED

SEQ ID NO: 2361189 - protein, 5 aa, Entamoeba dispar
DIQPN

SEQ ID NO: 2361190 - protein, 6 aa, Entamoeba dispar
DIRKPE

SEQ ID NO: 2361191 - protein, 13 aa, Entamoeba dispar
DIRTRRNQRQGEF

SEQ ID NO: 2361192 - protein, 6 aa, Entamoeba dispar
DISDAS

SEQ ID NO: 2361193 - protein, 5 aa, Entamoeba dispar
DISEE

SEQ ID NO: 2361194 - protein, 9 aa, Entamoeba dispar
DISERFPKD

SEQ ID NO: 2361195 - protein, 4 aa, Entamoeba dispar
DISK

SEQ ID NO: 2361196 - protein, 5 aa, Entamoeba dispar
DISKE

SEQ ID NO: 2361197 - protein, 5 aa, Entamoeba dispar
DISPN

SEQ ID NO: 2361198 - protein, 15 aa, Entamoeba dispar
DISQVETSDSYSIDP

SEQ ID NO: 2361199 - protein, 10 aa, Entamoeba dispar
DITDDLKANY

SEQ ID NO: 2361200 - protein, 6 aa, Entamoeba dispar
DITEEK

SEQ ID NO: 2361201 - protein, 7 aa, Entamoeba dispar
DITHTRS

SEQ ID NO: 2361202 - protein, 14 aa, Entamoeba dispar
DITKGQKIAATNYP

SEQ ID NO: 2361203 - protein, 17 aa, Entamoeba dispar
DITNPKSFDLSKSTTTF

SEQ ID NO: 2361204 - protein, 10 aa, Entamoeba dispar
DITNSDIENG

SEQ ID NO: 2361205 - protein, 13 aa, Entamoeba dispar
DITPSTTHNINPH

SEQ ID NO: 2361206 - protein, 11 aa, Entamoeba dispar
DITRTGKRTKM

SEQ ID NO: 2361207 - protein, 12 aa, Entamoeba dispar
DIVQSDDSDENV

SEQ ID NO: 2361208 - protein, 23 aa, Entamoeba dispar
DIVTSSSESSDDDDDLEKKSLLS

SEQ ID NO: 2361209 - protein, 10 aa, Entamoeba dispar
DIYQKEPQQL

SEQ ID NO: 2361210 - protein, 4 aa, Entamoeba dispar
DIYT

SEQ ID NO: 2361211 - protein, 14 aa, Entamoeba dispar
DKAFEQEPEEEKST

SEQ ID NO: 2361212 - protein, 4 aa, Entamoeba dispar
DKAI

SEQ ID NO: 2361213 - protein, 31 aa, Entamoeba dispar
DKAKQTGAKIKEKTIEYTKKGANKVKETGAV

SEQ ID NO: 2361214 - protein, 13 aa, Entamoeba dispar
DKALKDPSNPNSE

SEQ ID NO: 2361215 - protein, 20 aa, Entamoeba dispar
DKARKDLEAAQDFEPDSKDI

SEQ ID NO: 2361216 - protein, 9 aa, Entamoeba dispar
DKASKGRTT

SEQ ID NO: 2361217 - protein, 11 aa, Entamoeba dispar
DKASKTNKKWR

SEQ ID NO: 2361218 - protein, 32 aa, Entamoeba dispar
DKCTSCDSSCKQCSSVTGKCTSCPNGEKTVSG

SEQ ID NO: 2361219 - protein, 10 aa, Entamoeba dispar
DKDGQEKTKE

SEQ ID NO: 2361220 - protein, 9 aa, Entamoeba dispar
DKDKIEATG

SEQ ID NO: 2361221 - protein, 18 aa, Entamoeba dispar
DKDSNDKTIISKNSNLTI

SEQ ID NO: 2361222 - protein, 5 aa, Entamoeba dispar
DKEAF

SEQ ID NO: 2361223 - protein, 12 aa, Entamoeba dispar
DKEDECNSKKLP

SEQ ID NO: 2361224 - protein, 9 aa, Entamoeba dispar
DKEEQCGDI

SEQ ID NO: 2361225 - protein, 8 aa, Entamoeba dispar
DKEFPRKE

SEQ ID NO: 2361226 - protein, 7 aa, Entamoeba dispar
DKEIEEL

SEQ ID NO: 2361227 - protein, 14 aa, Entamoeba dispar
DKEIERCKSEGKTY

SEQ ID NO: 2361228 - protein, 6 aa, Entamoeba dispar
DKEKEI

SEQ ID NO: 2361229 - protein, 5 aa, Entamoeba dispar
DKELK

SEQ ID NO: 2361230 - protein, 8 aa, Entamoeba dispar
DKENEATK

SEQ ID NO: 2361231 - protein, 6 aa, Entamoeba dispar
DKENNF

SEQ ID NO: 2361232 - protein, 5 aa, Entamoeba dispar
DKEQK

SEQ ID NO: 2361233 - protein, 15 aa, Entamoeba dispar
DKEQQKYHPLSPSLE

SEQ ID NO: 2361234 - protein, 6 aa, Entamoeba dispar
DKESGL

SEQ ID NO: 2361235 - protein, 9 aa, Entamoeba dispar
DKETGITKD

SEQ ID NO: 2361236 - protein, 7 aa, Entamoeba dispar
DKETGKC

SEQ ID NO: 2361237 - protein, 4 aa, Entamoeba dispar
DKEV

SEQ ID NO: 2361238 - protein, 6 aa, Entamoeba dispar
DKEVTQ

SEQ ID NO: 2361239 - protein, 6 aa, Entamoeba dispar
DKEYAI

SEQ ID NO: 2361240 - protein, 12 aa, Entamoeba dispar
DKEYKCSEHTEK

SEQ ID NO: 2361241 - protein, 7 aa, Entamoeba dispar
DKFKTPK

SEQ ID NO: 2361242 - protein, 6 aa, Entamoeba dispar
DKFNGN

SEQ ID NO: 2361243 - protein, 13 aa, Entamoeba dispar
DKFSRPMTKQNKK

SEQ ID NO: 2361244 - protein, 7 aa, Entamoeba dispar
DKGGSTF

SEQ ID NO: 2361245 - protein, 7 aa, Entamoeba dispar
DKGNAQR

SEQ ID NO: 2361246 - protein, 13 aa, Entamoeba dispar
DKGNSQKKSLRRE

SEQ ID NO: 2361247 - protein, 8 aa, Entamoeba dispar
DKGRTNND

SEQ ID NO: 2361248 - protein, 6 aa, Entamoeba dispar
DKHQYE

SEQ ID NO: 2361249 - protein, 21 aa, Entamoeba dispar
DKIDTVSDKVDDALKNSEAIK

SEQ ID NO: 2361250 - protein, 11 aa, Entamoeba dispar
DKIEEKPISEE

SEQ ID NO: 2361251 - protein, 6 aa, Entamoeba dispar
DKIERL

SEQ ID NO: 2361252 - protein, 6 aa, Entamoeba dispar
DKIERS

SEQ ID NO: 2361253 - protein, 6 aa, Entamoeba dispar
DKIKDN

SEQ ID NO: 2361254 - protein, 14 aa, Entamoeba dispar
DKINKVDDTVSVAK

SEQ ID NO: 2361255 - protein, 6 aa, Entamoeba dispar
DKIPAE

SEQ ID NO: 2361256 - protein, 9 aa, Entamoeba dispar
DKIQGENIE

SEQ ID NO: 2361257 - protein, 7 aa, Entamoeba dispar
DKIQGKE

SEQ ID NO: 2361258 - protein, 15 aa, Entamoeba dispar
DKISNTEPSKVPGSV

SEQ ID NO: 2361259 - protein, 9 aa, Entamoeba dispar
DKITTSGCT

SEQ ID NO: 2361260 - protein, 8 aa, Entamoeba dispar
DKKCKEKQ

SEQ ID NO: 2361261 - protein, 4 aa, Entamoeba dispar
DKKE

SEQ ID NO: 2361262 - protein, 10 aa, Entamoeba dispar
DKKESNSFDE

SEQ ID NO: 2361263 - protein, 16 aa, Entamoeba dispar
DKKKEYKEMQSKVPTE

SEQ ID NO: 2361264 - protein, 8 aa, Entamoeba dispar
DKKKKYPK

SEQ ID NO: 2361265 - protein, 7 aa, Entamoeba dispar
DKKQAST

SEQ ID NO: 2361266 - protein, 9 aa, Entamoeba dispar
DKKRPVPED

SEQ ID NO: 2361267 - protein, 6 aa, Entamoeba dispar
DKKSIK

SEQ ID NO: 2361268 - protein, 10 aa, Entamoeba dispar
DKKSISSARS

SEQ ID NO: 2361269 - protein, 19 aa, Entamoeba dispar
DKKSNGEYQQIDEEENDYS

SEQ ID NO: 2361270 - protein, 9 aa, Entamoeba dispar
DKKSQKGIV

SEQ ID NO: 2361271 - protein, 8 aa, Entamoeba dispar
DKKSRAKA

SEQ ID NO: 2361272 - protein, 35 aa, Entamoeba dispar
DKKSSHVPRKPLPSPKVSVPTRSLSSSPEVSDRTS

SEQ ID NO: 2361273 - protein, 7 aa, Entamoeba dispar
DKKSTSH

SEQ ID NO: 2361274 - protein, 29 aa, Entamoeba dispar
DKKSVSTIPESKNEEQLNTENTDTSTSEI

SEQ ID NO: 2361275 - protein, 5 aa, Entamoeba dispar
DKKSY

SEQ ID NO: 2361276 - protein, 8 aa, Entamoeba dispar
DKKTCIST

SEQ ID NO: 2361277 - protein, 7 aa, Entamoeba dispar
DKKYLGE

SEQ ID NO: 2361278 - protein, 4 aa, Entamoeba dispar
DKLN

SEQ ID NO: 2361279 - protein, 10 aa, Entamoeba dispar
DKLNIKGCSP

SEQ ID NO: 2361280 - protein, 8 aa, Entamoeba dispar
DKLPSELT

SEQ ID NO: 2361281 - protein, 9 aa, Entamoeba dispar
DKLQEGVPE

SEQ ID NO: 2361282 - protein, 19 aa, Entamoeba dispar
DKLQNDGNITKTKASQIYP

SEQ ID NO: 2361283 - protein, 7 aa, Entamoeba dispar
DKLQTVE

SEQ ID NO: 2361284 - protein, 16 aa, Entamoeba dispar
DKMKRRKSIMKTESGT

SEQ ID NO: 2361285 - protein, 9 aa, Entamoeba dispar
DKNCNSCDE

SEQ ID NO: 2361286 - protein, 4 aa, Entamoeba dispar
DKND

SEQ ID NO: 2361287 - protein, 15 aa, Entamoeba dispar
DKNKIQVNSPNNYAY

SEQ ID NO: 2361288 - protein, 7 aa, Entamoeba dispar
DKNLTDN

SEQ ID NO: 2361289 - protein, 5 aa, Entamoeba dispar
DKNTI

SEQ ID NO: 2361290 - protein, 8 aa, Entamoeba dispar
DKNTQKTT

SEQ ID NO: 2361291 - protein, 5 aa, Entamoeba dispar
DKNVK

SEQ ID NO: 2361292 - protein, 11 aa, Entamoeba dispar
DKNVNEAKDYP

SEQ ID NO: 2361293 - protein, 6 aa, Entamoeba dispar
DKPEEM

SEQ ID NO: 2361294 - protein, 6 aa, Entamoeba dispar
DKPIQG

SEQ ID NO: 2361295 - protein, 8 aa, Entamoeba dispar
DKPLPPLP

SEQ ID NO: 2361296 - protein, 8 aa, Entamoeba dispar
DKPPKPSC

SEQ ID NO: 2361297 - protein, 19 aa, Entamoeba dispar
DKPRNEENETESRTVITPS

SEQ ID NO: 2361298 - protein, 12 aa, Entamoeba dispar
DKPYRKTPCGHG

SEQ ID NO: 2361299 - protein, 8 aa, Entamoeba dispar
DKQCQSCG

SEQ ID NO: 2361300 - protein, 19 aa, Entamoeba dispar
DKQELNRKSKKFEISHPTE

SEQ ID NO: 2361301 - protein, 9 aa, Entamoeba dispar
DKQLGTGSL

SEQ ID NO: 2361302 - protein, 6 aa, Entamoeba dispar
DKQQPI

SEQ ID NO: 2361303 - protein, 7 aa, Entamoeba dispar
DKQRSKF

SEQ ID NO: 2361304 - protein, 9 aa, Entamoeba dispar
DKQTNSQPF

SEQ ID NO: 2361305 - protein, 8 aa, Entamoeba dispar
DKREEEGI

SEQ ID NO: 2361306 - protein, 5 aa, Entamoeba dispar
DKRNE

SEQ ID NO: 2361307 - protein, 8 aa, Entamoeba dispar
DKRNNNPM

SEQ ID NO: 2361308 - protein, 6 aa, Entamoeba dispar
DKRRTK

SEQ ID NO: 2361309 - protein, 6 aa, Entamoeba dispar
DKRVQT

SEQ ID NO: 2361310 - protein, 7 aa, Entamoeba dispar
DKSAASS

SEQ ID NO: 2361311 - protein, 5 aa, Entamoeba dispar
DKSEL

SEQ ID NO: 2361312 - protein, 7 aa, Entamoeba dispar
DKSGHKP

SEQ ID NO: 2361313 - protein, 7 aa, Entamoeba dispar
DKSGNGL

SEQ ID NO: 2361314 - protein, 67 aa, Entamoeba dispar
DKSKSDSNNKNQSTSIKTDSQIKTSSTSNQHTINTNTSTSNTISKTQTEESKESHVSDTDSNSSNIE

SEQ ID NO: 2361315 - protein, 8 aa, Entamoeba dispar
DKSLKNNR

SEQ ID NO: 2361316 - protein, 7 aa, Entamoeba dispar
DKSNERI

SEQ ID NO: 2361317 - protein, 6 aa, Entamoeba dispar
DKSPVD

SEQ ID NO: 2361318 - protein, 9 aa, Entamoeba dispar
DKSQFGNIP

SEQ ID NO: 2361319 - protein, 9 aa, Entamoeba dispar
DKSTGIPEE

SEQ ID NO: 2361320 - protein, 5 aa, Entamoeba dispar
DKSTI

SEQ ID NO: 2361321 - protein, 7 aa, Entamoeba dispar
DKSTTPF

SEQ ID NO: 2361322 - protein, 5 aa, Entamoeba dispar
DKSYA

SEQ ID NO: 2361323 - protein, 7 aa, Entamoeba dispar
DKSYKEM

SEQ ID NO: 2361324 - protein, 12 aa, Entamoeba dispar
DKTCQSNEELNG

SEQ ID NO: 2361325 - protein, 10 aa, Entamoeba dispar
DKTDATNNNA

SEQ ID NO: 2361326 - protein, 19 aa, Entamoeba dispar
DKTESSVKVGEKSLESSKS

SEQ ID NO: 2361327 - protein, 17 aa, Entamoeba dispar
DKTETNDDSSKALIDHL

SEQ ID NO: 2361328 - protein, 8 aa, Entamoeba dispar
DKTGEEDV

SEQ ID NO: 2361329 - protein, 8 aa, Entamoeba dispar
DKTGTLTE

SEQ ID NO: 2361330 - protein, 10 aa, Entamoeba dispar
DKTGTLTENE

SEQ ID NO: 2361331 - protein, 10 aa, Entamoeba dispar
DKTGTLTKNE

SEQ ID NO: 2361332 - protein, 9 aa, Entamoeba dispar
DKTGTLTQG

SEQ ID NO: 2361333 - protein, 6 aa, Entamoeba dispar
DKTKDI

SEQ ID NO: 2361334 - protein, 7 aa, Entamoeba dispar
DKTKDNN

SEQ ID NO: 2361335 - protein, 7 aa, Entamoeba dispar
DKTKGEL

SEQ ID NO: 2361336 - protein, 28 aa, Entamoeba dispar
DKTLSKEEDIKTDKTVSNNKKDISGESL

SEQ ID NO: 2361337 - protein, 8 aa, Entamoeba dispar
DKTNNSFN

SEQ ID NO: 2361338 - protein, 16 aa, Entamoeba dispar
DKVDHTDSRIVSTRKK

SEQ ID NO: 2361339 - protein, 14 aa, Entamoeba dispar
DKVNKEIKFNKDKR

SEQ ID NO: 2361340 - protein, 7 aa, Entamoeba dispar
DKVNSST

SEQ ID NO: 2361341 - protein, 10 aa, Entamoeba dispar
DKVPKTEFGT

SEQ ID NO: 2361342 - protein, 6 aa, Entamoeba dispar
DKVSAS

SEQ ID NO: 2361343 - protein, 7 aa, Entamoeba dispar
DKVSINE

SEQ ID NO: 2361344 - protein, 11 aa, Entamoeba dispar
DKYENKKQENE

SEQ ID NO: 2361345 - protein, 5 aa, Entamoeba dispar
DKYHN

SEQ ID NO: 2361346 - protein, 17 aa, Entamoeba dispar
DKYLRNDKTCQSNEELN

SEQ ID NO: 2361347 - protein, 8 aa, Entamoeba dispar
DKYNTTGL

SEQ ID NO: 2361348 - protein, 13 aa, Entamoeba dispar
DLADKISKKTIKR

SEQ ID NO: 2361349 - protein, 9 aa, Entamoeba dispar
DLEDETSHL

SEQ ID NO: 2361350 - protein, 20 aa, Entamoeba dispar
DLEESDSSSESMDEEAQNEI

SEQ ID NO: 2361351 - protein, 10 aa, Entamoeba dispar
DLEKNKDSER

SEQ ID NO: 2361352 - protein, 10 aa, Entamoeba dispar
DLEQSHPSPI

SEQ ID NO: 2361353 - protein, 22 aa, Entamoeba dispar
DLGAQHKRLRTSSEAEPEDSAV

SEQ ID NO: 2361354 - protein, 7 aa, Entamoeba dispar
DLGEDRT

SEQ ID NO: 2361355 - protein, 8 aa, Entamoeba dispar
DLGNGQYD

SEQ ID NO: 2361356 - protein, 5 aa, Entamoeba dispar
DLIKE

SEQ ID NO: 2361357 - protein, 5 aa, Entamoeba dispar
DLISS

SEQ ID NO: 2361358 - protein, 15 aa, Entamoeba dispar
DLKGGEKSLGDKYEE

SEQ ID NO: 2361359 - protein, 8 aa, Entamoeba dispar
DLKPEEFS

SEQ ID NO: 2361360 - protein, 14 aa, Entamoeba dispar
DLKQSLKENKEGKI

SEQ ID NO: 2361361 - protein, 10 aa, Entamoeba dispar
DLKSEKESMT

SEQ ID NO: 2361362 - protein, 11 aa, Entamoeba dispar
DLKSNKNEDIA

SEQ ID NO: 2361363 - protein, 6 aa, Entamoeba dispar
DLNDAF

SEQ ID NO: 2361364 - protein, 5 aa, Entamoeba dispar
DLNGE

SEQ ID NO: 2361365 - protein, 10 aa, Entamoeba dispar
DLNGEEDSFD

SEQ ID NO: 2361366 - protein, 8 aa, Entamoeba dispar
DLNKPNSE

SEQ ID NO: 2361367 - protein, 9 aa, Entamoeba dispar
DLNKPNSEL

SEQ ID NO: 2361368 - protein, 6 aa, Entamoeba dispar
DLNPTN

SEQ ID NO: 2361369 - protein, 7 aa, Entamoeba dispar
DLNQSGE

SEQ ID NO: 2361370 - protein, 8 aa, Entamoeba dispar
DLNSDKGM

SEQ ID NO: 2361371 - protein, 4 aa, Entamoeba dispar
DLPP

SEQ ID NO: 2361372 - protein, 5 aa, Entamoeba dispar
DLPTS

SEQ ID NO: 2361373 - protein, 9 aa, Entamoeba dispar
DLRPDDIDT

SEQ ID NO: 2361374 - protein, 10 aa, Entamoeba dispar
DLSEGEYSFN

SEQ ID NO: 2361375 - protein, 7 aa, Entamoeba dispar
DLSGPES

SEQ ID NO: 2361376 - protein, 7 aa, Entamoeba dispar
DLSINST

SEQ ID NO: 2361377 - protein, 21 aa, Entamoeba dispar
DLSPKNPSNLNEKYEESPEED

SEQ ID NO: 2361378 - protein, 12 aa, Entamoeba dispar
DLSQNIQSSLLS

SEQ ID NO: 2361379 - protein, 12 aa, Entamoeba dispar
DLSSSVKKEDKF

SEQ ID NO: 2361380 - protein, 7 aa, Entamoeba dispar
DLSSTKP

SEQ ID NO: 2361381 - protein, 5 aa, Entamoeba dispar
DLSSV

SEQ ID NO: 2361382 - protein, 6 aa, Entamoeba dispar
DLTNVG

SEQ ID NO: 2361383 - protein, 11 aa, Entamoeba dispar
DLTPQMPPIGE

SEQ ID NO: 2361384 - protein, 10 aa, Entamoeba dispar
DLTVKGSGKV

SEQ ID NO: 2361385 - protein, 8 aa, Entamoeba dispar
DLYGTDDE

SEQ ID NO: 2361386 - protein, 8 aa, Entamoeba dispar
DLYGTDEE

SEQ ID NO: 2361387 - protein, 7 aa, Entamoeba dispar
DLYPQAT

SEQ ID NO: 2361388 - protein, 5 aa, Entamoeba dispar
DMEDS

SEQ ID NO: 2361389 - protein, 5 aa, Entamoeba dispar
DMEKV

SEQ ID NO: 2361390 - protein, 10 aa, Entamoeba dispar
DMTDKQTITI

SEQ ID NO: 2361391 - protein, 14 aa, Entamoeba dispar
DMTEEQKKDNPLEE

SEQ ID NO: 2361392 - protein, 14 aa, Entamoeba dispar
DNCAEVSSNTCGND

SEQ ID NO: 2361393 - protein, 11 aa, Entamoeba dispar
DNCEQSNENGC

SEQ ID NO: 2361394 - protein, 5 aa, Entamoeba dispar
DNCET

SEQ ID NO: 2361395 - protein, 12 aa, Entamoeba dispar
DNCGAIPKTNTT

SEQ ID NO: 2361396 - protein, 10 aa, Entamoeba dispar
DNCGTEGCVS

SEQ ID NO: 2361397 - protein, 13 aa, Entamoeba dispar
DNCKDDEGSRIRY

SEQ ID NO: 2361398 - protein, 10 aa, Entamoeba dispar
DNCPNSNNEE

SEQ ID NO: 2361399 - protein, 6 aa, Entamoeba dispar
DNDEKV

SEQ ID NO: 2361400 - protein, 4 aa, Entamoeba dispar
DNDG

SEQ ID NO: 2361401 - protein, 7 aa, Entamoeba dispar
DNDGKIP

SEQ ID NO: 2361402 - protein, 5 aa, Entamoeba dispar
DNDMP

SEQ ID NO: 2361403 - protein, 13 aa, Entamoeba dispar
DNDNDKFTPGVSK

SEQ ID NO: 2361404 - protein, 13 aa, Entamoeba dispar
DNDNRYNLSSPDY

SEQ ID NO: 2361405 - protein, 8 aa, Entamoeba dispar
DNDPQKRL

SEQ ID NO: 2361406 - protein, 5 aa, Entamoeba dispar
DNDQV

SEQ ID NO: 2361407 - protein, 29 aa, Entamoeba dispar
DNEDTIIETPNPISTVENENTTQFQNSQI

SEQ ID NO: 2361408 - protein, 8 aa, Entamoeba dispar
DNEENSQC

SEQ ID NO: 2361409 - protein, 7 aa, Entamoeba dispar
DNEKTKS

SEQ ID NO: 2361410 - protein, 23 aa, Entamoeba dispar
DNEKVDNSETLPLNSDSSDIEEN

SEQ ID NO: 2361411 - protein, 9 aa, Entamoeba dispar
DNEMTEGSM

SEQ ID NO: 2361412 - protein, 8 aa, Entamoeba dispar
DNENFPLK

SEQ ID NO: 2361413 - protein, 4 aa, Entamoeba dispar
DNEQ

SEQ ID NO: 2361414 - protein, 8 aa, Entamoeba dispar
DNEQQDDI

SEQ ID NO: 2361415 - protein, 9 aa, Entamoeba dispar
DNERGGDGR

SEQ ID NO: 2361416 - protein, 10 aa, Entamoeba dispar
DNETKTPLVK

SEQ ID NO: 2361417 - protein, 6 aa, Entamoeba dispar
DNEYSQ

SEQ ID NO: 2361418 - protein, 4 aa, Entamoeba dispar
DNFN

SEQ ID NO: 2361419 - protein, 14 aa, Entamoeba dispar
DNGDQMSKQYTGTC

SEQ ID NO: 2361420 - protein, 6 aa, Entamoeba dispar
DNGERY

SEQ ID NO: 2361421 - protein, 23 aa, Entamoeba dispar
DNGKTIIEEESEKETIKQTSLGA

SEQ ID NO: 2361422 - protein, 6 aa, Entamoeba dispar
DNGQIG

SEQ ID NO: 2361423 - protein, 7 aa, Entamoeba dispar
DNGSGAV

SEQ ID NO: 2361424 - protein, 9 aa, Entamoeba dispar
DNGSGINEE

SEQ ID NO: 2361425 - protein, 7 aa, Entamoeba dispar
DNHYEDK

SEQ ID NO: 2361426 - protein, 9 aa, Entamoeba dispar
DNIATGRSI

SEQ ID NO: 2361427 - protein, 9 aa, Entamoeba dispar
DNIDTHPPQ

SEQ ID NO: 2361428 - protein, 7 aa, Entamoeba dispar
DNIEKER

SEQ ID NO: 2361429 - protein, 9 aa, Entamoeba dispar
DNIGSQNGM

SEQ ID NO: 2361430 - protein, 8 aa, Entamoeba dispar
DNIPNAKE

SEQ ID NO: 2361431 - protein, 8 aa, Entamoeba dispar
DNIPPPNG

SEQ ID NO: 2361432 - protein, 4 aa, Entamoeba dispar
DNIQ

SEQ ID NO: 2361433 - protein, 5 aa, Entamoeba dispar
DNISE

SEQ ID NO: 2361434 - protein, 9 aa, Entamoeba dispar
DNISSSKDH

SEQ ID NO: 2361435 - protein, 12 aa, Entamoeba dispar
DNIYSGQLSSDA

SEQ ID NO: 2361436 - protein, 8 aa, Entamoeba dispar
DNKDTGIP

SEQ ID NO: 2361437 - protein, 17 aa, Entamoeba dispar
DNKEYNYSSACLMIKTV

SEQ ID NO: 2361438 - protein, 8 aa, Entamoeba dispar
DNKIPKKI

SEQ ID NO: 2361439 - protein, 19 aa, Entamoeba dispar
DNKKDGNSSADINRKIHGR

SEQ ID NO: 2361440 - protein, 9 aa, Entamoeba dispar
DNKKNLKGG

SEQ ID NO: 2361441 - protein, 18 aa, Entamoeba dispar
DNKNKEKKISVTKENQYL

SEQ ID NO: 2361442 - protein, 7 aa, Entamoeba dispar
DNKPTQF

SEQ ID NO: 2361443 - protein, 9 aa, Entamoeba dispar
DNKPTQLNE

SEQ ID NO: 2361444 - protein, 8 aa, Entamoeba dispar
DNKQPPIQ

SEQ ID NO: 2361445 - protein, 6 aa, Entamoeba dispar
DNKREV

SEQ ID NO: 2361446 - protein, 6 aa, Entamoeba dispar
DNKRQL

SEQ ID NO: 2361447 - protein, 5 aa, Entamoeba dispar
DNKSC

SEQ ID NO: 2361448 - protein, 18 aa, Entamoeba dispar
DNLDGKQARRTKSSSPLG

SEQ ID NO: 2361449 - protein, 18 aa, Entamoeba dispar
DNLDGKQARRTSNSSPLG

SEQ ID NO: 2361450 - protein, 10 aa, Entamoeba dispar
DNLDSTSTTL

SEQ ID NO: 2361451 - protein, 10 aa, Entamoeba dispar
DNLEEGYDDT

SEQ ID NO: 2361452 - protein, 5 aa, Entamoeba dispar
DNLGR

SEQ ID NO: 2361453 - protein, 6 aa, Entamoeba dispar
DNLKTY

SEQ ID NO: 2361454 - protein, 16 aa, Entamoeba dispar
DNLNENAQFSSKKGQV

SEQ ID NO: 2361455 - protein, 31 aa, Entamoeba dispar
DNLNSPLLTNSQDGITQRTSESTTTNSEDYL

SEQ ID NO: 2361456 - protein, 7 aa, Entamoeba dispar
DNLPPGF

SEQ ID NO: 2361457 - protein, 6 aa, Entamoeba dispar
DNMNND

SEQ ID NO: 2361458 - protein, 19 aa, Entamoeba dispar
DNMSNTQNCTNRKATINYK

SEQ ID NO: 2361459 - protein, 5 aa, Entamoeba dispar
DNNEY

SEQ ID NO: 2361460 - protein, 6 aa, Entamoeba dispar
DNNFNP

SEQ ID NO: 2361461 - protein, 5 aa, Entamoeba dispar
DNNGC

SEQ ID NO: 2361462 - protein, 4 aa, Entamoeba dispar
DNNH

SEQ ID NO: 2361463 - protein, 8 aa, Entamoeba dispar
DNNNNGTI

SEQ ID NO: 2361464 - protein, 7 aa, Entamoeba dispar
DNNNQEV

SEQ ID NO: 2361465 - protein, 5 aa, Entamoeba dispar
DNNNS

SEQ ID NO: 2361466 - protein, 10 aa, Entamoeba dispar
DNNTDTLTSN

SEQ ID NO: 2361467 - protein, 7 aa, Entamoeba dispar
DNNYRNI

SEQ ID NO: 2361468 - protein, 6 aa, Entamoeba dispar
DNPEVH

SEQ ID NO: 2361469 - protein, 6 aa, Entamoeba dispar
DNPINI

SEQ ID NO: 2361470 - protein, 5 aa, Entamoeba dispar
DNPNE

SEQ ID NO: 2361471 - protein, 10 aa, Entamoeba dispar
DNPNTPHSNC

SEQ ID NO: 2361472 - protein, 7 aa, Entamoeba dispar
DNPSAGG

SEQ ID NO: 2361473 - protein, 7 aa, Entamoeba dispar
DNPYSKE

SEQ ID NO: 2361474 - protein, 12 aa, Entamoeba dispar
DNQHEILSWIRN

SEQ ID NO: 2361475 - protein, 8 aa, Entamoeba dispar
DNQNLPKI

SEQ ID NO: 2361476 - protein, 6 aa, Entamoeba dispar
DNQNYC

SEQ ID NO: 2361477 - protein, 12 aa, Entamoeba dispar
DNQPQPTQKNQV

SEQ ID NO: 2361478 - protein, 5 aa, Entamoeba dispar
DNQQQ

SEQ ID NO: 2361479 - protein, 7 aa, Entamoeba dispar
DNREESL

SEQ ID NO: 2361480 - protein, 8 aa, Entamoeba dispar
DNRGKITN

SEQ ID NO: 2361481 - protein, 5 aa, Entamoeba dispar
DNRKE

SEQ ID NO: 2361482 - protein, 5 aa, Entamoeba dispar
DNSAS

SEQ ID NO: 2361483 - protein, 6 aa, Entamoeba dispar
DNSDVD

SEQ ID NO: 2361484 - protein, 13 aa, Entamoeba dispar
DNSENAGFTSGNP

SEQ ID NO: 2361485 - protein, 4 aa, Entamoeba dispar
DNSF

SEQ ID NO: 2361486 - protein, 21 aa, Entamoeba dispar
DNSKELVKTSQDHANNFASEG

SEQ ID NO: 2361487 - protein, 18 aa, Entamoeba dispar
DNSLSNGTISVKPNSNLL

SEQ ID NO: 2361488 - protein, 7 aa, Entamoeba dispar
DNSMESP

SEQ ID NO: 2361489 - protein, 7 aa, Entamoeba dispar
DNSNCSV

SEQ ID NO: 2361490 - protein, 8 aa, Entamoeba dispar
DNSNFNNK

SEQ ID NO: 2361491 - protein, 6 aa, Entamoeba dispar
DNSNSI

SEQ ID NO: 2361492 - protein, 5 aa, Entamoeba dispar
DNSPD

SEQ ID NO: 2361493 - protein, 20 aa, Entamoeba dispar
DNSPDKTGEKVQRLKSEGHK

SEQ ID NO: 2361494 - protein, 9 aa, Entamoeba dispar
DNSYKDEIT

SEQ ID NO: 2361495 - protein, 4 aa, Entamoeba dispar
DNTI

SEQ ID NO: 2361496 - protein, 42 aa, Entamoeba dispar
DNTKGQYKQTSTSPKSQKVTQPITPRKESTKIDEVQNKSFGR

SEQ ID NO: 2361497 - protein, 4 aa, Entamoeba dispar
DNTL

SEQ ID NO: 2361498 - protein, 9 aa, Entamoeba dispar
DNTLKDPNS

SEQ ID NO: 2361499 - protein, 6 aa, Entamoeba dispar
DNTMPY

SEQ ID NO: 2361500 - protein, 25 aa, Entamoeba dispar
DNTNTTVDPPFTPNPKDSIPKNRAY

SEQ ID NO: 2361501 - protein, 6 aa, Entamoeba dispar
DNTNTY

SEQ ID NO: 2361502 - protein, 20 aa, Entamoeba dispar
DNTNYFAAGGGGSCKSGIKN

SEQ ID NO: 2361503 - protein, 7 aa, Entamoeba dispar
DNTQEIS

SEQ ID NO: 2361504 - protein, 4 aa, Entamoeba dispar
DNTT

SEQ ID NO: 2361505 - protein, 7 aa, Entamoeba dispar
DNVEETN

SEQ ID NO: 2361506 - protein, 6 aa, Entamoeba dispar
DNVTSF

SEQ ID NO: 2361507 - protein, 14 aa, Entamoeba dispar
DPDKPGTKRTYEGT

SEQ ID NO: 2361508 - protein, 12 aa, Entamoeba dispar
DPDLSNTLEEAG

SEQ ID NO: 2361509 - protein, 6 aa, Entamoeba dispar
DPDYIQ

SEQ ID NO: 2361510 - protein, 7 aa, Entamoeba dispar
DPEDAYV

SEQ ID NO: 2361511 - protein, 6 aa, Entamoeba dispar
DPEDDV

SEQ ID NO: 2361512 - protein, 9 aa, Entamoeba dispar
DPEKAAQMR

SEQ ID NO: 2361513 - protein, 4 aa, Entamoeba dispar
DPEL

SEQ ID NO: 2361514 - protein, 7 aa, Entamoeba dispar
DPETKGC

SEQ ID NO: 2361515 - protein, 5 aa, Entamoeba dispar
DPEVT

SEQ ID NO: 2361516 - protein, 13 aa, Entamoeba dispar
DPGSITTDSGYSS

SEQ ID NO: 2361517 - protein, 8 aa, Entamoeba dispar
DPGTYRDE

SEQ ID NO: 2361518 - protein, 13 aa, Entamoeba dispar
DPGYSYDSNKRQC

SEQ ID NO: 2361519 - protein, 10 aa, Entamoeba dispar
DPGYYQPMSG

SEQ ID NO: 2361520 - protein, 6 aa, Entamoeba dispar
DPHASS

SEQ ID NO: 2361521 - protein, 5 aa, Entamoeba dispar
DPIKI

SEQ ID NO: 2361522 - protein, 10 aa, Entamoeba dispar
DPKASKGKRY

SEQ ID NO: 2361523 - protein, 14 aa, Entamoeba dispar
DPKCGDAYKRRGQT

SEQ ID NO: 2361524 - protein, 11 aa, Entamoeba dispar
DPKDAYVKSYE

SEQ ID NO: 2361525 - protein, 6 aa, Entamoeba dispar
DPKDDN

SEQ ID NO: 2361526 - protein, 18 aa, Entamoeba dispar
DPKENKFDNLKTSAKMRS

SEQ ID NO: 2361527 - protein, 9 aa, Entamoeba dispar
DPKGKSIKV

SEQ ID NO: 2361528 - protein, 22 aa, Entamoeba dispar
DPKIKIPKRKEYKTKEPETEEL

SEQ ID NO: 2361529 - protein, 9 aa, Entamoeba dispar
DPKNEDKIR

SEQ ID NO: 2361530 - protein, 8 aa, Entamoeba dispar
DPKNQAIP

SEQ ID NO: 2361531 - protein, 5 aa, Entamoeba dispar
DPKQA

SEQ ID NO: 2361532 - protein, 7 aa, Entamoeba dispar
DPKQSNE

SEQ ID NO: 2361533 - protein, 8 aa, Entamoeba dispar
DPKRKRLS

SEQ ID NO: 2361534 - protein, 13 aa, Entamoeba dispar
DPKRYEATEPSRD

SEQ ID NO: 2361535 - protein, 5 aa, Entamoeba dispar
DPLEK

SEQ ID NO: 2361536 - protein, 5 aa, Entamoeba dispar
DPLKN

SEQ ID NO: 2361537 - protein, 7 aa, Entamoeba dispar
DPLNSGD

SEQ ID NO: 2361538 - protein, 5 aa, Entamoeba dispar
DPLPK

SEQ ID NO: 2361539 - protein, 6 aa, Entamoeba dispar
DPNDDV

SEQ ID NO: 2361540 - protein, 8 aa, Entamoeba dispar
DPNGKPLF

SEQ ID NO: 2361541 - protein, 26 aa, Entamoeba dispar
DPNKISSGGKSKPSISIADGKGNKIN

SEQ ID NO: 2361542 - protein, 12 aa, Entamoeba dispar
DPNKKEEVPKNN

SEQ ID NO: 2361543 - protein, 13 aa, Entamoeba dispar
DPNKVSNDTDSNV

SEQ ID NO: 2361544 - protein, 9 aa, Entamoeba dispar
DPNNTQNGK

SEQ ID NO: 2361545 - protein, 19 aa, Entamoeba dispar
DPNQPTIQPELYLSGWVKN

SEQ ID NO: 2361546 - protein, 8 aa, Entamoeba dispar
DPNSARWT

SEQ ID NO: 2361547 - protein, 6 aa, Entamoeba dispar
DPNSIS

SEQ ID NO: 2361548 - protein, 9 aa, Entamoeba dispar
DPNSSIPSV

SEQ ID NO: 2361549 - protein, 8 aa, Entamoeba dispar
DPNTENFS

SEQ ID NO: 2361550 - protein, 5 aa, Entamoeba dispar
DPNVN

SEQ ID NO: 2361551 - protein, 5 aa, Entamoeba dispar
DPNYN

SEQ ID NO: 2361552 - protein, 6 aa, Entamoeba dispar
DPPNDA

SEQ ID NO: 2361553 - protein, 8 aa, Entamoeba dispar
DPPRNESA

SEQ ID NO: 2361554 - protein, 8 aa, Entamoeba dispar
DPPSSFSR

SEQ ID NO: 2361555 - protein, 7 aa, Entamoeba dispar
DPPTSDF

SEQ ID NO: 2361556 - protein, 9 aa, Entamoeba dispar
DPQHDLNKG

SEQ ID NO: 2361557 - protein, 6 aa, Entamoeba dispar
DPQIPS

SEQ ID NO: 2361558 - protein, 5 aa, Entamoeba dispar
DPQMT

SEQ ID NO: 2361559 - protein, 12 aa, Entamoeba dispar
DPQNNEGTCSSI

SEQ ID NO: 2361560 - protein, 6 aa, Entamoeba dispar
DPQQTV

SEQ ID NO: 2361561 - protein, 12 aa, Entamoeba dispar
DPQTFEDSNYPE

SEQ ID NO: 2361562 - protein, 4 aa, Entamoeba dispar
DPQY

SEQ ID NO: 2361563 - protein, 13 aa, Entamoeba dispar
DPRGAEELTKNKE

SEQ ID NO: 2361564 - protein, 8 aa, Entamoeba dispar
DPRLDKDD

SEQ ID NO: 2361565 - protein, 8 aa, Entamoeba dispar
DPSGNHTP

SEQ ID NO: 2361566 - protein, 6 aa, Entamoeba dispar
DPSIPI

SEQ ID NO: 2361567 - protein, 7 aa, Entamoeba dispar
DPSRPYT

SEQ ID NO: 2361568 - protein, 6 aa, Entamoeba dispar
DPSSPY

SEQ ID NO: 2361569 - protein, 9 aa, Entamoeba dispar
DPSSYQMTG

SEQ ID NO: 2361570 - protein, 9 aa, Entamoeba dispar
DPSTKKKMP

SEQ ID NO: 2361571 - protein, 5 aa, Entamoeba dispar
DPSVK

SEQ ID NO: 2361572 - protein, 5 aa, Entamoeba dispar
DPSVT

SEQ ID NO: 2361573 - protein, 9 aa, Entamoeba dispar
DPTDKGTNY

SEQ ID NO: 2361574 - protein, 4 aa, Entamoeba dispar
DPTF

SEQ ID NO: 2361575 - protein, 6 aa, Entamoeba dispar
DPTNNY

SEQ ID NO: 2361576 - protein, 9 aa, Entamoeba dispar
DPVERTSSN

SEQ ID NO: 2361577 - protein, 8 aa, Entamoeba dispar
DPVNEVSE

SEQ ID NO: 2361578 - protein, 19 aa, Entamoeba dispar
DPVNTDNTKTNRKQDSSVE

SEQ ID NO: 2361579 - protein, 10 aa, Entamoeba dispar
DPYANVDDGS

SEQ ID NO: 2361580 - protein, 12 aa, Entamoeba dispar
DPYDPAKFPDSD

SEQ ID NO: 2361581 - protein, 12 aa, Entamoeba dispar
DPYDPEKFPDSE

SEQ ID NO: 2361582 - protein, 12 aa, Entamoeba dispar
DPYDPIKFPDSE

SEQ ID NO: 2361583 - protein, 12 aa, Entamoeba dispar
DPYNPTKFPDSE

SEQ ID NO: 2361584 - protein, 7 aa, Entamoeba dispar
DPYPKQE

SEQ ID NO: 2361585 - protein, 7 aa, Entamoeba dispar
DPYPNDK

SEQ ID NO: 2361586 - protein, 5 aa, Entamoeba dispar
DQANH

SEQ ID NO: 2361587 - protein, 10 aa, Entamoeba dispar
DQARPKETHK

SEQ ID NO: 2361588 - protein, 6 aa, Entamoeba dispar
DQDALK

SEQ ID NO: 2361589 - protein, 10 aa, Entamoeba dispar
DQDVRTPTKG

SEQ ID NO: 2361590 - protein, 6 aa, Entamoeba dispar
DQETSS

SEQ ID NO: 2361591 - protein, 6 aa, Entamoeba dispar
DQFKRG

SEQ ID NO: 2361592 - protein, 16 aa, Entamoeba dispar
DQGDIQFGENGERVMG

SEQ ID NO: 2361593 - protein, 28 aa, Entamoeba dispar
DQKAEKEKSSKVESKETKPVEETERPKT

SEQ ID NO: 2361594 - protein, 10 aa, Entamoeba dispar
DQKHPLPTNT

SEQ ID NO: 2361595 - protein, 7 aa, Entamoeba dispar
DQLNSDD

SEQ ID NO: 2361596 - protein, 10 aa, Entamoeba dispar
DQLQEGVPST

SEQ ID NO: 2361597 - protein, 5 aa, Entamoeba dispar
DQLTN

SEQ ID NO: 2361598 - protein, 6 aa, Entamoeba dispar
DQNGKI

SEQ ID NO: 2361599 - protein, 9 aa, Entamoeba dispar
DQNKSMDEV

SEQ ID NO: 2361600 - protein, 8 aa, Entamoeba dispar
DQNYKECS

SEQ ID NO: 2361601 - protein, 6 aa, Entamoeba dispar
DQQDSN

SEQ ID NO: 2361602 - protein, 6 aa, Entamoeba dispar
DQQFQE

SEQ ID NO: 2361603 - protein, 8 aa, Entamoeba dispar
DQQGMRDK

SEQ ID NO: 2361604 - protein, 12 aa, Entamoeba dispar
DQQNDVKNYNPT

SEQ ID NO: 2361605 - protein, 6 aa, Entamoeba dispar
DQQNEQ

SEQ ID NO: 2361606 - protein, 8 aa, Entamoeba dispar
DQQQRDTL

SEQ ID NO: 2361607 - protein, 6 aa, Entamoeba dispar
DQRDSA

SEQ ID NO: 2361608 - protein, 13 aa, Entamoeba dispar
DQSENLKEKKYAR

SEQ ID NO: 2361609 - protein, 8 aa, Entamoeba dispar
DQSYASQP

SEQ ID NO: 2361610 - protein, 6 aa, Entamoeba dispar
DQTEQL

SEQ ID NO: 2361611 - protein, 8 aa, Entamoeba dispar
DQTGLKGF

SEQ ID NO: 2361612 - protein, 6 aa, Entamoeba dispar
DQTGVE

SEQ ID NO: 2361613 - protein, 8 aa, Entamoeba dispar
DQTKNKYQ

SEQ ID NO: 2361614 - protein, 4 aa, Entamoeba dispar
DQTN

SEQ ID NO: 2361615 - protein, 6 aa, Entamoeba dispar
DQTTFH

SEQ ID NO: 2361616 - protein, 5 aa, Entamoeba dispar
DQTTL

SEQ ID NO: 2361617 - protein, 6 aa, Entamoeba dispar
DQVPQD

SEQ ID NO: 2361618 - protein, 6 aa, Entamoeba dispar
DQYDDV

SEQ ID NO: 2361619 - protein, 5 aa, Entamoeba dispar
DRAGT

SEQ ID NO: 2361620 - protein, 12 aa, Entamoeba dispar
DRANKNEGSTRY

SEQ ID NO: 2361621 - protein, 15 aa, Entamoeba dispar
DRDDSSGTFPSGHCG

SEQ ID NO: 2361622 - protein, 5 aa, Entamoeba dispar
DRDGN

SEQ ID NO: 2361623 - protein, 8 aa, Entamoeba dispar
DRDGTAIP

SEQ ID NO: 2361624 - protein, 7 aa, Entamoeba dispar
DRDYNGN

SEQ ID NO: 2361625 - protein, 7 aa, Entamoeba dispar
DREGQDN

SEQ ID NO: 2361626 - protein, 5 aa, Entamoeba dispar
DREHQ

SEQ ID NO: 2361627 - protein, 7 aa, Entamoeba dispar
DREQSKL

SEQ ID NO: 2361628 - protein, 5 aa, Entamoeba dispar
DRERI

SEQ ID NO: 2361629 - protein, 5 aa, Entamoeba dispar
DRESI

SEQ ID NO: 2361630 - protein, 5 aa, Entamoeba dispar
DRFSS

SEQ ID NO: 2361631 - protein, 5 aa, Entamoeba dispar
DRGCG

SEQ ID NO: 2361632 - protein, 5 aa, Entamoeba dispar
DRHPS

SEQ ID NO: 2361633 - protein, 13 aa, Entamoeba dispar
DRIRTTTTTTTTN

SEQ ID NO: 2361634 - protein, 4 aa, Entamoeba dispar
DRIT

SEQ ID NO: 2361635 - protein, 5 aa, Entamoeba dispar
DRITS

SEQ ID NO: 2361636 - protein, 6 aa, Entamoeba dispar
DRKREE

SEQ ID NO: 2361637 - protein, 5 aa, Entamoeba dispar
DRKSY

SEQ ID NO: 2361638 - protein, 10 aa, Entamoeba dispar
DRLDATNAKL

SEQ ID NO: 2361639 - protein, 5 aa, Entamoeba dispar
DRLDD

SEQ ID NO: 2361640 - protein, 6 aa, Entamoeba dispar
DRNEND

SEQ ID NO: 2361641 - protein, 7 aa, Entamoeba dispar
DRNKQID

SEQ ID NO: 2361642 - protein, 10 aa, Entamoeba dispar
DRNTTQTPQT

SEQ ID NO: 2361643 - protein, 7 aa, Entamoeba dispar
DRNYEES

SEQ ID NO: 2361644 - protein, 8 aa, Entamoeba dispar
DRPDQGYT

SEQ ID NO: 2361645 - protein, 4 aa, Entamoeba dispar
DRPI

SEQ ID NO: 2361646 - protein, 8 aa, Entamoeba dispar
DRQDIQRK

SEQ ID NO: 2361647 - protein, 8 aa, Entamoeba dispar
DRQGWKEK

SEQ ID NO: 2361648 - protein, 8 aa, Entamoeba dispar
DRSPHSPP

SEQ ID NO: 2361649 - protein, 118 aa, Entamoeba dispar
DRSPSDKRNEFDKRYNRDYDKRHEETKPRRPDSNRPQRPTNKRPTQDRRPSQKDKPGNRPENKRPVQDRKPTNPNRQPVDQKKPRQPTRPEQRRPTNPNNNPTQKPSKIDDKYDPDLG

SEQ ID NO: 2361650 - protein, 8 aa, Entamoeba dispar
DRSSNRCN

SEQ ID NO: 2361651 - protein, 9 aa, Entamoeba dispar
DRSTGTNKI

SEQ ID NO: 2361652 - protein, 4 aa, Entamoeba dispar
DRTN

SEQ ID NO: 2361653 - protein, 6 aa, Entamoeba dispar
DRTNNS

SEQ ID NO: 2361654 - protein, 7 aa, Entamoeba dispar
DRTPASS

SEQ ID NO: 2361655 - protein, 4 aa, Entamoeba dispar
DRTS

SEQ ID NO: 2361656 - protein, 7 aa, Entamoeba dispar
DRTSQTC

SEQ ID NO: 2361657 - protein, 15 aa, Entamoeba dispar
DRTTNGKGNASDYTL

SEQ ID NO: 2361658 - protein, 9 aa, Entamoeba dispar
DRVERPSIA

SEQ ID NO: 2361659 - protein, 14 aa, Entamoeba dispar
DRVSQEGLDDVPGY

SEQ ID NO: 2361660 - protein, 6 aa, Entamoeba dispar
DRYDQQ

SEQ ID NO: 2361661 - protein, 5 aa, Entamoeba dispar
DSANS

SEQ ID NO: 2361662 - protein, 4 aa, Entamoeba dispar
DSAP

SEQ ID NO: 2361663 - protein, 6 aa, Entamoeba dispar
DSAPIK

SEQ ID NO: 2361664 - protein, 10 aa, Entamoeba dispar
DSASPKDRIK

SEQ ID NO: 2361665 - protein, 10 aa, Entamoeba dispar
DSCDSQNKCT

SEQ ID NO: 2361666 - protein, 7 aa, Entamoeba dispar
DSCEVPE

SEQ ID NO: 2361667 - protein, 32 aa, Entamoeba dispar
DSCRGNDKTNYSFPSTPTASEYSDFKTGNCGK

SEQ ID NO: 2361668 - protein, 8 aa, Entamoeba dispar
DSCSDASP

SEQ ID NO: 2361669 - protein, 8 aa, Entamoeba dispar
DSDAQKYT

SEQ ID NO: 2361670 - protein, 5 aa, Entamoeba dispar
DSDCE

SEQ ID NO: 2361671 - protein, 6 aa, Entamoeba dispar
DSDGTR

SEQ ID NO: 2361672 - protein, 17 aa, Entamoeba dispar
DSDLNADPYECKKSNGL

SEQ ID NO: 2361673 - protein, 8 aa, Entamoeba dispar
DSDNLTAE

SEQ ID NO: 2361674 - protein, 9 aa, Entamoeba dispar
DSDSAEHGS

SEQ ID NO: 2361675 - protein, 7 aa, Entamoeba dispar
DSDTGKD

SEQ ID NO: 2361676 - protein, 11 aa, Entamoeba dispar
DSDTSLSKKSS

SEQ ID NO: 2361677 - protein, 7 aa, Entamoeba dispar
DSEDEIG

SEQ ID NO: 2361678 - protein, 6 aa, Entamoeba dispar
DSEEEH

SEQ ID NO: 2361679 - protein, 7 aa, Entamoeba dispar
DSEGNEE

SEQ ID NO: 2361680 - protein, 18 aa, Entamoeba dispar
DSEIDNTKINQPSSSTNF

SEQ ID NO: 2361681 - protein, 7 aa, Entamoeba dispar
DSEKKVN

SEQ ID NO: 2361682 - protein, 4 aa, Entamoeba dispar
DSEL

SEQ ID NO: 2361683 - protein, 5 aa, Entamoeba dispar
DSEMY

SEQ ID NO: 2361684 - protein, 8 aa, Entamoeba dispar
DSENQRGI

SEQ ID NO: 2361685 - protein, 7 aa, Entamoeba dispar
DSEQDNT

SEQ ID NO: 2361686 - protein, 9 aa, Entamoeba dispar
DSESEIITH

SEQ ID NO: 2361687 - protein, 4 aa, Entamoeba dispar
DSEV

SEQ ID NO: 2361688 - protein, 9 aa, Entamoeba dispar
DSEVHEDKS

SEQ ID NO: 2361689 - protein, 7 aa, Entamoeba dispar
DSFGGDD

SEQ ID NO: 2361690 - protein, 8 aa, Entamoeba dispar
DSFPNFPQ

SEQ ID NO: 2361691 - protein, 7 aa, Entamoeba dispar
DSFPPEM

SEQ ID NO: 2361692 - protein, 7 aa, Entamoeba dispar
DSFTQNE

SEQ ID NO: 2361693 - protein, 5 aa, Entamoeba dispar
DSGDC

SEQ ID NO: 2361694 - protein, 13 aa, Entamoeba dispar
DSGQLPTSFFSQP

SEQ ID NO: 2361695 - protein, 9 aa, Entamoeba dispar
DSGRYKKPA

SEQ ID NO: 2361696 - protein, 5 aa, Entamoeba dispar
DSHER

SEQ ID NO: 2361697 - protein, 8 aa, Entamoeba dispar
DSHGNRNV

SEQ ID NO: 2361698 - protein, 25 aa, Entamoeba dispar
DSHTDAQKSQRDDTNKEDSLSTTQK

SEQ ID NO: 2361699 - protein, 9 aa, Entamoeba dispar
DSIEASELK

SEQ ID NO: 2361700 - protein, 4 aa, Entamoeba dispar
DSIG

SEQ ID NO: 2361701 - protein, 4 aa, Entamoeba dispar
DSIK

SEQ ID NO: 2361702 - protein, 10 aa, Entamoeba dispar
DSIKGEMKTL

SEQ ID NO: 2361703 - protein, 31 aa, Entamoeba dispar
DSIPPDKSSISNSSQNLSSNSCDESDCHSKH

SEQ ID NO: 2361704 - protein, 9 aa, Entamoeba dispar
DSISGESKK

SEQ ID NO: 2361705 - protein, 7 aa, Entamoeba dispar
DSIYPEK

SEQ ID NO: 2361706 - protein, 10 aa, Entamoeba dispar
DSKEIKDNSL

SEQ ID NO: 2361707 - protein, 8 aa, Entamoeba dispar
DSKNQNQV

SEQ ID NO: 2361708 - protein, 9 aa, Entamoeba dispar
DSKNSRTGE

SEQ ID NO: 2361709 - protein, 10 aa, Entamoeba dispar
DSKQKAQPVE

SEQ ID NO: 2361710 - protein, 9 aa, Entamoeba dispar
DSKQSKKLK

SEQ ID NO: 2361711 - protein, 13 aa, Entamoeba dispar
DSKTGDCSSCEEG

SEQ ID NO: 2361712 - protein, 7 aa, Entamoeba dispar
DSKTSES

SEQ ID NO: 2361713 - protein, 11 aa, Entamoeba dispar
DSKVTDIVNGQ

SEQ ID NO: 2361714 - protein, 7 aa, Entamoeba dispar
DSKYDST

SEQ ID NO: 2361715 - protein, 8 aa, Entamoeba dispar
DSLANDLS

SEQ ID NO: 2361716 - protein, 9 aa, Entamoeba dispar
DSLASDLTK

SEQ ID NO: 2361717 - protein, 6 aa, Entamoeba dispar
DSLDEE

SEQ ID NO: 2361718 - protein, 8 aa, Entamoeba dispar
DSLDGESD

SEQ ID NO: 2361719 - protein, 7 aa, Entamoeba dispar
DSLENPI

SEQ ID NO: 2361720 - protein, 7 aa, Entamoeba dispar
DSLESSV

SEQ ID NO: 2361721 - protein, 11 aa, Entamoeba dispar
DSLFDESKPDA

SEQ ID NO: 2361722 - protein, 6 aa, Entamoeba dispar
DSLGGS

SEQ ID NO: 2361723 - protein, 6 aa, Entamoeba dispar
DSLNEK

SEQ ID NO: 2361724 - protein, 12 aa, Entamoeba dispar
DSLNSYDPDDIN

SEQ ID NO: 2361725 - protein, 6 aa, Entamoeba dispar
DSLQPI

SEQ ID NO: 2361726 - protein, 8 aa, Entamoeba dispar
DSLSNTKL

SEQ ID NO: 2361727 - protein, 33 aa, Entamoeba dispar
  misc_feature (13)..(14): Xaa can be any naturally occurring amino acid
DSLTHKLNSISFXXRKERRNTRRVFSQNIINKL

SEQ ID NO: 2361728 - protein, 8 aa, Entamoeba dispar
DSMARDDS

SEQ ID NO: 2361729 - protein, 13 aa, Entamoeba dispar
DSMPATEEQPDVC

SEQ ID NO: 2361730 - protein, 9 aa, Entamoeba dispar
DSNARQYEY

SEQ ID NO: 2361731 - protein, 10 aa, Entamoeba dispar
DSNATHSQYM

SEQ ID NO: 2361732 - protein, 8 aa, Entamoeba dispar
DSNDPNPI

SEQ ID NO: 2361733 - protein, 6 aa, Entamoeba dispar
DSNEVF

SEQ ID NO: 2361734 - protein, 12 aa, Entamoeba dispar
DSNEVSNSTSLL

SEQ ID NO: 2361735 - protein, 12 aa, Entamoeba dispar
DSNGRAVAKSIG

SEQ ID NO: 2361736 - protein, 17 aa, Entamoeba dispar
DSNGRCSKCNSNKFRIS

SEQ ID NO: 2361737 - protein, 8 aa, Entamoeba dispar
DSNHCTTC

SEQ ID NO: 2361738 - protein, 7 aa, Entamoeba dispar
DSNIEIS

SEQ ID NO: 2361739 - protein, 24 aa, Entamoeba dispar
DSNINEKRDELMTKSNENNTPTQQ

SEQ ID NO: 2361740 - protein, 5 aa, Entamoeba dispar
DSNNY

SEQ ID NO: 2361741 - protein, 4 aa, Entamoeba dispar
DSNP

SEQ ID NO: 2361742 - protein, 9 aa, Entamoeba dispar
DSNPKSKYV

SEQ ID NO: 2361743 - protein, 11 aa, Entamoeba dispar
DSNPNGIGSGY

SEQ ID NO: 2361744 - protein, 8 aa, Entamoeba dispar
DSNPTKER

SEQ ID NO: 2361745 - protein, 4 aa, Entamoeba dispar
DSNS

SEQ ID NO: 2361746 - protein, 9 aa, Entamoeba dispar
DSNSDQSNR

SEQ ID NO: 2361747 - protein, 7 aa, Entamoeba dispar
DSNSFKS

SEQ ID NO: 2361748 - protein, 5 aa, Entamoeba dispar
DSNSI

SEQ ID NO: 2361749 - protein, 8 aa, Entamoeba dispar
DSNSNVHP

SEQ ID NO: 2361750 - protein, 6 aa, Entamoeba dispar
DSNSYD

SEQ ID NO: 2361751 - protein, 6 aa, Entamoeba dispar
DSNSYP

SEQ ID NO: 2361752 - protein, 7 aa, Entamoeba dispar
DSNSYSL

SEQ ID NO: 2361753 - protein, 14 aa, Entamoeba dispar
DSPEKLIKDIQNKS

SEQ ID NO: 2361754 - protein, 8 aa, Entamoeba dispar
DSPHESRS

SEQ ID NO: 2361755 - protein, 5 aa, Entamoeba dispar
DSPIP

SEQ ID NO: 2361756 - protein, 5 aa, Entamoeba dispar
DSPIQ

SEQ ID NO: 2361757 - protein, 5 aa, Entamoeba dispar
DSPIS

SEQ ID NO: 2361758 - protein, 7 aa, Entamoeba dispar
DSPLEKC

SEQ ID NO: 2361759 - protein, 13 aa, Entamoeba dispar
DSPLTREKVPRTP

SEQ ID NO: 2361760 - protein, 5 aa, Entamoeba dispar
DSPNE

SEQ ID NO: 2361761 - protein, 19 aa, Entamoeba dispar
DSPNPETTEVNGDYGGYDR

SEQ ID NO: 2361762 - protein, 10 aa, Entamoeba dispar
DSPQHPKSVN

SEQ ID NO: 2361763 - protein, 11 aa, Entamoeba dispar
DSPQPREMQDS

SEQ ID NO: 2361764 - protein, 9 aa, Entamoeba dispar
DSPRVRTSD

SEQ ID NO: 2361765 - protein, 5 aa, Entamoeba dispar
DSPYY

SEQ ID NO: 2361766 - protein, 10 aa, Entamoeba dispar
DSQCTKSPYI

SEQ ID NO: 2361767 - protein, 10 aa, Entamoeba dispar
DSQDGIDNTV

SEQ ID NO: 2361768 - protein, 26 aa, Entamoeba dispar
DSQGNVIKSDDHNLKQSTKNSEQEIE

SEQ ID NO: 2361769 - protein, 7 aa, Entamoeba dispar
DSQIKRR

SEQ ID NO: 2361770 - protein, 6 aa, Entamoeba dispar
DSQKNL

SEQ ID NO: 2361771 - protein, 17 aa, Entamoeba dispar
DSQQGEVTSQSYFSDSE

SEQ ID NO: 2361772 - protein, 8 aa, Entamoeba dispar
DSQTSYSN

SEQ ID NO: 2361773 - protein, 10 aa, Entamoeba dispar
DSQYNKSHGF

SEQ ID NO: 2361774 - protein, 9 aa, Entamoeba dispar
DSRALSKRK

SEQ ID NO: 2361775 - protein, 13 aa, Entamoeba dispar
DSRGKKGGSSFEK

SEQ ID NO: 2361776 - protein, 4 aa, Entamoeba dispar
DSRH

SEQ ID NO: 2361777 - protein, 9 aa, Entamoeba dispar
DSRKEGNDY

SEQ ID NO: 2361778 - protein, 8 aa, Entamoeba dispar
DSSAIDRR

SEQ ID NO: 2361779 - protein, 7 aa, Entamoeba dispar
DSSDENI

SEQ ID NO: 2361780 - protein, 8 aa, Entamoeba dispar
DSSDNSPH

SEQ ID NO: 2361781 - protein, 8 aa, Entamoeba dispar
DSSEQHQD

SEQ ID NO: 2361782 - protein, 7 aa, Entamoeba dispar
DSSIEKD

SEQ ID NO: 2361783 - protein, 10 aa, Entamoeba dispar
DSSINSKEPI

SEQ ID NO: 2361784 - protein, 7 aa, Entamoeba dispar
DSSINTI

SEQ ID NO: 2361785 - protein, 7 aa, Entamoeba dispar
DSSKSNK

SEQ ID NO: 2361786 - protein, 8 aa, Entamoeba dispar
DSSQNPEI

SEQ ID NO: 2361787 - protein, 9 aa, Entamoeba dispar
DSSRRTGDM

SEQ ID NO: 2361788 - protein, 8 aa, Entamoeba dispar
DSSSDRCS

SEQ ID NO: 2361789 - protein, 13 aa, Entamoeba dispar
DSSSIKEDHCEKC

SEQ ID NO: 2361790 - protein, 28 aa, Entamoeba dispar
DSSSTNESEENSNQIESTQQGTDSTPLL

SEQ ID NO: 2361791 - protein, 4 aa, Entamoeba dispar
DSST

SEQ ID NO: 2361792 - protein, 5 aa, Entamoeba dispar
DSSTL

SEQ ID NO: 2361793 - protein, 7 aa, Entamoeba dispar
DSSTTIK

SEQ ID NO: 2361794 - protein, 6 aa, Entamoeba dispar
DSSVPY

SEQ ID NO: 2361795 - protein, 4 aa, Entamoeba dispar
DSSY

SEQ ID NO: 2361796 - protein, 6 aa, Entamoeba dispar
DSTAEG

SEQ ID NO: 2361797 - protein, 7 aa, Entamoeba dispar
DSTCSEC

SEQ ID NO: 2361798 - protein, 12 aa, Entamoeba dispar
DSTCSHRDNTTR

SEQ ID NO: 2361799 - protein, 7 aa, Entamoeba dispar
DSTDDTL

SEQ ID NO: 2361800 - protein, 9 aa, Entamoeba dispar
DSTDNSQRL

SEQ ID NO: 2361801 - protein, 4 aa, Entamoeba dispar
DSTF

SEQ ID NO: 2361802 - protein, 4 aa, Entamoeba dispar
DSTG

SEQ ID NO: 2361803 - protein, 7 aa, Entamoeba dispar
DSTGCSK

SEQ ID NO: 2361804 - protein, 18 aa, Entamoeba dispar
DSTHCQQCSDGFDKRGDK

SEQ ID NO: 2361805 - protein, 12 aa, Entamoeba dispar
DSTIRPDVDEVA

SEQ ID NO: 2361806 - protein, 6 aa, Entamoeba dispar
DSTISG

SEQ ID NO: 2361807 - protein, 15 aa, Entamoeba dispar
DSTLTSKELTGDYTK

SEQ ID NO: 2361808 - protein, 17 aa, Entamoeba dispar
DSTLTSNTLEGDYTKYS

SEQ ID NO: 2361809 - protein, 8 aa, Entamoeba dispar
DSTNGTCH

SEQ ID NO: 2361810 - protein, 6 aa, Entamoeba dispar
DSTPLK

SEQ ID NO: 2361811 - protein, 14 aa, Entamoeba dispar
DSTQCVSKETNTAQ

SEQ ID NO: 2361812 - protein, 5 aa, Entamoeba dispar
DSTQH

SEQ ID NO: 2361813 - protein, 16 aa, Entamoeba dispar
DSTQNIQAEEDEYIPP

SEQ ID NO: 2361814 - protein, 13 aa, Entamoeba dispar
DSTRSLIETPRRH

SEQ ID NO: 2361815 - protein, 9 aa, Entamoeba dispar
DSTTKGIRR

SEQ ID NO: 2361816 - protein, 5 aa, Entamoeba dispar
DSTTR

SEQ ID NO: 2361817 - protein, 12 aa, Entamoeba dispar
DSTTTNSTFGCS

SEQ ID NO: 2361818 - protein, 5 aa, Entamoeba dispar
DSTVM

SEQ ID NO: 2361819 - protein, 4 aa, Entamoeba dispar
DSVG

SEQ ID NO: 2361820 - protein, 7 aa, Entamoeba dispar
DSVGKDV

SEQ ID NO: 2361821 - protein, 6 aa, Entamoeba dispar
DSVQTD

SEQ ID NO: 2361822 - protein, 24 aa, Entamoeba dispar
DSVTETCKQKPNCEADQKPSSDGY

SEQ ID NO: 2361823 - protein, 7 aa, Entamoeba dispar
DSYATAN

SEQ ID NO: 2361824 - protein, 14 aa, Entamoeba dispar
DSYGQTINHGGEPF

SEQ ID NO: 2361825 - protein, 12 aa, Entamoeba dispar
DSYKNVIENEKK

SEQ ID NO: 2361826 - protein, 5 aa, Entamoeba dispar
DSYSP

SEQ ID NO: 2361827 - protein, 8 aa, Entamoeba dispar
DSYSPRND

SEQ ID NO: 2361828 - protein, 8 aa, Entamoeba dispar
DSYSTGDL

SEQ ID NO: 2361829 - protein, 9 aa, Entamoeba dispar
DTAATISRQ

SEQ ID NO: 2361830 - protein, 8 aa, Entamoeba dispar
DTAFQDGS

SEQ ID NO: 2361831 - protein, 6 aa, Entamoeba dispar
DTAKKV

SEQ ID NO: 2361832 - protein, 18 aa, Entamoeba dispar
DTAPECENATEFNVDEKG

SEQ ID NO: 2361833 - protein, 4 aa, Entamoeba dispar
DTDD

SEQ ID NO: 2361834 - protein, 8 aa, Entamoeba dispar
DTDDNGRL

SEQ ID NO: 2361835 - protein, 7 aa, Entamoeba dispar
DTDEDIE

SEQ ID NO: 2361836 - protein, 7 aa, Entamoeba dispar
DTDTPKF

SEQ ID NO: 2361837 - protein, 12 aa, Entamoeba dispar
DTEEDSDQNSIK

SEQ ID NO: 2361838 - protein, 4 aa, Entamoeba dispar
DTEK

SEQ ID NO: 2361839 - protein, 9 aa, Entamoeba dispar
DTEKEDIGN

SEQ ID NO: 2361840 - protein, 6 aa, Entamoeba dispar
DTELSS

SEQ ID NO: 2361841 - protein, 14 aa, Entamoeba dispar
DTETTEIPVNKETR

SEQ ID NO: 2361842 - protein, 5 aa, Entamoeba dispar
DTEYE

SEQ ID NO: 2361843 - protein, 11 aa, Entamoeba dispar
DTFAPQGDSDM

SEQ ID NO: 2361844 - protein, 8 aa, Entamoeba dispar
DTFNSDEY

SEQ ID NO: 2361845 - protein, 8 aa, Entamoeba dispar
DTFSTTSR

SEQ ID NO: 2361846 - protein, 5 aa, Entamoeba dispar
DTFTN

SEQ ID NO: 2361847 - protein, 4 aa, Entamoeba dispar
DTGM

SEQ ID NO: 2361848 - protein, 6 aa, Entamoeba dispar
DTGVGE

SEQ ID NO: 2361849 - protein, 5 aa, Entamoeba dispar
DTHCT

SEQ ID NO: 2361850 - protein, 14 aa, Entamoeba dispar
DTHNTLETTNKPYI

SEQ ID NO: 2361851 - protein, 7 aa, Entamoeba dispar
DTIGDRV

SEQ ID NO: 2361852 - protein, 4 aa, Entamoeba dispar
DTIK

SEQ ID NO: 2361853 - protein, 8 aa, Entamoeba dispar
DTIRTPEQ

SEQ ID NO: 2361854 - protein, 7 aa, Entamoeba dispar
DTISTTM

SEQ ID NO: 2361855 - protein, 6 aa, Entamoeba dispar
DTITSA

SEQ ID NO: 2361856 - protein, 26 aa, Entamoeba dispar
DTKETQKSSSSSSSPISSVSRSETQN

SEQ ID NO: 2361857 - protein, 11 aa, Entamoeba dispar
DTKETTTYEDT

SEQ ID NO: 2361858 - protein, 4 aa, Entamoeba dispar
DTKI

SEQ ID NO: 2361859 - protein, 15 aa, Entamoeba dispar
DTKYNTIKNTTAFGP

SEQ ID NO: 2361860 - protein, 19 aa, Entamoeba dispar
DTLENGQPQKEFGRKEAEI

SEQ ID NO: 2361861 - protein, 8 aa, Entamoeba dispar
DTMGKSEK

SEQ ID NO: 2361862 - protein, 13 aa, Entamoeba dispar
DTNDDQTDTYENG

SEQ ID NO: 2361863 - protein, 4 aa, Entamoeba dispar
DTNE

SEQ ID NO: 2361864 - protein, 12 aa, Entamoeba dispar
DTNEKPDATPAL

SEQ ID NO: 2361865 - protein, 11 aa, Entamoeba dispar
DTNGKELPDKK

SEQ ID NO: 2361866 - protein, 10 aa, Entamoeba dispar
DTNPKITSFE

SEQ ID NO: 2361867 - protein, 10 aa, Entamoeba dispar
DTNQSIEQSI

SEQ ID NO: 2361868 - protein, 9 aa, Entamoeba dispar
DTNQSNRAI

SEQ ID NO: 2361869 - protein, 10 aa, Entamoeba dispar
DTNTNGQQEI

SEQ ID NO: 2361870 - protein, 10 aa, Entamoeba dispar
DTNVKRKTIE

SEQ ID NO: 2361871 - protein, 5 aa, Entamoeba dispar
DTPDH

SEQ ID NO: 2361872 - protein, 6 aa, Entamoeba dispar
DTPDIG

SEQ ID NO: 2361873 - protein, 14 aa, Entamoeba dispar
DTPDYLNEPNTKKV

SEQ ID NO: 2361874 - protein, 5 aa, Entamoeba dispar
DTPGY

SEQ ID NO: 2361875 - protein, 4 aa, Entamoeba dispar
DTPI

SEQ ID NO: 2361876 - protein, 5 aa, Entamoeba dispar
DTPIK

SEQ ID NO: 2361877 - protein, 6 aa, Entamoeba dispar
DTPIKD

SEQ ID NO: 2361878 - protein, 12 aa, Entamoeba dispar
DTPKHKSTTNSV

SEQ ID NO: 2361879 - protein, 4 aa, Entamoeba dispar
DTPQ

SEQ ID NO: 2361880 - protein, 7 aa, Entamoeba dispar
DTPSDPI

SEQ ID NO: 2361881 - protein, 12 aa, Entamoeba dispar
DTPVSKENNESM

SEQ ID NO: 2361882 - protein, 9 aa, Entamoeba dispar
DTQCTIDSS

SEQ ID NO: 2361883 - protein, 4 aa, Entamoeba dispar
DTQD

SEQ ID NO: 2361884 - protein, 20 aa, Entamoeba dispar
DTQQQVKKRIDKDIKENKYR

SEQ ID NO: 2361885 - protein, 5 aa, Entamoeba dispar
DTQTQ

SEQ ID NO: 2361886 - protein, 8 aa, Entamoeba dispar
DTRPEIDE

SEQ ID NO: 2361887 - protein, 5 aa, Entamoeba dispar
DTSCS

SEQ ID NO: 2361888 - protein, 8 aa, Entamoeba dispar
DTSDKNRV

SEQ ID NO: 2361889 - protein, 11 aa, Entamoeba dispar
DTSDTFDKVSS

SEQ ID NO: 2361890 - protein, 6 aa, Entamoeba dispar
DTSETF

SEQ ID NO: 2361891 - protein, 6 aa, Entamoeba dispar
DTSINS

SEQ ID NO: 2361892 - protein, 9 aa, Entamoeba dispar
DTSITTSEQ

SEQ ID NO: 2361893 - protein, 23 aa, Entamoeba dispar
DTSLSQSNSNSRINSRTGSRRTD

SEQ ID NO: 2361894 - protein, 8 aa, Entamoeba dispar
DTSPKDKI

SEQ ID NO: 2361895 - protein, 5 aa, Entamoeba dispar
DTSSM

SEQ ID NO: 2361896 - protein, 5 aa, Entamoeba dispar
DTSSN

SEQ ID NO: 2361897 - protein, 5 aa, Entamoeba dispar
DTSTL

SEQ ID NO: 2361898 - protein, 10 aa, Entamoeba dispar
DTTAASSTHI

SEQ ID NO: 2361899 - protein, 5 aa, Entamoeba dispar
DTTCT

SEQ ID NO: 2361900 - protein, 8 aa, Entamoeba dispar
DTTEYENA

SEQ ID NO: 2361901 - protein, 7 aa, Entamoeba dispar
DTTFNTT

SEQ ID NO: 2361902 - protein, 8 aa, Entamoeba dispar
DTTGKDST

SEQ ID NO: 2361903 - protein, 8 aa, Entamoeba dispar
DTTGKSPK

SEQ ID NO: 2361904 - protein, 9 aa, Entamoeba dispar
DTTHASDSI

SEQ ID NO: 2361905 - protein, 25 aa, Entamoeba dispar
DTTKPLNKKQPPALPKKESLIKSST

SEQ ID NO: 2361906 - protein, 8 aa, Entamoeba dispar
DTTKVSSN

SEQ ID NO: 2361907 - protein, 11 aa, Entamoeba dispar
DTTLSIPKRNS

SEQ ID NO: 2361908 - protein, 22 aa, Entamoeba dispar
DTTPSIEQPHPVKEQKEKTQYT

SEQ ID NO: 2361909 - protein, 4 aa, Entamoeba dispar
DTTS

SEQ ID NO: 2361910 - protein, 19 aa, Entamoeba dispar
DTTTCKPRYDPVTNEYKGD

SEQ ID NO: 2361911 - protein, 9 aa, Entamoeba dispar
DTTTTGYLS

SEQ ID NO: 2361912 - protein, 10 aa, Entamoeba dispar
DTVEENPMTS

SEQ ID NO: 2361913 - protein, 4 aa, Entamoeba dispar
DTVK

SEQ ID NO: 2361914 - protein, 23 aa, Entamoeba dispar
DTVPIEDATSSSKEITKQNLEGG

SEQ ID NO: 2361915 - protein, 5 aa, Entamoeba dispar
DTVPT

SEQ ID NO: 2361916 - protein, 34 aa, Entamoeba dispar
DTVPTTKLNGIDAHKNNNTDSLNTNESQNTKFEQ

SEQ ID NO: 2361917 - protein, 5 aa, Entamoeba dispar
DTVQP

SEQ ID NO: 2361918 - protein, 8 aa, Entamoeba dispar
DTYFSPSS

SEQ ID NO: 2361919 - protein, 9 aa, Entamoeba dispar
DVCNTPGDS

SEQ ID NO: 2361920 - protein, 13 aa, Entamoeba dispar
DVDDDEAECQQCE

SEQ ID NO: 2361921 - protein, 4 aa, Entamoeba dispar
DVDI

SEQ ID NO: 2361922 - protein, 8 aa, Entamoeba dispar
DVDPNDMK

SEQ ID NO: 2361923 - protein, 41 aa, Entamoeba dispar
DVENTNGEYKKGLVEGKKGKSKKVEEEEDPIKDIKNAATGI

SEQ ID NO: 2361924 - protein, 9 aa, Entamoeba dispar
DVGQSPTVV

SEQ ID NO: 2361925 - protein, 5 aa, Entamoeba dispar
DVIGH

SEQ ID NO: 2361926 - protein, 14 aa, Entamoeba dispar
DVKKRQTAQRRFEK

SEQ ID NO: 2361927 - protein, 4 aa, Entamoeba dispar
DVND

SEQ ID NO: 2361928 - protein, 11 aa, Entamoeba dispar
DVNKMNEQTLA

SEQ ID NO: 2361929 - protein, 5 aa, Entamoeba dispar
DVPDN

SEQ ID NO: 2361930 - protein, 6 aa, Entamoeba dispar
DVPDPA

SEQ ID NO: 2361931 - protein, 8 aa, Entamoeba dispar
DVPEKNRN

SEQ ID NO: 2361932 - protein, 6 aa, Entamoeba dispar
DVPNQE

SEQ ID NO: 2361933 - protein, 14 aa, Entamoeba dispar
DVPPPQRPKPPTGI

SEQ ID NO: 2361934 - protein, 6 aa, Entamoeba dispar
DVQVGK

SEQ ID NO: 2361935 - protein, 8 aa, Entamoeba dispar
DVRKEKKS

SEQ ID NO: 2361936 - protein, 6 aa, Entamoeba dispar
DVRNDC

SEQ ID NO: 2361937 - protein, 9 aa, Entamoeba dispar
DVSAEEVQN

SEQ ID NO: 2361938 - protein, 8 aa, Entamoeba dispar
DVSVEKTV

SEQ ID NO: 2361939 - protein, 7 aa, Entamoeba dispar
DVTPEEN

SEQ ID NO: 2361940 - protein, 8 aa, Entamoeba dispar
DVTSFDGK

SEQ ID NO: 2361941 - protein, 8 aa, Entamoeba dispar
DVYGNENV

SEQ ID NO: 2361942 - protein, 15 aa, Entamoeba dispar
DVYKNRKKKDPKIRD

SEQ ID NO: 2361943 - protein, 14 aa, Entamoeba dispar
DWGNEPKEQEDVQE

SEQ ID NO: 2361944 - protein, 5 aa, Entamoeba dispar
DWKEI

SEQ ID NO: 2361945 - protein, 7 aa, Entamoeba dispar
DWTPENG

SEQ ID NO: 2361946 - protein, 6 aa, Entamoeba dispar
DWVPQR

SEQ ID NO: 2361947 - protein, 6 aa, Entamoeba dispar
DYAKAS

SEQ ID NO: 2361948 - protein, 5 aa, Entamoeba dispar
DYCTG

SEQ ID NO: 2361949 - protein, 13 aa, Entamoeba dispar
DYDRDKSDTKVEN

SEQ ID NO: 2361950 - protein, 4 aa, Entamoeba dispar
DYEA

SEQ ID NO: 2361951 - protein, 6 aa, Entamoeba dispar
DYENYY

SEQ ID NO: 2361952 - protein, 5 aa, Entamoeba dispar
DYESA

SEQ ID NO: 2361953 - protein, 9 aa, Entamoeba dispar
DYESGSDSV

SEQ ID NO: 2361954 - protein, 4 aa, Entamoeba dispar
DYFE

SEQ ID NO: 2361955 - protein, 9 aa, Entamoeba dispar
DYGGESNMK

SEQ ID NO: 2361956 - protein, 7 aa, Entamoeba dispar
DYGGSSL

SEQ ID NO: 2361957 - protein, 13 aa, Entamoeba dispar
DYGNTCNSSLGEA

SEQ ID NO: 2361958 - protein, 4 aa, Entamoeba dispar
DYGS

SEQ ID NO: 2361959 - protein, 6 aa, Entamoeba dispar
DYGTTT

SEQ ID NO: 2361960 - protein, 9 aa, Entamoeba dispar
DYKDTNKTF

SEQ ID NO: 2361961 - protein, 7 aa, Entamoeba dispar
DYKNEAL

SEQ ID NO: 2361962 - protein, 5 aa, Entamoeba dispar
DYLKE

SEQ ID NO: 2361963 - protein, 10 aa, Entamoeba dispar
DYLKGTQTVE

SEQ ID NO: 2361964 - protein, 4 aa, Entamoeba dispar
DYLP

SEQ ID NO: 2361965 - protein, 8 aa, Entamoeba dispar
DYLSQPNG

SEQ ID NO: 2361966 - protein, 8 aa, Entamoeba dispar
DYNGGNVK

SEQ ID NO: 2361967 - protein, 8 aa, Entamoeba dispar
DYNNQSTI

SEQ ID NO: 2361968 - protein, 5 aa, Entamoeba dispar
DYNQH

SEQ ID NO: 2361969 - protein, 4 aa, Entamoeba dispar
DYPH

SEQ ID NO: 2361970 - protein, 12 aa, Entamoeba dispar
DYPPFPNTVSPQ

SEQ ID NO: 2361971 - protein, 7 aa, Entamoeba dispar
DYPQFEG

SEQ ID NO: 2361972 - protein, 10 aa, Entamoeba dispar
DYSDGGKGIE

SEQ ID NO: 2361973 - protein, 6 aa, Entamoeba dispar
DYSGSS

SEQ ID NO: 2361974 - protein, 7 aa, Entamoeba dispar
DYSKQSK

SEQ ID NO: 2361975 - protein, 6 aa, Entamoeba dispar
DYSNSR

SEQ ID NO: 2361976 - protein, 6 aa, Entamoeba dispar
DYSSLS

SEQ ID NO: 2361977 - protein, 5 aa, Entamoeba dispar
DYSYS

SEQ ID NO: 2361978 - protein, 9 aa, Entamoeba dispar
DYTDGDPKC

SEQ ID NO: 2361979 - protein, 4 aa, Entamoeba dispar
DYTE

SEQ ID NO: 2361980 - protein, 6 aa, Entamoeba dispar
DYTGPF

SEQ ID NO: 2361981 - protein, 4 aa, Entamoeba dispar
DYTK

SEQ ID NO: 2361982 - protein, 5 aa, Entamoeba dispar
DYTKY

SEQ ID NO: 2361983 - protein, 7 aa, Entamoeba dispar
DYTRKEC

SEQ ID NO: 2361984 - protein, 4 aa, Entamoeba dispar
EAAQ

SEQ ID NO: 2361985 - protein, 8 aa, Entamoeba dispar
EAASSTHI

SEQ ID NO: 2361986 - protein, 5 aa, Entamoeba dispar
EACGP

SEQ ID NO: 2361987 - protein, 5 aa, Entamoeba dispar
EADKN

SEQ ID NO: 2361988 - protein, 16 aa, Entamoeba dispar
EAEAEKEQIDPNGDKP

SEQ ID NO: 2361989 - protein, 4 aa, Entamoeba dispar
EAEK

SEQ ID NO: 2361990 - protein, 11 aa, Entamoeba dispar
EAEKQYEDAGS

SEQ ID NO: 2361991 - protein, 10 aa, Entamoeba dispar
EAEKQYEDSN

SEQ ID NO: 2361992 - protein, 6 aa, Entamoeba dispar
EAESNV

SEQ ID NO: 2361993 - protein, 5 aa, Entamoeba dispar
EAEYP

SEQ ID NO: 2361994 - protein, 10 aa, Entamoeba dispar
EAFPGHESKN

SEQ ID NO: 2361995 - protein, 9 aa, Entamoeba dispar
EAGPHPNSE

SEQ ID NO: 2361996 - protein, 4 aa, Entamoeba dispar
EAIP

SEQ ID NO: 2361997 - protein, 11 aa, Entamoeba dispar
EAKEKDEPNVD

SEQ ID NO: 2361998 - protein, 13 aa, Entamoeba dispar
EAKEQNKEQNKQE

SEQ ID NO: 2361999 - protein, 8 aa, Entamoeba dispar
EAKESLKR

SEQ ID NO: 2362000 - protein, 8 aa, Entamoeba dispar
EAKGISKM

SEQ ID NO: 2362001 - protein, 10 aa, Entamoeba dispar
EAKKGFEPFK

SEQ ID NO: 2362002 - protein, 9 aa, Entamoeba dispar
EAKRPNDEL

SEQ ID NO: 2362003 - protein, 9 aa, Entamoeba dispar
EAKRVGNTK

SEQ ID NO: 2362004 - protein, 5 aa, Entamoeba dispar
EALQK

SEQ ID NO: 2362005 - protein, 7 aa, Entamoeba dispar
EANDYLP

SEQ ID NO: 2362006 - protein, 9 aa, Entamoeba dispar
EANSGESRV

SEQ ID NO: 2362007 - protein, 9 aa, Entamoeba dispar
EAPEGEEDF

SEQ ID NO: 2362008 - protein, 19 aa, Entamoeba dispar
EAPNNHPSYHYSKQENTFT

SEQ ID NO: 2362009 - protein, 7 aa, Entamoeba dispar
EAPNTDI

SEQ ID NO: 2362010 - protein, 15 aa, Entamoeba dispar
EAPSVESKLIIDDLE

SEQ ID NO: 2362011 - protein, 5 aa, Entamoeba dispar
EAPVH

SEQ ID NO: 2362012 - protein, 6 aa, Entamoeba dispar
EAQEDY

SEQ ID NO: 2362013 - protein, 9 aa, Entamoeba dispar
EAQNIESTP

SEQ ID NO: 2362014 - protein, 15 aa, Entamoeba dispar
EAQPQDMITLHISRV

SEQ ID NO: 2362015 - protein, 12 aa, Entamoeba dispar
EARKLGEKGQRI

SEQ ID NO: 2362016 - protein, 9 aa, Entamoeba dispar
EARLQDQSN

SEQ ID NO: 2362017 - protein, 7 aa, Entamoeba dispar
EARNNGI

SEQ ID NO: 2362018 - protein, 21 aa, Entamoeba dispar
EARPKKEGNKINYQSQSPDEV

SEQ ID NO: 2362019 - protein, 7 aa, Entamoeba dispar
EASDAHP

SEQ ID NO: 2362020 - protein, 16 aa, Entamoeba dispar
EASFKERDGSNNNGRT

SEQ ID NO: 2362021 - protein, 13 aa, Entamoeba dispar
EASSTPKYTVSDS

SEQ ID NO: 2362022 - protein, 6 aa, Entamoeba dispar
EASTKT

SEQ ID NO: 2362023 - protein, 8 aa, Entamoeba dispar
EATGSESD

SEQ ID NO: 2362024 - protein, 6 aa, Entamoeba dispar
EATIRR

SEQ ID NO: 2362025 - protein, 9 aa, Entamoeba dispar
EATNSTNLD

SEQ ID NO: 2362026 - protein, 5 aa, Entamoeba dispar
EATSA

SEQ ID NO: 2362027 - protein, 18 aa, Entamoeba dispar
EATSNENLSQSYQGWCPY

SEQ ID NO: 2362028 - protein, 8 aa, Entamoeba dispar
EATVTGVA

SEQ ID NO: 2362029 - protein, 4 aa, Entamoeba dispar
EAVD

SEQ ID NO: 2362030 - protein, 6 aa, Entamoeba dispar
EAVSTT

SEQ ID NO: 2362031 - protein, 7 aa, Entamoeba dispar
EAYKGEV

SEQ ID NO: 2362032 - protein, 15 aa, Entamoeba dispar
ECASGKCKEKVGCTQ

SEQ ID NO: 2362033 - protein, 9 aa, Entamoeba dispar
ECDGGSGCE

SEQ ID NO: 2362034 - protein, 5 aa, Entamoeba dispar
ECDGT

SEQ ID NO: 2362035 - protein, 9 aa, Entamoeba dispar
ECDNVEGCG

SEQ ID NO: 2362036 - protein, 7 aa, Entamoeba dispar
ECDSTEH

SEQ ID NO: 2362037 - protein, 12 aa, Entamoeba dispar
ECDSTSTIEHGH

SEQ ID NO: 2362038 - protein, 35 aa, Entamoeba dispar
  misc_feature (17)..(18): Xaa can be any naturally occurring amino acid
ECEEDPDEIILGYKPSXXDDSISDIHSDDEGIKKI

SEQ ID NO: 2362039 - protein, 4 aa, Entamoeba dispar
ECGK

SEQ ID NO: 2362040 - protein, 5 aa, Entamoeba dispar
ECHPC

SEQ ID NO: 2362041 - protein, 9 aa, Entamoeba dispar
ECITPEEEA

SEQ ID NO: 2362042 - protein, 12 aa, Entamoeba dispar
ECKEDCERCTTK

SEQ ID NO: 2362043 - protein, 7 aa, Entamoeba dispar
ECKEGDY

SEQ ID NO: 2362044 - protein, 5 aa, Entamoeba dispar
ECNKK

SEQ ID NO: 2362045 - protein, 16 aa, Entamoeba dispar
ECNTTKGYTEDCQGCQ

SEQ ID NO: 2362046 - protein, 8 aa, Entamoeba dispar
ECPGTATG

SEQ ID NO: 2362047 - protein, 8 aa, Entamoeba dispar
ECPSTTDL

SEQ ID NO: 2362048 - protein, 10 aa, Entamoeba dispar
ECQKEDCPEP

SEQ ID NO: 2362049 - protein, 11 aa, Entamoeba dispar
ECRKGMNKQTA

SEQ ID NO: 2362050 - protein, 8 aa, Entamoeba dispar
ECRPKTEL

SEQ ID NO: 2362051 - protein, 4 aa, Entamoeba dispar
ECSE

SEQ ID NO: 2362052 - protein, 7 aa, Entamoeba dispar
ECSNSIE

SEQ ID NO: 2362053 - protein, 10 aa, Entamoeba dispar
ECSNTGVPKQ

SEQ ID NO: 2362054 - protein, 29 aa, Entamoeba dispar
ECSTSSDGCSENGCDKLTGRCTNCPSGKY

SEQ ID NO: 2362055 - protein, 5 aa, Entamoeba dispar
ECTSD

SEQ ID NO: 2362056 - protein, 25 aa, Entamoeba dispar
ECTSTECKKCDNGYDLKDANTEVPG

SEQ ID NO: 2362057 - protein, 6 aa, Entamoeba dispar
ECTSVT

SEQ ID NO: 2362058 - protein, 4 aa, Entamoeba dispar
ECTT

SEQ ID NO: 2362059 - protein, 8 aa, Entamoeba dispar
ECYETPID

SEQ ID NO: 2362060 - protein, 10 aa, Entamoeba dispar
EDASGVEGGI

SEQ ID NO: 2362061 - protein, 10 aa, Entamoeba dispar
EDATSGKQES

SEQ ID NO: 2362062 - protein, 35 aa, Entamoeba dispar
EDATSNTSNISTHTSSSSSDERAKKSGNTGTPPSI

SEQ ID NO: 2362063 - protein, 11 aa, Entamoeba dispar
EDCEEQNGYGC

SEQ ID NO: 2362064 - protein, 6 aa, Entamoeba dispar
EDCMPS

SEQ ID NO: 2362065 - protein, 14 aa, Entamoeba dispar
EDCNNYKIKEKKSP

SEQ ID NO: 2362066 - protein, 8 aa, Entamoeba dispar
EDDAAEKS

SEQ ID NO: 2362067 - protein, 14 aa, Entamoeba dispar
EDDDEEKDTNNTDY

SEQ ID NO: 2362068 - protein, 21 aa, Entamoeba dispar
EDDEPMTLKADNSSSDFHEKQ

SEQ ID NO: 2362069 - protein, 21 aa, Entamoeba dispar
EDDEPMTLKADNSSSNFHEKQ

SEQ ID NO: 2362070 - protein, 9 aa, Entamoeba dispar
EDDGNVKSN

SEQ ID NO: 2362071 - protein, 5 aa, Entamoeba dispar
EDDIE

SEQ ID NO: 2362072 - protein, 4 aa, Entamoeba dispar
EDDM

SEQ ID NO: 2362073 - protein, 5 aa, Entamoeba dispar
EDDNF

SEQ ID NO: 2362074 - protein, 8 aa, Entamoeba dispar
EDDPNKTF

SEQ ID NO: 2362075 - protein, 8 aa, Entamoeba dispar
EDDPSDEI

SEQ ID NO: 2362076 - protein, 6 aa, Entamoeba dispar
EDDQKK

SEQ ID NO: 2362077 - protein, 4 aa, Entamoeba dispar
EDDR

SEQ ID NO: 2362078 - protein, 18 aa, Entamoeba dispar
EDDSIPPDSTEVDIPQST

SEQ ID NO: 2362079 - protein, 8 aa, Entamoeba dispar
EDDSLKDS

SEQ ID NO: 2362080 - protein, 6 aa, Entamoeba dispar
EDDVLT

SEQ ID NO: 2362081 - protein, 8 aa, Entamoeba dispar
EDEDKGTF

SEQ ID NO: 2362082 - protein, 5 aa, Entamoeba dispar
EDEDM

SEQ ID NO: 2362083 - protein, 7 aa, Entamoeba dispar
EDEFHES

SEQ ID NO: 2362084 - protein, 8 aa, Entamoeba dispar
EDEHYDTE

SEQ ID NO: 2362085 - protein, 9 aa, Entamoeba dispar
EDEKQVNSA

SEQ ID NO: 2362086 - protein, 5 aa, Entamoeba dispar
EDEKT

SEQ ID NO: 2362087 - protein, 6 aa, Entamoeba dispar
EDELQE

SEQ ID NO: 2362088 - protein, 7 aa, Entamoeba dispar
EDELTNQ

SEQ ID NO: 2362089 - protein, 15 aa, Entamoeba dispar
EDENIPKKSVKQQVE

SEQ ID NO: 2362090 - protein, 6 aa, Entamoeba dispar
EDEPKK

SEQ ID NO: 2362091 - protein, 35 aa, Entamoeba dispar
EDESELEKEIEKLKKEKLEKELQKKENKKSVREID

SEQ ID NO: 2362092 - protein, 6 aa, Entamoeba dispar
EDESGY

SEQ ID NO: 2362093 - protein, 11 aa, Entamoeba dispar
EDETGSDGVSI

SEQ ID NO: 2362094 - protein, 17 aa, Entamoeba dispar
EDETTTTKGSQPSLPSS

SEQ ID NO: 2362095 - protein, 8 aa, Entamoeba dispar
EDFNQPQK

SEQ ID NO: 2362096 - protein, 11 aa, Entamoeba dispar
EDGGGPGTANA

SEQ ID NO: 2362097 - protein, 14 aa, Entamoeba dispar
EDGGMGKGKTDDGE

SEQ ID NO: 2362098 - protein, 5 aa, Entamoeba dispar
EDGKL

SEQ ID NO: 2362099 - protein, 6 aa, Entamoeba dispar
EDGNSF

SEQ ID NO: 2362100 - protein, 8 aa, Entamoeba dispar
EDGPIPDP

SEQ ID NO: 2362101 - protein, 8 aa, Entamoeba dispar
EDGTSQSC

SEQ ID NO: 2362102 - protein, 6 aa, Entamoeba dispar
EDGYYK

SEQ ID NO: 2362103 - protein, 7 aa, Entamoeba dispar
EDHCERC

SEQ ID NO: 2362104 - protein, 9 aa, Entamoeba dispar
EDHNLNSQQ

SEQ ID NO: 2362105 - protein, 6 aa, Entamoeba dispar
EDIESP

SEQ ID NO: 2362106 - protein, 6 aa, Entamoeba dispar
EDIKGF

SEQ ID NO: 2362107 - protein, 13 aa, Entamoeba dispar
EDIKHSVNTRCRN

SEQ ID NO: 2362108 - protein, 6 aa, Entamoeba dispar
EDISQN

SEQ ID NO: 2362109 - protein, 11 aa, Entamoeba dispar
EDKETVTTQSL

SEQ ID NO: 2362110 - protein, 7 aa, Entamoeba dispar
EDKGSDI

SEQ ID NO: 2362111 - protein, 9 aa, Entamoeba dispar
EDKKILQPK

SEQ ID NO: 2362112 - protein, 12 aa, Entamoeba dispar
EDKLQDGVPETI

SEQ ID NO: 2362113 - protein, 5 aa, Entamoeba dispar
EDKLS

SEQ ID NO: 2362114 - protein, 35 aa, Entamoeba dispar
EDKNDIQQKDETTQQDVNPTNQTNTTKADSSEEQV

SEQ ID NO: 2362115 - protein, 43 aa, Entamoeba dispar
EDKNDIQQKDETTQQDVNPTNQTNTTKADSSEEQVNAIIIDEG

SEQ ID NO: 2362116 - protein, 6 aa, Entamoeba dispar
EDKSIQ

SEQ ID NO: 2362117 - protein, 4 aa, Entamoeba dispar
EDKT

SEQ ID NO: 2362118 - protein, 11 aa, Entamoeba dispar
EDKTRGLQKEK

SEQ ID NO: 2362119 - protein, 7 aa, Entamoeba dispar
EDKWEEE

SEQ ID NO: 2362120 - protein, 13 aa, Entamoeba dispar
EDKYQRPKDKVKF

SEQ ID NO: 2362121 - protein, 5 aa, Entamoeba dispar
EDLDT

SEQ ID NO: 2362122 - protein, 23 aa, Entamoeba dispar
EDLENSKQKSTNTTNTNNTTGTL

SEQ ID NO: 2362123 - protein, 10 aa, Entamoeba dispar
EDLNKPNSEL

SEQ ID NO: 2362124 - protein, 7 aa, Entamoeba dispar
EDLRQDE

SEQ ID NO: 2362125 - protein, 6 aa, Entamoeba dispar
EDMSSN

SEQ ID NO: 2362126 - protein, 35 aa, Entamoeba dispar
EDNASIDRQNQAMDKINNRNSIYNSTLNDSNRLTN

SEQ ID NO: 2362127 - protein, 35 aa, Entamoeba dispar
EDNASIDRQNQTMDKINNRNSIYNSTLNDSNRLTN

SEQ ID NO: 2362128 - protein, 5 aa, Entamoeba dispar
EDNCT

SEQ ID NO: 2362129 - protein, 9 aa, Entamoeba dispar
EDNDPNQVN

SEQ ID NO: 2362130 - protein, 18 aa, Entamoeba dispar
EDNEENKLKNNIKEEEEK

SEQ ID NO: 2362131 - protein, 6 aa, Entamoeba dispar
EDNEKY

SEQ ID NO: 2362132 - protein, 8 aa, Entamoeba dispar
EDNESNCR

SEQ ID NO: 2362133 - protein, 6 aa, Entamoeba dispar
EDNFNG

SEQ ID NO: 2362134 - protein, 8 aa, Entamoeba dispar
EDNGADYS

SEQ ID NO: 2362135 - protein, 8 aa, Entamoeba dispar
EDNKKNYI

SEQ ID NO: 2362136 - protein, 8 aa, Entamoeba dispar
EDNKKSVI

SEQ ID NO: 2362137 - protein, 6 aa, Entamoeba dispar
EDNQQE

SEQ ID NO: 2362138 - protein, 5 aa, Entamoeba dispar
EDNRK

SEQ ID NO: 2362139 - protein, 25 aa, Entamoeba dispar
EDNSGSSDSQISGTEIKTQKRQGFM

SEQ ID NO: 2362140 - protein, 16 aa, Entamoeba dispar
EDNSNENYSIRTNPPQ

SEQ ID NO: 2362141 - protein, 7 aa, Entamoeba dispar
EDPKPTY

SEQ ID NO: 2362142 - protein, 9 aa, Entamoeba dispar
EDPNRVPNQ

SEQ ID NO: 2362143 - protein, 4 aa, Entamoeba dispar
EDPT

SEQ ID NO: 2362144 - protein, 8 aa, Entamoeba dispar
EDQIRGED

SEQ ID NO: 2362145 - protein, 10 aa, Entamoeba dispar
EDQKKSEDFG

SEQ ID NO: 2362146 - protein, 8 aa, Entamoeba dispar
EDQTESCG

SEQ ID NO: 2362147 - protein, 13 aa, Entamoeba dispar
EDRFGTDGSSFPI

SEQ ID NO: 2362148 - protein, 6 aa, Entamoeba dispar
EDRPQF

SEQ ID NO: 2362149 - protein, 8 aa, Entamoeba dispar
EDRRKERM

SEQ ID NO: 2362150 - protein, 16 aa, Entamoeba dispar
EDSEDLNNEDDNQGFE

SEQ ID NO: 2362151 - protein, 8 aa, Entamoeba dispar
EDSENDPL

SEQ ID NO: 2362152 - protein, 5 aa, Entamoeba dispar
EDSIS

SEQ ID NO: 2362153 - protein, 14 aa, Entamoeba dispar
EDSKITSSKNESLM

SEQ ID NO: 2362154 - protein, 7 aa, Entamoeba dispar
EDSKPIQ

SEQ ID NO: 2362155 - protein, 8 aa, Entamoeba dispar
EDSKTNEE

SEQ ID NO: 2362156 - protein, 9 aa, Entamoeba dispar
EDSNNENKT

SEQ ID NO: 2362157 - protein, 20 aa, Entamoeba dispar
EDSPKTKPTQVESDQKSDVE

SEQ ID NO: 2362158 - protein, 10 aa, Entamoeba dispar
EDSQNGSSEL

SEQ ID NO: 2362159 - protein, 7 aa, Entamoeba dispar
EDSSDSP

SEQ ID NO: 2362160 - protein, 8 aa, Entamoeba dispar
EDSTTTFK

SEQ ID NO: 2362161 - protein, 11 aa, Entamoeba dispar
EDTEENKNQKN

SEQ ID NO: 2362162 - protein, 9 aa, Entamoeba dispar
EDTQSNSLK

SEQ ID NO: 2362163 - protein, 12 aa, Entamoeba dispar
EDTTSSDDGIFE

SEQ ID NO: 2362164 - protein, 6 aa, Entamoeba dispar
EDVVSE

SEQ ID NO: 2362165 - protein, 13 aa, Entamoeba dispar
EDWAEKVKAAKNI

SEQ ID NO: 2362166 - protein, 7 aa, Entamoeba dispar
EDWHKKE

SEQ ID NO: 2362167 - protein, 8 aa, Entamoeba dispar
EDYELRQA

SEQ ID NO: 2362168 - protein, 6 aa, Entamoeba dispar
EDYGQK

SEQ ID NO: 2362169 - protein, 7 aa, Entamoeba dispar
EDYIKEK

SEQ ID NO: 2362170 - protein, 6 aa, Entamoeba dispar
EDYPGK

SEQ ID NO: 2362171 - protein, 8 aa, Entamoeba dispar
EDYTEHTE

SEQ ID NO: 2362172 - protein, 6 aa, Entamoeba dispar
EEAERK

SEQ ID NO: 2362173 - protein, 6 aa, Entamoeba dispar
EEAKEK

SEQ ID NO: 2362174 - protein, 9 aa, Entamoeba dispar
EEAKKEGKG

SEQ ID NO: 2362175 - protein, 15 aa, Entamoeba dispar
EEANQNHCTNISKTG

SEQ ID NO: 2362176 - protein, 5 aa, Entamoeba dispar
EEAPT

SEQ ID NO: 2362177 - protein, 9 aa, Entamoeba dispar
EEATKTNPI

SEQ ID NO: 2362178 - protein, 7 aa, Entamoeba dispar
EEAYAGA

SEQ ID NO: 2362179 - protein, 11 aa, Entamoeba dispar
EECDGGEGCGS

SEQ ID NO: 2362180 - protein, 8 aa, Entamoeba dispar
EECDGGIN

SEQ ID NO: 2362181 - protein, 7 aa, Entamoeba dispar
EECDGGM

SEQ ID NO: 2362182 - protein, 10 aa, Entamoeba dispar
EECDGGSNCR

SEQ ID NO: 2362183 - protein, 9 aa, Entamoeba dispar
EECDNGTNC

SEQ ID NO: 2362184 - protein, 10 aa, Entamoeba dispar
EECDPSNNIT

SEQ ID NO: 2362185 - protein, 7 aa, Entamoeba dispar
EECDSGL

SEQ ID NO: 2362186 - protein, 15 aa, Entamoeba dispar
EECGKPFKYKPNNKR

SEQ ID NO: 2362187 - protein, 5 aa, Entamoeba dispar
EECKE

SEQ ID NO: 2362188 - protein, 6 aa, Entamoeba dispar
EECKSC

SEQ ID NO: 2362189 - protein, 4 aa, Entamoeba dispar
EECQ

SEQ ID NO: 2362190 - protein, 4 aa, Entamoeba dispar
EEDA

SEQ ID NO: 2362191 - protein, 7 aa, Entamoeba dispar
EEDAQEI

SEQ ID NO: 2362192 - protein, 5 aa, Entamoeba dispar
EEDDG

SEQ ID NO: 2362193 - protein, 13 aa, Entamoeba dispar
EEDEISSSLSEGE

SEQ ID NO: 2362194 - protein, 6 aa, Entamoeba dispar
EEDGKC

SEQ ID NO: 2362195 - protein, 12 aa, Entamoeba dispar
EEDGTKSESYKC

SEQ ID NO: 2362196 - protein, 8 aa, Entamoeba dispar
EEDINQEE

SEQ ID NO: 2362197 - protein, 10 aa, Entamoeba dispar
EEDKIDEITT

SEQ ID NO: 2362198 - protein, 9 aa, Entamoeba dispar
EEDKKSIQF

SEQ ID NO: 2362199 - protein, 10 aa, Entamoeba dispar
EEDPNTKETR

SEQ ID NO: 2362200 - protein, 10 aa, Entamoeba dispar
EEDQRKKFNI

SEQ ID NO: 2362201 - protein, 17 aa, Entamoeba dispar
EEDREWAQKEMETAMEK

SEQ ID NO: 2362202 - protein, 4 aa, Entamoeba dispar
EEDS

SEQ ID NO: 2362203 - protein, 9 aa, Entamoeba dispar
EEDSLRQKE

SEQ ID NO: 2362204 - protein, 9 aa, Entamoeba dispar
EEDSTYEFA

SEQ ID NO: 2362205 - protein, 16 aa, Entamoeba dispar
EEDTGYYYSGGECKQC

SEQ ID NO: 2362206 - protein, 9 aa, Entamoeba dispar
EEDVETDID

SEQ ID NO: 2362207 - protein, 6 aa, Entamoeba dispar
EEDYIP

SEQ ID NO: 2362208 - protein, 4 aa, Entamoeba dispar
EEED

SEQ ID NO: 2362209 - protein, 7 aa, Entamoeba dispar
EEEDSLC

SEQ ID NO: 2362210 - protein, 18 aa, Entamoeba dispar
EEEEEKEKIKEEEIVNNN

SEQ ID NO: 2362211 - protein, 15 aa, Entamoeba dispar
EEEEKENKENKEENI

SEQ ID NO: 2362212 - protein, 13 aa, Entamoeba dispar
EEEENTNNNLTQR

SEQ ID NO: 2362213 - protein, 6 aa, Entamoeba dispar
EEEERS

SEQ ID NO: 2362214 - protein, 4 aa, Entamoeba dispar
EEEI

SEQ ID NO: 2362215 - protein, 17 aa, Entamoeba dispar
EEEIKEKENKINKQKKI

SEQ ID NO: 2362216 - protein, 7 aa, Entamoeba dispar
EEEIKNG

SEQ ID NO: 2362217 - protein, 14 aa, Entamoeba dispar
EEEIQGWKNSNDHN

SEQ ID NO: 2362218 - protein, 6 aa, Entamoeba dispar
EEEKEL

SEQ ID NO: 2362219 - protein, 5 aa, Entamoeba dispar
EEENE

SEQ ID NO: 2362220 - protein, 10 aa, Entamoeba dispar
EEENTDSDPL

SEQ ID NO: 2362221 - protein, 7 aa, Entamoeba dispar
EEEPTKI

SEQ ID NO: 2362222 - protein, 8 aa, Entamoeba dispar
EEEQNKCK

SEQ ID NO: 2362223 - protein, 25 aa, Entamoeba dispar
EEEQNRDIELNEENQTEDQQVNEND

SEQ ID NO: 2362224 - protein, 14 aa, Entamoeba dispar
EEERLEADDQHGET

SEQ ID NO: 2362225 - protein, 20 aa, Entamoeba dispar
EEERRNRKKIENEKEIIEKE

SEQ ID NO: 2362226 - protein, 11 aa, Entamoeba dispar
EEESCKRDQIR

SEQ ID NO: 2362227 - protein, 14 aa, Entamoeba dispar
EEESKQETIETETI

SEQ ID NO: 2362228 - protein, 5 aa, Entamoeba dispar
EEESN

SEQ ID NO: 2362229 - protein, 5 aa, Entamoeba dispar
EEESP

SEQ ID NO: 2362230 - protein, 9 aa, Entamoeba dispar
EEETSENGI

SEQ ID NO: 2362231 - protein, 4 aa, Entamoeba dispar
EEEV

SEQ ID NO: 2362232 - protein, 5 aa, Entamoeba dispar
EEFDG

SEQ ID NO: 2362233 - protein, 21 aa, Entamoeba dispar
EEFDTENEVKEKKVKKNKPVE

SEQ ID NO: 2362234 - protein, 13 aa, Entamoeba dispar
EEFNGDSKIESCT

SEQ ID NO: 2362235 - protein, 11 aa, Entamoeba dispar
EEFNPETEECD

SEQ ID NO: 2362236 - protein, 5 aa, Entamoeba dispar
EEFNY

SEQ ID NO: 2362237 - protein, 6 aa, Entamoeba dispar
EEFTKQ

SEQ ID NO: 2362238 - protein, 17 aa, Entamoeba dispar
EEGCDKTGCIDSNSASL

SEQ ID NO: 2362239 - protein, 5 aa, Entamoeba dispar
EEGEE

SEQ ID NO: 2362240 - protein, 4 aa, Entamoeba dispar
EEGF

SEQ ID NO: 2362241 - protein, 14 aa, Entamoeba dispar
EEGFSVKTNNSGFN

SEQ ID NO: 2362242 - protein, 7 aa, Entamoeba dispar
EEGGKKM

SEQ ID NO: 2362243 - protein, 7 aa, Entamoeba dispar
EEGGMTD

SEQ ID NO: 2362244 - protein, 5 aa, Entamoeba dispar
EEGIS

SEQ ID NO: 2362245 - protein, 5 aa, Entamoeba dispar
EEGKE

SEQ ID NO: 2362246 - protein, 8 aa, Entamoeba dispar
EEGKEFTD

SEQ ID NO: 2362247 - protein, 8 aa, Entamoeba dispar
EEGNEEPK

SEQ ID NO: 2362248 - protein, 7 aa, Entamoeba dispar
EEGQKNI

SEQ ID NO: 2362249 - protein, 8 aa, Entamoeba dispar
EEGSKQSK

SEQ ID NO: 2362250 - protein, 40 aa, Entamoeba dispar
EEGTNAPIKNEVNSSNKDLDDENNNQRPAQHYEASNETFS

SEQ ID NO: 2362251 - protein, 14 aa, Entamoeba dispar
EEGWERIKKDGKKW

SEQ ID NO: 2362252 - protein, 7 aa, Entamoeba dispar
EEGWNKS

SEQ ID NO: 2362253 - protein, 15 aa, Entamoeba dispar
EEGYDLDKGGMSCSK

SEQ ID NO: 2362254 - protein, 12 aa, Entamoeba dispar
EEHGRMKSPHGN

SEQ ID NO: 2362255 - protein, 5 aa, Entamoeba dispar
EEHNN

SEQ ID NO: 2362256 - protein, 4 aa, Entamoeba dispar
EEHT

SEQ ID NO: 2362257 - protein, 7 aa, Entamoeba dispar
EEIAPDD

SEQ ID NO: 2362258 - protein, 8 aa, Entamoeba dispar
EEIDDNQN

SEQ ID NO: 2362259 - protein, 8 aa, Entamoeba dispar
EEIEKEKI

SEQ ID NO: 2362260 - protein, 6 aa, Entamoeba dispar
EEIKAR

SEQ ID NO: 2362261 - protein, 13 aa, Entamoeba dispar
EEIKEEQEIQDKE

SEQ ID NO: 2362262 - protein, 8 aa, Entamoeba dispar
EEIKGDDE

SEQ ID NO: 2362263 - protein, 37 aa, Entamoeba dispar
EEIKNNEIKENESTSNDNKKSQSSFELTTNDPSKIEE

SEQ ID NO: 2362264 - protein, 4 aa, Entamoeba dispar
EEIN

SEQ ID NO: 2362265 - protein, 10 aa, Entamoeba dispar
EEINDSNEEF

SEQ ID NO: 2362266 - protein, 11 aa, Entamoeba dispar
EEINKKQSYYD

SEQ ID NO: 2362267 - protein, 29 aa, Entamoeba dispar
EEIQNHPSQNESNNSDFPISPEDDNDEVD

SEQ ID NO: 2362268 - protein, 13 aa, Entamoeba dispar
EEIQRTQKQRKKN

SEQ ID NO: 2362269 - protein, 5 aa, Entamoeba dispar
EEISN

SEQ ID NO: 2362270 - protein, 9 aa, Entamoeba dispar
EEITNNDGK

SEQ ID NO: 2362271 - protein, 5 aa, Entamoeba dispar
EEIVK

SEQ ID NO: 2362272 - protein, 11 aa, Entamoeba dispar
EEKAPHNTYRQ

SEQ ID NO: 2362273 - protein, 23 aa, Entamoeba dispar
EEKDDYKKIKEKGINEEEYEIEK

SEQ ID NO: 2362274 - protein, 10 aa, Entamoeba dispar
EEKDKQERVI

SEQ ID NO: 2362275 - protein, 4 aa, Entamoeba dispar
EEKE

SEQ ID NO: 2362276 - protein, 38 aa, Entamoeba dispar
EEKEDTRIIEETKSSITYETKTYRRSNKKMNKGENVPG

SEQ ID NO: 2362277 - protein, 8 aa, Entamoeba dispar
EEKEEVKR

SEQ ID NO: 2362278 - protein, 8 aa, Entamoeba dispar
EEKEKTYQ

SEQ ID NO: 2362279 - protein, 13 aa, Entamoeba dispar
EEKEQTESMGNNG

SEQ ID NO: 2362280 - protein, 7 aa, Entamoeba dispar
EEKIPDV

SEQ ID NO: 2362281 - protein, 6 aa, Entamoeba dispar
EEKIRK

SEQ ID NO: 2362282 - protein, 9 aa, Entamoeba dispar
EEKKDGDSV

SEQ ID NO: 2362283 - protein, 8 aa, Entamoeba dispar
EEKKDRSG

SEQ ID NO: 2362284 - protein, 8 aa, Entamoeba dispar
EEKKNNSA

SEQ ID NO: 2362285 - protein, 9 aa, Entamoeba dispar
EEKKRNKIG

SEQ ID NO: 2362286 - protein, 5 aa, Entamoeba dispar
EEKMN

SEQ ID NO: 2362287 - protein, 4 aa, Entamoeba dispar
EEKN

SEQ ID NO: 2362288 - protein, 12 aa, Entamoeba dispar
EEKNDMVKENRD

SEQ ID NO: 2362289 - protein, 15 aa, Entamoeba dispar
EEKNQIVSNTTLSKP

SEQ ID NO: 2362290 - protein, 17 aa, Entamoeba dispar
EEKPEEVFEEDSDEIVD

SEQ ID NO: 2362291 - protein, 7 aa, Entamoeba dispar
EEKPTNI

SEQ ID NO: 2362292 - protein, 24 aa, Entamoeba dispar
EEKTERLSSQSNSPSTKYEKINNQ

SEQ ID NO: 2362293 - protein, 10 aa, Entamoeba dispar
EEKTKQIVSN

SEQ ID NO: 2362294 - protein, 8 aa, Entamoeba dispar
EEKYKNNI

SEQ ID NO: 2362295 - protein, 4 aa, Entamoeba dispar
EELE

SEQ ID NO: 2362296 - protein, 13 aa, Entamoeba dispar
EELELENKSNLIT

SEQ ID NO: 2362297 - protein, 13 aa, Entamoeba dispar
EELENEKKENEKM

SEQ ID NO: 2362298 - protein, 7 aa, Entamoeba dispar
EELGQTN

SEQ ID NO: 2362299 - protein, 11 aa, Entamoeba dispar
EELKASQNSEF

SEQ ID NO: 2362300 - protein, 13 aa, Entamoeba dispar
EELKKKDKKKIED

SEQ ID NO: 2362301 - protein, 7 aa, Entamoeba dispar
EELKNAT

SEQ ID NO: 2362302 - protein, 13 aa, Entamoeba dispar
EELNQNKISDNKY

SEQ ID NO: 2362303 - protein, 12 aa, Entamoeba dispar
EELPKGKKLEAL

SEQ ID NO: 2362304 - protein, 13 aa, Entamoeba dispar
EELPKKRKQTEEN

SEQ ID NO: 2362305 - protein, 5 aa, Entamoeba dispar
EELPQ

SEQ ID NO: 2362306 - protein, 6 aa, Entamoeba dispar
EELSEQ

SEQ ID NO: 2362307 - protein, 6 aa, Entamoeba dispar
EEMKRD

SEQ ID NO: 2362308 - protein, 7 aa, Entamoeba dispar
EEMSTSY

SEQ ID NO: 2362309 - protein, 8 aa, Entamoeba dispar
EENDEYKN

SEQ ID NO: 2362310 - protein, 10 aa, Entamoeba dispar
EENEEEDKIN

SEQ ID NO: 2362311 - protein, 9 aa, Entamoeba dispar
EENENNSLE

SEQ ID NO: 2362312 - protein, 14 aa, Entamoeba dispar
EENEQMDKELSASE

SEQ ID NO: 2362313 - protein, 5 aa, Entamoeba dispar
EENEV

SEQ ID NO: 2362314 - protein, 4 aa, Entamoeba dispar
EENK

SEQ ID NO: 2362315 - protein, 8 aa, Entamoeba dispar
EENKEKYD

SEQ ID NO: 2362316 - protein, 10 aa, Entamoeba dispar
EENKPRNNTS

SEQ ID NO: 2362317 - protein, 6 aa, Entamoeba dispar
EENLMK

SEQ ID NO: 2362318 - protein, 8 aa, Entamoeba dispar
EENNDGNF

SEQ ID NO: 2362319 - protein, 10 aa, Entamoeba dispar
EENNNGLSYS

SEQ ID NO: 2362320 - protein, 7 aa, Entamoeba dispar
EENPPEN

SEQ ID NO: 2362321 - protein, 9 aa, Entamoeba dispar
EENQNNKAN

SEQ ID NO: 2362322 - protein, 10 aa, Entamoeba dispar
EENSSAQSSI

SEQ ID NO: 2362323 - protein, 11 aa, Entamoeba dispar
EENSSGIKDKT

SEQ ID NO: 2362324 - protein, 10 aa, Entamoeba dispar
EENTGGIKDK

SEQ ID NO: 2362325 - protein, 9 aa, Entamoeba dispar
EENTQALER

SEQ ID NO: 2362326 - protein, 5 aa, Entamoeba dispar
EENVE

SEQ ID NO: 2362327 - protein, 8 aa, Entamoeba dispar
EENVEGGK

SEQ ID NO: 2362328 - protein, 6 aa, Entamoeba dispar
EENVKP

SEQ ID NO: 2362329 - protein, 4 aa, Entamoeba dispar
EENY

SEQ ID NO: 2362330 - protein, 8 aa, Entamoeba dispar
EEPDNMKT

SEQ ID NO: 2362331 - protein, 9 aa, Entamoeba dispar
EEPENGVID

SEQ ID NO: 2362332 - protein, 4 aa, Entamoeba dispar
EEPF

SEQ ID NO: 2362333 - protein, 12 aa, Entamoeba dispar
EEPGASAELDKN

SEQ ID NO: 2362334 - protein, 12 aa, Entamoeba dispar
EEPHSLTEQPIG

SEQ ID NO: 2362335 - protein, 11 aa, Entamoeba dispar
EEPLKGSSFAD

SEQ ID NO: 2362336 - protein, 9 aa, Entamoeba dispar
EEPNKMNEE

SEQ ID NO: 2362337 - protein, 6 aa, Entamoeba dispar
EEPSKH

SEQ ID NO: 2362338 - protein, 6 aa, Entamoeba dispar
EEPYKD

SEQ ID NO: 2362339 - protein, 6 aa, Entamoeba dispar
EEPYKE

SEQ ID NO: 2362340 - protein, 7 aa, Entamoeba dispar
EEQKNQV

SEQ ID NO: 2362341 - protein, 5 aa, Entamoeba dispar
EEQLA

SEQ ID NO: 2362342 - protein, 8 aa, Entamoeba dispar
EEQNEYGC

SEQ ID NO: 2362343 - protein, 5 aa, Entamoeba dispar
EEQNG

SEQ ID NO: 2362344 - protein, 9 aa, Entamoeba dispar
EEQNGYGCK

SEQ ID NO: 2362345 - protein, 10 aa, Entamoeba dispar
EEQPKEEKDT

SEQ ID NO: 2362346 - protein, 22 aa, Entamoeba dispar
EEQPPFEESISDVDEKSLPSQN

SEQ ID NO: 2362347 - protein, 20 aa, Entamoeba dispar
EEQPQEPTSEEEQEQTEFGK

SEQ ID NO: 2362348 - protein, 11 aa, Entamoeba dispar
EERDRKGLYAK

SEQ ID NO: 2362349 - protein, 16 aa, Entamoeba dispar
EERDTEISTNFDNEIE

SEQ ID NO: 2362350 - protein, 7 aa, Entamoeba dispar
EERESVE

SEQ ID NO: 2362351 - protein, 5 aa, Entamoeba dispar
EERIP

SEQ ID NO: 2362352 - protein, 5 aa, Entamoeba dispar
EERKE

SEQ ID NO: 2362353 - protein, 6 aa, Entamoeba dispar
EERKRS

SEQ ID NO: 2362354 - protein, 5 aa, Entamoeba dispar
EERNY

SEQ ID NO: 2362355 - protein, 4 aa, Entamoeba dispar
EERQ

SEQ ID NO: 2362356 - protein, 8 aa, Entamoeba dispar
EERRGDDL

SEQ ID NO: 2362357 - protein, 5 aa, Entamoeba dispar
EESCS

SEQ ID NO: 2362358 - protein, 6 aa, Entamoeba dispar
EESDEE

SEQ ID NO: 2362359 - protein, 10 aa, Entamoeba dispar
EESDEKDGGN

SEQ ID NO: 2362360 - protein, 6 aa, Entamoeba dispar
EESEIY

SEQ ID NO: 2362361 - protein, 4 aa, Entamoeba dispar
EESF

SEQ ID NO: 2362362 - protein, 4 aa, Entamoeba dispar
EESG

SEQ ID NO: 2362363 - protein, 8 aa, Entamoeba dispar
EESINKSH

SEQ ID NO: 2362364 - protein, 5 aa, Entamoeba dispar
EESNK

SEQ ID NO: 2362365 - protein, 9 aa, Entamoeba dispar
EESSALNKT

SEQ ID NO: 2362366 - protein, 18 aa, Entamoeba dispar
EESSSVEPNIRPKNENRL

SEQ ID NO: 2362367 - protein, 4 aa, Entamoeba dispar
EEST

SEQ ID NO: 2362368 - protein, 8 aa, Entamoeba dispar
EESTEAFE

SEQ ID NO: 2362369 - protein, 9 aa, Entamoeba dispar
EESTEYPEV

SEQ ID NO: 2362370 - protein, 5 aa, Entamoeba dispar
EESVT

SEQ ID NO: 2362371 - protein, 7 aa, Entamoeba dispar
EESYDKR

SEQ ID NO: 2362372 - protein, 8 aa, Entamoeba dispar
EETGQRKD

SEQ ID NO: 2362373 - protein, 7 aa, Entamoeba dispar
EETIKKN

SEQ ID NO: 2362374 - protein, 17 aa, Entamoeba dispar
EETKEHYKEEKDKNQNI

SEQ ID NO: 2362375 - protein, 24 aa, Entamoeba dispar
EETKQKRPTSFTPIQENKNEDPHL

SEQ ID NO: 2362376 - protein, 4 aa, Entamoeba dispar
EETN

SEQ ID NO: 2362377 - protein, 9 aa, Entamoeba dispar
EETNEYVQS

SEQ ID NO: 2362378 - protein, 11 aa, Entamoeba dispar
EETNNGGVPYK

SEQ ID NO: 2362379 - protein, 7 aa, Entamoeba dispar
EETNNIN

SEQ ID NO: 2362380 - protein, 26 aa, Entamoeba dispar
EETNSTSVSSQPRGYTQRKHYSNNER

SEQ ID NO: 2362381 - protein, 5 aa, Entamoeba dispar
EETPK

SEQ ID NO: 2362382 - protein, 14 aa, Entamoeba dispar
EETQPVEKKEEACK

SEQ ID NO: 2362383 - protein, 4 aa, Entamoeba dispar
EETS

SEQ ID NO: 2362384 - protein, 4 aa, Entamoeba dispar
EETT

SEQ ID NO: 2362385 - protein, 10 aa, Entamoeba dispar
EETTKEIKEN

SEQ ID NO: 2362386 - protein, 6 aa, Entamoeba dispar
EETYEK

SEQ ID NO: 2362387 - protein, 10 aa, Entamoeba dispar
EEVDEKNQPI

SEQ ID NO: 2362388 - protein, 8 aa, Entamoeba dispar
EEVHEAKR

SEQ ID NO: 2362389 - protein, 14 aa, Entamoeba dispar
EEVLTNSEKRKEVL

SEQ ID NO: 2362390 - protein, 18 aa, Entamoeba dispar
EEVNNKIKQTKEKLETKI

SEQ ID NO: 2362391 - protein, 5 aa, Entamoeba dispar
EEVPE

SEQ ID NO: 2362392 - protein, 4 aa, Entamoeba dispar
EEVR

SEQ ID NO: 2362393 - protein, 5 aa, Entamoeba dispar
EEVRK

SEQ ID NO: 2362394 - protein, 8 aa, Entamoeba dispar
EEVSKDSA

SEQ ID NO: 2362395 - protein, 12 aa, Entamoeba dispar
EEVSKKEYDNIG

SEQ ID NO: 2362396 - protein, 4 aa, Entamoeba dispar
EEVT

SEQ ID NO: 2362397 - protein, 7 aa, Entamoeba dispar
EEYEIPN

SEQ ID NO: 2362398 - protein, 7 aa, Entamoeba dispar
EEYESNK

SEQ ID NO: 2362399 - protein, 5 aa, Entamoeba dispar
EEYPK

SEQ ID NO: 2362400 - protein, 5 aa, Entamoeba dispar
EEYQP

SEQ ID NO: 2362401 - protein, 4 aa, Entamoeba dispar
EEYS

SEQ ID NO: 2362402 - protein, 7 aa, Entamoeba dispar
EEYSASS

SEQ ID NO: 2362403 - protein, 5 aa, Entamoeba dispar
EEYSG

SEQ ID NO: 2362404 - protein, 5 aa, Entamoeba dispar
EEYSQ

SEQ ID NO: 2362405 - protein, 6 aa, Entamoeba dispar
EEYVDP

SEQ ID NO: 2362406 - protein, 6 aa, Entamoeba dispar
EFATEE

SEQ ID NO: 2362407 - protein, 7 aa, Entamoeba dispar
EFDEPSY

SEQ ID NO: 2362408 - protein, 4 aa, Entamoeba dispar
EFDT

SEQ ID NO: 2362409 - protein, 9 aa, Entamoeba dispar
EFEEETKKI

SEQ ID NO: 2362410 - protein, 14 aa, Entamoeba dispar
EFEEQTKKIADKYN

SEQ ID NO: 2362411 - protein, 5 aa, Entamoeba dispar
EFEET

SEQ ID NO: 2362412 - protein, 4 aa, Entamoeba dispar
EFEK

SEQ ID NO: 2362413 - protein, 11 aa, Entamoeba dispar
EFEKKDNYITQ

SEQ ID NO: 2362414 - protein, 5 aa, Entamoeba dispar
EFENS

SEQ ID NO: 2362415 - protein, 42 aa, Entamoeba dispar
EFEQEIKSKREEQIKEKEDKIQELKNNNEKKEQEKEEEIKKI

SEQ ID NO: 2362416 - protein, 11 aa, Entamoeba dispar
EFERARGRREA

SEQ ID NO: 2362417 - protein, 4 aa, Entamoeba dispar
EFGN

SEQ ID NO: 2362418 - protein, 7 aa, Entamoeba dispar
EFKEQKN

SEQ ID NO: 2362419 - protein, 6 aa, Entamoeba dispar
EFKGNS

SEQ ID NO: 2362420 - protein, 8 aa, Entamoeba dispar
EFKNTKMS

SEQ ID NO: 2362421 - protein, 23 aa, Entamoeba dispar
EFKQENDNIKRDIESNPIHQVGE

SEQ ID NO: 2362422 - protein, 16 aa, Entamoeba dispar
EFKRNEDGKLKRTPSA

SEQ ID NO: 2362423 - protein, 15 aa, Entamoeba dispar
EFKRNEVGDLQRTKK

SEQ ID NO: 2362424 - protein, 5 aa, Entamoeba dispar
EFNEQ

SEQ ID NO: 2362425 - protein, 5 aa, Entamoeba dispar
EFNPM

SEQ ID NO: 2362426 - protein, 7 aa, Entamoeba dispar
EFNSEEQ

SEQ ID NO: 2362427 - protein, 5 aa, Entamoeba dispar
EFPPL

SEQ ID NO: 2362428 - protein, 8 aa, Entamoeba dispar
EFPPTEEQ

SEQ ID NO: 2362429 - protein, 10 aa, Entamoeba dispar
EFQPGGETDF

SEQ ID NO: 2362430 - protein, 9 aa, Entamoeba dispar
EFRDSKGEV

SEQ ID NO: 2362431 - protein, 9 aa, Entamoeba dispar
EFSEKRNVT

SEQ ID NO: 2362432 - protein, 5 aa, Entamoeba dispar
EFTNY

SEQ ID NO: 2362433 - protein, 11 aa, Entamoeba dispar
EFTPDKGNIRA

SEQ ID NO: 2362434 - protein, 4 aa, Entamoeba dispar
EFTQ

SEQ ID NO: 2362435 - protein, 4 aa, Entamoeba dispar
EFTS

SEQ ID NO: 2362436 - protein, 10 aa, Entamoeba dispar
EFTTPTGDYL

SEQ ID NO: 2362437 - protein, 7 aa, Entamoeba dispar
EGARKYA

SEQ ID NO: 2362438 - protein, 13 aa, Entamoeba dispar
EGARNKAKHLQNP

SEQ ID NO: 2362439 - protein, 8 aa, Entamoeba dispar
EGATTGHS

SEQ ID NO: 2362440 - protein, 6 aa, Entamoeba dispar
EGATVQ

SEQ ID NO: 2362441 - protein, 5 aa, Entamoeba dispar
EGAVK

SEQ ID NO: 2362442 - protein, 6 aa, Entamoeba dispar
EGCQPS

SEQ ID NO: 2362443 - protein, 12 aa, Entamoeba dispar
EGCRNNGNSNSR

SEQ ID NO: 2362444 - protein, 14 aa, Entamoeba dispar
EGDEEIDEKEEEIV

SEQ ID NO: 2362445 - protein, 15 aa, Entamoeba dispar
EGDEEMKKKFSSAMK

SEQ ID NO: 2362446 - protein, 6 aa, Entamoeba dispar
EGDEIE

SEQ ID NO: 2362447 - protein, 7 aa, Entamoeba dispar
EGDPEGD

SEQ ID NO: 2362448 - protein, 7 aa, Entamoeba dispar
EGDPELS

SEQ ID NO: 2362449 - protein, 21 aa, Entamoeba dispar
EGDPNGKIEEFDAGNSPTAVV

SEQ ID NO: 2362450 - protein, 9 aa, Entamoeba dispar
EGECSNSEG

SEQ ID NO: 2362451 - protein, 4 aa, Entamoeba dispar
EGED

SEQ ID NO: 2362452 - protein, 32 aa, Entamoeba dispar
EGEEIDIDDNKKEEEIENKPTETKADENKDTT

SEQ ID NO: 2362453 - protein, 5 aa, Entamoeba dispar
EGEFN

SEQ ID NO: 2362454 - protein, 6 aa, Entamoeba dispar
EGEIAS

SEQ ID NO: 2362455 - protein, 8 aa, Entamoeba dispar
EGEKGYYD

SEQ ID NO: 2362456 - protein, 70 aa, Entamoeba dispar
EGEKKMNGSDISSNSTPSVPSSAQEQSIPSEEQQIDPLQQNSQNGSIQSPSQPEKNQPMTSSSSSSSSSS

SEQ ID NO: 2362457 - protein, 18 aa, Entamoeba dispar
EGEYQDEEGSGQCKECPV

SEQ ID NO: 2362458 - protein, 6 aa, Entamoeba dispar
EGEYQI

SEQ ID NO: 2362459 - protein, 13 aa, Entamoeba dispar
EGFDKERAAGTYR

SEQ ID NO: 2362460 - protein, 5 aa, Entamoeba dispar
EGFGS

SEQ ID NO: 2362461 - protein, 7 aa, Entamoeba dispar
EGFQAED

SEQ ID NO: 2362462 - protein, 4 aa, Entamoeba dispar
EGGD

SEQ ID NO: 2362463 - protein, 6 aa, Entamoeba dispar
EGGDQI

SEQ ID NO: 2362464 - protein, 8 aa, Entamoeba dispar
EGGEYKNK

SEQ ID NO: 2362465 - protein, 7 aa, Entamoeba dispar
EGGNELS

SEQ ID NO: 2362466 - protein, 13 aa, Entamoeba dispar
EGGQEDHDCAYKD

SEQ ID NO: 2362467 - protein, 6 aa, Entamoeba dispar
EGGSQG

SEQ ID NO: 2362468 - protein, 9 aa, Entamoeba dispar
EGGSYGVST

SEQ ID NO: 2362469 - protein, 8 aa, Entamoeba dispar
EGGVQEAT

SEQ ID NO: 2362470 - protein, 28 aa, Entamoeba dispar
  misc_feature (15)..(16): Xaa can be any naturally occurring amino acid
EGHEGTVIVIGMEVXXSIYLFLFYIVIS

SEQ ID NO: 2362471 - protein, 12 aa, Entamoeba dispar
EGILSKSDIKGN

SEQ ID NO: 2362472 - protein, 9 aa, Entamoeba dispar
EGINENTYN

SEQ ID NO: 2362473 - protein, 7 aa, Entamoeba dispar
EGINETR

SEQ ID NO: 2362474 - protein, 6 aa, Entamoeba dispar
EGIPIK

SEQ ID NO: 2362475 - protein, 7 aa, Entamoeba dispar
EGKAQNV

SEQ ID NO: 2362476 - protein, 8 aa, Entamoeba dispar
EGKDDPVA

SEQ ID NO: 2362477 - protein, 5 aa, Entamoeba dispar
EGKEI

SEQ ID NO: 2362478 - protein, 18 aa, Entamoeba dispar
EGKEINGNECKNVNTDNC

SEQ ID NO: 2362479 - protein, 8 aa, Entamoeba dispar
EGKERKEI

SEQ ID NO: 2362480 - protein, 10 aa, Entamoeba dispar
EGKGADIEQI

SEQ ID NO: 2362481 - protein, 14 aa, Entamoeba dispar
EGKGCSGNPTATTV

SEQ ID NO: 2362482 - protein, 4 aa, Entamoeba dispar
EGKL

SEQ ID NO: 2362483 - protein, 8 aa, Entamoeba dispar
EGKRPSFK

SEQ ID NO: 2362484 - protein, 19 aa, Entamoeba dispar
EGKRSSNSQTCDTTCDESC

SEQ ID NO: 2362485 - protein, 5 aa, Entamoeba dispar
EGKSI

SEQ ID NO: 2362486 - protein, 4 aa, Entamoeba dispar
EGKY

SEQ ID NO: 2362487 - protein, 5 aa, Entamoeba dispar
EGKYT

SEQ ID NO: 2362488 - protein, 9 aa, Entamoeba dispar
EGLKPLSEA

SEQ ID NO: 2362489 - protein, 15 aa, Entamoeba dispar
EGLKSESKEIENYNS

SEQ ID NO: 2362490 - protein, 5 aa, Entamoeba dispar
EGLKT

SEQ ID NO: 2362491 - protein, 22 aa, Entamoeba dispar
EGLPDDESTVAKFGDASMASPF

SEQ ID NO: 2362492 - protein, 7 aa, Entamoeba dispar
EGLREEL

SEQ ID NO: 2362493 - protein, 14 aa, Entamoeba dispar
EGLSSGLANSTEAY

SEQ ID NO: 2362494 - protein, 10 aa, Entamoeba dispar
EGLSSNPLGF

SEQ ID NO: 2362495 - protein, 8 aa, Entamoeba dispar
EGLTTSQG

SEQ ID NO: 2362496 - protein, 6 aa, Entamoeba dispar
EGNEIE

SEQ ID NO: 2362497 - protein, 9 aa, Entamoeba dispar
EGNESHGYT

SEQ ID NO: 2362498 - protein, 6 aa, Entamoeba dispar
EGNGKE

SEQ ID NO: 2362499 - protein, 10 aa, Entamoeba dispar
EGNGSTESGM

SEQ ID NO: 2362500 - protein, 9 aa, Entamoeba dispar
EGNIKTDYP

SEQ ID NO: 2362501 - protein, 9 aa, Entamoeba dispar
EGNLTEEEF

SEQ ID NO: 2362502 - protein, 12 aa, Entamoeba dispar
EGNSTSKRRKEI

SEQ ID NO: 2362503 - protein, 6 aa, Entamoeba dispar
EGNSVT

SEQ ID NO: 2362504 - protein, 13 aa, Entamoeba dispar
EGNTISSVEGSSL

SEQ ID NO: 2362505 - protein, 6 aa, Entamoeba dispar
EGNTNN

SEQ ID NO: 2362506 - protein, 7 aa, Entamoeba dispar
EGNTVPA

SEQ ID NO: 2362507 - protein, 9 aa, Entamoeba dispar
EGPDRLPVG

SEQ ID NO: 2362508 - protein, 5 aa, Entamoeba dispar
EGPLH

SEQ ID NO: 2362509 - protein, 17 aa, Entamoeba dispar
EGQESSEDKKEKEQMSS

SEQ ID NO: 2362510 - protein, 4 aa, Entamoeba dispar
EGQK

SEQ ID NO: 2362511 - protein, 8 aa, Entamoeba dispar
EGQNEPIP

SEQ ID NO: 2362512 - protein, 10 aa, Entamoeba dispar
EGQTLSNENV

SEQ ID NO: 2362513 - protein, 5 aa, Entamoeba dispar
EGQTN

SEQ ID NO: 2362514 - protein, 6 aa, Entamoeba dispar
EGRKEK

SEQ ID NO: 2362515 - protein, 4 aa, Entamoeba dispar
EGRN

SEQ ID NO: 2362516 - protein, 5 aa, Entamoeba dispar
EGRYT

SEQ ID NO: 2362517 - protein, 10 aa, Entamoeba dispar
EGSCSTTKEG

SEQ ID NO: 2362518 - protein, 6 aa, Entamoeba dispar
EGSDTY

SEQ ID NO: 2362519 - protein, 6 aa, Entamoeba dispar
EGSFGK

SEQ ID NO: 2362520 - protein, 8 aa, Entamoeba dispar
EGSGNAEM

SEQ ID NO: 2362521 - protein, 6 aa, Entamoeba dispar
EGSIGT

SEQ ID NO: 2362522 - protein, 4 aa, Entamoeba dispar
EGSK

SEQ ID NO: 2362523 - protein, 6 aa, Entamoeba dispar
EGSKRR

SEQ ID NO: 2362524 - protein, 8 aa, Entamoeba dispar
EGSKYESA

SEQ ID NO: 2362525 - protein, 4 aa, Entamoeba dispar
EGSN

SEQ ID NO: 2362526 - protein, 15 aa, Entamoeba dispar
EGSQDKITPETESFY

SEQ ID NO: 2362527 - protein, 10 aa, Entamoeba dispar
EGSTKEKREL

SEQ ID NO: 2362528 - protein, 5 aa, Entamoeba dispar
EGSYQ

SEQ ID NO: 2362529 - protein, 5 aa, Entamoeba dispar
EGTAK

SEQ ID NO: 2362530 - protein, 17 aa, Entamoeba dispar
EGTDGSAREDDYSFERK

SEQ ID NO: 2362531 - protein, 8 aa, Entamoeba dispar
EGTEEAHT

SEQ ID NO: 2362532 - protein, 7 aa, Entamoeba dispar
EGTFQGK

SEQ ID NO: 2362533 - protein, 5 aa, Entamoeba dispar
EGTFV

SEQ ID NO: 2362534 - protein, 12 aa, Entamoeba dispar
EGTGKSDSSRSK

SEQ ID NO: 2362535 - protein, 6 aa, Entamoeba dispar
EGTGSE

SEQ ID NO: 2362536 - protein, 5 aa, Entamoeba dispar
EGTHT

SEQ ID NO: 2362537 - protein, 17 aa, Entamoeba dispar
EGTINQITSTSSSDDYF

SEQ ID NO: 2362538 - protein, 8 aa, Entamoeba dispar
EGTKSITI

SEQ ID NO: 2362539 - protein, 9 aa, Entamoeba dispar
EGTRVKPQK

SEQ ID NO: 2362540 - protein, 17 aa, Entamoeba dispar
EGTSTYYTSYTENGACS

SEQ ID NO: 2362541 - protein, 6 aa, Entamoeba dispar
EGVKGS

SEQ ID NO: 2362542 - protein, 8 aa, Entamoeba dispar
EGVKTSII

SEQ ID NO: 2362543 - protein, 8 aa, Entamoeba dispar
EGVPNDSI

SEQ ID NO: 2362544 - protein, 29 aa, Entamoeba dispar
EGVPTPNNEVYSESDEQSKSEETSIDGTN

SEQ ID NO: 2362545 - protein, 8 aa, Entamoeba dispar
EGVQIKEY

SEQ ID NO: 2362546 - protein, 10 aa, Entamoeba dispar
EGVRRNKSLK

SEQ ID NO: 2362547 - protein, 11 aa, Entamoeba dispar
EGVRRNKSLQR

SEQ ID NO: 2362548 - protein, 14 aa, Entamoeba dispar
EGVVDPHAGKQKNE

SEQ ID NO: 2362549 - protein, 4 aa, Entamoeba dispar
EGYD

SEQ ID NO: 2362550 - protein, 7 aa, Entamoeba dispar
EGYDASD

SEQ ID NO: 2362551 - protein, 9 aa, Entamoeba dispar
EGYDDSKCS

SEQ ID NO: 2362552 - protein, 11 aa, Entamoeba dispar
EGYEEFKDKDT

SEQ ID NO: 2362553 - protein, 7 aa, Entamoeba dispar
EGYGGSD

SEQ ID NO: 2362554 - protein, 6 aa, Entamoeba dispar
EGYGLS

SEQ ID NO: 2362555 - protein, 6 aa, Entamoeba dispar
EGYHDK

SEQ ID NO: 2362556 - protein, 4 aa, Entamoeba dispar
EGYK

SEQ ID NO: 2362557 - protein, 8 aa, Entamoeba dispar
EGYLSEQS

SEQ ID NO: 2362558 - protein, 6 aa, Entamoeba dispar
EGYQNA

SEQ ID NO: 2362559 - protein, 4 aa, Entamoeba dispar
EGYR

SEQ ID NO: 2362560 - protein, 9 aa, Entamoeba dispar
EGYSGGALK

SEQ ID NO: 2362561 - protein, 9 aa, Entamoeba dispar
EGYTEKDGI

SEQ ID NO: 2362562 - protein, 6 aa, Entamoeba dispar
EGYTGP

SEQ ID NO: 2362563 - protein, 7 aa, Entamoeba dispar
EHAQEPI

SEQ ID NO: 2362564 - protein, 10 aa, Entamoeba dispar
EHCKAANGIE

SEQ ID NO: 2362565 - protein, 6 aa, Entamoeba dispar
EHEGEI

SEQ ID NO: 2362566 - protein, 7 aa, Entamoeba dispar
EHEGKGS

SEQ ID NO: 2362567 - protein, 9 aa, Entamoeba dispar
EHEKRGNYV

SEQ ID NO: 2362568 - protein, 7 aa, Entamoeba dispar
EHETQRE

SEQ ID NO: 2362569 - protein, 8 aa, Entamoeba dispar
EHFGKKNP

SEQ ID NO: 2362570 - protein, 5 aa, Entamoeba dispar
EHGSL

SEQ ID NO: 2362571 - protein, 8 aa, Entamoeba dispar
EHIQRDSE

SEQ ID NO: 2362572 - protein, 9 aa, Entamoeba dispar
EHKEENDTM

SEQ ID NO: 2362573 - protein, 33 aa, Entamoeba dispar
EHKETKTQKEIEQEIEQDVESYKKSVGINQNKI

SEQ ID NO: 2362574 - protein, 8 aa, Entamoeba dispar
EHKRTQES

SEQ ID NO: 2362575 - protein, 9 aa, Entamoeba dispar
EHKVKRNSQ

SEQ ID NO: 2362576 - protein, 28 aa, Entamoeba dispar
EHNTQFKESPGKYKRKNNKSKKPIKKRN

SEQ ID NO: 2362577 - protein, 6 aa, Entamoeba dispar
EHQNNT

SEQ ID NO: 2362578 - protein, 6 aa, Entamoeba dispar
EHQPAN

SEQ ID NO: 2362579 - protein, 24 aa, Entamoeba dispar
EHQQQNRSNHSNEAVLYDGSEAIE

SEQ ID NO: 2362580 - protein, 4 aa, Entamoeba dispar
EHQV

SEQ ID NO: 2362581 - protein, 7 aa, Entamoeba dispar
EHRERGR

SEQ ID NO: 2362582 - protein, 20 aa, Entamoeba dispar
EHSEISRRKRNKLRTAAEEY

SEQ ID NO: 2362583 - protein, 6 aa, Entamoeba dispar
EHSGNV

SEQ ID NO: 2362584 - protein, 5 aa, Entamoeba dispar
EHSTL

SEQ ID NO: 2362585 - protein, 12 aa, Entamoeba dispar
EHTHTDSTQQSY

SEQ ID NO: 2362586 - protein, 8 aa, Entamoeba dispar
EHYKTPAD

SEQ ID NO: 2362587 - protein, 15 aa, Entamoeba dispar
EHYRPGNLKSPEQGI

SEQ ID NO: 2362588 - protein, 20 aa, Entamoeba dispar
EIAEDKKEENIEKQIEEDEI

SEQ ID NO: 2362589 - protein, 5 aa, Entamoeba dispar
EIAQE

SEQ ID NO: 2362590 - protein, 12 aa, Entamoeba dispar
EIAQTKTAIDEF

SEQ ID NO: 2362591 - protein, 8 aa, Entamoeba dispar
EIDDNQNI

SEQ ID NO: 2362592 - protein, 19 aa, Entamoeba dispar
EIDEDDDVFTKNESETLKA

SEQ ID NO: 2362593 - protein, 12 aa, Entamoeba dispar
EIDKSENKMKEF

SEQ ID NO: 2362594 - protein, 24 aa, Entamoeba dispar
EIDSNSDSKENSSLSDDSSMSYSE

SEQ ID NO: 2362595 - protein, 6 aa, Entamoeba dispar
EIEAPD

SEQ ID NO: 2362596 - protein, 7 aa, Entamoeba dispar
EIEEDAT

SEQ ID NO: 2362597 - protein, 19 aa, Entamoeba dispar
EIEEEDNKEETSSIDSNEI

SEQ ID NO: 2362598 - protein, 6 aa, Entamoeba dispar
EIEEEQ

SEQ ID NO: 2362599 - protein, 6 aa, Entamoeba dispar
EIEEIG

SEQ ID NO: 2362600 - protein, 21 aa, Entamoeba dispar
EIEERKKKKVVEKEEEAPSYE

SEQ ID NO: 2362601 - protein, 9 aa, Entamoeba dispar
EIEESGETN

SEQ ID NO: 2362602 - protein, 5 aa, Entamoeba dispar
EIEGP

SEQ ID NO: 2362603 - protein, 11 aa, Entamoeba dispar
EIEGQTFTEEE

SEQ ID NO: 2362604 - protein, 23 aa, Entamoeba dispar
EIEIGEGEEIEKEENEKYSIRTN

SEQ ID NO: 2362605 - protein, 23 aa, Entamoeba dispar
EIEIGEGEEIEKEENETYSIRTK

SEQ ID NO: 2362606 - protein, 11 aa, Entamoeba dispar
EIEKENEKLKK

SEQ ID NO: 2362607 - protein, 13 aa, Entamoeba dispar
EIEKKKEQEKIQR

SEQ ID NO: 2362608 - protein, 6 aa, Entamoeba dispar
EIENNG

SEQ ID NO: 2362609 - protein, 22 aa, Entamoeba dispar
EIEQKKSLTNVSNKKEYDEKEE

SEQ ID NO: 2362610 - protein, 8 aa, Entamoeba dispar
EIERDERR

SEQ ID NO: 2362611 - protein, 14 aa, Entamoeba dispar
EIERYEKASEESME

SEQ ID NO: 2362612 - protein, 7 aa, Entamoeba dispar
EIETNSN

SEQ ID NO: 2362613 - protein, 8 aa, Entamoeba dispar
EIGDTSEL

SEQ ID NO: 2362614 - protein, 10 aa, Entamoeba dispar
EIGNDGTTFG

SEQ ID NO: 2362615 - protein, 21 aa, Entamoeba dispar
EIGNTEPNKVSDENVTPVTSS

SEQ ID NO: 2362616 - protein, 11 aa, Entamoeba dispar
EIGSNISISKD

SEQ ID NO: 2362617 - protein, 8 aa, Entamoeba dispar
EIGTQKGI

SEQ ID NO: 2362618 - protein, 19 aa, Entamoeba dispar
EIIEKEKTQKGPKKMNEEN

SEQ ID NO: 2362619 - protein, 10 aa, Entamoeba dispar
EIISKTKQNK

SEQ ID NO: 2362620 - protein, 10 aa, Entamoeba dispar
EIKDPNNKEK

SEQ ID NO: 2362621 - protein, 4 aa, Entamoeba dispar
EIKE

SEQ ID NO: 2362622 - protein, 5 aa, Entamoeba dispar
EIKGG

SEQ ID NO: 2362623 - protein, 12 aa, Entamoeba dispar
EIKGKENKKGEW

SEQ ID NO: 2362624 - protein, 13 aa, Entamoeba dispar
EIKKERRKEKIQN

SEQ ID NO: 2362625 - protein, 8 aa, Entamoeba dispar
EIKKIEKA

SEQ ID NO: 2362626 - protein, 17 aa, Entamoeba dispar
EIKNEFDTSLKKKEINV

SEQ ID NO: 2362627 - protein, 10 aa, Entamoeba dispar
EIKPNNSYCQ

SEQ ID NO: 2362628 - protein, 15 aa, Entamoeba dispar
EIKRSVQASNITSND

SEQ ID NO: 2362629 - protein, 10 aa, Entamoeba dispar
EIKSEELTTQ

SEQ ID NO: 2362630 - protein, 8 aa, Entamoeba dispar
EIKSGDDD

SEQ ID NO: 2362631 - protein, 48 aa, Entamoeba dispar
EIKSNKEELNQKNIENEGDDDDNEIEEKQEKDTTKKKRPNDEEKERLR

SEQ ID NO: 2362632 - protein, 24 aa, Entamoeba dispar
EIKSTTRSSNVTNPHQQSEVKHQE

SEQ ID NO: 2362633 - protein, 8 aa, Entamoeba dispar
EILPGGRK

SEQ ID NO: 2362634 - protein, 5 aa, Entamoeba dispar
EILSD

SEQ ID NO: 2362635 - protein, 5 aa, Entamoeba dispar
EINEE

SEQ ID NO: 2362636 - protein, 19 aa, Entamoeba dispar
EINKRSPSNMKTNESKNSQ

SEQ ID NO: 2362637 - protein, 7 aa, Entamoeba dispar
EINNECK

SEQ ID NO: 2362638 - protein, 6 aa, Entamoeba dispar
EINNQQ

SEQ ID NO: 2362639 - protein, 5 aa, Entamoeba dispar
EINPQ

SEQ ID NO: 2362640 - protein, 6 aa, Entamoeba dispar
EINPTN

SEQ ID NO: 2362641 - protein, 10 aa, Entamoeba dispar
EINQNPNDHY

SEQ ID NO: 2362642 - protein, 5 aa, Entamoeba dispar
EIPAE

SEQ ID NO: 2362643 - protein, 6 aa, Entamoeba dispar
EIPETN

SEQ ID NO: 2362644 - protein, 4 aa, Entamoeba dispar
EIPP

SEQ ID NO: 2362645 - protein, 6 aa, Entamoeba dispar
EIPPTT

SEQ ID NO: 2362646 - protein, 10 aa, Entamoeba dispar
EIQENHKKVN

SEQ ID NO: 2362647 - protein, 14 aa, Entamoeba dispar
EIQEQGEKDDEEYS

SEQ ID NO: 2362648 - protein, 9 aa, Entamoeba dispar
EIQETRDDI

SEQ ID NO: 2362649 - protein, 9 aa, Entamoeba dispar
EIQQHSKGE

SEQ ID NO: 2362650 - protein, 4 aa, Entamoeba dispar
EIQS

SEQ ID NO: 2362651 - protein, 7 aa, Entamoeba dispar
EIQSNEM

SEQ ID NO: 2362652 - protein, 6 aa, Entamoeba dispar
EIQSVG

SEQ ID NO: 2362653 - protein, 12 aa, Entamoeba dispar
EIRGSDENTFKT

SEQ ID NO: 2362654 - protein, 5 aa, Entamoeba dispar
EIRTV

SEQ ID NO: 2362655 - protein, 7 aa, Entamoeba dispar
EISETNP

SEQ ID NO: 2362656 - protein, 10 aa, Entamoeba dispar
EISKEKTNSI

SEQ ID NO: 2362657 - protein, 19 aa, Entamoeba dispar
EISKKEKEIDERKKEEEKL

SEQ ID NO: 2362658 - protein, 9 aa, Entamoeba dispar
EISKKNKKL

SEQ ID NO: 2362659 - protein, 12 aa, Entamoeba dispar
EISKNQKETPKE

SEQ ID NO: 2362660 - protein, 15 aa, Entamoeba dispar
EISNPNNDGYFTDPE

SEQ ID NO: 2362661 - protein, 19 aa, Entamoeba dispar
EISTTPSPSNNEEEKPQKE

SEQ ID NO: 2362662 - protein, 5 aa, Entamoeba dispar
EISYT

SEQ ID NO: 2362663 - protein, 13 aa, Entamoeba dispar
EITGQTKESPELT

SEQ ID NO: 2362664 - protein, 5 aa, Entamoeba dispar
EITGT

SEQ ID NO: 2362665 - protein, 8 aa, Entamoeba dispar
EITKDRPR

SEQ ID NO: 2362666 - protein, 5 aa, Entamoeba dispar
EITSE

SEQ ID NO: 2362667 - protein, 11 aa, Entamoeba dispar
EITSRTDSFTD

SEQ ID NO: 2362668 - protein, 12 aa, Entamoeba dispar
EITYSPPYGQIG

SEQ ID NO: 2362669 - protein, 5 aa, Entamoeba dispar
EIVQN

SEQ ID NO: 2362670 - protein, 5 aa, Entamoeba dispar
EIVRT

SEQ ID NO: 2362671 - protein, 10 aa, Entamoeba dispar
EKAERREENY

SEQ ID NO: 2362672 - protein, 7 aa, Entamoeba dispar
EKARPNQ

SEQ ID NO: 2362673 - protein, 4 aa, Entamoeba dispar
EKAS

SEQ ID NO: 2362674 - protein, 12 aa, Entamoeba dispar
EKASSHDTCESA

SEQ ID NO: 2362675 - protein, 11 aa, Entamoeba dispar
EKATDKDGHPL

SEQ ID NO: 2362676 - protein, 7 aa, Entamoeba dispar
EKATNIQ

SEQ ID NO: 2362677 - protein, 5 aa, Entamoeba dispar
EKAYE

SEQ ID NO: 2362678 - protein, 18 aa, Entamoeba dispar
EKCDTTKHIKSDCNDCED

SEQ ID NO: 2362679 - protein, 8 aa, Entamoeba dispar
EKCPTQKP

SEQ ID NO: 2362680 - protein, 13 aa, Entamoeba dispar
EKCSDSCGTCVQE

SEQ ID NO: 2362681 - protein, 9 aa, Entamoeba dispar
EKCSEGCKS

SEQ ID NO: 2362682 - protein, 5 aa, Entamoeba dispar
EKDAS

SEQ ID NO: 2362683 - protein, 9 aa, Entamoeba dispar
EKDAVHRQT

SEQ ID NO: 2362684 - protein, 7 aa, Entamoeba dispar
EKDDRMT

SEQ ID NO: 2362685 - protein, 11 aa, Entamoeba dispar
EKDDTKNKRIT

SEQ ID NO: 2362686 - protein, 9 aa, Entamoeba dispar
EKDENGFKN

SEQ ID NO: 2362687 - protein, 6 aa, Entamoeba dispar
EKDITQ

SEQ ID NO: 2362688 - protein, 17 aa, Entamoeba dispar
EKDKKTSSIQQTTENTL

SEQ ID NO: 2362689 - protein, 8 aa, Entamoeba dispar
EKDNETVS

SEQ ID NO: 2362690 - protein, 6 aa, Entamoeba dispar
EKDNKY

SEQ ID NO: 2362691 - protein, 10 aa, Entamoeba dispar
EKDNPDNESL

SEQ ID NO: 2362692 - protein, 5 aa, Entamoeba dispar
EKDQL

SEQ ID NO: 2362693 - protein, 8 aa, Entamoeba dispar
EKDSKIKI

SEQ ID NO: 2362694 - protein, 4 aa, Entamoeba dispar
EKDT

SEQ ID NO: 2362695 - protein, 6 aa, Entamoeba dispar
EKDTEY

SEQ ID NO: 2362696 - protein, 6 aa, Entamoeba dispar
EKDTGH

SEQ ID NO: 2362697 - protein, 8 aa, Entamoeba dispar
EKDTNKTI

SEQ ID NO: 2362698 - protein, 7 aa, Entamoeba dispar
EKDTTTI

SEQ ID NO: 2362699 - protein, 7 aa, Entamoeba dispar
EKDVQRN

SEQ ID NO: 2362700 - protein, 10 aa, Entamoeba dispar
EKDVTSIKTI

SEQ ID NO: 2362701 - protein, 12 aa, Entamoeba dispar
EKDYEIETLPNG

SEQ ID NO: 2362702 - protein, 5 aa, Entamoeba dispar
EKEAE

SEQ ID NO: 2362703 - protein, 8 aa, Entamoeba dispar
EKEDDEDI

SEQ ID NO: 2362704 - protein, 4 aa, Entamoeba dispar
EKEE

SEQ ID NO: 2362705 - protein, 6 aa, Entamoeba dispar
EKEEDI

SEQ ID NO: 2362706 - protein, 20 aa, Entamoeba dispar
EKEEHEKAEKELKQKTIGSK

SEQ ID NO: 2362707 - protein, 5 aa, Entamoeba dispar
EKEEL

SEQ ID NO: 2362708 - protein, 12 aa, Entamoeba dispar
EKEENDFNSGVD

SEQ ID NO: 2362709 - protein, 9 aa, Entamoeba dispar
EKEERETIK

SEQ ID NO: 2362710 - protein, 6 aa, Entamoeba dispar
EKEEYK

SEQ ID NO: 2362711 - protein, 9 aa, Entamoeba dispar
EKEFSERYS

SEQ ID NO: 2362712 - protein, 7 aa, Entamoeba dispar
EKEGEFS

SEQ ID NO: 2362713 - protein, 29 aa, Entamoeba dispar
EKEGETTNEYKTPTKESNNIKNRTEKSHS

SEQ ID NO: 2362714 - protein, 7 aa, Entamoeba dispar
EKEGKTQ

SEQ ID NO: 2362715 - protein, 10 aa, Entamoeba dispar
EKEHTTGNYY

SEQ ID NO: 2362716 - protein, 6 aa, Entamoeba dispar
EKEIHA

SEQ ID NO: 2362717 - protein, 12 aa, Entamoeba dispar
EKEINKSKQGIP

SEQ ID NO: 2362718 - protein, 15 aa, Entamoeba dispar
EKEKKESHSYSQAAG

SEQ ID NO: 2362719 - protein, 9 aa, Entamoeba dispar
EKEKQAGEI

SEQ ID NO: 2362720 - protein, 8 aa, Entamoeba dispar
EKEKYSAE

SEQ ID NO: 2362721 - protein, 7 aa, Entamoeba dispar
EKENALK

SEQ ID NO: 2362722 - protein, 7 aa, Entamoeba dispar
EKENDIK

SEQ ID NO: 2362723 - protein, 7 aa, Entamoeba dispar
EKENEHR

SEQ ID NO: 2362724 - protein, 6 aa, Entamoeba dispar
EKENET

SEQ ID NO: 2362725 - protein, 10 aa, Entamoeba dispar
EKENKPIGYK

SEQ ID NO: 2362726 - protein, 6 aa, Entamoeba dispar
EKENRN

SEQ ID NO: 2362727 - protein, 8 aa, Entamoeba dispar
EKENSEIK

SEQ ID NO: 2362728 - protein, 8 aa, Entamoeba dispar
EKENTEYK

SEQ ID NO: 2362729 - protein, 13 aa, Entamoeba dispar
EKENYKCSNSTEI

SEQ ID NO: 2362730 - protein, 5 aa, Entamoeba dispar
EKERW

SEQ ID NO: 2362731 - protein, 16 aa, Entamoeba dispar
EKESSCYASQTGQYNG

SEQ ID NO: 2362732 - protein, 7 aa, Entamoeba dispar
EKETLCG

SEQ ID NO: 2362733 - protein, 13 aa, Entamoeba dispar
EKEYNEFKTKYEK

SEQ ID NO: 2362734 - protein, 6 aa, Entamoeba dispar
EKEYSK

SEQ ID NO: 2362735 - protein, 4 aa, Entamoeba dispar
EKFG

SEQ ID NO: 2362736 - protein, 5 aa, Entamoeba dispar
EKFGG

SEQ ID NO: 2362737 - protein, 7 aa, Entamoeba dispar
EKFKPET

SEQ ID NO: 2362738 - protein, 8 aa, Entamoeba dispar
EKGDETLD

SEQ ID NO: 2362739 - protein, 18 aa, Entamoeba dispar
EKGECQKNDNKCNKSERN

SEQ ID NO: 2362740 - protein, 7 aa, Entamoeba dispar
EKGEEID

SEQ ID NO: 2362741 - protein, 11 aa, Entamoeba dispar
EKGGETQNERG

SEQ ID NO: 2362742 - protein, 9 aa, Entamoeba dispar
EKGGKGNIK

SEQ ID NO: 2362743 - protein, 6 aa, Entamoeba dispar
EKGGNI

SEQ ID NO: 2362744 - protein, 9 aa, Entamoeba dispar
EKGGYSDEK

SEQ ID NO: 2362745 - protein, 4 aa, Entamoeba dispar
EKGI

SEQ ID NO: 2362746 - protein, 8 aa, Entamoeba dispar
EKGITSEC

SEQ ID NO: 2362747 - protein, 6 aa, Entamoeba dispar
EKGLSS

SEQ ID NO: 2362748 - protein, 8 aa, Entamoeba dispar
EKGMNKQT

SEQ ID NO: 2362749 - protein, 8 aa, Entamoeba dispar
EKGSTISI

SEQ ID NO: 2362750 - protein, 7 aa, Entamoeba dispar
EKGTKCN

SEQ ID NO: 2362751 - protein, 8 aa, Entamoeba dispar
EKGTNNYD

SEQ ID NO: 2362752 - protein, 10 aa, Entamoeba dispar
EKGVREGEEN

SEQ ID NO: 2362753 - protein, 9 aa, Entamoeba dispar
EKHKGDYDL

SEQ ID NO: 2362754 - protein, 8 aa, Entamoeba dispar
EKHPRNPT

SEQ ID NO: 2362755 - protein, 5 aa, Entamoeba dispar
EKIDR

SEQ ID NO: 2362756 - protein, 5 aa, Entamoeba dispar
EKIDS

SEQ ID NO: 2362757 - protein, 21 aa, Entamoeba dispar
EKINAKLSDFGTSRDVSSSNV

SEQ ID NO: 2362758 - protein, 4 aa, Entamoeba dispar
EKIQ

SEQ ID NO: 2362759 - protein, 5 aa, Entamoeba dispar
EKISQ

SEQ ID NO: 2362760 - protein, 14 aa, Entamoeba dispar
EKKAPKSNHSHRIA

SEQ ID NO: 2362761 - protein, 18 aa, Entamoeba dispar
EKKDDGYYCSNRKSKCYK

SEQ ID NO: 2362762 - protein, 9 aa, Entamoeba dispar
EKKDISTPL

SEQ ID NO: 2362763 - protein, 33 aa, Entamoeba dispar
  misc_feature (16)..(17): Xaa can be any naturally occurring amino acid
EKKDKMAKFGTIPPLXXRIILLDVVIVLIQILV

SEQ ID NO: 2362764 - protein, 13 aa, Entamoeba dispar
EKKEEEENHKKEI

SEQ ID NO: 2362765 - protein, 9 aa, Entamoeba dispar
EKKEETGRY

SEQ ID NO: 2362766 - protein, 12 aa, Entamoeba dispar
EKKEMAKENERI

SEQ ID NO: 2362767 - protein, 8 aa, Entamoeba dispar
EKKGITLS

SEQ ID NO: 2362768 - protein, 7 aa, Entamoeba dispar
EKKGPII

SEQ ID NO: 2362769 - protein, 8 aa, Entamoeba dispar
EKKIGEGT

SEQ ID NO: 2362770 - protein, 4 aa, Entamoeba dispar
EKKM

SEQ ID NO: 2362771 - protein, 10 aa, Entamoeba dispar
EKKNRTEEVA

SEQ ID NO: 2362772 - protein, 10 aa, Entamoeba dispar
EKKPGSDSFQ

SEQ ID NO: 2362773 - protein, 7 aa, Entamoeba dispar
EKKPIEV

SEQ ID NO: 2362774 - protein, 8 aa, Entamoeba dispar
EKKPRIKE

SEQ ID NO: 2362775 - protein, 23 aa, Entamoeba dispar
EKKPYQCQPSKYSKSTGCSECND

SEQ ID NO: 2362776 - protein, 8 aa, Entamoeba dispar
EKKRQEKI

SEQ ID NO: 2362777 - protein, 6 aa, Entamoeba dispar
EKKTTV

SEQ ID NO: 2362778 - protein, 7 aa, Entamoeba dispar
EKKYEKG

SEQ ID NO: 2362779 - protein, 11 aa, Entamoeba dispar
EKLKNADKSNV

SEQ ID NO: 2362780 - protein, 7 aa, Entamoeba dispar
EKLPNET

SEQ ID NO: 2362781 - protein, 8 aa, Entamoeba dispar
EKLPPGNS

SEQ ID NO: 2362782 - protein, 4 aa, Entamoeba dispar
EKLS

SEQ ID NO: 2362783 - protein, 5 aa, Entamoeba dispar
EKMDT

SEQ ID NO: 2362784 - protein, 5 aa, Entamoeba dispar
EKMEE

SEQ ID NO: 2362785 - protein, 7 aa, Entamoeba dispar
EKMPENL

SEQ ID NO: 2362786 - protein, 9 aa, Entamoeba dispar
EKNAKTFKP

SEQ ID NO: 2362787 - protein, 20 aa, Entamoeba dispar
EKNDFDKTFETNSDDISLTM

SEQ ID NO: 2362788 - protein, 9 aa, Entamoeba dispar
EKNDKEKKE

SEQ ID NO: 2362789 - protein, 8 aa, Entamoeba dispar
EKNDTAKK

SEQ ID NO: 2362790 - protein, 4 aa, Entamoeba dispar
EKNE

SEQ ID NO: 2362791 - protein, 6 aa, Entamoeba dispar
EKNFAE

SEQ ID NO: 2362792 - protein, 6 aa, Entamoeba dispar
EKNFRP

SEQ ID NO: 2362793 - protein, 10 aa, Entamoeba dispar
EKNGRQRTTR

SEQ ID NO: 2362794 - protein, 6 aa, Entamoeba dispar
EKNHLK

SEQ ID NO: 2362795 - protein, 9 aa, Entamoeba dispar
EKNKCNKCS

SEQ ID NO: 2362796 - protein, 7 aa, Entamoeba dispar
EKNKDKE

SEQ ID NO: 2362797 - protein, 8 aa, Entamoeba dispar
EKNKEEYQ

SEQ ID NO: 2362798 - protein, 8 aa, Entamoeba dispar
EKNKKKIQ

SEQ ID NO: 2362799 - protein, 18 aa, Entamoeba dispar
EKNKPTGFDRARNKEIGY

SEQ ID NO: 2362800 - protein, 6 aa, Entamoeba dispar
EKNKRI

SEQ ID NO: 2362801 - protein, 8 aa, Entamoeba dispar
EKNNENYE

SEQ ID NO: 2362802 - protein, 6 aa, Entamoeba dispar
EKNQKE

SEQ ID NO: 2362803 - protein, 10 aa, Entamoeba dispar
EKNQPALSST

SEQ ID NO: 2362804 - protein, 5 aa, Entamoeba dispar
EKNRC

SEQ ID NO: 2362805 - protein, 5 aa, Entamoeba dispar
EKNYA

SEQ ID NO: 2362806 - protein, 9 aa, Entamoeba dispar
EKNYKEEEF

SEQ ID NO: 2362807 - protein, 12 aa, Entamoeba dispar
EKPGKQSKMTTT

SEQ ID NO: 2362808 - protein, 4 aa, Entamoeba dispar
EKPH

SEQ ID NO: 2362809 - protein, 6 aa, Entamoeba dispar
EKPHMS

SEQ ID NO: 2362810 - protein, 19 aa, Entamoeba dispar
EKPIPTPLNNKEENEKEGI

SEQ ID NO: 2362811 - protein, 5 aa, Entamoeba dispar
EKPKP

SEQ ID NO: 2362812 - protein, 7 aa, Entamoeba dispar
EKPKSCL

SEQ ID NO: 2362813 - protein, 10 aa, Entamoeba dispar
EKPNKGSKPI

SEQ ID NO: 2362814 - protein, 7 aa, Entamoeba dispar
EKPSHAQ

SEQ ID NO: 2362815 - protein, 8 aa, Entamoeba dispar
EKPTEVSI

SEQ ID NO: 2362816 - protein, 13 aa, Entamoeba dispar
EKPYDGEHKIKGE

SEQ ID NO: 2362817 - protein, 11 aa, Entamoeba dispar
EKQAYENDERF

SEQ ID NO: 2362818 - protein, 12 aa, Entamoeba dispar
EKQGEKKFNENK

SEQ ID NO: 2362819 - protein, 8 aa, Entamoeba dispar
EKQIGEGS

SEQ ID NO: 2362820 - protein, 7 aa, Entamoeba dispar
EKQLNQK

SEQ ID NO: 2362821 - protein, 4 aa, Entamoeba dispar
EKQN

SEQ ID NO: 2362822 - protein, 6 aa, Entamoeba dispar
EKQPKF

SEQ ID NO: 2362823 - protein, 7 aa, Entamoeba dispar
EKQPYSK

SEQ ID NO: 2362824 - protein, 6 aa, Entamoeba dispar
EKQQIS

SEQ ID NO: 2362825 - protein, 14 aa, Entamoeba dispar
EKQQKNNKSIENEQ

SEQ ID NO: 2362826 - protein, 8 aa, Entamoeba dispar
EKQVIEGK

SEQ ID NO: 2362827 - protein, 7 aa, Entamoeba dispar
EKRENEN

SEQ ID NO: 2362828 - protein, 6 aa, Entamoeba dispar
EKRGIE

SEQ ID NO: 2362829 - protein, 6 aa, Entamoeba dispar
EKRKKN

SEQ ID NO: 2362830 - protein, 12 aa, Entamoeba dispar
EKRLEEKKEDVI

SEQ ID NO: 2362831 - protein, 16 aa, Entamoeba dispar
EKRNEKDDILGDENSN

SEQ ID NO: 2362832 - protein, 15 aa, Entamoeba dispar
EKRNKEEIKEDNKNI

SEQ ID NO: 2362833 - protein, 4 aa, Entamoeba dispar
EKRP

SEQ ID NO: 2362834 - protein, 10 aa, Entamoeba dispar
EKRRESEQKK

SEQ ID NO: 2362835 - protein, 8 aa, Entamoeba dispar
EKRSAKSY

SEQ ID NO: 2362836 - protein, 7 aa, Entamoeba dispar
EKRTAKK

SEQ ID NO: 2362837 - protein, 15 aa, Entamoeba dispar
EKSARVNELLADQDT

SEQ ID NO: 2362838 - protein, 19 aa, Entamoeba dispar
EKSDEGLNEDESAISEGSG

SEQ ID NO: 2362839 - protein, 9 aa, Entamoeba dispar
EKSEDEVAT

SEQ ID NO: 2362840 - protein, 7 aa, Entamoeba dispar
EKSKANN

SEQ ID NO: 2362841 - protein, 6 aa, Entamoeba dispar
EKSKDY

SEQ ID NO: 2362842 - protein, 7 aa, Entamoeba dispar
EKSNETI

SEQ ID NO: 2362843 - protein, 4 aa, Entamoeba dispar
EKSP

SEQ ID NO: 2362844 - protein, 5 aa, Entamoeba dispar
EKSPM

SEQ ID NO: 2362845 - protein, 4 aa, Entamoeba dispar
EKSQ

SEQ ID NO: 2362846 - protein, 8 aa, Entamoeba dispar
EKSQEDIP

SEQ ID NO: 2362847 - protein, 28 aa, Entamoeba dispar
EKSQNPPMPPPEESSTNDNDDNNEQHHG

SEQ ID NO: 2362848 - protein, 6 aa, Entamoeba dispar
EKSSKT

SEQ ID NO: 2362849 - protein, 5 aa, Entamoeba dispar
EKSSN

SEQ ID NO: 2362850 - protein, 10 aa, Entamoeba dispar
EKSSSCQKCN

SEQ ID NO: 2362851 - protein, 12 aa, Entamoeba dispar
EKSSSSVDVGAY

SEQ ID NO: 2362852 - protein, 7 aa, Entamoeba dispar
EKSTGSL

SEQ ID NO: 2362853 - protein, 7 aa, Entamoeba dispar
EKTCYYD

SEQ ID NO: 2362854 - protein, 10 aa, Entamoeba dispar
EKTEEKIRKE

SEQ ID NO: 2362855 - protein, 12 aa, Entamoeba dispar
EKTEKKKELFSS

SEQ ID NO: 2362856 - protein, 6 aa, Entamoeba dispar
EKTGNI

SEQ ID NO: 2362857 - protein, 7 aa, Entamoeba dispar
EKTITKT

SEQ ID NO: 2362858 - protein, 9 aa, Entamoeba dispar
EKTKEKFNS

SEQ ID NO: 2362859 - protein, 7 aa, Entamoeba dispar
EKTLEKQ

SEQ ID NO: 2362860 - protein, 5 aa, Entamoeba dispar
EKTNH

SEQ ID NO: 2362861 - protein, 5 aa, Entamoeba dispar
EKTNK

SEQ ID NO: 2362862 - protein, 7 aa, Entamoeba dispar
EKTNSYC

SEQ ID NO: 2362863 - protein, 5 aa, Entamoeba dispar
EKTTA

SEQ ID NO: 2362864 - protein, 7 aa, Entamoeba dispar
EKTTTIT

SEQ ID NO: 2362865 - protein, 6 aa, Entamoeba dispar
EKTYTT

SEQ ID NO: 2362866 - protein, 4 aa, Entamoeba dispar
EKVD

SEQ ID NO: 2362867 - protein, 12 aa, Entamoeba dispar
EKVETKKTEIKS

SEQ ID NO: 2362868 - protein, 8 aa, Entamoeba dispar
EKVGKDEV

SEQ ID NO: 2362869 - protein, 8 aa, Entamoeba dispar
EKVKDETT

SEQ ID NO: 2362870 - protein, 6 aa, Entamoeba dispar
EKVKKE

SEQ ID NO: 2362871 - protein, 5 aa, Entamoeba dispar
EKVKV

SEQ ID NO: 2362872 - protein, 6 aa, Entamoeba dispar
EKVPKQ

SEQ ID NO: 2362873 - protein, 26 aa, Entamoeba dispar
EKVQNEINELKEKEKIQEEENNKLQH

SEQ ID NO: 2362874 - protein, 5 aa, Entamoeba dispar
ELDEE

SEQ ID NO: 2362875 - protein, 4 aa, Entamoeba dispar
ELDG

SEQ ID NO: 2362876 - protein, 10 aa, Entamoeba dispar
ELDGESNLKQ

SEQ ID NO: 2362877 - protein, 5 aa, Entamoeba dispar
ELDKR

SEQ ID NO: 2362878 - protein, 13 aa, Entamoeba dispar
ELDNLKEKNDDEL

SEQ ID NO: 2362879 - protein, 5 aa, Entamoeba dispar
ELDQN

SEQ ID NO: 2362880 - protein, 8 aa, Entamoeba dispar
ELDQNSMS

SEQ ID NO: 2362881 - protein, 16 aa, Entamoeba dispar
ELDSNNSPPLIIVESD

SEQ ID NO: 2362882 - protein, 8 aa, Entamoeba dispar
ELDSNSYN

SEQ ID NO: 2362883 - protein, 11 aa, Entamoeba dispar
ELEEENSKSYI

SEQ ID NO: 2362884 - protein, 9 aa, Entamoeba dispar
ELEEKNNYN

SEQ ID NO: 2362885 - protein, 10 aa, Entamoeba dispar
ELEEKNYGND

SEQ ID NO: 2362886 - protein, 15 aa, Entamoeba dispar
ELEEQDTSSHDDGLF

SEQ ID NO: 2362887 - protein, 5 aa, Entamoeba dispar
ELENE

SEQ ID NO: 2362888 - protein, 10 aa, Entamoeba dispar
ELENEYKKPI

SEQ ID NO: 2362889 - protein, 10 aa, Entamoeba dispar
ELEPQNPFTQ

SEQ ID NO: 2362890 - protein, 9 aa, Entamoeba dispar
ELERTEDDY

SEQ ID NO: 2362891 - protein, 6 aa, Entamoeba dispar
ELGEDN

SEQ ID NO: 2362892 - protein, 6 aa, Entamoeba dispar
ELGHTK

SEQ ID NO: 2362893 - protein, 6 aa, Entamoeba dispar
ELGIGG

SEQ ID NO: 2362894 - protein, 14 aa, Entamoeba dispar
ELIGSNDNACGAQS

SEQ ID NO: 2362895 - protein, 10 aa, Entamoeba dispar
ELIRDQPEKN

SEQ ID NO: 2362896 - protein, 5 aa, Entamoeba dispar
ELKEE

SEQ ID NO: 2362897 - protein, 6 aa, Entamoeba dispar
ELKEEE

SEQ ID NO: 2362898 - protein, 12 aa, Entamoeba dispar
ELKEEKKLGEGS

SEQ ID NO: 2362899 - protein, 12 aa, Entamoeba dispar
ELKEEKQIGEGS

SEQ ID NO: 2362900 - protein, 5 aa, Entamoeba dispar
ELKEK

SEQ ID NO: 2362901 - protein, 15 aa, Entamoeba dispar
ELKGSTAKEQCTEEN

SEQ ID NO: 2362902 - protein, 21 aa, Entamoeba dispar
ELKKEEEIENNLEKKKTPGID

SEQ ID NO: 2362903 - protein, 9 aa, Entamoeba dispar
ELKKEEIQN

SEQ ID NO: 2362904 - protein, 11 aa, Entamoeba dispar
ELKNQSQDPQF

SEQ ID NO: 2362905 - protein, 27 aa, Entamoeba dispar
ELKSNNGNIKSVSCGNSKRFVKSDSQI

SEQ ID NO: 2362906 - protein, 5 aa, Entamoeba dispar
ELNEN

SEQ ID NO: 2362907 - protein, 12 aa, Entamoeba dispar
ELNKKRAEKQEL

SEQ ID NO: 2362908 - protein, 4 aa, Entamoeba dispar
ELNN

SEQ ID NO: 2362909 - protein, 25 aa, Entamoeba dispar
ELNNSKSGSSDESEEQPKSSIQRNE

SEQ ID NO: 2362910 - protein, 10 aa, Entamoeba dispar
ELNPNASIKI

SEQ ID NO: 2362911 - protein, 4 aa, Entamoeba dispar
ELNS

SEQ ID NO: 2362912 - protein, 9 aa, Entamoeba dispar
ELPKAKNRD

SEQ ID NO: 2362913 - protein, 8 aa, Entamoeba dispar
ELPNRKSE

SEQ ID NO: 2362914 - protein, 4 aa, Entamoeba dispar
ELPP

SEQ ID NO: 2362915 - protein, 8 aa, Entamoeba dispar
ELPPQQQL

SEQ ID NO: 2362916 - protein, 13 aa, Entamoeba dispar
ELQNENDINKQCT

SEQ ID NO: 2362917 - protein, 9 aa, Entamoeba dispar
ELQNSGNLS

SEQ ID NO: 2362918 - protein, 6 aa, Entamoeba dispar
ELQPSK

SEQ ID NO: 2362919 - protein, 10 aa, Entamoeba dispar
ELQQTLNNNP

SEQ ID NO: 2362920 - protein, 8 aa, Entamoeba dispar
ELQRKQKD

SEQ ID NO: 2362921 - protein, 4 aa, Entamoeba dispar
ELRR

SEQ ID NO: 2362922 - protein, 9 aa, Entamoeba dispar
ELSEDTHYE

SEQ ID NO: 2362923 - protein, 11 aa, Entamoeba dispar
ELSKPGKNPKN

SEQ ID NO: 2362924 - protein, 15 aa, Entamoeba dispar
ELSNGKDGDCYAQRG

SEQ ID NO: 2362925 - protein, 6 aa, Entamoeba dispar
ELSNNK

SEQ ID NO: 2362926 - protein, 18 aa, Entamoeba dispar
ELSNSINSDKINKEGEKY

SEQ ID NO: 2362927 - protein, 9 aa, Entamoeba dispar
ELSPYDPPL

SEQ ID NO: 2362928 - protein, 5 aa, Entamoeba dispar
ELSQS

SEQ ID NO: 2362929 - protein, 10 aa, Entamoeba dispar
ELSTGSNDDY

SEQ ID NO: 2362930 - protein, 8 aa, Entamoeba dispar
ELTASTNN

SEQ ID NO: 2362931 - protein, 9 aa, Entamoeba dispar
ELTDGKSVI

SEQ ID NO: 2362932 - protein, 5 aa, Entamoeba dispar
ELTEE

SEQ ID NO: 2362933 - protein, 7 aa, Entamoeba dispar
ELTETPT

SEQ ID NO: 2362934 - protein, 11 aa, Entamoeba dispar
ELTGNENNRYL

SEQ ID NO: 2362935 - protein, 8 aa, Entamoeba dispar
ELTGNTQN

SEQ ID NO: 2362936 - protein, 5 aa, Entamoeba dispar
ELTPG

SEQ ID NO: 2362937 - protein, 5 aa, Entamoeba dispar
ELVST

SEQ ID NO: 2362938 - protein, 5 aa, Entamoeba dispar
ELYAN

SEQ ID NO: 2362939 - protein, 12 aa, Entamoeba dispar
EMAPDGAISNET

SEQ ID NO: 2362940 - protein, 51 aa, Entamoeba dispar
EMDDSSSSTDEDKIARENGEEVAYKSKISKKVNYNSEGESKDELSKEDIKN

SEQ ID NO: 2362941 - protein, 44 aa, Entamoeba dispar
EMDENKEESHTTEQNDENKEQSPTESIENNEIKEHPQPVEQEES

SEQ ID NO: 2362942 - protein, 13 aa, Entamoeba dispar
EMEEEVEDKENIQ

SEQ ID NO: 2362943 - protein, 11 aa, Entamoeba dispar
EMEKEKKENKI

SEQ ID NO: 2362944 - protein, 8 aa, Entamoeba dispar
EMEPSGDF

SEQ ID NO: 2362945 - protein, 6 aa, Entamoeba dispar
EMGDDM

SEQ ID NO: 2362946 - protein, 5 aa, Entamoeba dispar
EMHNG

SEQ ID NO: 2362947 - protein, 23 aa, Entamoeba dispar
EMKEEEEKKKFAKEEKKKVQNDL

SEQ ID NO: 2362948 - protein, 16 aa, Entamoeba dispar
EMKNNKKNDNDSWEDE

SEQ ID NO: 2362949 - protein, 13 aa, Entamoeba dispar
EMKPTGTNEYHPI

SEQ ID NO: 2362950 - protein, 7 aa, Entamoeba dispar
EMNKKQN

SEQ ID NO: 2362951 - protein, 5 aa, Entamoeba dispar
EMNPD

SEQ ID NO: 2362952 - protein, 4 aa, Entamoeba dispar
EMNQ

SEQ ID NO: 2362953 - protein, 11 aa, Entamoeba dispar
EMQKKNKKNKF

SEQ ID NO: 2362954 - protein, 20 aa, Entamoeba dispar
EMSPKQSEKEKKVKTVDTGY

SEQ ID NO: 2362955 - protein, 12 aa, Entamoeba dispar
EMSSLNDSSSSS

SEQ ID NO: 2362956 - protein, 11 aa, Entamoeba dispar
ENAEEARGDKV

SEQ ID NO: 2362957 - protein, 12 aa, Entamoeba dispar
ENAEIQQQKQKE

SEQ ID NO: 2362958 - protein, 13 aa, Entamoeba dispar
ENANEVQSTIQQI

SEQ ID NO: 2362959 - protein, 6 aa, Entamoeba dispar
ENASNI

SEQ ID NO: 2362960 - protein, 7 aa, Entamoeba dispar
ENDADQE

SEQ ID NO: 2362961 - protein, 5 aa, Entamoeba dispar
ENDDQ

SEQ ID NO: 2362962 - protein, 7 aa, Entamoeba dispar
ENDDSTV

SEQ ID NO: 2362963 - protein, 20 aa, Entamoeba dispar
ENDEINKETKEKEEEINQED

SEQ ID NO: 2362964 - protein, 5 aa, Entamoeba dispar
ENDEQ

SEQ ID NO: 2362965 - protein, 9 aa, Entamoeba dispar
ENDGGSEGL

SEQ ID NO: 2362966 - protein, 6 aa, Entamoeba dispar
ENDITD

SEQ ID NO: 2362967 - protein, 8 aa, Entamoeba dispar
ENDKEIDA

SEQ ID NO: 2362968 - protein, 9 aa, Entamoeba dispar
ENDSNETDA

SEQ ID NO: 2362969 - protein, 5 aa, Entamoeba dispar
ENDSQ

SEQ ID NO: 2362970 - protein, 7 aa, Entamoeba dispar
ENDTNFT

SEQ ID NO: 2362971 - protein, 15 aa, Entamoeba dispar
ENEAQLEKCASKNVQ

SEQ ID NO: 2362972 - protein, 10 aa, Entamoeba dispar
ENEDDERKEE

SEQ ID NO: 2362973 - protein, 5 aa, Entamoeba dispar
ENEDK

SEQ ID NO: 2362974 - protein, 19 aa, Entamoeba dispar
ENEDKEIDNYYNQGNDYNS

SEQ ID NO: 2362975 - protein, 8 aa, Entamoeba dispar
ENEEFNEE

SEQ ID NO: 2362976 - protein, 10 aa, Entamoeba dispar
ENEEGLTERQ

SEQ ID NO: 2362977 - protein, 7 aa, Entamoeba dispar
ENEENKE

SEQ ID NO: 2362978 - protein, 15 aa, Entamoeba dispar
ENEEQKEESPSRIEN

SEQ ID NO: 2362979 - protein, 5 aa, Entamoeba dispar
ENEES

SEQ ID NO: 2362980 - protein, 7 aa, Entamoeba dispar
ENEESTT

SEQ ID NO: 2362981 - protein, 11 aa, Entamoeba dispar
ENEGGDEGSEQ

SEQ ID NO: 2362982 - protein, 7 aa, Entamoeba dispar
ENEGTHS

SEQ ID NO: 2362983 - protein, 10 aa, Entamoeba dispar
ENEKGEKKIK

SEQ ID NO: 2362984 - protein, 5 aa, Entamoeba dispar
ENEKK

SEQ ID NO: 2362985 - protein, 7 aa, Entamoeba dispar
ENEKVTQ

SEQ ID NO: 2362986 - protein, 6 aa, Entamoeba dispar
ENEKYS

SEQ ID NO: 2362987 - protein, 10 aa, Entamoeba dispar
ENELKTTQLS

SEQ ID NO: 2362988 - protein, 19 aa, Entamoeba dispar
ENENQESKSQEEKEEPIKV

SEQ ID NO: 2362989 - protein, 8 aa, Entamoeba dispar
ENEPERYE

SEQ ID NO: 2362990 - protein, 6 aa, Entamoeba dispar
ENEPFR

SEQ ID NO: 2362991 - protein, 12 aa, Entamoeba dispar
ENEPTPKGNDEL

SEQ ID NO: 2362992 - protein, 5 aa, Entamoeba dispar
ENEQI

SEQ ID NO: 2362993 - protein, 6 aa, Entamoeba dispar
ENEQLD

SEQ ID NO: 2362994 - protein, 8 aa, Entamoeba dispar
ENESSVND

SEQ ID NO: 2362995 - protein, 9 aa, Entamoeba dispar
ENETKQYNY

SEQ ID NO: 2362996 - protein, 7 aa, Entamoeba dispar
ENETYSQ

SEQ ID NO: 2362997 - protein, 15 aa, Entamoeba dispar
ENEVTNQKNMDRKNK

SEQ ID NO: 2362998 - protein, 7 aa, Entamoeba dispar
ENEYDSD

SEQ ID NO: 2362999 - protein, 7 aa, Entamoeba dispar
ENFPGAD

SEQ ID NO: 2363000 - protein, 16 aa, Entamoeba dispar
ENFSKEGGNLKITTEE

SEQ ID NO: 2363001 - protein, 4 aa, Entamoeba dispar
ENFY

SEQ ID NO: 2363002 - protein, 6 aa, Entamoeba dispar
ENGASS

SEQ ID NO: 2363003 - protein, 4 aa, Entamoeba dispar
ENGC

SEQ ID NO: 2363004 - protein, 9 aa, Entamoeba dispar
ENGCNPKNK

SEQ ID NO: 2363005 - protein, 10 aa, Entamoeba dispar
ENGELPSTSM

SEQ ID NO: 2363006 - protein, 5 aa, Entamoeba dispar
ENGER

SEQ ID NO: 2363007 - protein, 6 aa, Entamoeba dispar
ENGESV

SEQ ID NO: 2363008 - protein, 5 aa, Entamoeba dispar
ENGHI

SEQ ID NO: 2363009 - protein, 5 aa, Entamoeba dispar
ENGIE

SEQ ID NO: 2363010 - protein, 6 aa, Entamoeba dispar
ENGKEV

SEQ ID NO: 2363011 - protein, 11 aa, Entamoeba dispar
ENGKIKPINGS

SEQ ID NO: 2363012 - protein, 6 aa, Entamoeba dispar
ENGNEI

SEQ ID NO: 2363013 - protein, 10 aa, Entamoeba dispar
ENGNHSHQQS

SEQ ID NO: 2363014 - protein, 25 aa, Entamoeba dispar
ENGNKLDSTIYKNSDCSEATNKYTL

SEQ ID NO: 2363015 - protein, 4 aa, Entamoeba dispar
ENGR

SEQ ID NO: 2363016 - protein, 5 aa, Entamoeba dispar
ENGRE

SEQ ID NO: 2363017 - protein, 5 aa, Entamoeba dispar
ENGSC

SEQ ID NO: 2363018 - protein, 7 aa, Entamoeba dispar
ENGSDFE

SEQ ID NO: 2363019 - protein, 9 aa, Entamoeba dispar
ENGSIKPNE

SEQ ID NO: 2363020 - protein, 5 aa, Entamoeba dispar
ENGTI

SEQ ID NO: 2363021 - protein, 6 aa, Entamoeba dispar
ENHQET

SEQ ID NO: 2363022 - protein, 14 aa, Entamoeba dispar
ENIDKDNNKDKTLT

SEQ ID NO: 2363023 - protein, 5 aa, Entamoeba dispar
ENIEE

SEQ ID NO: 2363024 - protein, 4 aa, Entamoeba dispar
ENIG

SEQ ID NO: 2363025 - protein, 15 aa, Entamoeba dispar
ENIGSDSFEASQEPS

SEQ ID NO: 2363026 - protein, 4 aa, Entamoeba dispar
ENIN

SEQ ID NO: 2363027 - protein, 5 aa, Entamoeba dispar
ENIPQ

SEQ ID NO: 2363028 - protein, 7 aa, Entamoeba dispar
ENIQNST

SEQ ID NO: 2363029 - protein, 8 aa, Entamoeba dispar
ENITDGSI

SEQ ID NO: 2363030 - protein, 5 aa, Entamoeba dispar
ENITE

SEQ ID NO: 2363031 - protein, 9 aa, Entamoeba dispar
ENKDGSEEL

SEQ ID NO: 2363032 - protein, 18 aa, Entamoeba dispar
ENKDTLSSSRSPSPSLMR

SEQ ID NO: 2363033 - protein, 9 aa, Entamoeba dispar
ENKEEEEEI

SEQ ID NO: 2363034 - protein, 8 aa, Entamoeba dispar
ENKEEIQS

SEQ ID NO: 2363035 - protein, 6 aa, Entamoeba dispar
ENKEEV

SEQ ID NO: 2363036 - protein, 17 aa, Entamoeba dispar
ENKEIKSSINGTSSFDS

SEQ ID NO: 2363037 - protein, 8 aa, Entamoeba dispar
ENKELPKE

SEQ ID NO: 2363038 - protein, 8 aa, Entamoeba dispar
ENKFNSTG

SEQ ID NO: 2363039 - protein, 10 aa, Entamoeba dispar
ENKGGDSYFD

SEQ ID NO: 2363040 - protein, 8 aa, Entamoeba dispar
ENKGKYDR

SEQ ID NO: 2363041 - protein, 8 aa, Entamoeba dispar
ENKGLNPI

SEQ ID NO: 2363042 - protein, 5 aa, Entamoeba dispar
ENKIN

SEQ ID NO: 2363043 - protein, 12 aa, Entamoeba dispar
ENKIQKEKDDKV

SEQ ID NO: 2363044 - protein, 12 aa, Entamoeba dispar
ENKISSSENPVS

SEQ ID NO: 2363045 - protein, 7 aa, Entamoeba dispar
ENKLNEQ

SEQ ID NO: 2363046 - protein, 12 aa, Entamoeba dispar
ENKLNNKEKEGI

SEQ ID NO: 2363047 - protein, 5 aa, Entamoeba dispar
ENKND

SEQ ID NO: 2363048 - protein, 13 aa, Entamoeba dispar
ENKNESIIDKKDS

SEQ ID NO: 2363049 - protein, 6 aa, Entamoeba dispar
ENKQIT

SEQ ID NO: 2363050 - protein, 7 aa, Entamoeba dispar
ENKRMDT

SEQ ID NO: 2363051 - protein, 7 aa, Entamoeba dispar
ENKTPRY

SEQ ID NO: 2363052 - protein, 4 aa, Entamoeba dispar
ENKW

SEQ ID NO: 2363053 - protein, 7 aa, Entamoeba dispar
ENKWKEQ

SEQ ID NO: 2363054 - protein, 14 aa, Entamoeba dispar
ENLDPTFQKSDEEM

SEQ ID NO: 2363055 - protein, 7 aa, Entamoeba dispar
ENLNETY

SEQ ID NO: 2363056 - protein, 22 aa, Entamoeba dispar
ENLQTSTVELTEEDGTKSTETV

SEQ ID NO: 2363057 - protein, 16 aa, Entamoeba dispar
ENNEEEKEEIDEEEER

SEQ ID NO: 2363058 - protein, 7 aa, Entamoeba dispar
ENNEENS

SEQ ID NO: 2363059 - protein, 9 aa, Entamoeba dispar
ENNEKNEEE

SEQ ID NO: 2363060 - protein, 9 aa, Entamoeba dispar
ENNEKNGEI

SEQ ID NO: 2363061 - protein, 11 aa, Entamoeba dispar
ENNGDNDKIES

SEQ ID NO: 2363062 - protein, 7 aa, Entamoeba dispar
ENNGSPE

SEQ ID NO: 2363063 - protein, 6 aa, Entamoeba dispar
ENNIGT

SEQ ID NO: 2363064 - protein, 10 aa, Entamoeba dispar
ENNKAKNQLK

SEQ ID NO: 2363065 - protein, 7 aa, Entamoeba dispar
ENNKGIP

SEQ ID NO: 2363066 - protein, 9 aa, Entamoeba dispar
ENNKQLDLA

SEQ ID NO: 2363067 - protein, 6 aa, Entamoeba dispar
ENNKSI

SEQ ID NO: 2363068 - protein, 4 aa, Entamoeba dispar
ENNN

SEQ ID NO: 2363069 - protein, 9 aa, Entamoeba dispar
ENNNKKGEL

SEQ ID NO: 2363070 - protein, 8 aa, Entamoeba dispar
ENNQADEL

SEQ ID NO: 2363071 - protein, 15 aa, Entamoeba dispar
ENNQCNGDNDDQCYY

SEQ ID NO: 2363072 - protein, 13 aa, Entamoeba dispar
ENNRCKYDKCGNG

SEQ ID NO: 2363073 - protein, 8 aa, Entamoeba dispar
ENNRDQNY

SEQ ID NO: 2363074 - protein, 7 aa, Entamoeba dispar
ENNSGSK

SEQ ID NO: 2363075 - protein, 10 aa, Entamoeba dispar
ENNSSSTSFP

SEQ ID NO: 2363076 - protein, 11 aa, Entamoeba dispar
ENNSYTQPDFK
